United States Patent 7,468,248 (METHODS AND SYSTEMS FOR INFERRING BOVINE TRAITS) - sequence listing, part 16

SEQ ID NO: 50457 - DNA, 825 bp, Bovine  19866881187874
gtgccggcagagcagctcaggcaatcaaagtgctaaggtacccgaggttgccaagctttgaagaggcagtttgttgggggcagggttggggggtggggaggggggatgaaagctgtgatggaacttctcaagggagctgcctgcccagatttccctcttgaatgtttctagctaacaggtggtccctccactggaagtaaattcctgggtatttttacccaacacctcataaacaaaatggcaatgctattggctatgtcatacaaccaggcgtattgaatcatgtccccattcatcaatttgccaaacaaagcaggttgctatctgagcttgtttggagagaggctaactatgggaaggaagaaaaactcaggcatctgcctacacgtacactgtcaagatttaaatgatagatgtgctcagtggtatccaactctgtgtgaccccatgaactacagcccaccaagttcctctgtccatgggattttccaggcaagaatactggagtgggttgccatttccttctctagggaaatgatacatacaggatgacttggtgcatttttaagtgaccctttccctacataagactgcactggcagcatggttgacactctagtcattgttatgagaaccgcactataatgcctcggggaggcctgttgcactggaactgaggtagggaggagatggaacccaagcgagatgcagaatgtatccagaggataactgatttatttttttttaaaggcattttattttttaaagtctttattgaatttgttaaaatactgcttctgttttatatttcagtgtttctttggc

SEQ ID NO: 50458 - DNA, 1329 bp, Bovine  19866881195119
ctgcacacccttctgactctcactaagggaatttttcccagtcaggtgcatcctggctggccaaatgagacatgattgggaataattgtgacatgacatggtctggaatgaatagcagatgggacttgagtgcacaaaacctgtggggtccaatttcaagggaaggaagtgtggccgtctttacgatttccagcacactctggcaagagaagtcagagaggaggggtgacagccatggctgatgtggtttgcaacagtcagtgccgaaaaccatcttctgcctatccttgtaagtcatccttccaggcgtgacttgcctgggagcctggaaccaagaggggtcatgtggaagaggctgagagatgaggctagggggaaggggcctctctttgggaaagttctaaccattatcaaaacgaacccacagcatttcagaccttgcagcaggggttgaactgaaagcagaggaaaggggcagagctgtgttgaaaagagcattgaattgggggatcttctgaagacctggtccccagctccgtttctgccctaacaaggtgttgacccttgagaaatcactgactccctttgagccttaagcaagggggataagtcccttataagtctaaaatattttttaaatcaatctttattggaatatagttgctttacaatgttgtgctattttctgctgtacagcaaagttaatcagatatacatgtacattcaccccctcttttttgggttttcttcccatttaggtcaccacagagcattgaataaggttccctgtgctgtacagtaggttctcattagttatctactgtatacgctaaaatattctaacctgagcctattaaatactctgtagaaaggtatcctttctgtagaaatcaaaacaaaggtacttcttataagaaatagagaaatacaggggcatagacgggtgtctcgcttgccagcctgcgagcagagaggaatgggtctcttcctttttttctcccacatatcagacaggctacctttggttgcaagtaaaaaaatgccctgattcaactggcttaaatatgaaatctatttcataagaagtccagaagtaggccagctccaaagttggtcacatcctcaaagaccgagattctttccatctcttccctctgccatcttccaggtgtgactttgtcctcagaagtaggttccccagatggtgacaaagatggttgccgcattttcagatgtcattgccagacattacaaagtctagtagaaaaattaaaacagtctcttaccccaataccaaaactttaagagcaaagagaccttttccagaag

SEQ ID NO: 50459 - DNA, 1890 bp, Bovine  19866881208174
atcttagagtactttgctgagaaaagataattttatgtgctaaaaatttctaaagggggaaatttatattttgttaacttactctgagcttcatgtaattacacagtagcggctgcctcatcatgtaaacttctcgccttgaggttaggtaggtaatttcacacctcttagattagaggacgtttaactattgtttacatgggttataaacatgataatatagctatataataacacagctttcctctgaaccagacgtgctaacaacatcacaatctctgtttccttaaaaatgggttggcatttccaaagttccttctaaatctgacgtgaacagggaattagaagtcataacgcaaatgccaaggtcccttaaggcagtggccttcagcctttctccccccgcatgtgaagggctggtgtgcccagtattacctgaaaatccttgctcatgaattatgtcttaccactctttcccctcttttggaaaaaatacacctaaaatgcaagcaactgaatagatattaggctatagcctggaccatcggttgcgaacttccatacttctttctaccaactcaactataatagtcacataggattattcccggttcacagtgggaagaaatattaaaaacgagtccaaatgttgggttttgattcacacctccctgaagtgcctgggtgcattttgctacagcctgcatgcaggagaaagccccgagtagtctgataagcagaggttttctccctacaggtaaataataactgaccaacatttatgaagcagtgtgtgttaaggtacttgtctacgtgatttcttttaatcctgatgaaattctgagaagtagctttatcgatgagaaagcggattctgggagctatggctccagatcacattaaaccgctgaaaaaggctcaaatttaggtcctgctgactctcaggctgtctttagagggtgttttgttgttcttgtaaataatctcaatatgaacaaggccaactggctcagggtgacacgtgatccccaatcattctctttcactttctgccagattggaagacggtcttgtgattaaatatttctggccagcaatatcttgctgcctacggaaaaatgatattcccgaatccttgataattgtttcactggacacagaaacaaagcttggaatgtctacaggaaaaccgctgtttctctgtacctgtctttcctccggcaagatggaaagaacggtatcactttagaaagtggctttgggaagaaggaaaaccagggatgctgcttggctatgattagtagacactttgggggggcaggctacgcctaccactggacattttaaaatttggaagccacttcttaagggatgaaggcaggagaaccagagaaggcccaaacaaggagattggttggctgcttgattgattgacttgagataggaaggacttttactatgggcctgcctctgagcttcccaggtggctcattggtaaagaatctgcctgccaatgcaggagatgtaggtttgatccctgggtcgggaaaattccccagaggaggaaatagcaacccactccagtattcttgtctgggaaatcccatgaacagaggagcctggcggactacagcccatggggtcgtaaagagttggacacactttcactctgatttaaatatatagtgtacaacatattattatgcattgtatataacaatttaatgacattatattattataacatcgtgtaataatataatgattaatattattaagggcttctctggtgactcagtggtaaagaatctgcctgccaatgcaggagacacagtttccattcctgagttgggaagatcgccggagaaggaaatggcaacccactccagt

SEQ ID NO: 50460 - DNA, 1129 bp, Bovine  19866881210172
ccctcggcaatagaagttttgctatgagggctgagcttgggcagagctgaagttttcctcttaaagtgctgcaaaaaatttaaactgtgatagacttaacagccctccccacacacccaacacagctctcctctgtcaaacaggaaactaatacctgggcttggtgtttgcagctctggttatcttcccccagggtcttcctggccattcaacacggttaaaaatagtaaccaccagagccagaaaaaaagatgatttcattgtctgcccactgccactagtggcctgatttgggtggtggcagatggagctagtcctctgactcggcaccttgtgaattctcgtgtaaggtcaagactggtccctcccataggattgcaacaccgtggtgctcccccaggggccagcctgtcttggtggttggcggggaaggcagtgaatcaggcagagccagcttgccctgcacgtgcacacacagacacacagcaggtgacatagtcacagaaaactgccatcccctgtggctcagccagtccacgtgcagaccccctggctccccggcttgagaaggcgaggctggggcaagacctctctgccctctgagttggcccctcctgctatggtttgaggaaaatgcatcccccttggaccagccagatacaaaaatttgtacagtttactgaagcctacttggccttagggagctgtccgagtgacaggtgtcatggggacccagtggtcttccaaggctgggaggagagcaaactactttgagaaggaacaaaagatttgctggcggttaatcttggggaataaatgagaaatcagtttttacaccccacctccaactggtatgtcgctggtatgtgagttaaaccctccgagcgtgctcagtcgctcagtcttgtctgactctttgtgaccccatggactgtaccccaccaggctcctctgttcatgggattctccagggaagaatactggagtggattgctatttcctctgccaggggatcttcctgacccagggattgaaccctcatctcctgtgttagtaggtggattctttaccactgagccacctgagacgcccttaaaattctcttaacagaggtaaattcacaatgctg

SEQ ID NO: 50461 - DNA, 1528 bp, Bovine  19866881323794
tgtgtagcttttttctttttatttatagaatgctaaaatattctgaggtcaactatttcgggcttcccaggtggcacagtggtgaagaatctgcctgccagtgcaggagacttagaagagtcaagttcgattcctggttgggaagatcccctggtggaggaaatgacaacccactccagtgttcttgcctggaaaatcccatggacagaggaggctggcaggctactgtctgtggagtcacaaagagtcagacatgactgagcacgcacgcacacacaggtgttagatttctcacttttcattattaacaacaatacaaatatcataattttattttgaaaagcaaagcattaaaggtctctgattccttgaaaaaacttccctcaaagcttataatggcattataagttatgacacagattgccacttaataaagaagatgagttgcaaatatatataagtaatctgaagtgcctttcactgctccttggttattgaactagttaacttatcttaaacttactagttaagcagtactcatttgctccctttaccagggaatggtaacaaatatttactgagtgcctgctcagcccagtcattgtactagttaatttctataaacatctcattctagtcatttagtctcagacagttttttattgttatatcctttgttgatattttgattcagcttttcttttaccatatccatttgttgttttgccagtagaaatgaagtttataaattatggaaacagtaagtaggtttcagtaacttttttaaatgcaaagatttgcctgtaaaaaatggaattgtgtatttggaatggtcagatgatcagtgagaactcttcaatgctggaacaaatgaagtttgacctacacatttaaagggtacaatgtttgcttatctttattatgtatcttgccctatgatttcaacctatagtttttaaccattttttcttttaactttaatacaatgacgttatttaatttttcaaaaaaatattgtcaccatcacactgtccaaggataacctttgggaacatttggatgtatcttctccaatttaaaagtttgaactgagaaatgggtgggataaaaattggattttaggtggcttaatttgaccaaagcatattagaaagatctgagcaaagggaccatagaacaagagagaccatattgagctatagtgacaagtcagacataagtcaaaaagaaccaaggctggtaccggggcaatggacgtggaaagcaagcaacaaatacaagaaatagttcagagggaggattaggaggacttggtgactcatgagctctggacggtgaagaagataagtcattaaagatgatgggaaggtgtcaccttcggcaatttatataaacttcaatttccttgtctgtaaaatagggttaacaattgtaccttcctcataggattgttgggaggactcagtggatgacatctaaatgcttagcacaatcactggaatgtattcccagtaagggttagctgtga

SEQ ID NO: 50462 - DNA, 968 bp, Bovine  19866881350954
ttgtctctagtttcttgaacaatcctgaaaggtgggtattattgtccgcattataagctaaggagctggactatccagttgtgagaccttgggcaaagtattcaacttttcttgtttcaatgtccttatctgaagaaacacggatagtaataaagctaccttgtgaggtttaaatgaactatactgtggctcttccttataatgattactaagtgttagccattgtgattgtcattattgttaggattattacagatgaagagtggataagcattaatagcttgcccatacagcttgccatacagctcgccatacagctcataagggacccaatttgatgccaagtttctactctttatcctaaatacactttgtattatgtgtacatgtataatttcatattattcattcagcaagtgcttactgattgaagatcgaatcatcgtttatatttttttcctttgaaaaaaaatttattccacctaataaagaagtatatgacacaaaagggctttcaaacccatttgcagatccaaacttccagatccttgcagatcctccttcggtgggaggctatgatattttcattttcaccagtagatggcagaagggagaaaaatactccagaatggggaagttttcactgtggcctatttaaagggctctttgtctgatatttggcccacagtgatgaagggcttgggggtcagggtggctatgagaactaccttcaggtatttgaaaggtgtcaaccttcatgaggatctactaggttgacccagaagatggggactgggagataaaaataaactgaaattcagatgttataagaagaaaaagttgcattcctctattatctcttgcttacagtcccagctggcattccctccttttcagcccacaagcagctttgttcttttcaaaagcctgcccttccctcctggggattttgataaagtcccttgcca

SEQ ID NO: 50463 - DNA, 1038 bp, Bovine  19866881414284
taagtgtagtgaatatttgaactactagatgaccttatcaactcagactatctcttcggataatacactttttcagattgtattgagggtggaatttggagaataggacacatacttagttgtctgagggtaagaaaggatctggaattctgaaaaagtttctcttatcaacagagtggcacatgagggtggacagatgaatgagggtagagttaagaggctcctagtagatgagatgggcctatggcctctgggccaaagcattggggaaattcttgagcccaggtgaggcagaccatggctgacacagacaagaaagtgtccccattcaaatctggttcttgctgtgacaggttttgccttgaaccagtttctcaagcctcttacatctttgcacaacatttgccctattgagaaactggttttgcatgaaacctcccatggctcggagcaagtctccatgacggtgtttgcataccgtgggggttttactcctcccctatgtgccaataagggtgaagcggccttcagatgacatgatatgtagtccatcaccgcgtactccaaaaccaagaatctttgaactatgtgaaaggttcataccaggatttcacaagccaggaaagactagtctagaaggcaaggttaagaacattgtctttgcccaagttctcatgaagccttctctgagtactacagccacattgatctcccctgtctccggttcctgttctactgggttgcccaaaaaaagttactacaggtttttccatatgatggtatagaaaaacctgagcgaaccttttggccaacccaatacatattgtctagactacacagttcagtcctggttgtctattgtcttctagaaattgctttgtgtgttaacagtgaattccctgagaatacagactacctcttgtacttttttgctggccagttttcgatacaatttaacccagtatgggcaagagaagattctcgacaataagtgttgatgaatttgttttgggaaatgcaaattcattataaaaaaaa

SEQ ID NO: 50464 - DNA, 1493 bp, Bovine  19866881544885
tacccttaaaacaatgaattttatggcatgtaaataaagcaattaaaaagaaaaggcaggcctgggacccttgcctcacttcctcactgtgctccaggtaagggacagatggtgatggaggtttgcagttagggaggtgggttcaaggaatggagttccccagctggaaaagaggccactgctccaggtcaggggtagggcagggggctatactgatccagcagcttcaccagccttcaagcacacacaccagttcaggccataaatacatctctgctataatcagaggggatccaagcctagaggggccaccctatctttttgtagtgtgtaagagccccgagtcctagaaagaggatgagaatcctactaatgtttggcaccaactttcccattgtcctggtaggatggagccttgccattatttaaaggaactaacatgtacagtccacagggtcacacagagttggaaacgactgacgcgacttagcacacactcagacgacgtgtatagcaggcagaatgccacccccccccaccaagacgtccatacttccacctctgtgaatgttacactaaatagcaaagggactctacatatacaatcaaggttatgcaatttaaaatgggaagatgatcttgaattagccaggggggcccaaactaatgagccctttcagagatagaactttctcggctgatagcagagagctacaatagaagccagagacagattctaagagtgagaaggaactgatatgctgctctggctctgaggtggagggacccacatgcaagaaccagggggaagccttggggagctacgggtggcccccaactgacagccatcaaggaaacgtgcccttagtcctacaaggataaggcacgggattctaccaaccacagataggagcttggaaggggaatcagccctggagcctctacaaagagtgctgtcctgtcaacaccttgaaactctgtgagactctaagcggagaaaccggccaagcccacccagacttctgatctgcagaactgttacataatcaatggctgcaattgtgttggccaagtttgtgttcgtttgtgacagcagcaacagaaacattcaataccaatttgttacaaaactgagtgtgaacaatgaaactcataccagccattctatcaccttccactaccctaccagtatctaggatatcagaaactctccaaatcttaaagaacgtagtactttctacttcacctttaatgttagactgtaggccgagaaacccaagctataattctgattataagcactgaacagcaaattaagagacccaggtcttatttttatatcagtgtacggacctcaagtaaattaatctccctgaatctctgtttccatgtctgcaacaaaaatgagttggtccagataatttctaaggtcatgttcgctgtagaactaaaacgacaggcagacatcataacgagcaacacgcattcattta

SEQ ID NO: 50465 - DNA, 1614 bp, Bovine  19866881567051
ctccccttgtatcctctctgagtctcattttcctgtgctttccccattttggcccttgaggtcactttagagtgtaaggaagagagtcacgttcaagttgcgtcagggaaaatttctaggtgaggaatcctgagcaatcaagtgtggcggtcattacttcaaggaaacctttccgctgggggctgagacattgattcagtgtcccagtctctggcccaggccaaagatcgctgccttgggggctacagcgaacctagagacagtggttttggcttgggaattaattgccagatcttctcagttatggcttgattggcaataacagaccattcttaaggaatctggcattcttccctcaggaggagcagtataaacagtgattactgttaagctccttggcttctccttatgccatcaggcctagggtttatcttcttaaagagtcatgtcatgtcatgtgttagtcgctcagtcacgttcgactctttgtgacccccggactgtagcccgccaggcttctctgtccatgggatttttccaggcaagagtactggagtgggttgtcatttccttctccaggggatcttcccaacccagggacagaacccaggtctcccgtattgcaggcagcttctttaccatctgagtcaccagggaagtcttaaagagtgttgatacttaaaggtcatgatactccctgcctaaaatccttccattcctctgtcttaaaggaagatatccaaactccttagcatggctgtgggtttcctcattcttctccgttttcccccttgacttctgtgttctggccatgttgtacttttccctgtccttactcattctgtgttctttaaagcctctttcctcacatgagactgtcctttctttgctgacctccagatttaatttgcttgtcacctctgttagcctttcctgactcctccttcctttttcaccctgtcctacagggacctatcatattattatgtattgtgtggattttgagcttattcaggacagagaccgtgtcttctgtctgatcaactttctcttcccctcaattcatcaaatatgtattcatggtctgtgttgtgcccagcatttagtcatattcccaccaatatgggaatggcgcagagagcatttctttgctattatgtatattttttgtcttctaggtcgtgatatcatcgggctggcagaaaccggctctgggaaaaccggtgcctttgctctgcccattctcaacgcattgttggagacgcctcagcgtctgtttgccttagttctcaccccgactcgggagctggcctttcagatctcagagcagtttgaagccctggggtcttcgattggggtgcagtgtggtaagtgttgggaggaaaggactcttcacagtttcttcacaggttgagcatgaatgtgaaagggaatgaaagcaagtgttaatataagttcgccgacctaaagagctgattgggtattttagctttggggaaagttgtcattgtaagggaagagaaatgaaagtagaaatctggcattggctttaaaagatgtttagtgcatcatggaaacaaaattaaggatctctttttaatattctttttattt

SEQ ID NO: 50466 - DNA, 1281 bp, Bovine  19866881597752
aaatatgtgtgtgtcggcttccctggtggctcagagagtaaaaaatctgcctgcaatacaggagacccaggttcaatctccgggtcaagaagattcccctagagaagggaatagccggctacccactccagtagactggcagactatagtccatggagttggacacgactgagtgactcacacacacacacacgtcagggaaaggcaagaggtagtgcgttgggctgcgtgtactgtgtcagatgagctacaggtctgtggaattgttgagattatatgagggtaactgcagcttgggaaactgcagtagtccaaaaaattgtgtgtggcggggcaggagtgagtgtgtgtatgtgtgtgtgtatacacatatacacagagcttccctggtggctcagatggtaaagaatctgcctgccaatgcaggagatgcaagtttgatcgctaagtggggaagatcctctggaggagggaaatggcaacctactccagtattcttgccttgaaaatcccatggacagaggaccctggcaggttacagttcatgggattgaaaaagagacagacacaacttagtgactaaacaacaacacacacaaacatacacacgtataaaataggccaccaggtatgaaagaacacagcacttacaacgaatcagtgcagtgaaaatgaatgttaaactcctgactttaaccccatatgaatcatggttttttactacaaaacattcagaacttaccctaggacagaccaaattcagacctctgctctttatctatatgtgaaaggtgacaccctcatgttcctaaatccctaagaggcattccctagttgactagtaggaagggaccttgatatttttctttcaaacccgtgagaaagcatcttaatttcccattttgtgtgtgtgtgtccctagcacggcctgggtctcctttacctgttgcatggcatcggcggtcaccaccttcaacacctacacccggctggtgctggagttcaagtgcaggcacagcaagagcttccgaggagccccgggctgccaaccacatcatcaccagtgcttcctgcagcagctggcgtgcacagcccacccagggggccccgtgaccagctacccccagttccactgtcagcccatccgctccatctccgaaggggtagacttctactcagaactacatgacaaggaacttcaacaaggcaccagccaggagcctgagaccaaagcagctggctcatctgtagaagagtgttaggagttagggggttggagag

SEQ ID NO: 50467 - DNA, 1291 bp, Bovine  19866881613129
ccccgcaccctgtgtagagacatgagcagggggcgatgcctgaagcagactcagagctgcaactctgctcagtgtcccggcaccctgaatcatatcacagcaaatttaggactgcgccaatggagacaagaacctcagcacctcccctttgctgcctgccggatgcctggcatctgggccacagtcgctctgcagggtcgctccccaccctggaaaatgagagaggttgtttggacactgggttcctgcagatggttttactgcctcaccccagcaaagctgctgtatgggagactggggctctggcatctttttctcaaggctggggtgtgttttgggtaccagttctttccccccttccctcttggtcagattttgttggacaccagtgaccggcagtctcacaacagatacaagcctaagctgccctcttgggtttttgaattttaatgtaggaagtcatgtattcactaaaaataacattttaatcaaatgttctctagaaccaaaccgcactggggctgtaacattacaaaagaagagacaaggaagcctagatctagatgtcaaagtcagaacctcctcgtttccagtcttcacagctgtaaggaactcctatcactccatgtgtcacgaaacaagactgccagattgacgcacagccttcttcggaatggctgttaaggataacagaagcttcccatgggagttgtcattttcatacctggttttcatgcaggggtgaaattctgtatttaaattaaccaccgaggctgggctctgattaacagacttacagataattccgatttctgttcacaagcgcatgtctcattttttgtgtttttctctctgcttgtgtatgtgcataattcaatacataactgctgagcctagaaaaaggagcaattgtgcctctatttcttcctctttttttcatagctaatgtttcaaaatactcttttgaaatgctaagagactctgaaatatttaagtaaacagactattaggatgagaacctaagtgtcaaacaacaaagaggcaacgtagcaatttgctattcgggggagacagaattcagagctaccttgcaggagacaaaaaaataaaaaataaactctgtctgacaacagacctcccaagcaggtcccacagaaaggctatgtaagaacaaacaagaacaacaacaacagtaatttccttggtcgagacaagctgatttgcatagacattaaacatttttctggccataatggtggagacgggtagaagctttcacccccattttaca

SEQ ID NO: 50468 - DNA, 835 bp, Bovine  19866882049181
attctatggtcctttcggctgtgggagattagatgttgttacataccactcatattccacagaagctaacaagggcttcaggaagttaagagacctgagttcccaatgcagactctgctcctttgatgcttatgctttttgctgttaaaagtcatgatgtgaagatctccactgtgaattgcttgtaggtaatctcctcattttcagggctttaaataccatctatatgctaatgccttccaaattggtatctgtcgtgccatcctcttccctgaacttgagactttacatccagcttgcggtggtcagcccccttcagatgtctgatatgcatcctgatcttggtgtgactgccagtgcccctctccagtgttggccatttcagaacaaggacccaccaagtacccagataccaatgcagaaagctccaaagcctcttctcttctttgccccacatcttatccagattctcttcatcatccattaggttaaaaacgaggtcccgtcactgtcacctttaagatcaaccctaaccttaacctgtctcaccaacatcctaaatcacaatcctttttcactccaccattgccatcgcctcttggctggtccttctgtgtccacgctgaccttcctgtcgactacatggcaggatattttgtattctaaaatgaaaatccaaccattctcctgttcctaattctcttttggcttcccatccctcttagatgaaacttggaatcctcctcacacggtctgcaatccactgtacccttgcccacctctctgcccagggattactctgccttgcccaccttgtccagccacctgtgtgaat

SEQ ID NO: 50469 - DNA, 999 bp, Bovine  19866880625990
tttaagaatgttttcataattacttatttaagagtttggataccaaagggttaaaaatacacatgtttttcttttattgaagacattttagatgtttgtaatgttttgtctgtacaaatgggcgtttagtaatgttttatcttttttttttttttaatgattccatgtatttgcttatttccatctaggaatagttactaatgtatttgagatacagcataccaaattttaaagtaaccagaatcgtgagttaatggtttttagtccatactgttaaacttttgttgaaatactgacatgattaaattggcttcatgctaaacgttactagaagtaacggaaggcagtgtctcagagtggcagcccttggcacgtgtggccacgcggcagtggctgcgccgatagctgtgcttctgcacctcgtgtatgtgtatgtattttcaatcaaaatgttgcctgcaaatatgtgatcccttattatttaagtttcctgtttatgaaccattgcccgttttaaatcacatagaagattctgaatctgtaaaaactacacatgtcaatgttttacagctacgtaattcgaattgacttgattttttcaagtaatcctagaaagggggagcattccatatagaaaccgctgaaactgccacaggtgcttctccgaacccttaccgttgtggcattgaatgctcagtatggcttcccttctccactcgaggcatactgttgaggtatttgttgcggtgattggttttaatgctaatctaggaattcagatatagattctttagatttgcatgctttgcttaccctaatttatgatatctacctttttatttgtaaactaacaatagttaagttgagatcagaattttaacagaaatattatttagataaaaattgtggttatctttcattgtcacatggcattaactaaaaagagaacatcctgaaggtgatgtgacaactcacactctaaatatacttcagaaactt

SEQ ID NO: 50470 - DNA, 1769 bp, Bovine  19866880757355
tcggcagggccgcctcacctgaaggctggactgggctggaccacccaaggctgaggtggtcttggtgggagggcctctcctggggctgctcattgtcctcacgacgaggcagctggcttcctgcagagtggggacagagagcagaggcgtgtgtatggcctgggctcgaggcgacaccctgtcctgtccacggtgtcctggctcactcactccagcactcggagtgggaggggccgcacgaagccgtccagaccacaggcgctgcgcgggggtcgggggaaatcaggctgagggaagcacaggttaagatctgcatccccactcacaaggggagcacccacggggacacagcatccttttccaggcaccctcgaccccacgggcctttatcctcacccctgaaccccatgggcctttacccgcacccccgacgccgcgagcctttactcgcatccctgattccatgagcctttacctgcacccctgaaccccacgagcctttacctgcacccctgaaccccacggggctttacccgcacccctgaaccccacgagcctttactcgcacccctgaaccccacgggcctttacccgcacccctgaaccccatgagcctttactcgcacccctgaaccccacggggctttacccgcacccctgaaccccacgagcctttactcacatccctgaaccccacgggcctttacccgcacccctgaaccccacgagtctttactcgcatccctgattccacgagcctttacccttacccctgaccccaggggcctttatctgcacccccgaccccacgagcctttaccaggcacccctgaactccacgttaagccccaactgcacggcagctgtggtttgattgttccaagcagcgcatctgtggttccaggtcaaaagggattcttcggcgagagaggcactgagggtgatatcggctttccagggatcaccggcctggctggagtccagggcccccctggattcaaagggcaaaaaggtaaggtccagcggtcacaccgccctcctggtgcggctgagcccgcggtctccgcgggcccagaacaaggccggccggttctgcctgtcagctcgtcccctgcagtcacagccaggagctccccccgcatgtccgtccccacgtgcacacagcccggctgtgcaggacgcgcgggactgacggccgagtctgtgtgtccgtctgtctctctgtacctgccgtgacagcccccttttggcgtctgagtcgcggaattcgtcagaggccgagttacaggagggaatccctttggtgatttttcttgctactgttgtgctcgctgttttctggcgtttgtgaccgcagggaggctgaccctcggagggtctctgggctgtgcccaggctcccgtgtggacccgagaatgacaatatgcacacacgagctcttctgatgcccaggctgtgctcacaccaccaaggccacgtgaaggggacgctggtccttacccacccagccccttatctggaggccaggaggcctcggggcgcctgcatgccccctgaaggatctatctgtcccccaggctttccaggactcacagggctccaggggcctcagggagacccgggacgggccggagcgcctggcatcaaaggagactctggctggccggggaacccaggcttaccaggtaagaggaacccccccgtcccagacaccatgcctgcggagaggtgtttcctccccagaaggctgagcacaacctgccgggaga

SEQ ID NO: 50471 - DNA, 1580 bp, Bovine  19866880824976
tgcacagctgtttgacgctcatccatcaggatcgtccatatcccagttaccagctgtgctcactgtagggaggcttctcggaggcccttagattcgagcttaccagcgtgggtcccgggacggcaggcaggacgcacagggtgcggtggccgcccctgagacctctcccccgcaggcccagcccgctgctcgtggccgccttcggcgcctgcgccctcacccgacagtgcagccagcaggccttccagaagtacggacgcgccaccaccacctccgacatggtcgccgaggtcgggcccgccttccgcaggctcttcgaggcctgagccggagccgctggagggcgggtgccgtctgcccgcgtcctccgagaggtctccgctgtgcaggttgacacaacgccagtttggaacttagcgctttctgcctaaactgatacggaacggtgttggtgaacttccctcagtctctgcagcttcagaaaagaacgtagagcatcgtgtgacgagacggtctgacagcggctcagctgggctgtgggctccgctgctgcctggagcggaccccgcgtctgagcgtcgtgttcctgcgagaagggccctcactagcaggccccttgggggtcccgtctcttgttcccaactgtgtgtgaatcatgttttaagttgaggtcccgcaaaggttgtggtggtcattctttagttcattttggcgttttaaacagttattaggtcgcacacatctgggcagaaatattcagcattggttggttaattggctgaagttttccagaatagtcagcgatctgtcagaactggaaatgctggaggcccctgggaaaaccaccgaaggaaatgacgaaccctggcccccgagtgtgcagggcagctctgggacacctcactttgacgtgtccatgcaaaggcgggcgtggtgacaggcctgcggtgaaggggtgcccagggctcccaagtcaggtccccggtgggggcccaagctgcccggcacctgctggtggggcaggacagcagggcctctgcctcgaggcagggtggggggtgctctcagaacgttcagaacgcgcgctctctgtactgagctgtcttgtcggcatggggtcggcctgtgtggcgcctggtggcccgtctcgtttctccgaggggttgattacagccctgagtgcgctatccacgtgccttctgcagggcaggcctggcccgagtccgtacatctgtcctcagtgatccctgctctgtgttcagacaaaagatcccagttgctttgaataggctggagttaaggtttctttaaaattgtggctcacttacacctaatggtagaaaagcttcgctactgccgtggactctcttcctttggggaatcacacctaataaaaggcagatgtggttgatttcactggcgagagctgtgtattttttgctcaaacagccagaattcaccttcagtttggtcctcagcgaggacgttgtcagacacggggatgaatacacagctgcccacccagctgccagtgcggtccacgggtgcccgtcgtgctgctaaagcggagggtcagcccg

SEQ ID NO: 50472 - DNA, 692 bp, Bovine  19866881038778
gctgtggttctttatgaagataagcgtacaggcaagtactgtcagctgacagcaattcctaacaccccctcaccctcctcccaagagagaccctgcacctcccgagagaaaccccgtgcctcccgagagaaacccaatgtgcccgtaagccgaaagcaggtgaacaaaccggaggtgctaacaagtgctccgtgggagtgctccacgggcaatcagaagagggaatcactgttcacagcagaaagcaaggcaacagttcctgccacagcgcccccgcccccacatgggggcaagcacacccagaaacacagcgcgtgtgagaggtttttattcaatctgtaaaggacagtttaaaaacaaaatgttagtaacactcggaggacactggttttgttcatctgacacatcttctatcttcacagattttttattacaaaaatcagaaaagtaaaaattcaggacaatagtcgcacagtggaaccactagttgcctaaacaaaagctaatttctataaaaccataaacttaatgaagctttattaagagagattcaaaattctgttaactggatacacgtagtggtatatattttaaagcagaacaccccaagaaacaaaagcaaggaaaaaagaaagtacaggtcggaagagtcagttaaatgtgttgaccctgacagtccctacaaggagtaa

SEQ ID NO: 50473 - DNA, 1344 bp, Bovine  19866881096665
tcatgtagaagcaaatcactcgcattcaggttgtagcaccatagaagctacaaaagcaacctcaggagacctgacctcagccaccttttccgcacatgacaggtgacatcggagacacgatagatctccccgggagcccgggcctgaagggggagcggggcaccaccggaataccaggtacccaagccatccgcgtcccccgtcctctgcaaccctgcccctcctctgcagtcactcgtgagctggctcgcgcactgtgccattacctagtgagcccacggagcacgttgtagggctggtctgaggtctccaagcccaacatgcaaggaagagtgggattttttattacattgagtgtgaggacatcaggaagcctgtatctccctgcaagggaagatggcgagaagcagcgcttggtgctgggagtcgctgcagcctctaaactaccatgtaagcctgggctcctgggatgatgatgcacaaagcagatgatgcaatggccggagcccctgcaagcggtgaagggtctagaggaaaagcaggtggagtcagacccctctcctgagtaagacagcaaggaaggcaacccccccagcctatggacgtcagggggtgtcacgccccctctgtaagcatcactgaagttcaaggtcagaattcctgccagtggtcacatcccaaggggcttggactagatgctccttcatgggtttctatctcaggagacaccccccacccctggccacgtgctcctaggaatgctcagggtgaaggagtctgttcgcgtgatggaccaatgaagagggtgctaagctggtgctttaatgagaatgagcttcaggatgggaaggggtggtcggtctagctgaggtcagatcctaagtgacacttagggccaggcagccccgcctacaagctcttctggactcctgtggatccatcttttggtctcccgaaggctctcgtcccagacacatgatgcctcaggctggctggatctcccatccaaaataatcagtgtcccagaaacaccaaaatgtgtgacccggaatctaagtctgccaataagcagctttgcccaaggagttcatttaaaatgcagattccaggagtgatccagacctgaaaggctcaaacatctcctgcttgactaactccccagattccccagcaccacacgcatcagcaagtgctcagatgaggggtctgccactcagatgaaggatccactgctcagatgagggatccaccactcagatgagggatccgccactcagatgaaggatctgatgctcagatgagggatccgccactcagatgagggatctaccgctcagatgaggg

SEQ ID NO: 50474 - DNA, 872 bp, Bovine  19866881133171
atgctggacgagaaggacgtgccggccgccgagcagatgtgcttcgagacaagcgccaagactggcaagaatgtggacctgctgttcgaaaccgtgttcgacatggtggtgcccgtgatcctgcggcagagggcccaggccccaccgcagaccgtggacatcgccagcgccccgccgcccgcacggaccagatccgggtgctgctcctgacgcgccccggcccgatcccggggatccgggtgggctgaggagccaagcggtgtcactctgtaggactgcacgtggaggaggagccgggaggaagtgccagccagtccccaagacaagggccgtgtgacgcgacccccacgtccatcgctgccccgggaggtgggcagcagacggatcgtccggaggagccacctgcagagccaggctcccggagatcggcgtcccctcgctgccccgtcctgacacctggaccctgtctccgcacctgcgtgattctccagggttcctcttcactgtgatttacctttgatctagccatttggtacttgtctcttgatgcctcgtaatgattcttgacaaatgttaatttatataaaatcaggaatcgctgtttttgtattgtttgcagcattgtgagccactttattattaaaaattatttaagaagaacctgggtttggaccttatttgtgcccccgtggactttaatgtctgtcacacggacttgcagtttctcacgtggactgtgggtgaagcatgacctcacacttctgcagcatcccggaccaaattcttaccccaggtcttcactgggcttttcagtaaagaatctgcctgccaatgcaggatggcccagatttgatccctgggtggggaagatc

SEQ ID NO: 50475 - DNA, 2089 bp, Bovine  19866881136137
acgggggtggggtggggggtgggggggtgctctctgttaggtccgtggggcagacccttgacaagcacctgcccggagtggctgcagctggtgtggacagcggtctgctactgcagcatggtgtgtgtgttccacgcgagcaagggtcatcgcgtagccgagatgggcggccatgtgctgggggaaacccaccccagtggcggaccacacgcagtgtgtatatacagcttgaagatctatgcgctgagcacctccccatggctccacagtgactgaccagttttcaaatttacatcgagctgtttcaaagaacaaaaattccgtttttttcccatatcccagttatacacgtttgagggtgttgatcagcaacatgcgacaggagagaccgcccgttagcgagaccacagctcaactgggagagggcgagaccacgactgctgaggctcagagccgcttaggccccctcccctcctcccgaagccagcaacagccacccacctgggccaccgacagggcccgcgttccccgcaccccatccatccgccgccacccacctccgagagcgttctgtgcacactctgcttcctctctcactccgctcctctctgcttttcacattgatttatattgttgaacttaaggaatcttgtgaggttaagaattatttgctcatactttgacccaagtccagggacccacagactgtgggaaactcttagctccttgaaaaaaatgcaacggctaatttgtgctggttctgtctctgctgaagggagtgggctcagccgcacccttccaggagctggggtttcagtctcaaggctcctgctgccaggcccagggagggcgaacgtggggtgacaactccacggggtggggagatgccgggcccctggctcaggctggtggtacagccctgggaccagtcgcagggtggctgctcctcgtcccatcgcagcttccagggccgttcaaccacctcagtgatccccaacactggggaggggcttcatgtgtctttggattaccaatttgtgcaacactcgactgcgtaggaaaacaggcgcctcgtgaaggtggatgccgttcaaaagttgaaataacctatcttacctgagtttatggtaaaaaaccatagggctgaggggctaggaatctaagtaactgaaataatgatttacattgacctcaggtggaaaaatctgagcacttttcagtgaggtaacgcgcaaaggccaaggtggctctttcggctaaatcatgggcccacctgttgtctctcctgtttcctgtgctctggagccttgtatcccatggagacactcactctgcttcaacaggaattctgtaacagaaatgccctctgatgcttgcagctcgaccgccttcagcctccaccgagtgtacagaaagaagaaaaagaaaacaggagaagacagaacctgccacactgttggtgggaacgtaagttggtgcagccaccatggaaagccgtctggaggttccttgaaaataccaaaatgagagtcaccacctgatccagcaaccccactcctgggcgtacacccagagaaaaacgtggtccgaaaggatacttggaccccagtgttcactgcagcactgtttacaatagccaagtcatggaacccaacgtccatcggcagaggaatggatgaggaagatgtggtgcatgtatacaaaggaatattactcagagcaaaagaattccatttgcggtaactggatggcctagtgaggatcatactaaatcaagtcagacagaaacaaatatataagatcacttacatatggaatctaaagtatgatacaaatgaacttacttagaaaaacagagtcacacagacacatagaacaagcttgtggtcaccaaaggggaaagtgggggaagaaaaatttggaatttggaagtaacttatacacaccactctgtataaaaaagacaaacaaggacagactgtatagcacagggagctatactcaatagcttgtaataacctgcatggaaacgagtctgaaaaagaacacacacacacacacacacataaccaaatccctttgctgtacg

SEQ ID NO: 50476 - DNA, 708 bp, Bovine  19866881196467
ctccgtatcgaatacactgacaaacggatgtgtcgccaatggacacttggacttcccctccacggcccagccctgtgggatggagagcaggagtggccagtgctcggcaggacttaacggagtcggcactggcctagttccagggctgcctttcccgagcagccagggctcccccggcgttaacgggactgaggagccggaaaggagcacccaagtcagcccggagacatgcggctctctgcacctcaacgggagcccgagcagctgcgtggccagcaggccctcctgggcagaggagagcctgcagtacggccactaccacggctttggggacacggccgagagcatccccgagctcagcagcgcgctggagcatgccagccccgtgaaggcggagcagggctgccacagcgccgtgctgggcgccatgcacctgtcccacggctcgtagggccgcgggcctccgcccccgaaggagcgccacgcccgtgcggcgtctcgtgcttcagctttctggaaaagcgcgctccgagtggccggcctcctcaagtcctggtgcgagtgcaggcagggcctactcagcgcgcggctgtctccgtgggacggggggcctctttccggacgcgcttttagaacctacgttttctgctgccaatctcgatattctcttttgaataatgtcaccgtaaattgccattttctcttctg

SEQ ID NO: 50477 - DNA, 1053 bp, Bovine  19866881505286
actgctgcacgtgcaaagttagataaacatgcgcccagcagggaggaccccgctctaactttacctttgtcccgttgcatcctggaatacctgggggacccggaggaccatcctggccaggaataccctgcaattaacaaaacgaacaagtaaacaagttagaaaaccatcaatgctactgtaacacacatcaaacatctcataaaggaactagaagccttgtatatacatacaggaagtcctgggtttccagggtaaccaggcactcctgagggtccctgtagggatggaaaggaaaaggttttgaatgggtgcgggagaaccccattttctcccaccgcaccctcctggataaggatgtcagactctcactgctggcatttggaacatcgaccccgagtagacagaggcgacggaggacccggcccaggggtgggctggagatgacctggagtttcagtagcaactcttcatcatcaaaccctggtggttaattacttctaaaatcaaggctgcacacccacaagataactctgccctcgtttcatcctttgtaatttctaggagatgagagatagatgtacagacagagagatgggtagatggatagataggcagatagagagagagagaatttacagtaaaatctcagacagttgggaagaacagggtaggcataaatcagttccctgagggaagaaagtcagagctcttcctggctgaaatccagatcttcactgcagacagttacaatgctatctgttatctttctgccccaaggaggatccagcaggctgggcacacttcccttccgagaagtaacaataacacaattaaaacgtttacattttacagcctcttctatttttcaaagattttttcaaagagctccctgcttgcacatcccaggagcaggcacagcaaagacagcagagcgtgaagaaggaagacggagcgtggatccgaacacatcaccacttttcacactgaccgaaggcatctttgatgaagacctggagacgcgtcatccgcccccccccccccccgccccgc

SEQ ID NO: 50478 - DNA, 1729 bp, Bovine  19866881676869
tttgagacgttaaataggaagatgccttttatttttttaagtttagtatgttgatttttaaattactatctcccaaatcttgtttagtaatcaaatgtgcgtaagagagaagttagttacagagataggaagagcagctccttctttaatgaagacttgctgtaaatctgtatgctctttcatatcaccttcagatagttagtcagtgcagcaggagcagagaccagatgaacgtgctaatggggtgtaattcagtgtttttgtgtcgtacagcctgagaaatgccagtggcctgacggcagcagacattgctcaaacccagggtttccaagagtgtacccagtttctcttgaacctccagaattgtcatctgactcgtttcggtcacaatggcaccttaaacggaggccatccgagtgtatttcctagtcacgttagtgtgggaacaaaccgcaagagatgcctggaagattcggaaccctttggcatgaagaaagctcgaccagcaggtgagaccgctttgtgggcggggcaggcaggcctgtttcttctctaacgtgtgttcttcttacggctgagcgcgcctcggagacggctccctcactaagggtgctgtgccctgaggactctggtgcagtgatggaggaggctttcctgtgttgcttcttggaagattggccatttaacgagaggggaggatgtgcgagggcagttcggcccaagcgtaaatgtgtgtatgtaactctgcacacccaggtttacctgccgtgaattagagtcttcccgtttgttgtacctgcttgaaatataactattaaaaaaatctgcccctgtgcctcattttttcttcctgtgaattttcctggacttagaacaattgttggtctgatgtaaaatacagtttcacatcggggaaggtgggtgtttgcactgctacgtggcctcagctggtctgcacacctgggtgtggggggtgtgtgccgcagcggggcccggtgtgccgcctccacactgaggggtcgcgtctccaaggtaagtgttctggttctcatgtccttccagctttttatctctagatggtttcaggacggtgtaaataaacagtcagctagtcactctttgaggtgtccctttcatttagggggagaaaattaatatatataatcagaagacgttagtagcttggcaggaatgttcagcaaacttacatggaaagggaagtttagaggtgacagtgaaagtaatcacactgaaattatgtgctcagataagatttgccaaggataaatacaaaatcatgccctttggtttttaaaaaaaagaaactgttcaagtatagtctgagaaaaccggagtggctcctgtctttaaattcgatgtgtcagcctgatcctcccagcgctgtgcctctttaatgtaactggcacatatccagacaagagcatttctcccagagtcagtaaaaagtgaattctctccttcacaacatttaagatattggtcactgtgaaaagttgtgattacgcaacttttctatagaaatgaatgtatggacttaatagtttctaaaattcgtaacttgtataaattatgggcctaatccttagaaagatgttgtaaaagtcatacccagaacatgaaggtatgtgtaaacttcagaaactaatccccgttctgtttcctgcctggttagtattttggggggggggggggctggtttcactgtgtc

SEQ ID NO: 50479 - DNA, 1071 bp, Bovine  19866880341778
catggactgcagcatgccaggcttccctgtccttcactatctcccggagtttgctcaaacttatgtccattgagtcagtgatgccatccaaccatcttatcctctgccccctgcttctcctcctgtcctcaatctttcccagcatcagggtcttttccaatgagtcgtctcttcacatcaggtggccagagtattagagcttcggcttcaatatcagtccttccaatgaatattcagggttaatttcttttaggattgactgatttgatctccttgcaatccaagggactctcaagagtcttctccagcaccacagttcgaataggaaaagttttctgagacttgaggatttcactttgaaaaagaggacacccttacccatttctctttcactttctgcttcttcctccattcatttcctaaacctcccagaaaactatttccccagcaagacagcctgtgtttgctgcttggaagttctgcatgtctgggatccttccctgattgctaggggcttcccaagtcttcctactcaaccattcagccctggtctgggaaaaaatgatgaagccaatagctgcaaccactcagggatgatcttacaaaacctgactcttgtgtgcatctctgttcacttacgccttctgttgtcctgtggtcgctgatgctttatttatgtcgggcatgcggactgctgtgctggccctttcagagcgtctggcaccattgtgggagcactcagttctgctacatttgtgtcacacatttgcgacacactgaaaggatgaagttgggaggttcagggaaatgtcagcctgggatgggtgtgaggctagctgtgtttctctgtctaccagaagaaacattactttaaattgatttgtcgctttcaaaaccacaatcccaatgaatgtttcataagaggctactaccaacttttatggggacactggtggtccctgcagactccagatctgctatgaattgattttcagacttctgcttattctttgaactgccaatcaaatcatgcagtaacttctccttaaggaaacttagctaaagaaagag

SEQ ID NO: 50480 - DNA, 2644 bp, Bovine  19866880432081
agtcatgcctacttaggcccttggtgttttctccacatcctggcttcatacaggatggctcagagggatgccaaccctgtgtgtgcagagtggagacacacaccacgtgagtatcaccctctcgtttttattaaaacacgggcaggatgtgcaaaatcagaaacaaggccaaagtgctgctccatctctcaccctcagggattatgcagagctttgtaagctttgatacatgtttaaaagacaggataatgcttcatttggcctgctgtactctaagatgtaccttttaaggagagttttccaaaagaactgctcttgatggatatcctataaaaaaagctctataggccaaagcacataggtatgttaaagtacctgagaagtctggctggaaagaagcagctttaactgcctgtaagtatttaatcatggaactttaggttgagtcaatattcattaatacctgtaaaacacatttcgggaaactgctgtaaagttgtgagagtgactgttttttccctaaatgttccataacgtaaacccgagtgctgtcttgtagaagagttctcttaggaagttgtgtgctaatttcagtgatgctgcgttagctcaaaatatttttaaaacttagatctctagaatctccttcaaagccttttgtaaaccacatcattaatccaaaaagaataattttacctgttattctatactagtataatttaataatgtgattattatatataatatacaattattaaatattttataaattatattataaataagatttgtagattataataaatatatattatttataataattgtaattgtcactatttgtggagtgcttttatgtgctagccacttatatatagtacctcctaaaagtcctgtgaatttgatcccacatatctagggtctaaagctttatagctgtttgttgttcagtccctcagtcatgtctgactctttgtgaccccatggactgcagcatgccagtcttccctgtccttcactatcttccggagcttgctcaaactcatgtcccttgagtggatgatgccatccaaccatctcatcctctgtcactcctttctccttttgccctcagtctttcccagtgtcagggcttttccaatgagtcagctctttgtatcagctggccaaagtattggagtttcagcatcagtccttccaatgaataatcagggttgatttcctttaggattgactagtttgatctccttgcagttcaaggcactctcaggagtcttttccagcaccacaattcgaaagcattaattcttcggtgcccagccttccttatggatcaactctcacattcatacatcattactgaaaaaaccatagctttgtctatatgaacctttgttggcaaggtgatgtctctgctttaaaatacattgcctaggtttgtcacagctttccatagtctctgcatacttcatacttcaccttaaaattcccactgcggtaaatacacacaacaggtggtgtagccatgttgactttcgtcaggggagttgattcccactggcctgttctctccacacagtgcccccctcacatccttcaagatgagagaacggcttctctcatctgaggttttcccgtctgaggttctggtatctgctcctctccccctgaaaaaaaagacaagatgatcaaaccagacaaactaaatctcatggccattgatttttgttgaactcactttaatcttggtcttactaaatcatctattttcaaaagattttaccatttttatgtcaaaagatttagtgactcgagtaatcatttgggtccaggtgatttcttctacagtaaagatgaaaacacattcagtataatgaatcaaaatgatcttaatactctttcccttggcagctacagggccctggtcatgatctatgtgctttccatgtaggtaaaccagaaagcattaggatcatggctggtggcaatgtattttaagtgcttatcctcaagtgatttttcacaagaaatattcaattagattgccaaaggaaatgagaaaccaggtttcttactcaaaattgaaggcattgtacaatggtttacttaacatttttcaagacgcaatctacatatctttttagttagggaaatgggaattaaccagggcttccctggtgccttagaaggtaaagaatctgtctgctttgcaggagacccatgtttgctccctgggtcaggaagatcccctggagaaggaaattgcaacccactccagtattcttgcctggagaattccatgatcagaggagcttggtggtctacagtccatgggatcgcaaagagttggacacaactaagcgactaacacaacaaatgcaaataccccaagaagaaaggggcacggcacagaaagaaccggtttggatgtctgtttcaatcagattgcacagtttccaaggtggcaagtgtgttagtggcaggcttcccatctttccacacaactgctcctctgcacagctccgattgcctcccaggtttctgagcttcccacagaactgacttcttgaacaatcgcctcctctccttgtcctttccttcagccccactctgttctcaccttcccatgccacccagctctcct

SEQ ID NO: 50481 - DNA, 1245 bp, Bovine  19866880634420
tgtgttgttgctgagcgttgattattgaactcttcaactgttactgggatttccgttctaagagtttttacttcaaatattttgaagccttttgtttcactgaatgtacatttaagattgtcagggtcttcttatgaatttatttagctttttatcttcaaaaagtctctctctttgtccttgggcatgtcctttgtcctaaaatgtgaaagtcatagaactgtacccttcccccaaagtcgtacactcagtccacaggctcagctgccacacaggctgtgaaatgaattcataaattcatttaattttcatcagagccctgggaagcagatactagtatgatctctgttttacccatgaggaaagtgaggcttagagggacgaagtttctggaagatcaagcagcttggaagtgacaaagcccttgaccctgtgtccttcccgtctcctgccttgcactcttgacctttggtgatcctttctcttttactacatactaccttgtacttgatttttctgtacctgtctcaccagttcgtgaattgaaggaggataagaacctcatgtcttcaaagcgtttaacggagctcttaccccacagccagttgagagggaggaaaagagggagagatactatcttcttcgttcctcattttggaaaagaaatagccctaacctcttagaattaattgccatcaaaatgcatccttatcaataagattaatctttcagtgtgactttgttttactcattcgagtcagctggcaggaaatgtgctgtcctataaaacaacagatggcagaaaggaaatattcattattgttctgttgtccagtttattatacctagtaatgatattctttgggataatgtgttctgagatatttgctcctgttagtcttgcctataaattcttgtcccttaccagattgatttttgtgctttctgtagcattagataaatatttattcaaatgaaatatatagtctcaaataatgatagaaataagcataaggagaccctgtaatcagtaacttgaagtttcctttttattcgttaaccatacacaatgatatcttgactaagtctgttagtattaataactagggcaataaaactgttttatagaaaacagctagcagggtacatctgcttccccagggaaaggggagggtattagaacttctcgaagaactgcttaaagaggttctttcttcattagatgaagaagaaacttgacgactg

SEQ ID NO: 50482 - DNA, 1418 bp, Bovine  19866880869059
cctggccatgggctctccaggtgcgtaaagaatccacctgccaatcaggagatgtgggttcgatccctgggtcaggaagatcccctggagaaggaaatggcaacctactccagtattcttgcctgggaaagcccatggacagaggagcctggcgggcaacagtccaaggaatctcaaaagagtcggacatgacttagcaactaaacaacaagaccctgtccatctatggtttaacaagcccttcaggtgactccacaaataagatttgagaactgctgttctagacactggctcccaattgctgttccacagatggtctgtatcagaatcacctggagaacactgacaatttcaccctcagagattttgattcagtaggtttcgataggaatcatataaaatacaagacacttagtttaatttgaatttcagataaacaatgaataattttttttagtgtgaggatgccccaaatatgaaattcatgaaattcaaattattttaactgtgtatcctgtatttttatttgcaaaatcaggcaacccaacctacttctaacaagcttctcagcagactcagccaggtttgccctaaatcctccgaccacttgtgtattcttatcacttccccccttccagacattatatttttgttgatgtgggctaagataacatgtgcttttggcagccacattatgatattgacttaaattgagcctatgaccactgaaaacccctaaattcttcctaaatatgctccttctaacatatgtctatctcactccaattttagaaagttcgtttgggacccagagtcaggatgtggcatttctcgtgatctggtttcaccttttcagactcctcccatcttttccgtctgttgagtctttttagattctgactctgaatttctgaaccttcccaagtggtggtctcactgaatctggtcatcaggttttcaaagttctctccagtcaatggtgaatatactagatcggacatgggtgaagacggagcccttcgggccttccctagatacccccatctgatatgacagggacccattcatcagctccctctgagcacaggttaatccgcccaccaattaaaatagcacagaatgttagtttccaccaacacagtgtctctccctccttatgaaatctcacaattctgtaatagataatatcagataagggcttccctggtggctcagatggtaaagagtctgcctgtaacgcgggagacccaggttcaatctctaggtcaggaagatcctctggagaagggaatggcaacccaatccagacctgatgtctgcaataacttcctggtctgctggtccagcaaccctgactaggaaagaagtgggctcagcatacaatgatttggtcttaagggcctggccgctctgctagg

SEQ ID NO: 50483 - DNA, 2384 bp, Bovine  19866880873201
gatcctggcggcctacagtccatggggttgcaaagagtgggactcaaccggagcgactgagcacagcactgcacacaccagccaaggagatattccacaggcattcaggagcctctttgcatacaatggtctctccagtggcatttgacttatggccttctgagtgttggcattcattgccccacactgcagctgagcacgcttcacacattcctccaatcttgaaagagccacagaaacccatcctgcttcttcactttctgtcaaaaatgcgggaccagttaggggaaggagtgtatcactgggaactcttttcccttccctgttcttccttgagtggtgatggctccaccgcaatggtgcgcagcatctctggtgcacttccttccatctagcagaatcaaaagaacttaacaggtcataaagatagtcatatgtcaaactcactcaagacagacaaaaacattttcctgggtgccttccagatccaggtcttcagaattacatgtaactgctgctttggactattgatttgaactaatcattccacgtccaccctggtggctcagatggtaaagaatctgctgcagtgcaggagactcaggttcgatcactgagtcagggaagatcccctggagaagggaacggcaacccactccagtattcttgcctgaagaattccatggacagaggagcctggtgggtgatattccatgaggttctcaaagagtcagatacaaccgagtgactaatacttttactcacttttcacacttatgacaattatttcgttgtatgttcactgattttttctgacacatctttctactaataagtaaaaaacacattaagaaaattgttagcttattatataataccctgatggaagttttagtataattgaatttttgttttcccttgagacacaaatactatgaatgtttcatagattatgtaaatggaacagtgaaaactatttgcaagtcacgccatttaatgtgtccgggaaaaatattttaacctcctttcctacagagagaagcaaaaaagacataggccttgttgaaatggaaaaggtggggttttgtgctgtctctcaagaataggtttggggtgggggtacaatgtggaagtgaacttcttctccttctgatgtgagagtaaaaaccagtgagaatgaaggctggcttggggcagaaccagatgcatgttaatacaaatgcaacctttggttaaatggtgtcctcggccttgttccatctactcaaggttgtacacaccacatctaggtcacgactttcccaaggcttaaagcactcacatggttggtgattgcttctgatttcaaaactaactgatgaactaagatggacatgagaaccatgcccccccccaccaccgactccccagataagttctatccaatttgataagcaaatcatgtttttatcctgttggagggagggggtttaacttccaaactgctgaagggtgggctgtttgttaatttcgtaaaaagaaaaccagcactaaagtatttttaagctttatttggtttaagttttgcatgaaaataggcacgtttctcatgaattgatgcattgtgtttacaagtttcatccttggaatgcaaccagttgaactggttatttttaatccagagaatgtcatgcaaagcccaatactcaacttagtcatgcaaacaaaggaggcaagcaaaatgctcccaagtatgctgacaatttagcttttctcctgcaaaaggcaacaacctttaacttgagaaagaagtcccagagatcgtaaatactgttgcacaaacataaggcagcatttggtttaaatacttacatagcttatcaaaagttttgtaccatcgacagagttccattgtgctctaaacaatctattgcttcatagtcctggtttcttccctcaagtcattagaaaaaaattaggtagcagactgaacacatttctacggagtagcagcagagaaacttatggtgatgccaaaggaagttttggaaattcgttgttggggaccattttccctgatagaataaaagccttcaacttttggaaattggagctatacaaggctcttaattgttacctaaaattgtcatcattgctcaaaaattttctggcagaggaaataggggcaaaaagtcagtctaatcaaagttgggtggtaagattagaaaagggttgagatcagcattctaactcagagataaagtctagtacctgtgtgtatatgtgtgtgttaatgaccaacgacagctccttttttttaattgaggtatagtttgagcttcccaagtggcgctagtggtaaaccccccgtctgccaatgcaggagacacaagagacgcaggtca

SEQ ID NO: 50484 - DNA, 2002 bp, Bovine  19866881023568
ataatacataaaattcaccgtatctgaaattgtgtgctcctgtatatgtatatgggtttcccttgtggctcagctggtaaagaatctgtctgcaatgtgggagacctgggttcgatccctgagttggaaagatcccctggagatgggaaaggctactcaccccagtattctggcctggagaattccatggtctgtacagtccatgaagtcacaaacagtcagacacatacatacatatacgtatatatatgtgtagagacatgcatagagagatggtcctgcaaatgtttatatgcctgagtggtgtgatttaggagtaatgtttgccttcttcatatagttttgaacttcctcaaagttaaaaatgactgattgcacatctgttatatgtgaattggaaaaaaagtgatacaaatgaatttacttacagaacagaaagagacttacagacttagagaaggaacttacaattgtagggggttgggggggattaggggaaaggatagttagggggtttggaaatggacatgtacaaactactgtttttaaaatagataaccaacaaggacttattgtatagcacatggaactctactcaatgttatgcggtagcctggacaggagggggagaatggataccaagtagatgtatgctgagtccctttgctgtttacttgaaactatcacaacattgttaatcggctattgattgctcactcagtcgtgtatagatggactgtagctcaccaggctgctctgcccatggaatttcccaggcaagaatactggagtggattgccatgccctccttcaagggatcttcccagacccaaggatcgaaccccaggtctctttttctcctgcattggcaggtgggttctttactactagcaccatctggggaagcccatagttagttatactccaatgcaaaataaaaaagtttaaaaattaaattacctgattgctctgtgacatggatttcaccaaaataaaagccatgagaatatattgtaattttattacaattaattataattaaaatcaagaaaaaatgcaattacctttattttggaaaaaaattatctggttaattgatttagcaattcattttgtttcaacagtagcaattgactagaaagtgagacatagagatttagtgacagaatctcctttaccgtggactataaataatgttttagaaatgtccctatattttggagcagattttaatttggggaatttttaccaaacatttaaaaattttctcaacatataaaagatcaaatgatagtcaaatagctaattattacttgatattttgatattatttctttcttacagccttagtagaaacagtattaaagacttaaaaagtactttgagctcttgctctcttggtttttctatgaaactattttggaggagtgccaagcatgtgttcaacaaatgttttatactagaaatattttgctctaatcacaaactggtggaataaccacgataattcaagcgttcttttgttcataggcttccacgttttgttcatttgcttgaaatatgtgctttgtttttagctgaaatcaggttcatatgtgttgagaaataaagagctgtgtatttccagaactatattcttgtaacatgagctctgtaaaagattttagaaagaaggaataatcacttggcatcaagtgaaaagaaagctatatacgggatatgttttcacagtaagaacatttgattttggtcaaactcatgtcaaagaagaattagaattaattttagccttggtatgcctaagatatggacagccagattatcttaataggaaacatatttatgcattcagaattgcttacgctcaggcagagttttccattgcaaatactgtagcctcatgcagcaaatccatcatttatgggaaaacctcaactattcagatcaccaagaaagtcaggaaaaaaaaaaaaaaagagtccgaatactaaaatagaagtca

SEQ ID NO: 50485 - DNA, 1737 bp, Bovine  19866881037067
acttaaatagatatgtaagatttcatgatcggaaaagaaaagaaggggcacttgagttgtgaacaggcctatagaagtgagatggtgattgcatctgaaggagatgagcagacaaatttgattggattagacacagatgtaggctctatatggtccccctgctaatccagtgcctctgttttgttttttattggaatattgttttgttttatttattggaatattgttttgttgttgttcagtccttaaatcctgccttactctttgcacctccatggattacagcatgccaggctcttctatccttcagtatctcccagagtttgctcaaattcatgtccatcaaggcagggatgctatctagctatttcatcatctgccacccctttctctttttgccttcaatctttcccagggtcctttacaatgagtcagctcttcgcatcaggtggccaaagtattggagcttcccagcgtcagtctttccagtgagtattcagggttgaatattggaaaatagccacaaaaaataaaataaaatactcatgagtgtctctcatgataaagttccttccactggaaggaattactggtgacttcctctttcactgaaactgcccaatatttattacacctccttccctctcatcttgtcctcctttgtctacctaaatctcaattattcactcactcagcaattcgcaggggagctccagagactttttgactcttacttctgaattttaaattcccttataaacaaaaaccccttttcctattgattttgtctcagttttctggaaactctaaatgattcttggcttttctacatcagtctcagagtaatcgctttcttttccctttggagcttcttaaaacaagtcagcataattgtgtctacttacccctttagcataaagccttcattctagtctttaaagccactcaatgatcttggaaatgttttcttcacattttttttttgttcactctttatttttaaagcaagtaaaagcaagcaatccaagtatgtgatttatttttatgaacaagaagacccagagaaaagaaaatcctttcttcctgagaagcaaaggtctaactgaccataacattattgcttcaaatgtaattccttaaaatataaggctgtctttctcaggagacaagcacactcaaagccagcattattccactgaaccatgtcagataaagtgcatctttttcttttctccaagatcaatataataccatatacaaaaggaaaattatatccatgtagacaaaaaaagtgcttttcagagggaaatctaaaacattagatgctctgtttctccttgtaaacatatatacttttttctggaaagggccacacagatctttgcagtggttgcttaagatcatagatgatgatgagagtcagttccactttccacaagaaaagaaaaatcactgctcaggtacagccaaaggtttccagcacagataaggaatttcctaagtgtttcccataagataagcagccagatttacaaaagtgtaaggatgttcaccaccacatttcattttttgaataataaatcccagaagcaatctaaaaatccattaatacagaattgattaagtaaactatggtctggttaaatatttgaatgttgtgtaatcctttgaccaatgatgtatatctacatccttagacagggaaagaactatataagaccttgatttaaaaacaga

SEQ ID NO: 50486 - DNA, 1612 bp, Bovine  19866881064908
ggatgttaatgttcttcctaaccttcttagggggagttttctcatcactacctagtagaaggctgaggagctcagaaagcctagagctgggctcttaggaaagagtttatggatctcctgcagtgcgattaatagtctctgcatctgtgtgcatgcttagtcgtgtctgactctttgtgccctgtggaatgtagcccactcagctcttctgtccgtgggattttccaggcaagaatactggagtgggttgccatgcccttctccagggggatcttcctgacccagggatcaaaccggggtctcccacattgcagaaggattctttactatttgagccaccagggaagtccctcgatacatttgatactcttttaaaaaccatgcttgccttctaaaacatgcaaataatcgagacaaatttataacagctcacactcaaattccacttgatagctggttaaaggaaacgaaccaaactttcaataatagagctgggagggattgggggcaggaggagaaggggatgacagaggatgagatggctggatggcatcactaactccatggacgtgagtctgggtgaactctgggagttggtgatggacagggaggcctggcgtgctgcgattcacggggtcgcaaagagtcagacacgactgagagactgaactgaacaattaagaaaccatcacattggttaatccatatttccagtattatttagtaaattttagcaacattaagataccattatacaccgatttactaaatacatagaaatcatgaaatgccaattttgtgatttgttggatctgagactgacataaattgttttaaataaaattttaaatgtttctggtcacattttccattgttttagtttctctgtgggaaaaaaaagacatggtgacctatgaaagtactggatataatttggcactataatcctactctatggaacattctacaaggaaatacacagattaaaaagttatttacttaggaatatttatagtagtgctataaatatgattacaaaatgaaaacacaactaggaaaacccaaatggctaagaataagagagagattagcaaagcctgtcccatgacaacagaagatcactgcaggactgtaagaaggtcaactgtgtgactgatgcatgaaaatgtgaaataaaattaattttctaaagcagagtgataaaaatgtcaactgtgaaaactctgttgacatatggaaataaaaattaaaattaatttgaaagagcagagcacatcctttcctgatttccttcatgagaaaacaacatccagcaaagatagtaagagaatttatagggaaataaatgaattgagttgggttcattggattcttgttctttccttcaaaggtgcttaagttgatctgtattcattaataaaacaagaccacaggaattttatgggcagcacgtgagatctatgaataaacagacaagttcaggcccaggcagtgtaattaggaaacacttgccttttctcctctgacatggcccatcctcaaggcaggtgaccacatggtttactggggaacaacatttcttcctaatagatatgcccagtcggatcatgtt

SEQ ID NO: 50487 - DNA, 2192 bp, Bovine  19866881134068
caaagcagggaaggtgggttcgatccctgggtgggaaactaaaatcccacatactatggggcaattaagcccatgagccgcaactactgagccccgtgcgcctcagctagagaagaaggccatgcactgcaactcagagttacatgctgtgactcagacccaacagagccaaaaataagtaacaaagaaatattttttaaacaaagaattgcagaggacgtatccattaattatctcttgcatcaatgatgcaataaatggatgaatgaagtagatcagagctagcactgaaacgactgcagaaataggaagacgtgactcacagccttgcaagtaaaactgtggcccgggaactgccaagggtgaggtggaatttcaaccagccatggctcagaaaacatgtgaggctcccctgatgttttttgaatcattctctggctcacttgattaatgctgtatctcactttttaccattttaatttctttgaacataaagggtaccctaaccactctcccatttccacccccagttaaagcaaaccacccagacatgctcatgagacttgggcccacttcttcaggagtgtgttgcctgtccacagagcttccagtcagcactcagatttaagtaaaggctccctggaacccatccacaaagatgtgctccattaccaaagaacttatcctccagcttcaaaagggaataaattttgtgtgcagggaacctgctgcatggggaataagaaatagtcacttaagtttataaaatcttgcatggtgctatctgcttcagttttctcttttaaagctagaggatgactatgaactttcctgatattttttccatattctcctctgctcccctaatcatacctttcgagccctgtccattacttacaggagattcgctggttccgaagatgtctctgacatccctgacagactgcttgttctttttcctcaaggtttgtgtgtaagtattgtatctcttcttcactgcagctgcctgggttcgagtcaaagtagagagcaaggctttgccatcttcctcctcatcacccgagatcagggttgataaaccaacatcttgcaaccactctgcttcaagttctccttctgtaaaacgaagttgccaaaagaaggtgagaatattctgggattggatgatgtgtatatctgtaagtctgtacacatcagtgaataagaaatatcagtaaacaatattaataagaccatcctggaccctgaggacattatgccaagtgaagtaagtgagactgagaaagacaaacaccaaacaccagatgatctcattacatgtggagtttaagaacaaaatgaagtaaaaagcccaagtacataaatacggagaatagactggtgtgcttagcagaggcaaggggtcggggtgggcaagatgggtaacggtggtcaaaaggtacatactccagttagaaaataagtaagtcatgaggatgtaacgcacagcatggtgactttatttaataacattctattgcgtatttgaaaattgttaggaaagtaggaccttgaaagttcttaccacaagaaaaacaattttgtaacaatgtgtgacaacggatattaactacacttactttggtgactgtttcacaactgtatatgtattcaaatatctaatcattatgttgtataccagaaactaatacaatgggaatagaaggctattgatgaagaacatctacaaaaagttaacagttacaaccattttttgtggtgaatattgaacccttcccctgcaaaaccgggatcacagccaggatataaactgtcattacttactttcattcaacttatatggaggccttaccagaatgataaggcaagattaaaaaaataaaaacatagaagtcagaaaggaaagagtaaaaccgtctctattccccccaaaatctctttgtttatttagaaaatcctaagacatttagtaggagaaggcaatggcaccccactccagtacttttgcctagaaaatcccatggacggaggagcctgataggctgcagtccatggggtggctacagttggacaagactgagcgacttcactttcacttttcactttcatgcattggagaaggaaatggcaacccactccagtgttctcgcctggagaatcccagggacgggaagtctggtgggcctgcccgt

SEQ ID NO: 50488 - DNA, 1132 bp, Bovine  19866881217127
cgtgggtctagtttttccccaccagaaaggtactattttatactttttaaaggtactatttctcttttctctttttctttctcggaagtgaagaaccatgtctttctccaggtccgagggtaaggtgattctgattcacggcacaaccaaggaaacttctttccttaagcaggggtggaggatgagctcagactggttagtgctaacgactcgagtagactggttaagtcttctagatcaattagtgaaggtgctggtttgtcctggcacagagggactcgttgtaagagcttaaagtgtgtgaggggcttccctgatggtctggcagcaaagactccatgttcccaatgcaggggctctggctgggttgcatcccgggtcagggaactagatcccacatcctgcagctaagagttcacatgtcacaaccaagtcctggcacagccaaacacataaaagcaaatcttaaaaaattaaaaaataaagtgtgtgaatagttagccaggaagctcctgtggctgggcagaattgctatccgtaaataacaattctgatggttgcaccttctcagcgcccagaaaggatcgtcctcttaggcagaaacggaaagtctcatctttcccatcctttgtggagttgcccacagaggaaaagcacagaataacctcttcaagaacaacagacccaacaatctcggagcaacaagggaatttaaggtcatctgtctggctctggtcagatgcctgattcccagcatgctgtggatgtcccagatgacctgcctgttggtggggttcaggagttgtatgtgtgtgatgcacacgcctgtcctcagatcccagggacagttggacttggctggagaaacttgtgtcctgtggttgcccactttggctcccagatgccttgggaaatgacacataaaatttttattaatattataatgtatatgataatccatgtgagttcacaagaatccacacagctcattttggttctaattagaatctgaaaatgcattctccgccataaaatccgtatcatttaatcattgaattactaatcccatccacattagtggttcccaaattgtggtgcctttaatataaataccaatattgaatggattaca

SEQ ID NO: 50489 - DNA, 1702 bp, Bovine  19866881467950
tctccttttgtctcatgattacttacgcacaacagactgctggttaactgatgggcctgacacagcaggcacaccagcattgtaaatcctttacccttaaggcctttacttgtccgtgtacacagtatacagttaagtttggtctcctgggaatacttcttaattcctttatttcacattcatattctaagttaggagaagcctttaatcctactgggcatgtgtgtgcatgtgtgtgttagtcattcagtcatgcccgactctttgggacaccatagactacagcccgccaggctcctctgtcctccgtccattctccaggcaagaatactggagtgggttgccattccctctccaggggatcttcttgacccagggattgaatccaggtctccctcattgcaggcagattctttaccatcgaaccagcaaggaagccctcctgttgggcatacccaacatgtttcctgtttgttgctacatctccattagaaataatactaaatacaaatgtccttgacttaggatggttcaacataagatttttcagttttacaaaaatttgatgctttttccacctagtgatatgcagcaagatactctctcataatgctggggaaacagcaactgagccacagctcccaattagccacatgatcatgaggatgaacaactgatacacttacaaccattctgtacccatacgacctttctgcttttcactttcagtatcttattcaatacattgtgtgtgctggccttagttgctcagttgcacacagctctttgtgaccctttagactgtagcccaccagtttcctctgtccatggaattctcaagcaagaatactggagagggctgccattttcttctgaaggggatctttctggcccaggtatcaaacctgattctcctacattgcaggcagattctttactgtccgaatgaccagggaagcccgtgatattcaaagtagggtaggtgtattttcaacttatgatattttcaatttatgatgagtttatctggacatgtccttttcattaagtcaaggaagatttttatgaaaaacaaaatttaagaatctgcagtcttatgattcttgataaaatgaattttcaaaaatcaaataatgtctctaaaaagttcaccaagctacctgaatgaatgtaactatatagatgttatgaaagaaagtgaaaagacttcttcctttctagcctaaagaacttgcaatcttattttattgtattcctgtgagttgtgaagttgtaaatcagctgcttttctgatgtcaacccaaactggttttcaaccaccattatagtctagataagaactaatgaaaggtagattttttttatggagtaaccaccttttcttcatcttgttttactatcttgtctaatggctcttgacccaccttgcaatttctgtgacagtgcgggcctcctgacctgtgcacctgctctccaagtgcttcaccacattccctgttccagtgtgagacattgataaattctctctgagatacaaggaacgataggtgatttgaaatgtatgtattttcctctgttcccacttgtttctgagaagtctttcattctgtttctgagttgagctgattgattctgaactagttgaaactcaaggtccagagcaacaagctagaaaaaaagatagaaatatgttttaaaagtg

SEQ ID NO: 50490 - DNA, 726 bp, Bovine  19866881562445
ctttaatagttccgtgttctgaaaaacaagctgatcaaatgaatcccctggaaaatgaacacaagtgcctggaggccactctgtggactctgacctctccagaagattcaagtccagactgcaatgagccctgggtttgttttctaaacagaaatccttgaagcccaattttggttcagcatcatccgtggctccagggtcactgagggacaaggactgtgctcaggcggacaggagactagggatggcccggagtccagactggactgtacaatctagctcaacttatcctaagtttttgagcaacatttagaacagacctggtctgcacaaaggcaaggtccaggagctgcttatcccttggttggtttcagagtcaagataaagtgaaaacctgactgaatattaggagagacaaaaggaaaaccccgaataattctcctggagcctgtttcttgacctgcattaagaactacatgttatagatcacatggaaagaacaaaatgaaacatatgtttttagccgtagaaatctgtcttagtagttagagaaaacaactgataaaactaaaatgaaaaaattctaagaacatgaacctacaggttaaaggattaaaaaatgccttcccttccttctgcctaaaaaagagtccagggaatatttcctataacccaaaattgcttggatctcactttcatgatcaagctgacttctataatacattt

SEQ ID NO: 50491 - DNA, 1065 bp, Bovine  19866881885000
ttttacttttatgtattggagaaggaaatggcaacccactccgtgtttttgcctggagaatcccagggatgggggagcctggtgggctgccatctgtggggttgcacagagtcggacatgactgaagtgacttagcagtagcaaacctctttttactatactgtgctgcctcttataccaaatctagaatgttatttataaggaaatgtcatttaaggtatgtttaaacacagctgccaaaacagtagttgtagggtgcttaaaataaggacagaatccaatttattagcgtgcttcaccatatattccactgacacaaaattcctcagaagtgtggctcacagccattctcagacatactctaggtctgtataaaataaaggataagcatttaatggtagttttaaaaacacagccgatagtaaagcaaaattgagtcattttttcccatacaggaaagtaaacgagactgagctatttgatgttttcatccactttcaaaaataacctgtgatgcaactctgaggctggggagaggaccccatattacagtatgattatttctggaagaattattagcacatcagataatgtaacacgggaagcataagtccatttgttaaaaaaaagaagaaagattatatttaaatgtagacaaaggggagatgctataaagagagaagccagggaggatgataggcagtaaggtttctgagatggttatcacatctccgaaagatggttaatttggagtaagtgaccataacacataggtagcaggaaagaaaagggttcgagggtttcaaagggtgtgttctgctaaggaaacaacagtttgaacacaaaatgcatcttttctaaaacaacaaagcccttttcctccagcccagcagatgaaggagaatcttcctgaagaaggaacctggaggcaaggatgacagatgacgagcagctcctcccgcagcggaggagggggacgaaggcaaagctgatgctcgctagtgagaccccctggaccctcccaggaagcccaggatcggcggggcagcacagcacacagcagtg

SEQ ID NO: 50492 - DNA, 1106 bp, Bovine  19866880964429
aaaataaagagaaccaaggaatcattccaagaatacataaataccagtgatcaaaaattaatgtcttagaaattttaagttgtttctactattaagataggaaattgctgaatttaatagttttagactatgaaaaacctgtatttgccaaacaaaaatcattcaatgtgcctaaggcgtgtcatcaaagacagataaggatattttggatttttgttggcggtctgaagatagaaacaaagcctagtcttggagctaagcaaagcacataatacatacctgcccaacgttcacagttggtttgcagaaatattcagcaaatgacagaagtgctggatcagaagtgaatgtggaaatcgtttcaggctaaaaaaaatgaagaataagtatacgtgagataataaagattcttttcattacgactcaaattgtatgcagctgtaatctactttattttttttttcacataatgtttccacaaaacccaaggctgctagagcttcattaacctattgggttgaaagtctttttttccttttttagtaatatcagcttacttcttcttttttttcgtacatgcccatcccaaactccctcactatcccttcctatgtttctcgctggcaaccataagctcgttctcaacgtctctgagtctgtttctgttttgtaagttcctttgtattacttccttcagattaaacacataagggatgtcatacttaagaaatatattgcataagctaccatgagctactgatttatcaaagggcagattaaaaccaggtgtttcttatagaagttgccccaaaaaggttttcccttccttcttaaactaactgaaaggcaaattagaaactagaatttttactgaacagattaaggaaaaaagattatcactctaacaggccactcacagaaagacaaatgctgtcataaggtcactacagtcatgaaagagaaaggacaatggtggctgccaggggctggggagaagggaatgggcagtgttaatggggtcagacaggcagctctgcaagaaaaagacagtcatggagatggatggtggtaatggtagcacagcgatacgaatgtacttactacca

SEQ ID NO: 50493 - DNA, 1136 bp, Bovine  19866881096639
ggggtccatcatccatttttcaaaattcttagcctctgtctcttcaaatgttgcttctctttttctctctcctcattgtgggatacatgcatgtctgacttcactgtacttcaaatgtctcttcctctcttttctgaatttgatactcatttttctctctgtgcttcgaactgtttactttctacacacctgtcctccagttcatttatctgctatgtctaatatgctaactaacctacataacaaattcttttttttcaccctgctggaatggcttttggagtctgttcctctaccagatactgaacctgggccatgggcaaccactgggctgccaggcaattctctacatactgaattcttagttatatttttcagttctagaatttcctttaactctttcttacagattccaaatttctggtgaaattcttcatctttccctctattttcttggaaatattagtcatagtaactccagacactgaagtaatctaagtctgataactccaatatgtggatcacattcaagcctgtttctatattaccctttttccccttatgtcttttcattttgattcagcactgatactgtgaattaaaaattacacaagttcaagaggtattttcttcctcctataaaggttaatttttcttctatcagctctgtcctagactggtcttagggctggtctgtctgggaggcttaccaaagcctccaccgtggcgggctgcgagcactgccctctgtttcctcggcactgcagtgctgctgaaatcgccgcttgtattttagtgtcctggtttcgctagatttcctgaagttttaccctgtgcgcgtgcagactaaggtttgataaacgcctcaagggaagacagcacccaggttttgcgttttgaactcctatggtttcctccatctgggattctgctccgtaagccccaggcctgggcagtgattaatccaacctccggctcctccgcccagcagcactgctgctttttctgcatctccacttcttctaacgaatctgctttttctgcctctccacttcttctaacgaatctgctttttctgcctctccacttcttctaacgaatctgctttttctgcctctccacttcttctaacgagt

SEQ ID NO: 50494 - DNA, 1509 bp, Bovine  19866881134510
gagagagaggcactggaaagaaacaggatttgatgctggaaaagatgaaacaagtttctaagtgtcaagtggtttttaaaatgctacattatacattctctccaagattatagagcagagttaaatacatctgttaaagaagtcaggacttcccttggtggtccagtggttaaggcttcaagctcctagacttccctggtggctctgtggataagaatcctcctgccaacgcaggggctatgggttcgatccctggtccgggtagattccacatgctgtggagcacctaagcctgtcccccacgacttccgagcctgtgctctagggccctccagtcacaactactaagccctactgaagcctgtattcctagagcccatgctccgcaagagaagccaccccagtgagaagcctgagcaccgccatgaagagtagccctcagtctctgcaactagagaaagcccatgcacagcaacaaagacccagtgcaaccaaaacaagactcggaactcctaatgctgggggcgcaggctggatccctggttggggagctaaaatttacatgtcacacagcgtggcctcagtaaataaatcccactttctatcctcaaaaaatgttagagcagataatcagagcgtaattcacctaactggaaacatgacatctacagccatttgcgattgtactaggacttaacctgcttaccaaggaaaacaggtaaaaacagaaagccctgaggcccagtgcagctcgaaggacaggggtgcagtgctgctctcaccttgcagccactggtccagagtgttgtcagtagtgcatttgacaacagggaggaattccgagttcataaaaagcccgcgattaggctggttctgcagccgttcctgatggctcctggagctgaaaaactccagcaccaactttatctgccagaggtcagatgtctcagacatttctcttcttcccagtcttcttacagccttgcagagagaacagaaatccacttgaaagagtgaagattcgtcacttccttggtgttgtacactggagcacttttttaatatggtcatgagatcaaggaagggcagggggagcttgctctgtgtttgatgtagcctgtgccacagagaagccctttagtgggtttaggtacatggtcattctgttcaaaacgaacatgaacagccttcagataaaaaatggtgaaggcaaatgaagctcattcttggctcaatggctctgagaaatgaagacctaataggtctacagctgagcccctctgggaaacccaagttggtacaatgatttgtccgcgatcaggccagggatcccaggggtcaggaggcaaaacctgtattattgacaatactgttcttgggacccatctgccaaagtcaccatggctgcagccagagggatgttccactataggtacctgcccatgactgccaagagttaaaagttcagagcgtaagaaaagaacacactctcaaccatcatctgaaaca

SEQ ID NO: 50495 - DNA, 1006 bp, Bovine  19866881333955
atgatggttgattgcttttggttggaaatggtcatatgcagataattactttgatgaacagagagtgctaataattttatacttcagttagcatgtaaattaagtctttaagtttgcagaaagtttaacaatttgtaacagattttacagtatcatcctcatttctgtttctcccagactataaatagctgctttttgtattctgtctttagatttgtagcatctttttctttttgctgtaaaccaatcagtagatatttaagggaatacatgttagataaaatatctcctttgaaattcatacttgagcaaatagaatgctgccttatttaataggttccttgaatcttgacagcagagaaaagcagaacttgattatgacttgtagggactggtttagtttcaacacaataaataatcacatagcagaaagtggtgaaaactttatctcatgtgaacatagtatcgggaactacatttccaggcaatagctcccagtaatgccttgtattaaatccattcttgttttctttcaggtccattctttccaaggatggggttttatatgttaagctcagagcaggtcagctctcctacaaagaagatccaatggggtggcaaagtttattggcccagactgtagctaacaggaactctgaagctcgagctttcaaggtaatgtgattggtaaaaactgaaggatattctcatcagaaggaaaaagaaaattgtaactaagtgtgatgctggatgttagctagacttgtggttgtcatttgtcagtatatacaaatagcaaataattgtacacctgaaactaataaactgttatatatcattatatctcaattagaacaaaaaccaaaattgaacaacaagagggaataggttcaaatcctactagtccacccaaagcatatacttctatcataacatttatggtactgtttaggtagatccactcactaatcacagcagattataaagacgaacgacccggggcctg

SEQ ID NO: 50496 - DNA, 2108 bp, Bovine  19866880342571
actctggaaaataaagaattggaatcagtttcttaaaatactggtctccccatgtctctctctttcactctggctgagtctccatctggagcgcggaacccaccatgcttactaattatgcctgggcttctaagatccgaccggggaggcctcagtgtctcttctccttcgggagaatggaaggacgcctgcggcctacgtaagtggagcaaacttcttgtcttgaagttttattggtctgccgcgtaaaccaagctactcagcctcttttctccactgaattttcctactgagctatccttattctattactctttatatctttaattaatatctaattgaagctattgtatcctgaccctcgccgacgccgtccccgcttcgaactccctggatcagccggggctggaccctggcacacatatattgaagacaccagtgtctcttaccaataacaacatttattaatattttatgcattactccagaaattttatgtggatatctagtgatatatttatagagtttcaaaaacaaataggagtaaattatgcatttcttatttttccccatttgcaatatgcttagagacctttgcctgaaagcacatgtagttctgattattttcatggcttcattgtatggcagttcatgttttatttactagctccataattttttttttaccagctctctccactattgatgattatttccagttgctagttattgcaataaaagtttgctgttgagtaattacattcatcacaaataattccctctctcttaatagaaggtagtctcaattactctccaaaatatcaaggcttttggactcccaacttactaagtgatctgctccattgtcccgtgcaaatgtcctggccatctagtctccaacttgactctctttacaaggcctcttaccagactgtcctccacccctgcaggccttgtagtctttgggatccatataacctgagttttcatcagttaatacttacaagttattgatcactacttttaaaaatgaccaaaggagacaatttaggtgatacaagcaaactttatttaacacttcatgaaatgaacagtttccttttggagaattttaaattggggtggatgggaggcaggaagttttataggctaaagaggaacaaggaaggaaggggagaatccagagttggcttcatgtttgggaaactgcctttctggtcaagtggagcatttcccagggacaaaaaggctgtctaaatattgacttgctgacatggcaccctgtgcagaagcagcttcatcttgggtcaagaaacttatttttatttcaaccctacacaggaagaacaatgtgaaactatgttcacagatggtggcagctgggaaggagggggaaacatggcccttcatctttctaccaggggaaatgatttataactgtcagaaatctgataaaaacgttagaagtacataaaatccattatataaattataaaacgtaagtcatgattctatttgtttggtgacaacttttaaaatgactaattttcatcaatatagaaaatcaatatgaatcactacaacatccaagtggttgtccccacttcctccctcccctgcaaatattatgctcaccctgtgcctgtggatggagttcagtactagaaggggaggaggctggagggagtggagggcaggcggagaggatccagatggaagagatgggaaaatgtcagagagaaatttccctcgtgtccctgcttcccccagagctgtgtctgcctggggctttacagtgaaaacggttcagaaaagaagcccaatagaggggaaaaaacactcttttgtgacgctttccaggcatggacatgtctgaaaagctcagttgtgcaggtctacagtcatgccagcacaaagactgagacggtaaacctccttcacagaaatttctggaacccaggcatcttttcagagacaaaagtcacgagaaacatacagtttctctctgttcatcgcagcctcatgttttactcactgtcagttggagaagcaaagacaggagtcagcgccacatcctgggatctatcttctggggatttcaggagaca

SEQ ID NO: 50497 - DNA, 924 bp, Bovine  19866880570368
ttttgtttatgcagcacggggtgagggctgggggttatcaaggaagtctgttccaagtttggcgtttggcattaatgtgaagcagtgggaccaatgctgcctgctaactactgtacgaatccctctgtgtcctgaagaccagcagctggaggccggcatccatacagcaaaggggaaacagcgccccttcaccggggaaaaggaattcatgcaaggcctggagtcatcatttgtaaagggagagtcggggtgtgcgcaatgctgtgaggaggctcacctttgattgcagtgctccacagagccctcagataaggccaaccctaatgggctacctcggctttaacagttaatttcagtaagtcctgtttccaaagtttgtcttttttttgcttccaccttcagtgccactattttccactgcagtgtttagactggcaaaccaccttctccagagagaacaatgtgttgctgaaaatgggcagcagaagccaatgcttttacatttgacctacaaagtattcagagtgactgctaggtgggaattaaaatttagccttccccacataggaccttgtttttgcaccttgtaaagagtgtactaattgttaattaggtgttgcttttatttatacaagtattcccaaagaattagatttggattttgtttttattggagtttggggatttttttttttaaagtatcttatttagatcgactaacatcatacttacaatataaaaaaaagaaacagttttcagttcatcttaacagatctgtctggtgaagtagtcaggatttgatggactgctttactttcattttggaaacgatagtgaagtttagtacaccccatattacataatcctgtccttttcactggtgacatcatcttcctcacatatagaaaaagaagcaacaaaaga

SEQ ID NO: 50498 - DNA, 1247 bp, Bovine  19866880583546
tagatgtgacttgaggcaagcattgctcccagtgaaatttgattgttttttaatgattaaaaaaagaatgaaagaaagaaaaaaccaattgcctggcagatatcttactaaaacaatggttaataattatgatggtaatgatttgaatgacagctttgacaccctgaggctaccaaagggactggtggattctcctccaactgctgcttctgtggatacaaaagaatcatccatcagactttgagcattcgggacattgtgtatcacagagcagctggttggctaaataaggctgtcagctgtccctgagatccacccaacccccctaaagctaaagaatgactggggaggactgtccctaaccttcagaggtggagatcagtgatgctctgttttattgtgggaactgctgacgtcatgtgcttaaggtagtttgtgaagaaaatggaatagcttaagtcaggtgaatgagaggccacctgggtgaccacttctgctttgggaatctgaccaggatatgttttgatggtggggcatgaggaggcctgttccgggagagacgatccaaagcaacctatctaagtttgatgattttctctttgagataaccttgggctcctttctcaagtatctaagcacctcatatttaacattttaacattcccttttaacatttgcaagcattttgaggtgggggggcggattttgagctcatcttatctttacataaggagttttcttggatagaaagcaaaagaataatgcatagaatgttttgaacagaagtaatacacattaggtatattacctaaatcttcacaaggaccttggaatgggttttatgatcttcatttcagcgacaaagaagcaaaaggaaagagggatgatgagcatgttgtctatgatcctttgtgtctaactcacttgccttctttttcctactatttcttttcactctataacatcaaagatgttatagtttccccttcgtaggtaaataaactcacaagcccaaacaattgctaccctatcccatcatcattacccttacaaataaggaaggtgaactgtgctcagggaggggatggtgattagtcatgactccaaggccagcgaaaatgttcacaagcttcccttctcaattcatggtcagttcccctttctttcactttctatcttaacagtatatctacttttatcttcctccccaaactatacctacatcctaccacaggcccatattgtta

SEQ ID NO: 50499 - DNA, 1940 bp, Bovine  19866880607718
cctgcaaatgtcacagtcctcagacctaaagtctgaggaccatacaatgcacaaattatcaaccaacaaaggagatttattgagaaaaggagaagagcaaataagataaaactcatgatcttaatgctgctaaacactccaacattaagtattaatagtatgctttttgattcaaagaagttcctagccccattttaccctcctttaacaggatcatgttgctgcagaagaaataacagggaaactttatagaagtcttaccaacacgatattttagttctatgatggtttccccttctctgctcaactccgttacttcgcaagtgtagtttcctaagacggcatcacttttagccatcttcaaagaggcaatgccacgcagtaattctgatggtgcgatttctgcactagaaaagttactgctaggcttggacatccgctgacttccatcaaagatgaaaatgttttctcctttaaatttccatctgacatacaattcagtaatgttcttcgtctccacattattaacaaaacatgggatgacaacggtttgattgcaaagggtatattctaccgatttgattgcattaaatattagttgagctgaacctggaaaagagaaataaaattgtttcatttcatacagaatactatgagatcttaggtatgttacaaattcttaagataaagagaagtgcttctattgttcacttaagcaagtaagcaactatagggaagatgggtgaagtgaaaagaacaaattattttaatattaatgtgctcagctgatagacaacactgtacctcttctttattcattcccactaacacaaaatatacattctcatgtatcctgggaataaactcagcaactgtgttagaacatgcagatgtagtatctggctttggaaactctgaagcttgtgtattctgatatttaaagaaaaatactgactttactatgagaaaatttttaaattgaaagtaaaaccaaataatatattcagtctcaacttctatacattttctccaaatagaacttgctaaactgataggaagtttatttctatccctaggttgcatttccaaaaaaggtagcaggctccactgtacttaaatataaaaagtaaatcacatgaatcacatcacatctttccactaggatggtaagccttagaatgctaaggattaagaaaaaaaaatattctctacagctatttttccattgcaaaatacagacagccacagacattcagtatgcacgtatcataaaggattatacacaattgaatggcattttcccactcccacatttcactgaaactaaggaacaacttccaaatatatattacaggtgtccctttcttctagaaaccacaaaccacccaaaacaaagacaagatgcaagctgaaaccaagatcggatactactaataagtagcatgtatcagatcaactcttttcaataatataaactactgattgttgccttataaaagagaggttgagaaatgggtcccctttcatgtggaatgtgcaaaaatgtggacaaactgtacttgttctccatattcttcagccacttatgacttctttcatgtaagcagtgagttggtgtttcctttcaaaaaaggattgacagatataaataaaaccttagttttaattgttcatctttaagaattttcctttatcaggggcacaggatattattactctaggaacataattactcttcaataaatgcccactgaattgaatgctgggctgcagcatggaatatgaactgaacaatgctcagaagcctgagaacaaatcccatctctgtctgttacttttcagggtgaaaccttaagcaatttgcttaactttctatgccttggtttactctctataagtaagaggatcaaaaaatgaacactgggctgcttcacagaatt

SEQ ID NO: 50500 - DNA, 1658 bp, Bovine  19866880654604
cctgagggagaaaatattttgtttaatggcaaaatcaaaccaagcagattacttaaatatgacctctttgtatttacaatttctgcatatcattctatgacaacccccttccttgtctgtgaatacatttgtgaaaagcgacattttaacagcggctatttgaatgttcctaacaggcaccatgtgtttaatgaaaacactatataaggctgaactaccttaaccaccatgtactgactgtgtaacactcagggccacagttcacaataaaaatttgtcctcagccattcctcaacagtttagacaatggctcttggttgatctaatctgcctgctatgcagagaaaactcgttctcagaaacaatagaacatcagaatcagtaattagtaagatttaacaagcagtatgagaatacagaaatgttcttgggaactaatttaacaattatttagtatcagtgtttgagaaatacagggtggctttaatcagagactttttacagcattttaaaaataaaaatacccatgaatacgtgtgtatatgtgcgaacagttaattaaacaaacaataaaaaatgtgaaggttagcttctgcttcatctttgagaactcctaaaagtattaatatagaagtatctccagtttattcccattcttttctccttctaaccttgtctgccttcaactgacattggtaagtgctcttagtggtcttcctcaacatcaggaaagtggggagcataaatcccagagaaaagtcattagatccctaccgttggaacaaagcatggctgctttcaaaggatgaaggtttttattttatttttggttgaaattctaaaactttgacaggatcaaaaaatgtgctcatttaattaattaaactgctgtctttgaatgtgtcttgctttcatatcccttattatgtggttgtaagccattatggcaaggctgtcttttcccccgacacatgtatatgcatactcttctacttcctcctactcagacagtaaattaacagcagacttagaaacaaaaccaggtgtcctgacaccctgttccttttctaaggaatatatgacttcttttacttcaatcagatgaagaaatgcattttaaagactcctaggatgtcatttctatcgcacgtaaaatggagatgacaagttccgtttgcttccaaatgcgggcagagaattactgtgctgctgtttgtgaaaagtactgcatgaccctctagaagacaagtgctgtgtcaagtttagggatcagagtcatgaactggaatgagccccaggcatcactcttcagttacctcactcagctgggcttgagccgcacgatattcctgaaccaagtgctccagctgattgttgatgtacttttctcggctgccaatcttttccagagtcctactaatttcattatgaagtctgtccaaaaatccctagaaatttcatgaaattttaataggcaaagaatgcacaaatatgattttccaaagtagttttaaatgggttaaatctccctctgttcagcccacaaattcttagttacaaataaaaaagatgaaacagtttgaaattttcagtaacaaaaaactctgcaaggagaattattttagtcacactctgcagaatgttaaaattaaaaagca

SEQ ID NO: 50501 - DNA, 674 bp, Bovine  19866880687546
tgagatagctcagtttaggcaacactgttatgattaacttttttgtgacttcaaccactgcagatctatcataatgtattcttagaaacttgcctcagccagttgaaagagtgcagactttccacagcgttttacaggttcagcaccacccaagtgtgaagtgtttgaagaaatctatatggaaaacaattcatataaagaatattaattgtgatatcagaatttttgctctccattcacacccattcaggaactttccttagtttataagaatatcattgctttcaagtgtcaaataacttaaatgcgttaggtttgggattataatttcgaaatcagtatcagtaaataacctcaaaaatagcaacaaaaaaaccagtgtgacttgggtggctgttgaactataccaagtatgagtattccaggctttaaatttaactctataaccttaaaacaagttatacatttccacttccatataaacaccaactcagcaactggtcatatagaaaagagatttagtatcatttaacaaaaagcaattagctaattttttgttgaaatattatttgggatccctgtgaaaagatagcaacaaggcagtcaacaaatatttttttgagaattgaacagaaatgtgtttggcaatatgacaagtgttagccaatattaca

SEQ ID NO: 50502 - DNA, 2372 bp, Bovine  19866880693751
ctacaaggatatgagagctgtgtacctgggcaaccttaccttaacaaaaacagcgtcatccaaacttgtatttttacaaaagagagagaggaggaatgggggctgtggtcgtcattgttgttcagtcgctaggtcatggcccactttctgtgactcccatggactgcagcatgccaggccttcctgtccttcaccagctcccagatagcatcaccaattcaatggacatgaacttgggtgaactccaagggttgtaggaattgctataaaataatcattgctatagttttatgtgtgctgctagaatacttaaatgtacacataaacatgcagtgtgagagtccctctagctcttgctcaaggatcatgtgttatgtgctcaacagggcagcatttcttatgcatttccattacttggagcagcacaaagagtggtgacctcaagcagcaggtctttccctctgccccagcaagctacttttatactgggtgtaagctcatttcccctagttaatcaatcatattaagtcccgtttgctatttgaaaactcactctgtgtgcacacagagcaacaggggaaactgggctctcacaggcacccggcaccctggtaaagagcccggtgggtgagtagacctcctggaaacgtcgagagggtcaagggcagctgcccagaccagagcagtcacaatcggcatgcgtgcctctgcaccatcagttctttctagctctgtccatttctctttcccagtgtagactagctttgttatgctagtagatgctctaccctgcatctctctgtgggtgaaataggcattcaaatgtctaacatagtcagcaaatgctttcaaacctttttggccactgtttagtagattttcattataactaagtacacacaaacatgcagatgtggaggtgaatgtacatgctgtaatatagatatatagttagacgcacacaactcatctttcaaactaaatgtcatctaactaaactaaacaccatcatcttactttgtgtgatatgctttgatattctcttttctattcttttattttacaaaaaaatcctggttataatccactaatggcttcccaggtagcactgagtggtaaagaacccacttgacaatgcaggaaactgagagacttgggttcgatccttgagtcaggaagatcccctggagaagggcatggcaatcttcctgggcacagaagcaggctacagtcagtccatagggtcacaaagagtgggacatgactgaagcagtttagcatgcacacgtgcaatacactaaatttatttcaaaacctgttgatgggtcataactttcatccgtaaccatcccctacagtgaaggtagagatcaaaggcatcagagtaaagttctcgggagcttgactgatttattattacactgtgaattaaatcagaaattagaacctgtttatatttgtcacataatagcacattacaagctccaccttaggtgaccagacagccctttggctgtactttgtgattaggttaatctggggagtgaatctatcagggagagagaagctctgcaggcctgcgagctgcccggaagccctgcctctcccattgttaccgtgatggatctgcacttccaaacagtaatcacccatcacatgaacccagttctatttttctagctcaacagggctcagtgtgctctctgaagctacaaaggggagaaaatactccctccagtctttctgcatgatgaattcttccatctctacataaagccatgcttacaggcctgtcttatgggctttttgaatgtcccaacaatgacaaaaaaggaaagaaaagaaaaaaaaaaaaaaactgggtaggagaacaataatgctgtgctgcagccaggtcatattgccttatatttttcacctctttccttataagagctctcagctctaggggcaaaaaaaagataagaggaaagaaaaacctacacaatatcaataagtttacccttgagaataagtcactttctcagatggtgttttcacaacataaatgttttatgcatttgtgcttagattttaagatattatgataagaaatcaaatttccctccagcttttattcagcaccatcccctcacatacaaactcacacatacacacatggaaactgattcctaatgtcagagttaatttctcatttaccaggagcatggagctttttctacagagtatgatcaacctagaggtattgtcgtgtgagtttaataatatttttgataactagaaaggaggaaattaacccatgagtcatgaaaaacctgaaaagattattctgatgtttgtttatcttgaactaaatttgcaaggaaataaaa

SEQ ID NO: 50503 - DNA, 1530 bp, Bovine  19866880696930
agaaaagtaaagccagttttccaagtacacaccagcagagaagcaacatgactttaacgcaaaccacaaatgactccagaaatgccaccagcaaagttgggaaatccttggactgctgctgactgtctctacgtagccccacagcaatggcagtgtgcctgctggaagtgaggctggttgctggctttcgtttatagtgagatttattagctaagatgcaacccaaacagatgggagaagctgcaggggaactgttgtgcttgggagatggaaaatggaaggcatactgggaagagggcagcttggagtactcacttggcagaagttaacacgttaggctgctacctgagaaatgtacttgaggtgtgttcacctaagactcttttctcagtcttggaggaatgtacaagaatggggagcacaaataggacagtcagatgatcatcagaaaggcccccctgaaaaaggccattactaagttctaacaaagcagttaaaggtgatggcttgtgggtgatgttcctcccttagtaaaattttcctttctcatttcagttaataaattatagtactggaaaatcagataatatctgatactaatcagttgctgtcagaaagctatctataagacgtgaattttttagatactctggataaccaaaagagaaatacgaaaatgtaagctgtaactccttaggtcccttgggactttcccctgccttttttcacctagaataattacctatgtttttcttaaagaagtctataaaagtagaactgccaatacagagtgaattttccttggccacaggtaactaaacagcacattttctgtgataaaaaggtttaaaatactcatttagaaatctcagagaagattgacagatgtggcatttttcactgctcatgaactatgttggcatgtgccaaataaagcaagcccagacaatctgattctgacaggccaatatttaaagaagggagagggggaaagaccagagttgtaccactgatttagcctgcagaaaatcacaccccccagttaaacacatgtggcttcctaagaaacgattaaaacaaaaaacaccccaatctcttttcaggaacagatttgcaaaagactgtttcacttttcttgttcctcagagaagactggtaaaaacattcaggagtttctaatagaagcaccagagaactttctgctggggagccttcaggcctgcattatttattcccttgggctttcacactgtctgccataagacctatacctctctcagtgtgtagacctacaggacagtggtaattccagaagatggagagcactggctctaatgctcaattgtcactttttaagaaaatcctgcaaatacttctgtgcttgacaatgacaaatgtgaggcttttcatgtcactgtttaagcataatgtcggcaaaataatctgaactttggactttaaaaaatattagaacaaaatatatagttataaatatatcatctcaatataaataatactaggaatcatcct

SEQ ID NO: 50504 - DNA, 3790 bp, Bovine  19866880812939
tctgtgcctatctggctgcctctatctcttacttacctttcctagtactttgtgtgtctctgcttagctctgttgggtttttgtcttgctcctctcattcagttttaaaaattccaccataaaacaaaagtcttttttccctttcctttctcttcctgcagtgtttgcatacattagatgctcactctgtaaatttgatgattgagtaggctgtatttcagtttccctatattgttaatagagtgagccagaaatttttctttttagacaaatttcacatgctctgaaaaccttcaaaggtgatagttttttcacctgaaaaccctaggtccaatctgttaattttctgagaatgtcagaatgaaaataatggggttatcccatacttgagagtattgttcttttcaggatgttgtagttattttagtaagtgaccaaccaaattgtgatttgacttataataaagctgaaaaagttgtgagtttatgctttcttctcgttaataagaattaagctctgtatcacctagatttctcttgtcctaacatgggtattcaaaaacagacatctgtagtgtatgtatggaatggcacaccccttgtttacctgttattggaaactagagaagtgattgttgggcaacgctttatcgttacattgtgtttaatttgatgaagattctgtgtagaaacagtctttcacgtgtcatgttttcagccactaactgccatcacccactggggtcctttgttaagtcatcttccatggctaatagggataatccaggtaacttttcagagatgagcagtgaacaggaagctttcctgcctttggcttttgacagcccttccttaatatttaagaacagctttcccataaatttagccttttgaaaagaagagagcatctgtagtgaacttctctgtaaggcaatatcagtggaatcttaaatgttgttatcagggttggtgagagacggaagcatttttgtttttattaaacagagcattatttacaaagagccattgttgagaattagattccacaccgtataaatatccattaacgattctaaataaaggaaactctggtgttgctatgcgtgagatcctctcctgggggcttttttccatagcaattaaaggtgtgctatttgtcagtagccattttttgcagtgatttaaagaccaaagttgttttacagctgtgttactgttaaaggttttctttttatatgtattaaatcaatttatcactgtttgaagctttgaatatctgcaatctttgccaagatacttttttatttaaaaaacataactttgtaaatattaccctgtaatattatatatacttaataaaacattttaagctatttttgttgggcttatttctattgctgcctcagcaggcgacaagtgcattactgagaaattttagtttatcaatgtattttcaggtccatatcctatgtaccaatgcaaatgatgacttaaaatattaatttgtaagttctttttttaaagtataacaatatccaaaaagtaaatgtttgatcagagcagagttttaattgaaagttccaagtaagtccaatgcattagttttccccatggtagagtgaatacttcacttttctagtcctgggtgtacatactccggactagcagaggacctcagcaagccaacttacctgcctctgtgtccccccttatctgtagaatcagatcagcctctttaagactgaaatgcaaattgaaatggttctccatgttaattggttatcagctaggtctagtttgattgcaagtgaaagtaaaactaaatataagaaaagtgggatttattggctcctataactgaaaattcacctgtccagctggagagggcctcccagcagtgtcctcaggatcagagtcttcaactttcagcttcagtctccttcctgttgccttcttcagagcctgtgtgtgatggcagaatggctgactgcaatccagtacccaccatctcctgagttcagggaggggagaggggagaaaaaaagagtgtctctccctttctgaatagtcctatccacccaagattgcagctcggagctcggcctgggccaggggcctctcagtcagtggggcccagtatctctgacacccaggttgggccagcctgaacctcatgtctgtctgtcctggagggaatggagctgtggactccatctgggataggggtgggggacagagggagttaactgaagcaaaatcgtgattgtaaccaaattaagatggcattagattttaggcctgtttcttgcaggtatatactgtgattctgcattgtatgtgtgattgtaaaccatttgaatggaaaataatatttggcagcaaagtaccatctcattccttacctcataggcaatttaatttttatgcatttatgaggacttttttcactcagcaggagtaactaatggagttcagaaagcatttaatagcctacctcctgtacagaaagctgttctgtgcagctcataacagcgctcaacttctttcaaactcccacggaggtgtaggcttccagatgcatctggatttcgtttttgtgtggcaacccttccagctcaaggcctcaagtctgacagctttagaaaacaatgtattatggtaacaccatccatgtaggacatgatttcaccagtagctcagagatttctgcacaattgacagagttgggtgtttgaagtgagactgtgctgggactcaacccctggtgtttattttgagaatttaagtttcatgctcaagtacccatccatcagatcagagggaaatgaagtatttaagttatggataattggattgattatttaatgccaaagacagcactgcagactacatagaagtgatcgtagattaaatgattagagctccacttattcagcatttatttagtcatttggtgataagacagcagcttttcaattctgttcatagtcacttgtggaagaccaggtatgtcgtcccagtttggagaatgagaaatgtttggtaaagagtctggtttggagagaaatgatttatatgtcggaagacccatccgatgtcaatctggaggccagataggcaaatctggcggattcatgaacctgctgctgcttttcccttacagatgttgcaactgcatgcactataccgggcgcccagatccctctcttaaaatgaccttatttaatcatagacttgtcttccaaaaaaagaaccactatcgtttgcttcctaattttctttgaattgcctgctacattcttcaaggtcaaactgacaacgtaaaatctggtaaacttccattctaaacaaatgtggttttcagagttaaagcgtatttgtttaaaacgtggattatatcttccctggatatactctctacttattaatttcttaaataaatgataattagtctttttaagccagtccataaaggccttctgagtcatttttatttaaaaagtgtttgttttgggggtgctgtggttaggttgcattatgggtgaagttttggggtacatagcaatcactgtgtaaattctgtggggtaatttttctctcatgcgctcatactgagggcaaccagaaagcactgaaaactgctacatctctttctccaacagttgtagcagtagctgccccaccgccttcatgtaagccctgtgttggaatgacttacccaccctcccaggtaagtcattctaggaatgctgctcactctccagggagtctccacccctagctccaccaga

SEQ ID NO: 50505 - DNA, 858 bp, Bovine  19866880845639
cagtaacagaaaaaggaaaatgaacctctactcctagtacagacacatacactataaaaataagacaatccacaaaacccacctcaataaaaaagcgttataacacaaatgaaacagaattttacttcaactatttaactctcaaaaccatatttgccaactaattaggccatatcagaaatgcatttaaagtaaacaaatttgcattttataaaaacattgttggataatttctatgactttaatcgagattaacctcgagattggttaaaagataaagataaaagctgacattttacctagagagagttctccactgaaagcagagaataaataccaacatataaaacaaaactaagaggctgaaatgcaggtgaaaataaaacccaataagtaaaaggtcacacacaggaacactcaggcatgtatgtctacacacggaagacagctgcatttaaagcctcattccataaacacgaaggactccacatctggccatgcaagtaggatgcaaatgggcatcggatgagcaggctcatggcagtcacgacactgacatgcaggagatgctcgagaaagactgacttccaggacacgtggctgtactgaaccagacggggaaatttatcttctgtgtgagagaacagaggcctgaactgtagagagggaaatcttaagatgagccctgaagaggttcaagggcccatccagatcatgacaatgacaccgatgctcagagtaaagggagggtagagtgcgtatgtctctcatgccctctggaaataatggttatgtgactgaaggaggtgggaagagcctgacaagctaagtatatagacagaaaaagagagagaaaga

SEQ ID NO: 50506 - DNA, 2573 bp, Bovine  19866880847916
aaatatttggtacagctgagctggagctggaggggaaagccgcaagcttggctcagggccaggagagagggtgcggggtaagagatggcgctgtttggaaggcaagggataggtgggagtcccctgtcctaggtgaagcatccaagaatgttcagctccacacctgggtgggtctggaggttgcagacgacctgggccaagagccattcaccagaaaggagtctaaagccagacagatgaaagcggacacttgagtgggtttcaggatcaaggtgcttagctcggtgccctgtgatgacctagaggggtggaataggcgaatgggagaagaggctcaagaggcaggggatacatgtatacatatggccgactcatgatgttgtacagcagaaactaacacaacattgtaaagcaattatattccaataaacaataaacaaaacaaaaagatcaaggacagtatagccggaaatgggtcaagataaagcgaaacaggaggattgagagaaggggagaacatagtgtaaaggcatggcgggcctgtgggcacagggaactctcaggcactgggggtcagaccaggtgtggccacttccccgctgggcatttcctcctccggccttcatcctgacatcgtgcccagcatcttcctcggcttggagagagagtcaaagtcatagtttcaagtttgcacttttccacaggtctttgtctccattttaggaatgaaatcgtgccttggataaattccttttcagcaggaatcaattgcaggctttaatatatgtatattttttgccaaaataataggccattatcttagattatctgaatatgcttaagtcatatcaactcataaaattaagacatcttttttttttttcataggtattctgtggtgggaagatggaaccaggttaatctatatgccttgctattgctatagaatataaaaaagagctcacagagttctgaaagcacatttttaatcctctttattactaaactagaaagggtatcagttcccttcttcctacctgtacaatagtgagtccctggcaggagcccttatcatccttcttcctatatactaaagaagcttacccggcccgatcctccccacgtgactcagctgcaagttccttgccagtaaaaaaggatgctgctgctgcttcctgaaaggtctgttcctttcactttctgactcacatttgttatctctcttgtcacagaagctgattcaacaaacatactcagttataccctccccttcatctcaccagtagcaggagcagagaagggatgaacatggcattgaaacctgggtgctgaaatgcctttaaagagcccagtgaatattcccacagcagcatcttcaggacagtgtttctcaagtggacaggctggctggttccttacagccgtattttcaatgtgggcgacccccttgaactcttgccttcaggggtgctgggaggattatgcccagaggtcctgaaagcaaagccaaatactaacatcagtggtgtccactgaccccaatcctgttgccagctgcaagactgaggagcagcaggtgcggagtggagaatgggaaatgagaagagcctaggggagggaggaaggataatccgaaataacctggaaatggactggcttctatggcacagctcatgctgggcaggttcccggaggccagggtgggggctggcgggcagtgtgggagtataggatctgggctcgagaggtctggcaaccctcagccacatagaggcaaacaggcaatgcctctcatggcaatagaagcagagggacattctgatggctgaactgagcccaacaggaatggggcagggtccctccgaggcgcggaggtgtggtggttggtggcctgtgtagatgtgcagggcgctgagcttggtttaattctctgctctcatgaccttgaaactcaatactttttaaacaaggtgctggcattttcctttttccctgagctgtgacatggggccctgtcaagataggggagtgtgatgtttctttcagttgacggggccccaggcagcagattggggcttggcacaaaactgcattccattccacagtctccatcactgttacctcttcaccctgcttgacactttagagcagtcttcttgtcctgaaatttcaatacttattttttgtttgctgctcatctccttttgctcgtaagagcccagggcttagtctatcttgctctggcaccatccccagttcccgtagcccatcagtccatgctacaagcctggagaaaaccagggcgtgggaaggtaagggttccagggcctcagaggaatcactgggctcacagggatccaggcagagctggggaggaactcagtcctttacatgaggtttgggagtctgactcagaaaaaaagcagttctgtgtcagagaatgaggaagctggtgttgaggaagaggtttgtggtgaggccagatcagtgtttatgctcctcaccttcatctgttacctgcctccagctgactggatactgggagactggacggaacatgttggcgggagaat

SEQ ID NO: 50507 - DNA, 1785 bp, Bovine  19866880889331
cgcccaggagcttggcccaccatgggtccatcttccaccaaggacctagctcctggcttcatagcactccttcccccatttgtcctgccatggctccctgctgtggctgatccctgggttacctcaccacctcctgttcgggttttccagttcttcataacttgtgtaatcaattcattccaagccataaattcccttggctagatatgccttccgttgtttctgtttgtgtacttagtccctgactactgcacaagccaccctcattttctatttcctaagcttataaataggctgagagaatgctgttggcactactgagtccagatttcagcaaaacttctgacaggtcatcttaaacgatgttcttgtaagcagaatgggaggaatttagagtggattattaaacattcttaggttgctaaagtttactaatgttcaaaatcaatctgattggaagggctctaaaggtttgtcagaaggctgtgtctttggccatgtcctactcaacattattaccaaagatttggaccaaaacacaaaaagcaactttatcaaatatgtgtataagaccaaactggaaggtaatttaattcagattttgaaaggatgtactttgtaaggaaaagtgaaaaatcttacatctaggtacaaaaaatataaacatattgaatggcagagaccaagctccccagcatagcatgtgggtagtccagaattttaattgactacaaacctaatccaagccagaaatttgacctgttttttaaaattaaaaaaaaaaaacagtggggcaagttcatctttggtccccattaaaagattaaggttgatatcaactgacaaatagtttcacttttcacctggagtattacaggatagctaggaacttaatctaagaaaaatgagtgttttccagacttaccgtcatttgcgagttttatttgcacacattcatttatttttgcctcataacaactcactggaggatgtactgttgccatttctcagcctttatatcctcatatggatttaagtataagctccgaggctcactgtgtggccttgggcaagtacagtgctcgcacaggaacccactttatttcaatcaagtccattctcagttcaggatgaccatactgcatatagataaaagggacccaacttttaaaaggccaggaagcctttacatattatgagcagtttgcccgggggagagactcatgggagcataaagtctgtcttctagaatttggaagtctgtcacataagagaatgagtgaattgatttaagtggcttcagggaacaaccaggactaatagggttaccttagattttgggcctccctgtccatcaccaactcccggagttcactgagactcacgtccatcgagtcagtgatgccatccagccatctcatcctctgtcatcccttctcctcctgcccccaatccctcccagcatcagagtcttttccaatgagtcaactcttcgcatgaggtggccaaagtattttagtattttattaaaatgaatttctatactaggaagaatgttaaattagataacattagataattagataagtctagagcaacactcaactctgagagtctgatttctgtgtgttttgggtttttggttagtgagatttgtgatttgtagttatttgttttattgttataatttaacttccagccatataattgttttccttgtaatttaaaattagaatgctctatttatgaaagaactttttaagagcctgaaacaaggaaggaaag

SEQ ID NO: 50508 - DNA, 2274 bp, Bovine  19866880904081
atttgatgtagatcgtacatgaatggagcaggacatgactgcccactccagtactcttgcctggaaaatcccatggatggaggagcctggtaggctgcagtccatggggtcgcacagagtcggacacgacttagcaagtttgctttcacttttcactttcacgctttggagaaggaaatggcaacccactccagtgttcttccctggagaatcccaggaataagggagcctggtgggctgctttctatggggtcgcacagagtcagactcgactgaagcgacttagcagcagcatacctgaataacctagtggttttccctactttgttcaatttaagcctgaattttgcaataaagagctcatgatctgagccagtcatctccaggtcttgttctggctgatagtatagacagtctccatctttagtacaaataatgcaatcaatcgggttttgatatgattaaccacctagtggtgaccgtgtgtagagctgtctcttatgtttttggaaaagggtggttgctatgaccagtgtagtctcttcacaaagctatgttagtctttgccttacttcattttataatccaaggccaaacttacctgttattcttggtatctcttgagttccttgttttgcattccaatcccttatgatgaaaaagataatttttccttttttggtgctagttctagaaggagttaggtcttcatagaccagtcagtgtcagcttctttgatatgtgtggttgtggcatagacgtggattacggtgatgctgaatgctttgccttggaatcaaacagagactattctgttgtttttcactttgcatccaaatttcagactcttttgttgactctgctactccatttcttctaaggggctcttgcctacagtagtatatatagcggtcatctgaattaaattcacccattcccacccatgttcattcactgattactaaaatgttgatgtttactcttgccatctcctgcttgaccaagtccagtttgccttgattcatggacctaacattcaggttcctatgtaatattgttctttacagcatctgactttactttcatcaccagacacatccacagctgaacatggtttctgcttttgctctgctccttcattctttctggagctattagtacttgccttccactcttccccagtagcatactgcacaccttccaacctggagggctcatcttccagcttcatatatttttgccttctcatatggtccatggggttcttgtggcaagaatactggagtgtgttgtcacttcctcctccagtggaccatgttttgtcagaactcttcactctgacctgaccatcttgggtgagcccatgtggtatggctcatagttttattgagttatgcaaaccccttcatcctgacaagcctgtgatccatgaaggggaataggtttactaacagggcacaaatccagacagctagaaatttcactggaatgacaggacagcacctcacacaggacatgagtggatgaccgggaactgctgactcattgggtagattgctccccagctacctgaccaacctgggcagatattgtatacaagtgagcattgcacagcctaaaatgactgctggatgaaatactggcaagagtgtctgggtcactatttggtgatatcagagcattcttcttagcagccctcttctcttaccttatttcctgcctctaatatgccatgggtccagaaatcagctaaccaaacctgttattaatagaattgtgcttcaaataagagtaagcataaatacggaagtcgctgagctgcactcaaagaagtgttgatgcttggagatggtgacatttcagtgtcatcacagagaaggaaaagccgttgaaaataatttgaagcctatcaaatgtttatactaatttgcatacataaatacatagatgtttatgtctgctgcacccacatttggctctgcttaaatgttctgttccttgctgagctcaaataatagccatgctcaacttttccctgtaaattgcctaaaacaccagggtctgatgcctggtaattttattggtgtttcctctagcaacccacactagcattacaattatctgttggtaggaatctaatactgactttcctgggctttgctacctttttttttcctgctgcagatacatttggttatagcttagcaaccttacagatattcatgtgcataggtattgtaatgtgctattttctttagcttattaaataaaacc

SEQ ID NO: 50509 - DNA, 1140 bp, Bovine  19866881085819
cagacacatatatgtataatgtacagttatacatacacaatacatatattcaaattataattttaaaatgtgtacatttaacttaaaagcaataattcattaataaagctctcacccaatacccagcaaccacaaatcacagcatagtggaacccaggtcccctcccgctcctgtggggggttgtgagcaccccgcttgccaacacttctcacgcagggcctcggcagacagagactgaaggaaatgagaaatgcaaagcaaagacagcagtgacggcagtgcacaattatttttatttttatttgtttgtcaagtgcatcttctccctctccactacaagggcttctctttaagcctagaagccaagggtgattctttcgaattagcctcgtggtcaacatcatggctccaataaaatcaatgaaatgactaattagatgcagaaaatcatgctatcgttacagtccactaatgaacaaaaatgtgaatgtctcagcttaggaaacttatggcctaaaggaaatacaaacagacttcaatttcctttttttctcacttgagtgagcatatcttacacagctctgtcaaatcagaaaggctctgtcagggagaataagctctttttaatatgtatgcagaaaaacctgaagagttcatgtggtgaacacaatagagtcaccttttcccaaaggctcagtgaggccctgttacaagaaacagccttggaatagagactgctcgctcttctcagccctggtgttgaatccaaagaatgtgccatctgcctaaaagactgaggaaaatcatcttcaagagacagaagatgaatggttgtgagctccctaaaaagatgttttattttacttagccaaattacgattattttcattggaaatcatggtacttcacatctgctaacttaaggctgtgatgctgtgtccctcaagggagaggctctgggtacctgaagagccatctctaatggatagaaatacgaattgtaatgcctttcaatgcttttcccagaaggcagccctctcattccaatgaaagctgagcaacatggtgattctacatgaagagcccagagtaaaggcaaactgattggaagaaagagttaacacatctccgagaataaa

SEQ ID NO: 50510 - DNA, 1734 bp, Bovine  19866881092478
taattttaatcttaaccagaacaaaactggaagggtaaatacatgattaaaaaaataacatttttaggtttatgcattatatcactcttttacggaagctggattcttgacaacagagccagcatcaaaagtgtaacatatatattaaaacatgtggagtatttgtagtttatttgtatgaaagtattttaattgaacaatgtaagcacttccccccacctcaggatttcaagagggtgggatttgtccaatgtatactttttcaaaacaaaatatctggatttccagacgttctactaattttatagaaggtattacaaatttctctttttctcaatataactgattagtcagttatttctcctcagtagtgtgtctatcagtcataaatagacacagcagttctgttcctcagggaacaatgtctggagatatttttaactgacaccgtttgggggttattactggtatgagatgtgcagaggtcagggatggtactaaacattctgttgtgtgtggagcagtgcctaacagcagcaacttacctgacctaaagtattaataatgctatgattaagaaagcctgatatatataacttcattttaggggaataaagtatcacctataaagtcagcatccatatttatattgccgtgataccatttagccattgactcattatgaaagagatttgaggtggcttgacatgatgtggagttttgtttctcaaaggttattcaattatagtaagttatcagtttaatctttgtaccttgtaagttacataaatggctttatttcttgtgattgagttcatgtaattctttgtgtttttttaagcgcttaaatataaatccaattatacgaaggagaaagccatttttctattagttgctggactactgctcactgtccttgtcattgttggagcctttcttttcatcccaggtaagatatacagttattatgagggaaaggaggattgataaggttgaggacatttctggagaggtgcatgttagtttcctagggctgttgttaacaaattaccacaaactgggtatcttaagacaatagaaattctctcaccattctggaggtcataaatctgaaataaagatgttatcttacaccctcctgacccattcaggaggggagaatccattccatgctctcctagcttctggtgtttgctggccatctgtgcatctccttggcttgtggtaacgtagctcccagcttcctccatggtcacgtggtctcctcccctctgtgtctccacttaatttcctgctgcttctctgttacaaagctacctgtcactggattcaggacccacctgggaaatccaggggacattccttctttcagatccttaacttcttcatgtattttactatatacattaatatttacagattttggagtatctgggaggtggacatatctttaggatggccattaggccactacagaggcacactttattagccaagacttggtagcgggaatgaacttgggaacccagatgggtctgaaattgcagttgcccatgaaagatggcagtatgagttggggggaagggtctgcatcacatgaaaagagcagcagagacaggctgggactcacaagtgcaaactggaagaagccttgttttttgagcagaatacagtataagcataatgtttaggaatatcaacatggtagctctttttgccattggagttagtaaa

SEQ ID NO: 50511 - DNA, 1705 bp, Bovine  19866881130144
taaccacatcagtcccttggtacatagtcacaggttcagagattaggacgtggacttcttttggggggacactcttctaccttttgcacgaagtatccagaccaaaaaaaagccagtgtaggtcaggcctgagccgccccagtgtcagggcatgtttaactagtcctgcaccaggcgccagggagaggggctagagcagaagtcaggaggtgtgagttctaatcttggtaagaggacttaaagtatataccaagacctgccttgctttttaccttggttaaaagttgatttgcattcatcgtgccctaaaaccatgtagcaattactacaatggtccaagataccaaattagcttgtacacatgcactaaagacagcagagaggtgacacagaggacctgaacactgggagtgcccctggcatgaaacgctaacatcaacagcatagtcgactgaacaaagggatgcagtaagcagttaatcccaagctatagttaacattcacacatttcaaggaagactgtcagagtggggaaggttaataagctttggagtggagaggtgcaaagaggtcagggtgggccgggccctcaccacttctctttcccccgacaaatccactgagctcgtcctgacgagagatggatacatcagacacatagcctgaggtcctgaagtcctcaggtcatgtaactaactgctctttcctctgattccaggcctgccatgaaaccctgggataactgggctccccagggaggcccccatgcagggagagggacgagatgtcaatctttggtccacttgacagatcgactgtgtttctcctagaaaattaacaaaccggagtacggacttgcatatattaatgccttgagagtttagttggcatgagtcagcacctcaaagctgtcaatctctggtctgtgtgaaagatatatactctaatttctcatgaaaattagcaaacagctatgctggtttgtatttattaatgccttaggagtttctttaggatgagtcagtgtctaaacactgatcagatctgaggtaccacccctctctgtcccccacccccagcacatgtcccaaccctcattctgggccacgtcctcacacatctcctctaattcacacagagcacaccatgcaaggtgactttggagctggacagccctgcagcattgccccgggtcacccccaagcattcttcagggtgtcgcttaaatgctgcttcttttaaaaaccttttgtaacccttcagcattcttcagacatccctgctttttgtttgaagaatcctgcattttcctctcttcaccctcatttggcatctttcccaccacaagaggaaccaggggagttttactcatttttagatgcccagtgcctagcataataactggcacaaagtaggtactcaatgaatatttattgaacaaatgagtaaatggacactctcctgatcacccctgatgcttcttttcatccactagagagtggaaaacagatgctagcacaccaaaagattcaagagtagatagtataaattaaaagaaaggtcacattcaatatagcagagatgcctttgtggagctaacagggaggctgtcttcccaggagccttggagagacagcccatgagggtgacagcccagcagtgacaggacaagactgctgcagtgacacggcagcaataaggcgtc

SEQ ID NO: 50512 - DNA, 1174 bp, Bovine  19866881184179
cgatgttcccagtagaaaggaccacatatgccatcctcatggaatcatgatcatcgaggatcccacagcactaagcaaaccagagaagctaaaaaagaaaaagaagaaaaacaaaatggatcgacacggaaatgataaatccacacccaagaaggcctgcaagaagaggcagtcctcggagtcagatatcgagagtgtcatgtacaccattgaggctgtggccaagggagactggggcatcgagaagcttggagatacccctcgcaagaaggtccgcccatcctccagtggaaaggggagtattttggatgccaagccaccaaagaaaaaagtgaaatctagagagaagaaaatgtcaaaggagaaatcctcagaccccaccaaagagtcaagacctccagattttatcagcatttctgccagcaagaacatttctggtgaggtgccagagggtataaaagcagaaccattgacccccacggaggatgcgctaccacccaccctgtcaggacaggccaagcctgaggacagtgactgtcacagaaagatagagacttgtggctcccggaaatcggagaggtcttgcaaaggtgctctttataaaaccctggtgtctgagggcatgctcacctctctgcgagctaatgttgacagaggtaagcgacttctcaaaatctggaaagaacatgaaaacctagcagaattcctcctttagaggtattgagaagcaattaagactacagtaaagaacattagtatcaaaatagtatcttagacttgtatgagtctttgtggtttatagaatatatacatttgtcattttaccgtatgttttagcaccacagaggaatgtttctattcattttagacataattctcagaatgtaagtgttctaagttactccagtctttttcctttttactggtgtcagctgactttttgttttgaaggatcagtattgcatgtgtagagctcttagtctggtttttaactgatggaaatacttttcagaatcacgcaggtattggttgacagactcttgacctgtagactctagaaacaaggaaatgtatctagccctccccgctagataatcagaactgtaatttgaagtgaatagctctttaatacataacagttccagaaactagttaatgtgtataccctttattt

SEQ ID NO: 50513 - DNA, 2788 bp, Bovine  19866881329613
atttctttgtccttctttacatttccaaaaagaagattaattcttaccatagattttggcaaccacagagaaccattttttttttctttttgtattaagtcaagaactttcaccttttcacttaaagttggaaagcactttacagttcctttttggatatccaaattgccagcatcattaccttgaggccatcattaagtaaaataagggttacctgaaaacaagttgccgtgtgatacggcaacatttggtctgataacctaaatgactacctggcggaatacactcaacaaagggctgatccacctcctgggagagatggagcgagatttcatcatgcttctcccagcaacatgcagcttgtatgtctgtgtgtgttcagctggttagtcatgtctgactctttgcaaccccatggactgcaacccgccagactcatctgtccatgggattctccaggcaagaatactggagtgagttgccatttccttctccacaacacgcaacataaaatgttgcattcagaaatgtttatttctgaaattttctatttaatcctctctgaccaaggttgactgtgtttgattgaaatctcagaaaccaaaacaacttgtaaggagggtcttactgcattctatgccatactggagagattttactttcgtttttcttctcattttctcctgctgctgatggaaagggaatttttcatgttggtttcaacctgaacaatggattccctcattgagtaaaacgtggatgccacagtactttctgtgtaatttttgcacctggactgtactgtaaggctgtacgctgtagttattccttaactaaccatttacagctgatgctgaatgggcttccaaagcgcataaagtgatactgaaacctatgtctgctatcttcaagtgccattttcagcagtttgtcagcagggccttctagcctcataaaatgactaagtagaaggcataagtgaaaaccatctggcttccaaaatgctgctcgtctctctcctcactcttctatagcctctgaaattcttagcactgttcattcattcttcaacccacaagtatttattgaggtcctccaaggatttcatgacggaactaggtggaaactcatatagcagtatatgtatatcaatatacatgaggctgcagcacacacagaactcacagtgggcacaggagggggacgactaagcaattattacaataatgggtgctcagtgccattgcaggaaaagcacagtcctcttgtgaacctttctagaaacttttagcctgtgagggtggagggaggcaggagacgcttcctggaggaagtgggattttaacagtcctatgacaccattcttctgaactaaggcatttcttttaacctttgttaaatgactcagtgataaagatttcacctgcaatgcagagacacaggagatacgggttccatctctgcgtgggaaagatcccctggaggaggaaatggcaactcactccagcaatcttgcctggacaatctcatggacagaggagtctggtgggttacagcccgtgggattgcaagggatcggacacaacagaactgctgagcaagcaccatcaccataccaaaatgcaaaccacttacttgaaagaaaaacacttttagatcataagaactatgggaactagttcaaactagtgttcacaaactgaggccctgaagaaataaatatttgaattgttaaatattggatggtggcagaagggaagttaagcctaaggtggcgttgataaaagagctgggagccacttctgtggagaattttgtgtctgcagagatttgaggcacccgggtgggggtgaggtaggaatagggcttggggctcaaaaccctgaaacaagatgcagctgcagcaatcatttcctccacatttagttttgcctacagccttctccactcttgagctagtccttacaagtcccactcaacgaggaaaatgcctcaacttggcttctagatagtgaaagtgaagtgtgagaggaaaaatatctttaaaatatctgacaatatgtccaaggtatctgagagccaagacaagtttggctggaaaaatccatcttgttttcctgtaggttatctctgtgacccctccttctatgtaaattgtttataactgtgtgattctataactcaacataaaaattgatcattcattatttggttacattatatgaacatgatctggcatctccatcttcctcattcctataacagttcagaaatgccaataagtgaatctcctctttattatttataaaaactttcagccaaacataattgcaacataatttacacaggtactctggatataaaaaaaatccttcaccttaatctcaatttgtgtcatttttgagtccacccaaacccatgtccattgagttggtgatgccatccaatcatgtcatcctctgtcgtccccttctcctcctgccctcaatcttttccagcattagggtcttttccaatgagtcagttcttcccatcaggtggtcaaagtattggagtttcagcttcaacatcagtcctgccaatgaacacccagaattgatctcctttaggatggactggttggatctccttgcagtccaagggactctcaagagtcttctccaacaccacagttcaaaagcatcaattcttctgcactcagctttctttatagtacaactctcagatccatacagaccactggaaaaaccatagcctgactagatggacctttgtgacaaagtaacat

SEQ ID NO: 50514 - DNA, 1150 bp, Bovine  19866881397138
tgcgtgtgtgtgtagagctctccttttttaaaatgttggctcattaaaaaacaacaatgacagtctgtagaccaaataaaacatgtctcctggctggatttaatatgtgggccttaggttggggaatttctgaaataaaactacataaagcttcccccatttcttgccttatggctagtaagaaacatggtgtctcttgtaaagagataaatatttaattcttacgatgtgcacaacacaccctatctactctaagagacacataagaaatgctgagttgttctctgccttctagaaacttaaaataccgttgaggcaataagctattcactcaggaaagtcaggtaacggtgctatgcagaattctggtatcaaggcctaaacagattcagattaaatataccaaagtcaccttaaaaaagaaagaatggctcttagatctttatcaaaacctgactgtagtaaagccagtggtgtggaagtatctagggtattgttcacttttatattcctagcatttcatacatagtaaatgatgttaaacaaacatttctcaaataagaggatcacattaatgagttatagagggaaaaactaaaccttgagagcttagaaaagttggaggggggtgggaagagaaaagcagatgttttcactgttgatgacaatgtccaatggagagacactgaaattggaggccagagcatttggttagtggagtcctcattcctgctagtgagcagaaaggaatgtagccagttctcgctgttgttgtttagttgttaagtcatatctgattctttgtgaccccatggactgtaacccaccaggctcctctgaccatggaatttcctaggcaagaataacagagtgggtttctatgcccttctccaggggatcttcccgacccagggatcaagatgacatctcttgcattggcaggcggattcttcaccacctgagccaccagggaagcagttctcactgtaacccatgttaaatagttcacaagaatattttccttctttgctgaaatgtctagtcaacctcctgatgactaattaagcttctctgacatcttgatggaggaagaaaggagcccaggataggggacccatgaattctgctgagaaggctgcatttttttaca

SEQ ID NO: 50515 - DNA, 1193 bp, Bovine  19866881403198
taaaatggaaaaaacaaaaacaaacacccaactgttgtgtgtttgtataacctaaagcagtgaataaacacctgatttagcttatcttcacttagtggtgccctgtagttactcgggtatttaatcagtcttacaaagctgcaccttaaaaaggaagaaaattttaaagctttttgcatttgttttatacccttcctactacacatcagacgtcctttgatatagcagtcatgctgccaacagagatttgtttgagaaagaacacataccatcctctttaggataaactatgttaaatgaaagggccaactgcttgcctctggctaagctgagaagagaggaagtttaaactgtagttgtttttctaacctcatctaattctatctcacctcttttttgttgttgttctacgtttttggcttttccctatcttcttctaaagagggatgaacatgggagaggcttgaagtaagctgagaagtcaggggtactaaaaatctgaaactcgaaagaaaaggagatctggcatggaaattttacctttcagtttattttgaaatcatctctatgcccctttgcttagttttctttcaaattcagttagcatcatcatttctgtcacccagtatgtcccaggcctatgttaatcacggtagatgttgaaaaataagacaggactcccctctgtccccgccgcccgagagggactcatcataatgtgggggtgtacaggtaagcaatcattgcaaaatagtaagtcactaaagtcactgaagactcatgaaattacaattttattttattcccatagtttaaaaatattctatagtgagaggtaaaatgacaatttcaacacactactaagaattaaaaattctcagtgattccacacttttcacatggtccatccctgggctgggaagatcccctggagaaggaaatggaaacccactccagtattcttgcctgagaaatcccatggaaagagaagcctgcctggtgggctatatatatagtccatggagtcacaaaagagtgacacataacttagtgactaataacaatataaggaaagctatgtattcacaagaccccaagaccatcccaaatttctacggtttgctaggagaactcccaggactcggcagattgtcgtactcctggctaatatttatttcagggaaaggtataga

SEQ ID NO: 50516 - DNA, 952 bp, Bovine  19866881420996
ttctgaagctagtgccctcaggacttgctgtcagaccagatgtggggtgtgagagaaaccaaggaaagtgacgagagaaaccaaagatgactgtaaggcattttgcttgagcaactggataaacagagtcaccactactgaaataaagggagaaaacccagcagggagattagtgtaggactgagaggagggtatcaggagtccgtttgggaaatgaaaatgcaagatgcctttaggataaaggaattgggccttcagttccctctaaccctctgtccagtcctcatattctatgattccacaactgtgagagaataaacagctaccctagtggcttctatggtaattgtgttcttcagagagaccttccactctgttttaccccactttcccaaatgcaattggtgagtatgctagctagagatcagttgctggaaggcaggcacactgaaagggagcaactgccagccaaaactagcaggagcacttggaagagcagcatgaatggtgtgcgtgctgaggaggctttgagagctggaggcaaattcctgtgtatcttagtttcctggaggttactcataatggagggttgtcagccgaccaggctaagaatgttcaatttgttttcagagaaaaagcaaaacatcttcttcgacttcacctcagctccactctcagaatggccacacttcagacccactcaccctctgcatagacacccgggagccgggcactgatcccgacagcccctggggaccctcaggacacagacgtggtctttgccactagcttctgcaggcaatttcctccctcttttctctcctccctgggaggtatatcctctgtctgcccgaattctttccacccaagaagtggctcggtgccagtggggttgtttgctgtgtggggagctggcaaaccactttgagagtgagctgatagtaatatattt

SEQ ID NO: 50517 - DNA, 1740 bp, Bovine  19866880187683
actgctgctgctgttgctgctaagtcgcttcagtcatgtccaactctgtgtgaccccatagacggcagcccaccaggctcccgcgtccctgggattctccaggcaagaatactggagtgggttgccatttccttctccaatgcatgaaagtgaaaaatgaaagtgaagtcactcagttgtgtccgactcttagcgaccccatggactgcagcctaccaggctcctccacccatgggattttccaggcaagagaactggagtggggtgactcagttgaactaggtatgtctaaatttattaattaaggaaagagatggcagagcaacacccatattttttaattgtatcatataactcaattcctagcccatgtggcaatagtggtaagtttgcctggcaatgcaggagacataggtttgatctctgagtcaggaagatactgcctggaaaatcccatggagagaggaacctggcaggctacagttcatggggtcacaaagagacgatcacaactggtgacttagcacacaacacaattccaagtgggctttgttgagagctttcttagaagccttaaattaatgttctgtatatagagttttaaaggagtacaattctggcagaagaatagtgcttgacctgggtctttgcagtttgagtagaattttgtgacacgtggggtgggaagaattgggaaagatatttcagagtggaaaaaagcatcagtaaagtttgaaagaaagagaatgtagaaaattatcagggaggcagggtgggggtggggggtagtggtggtggtagtggaaatttctgccacactgatgtactcagagtcatggccaggttggaaagtagaccaggggtctggagcttgccatgaaacagggagtagagttatcagtaaaggaaacaaacaatggtatgagtttggttgactgagagtctcttataatcaaattttggcaaagttaacctgatccctgtttggaaaaatacattgtccgcttgtttcagcagtatacctaagcatgggaaagcgatagaggggagttttatctgagtccttaaggaggtaagggtttagcttcactgggaatattgtttaaaatttgaattcaactagataccaaattaggactgggaagatgctggcttcaagccagaacacagaaatacaatggtaaattaacttaaagtggtttgaatcattttaaaataaactcatttgcccataagaacttgagggctgtataagggcctgaaataattcacaagtttgcattttcacagtgacaggagcagctgacaatgtctattctgattttcctcctgagggcttattttaacacagtcctattttctcagcatataagttttaacttttggtaacgaaagctaatagtcaattctaaaaaatgacactagggttttcaggctctggggcttttgtcagtctccatctgtatcacctctgcttttattatatctggatggtacttaacaaataactattgtccccagggaatcatttatgccatggaaatagaaaaatgaatgaaatctacatgctttcttatgatagcagctgatcttgcaaaaattcactccatgaatttttaaattacttaaaataatgtataaaataatgtgaactctagctctggagaccaatgaaagtgaaaagtgttagttgcgcaatcgtgtccagctctttgtgactccatggactgtagcctacca

SEQ ID NO: 50518 - DNA, 702 bp, Bovine  19866880412561
agagaaaaattaaaatatcattgaatatcgctaaagttccctttttgctggttcattttcttagctgctatactggcttccttgatggctcagagggtaaagaatctgcctgtaatgcagaagacacagcagatggggttcgacccctggatacaacagatcctctggaggaggaaatggctacccactccagtattcttgcctgaaaactctcatggccagagaagccttgtggcattcagtctatggggctgcaaaagagtcagacacgactgagtatacacactgatatttatctcccccctgaccctcccgtactttacttcattcctttgtttccctggcctgataataagccttaaactcaatgaatattctatgtatgctggttaatggagcattctggcttgagtccattaaaacaacttgcatgatgcaattatttactacttcatatgtcgtttcatgtactaggtgcaattttccttttatccaaaggggatgaaaatttgccaagatagctttcccagtaaacatagtttatattctttcactttagggaaacccccaaaggaagtttaaaagcatgaaattcaaaaggaccctatttctaagcaaccgatcaatttgagtgtggcaatgcctttcagagatgtagtatactatttctaaatagacgagttcagccaaccttctctcctg

SEQ ID NO: 50519 - DNA, 1067 bp, Bovine  19866880440280
acttttatgttccaaccaagaaatattaccattatgttcttgttccagaaacctggaaacaaggggtcaccagcttcatcatttccaccaaattgctccattattcatcaaacacatattgattatctatgtgagttgtttttctgtgcaagaattggcagtggtgctgtgagatgctgaggtacataaaacatggctgcttccctcaaattactttagctctgcctgagagagagaggaactctgagtcatatgatgcagagtatccaatccaaccactaattttatgatcttttcttgtgatattagatgtttctagtaattaaataccttatcaactgataaacagtgatgagctgttttattaaaaagatatttgtgatgaactaccatgtaccaattatatgctaagtgcagaagatacaggcaaaattgaagactggactcttaatgaactcatagcctggtagctaagtaaatcattaataatgcaccatagactagatatgatgcccaaagaggaattctaaatgtgttttgaataacagtagaattattaaaatattgaaaacttcttaaaagactattttgaatggacaaaaataaatctacgtttatttggaaatgtggtttctggactgtttagaaaacaaaaaaacagcatagcaagatgcaaaagactcagtccttgaaattctaagatctggcttctagtcctattctttctgtatggtttcaactcttatccactctaggccttagttttctgtgctgtaaaattaagaagtttgacagattagtttctgacatctgggtcaattcaatgaccacaactgcatagaaatcacagacttccttgatttccatctgcaaggtcaatagtgaaaaaaaccaaccttgttggtctaaagttacaggaccagctgtattaagagcttcataaaatgaactgagagatggaatgtagaaaccagagggacttcccagggagctggtgaaaatcccttcttccccatagcccagttcctagcttccatttcagatctaacagttttaataagagaaag

SEQ ID NO: 50520 - DNA, 1239 bp, Bovine  19866880572673
ttggtagttgatgaaagtaagggcagtgataaattgacaaacaagaagctgaaaccatcaggaaaggtaccagaatggcaagagggagaccagtagatggcactggtaaaaatgtgacaggatgtggggatcaagtaagtgactgtacaaggactgtttgtttcctttgtcttattttggttaaatattatcattgctgccagattagcagtggatacattagaaataactgaaaagtcagtggcttgtttttacgtcttgcaaaacttaccacatgaatctttaataaaacttccatgaaaattgaagattaaatactataagtttatattgttcactgaaagattccactaaagttatttgggtttcctttcatatgatgagaaatgcatatcctttccctattatcacctctgcttccaagaagaaaaatagcactgtgcagcataaaccaaggtaacgtgacttaattctgagaatttcacaaacattgatatagagcaatgactaatgacctgatatactgtttaaccagatttgggaatgtgctgatctggcaaattaatctctattctattgcctgcacctgtgaggctatatacattgcaataaacactaaacagcaatctaatgctatttcttccacccaggaaaacaaaaccttggaccacatcctcacatctatatccacatccgttttgagttacaagcaggaaatctcaagccatgagctacgtttcctatttagctttcttcagcactacagtcctagctttgggattcttgcagaaagcattactttgggaagttatttttcatttctcttgcatgtctgatgtccttcaattctatgaccctggttgctggtagcaacaagaaccattcaatacagatctgtccaaatgtatgaaacagtgaaccaaatttagcagccaagtaaaacagcccactgattcacattttccccacaatttccatggaactcaggcacagtgccagaaaaactgggacaatggtggccttggaaaggctgactcaaggtcaacagacctgatataacagtttggttgtgcttgagtacaacatagcaacaacagtaaggcactagattcatttgacattccgctctgcccagcccaaaagcagaaatgataaaactgggataataagaagacacatatgcatagtattttgaaatatacaaagttcttatacagctaatacaagaaagaaatatct

SEQ ID NO: 50521 - DNA, 1726 bp, Bovine  19866880726764
acaggcagattctctgccactgagcctcttgggaaggaataattatgtaactttgctgttgtttttccatccttaagttgtgtccgaccctcgtagtccctggactgcaacacaccagacttccctgatcattatctcccagagtttgctcaaactcatgtccactgagtcagtgatgccatccaatcacctcatcctctgtcatcccccttctcttcctgacctcaatctttcccagcatcaggatctttcccagtgagttggctctttgcatcaggtgacaaaagtattggagcttcagcttcctgcttcagcttcagctttatgtagctttaaaaaaacaaaaaattgaaatgtatgagtaccctggaaaaaccactgaattgattgctgggaaatcatggggtgactttgagcaattcacatgggtttcaactccagtgggtaaaattaaagtgctgaaggtgggaggcatgggggtacaggggaaggctgaggctcacaaagggctacaaatgtttatgtcatgtcttacttttcaccatatcatactgcttttctaagttaattttaatttctctctcaatatttttagccctgcactacaatgtttcatcttaaagtacaaaaatgaaactgtattggaaattgagaatcagtgtgagatatccactcataggaattcgctctgaatccattgaaccttggtagcacttagcttctcatggttagtgcaggatccccaaagcttaccaggtgtggtttggcctcccggtctaccagctggaggtcttcaactcccgccatcgttctgtaattctcgatgttctgctgcatttccatgtgctcggggttggccatgaaaaatgtgtgtgctgctgccactgccttttccatctggttaagctataaagagggggagaaaaaaaggaccaaatgaaggcaaatatttctaaaccacattgagtaccagtccaagggtcacagactgaaagtgccagggctgggttcattccctccagccagcctccacactaaagggcaggaggttaataaacaagcgctcctaaaatgatatgtgggtatgggtattttggctatggtgaaaacggataaacgtgctttgttctaagtttgttctcttctccctcatttcgaagccatctgtgtttcctggcaaattgaatcgacatgcttccgtttgcttttcgattgatcaaaattaaaaactgccaatgctgtgccatgtctgattcacattttcaatatttttgtcttttttatctgattttctttgtgttccttttggctttaatccttacaatagaggaataaaccgtgactttctgaaatatgatattggggatacattccactacaccaagtttgctataaaggctttagaatatgaagaacacagattttaaaataattcttccaatccatacaagatactaaatatagtacagaaaatgtactactatatttctttgattaagaaattgattccaaacttacacttggattctcgtcagtacaaaaagaaggattttcaataaaatacaaagacactataaatctcctcttaaaccacttaatatgctgttccccatgtaacatgcagtggtgtacttttttaaacaaaatgaaattaaatttgtttgatttaatacattttgccctgttttctccatggagaatatctatagacagagtctgacctcaa

SEQ ID NO: 50522 - DNA, 1622 bp, Bovine  19866880811238
gtatttagctgtcagctgtcttttctgagtaaaaggaactgcatgtggaataaactctcatggttttatatcaacagcaattcgtatgtctgtaaggtcactggagcaaggagatgtgaaatgacataactttctccccaacagcttctaattttttgagattaaagaagtttattgcagaacagaaagaggaatcttagactctttgaagccctacagatgttttgtagacatgcagtgctttttggaacaaggggtcctgtaattaggcacacaggggcctcaagggactgatcttaactgccatctctctctggtttttaataaagattacgaccccgtcatcaggctcccctcagctgaaatttaaaggaaactgggagtagccagagaccgtagaacctaatttattgtgaggtaaattagagagggaatctcactttacaaatagattcaggcttctaatttgagtttgaatctaataatgaagactcatgatttcttagtgtaaataacaaaacagtgtaatttgtcaccttgtcattgtattagaagggtctgaagatttggaatgtaacttctaattgttttatgcggaggtaattctacattgtcaagtacctcaaacaggtgtttttttgtgggttactcactgagtttgcaattttggttttactctttatgctgttttaccagtatcatctggactaaatattgtggaaaatagaatgaataatatgaagacaccatttaaaacgactttttgttttactttggagtagtttccaagttgtattacatagaaagaatcgtaattgcttaacgtaagaatcctcatttgaatttgagatgtcatttgacagcctcctgaagagtgtggttcattgagtagaacacagaactcaggacagcagtggccactgataagctgtgtgatcatggggcgagcgactctgcctctgctcatctattaatgggtattgtaacatttacttggtaggattgctgggaggcttaattaaagtttactaagtgctttgggaacctgagaaatgaagctcagaaaacataatacgttattatctgcatttttgtctttagatttatctgtgtgaatagtacatatccatgcttgtaattcaggcagttttttgaggttttccatttataagcagacctgaaatgaagcattataggtgtacaagtccctagaaataaatgtaggatgaatatatatgtttgcatagatgttatttttttcctaatgtaaaataacttcttcttaaagcctgttagatcttataattgttaatcagatgctgtttttcttaagagtctcagtactttattggtaatatttcagcaaactagtaacagagtttatttttttaaagtatttgtgtatgttattaatttatatatttttggctgaagtgggtcttcgttgctgcatgggcttttctctctttgtgggaggcggggactactctctagtgggggccagattctagtcctggtgtccggtcttctcattgcagaggcttctcttgttgcagagcactggctctagcatgtgggtttcagtacttgcagcacatgggctcagaatttgggctcacagc

SEQ ID NO: 50523 - DNA, 1357 bp, Bovine  19866880850128
ctcatttgtttttaatctaaaaaaacttttaatgctgaattctatatattattaacataatcatctttttgcctgtcctaagacccaaatttgagacaccttggctggtattcaattttaaaattccagctttttggggggagaggatgcttatgtgaagtctaactttaaagtcttttctttaacctgcttacttcctcaatttcaaagatttgacctctgatgtttcacaaacatcaatttgaaggaggcattcaaaatccaaaccttgaataactctcgtttgattttgtctttatctttgtttacttccattagtacttctctccctctctttccacttcccaggacccacatttttttcccttcatgatggcaaatattgttacagtccccaaggcaggaaacttctattcagactgtaaaaggaaatgttgaaatccttagctgtcctgtcaacagtagtggaatgaaaagtcgttggattgctttggcagtggttctgaagcaggcacaattggcaaattattattaacagtgctgcccgaaaatccccatttgcctcaagatagtggcatttgttggcagaggtctatgaaaggtccagcacattctctttatttaccatttaaggatcagtctgacaattgacttctttctgcatattcattccctttgaattgtctaagttggactgttcccaaatgacctttgaaaggatatagtgcaaatcagaaaagatgagaggagggtgatatctcttaaccctgaggtccagtctgtaacaatagggtaccaaagctgtttactgtgagaagagtgatctcagagatgacatgagaactatcttcatatttcatacagaccatcttgtgggatattctagaaactgataagtgggacctaggaagcaggattatgatcagaggataagaggattcagggatttggatggcagtttaagataagaaagaacttcttatacttaaaaatgcccaaggatgggaagcattgctctttgacatgtactaggagggactaatggagaaggcgatggcacccacgccagtactcctgcctggaaaatcccatggacggaggagcctggtgggctgcagtccatggggtcgctcagagttggacacgactgaagaaattcactttcacttttcactttcgtgcattggagaaggaaatggcaacccactctagtgttcttgcctggagaatcccagggacaggggagcctggtgggctgctgtctttggggttgcacagagtcggacacgactgaagtgacttagcagcagcagcaggaggaactaaagtgaatattgtgaaagggattgctaaagag

SEQ ID NO: 50524 - DNA, 1400 bp, Bovine  19866880870089
tacgtttagatctttaatccattttgagtttatttttgtgtatggtgttagaaagtggtctagtttcattcttttacaagtggttgaccagttttcccagcaccacttgttaaagagattgtctttaatccattgtatattcttacagaaagagaaattaaggaaacaattccattcaccattgcaatgaaaagaataaaatacttaggaatataactacctaaagaaactaaagacctatatatagaaaactataaaacactggtgaaagaaatcaaagaggacactaatagatggagaaatataccatgttcatggattagaagaatcaatatagtgaaaatgagtatactacccaaagcaatttatagattcaatgcaatccctatcaagctaccaacggcattcttcacagagctagaacaaataatttcacaatttgtatggaaatacaaaaaacctcgaatagccaaagctatcttgagaaagaagaatggaactggaggaatgcaggcagattctttacagtttgagccaccagggaatccctccctacctacttaaccccaactgaatgctaacctaactcaacttccctttaaccgtatctcacaaatatgacacccaacttgaggggaagagtgattaagggggagacagaatggaaaggaacagcacttctaaccaatttcagttaaataaaatttatttttgaaaattaagggtgaaaaagaagcaagaaaaattgacataggaatacattgctagggcccctctcaaagcctcagaagggacccattaggggaggtactttgaaatttaacctttattagcttcatatcaaattcattctggcccaaggattgtggaatgagtaataaatttggagtgcaaaatcttgattctagtcctggttttcccagtgattcattatatgggccttggacaaataattcatccctggctcctcagatattcctttacaaaattggagttttgaataaataacacccagagttctcttctccctctgacattgagttgcatccagtagagctggctacaatagcaaaatacacataaaagggcaccttcttgccttcacagtctcaggtcacgtaggctctaggcctaaattagaaggcagaagcaatctgggctatctcctctattttagaggcagcttggttttcaagaatgccttggttttcaagaatgcaggttatctcttctcaggggaaaaggtgtagtctttccagggactctagcctcctgtgtatcccagtgatcctgtgattcactacaagactgatgaggtacttgtttccatggtgaccacttctgctcttcccagcagctggagggcttaacccagtcctgacacagcttcctcagttggg

SEQ ID NO: 50525 - DNA, 984 bp, Bovine  19866880962888
ttcctgaagggtcaattagcacctataaaatttatctctgttgtcactaatggctattatactaaagtgaggactaatgaagacagatccccccccctcctcctgagattgctatttaagtggaaaataacttggaactctctacattgaacatcccaattcatgattagtttaagattcataaactattgtatagatttgaggttaaattgttaaagattctttcagataaggagctctgctgagtacctggtaacatgcacagttaggtgcccgcttggccattaaattaagttggcaagactgcctaatgatatgataactgacctcccagatgtatgggagttctgaagactttcaaaactcaagtggcacttcagcacccagtagtccagcatactgtctagactatgaagcaacactgagattcaatcttacctctgctgttttgtagtctcttgatcttggacatgttaattagtccatctgtgcctttgtttactcacttattagaccggactaattgaagtaccaaccttcaggagttgtagtagatgaaaacaatgaacagaaaatactcagtgggcaataacatttggtgactatgtgaacggattttttttttttttttttttgagaaaagcaaataatatctgaagtcagtggtgaaattttttatagtttgaattgctattatgtttaaagaatcttttcttacatgaacatctctgtcaaattatcatgtaattataggtatacatttcctatagacagtaggtaaaatgattcagtatgtagatttttgctttgggtcttatttatatcttctgataaaattagcacattctaaatctgtttctgaaaaaccaacagaaacaaagaaacaaaaataaaaaagaacttcacctatatacaatcacccaaagacatctgttaccttgtcacattctctttaagcaatttttaccatcaggaatactactg

SEQ ID NO: 50526 - DNA, 1018 bp, Bovine  19866881083806
aacatttaaatcattccctcaatttccgtaagagtcaagaatattaacctcaataataatggttacacttcttccctctgaaactccagattattcctaaagtgctaaagaaaggtcaaagtcttcagttgggcatgcaagaacttagtatggtgctctttccagtatgccagattcagttaatacaatatgtttaccacctactacatgccaagctctgtcagagtccttttactcatgtctaataagaacagtgatgcagttgtttattgctaccaccaaaaccacttgcttttacaaatgaagaaattgaggctggatgttcagcactttttgctgaaacttcagaataaatcaccacagtgcctggagaaatcaagtgtcctgatccccagggcactacactgagataattctattctaggaacacattctactttcagtgcactgagagcaagtgtcatctagattttccacctagcattatccttacccattaggcctgtctctcttcttcagtcactttcaggtggctttgatttcttaccttcaacttgtcttcagcctgacatgtggctgtgacacaagaagcaaagaagggtgggggcagaggtggggagtgttggggagggctggggcaaatggaaagtagatgactgggtgctgtttttgttctgatattattgtctagttaagatccctctcttgttgctgtgtattctttgctttgtaactcagaagtgtttatcacgacaagctgtgagcagatggactggagagaggagagaaatttgacccaagaaagatgtcacttaaacagctgaggctagtatttcaccagatgtccaagcatttaacccattaatggctttatgtagatcagtagccatgcttccactggctaaattattaactttttttatgctgagttaatggtattaagtatttgcctgttataaaacatattttgtttttaatggcatttgtatttagctttctttaggatgcattcttcaat

SEQ ID NO: 50527 - DNA, 1187 bp, Bovine  19866881134196
ctctcatttgaaaggaagcaagtagtcttatccttcagaacaaactatgaccaattctaagacaaatcatataggtttggtttctaaattagtttctgattcaccactctttgctatggaggtacaaaattgagatggcaaaatacatgctctctttctacctccttaagagggtgtggtgagaaatggcttgaataatacccattaagagctctcagcttcttgggaggacgataagtaaacacaatgaaataagaactgtttttttaatctataggtgaattacatgtctttcctaaacaaagaatgacttggatagacaaaaaagaccaaaagcaaactcacatcactgcagacaatatacttctgatggccacccaactcaactcacctttatccacaaaggaagtgagaggctcatactacaaagctgtctctccctctgtctctctctcgcatggtgtgtgcaagcacacacacacacacacatactttttactttttaccttttaccagatgaagagtctcataatctttctaattagaaataatcaattcagctatgattttatcagctttgttttatatctctatttcaacattttgttgtcatggttcttgttttctaactagtggatgtatagctttacctgtcatcaggtcataaagtggcctttcctggtggcttggatggtaaaagaatctgtctgcaatgtggaagacctgggttcgatggaggaagatcccctggaggaaggcctggcaacccacaccagtattcttgcatggacaatctccatggacagaggagcctagcaggctaagtgcatggggttgcaaagattcagacactaatgagtgactaagcacagcacagcacaggttatagagtgaaaggactctcattttaatctctattcctactccaagagctggttctggtatattctcaataaatgttggggaagaaaaagtagacagtgagcaggtccttatctgacaagaacagtcatccaaagagatttaatcataatcccaacacactcacttctcttgacaataagcacatggcatggtggatagagttttgccaagagaatgcactggtcatagcaaacaccctcttccaaaaacacaagagaagactctacacaggacatcaccagatagtcaacaccgaaatcaga

SEQ ID NO: 50528 - DNA, 1205 bp, Bovine  19866881135908
agttaaactgaacacttttccgaagcggccccagctcgtgtgctgttttccctttgtgaaaccttctgacacagggaatcctcattgtttcttcaatttagtgataggaaaacaaatgagaagcaaagagaaggcagtcctgttggtacacattttataaagaaaatgaggagtctggctcttcaagtgaaatataaccaagagtcccagaaaaagtcaaattaaagagaacacaaacttgtaaagaaattgatgcttgaaaacaattcatcttaagtgtaagggaagttgttttactaaactttaagtatttcacatggggaggagaaggactctgccattccattcagtccagagagcatctgtctaaatgttaacagtcgcatgcccattccattacatttatacattcacattccactgccgaatgccatgtccccatttgctcttcagataactattaatctctttacacttatccccctgctgacaagagcagctgttagtctcgcctctgctctccccggacttcccacagctcccagtcctcctcgcctccttcttcacctttcccccttgacaggtgaggcagactgcaggtgagacagctgtgagagaaaaaaactaaaacgtgaggccctgatgaaggtgtccacaaccctggctgaattaaagctcttaggtgtctaagcctgggggaatggtctaggaaggggactgaaaagaaattattatttgtgttcaagttaagggtcagtatacaaagcactcctgagcatcctgtaggaatcagataatgctcccagaggcacgtgcttccctgaagcagtacaattagggaggcagtcggccctgacaaaagggacaaagaaattcgctgagcactttctcacaggcagtaaaaaagcctgttaggtcaatcctgtccttctcctcctagctacacagaatggaacttcagctaattgtgggcctggagaagaacaaagaaacatggccctttgaatttttttttccaataaatataaagagaaaagtttgggacccagctttaaaagccagtgagtaaacactcagtgttacttgaaggacttaagagagatggaaactccatttacctcagaggtacaaagaagacctttctgggacagcagtgagactgaacatattgggggcactaaagaagcagaaaatgtatttcaagt

SEQ ID NO: 50529 - DNA, 1796 bp, Bovine  19866881175252
ttaaagacataaaaaatactcttaattctttataatttatggagcatttatatatactttatccaatttaaccttacaatggcccagtgaggttcagaggaaaggcagttgttcatcatgtccattttagagataatactaccaagggcctagaggaaaaaattgattaaacatgaccacagagctatatcttacttcctacttaacactactctacattccttctctgaataaaataattataatttaattatacacagaaaattctatatacactgtaagcaatagacatagatgaacacaagtattgcaagttttcaacaatattacactataatttttgctaagaaattagcaagaggaaatagcatcatatggttaatataaatacaatgcattctttctaatataaaacagctccactgtttactaaaaaaattctataaacctattatagcttttgtctatataaaacccaggttgaatcttatcatttttttaacattacatgtttttaaagcacatagattctccacaaaaactaatttaagagtgatgcccaagctgcctcctaccttgcaaatttcaagaaacttctcacttgtgtatttcatggggtgctcagtgaaagtagcaaaaggcatctcagtggaccacggattccagcggactaacagtgactgttgctcaggactcccccagtagatcctaaggccttctccttgtctcctgcaagaaagaagctttcccttagattagtcatcttcattagattaaaccaaaaaagaaaaggatgcaaaggaaatgtactaccccagtcagcctttgtattgatgctgagataagaggctgacctaccaactagctgaattctcccaaggaatttaagaggaaagacaaggatggatttggtctcaaacatgatgagtgagggacagagaggcctggtgtgctgcagtccatggggtcatgaagacacgacttggcaactgaacaacaacaactgatgagttcaaggtgttgttgagaattctgtaggttaatgcttggttggaaatgttactctggtgttctggacagaaactaaggctggaaataagcatactgaagttatgccaatattctgatggtcaaagctaaaagagaaaggaagaaagaagagtcaaggtggcaggacaggaatcgaaacatggaagacatagtcaacatgggagatggtttcaagaagaaggaaaataatagcaactatagaatctaccaagcagtaaaaccaggcaacaaatgactgagaaaagacattgggacttctgtagaagaagggtatgtttgatctttaagagaattgatggccaatttaaaatgccctgtgacctcagcttttatgtctcctggttctctattctctgcacacatttcatccaccagaattgcagcagcacacatgccagagctctgcctggtcacagttctgatccacagtatgtgggaggcaccactgtcttttagaggccaagcccatttagtaaacctaagtgcagagcaagagaaagtaggtttgggagtgatgataggaggggagttgtgggaggggaatgtggtccactgaataacaagtctataatctctgtggcctcttctttttgccggtacccttcagaatttacagtttgtggttttagacatttctgaatgcaaagaggtccctggaggttaagccaatctcaggtgctttgcattcgacaagctttaaaactaagttacctgtaattctaagcagccccaggaacatcacagag

SEQ ID NO: 50530 - DNA, 1003 bp, Bovine  19866881180411
cgcaccctctccctctcccacagtagtccaaaagactgttgtatacatcagtgtctcatttgctgtcttgtatacagggttattgttaccatctttctaaattccatatatatgcgttagtatactgtattggcgtttttctttctggcttacttcactctgtataataggctccagtttcatccacctcattagaactgattcaaatgtattctttttaatggctgagtaatactccattgtgtatatgtaccgtagctttcttatccattcatctgctgatggacatctaggttgcttccctgtcctggctattataaacactgctgcaaagacaccttatttcaacaagtggctgcatatatactttttttgaaataattgcttctgagctcagttttcttttcatcaatttacagtgtctaatatagtattttatctctcaacataagtttcttgacattttcccttgcaaaggcagaattaagcacctttatttgctctcctttatttctttctttctgttacacatttaccaatagtctattaaggtcaagtatttttgctttttctatgggatttccccctccctcttgtcggacttagcagtttctactttgtgtcatgcctagcctagaggataatattcacaccttattcatctttgtatttccttgccatttacaacccctacccaacacagacatttccagtatgtactagatatttgctgaatgaatggttttttcctcttgtttcctttggcttttctttttaactcaagcatggacaccacctctattgtatctgctcaaagacagatttgaccactttgaccacagtgggcacctagtcattagaaatctttccttccccgtgcttactagggacttcagccatctaatttcagctgtgtaaatgaagagtcaagatcacaagactgccaggatatttgtggttaaaccactcgaccaccttgggattgtgttaactctgtattatg

SEQ ID NO: 50531 - DNA, 1122 bp, Bovine  19866881236338
acatcttttttaaagtaggtgcttggatctacctcagctctagaagaaactttcttctatcgactagcaacctgcatgtcagtcacgaagacctctgtccaggtgtatttctaatgattgatgagggaagcctgtaaatatgaatacacaaggaaattgcttttcagagtgtcctaccaatctgcccgttgatggagcaaatatcatctcaatttttgacagactgtaaaatttaaaataataatagtactttaaaaatgttttaaattctgctgaatctctgaacttaatggcaagagtcacttttggggaaagggggttcatgttgggcagctgtgagatggtggtgctgagtgatcagtgaacatttatttgccaaataaattgttttaggtaagattatctacttcccatttgtcattaaaacttaattggaaaataaactaaagaaaaatgttccttgccaaccatctacttactctgatcaaggcactggaaatacaaaaatgaacaaggtatggctgtaatgtttaactctacaatacttacatatttaataacgaacattttcctcatatttttaaccaccgtcagatatttcaagttctgaattattatatttttctgtctagacttttagggaataaatgaatgaataactggaatatcactataagaaagaatcaaacaatattctgtttgattcctcaggagtgaatgggtttgagctggtttttctaagcagacaatccttgtagttctcagtttacaaaatctattttaagtaagaccaaatttaatcattccataatcatagtcatctacatagttaaatttgtctttttcctgaccttgtctttagaaaaaagttataaaagagaattttcataaaaggaaagaacaggatttcttgttatttttagctgtaagctaccttaatgcatgaatttccttttatcaaagaatacaataaatgagagctgctattatcatttattactgaatgttaatgccatttccccaaaagccagttttaatatacatttcaaagtatgatggtaatcattctctcggttaaaatttagatttctaagtttttttttttgctttttttgccctttg

SEQ ID NO: 50532 - DNA, 2561 bp, Bovine  19866881264542
tgctgtggctgaatgtttacaagtgcaggaatgatgccagaggggcttatgaaacattgaaagaactcttatcatcaaaaccacctctttagtaagaccctgtgggctgtcaggttaagagtccccattagtctgccttatgggttaaaaccctgaaaggaccttagagtcttttagaagtcccctccaagagtggtctttggagtgactctccgtttgatttgcagccatggtgctttcttccatatgagctgaaacgaaggctttgaaatactttttgaagtaagtctctccacccttaaaagagtaagaaaaagtttgtatttcatagaggaacatggcatatttataccaaaaaggtgcacgtgtgaaagtgtttgctttgcttgtttgcttttcttacatttctcacagtggactggtttgggtaggaagttaaattttgtttcataaacgcaaaatggaagggagaccaaaatgaaaagatgttagaaactgtcacaacatgggacttccctcgcggcccaatgattaagagttcactttccaatgcagagggtgctggttcagtccctggcggggcagctaataacccacatgcctcccagccaaaaaactgaagcataaaatagaggcgatattgtaacaaattcaacaaaagactaaaaatgatccacctcaataaagaaagagaaattgcaatgactgaatttttctgtatactcactaaactctaaagcccctccccaagtcatcagttttggcaagctatctcttagtgctatcctagtactgttacaatttttattgaggcaaagtccagtatgttacttcctttccctggcacatactcttccatctgtggtccacttaggatacctgagtgcttacaagagaaacacaacataaacgcaaactctgagtctcagtccttggttgtcccattccttctcacctatgacaagcattttatacccgtcacttttttatttcacgaatccatgcaactaacatacataaaagtttggaaaagcttttctattctcaagaaataaaaaatcagtgtcaaatctattttaagctttcactgctgatttttaaaggatacctttgaagcagaaagcccgaatttagtttatttgcatttgcaatcatttgtcagtcatttgacagataaattaaaaagattgcacctttgtacagtttggagtgaaaaaaaatgtgatctggctgctgatgactacagagacataactctggttgtaagcaattaggctgttggctcgagcaaagtgatggctagctagaactttcttaatgggtcactagggataggcagcattcatctccatttatcataatgaaaaccaggcagaagttaagcatgcgtgaacagttagaacaacaaactttgtttttataccatcgagttcattaagggccactcagtctgtgccagcactaatttccccgtgaagctatagctcattgttttattataatgtgttcttgtaaataatagtcaaccacttttgtactggacctaaggtgaggtaggggtgcatcttccacatttttcaagaatttcacaagaggaattgattatacacttgataaatgatcatttttattattttaatttttatcagtagtattgtaaattgtgttgcaaactatgcaatagtatacaaggttaaattcttattaacaatctcacaaacaaaatggtgctcacattatatgggagtcacaaaggagagtgcagttctgagctcacaaagagaaatattagatttttatttatttatttatttttcaaaatcagacatgagtaagattctttacatggcagtaatgactactacaatagacatgtgacattggcaaaactggagttgaacatgagtgacagccaccttccaaagacattttcaaagaggattaaagctgtgtctccaaaaacagtagcaggaagcaaatgtcagagaggtcttggcccaaacttacttttcggtaaccattagtcattctctgacacctcaagggagacttctggacaataccacagaggttgagacgctttctcagtagtgcagtcttaccctgtcctaatgtttgaaaccaaaaataacagtggcataccagtaaaccacacatcaatttcatctgatacgtggtaagtagggcttgtccacattgcatccctgagatagtcctctctcctcacccagcagccagccaagtcttggccgctgtcttgttaggaacttagacaatacacagacagcttgagagatttggtccaaattaagcacacacatgttttttggctagtgctttgagttccctgtgtgtgtgtgtgtgtgtgtgtgtgtgtgtgtgtgtgttttcctcaaaaagtcaaggactttttgttttaaatagtctctaatatgaaataacatgtttaaaagttttgcttctttactttagtgttttccttaccctaaaagatggtttttatttagataagaaatcttctagcatgcttaactgatagatttgttgttccacagagctcg

SEQ ID NO: 50533 - DNA, 549 bp, Bovine  19866881284332
ataaaatattttcccttgaatttatggatttttctgtgaagacaaatggtagagtgcaaaagaatcattcttttctaattgctaaaactgatctggtttcaaaacccagtggagcagagacctaactttttgatttttttttttttttctttagggaaacagttactattttaaacaaatgccttcaagatctaccttctatgcaaatatatctacaactcagtttgtgttttccttcttaaaagaaaaaaaaattagagaaaaattgctatttttaaggtcagattaatctttcaaattggtttgaaatctttcaaatcctatctaaggaaacaggaaggtagagttacagtttagtcctagttctattttgtgtacgtggacagatcagtagatcttgagttgacttcccagtctataaaacagagcattaaaaaaatatcccgagaccacagggatattatgagttctactgcttgcggagcactctgcattctttgggtgagaggtgttgggctcttatgaagacactgcacttacataatccta

SEQ ID NO: 50534 - DNA, 1008 bp, Bovine  19866881298201
accaggaactgccaagaggatatttcaacagcaccaattacacttgcaacatttgctagtgctgtgttaccaaacaaggtgacagcagctaaatcctcttcaaccacaactatggagggagatggctgtgataatccctgcaacaccatggatttggttaccgccgagtaactcactgaccttactgagctcagtgtacatcctcacagtagctgtacaggagaagctgaataaccggtccggtcccttgcactcaggggtgtggcacctgtagctcttgaaatgtctcctttcacttgattaatccattgtcttccaccctctctccaaggacccgctctcagatggtagataataggtttttcccacctgagacaggtgggcaatagaaagccgggggcatctcggatgacttcccttttctgaagggaaggtactttcccaaatagaagagtctagaacagcttccttctgttaaactgtctgttctcgtatgactaatttgagaatccacccactctgggggccattaggtggttgtgcagaaagatttccaagtagtgttctaatcacacactttatcggtacagggctttgtaatcagatggggattgacccacctttggtgtcattttccaggctgcgaagataatttatccctgggctgagattcaatcttagcccaataatgaattgtctctgtcatcttggctcaacggtctgcctccttcacatggaattctcaggtctctggtacatattccccacccccctcccccaaattgcaatttccaccatggttttctttcccttgttaatattttattccttctgggccctgtttaatggcaaagttggattctgcttcttacacaccattgactggtggactttgagaaaaccgtttcttagagcatccttaaagagttctgagtctgaggccttcattttgcagttagagaaaataagaactagagggagaaattagttttctcaaactcacccaaa

SEQ ID NO: 50535 - DNA, 438 bp, Bovine  19866881309662
tgagatggaccctgggatggtggtatgtgataagggcagtaaccctctctgttcctcctgcttctgttcagttcctatgatgggcacccacatgccaatggctggagacatgaatggactcagccccacccaggccctccctcccccactctccatgccatccacctcccactgcacccccccacctccgtaccccacagattgcagccttgtcaggtgagtccacagcatgtcccctgggggcctgtcctaagcatctctgggtggtggagggtggacactgtcaaagttaatagcatagttggaaagcaagcaagcaaccctgtggttcaagttcagttatctctaatcaatggagtcatcagtagtatttaatcaaagcaaccataataatcaacatggggaaaagtgaaaatgtgagtttataggcatatgtgt

SEQ ID NO: 50536 - DNA, 1175 bp, Bovine  19866881312434
tattctcttaaagcttgttcaaagtacttgatagctagttcaaagtcatcggcctcatagtgtttgactcctgcactgtaactctcctagaaagaaacagaaaaaatttttaagaccacccaagaagaacttgaatagcaagatgcaggaagattctagatcacttaggaagtggggcaggggattctttcactgtgaaagataaagggtctcactgggagataaagggtaactgccctggcttcagttcagttcacttcagtcgctggcttcaactcataaatgagaagggattgactgagtaagcctatgctgcagcatcaatcaatttcattcccttcctgagatcactcaagactttgatttctaacctgtttgaatgtaggtagggctatgcaaccaagtgcaggaagacttatgtgggtggatgagatgctcatttccaagcctggttcaattttttaaaaaagaagaaaaaagacttccatctaaaatcttcctctcttagccttttcttcagtcccttgaaggtcatactttgagaatagtgattttatttaaaggaataattgtatgcatgcatgctctgtctttgcatggcagaaagcaaagaggtgctgaggagcctcttgatgaaagtgaaagaggagagtgaaaaagctggcttaaaacccaacattcaaaaaacgaagatcatggcatctggtcccatcacttcatggcaaatggatggggaaacaatggaaatggtgacagactttgttttcttggggttcaaatatcattgcagatagtgactgcagccatgaaattaaaagatgcttgctccttggaagagcagctatgacaaatctatagagcattttaaaaagcagagacattacttttccaacaaaggttcagatggtcaaagctatgatttttccagtagtcataaatggatgtaagaaggctgagtgctgaagaactgatgcttttgaaatgtggtgttgggagaagagtcttcagagtctcttggactgcagggagatcaacccagtcaatcctcaagaaaatcagtcctgaatattcattggaaggactgatgctgaaactaaagctccaatactttggccagctgatgcgaagaactgactcactggaaaagaccttaatgctgtgaaagactaaaggca

SEQ ID NO: 50537 - DNA, 763 bp, Bovine  19866881313933
tcccctggagaaggaagtagcaacccaccccagtattcttgcctggagaatcctatggacagaggagcctggtggattacagtccatagggttgcaaagagtcagtcatgaccgaagtgaccaaagcaggcacccagcacacatgaaggcaactttgagcctggtccttttctttccattgaatatctggaccagaacctagggaaaaaagtttttcccttaaaatcgacctccaggtttccttgcatctacttcaggatgatcactcagctcccaacctgaggttttcaccaccaaatgagaggaggtggagtcgtggaaaggattcaagtcctctgaggctatttggtgatgtcaacccaattaccagagacagcgctatctgcccggcaatgcccttcaggtatctgcacctgtgtggctctgggtggaattcttgaatgtgacacttggctcatagaaattctgcccctccctgcctcttttttcccctcctgaaaaggaagcagaatcatcagtggagcaaagccccagctgccttaaaagagtttcagcaattacaaggaacctctgcaactttgggtattctgagaaacgatattgcactcttatgtaccagaatggctctaccagttattaaataattccagcagcccagtccctgaatcagcctaacacctaggacacaagatacctcaattcctcctctagaatccctgggacatcttcataatccagtaactgatactggtaaaggcttgta

SEQ ID NO: 50538 - DNA, 810 bp, Bovine  19866881409225
cccagattaagtctaaacttcttaagccttacccacaagatggcatatttccctctcattgtaatctattccatttcctgccatcagccttggacacactaaatgccccacaatattcaaaatatggcctttattctcacttttatgcttacttacatgcagtccctgcattattagatacattttccataattttgacttcctaaaatgggctggtcactctgtccatattaataccttcaaaactccctgtctagccatctaccaccacatttataatatgtaagatgattgtttgatgaactctctcttttctacaggatgttaggtttttcaagacagaatacatctttcacagctttgtattcctggcacccaggaaagtaccaggcaaatctaaggtaccaaataaatgttgaattcctaaatgggagatagagaatgaaagaatttcttttgggcaatatggccatatagtctagagacattgtcacagttctagaggaagactacattgtttctgtgggctcttctcacccactcacatcccatgtggcggtcagaatgatgtttcaccaactgctatcttgcagttgttgaaattgcacatgtctaggatataatcacatcttgttagtccctaaaactttgaacctatttttcattctaggtgacatgtctgaattctgcagatttccttctggtgagaacattgagtgctttaacactttgagagcaggtgctgaactgttgttattccaggtcatgcaaaacagagattctacaaattcagaagtagtgagatggggg

SEQ ID NO: 50539 - DNA, 923 bp, Bovine  19866881426692
agaagtggggcctaagaaggatggggagaaggaatgatggggcctgggagggatacaggaggcctggagcgatttcctattatctgtcagggcagatcatacattcacatcttccttcagctccccccaaacaagtatcttttttattattattttgaaaagagattacgtttagacagaagtggcaccaatatcctgccaacctgattaaaagcaggatgaagataaaatgatttctctatccctcatggcccgggaagccaacacctcccagggaaatggccctcacccagcggcagcctgctctctacttttgaagctgcttctaaacttgtttgctttgggagccccggtaagatctgtgctcgctgcccccaggctggccctgtgcggctgctcctgcagagaccatggctggcttcccagatgaacaaccacaacagtgaatgatatcaaaccaattagaagcagggcccaccttgtgccaaccaggctcacctgtggtcttacccacttctggaaaaagacccctgggccttggatagggggtgggggactgttaaattgaaagactaaatgtttagtagtgacttcctctcagaaccttctgtcttagagataagcgaggcaactggaaaaagatcaatctcttacaccatcatctgctaaataggctgtagagaatatggttttcagattcttctactggataggaacacagtcttcccttagcaccttgtgaatgatcagaggtggaggtttatcagatctggccccagtaatgaggctgtgtttgccctgcctctcacagaacccgcactaaggatgggccatctctgtggaaggagggagggaggcaggggagtggggccaagcatttcccttggctccatgctctcagttcccacctttacagagaatca

SEQ ID NO: 50540 - DNA, 789 bp, Bovine  19866881457145
aaatgggcacttttccccagcttttctatttcctgtacataatatggatgtttgtttgtttttacaagttaacagggccaatgatttaaattgttattgaaacatgctttgaacaatcaagtggcttatgttggcatagatttgcttgaaaccactggtatttctctagggagaagtgggaaatcctttacctatcaggcagtggatttttaaatttttatattaagtatatatatgcattgatttgggtagtttccccaaatttctaactgtgtaatcatttttgaaaatccacatctaggttttaaaacccaaaacaaaaaaccaacttctgaaagcttttcctgaagctttactttttgttgcaaagtgtaaaataactttctgaagtgccttctttaagtcctggtggtggtacgatctgtggtttgtttggggagattttgttttcaggaaagagtgtgttttcttatgaaagagacaagggaaagtttttacctgtctctctcctgtgttctttttttctctctctctctttctttccttttcttttaaagattggtgataaggaattctaactacttaatgagatgggagaggcctcactccattggagtggaggagtccaggtggaagttgatggattggacaggtaaagagaagagtcccgccccctcatgcctatagttgggtatatatgagggaacctaaaattatgtacagagagagaaagagacagaaggacttgagttctgttatcttcctagtagatttctactgtaagggtct

SEQ ID NO: 50541 - DNA, 856 bp, Bovine  19866880370453
ttaatttgtcattgtttgttttgttttttgtttcagtgttttgacggtcaccatatactataggtgggtagaaatagaatatttggttttaaaatagggatgaaagtatagtttacattgtatagattataaaatttgcttgaagactatctaagattggttcgctcaagaatggttttctttgctatatagtcttactttatgtccagattgatggggatcagatatccagaaattctagccgttcagctggttgaggaaacacaaggtttatacgtcaggaaggtatctcgcttggtaaacagtcatagaagatactgtagcatgcacataatttgaaagtgatcagcacccattggatggataattcttgagcagagtagtctggtaagagcatctaaaatataatttcaaaatgctagctttttggcagataatgataatttcctaatatgtatacaagaatcaagttgattaatttatatatctgtgaataaaagaaactttttcaaccatgtcatactaccttttctgaagtaaacctttagtaagccttgagttggttagattatttaaattgttagtgtaaatgaagtctaattttatttactatttatagaaaaaaacactatgattaacttataaactgtcatttaagacttggtgtattcctgaatagattggattaaagcttctctgttacaattttacactcagtattttaattctgtattgatagcaggtatcccctcattctaccatcttaaaaatcttttttttttttgcctcagttgagcaaaccttagatattcaaatgatgaaaggctatcctaaagggaagtgttgagatgatata

SEQ ID NO: 50542 - DNA, 854 bp, Bovine  19866880406608
gggtgagacctggcctgagctgatgctttcagggtcactcacaagtagatcctcccatctcaggatccacctcctctagccaactagatgacaggggcggcattccaaatccaagactatgtgatccacgtggggagcataggatttcactggttggatgtgcaagatttgtgtcttccaccgttttccatgcacttgatgaagaagtgtggcaattcgagtctctgcagctttggcccacctctgccactctggcttggtggccactgacagcgttttcctcctagaatcactggtagctccattattcaactggttgctgataatctgatgaggagaaggccaatgctcctccatctcactgcttccaggaggctggagagtcttccctgggaaagactccacattttggtgaatatgcaaaatgcctccagcatcctgttttagcactctgcaggcaatgggccagccttcttcagagctgggaatcagccccagattcacccggtcggcaacgtttgatagcttcagttttctgttatccccaaagtgtatttggcatcgatcagctactccattgagttcaaggttatttctcagagcaactaccgcatggggattccactcacaagcgtggacgaaagcagcctcggcatgaaccaggaaaggcaaggtaaaataaccaattcccgcatagagatccaccagcacttctccgacgcagggcagcgacgccacacgaagcttctcagtgatgtttccgaaggagaacatgcactgggtcacgtcaaacttataccgaatcccattatccacatgctctacccagccgtggtcgcccagcagcagactca

SEQ ID NO: 50543 - DNA, 1388 bp, Bovine  19866880453996
tgacatggggttcttaggcactacttgattatatccagtgatggggaggtcagtacttctagagaggcccattccattgctggagagttctgttataacaattatccttatagtaacctgaaatctctcttcctgcagcttaagaactgcaaaggtacccttacctgcttttagatggcagtattttcaagagtgggagacacctgagttactatcacccttcatccacaccctcagttttctcttttctgggttaaaggttaaactagtcctgattcttcaggagttttgtggcttctggacccaggcccagctctgccagcttcctgtagaacttttttatcttaattgcatttagaatgaaagatgttctgctgtaaacagccagcagtctactgacttatcagacaaaatattgaagatgacaggctcttttgtcctgcctactgtacatgtctaaaacttctcaagacagtagggatgggaaagttgtgagcaaagcattgtgagattttaggagagaaagggaacatgttcagttgtgacggatcaggcagggctgttggaaggaggcaacgtttgctctcggcatttaaagatgggtagagttgggacttccctggtggcctagtggttaagaatctaccttgcaatacaggggacatgggtttgatgcctggtcagggaactaagatcccatatgctgtggagctactaagtctgagtgctgcaattactgagcctatgtgccacaactgtagagcccatgtgctacaacagaagatccctcatggtgcaaggaagatcctgcatgccacagctaagaccccatgacaaagccaaaaaaaaaaaaggttgggtagagtttctaaacgcagaggtagatttgaatattgggctactctagagttcattttggctacaaacaaacaaaaaacaaaaaccttttaggtggtaagatttgacgggtgtccctgaaacgacatttagctaaaatcctgctagagggtgaggtaaagctgtgattctttgcccacccttacagccatccctgaggttcgataaccaaatgtcagtgtgccccagataagagtgaaggccagacaaggttcaaggcctagaatcctctttgatgggcttgtcttgagcccttttcgcagatttagcctcaaagagaaatctaatgttgccagactcactgctccgtctctcccaggtctttcaccacaagctgataggaagtgtactgatcggctccttcaaagtggacctggggaccgtgtacaaccaacctggtgagaaaaatttgcctcccagtctcccttgctcttcttctcttcttctgacacctaggagtcaattcatttaggcctttatccacttatcca

SEQ ID NO: 50544 - DNA, 1532 bp, Bovine  19866880571419
ttaaaaggtttatttattttatcttttggcctcgaggtatgtgggatcttatttccctgaccagggattgaatctgcaccccctgcattggcagcttagagtcagggaaatcctgggatttccttcctttttaaggttaatgtctcattgtgtgtatagactacattttctttatccatttaactgccatggacatttaggttgttcccacatcttggctattgtgaacagtgctgcagtgaatctatttctgttgatgagatttattgagtgcttatttactataggccaggaaccggtctaaatgctttatgtataatagtgcaggaaaaactcagaacagccctatgaagttgatgctccctgtatccccatttgcaggtgaagaaacagaccccatttagtacggccaaagctcataccatgaatcagttttcacccggagcttgaacccaggcaatctggccctacaagcagtgattctgatagttataatactgatagtattgaaatcataataatgataatgatcaaaagcaaactatgtgtcaaggttattggcaaggtgaagatgagagttatgcgtccaagtgaccctggggacaggatccaggggattgcccaagagatgagttaattctagcagtaacactcatgacttggggaacaggggtggagagggagacgataactaacaatggggcagggtggcccagaggaaaattgccttctacagctgtgatattcagctccatgcgtcgctttggtttatgcagttttcaaagccagaccttttcctatttctgagtctgctaggagcctgtacagcattttgcacacagtttcttttgttaccctctcccacctattttcctttcctcctgctttgcgcttcaagggtcaagggaacagcccaggcctgggggcttattttcaggtctttgcaaagctacttatttgactcccctcctccttgtctatttggtgttgatctaaatgacagatctggttgcgtgattaggcggtggagttgggaaaacaaacccaccagctcccaaattaacctgagtccattggtgctatttccaggttaaaactcccagcggggctctctgcagtgacaccacccacccggaagtcctcagagcgcctgaaaaaccaccgccaaagtcaggggcagtcagcaatctccataaactgatgagcaggacacagaagcgcagtgccatttattttgcaatagcaaaatcaatccactttcccataatcctgcaacttattgaactcggcatctcgctgcaggatacgcccccgaactctccctaattacgtatttggctgcttgcaatcgtgacttggctctgcagtcctgatagcagagaacgggcctcttagaagcctgcagcagcaacagcagtagcggcagttttcccgccctaccgagcgctccctagttgcaaggtactgcgctaatcgtgccaccgtgcaagtcccctgaggccgacggctgcaccctctgtgccgggcgctcg

SEQ ID NO: 50545 - DNA, 1552 bp, Bovine  19866880597145
acagaatctgagctttaaatagtgtggtaattgatacctttggctattatttatttaaagttgccctaatgtcagaagtgggcttccctagtggctcagtggtagagaatccgcccaccaatgcaggagacatgggttcgatccctgggtcaggaagatcccctggagaaggaaatggcaactcattccagtattcttgcctgggaaatcccagggacagaggagcctggcaggctacagtccatagggttgcaaaagagtcagacacgacttagctactaaataacactcacaatgtcagaagtagctgttctgaacaggcagaaaaatcatttttatggcagatggtggaattcatctctgatcattcatgattcatctttttgcaatagtaacatcaaagatcattgatcacagatcaccctaaccaatataataatgaagaagtttgaaatactgtgagaattaaccaaaataggagatagaggcacaaagtgagcagttttttgttggaaaaatggcaccttgctcaaaaaatggtaaacttcatgcaaagttgctataaaccttcagcgtgtgtgtgtgtataaagcagtatctgtgaagtgcactatagcaaagcacagtaaaatgagttgtgcctgttatttgagcctcagcttgttcttttctagaatgagcagaagatacttcttctttgatgagacattaagtaaaccgtaaagactgttcatgttagtcatcaggtttgcgaataggtgggtcacatgttgctcctcgcagagtaattgtatgaattatgacttctgtctgttaggacagcatctgagacctagatagattccccactggttacagttaccttgttagtagtgaccaagctgggtttagggtgaaggttcttggtggtgttggcataagaatatgcttcatgtggtttagtgtgaacctttgaatgtttatacttaataaaactcttgcttttcttaaactctttataattttgatttatccttttctcctgatctctgctataaaatttataaacgtgccttgcatttacagacgctgttaatcaccatggaaaatggcagagactgagggctaggtgggaacttttgcttctgttatgctttgcaagacagtgaatctttgctaacgatgcatttcttttaaatgaagactggatgggagaagaaggtcaaatgcttaaaaataggttaataattcatctggccaagattctcttcctcagggtcttgttggcaactgtcctcagaaatgcctcaggactgtcctttctttctttggagttgagcctgctattagctggccagttagtgatgctgatgtacctcattaccctcatgtaggggagtggtaagatatttccagaagcatccgcccagcaccgggagctctggaatgtaaataacctgagacgtggctgctttgcctgaatctgtgataggaaagaggccttttttttttttgtagccaaagcctccatctgcctcccaatgggcactcagggaatcagtgagttaagatt

SEQ ID NO: 50546 - DNA, 1595 bp, Bovine  19866880697700
ctttcccccaccccaaaccccataatctgtggagtaaagtgagcacaggattaggaagagagggggttatttgaagaacctttcccttcccaaacaaagggcttctttggtaatggctgccattgttccatgaggttgaacaaaacaagagcagccatggaaggtggctcctcgcaggtcttaaggacagagctggtttctaattccagccactgaatgctacctgcagattcataactgtcacctacatagagcgcaaaggaccctggtggtgttgttaagccatttgggaggttgcacatggcaaaaacacaacaacgtgctttgtgttcacaggctatacacacagcgcacacgcatgcgtgcatgtacccacaaacccgccaggatgtgcctccctcctttttttaaatttctggctgcacctcacagcatgcgggaccttagttccccaaaccagggatcaaacctgcacccctgcactggaaggtggactcttaacccctggaccccgggggaagtcaccatggatatgactctgtagtcacccctgcagagcatcattaaggatggcttctcccagggccctgggcatttttttttagatccatgcacatggattcttgggcaattcccaggagggtacatgtatgtagcccaggttgggagagggggatggggtgagctggggggatggctatcataaaagtgggtgcaagtctgactgaaggggacccccacacctcacccacatgtcctgctaggaggagcaacccggcctgcagcggaggcttctagattcaaccgacatgaaaaggccacctccaagtgtgtctcaccacttcccaggtggctttggacagcatctgtatctttcatcagtcactctgggcaagggcagtggtacccaggaccaccatcctgaagcaagcttaactcatttcatacaagaaggagtcagaaaagtgtgaagcaaagaatctggtccagtgtgctcgatgccgtataaagaatcccaaaagcagaactggaaaaaatgaaaagggtttgcacaaagagatcgtgctctcctcaataccaaacacccaactgagggctgattttccttggaatagatgtgatacgaagacagcaccaatgagcaagggtcgccccaaaaggctgccacacagctccccaggattacccagtcttttttttttaaacttatttggctgcaccagtcttagctgtggcccgtggaatctcgctcttcattgcaggattttttttagatacagcatgtgaactcttagctgtgtcacgtgggaacccagctccctgaccaggaatcgaacagggaccccctgcattgggagcttggagtctcagccactggaccaccagggaagtacccccacaaatgttgttaatcaggaacccagcattcttttggggaagaacctagaaaaccatcttaatggtacttcatcagcaaactctaaagtcagaggcaggaattagctccaggaagaattggcgtcagtttggtgagcatcccacagagatggggacggccactccaaaccagtggtgacaactgggggatgacaaag

SEQ ID NO: 50547 - DNA, 1304 bp, Bovine  19866880761970
tttgggcagctgcagaatgttctgacttatgtccacgagacacaatgctagtccctgcagggaaacccctgctgcatttttttccaagttaatgagtttcttctctctttggatgcttcccattacctaagtgggcttatttttcctaggacgcagaccacaattgaagatggcagttggcacatttggaacctactagcccaaaaaaagattcccagcctgaaataccacttgatttccagacagtggtttatgcactagagggcatgtttggggatgggggggttctgttctctcctgttattcttttccatattccaggcccctagcacagtacctgacacagaggccgggcttagtagatgttagatgactgagtcagaggaggaagtcggggactaaacaggtcaatgtacaaacagtgaattctgaccaagtttatagcctattgatgactaagactttctaggttggccagaggcttgttttgacatttactgacttgtgtttacaacaagaccaagggggaacctgttagggcctgctggtcctagctttcagttagggtaaggggcgctgtcagccccggcagaatgacctatgagcttcgggtgtaatcagtgtccagagccagccggttcagctcagggacagaaccacaaaaccactgctgctaagtgcctgtaaggtcacagcattcaggtttgggatcatgacattatttccgggacttctaatcatcccccactcacagcatgctggggtataggttcagaggaggttgcacctggaagggaccagtgttttatcgatgggcctgctgattacaagcatcagaattacctgggatactgattcactttacatgagaaaaatgaagcccagagagggtgagtgatttccccaaaggtcacacagctagtttgcaaaagatgattatactgtggtatcattagagctgtattctgttttatatgtcatcacaaagtgttttcatctctattctcctatttggttttctcatctaccctccatatgagaaaatggaatgatttgctttcatgttagaaggaaatgcagtttttctttctatttctgtgtcagtagccagacacgaccttctcaaggaaggtgccactagcctgtatagcacctttttgcaatggcacaggtctgacccatgtgacagagtgcaggctggacttgagcccctactctgtcttggttaaatggtttgggcagtttccaacctgcacaactgtgcatggcagtcctgctctccaggagaggaactgtcttatatt

SEQ ID NO: 50548 - DNA, 1287 bp, Bovine  19866880763601
gattcactttgctgcttggtcctttgttttggccagtattccagaatgccataggaaactgtcggaatcaagactagtatcagcacaatggcagagcctatgcagtgaacccccgggaccgcattcgtggtgactgcactcattatttcgatggattcggacactaaaaagcaggtagacagcagtcgaatctgggtaccaatcacatttcatcttcctgtgtttgaatctaggcccaggcaggagtatgatcacagctctagcaatagtgagagcttcaaatatgtgggtgatcccaagaggttagaattaacgtttaaaactgagtcaggaaaaaaaaggcttagctgatgatgctaataatggacagtatgacaaatgctgatttttctatcttatgatgttttaaaaaaggcttcttacatcaaagttcatcagcatggtattcattgcagaggacgtttttggaatactgatgtacactggctaaccagcatatattgtacacctgctgggagctaggtctgggggagaggaacagactagagagacgagaaagttgtagtaagtgccctgaaaaatgtcagtcattcaactgatggaccattgggtaagacaggcctggagaagtggatataatacaggggttggtgtggtcagacattgactcactggagtaaacgaagggctctggaaacagagaaggaagccagctgtgtatgtgaaacatagcacagtgtaaggaacattacctttggggcaaatagatgatgtcaggaatcctgcatctactacccactgatgtctttacctcgggcaagtcagcctgacctccctaagcctcagttagcccatccctgaaatggagtattatatttatcagcagagtcttaatgagaaatggatgagataaaatgtatacagtgtctaatgacgtagcacatagttggtgctcaaaaatgatagaaaatgttaatatagattttaaaaaaaacatttatttatttggctgcatcaggcttagctgccccttggcatgtgggatcttagttcccctatcagaaattgaactctcatcccctgcactggaagacggattcttaaccattgggccaccaggggagcctctaatataaattcttaagtagggttattgctctactataacttcttttctctttctaataaaaagtcactatgtcctgggctatcttagaacttctccaaaaagaagttctgatgtgagtatttgtgcctcaataacggaggacaactctacaccacgca

SEQ ID NO: 50549 - DNA, 1935 bp, Bovine  19866880776653
gctgccgtctgtggggttgcacagagtcagacacaattgaagcgacttagcagcagcaggaacagcagcagcagcaggatcaaaaaagcagtctgaaaactgcctttgtcatagttctcaccaacatcattcaaacaatttatgggtattttctaattttttgacaacatctctataacgtaggcttgggttgattttccttccattgtacagaaaaccctgtgtcctctgactcatgatttctctccatggggtgttgtctttccacttgtctaaccgcgatctgtttgggaacctgcacaaaataagaaggggtgtacctggagagccttcatccctctgatcctctctaggctgtccacaatctgcagtcacgactcattatcctgaatgcacatcagaattacttggatcttttttttttaaagtaattctggggccccaccccaagtttctatcaagtattaggtgaggcccaggtgtcttctcttataaagctctccagccggttcccttatgcagtgaggggcatgacccctttggtctgcaaccttgattgtgaatacaagtgttggaatttttttaaaaggcgatgagaagaggtcacaccaaccagtcatgtgtacagcttcttaacagtcattgaaaagcatcctgaggacacggtcattgtgaaattggggggtttggaggtaaacttgggcttagggtgctgccttgtcctgcttcaggtaattatgattcgggtgtgttttgacaaccgagtgtaaaccttgacaacagattatatctgtgtaatttctccttctctttgtctttttgtgcaagtgctttaatcgactgtctgataaacccacttcaagagcagatggaagaatggaagaaagtggccaaccagctggataaagaccacgctaaaggtacggggcgaggtggctgatgcacgtcagtctcagatggcaggtcgccagctgctgcctgtgcctctgctggggtccctggtgtcacctggaggacgtgcttctcccccgctgctcctgtgggcgtctcagtgttggaggatgaaggatgggaagtgatcccaccacaggactcagtgctgggtttggggcatgcagcgtcactcagtggatgccgtcattgtcccatggcgtcagttgcgatcagctgaattcaaagtgattgtaaccttacgcttaaatgctagagactcacacttcaggcatttcagcacattttgaaaaccagacttttaatgatgtaagttagccttcggtctcctgcccagaactggccattctctttgtatataccttcaaccggtgggtctcaaaacctcacgtgttggctctagggactgagtggtccagacggacatcactccgtcagtcttcctggaaccaaagggtaggggtgctggtggtgtggaagggtcaggagaccctgctcccagcatcgtacaacctgcagtgaatgtggtggagggaaagcgtgtgggccggcagtgatgccaagagcatataaaagagagctctgatggatgccaggagcatataaaaagagctctgataggctcagggcgggcgggagggaaaggatgggggtggctttgtgggaactggtcaaattggtgattaatcgactatgagggtagcaaaggagagaagtatcagagccaactgtcatttcagatgttcgtgcctgggtgacggaaatgccagcaacagaaatgggaaagtttggggtgggcatgagctgagcggggcagagagaagtgttggtggggctgtggccgtgtgggctgccccgccactggcgtccacagggtccagcctcggtattaatgtgaatgtaaggcagccaggcctttcgcacttctctgccatgggtctagtttctcctgtagtctgagatgctcatttttaattgtagcat

SEQ ID NO: 50550 - DNA, 982 bp, Bovine  19866880798963
cacagccaaaagattctgcttctgctatgtttatatacttggtagaagctataatggggaaaaaacaaaataaaaaacacataacatgtaaaattaattgtgtaggcttttgtgttttcttattggcaacacacacacgtgtacaaattacgtacagttaatgacagaacaaataaataaatacatattatgagtaccatattttacctgttaaatatctattgacatcaatctttttctctcttatacctaaagactgatatcataaaattgatctccatactagaaataataaaaaatcaaacttccctgaatcaaatttcagggaagttatctggtcacatttactttatcaaacaattttttaaacactgttagggaaatgtgattatgtcatttttattagacatctggattcaaaatcctctttccttcctcaacacatcagtatccctgactgctttcacaaactaaaacaaacaatatttgatttaaataaaaatgtaacttggcctcttcctaccaaaagcacaccataccttgtctacataatctgtacataatctggatgacctgagaaaacagaaatgtaactaggaagagctaatgtctattttaaaaatatatttagcttcatctttttttcctatttgcatcttcagcacattgcagaatacctagtgcatagtagatgctcaacaaacattagttaattaagttgaggacatctaccttggaaaggaagaaaattccaaactaagacaattgagggaagactgtgaaacagattaaaagctgagcatagttaagactttattctaattactctataaatctgccaaggtatagtcaacatccactcaactgagggctttttaaaaataggcatcaaagcatttagttttataccacatcaaaaaatagtcccttaaaccaacggttagttatgtgtttaggactttacatctttcttcttttaatg

SEQ ID NO: 50551 - DNA, 773 bp, Bovine  19866880810880
tagaatactctgaaggtttctctgtgtgtggtccctctggcttgctcattcatcctaaagaaattcatcatctttgttgcttctgatgtctcactttgctgtggttatttcaacaacatttaaaatatgttatttaaatattagtgattctgtcttttgttaagatcataaatgcaatctttcagtcaattaaacatgcaattattagtcaattatgtccacaggtctagggttagataataaaaatagatgttccaaagacaatggaacactgaaacactgatgtaaacaaacaaaaaaagactatcactataatcaaaacattctatttcaaacaagcaagaagtcctgtcaaatagatgctctttcacttgcaataaacatctgacaatcaatactgcaatactgtactgtaccaaaactatcaggggtctctgctgatgacacctccttcgctcgcttcacaatggcaatctcaggtttgggatacctgcatgctaaaaatattttaaatcaatgtattcaagcaataacataaatatgtataaaactttaaatgtatatgaaattttgaagtgaaacatgctagtatatgggcagtcctcactttgtacaatattgtggggacataaaaatgacaatgtaagtgggaaagaaatcttagtaactggtggggaaaatcaccattgttctgtgatttttaaatttcttttcaaaacattaaaaaattctcttactagtagttatacatataaagggaaagtttttaaaca

SEQ ID NO: 50552 - DNA, 995 bp, Bovine  19866880812267
cctggtttcttttagtggtgaaatggtattaaagaccaagatcttgggtgccaattgtactcagggcttctaagctcttttagcaagccatatccttttttagattcatttttgcttagaggactaacttgatcttctgaagtttcaatgaactctttttagaagcaatagaattggaattttccagaagaattaaaagtgggaacacttaacatcatttgcatgcttagctcatgctttatggaccctagtttagggcatgtgtttctaaataggaattcttgcccctctggtcagttcagaatttggctgtgaagtttttatagtgattgaaaatcgggggagggaaggaaacagctttcccatggcacttaggttttcgtaagatggcactgccatgatggagaggaagtaaggtaaagcaaacgtatttaaagtgaaaggttagctcgaagaaacaccggtagacagttatctttttggatcagaataaagacttttagctttaaatcttagaaagtcttagttgacttcctaggaaataaagtgtttttaaaaaattattctaccttattttaaaaaattttaatttttatttaaaaaattgaaggcaattctcaatattttcatcttcgacatttttgtttcatgttgtcagtctttcattctgtgtatgtggttgatcacaattcaggttttcctctggatctcttgcgctgtgaaagccttcttgggttggaccctgcaacctgcagcagagttctaaacaaaaattacacattgcttgtttccatggctcctctcaccaatgaaatccggcccgtcagcagctgcacccctcaggtaaagaaagacccactgggaagcctgctctgccattattttcttcttcctcatggcaacttgaaggggaggtttaacagtcttatgtattgattctcaaattgtaggcagcagatactaaaatcatcaactcagaaagcagttttgtacgt

SEQ ID NO: 50553 - DNA, 2241 bp, Bovine  19866880825733
ttttgtttcgttctgggggtaggaggtaggtaccaaactatttggaagaatgatatgaatgagagaatttcagtattttaatacaatgtatagaaaaggtcagggtaagcccaacatgcatgtactgctttgggacccagggaattcagcccctgttacagaactcaagtggcccgcacacagggaagccagtctgctgacaccaggtggtggggagggaaagtgttcagtgcagagccccaagcaaggagtccagggcacccagtgctgcctgttacactcctgcacgggtttcaggaaagcatttttaaagacaacgtaagggcgaggcatcccaggatatgtaatgagcttgtgtacaattctctgattgacggtgaggtaacagggcggtgtcatgggggttagctttaccaacccagaggcgtcagtaagtctgggggctactcgctcatggtcgtcaaggggtcaatttcttccatttgctgagggatttagcatctgtaagtcaacttgggaaatgtgcatcagtactgttatctaggtacttcagaggggagctaccgcagaagatatgggggaggggtctgtcctgggaagatcccatagggtcctgctcggttaccccccaccaccatggctatggcctgagactcagctctgccatcatcacctctgagggtgtacttgtcaaagacaccctctgccgtgccagattcaggggccctcatctagcacaagttggtgggtctttgatggatttcacctgcttgttcaggtaacgcgtctccataaagttacacaagtgggggatcgttcttcgtcaggaaccagtgtgtgcaatcccagtagtgactgatccacgctcttttttgagtgtaatgtgcacttactccattgcattcagcccattctcagacatcatggtccagtttcttgatttcctgaaagaagcttcagccaccccattgttcctgcagcttcatcattttctcagcatattctctcccctcctgagattagccaagagaatatttagcagaggtcctccaagcccgtcatcacggttcatgcagtaagacgggtgaacaaggcggggccagctccaggcccagtgttgtaaacgcttgtctttggggtgaccagacactgcatgtgatacctcagtgctgatgctgtgtttcctatgttctccctctagttaaaatatttttcacagcaggattcttttactttgctttcacctcctttatgagaacaccataaggcagaaggtcttcaccctcttgagataggtgggaatagctaggactgctgctgctgctgctgagtcacttcagtcgtgtccaactctgtgcgaccccatagacggcagcccatcaggcaccctgtccctgggattctccaggcaagaatactggagtaggttgcatttccttctccattattttgccatatgaagtaatattcacaggttctggggatcaggtcgcagacacatctttttggaggctaccatttagctcactataaaagccacctcctggagaaatggatttaggaaagagagtgtttgcttgcttcttagttttagagtcttaaatcctgacagcatttgattgtcagctacaaaaccctctttgctgtttttccaggaaccctctcatggtccatccttgcagattctaaaaggagagccttcatggttactgtgtccctggaaccacgatatatatacagcctgggggtgagtttgtgggatggagggatgggatggaatacactagagtgactagagatatgtagatgggagaaaagaactctgagaaagaacatcaaattttggtgtacattatacataacagtggggatgctatagacccaagccgtgcatcgtgtggtcttaccttatatacttggacatgaacgaaatgatgattaattcactcttgacattacgtggctttgatgccctcaaaactattgaatagagtattactcccagtctctgatcactgagaaaggagagacactatgttgcgcaattcaggatggcatcatgcacacagtagtcgatggattggtgtaatatgatgtcaccagtgtcttgaatttgcgtgtgcagtggctctgtgagtgaggtacaagggttagaagaaatagtcctgcctgtgaggtcagaggtctcaagcagagtttccaaaccaggatggtaagagtagagatagagagtctcacctt

SEQ ID NO: 50554 - DNA, 1458 bp, Bovine  19866880853745
catggatgtctttatagttttttccatggtcatatttttggaaatgattattttaaaaccacgcactgagtgcacatatagcttacaaatatgctaatatctgattatgacttcatataatatcatgattacatattgaataaccgaattgattgggatgttacatttttcctatagaagcactgtgagtagacaatgtctggaatgatccaataccataaattgttccacaattccctgaactgcagaaaagaaagaagttaaaagttttctttactgctaaagaaataactaataagaagtttctgaaaaagtagtatagaaagatcatgcttatgaggtacataattctttcctccattcctatccacagatcaaagaagcactttcaagtgcctctggcaaatgaaacgtctttttccaaataaatgggctcgtaacataaggaatttatgaaatggttatttacctaccaaccctgaaggaggagaggcataaacttagaggaaaaaaacacaactttcaaacacaccagaatgtaatataaaacagcagcaatgtattttgtttgtatcagggtatttaaatggcaaaggtattttaagaatgagtgattgatcactggtccctttcacctcttctggttttccgactttttagctctttcacttggactcaaattctgacctaccagcattctgcactagttttaaaaatatcctcttttaacatgttagcttaaaaatagcttggttttcaccattccagattatttttgagcagaagtctgctttttattgtagagtcacagatttccagaaaaaaaaaaacccttcctatctactgcattctttcatcctctgaggaaacaacagaaaggggagtttaacttgggtagcaccaaacctatgatggactgacttgccagtctgtatgtgctattgttggtctactccactctttccatttcccaggaaaatgtttccttcggctgttcaaatgaatccaactggaggcgtgtacaaacaggcagctgagagtatctctgccttaagaagcgacatcccttctttcggacccacacatcttcttttgataaccattcaacaaagtttcctcctgcctgtcggcttagccacctgcacggctgcacgctcccagaagcaacacgagctaggggacaggacgactagcgggtgtgggggtcggaggagagtgaacacggcaaatctaaacaaaatcagattctcgtcggttggtaactggggctgaagctccgaggaaccagccaagcgttggccccggctgcctggcacgatccgcggctgtcctacctgccccggggacactcaggaggcggaaagttccccctcctccgacgtcccaggcgcgaggccaggaaggcgaggggagcggcggccaggggcccaggccgaggggcgagcgggggaaaggagg

SEQ ID NO: 50555 - DNA, 1485 bp, Bovine  19866880941922
attagtaaaacaaatgatcgtcactgatttccctagttctgtaaaatcagcgtttttcccaggtgagaactgcgtccaggcaccgtcccaggctggataaagaaaggaaggtggctgaaaacagagtgtttttggtgaagcccggtcagcgcagccttgagacactcaccaccgcgtcactgtcgtacagctccaccaccactaagggtggggattctgccagctccttctggtctccatgcagcaccaggtcattgaacaggagcatctggttccaggtgggggagagggtctcaggaatgacctgtaaggtggggccaagagaaaagccaacactcactcgatcaagttggagggggctctgggaagggtaaagaggacacatccttaacatcattgctcacttgatcaacattcaagcaacaaaggaaattaatatactactaagtaccggatgctaggcatgcagactccctgccctggaggagcttacctaagtttcatgagtagtaccccacctgattgccaccctatttgcaaacacgagtgtaaaagtgaaagtcactcagttgtgtctgactcttttgtgaccccatgggacttgagcccgccaggctcctctgtcctgggattttccaagcaagaatactggagtgggctgccatttccttctcaagggatcttcctgatccagggattgaacccatgtctcttatgtttcctgcattggcaggcaggttctttaccactaggagaatttatatgaaaaaaagaaacataaaatatatcattaataatattttatattgattacctgtttaaataacagtttggacatcttggattgaataaatgtattattaatttcacctgcttattttttgcgtttggaaaagaccctgatgctgggaaagattgagggcaggaggagaaggggacaacagaggatgagatggttggatgccatcaccgactcgatggacttgggtttgggtggactctaggagctggtgatggacagggaggcctggcatgctgcggttcatggggtcgcaaagagtcggacacaaatgagcaactgaactaaactgaaaatgcagactataaaattctatacgtgactcacatttgtggctcacatatttctatccaataagactgcttgagatcattactgtcaagagaacacaaactatatgaaatcctgattataacaacaatatcagtgattttgctgacataatggcaagaaagataaattttacggagtaaatatgtgatcatttaagcattactcacatcttgttttttacatgattttgacactaatctattctaactttctcatgattctgatgttatcaagtcttttatggtagcatttgaggtgcaatttacatacagtgaaatgtcctcatttaagaatacagttggatgagtttggatccgtgtaaacacgcatattcccaacccttgtatctagat

SEQ ID NO: 50556 - DNA, 1281 bp, Bovine  19866880948415
acatggggtcgcagggagttggacacgactgagcaactgagcaggtacacacatcctatggatcacttcttgtttctgaaacacaccagacacttctattcccatccctttgcctcaccattcctgctgctctctctgcctgggatgcccctttcccattcctgtcttataaattcctactctaccccagcatctagcatagttagaagatgaataaatatttgctcagtgaataaatccctcaaaatccagtttctctctccccaacccccaccccattccttttctccctcccaccaccctccttcctctccctcagtcagacctgattcccccaggcagagcaattatttgcttgtctccccattaaaatgcaagcttctcatgtgcagacaccatgaatgacacagaaccttagcggttagtaaacatgagtaaaagtgaaaaacaagttggttgggaaaggtattattatctccatttaataatgactcttaggttttgaaaagtcccaaagaacttgcgaatcatcctggaaggttaagtaactcgcccatcacccagggccccagcagcctcattttctgacctgaatctgagccatcagatcacagttctccttggcatataagaaaaaggacttacttcacaaatcctaaagcacgttttccaacatctcagaaactgggatgtggttttctttcttaaatgatccttaaaataacaataatatattttataagcaacgtgtccttagatataagatctgtttatataactcaataacagggaaagctggaagcaacctgcacttggcagctgttgattaaagaagtgaagcacttttatgtaattgaataatacaaaataatgataaatatgtccataattatgattaattataaattgtgtgtgtatcaaggaaaaccactgtgatactttgctttactaacaaatctttgcttaaatctgattttttcttcttttttttttgatggcttaggtgcattttgaaaaacaattctgtattaatagccaccatttggccatctcatgcgaagagttgactcattggaaaagactctgatgctgggagggattgggggcaagaggagaaggggacaacagaggatgagatggctggatggcatcactgactcgatggacgtgagtctaagtgaactccaggagttggtgatggacagggaggcctggtgtgctgcgattcatggggatcgcaaagaatgggacacgactgagggactaatctgatctgatctg

SEQ ID NO: 50557 - DNA, 1582 bp, Bovine  19866880972436
cgcatgctcatacgcagtcacttcaggcgtgtctgactctttgcaaccctatggactgtagcctgccaggctcctctgtccatgggattctcgaggcaaaaatactggagtgggttgccatttcctcctctgtggaatcttcccgacccaaggactgaacctgtgtctcttgagtctcttgtattgcaggcagattctttactcactgagccacctgggaaacccatccaagactttcctgtctaaatagttgaccatgaatctaattaagtttttagagccaactgccaattacaggaaatataagacaaaaaagaataagttaaatgaaccacaaagaagcaaacaaaaatccagaatttggttgctgaaaacaactgattcagttttcataacatgccaatagtaaggagggagaggaaaaaagatgggaagagttgggggaaggaggctactgggaagaaccaatctagatttttcaagagtcttaagaaacattaatttgacatatggacattagttgaagcaaataactgtaaaaggacatttatattattctttcagaaaaaaaagttctgtcatttttgtctgataaagagttctttgggatatttataggaatggcattattgtggaaaggagcttatgctgtaaataagaaaacaaatacgaaactatacagtgagatgtgtacaataggacttaaataaaggatatacggctgggcttggtggaaaagtaattagtgcagcttgggggcagacagaaagcgtcgtgaatggatgacgccccgctgggtcgtgaagttggttggcaaaaaatgtgggacagatgctccaagagagatttgtgtaagcggagttaagaaagaatgaaagtgcacggtaggcaaagaaataataaacatctcaaacacttatgtggtcagagcttagtcgaagttttttgttcctatgcctgccatcacacttaagtggctgttgctagaatataaggtggagaaatggtggtatgtgagctgaacatattgaccagagggaaactctatttctgtgaagatgagatataatctaggttgagttattaataaatgataaatttgtttaaagagcttcaagggcactagtatgtgatactacgggatgggaaactataattttaaattgaattataccactattttaagaggatggtatttcggttagtggtacttttttaaaaaattgctcatcagggacttcccttggtggtccagtggttacaaatccacctgccgatgcagaggacacaggttcgatccctggtccgagaagatcccacttgcctcgaggtcactaggtctatgcaccccacttactgtacagtacactgaagagcagccctgcctggccactagagaaagcctggctggccgcaactagagaaagcctgcgcgcagtgatgaagacccagtgcaatccaaaataaataaaataaaactgctcatcattttttactcctgcttttttcatccagaacatagaaaatttaaatgaagattttaccccttacgaattttgtttgcacactgctgctgctgctg

SEQ ID NO: 50558 - DNA, 1775 bp, Bovine  19866881004024
cttctcagctgtgcaggattacaaattggaccttccttcctcagaggaggaaaaccatctcaagtttctggcattaaaaagcataaacaaatctctaggctctactaggacttgacttttttttccccccgttttcctgattttaaaatgcacacacatcctacaccaaatcccaagatgctgaatatagtcagcattctgaacctgctccatttactctgcagcatcagtcttttcagttgtgacttatgctccgactgtgattgtcaacttagtcaattaacttcagtcaaaccagatatttattttccattcttattcttatgaggtattgttattacataattattttagttatatgctcatggatccacttttcaagttggtcctgtttcatatacctattgcttatagacagaccctcccccaggttgagtggcttaaaacaactaactttgtatttgctcactattctgaaatctagactgggcttagctggggaaaccctctgctgattttgatggtggtcactcactagctgtattgagctgtgggttaacttggggctgggtggagttgatactctgggatgacagaatttctctcaggtcacttcacataccctctggcatgatcgtcagactccttatatggcagcatagaccctcatgagcaccgaacccaaagccatacttccccacaaggtggcacctgacatgctgccacttctgccacattccaccagttaaagctagtcataagcctagcccagattcagggaaagaagagcacacaagacggtgaatgccaggaggcattgtttcccgtggccactaatcaaacagactgcaatactttgctctctgatcctggatggctcacaatcctcccatattccaagacctctaggagtcgcatcctatgacagcaccagcctcaggctctaaggtcttttatctaatacaggttcaagtgtaggtgagactccctcaggtatattttcctttagatctgaaaacctgtgaacttaagagacaaacagtttttccccacatactggtaagaaagagatagggtgatcataatagatattcccattcaacacagaaaggaatggcaggcacatggtaattgctggcccacagtaattctgaactgctatattctgggcctatattatgaatttcacccctgctccagggacagttctgattcccaagttatattttcattgctcatctgtcttctaaatgatcctgtctctagacacttctgggtagaaaatgtacttgtcaggccttgtgtgccatgtctggttgcaagctcattagaagacatcaagtcttactctcttgttctcactacaacacccctgcatcttcacagtcctttgaggctctaagttttcctcctaacagcttccatccattggattaccctccttgtttgaccccacttctaccaatccggcattatcacggctgtaacccctcctggtcccttcagggctgaaggtggcttgactgccctgcatgtccagaactttcgctgggacgaagcagtaggtgtaaccatgtaattcaccaatgtgcagaaacacaatttaaaaagttgcgtgtgtgttcttctctttttcctaacacctcctttcatctgatgtttcccacctttccttggctatcatctaatcttccctgtaggctctgaacacatgcatcccaatctggtattcttttctttttcacctgcagtaccacctcagcagcatctgggtg

SEQ ID NO: 50559 - DNA, 3841 bp, Bovine  19866881011964
aaactgtttaatatgtaattgactagagatgagatgacccatccattaggttaaaggactaaagcttgtgagctcagccttggtaatattaccttgggagaaaggaaagaaaatacaggagaaaatgaattcctggtttcctgaaggagctgaaacaagatatcccaggactgcctctaaaaaatgaattaaatgtaattttaaaaaacctccactgtccattaagtgtatttaaagtacttaacattactttttctaagttaaccctggagagacggggagacatatagcaggcttgattgggattcatttgcctttagctgccttagcagctcctggtggaaccacagtctctttgaaatcaagtgaggttaattgacctttccgacccaaaagagcaaaggtcattgtgttaccacctgggctgagggagaaggaagctggggttttgtctgttggggaacatggacaactgtttccactgaaagcttagaagtgctcagaatagtaagatgcatgtggtcgttactgctttctgggcactcatgataaggagttgaagtcaaaggcctgggcttgaaattagaagtcatgctgagctgtaacagagaaaacgagatttggggaaaatagttaaaaaacaaaacaaaacaatctggtaaaggggtatgctttccacttgagatttcacagtggatacatgttattgtagttgctctcagattaagtgtctggggttcttgtggggaagaataattccaccagccaccttgtgtgtatgggaccccctgttttgttgtgttcacggaaagacgtattttgactaatgtgagggggtctctgagtcaggtgaatttttttgacttttgggtccccagtacttatcacactgccagactaatggtcaacccccactagatgcttatggttaaatgactgtgcatgacatgcctaactttatccatcttatctagccagagccatcctcaaaaatgactcaaggagtggacaaaacattttaagtccttttatattaatagttggacttccctggtggctcagacggtaaagtgtctgcctacaatgcgggagacctgggttcgatccctgggtcgggaagatcccctggagaaggaaatggcaatccactccagtactattgcctggaaaatcccatggacagaggagcctggtaggctacagcccatggggtcgcaaagagtcggacagttaccaggtcataaatggatgacttcagtttcctcatccccctctttgaaattatctcctggtcgctccataagtttctgtccataatgttcagatgtcaaagccatgctcacagcaaggcaggtttttgttttcctcattttgactttcacttgttaaaattaggtctgggaaacacctcactggctgctcaattgacaccaggtggagacagtaggtaaatgtttagacatcagtactgtttaacaaagttggagacttaagtgtaattttgtttttccttccccttatgaaaaagattaattatgtttatgtgatgctaaaattaaattttggtaatatgtgaaagtcagacagtttggaactcaaatggtgaatatatcaagattctgctctttatgatccgttgtgttatgaacaaatgtatccatttgtgaacaattttgttaattagaacttcttagcgagtgagtgttctgccaccgtcggccactctggtgctggcagtgggtctcagggactttggaggacaaagatgatttcatctgtagctgagatcaaagaagacagagataaggttgccagggaaacaaaaatactgcagaattaatgtgctactcatgcatttcaatgtggtttgtggtttgggagctcccgcccacacacacacacaaatgatgatacatatgtggaaaggggtgatgcccatgtgcctaggtcttcaaggaaatgaccccaggcttagtatagctcaaactgtgggcctcaggggatcatattctgtgccctgtttctgtgtgctcgagcatcagctactaatggtgtccttccagttggttttcatgaaaatacactgtgggatctctctttcagtactttctctccatcccacacacacacttcacaaaccttttttttaagcttatactttatttatagttattataaaatattgcctatatagccatgttatacaataaatgtacccctgtggcttatgtaaatagtttgcacttctgaatcttctacccctatattgcccccccttctctctcccacaaacttagtaacgttcttcttgatttttaaaataaattctttgtacagaattttaaaaacaggaagcagtcttcctcttacaaatgtataaaaataacctgtaatttcaccatctggaaatacctaacataatattttgttgtacttctaatattttccataaatatggatatacatatatacatgcatatgtgtataatttaactgtgtgaatgcatactattttaaatatatttatatattacatataaagtctctaagtttggggcacaggttttaatttttaaattatatatattgtgataattctgggccacagaaacattaacacatgtgaacatacaactgtttctgtagccatttcctggctgttagttgtatccttcttgtttctagggatccggtattataaatgatgccacagcaagcattcctgggcatctttctgcgtatcttatttccctaggttagagtcctaaggttgaattactgagtcagggcacaagcatttttaaggcttttgttctgtaatgccagatacttcttttggaaggatttggcaagatacctccctactggatggtgggtgagctgtctgaataggttttactatccccatttcacagatgagtacactgaggcttagagaaacagaggctgatgactgttttcatattttctttaagttacagtgaagacaagtaaggctgcctaaagagattcatatttccagattgggtgggttaatgcatatgttactagctgagaaaatattggctattttaaagcttagtgagacccacatgggttgttggaagaagacgggaattagctgaaactgtcggagaagggtaagctgcctttggctactgtttaaaattgagatgtttttctccccagaatgtagtgtcccctcccaaggtgttttgggtgtgtctcattagcactttgaacttttgtttaagaaaagtctacagagttggtgaaagccttatttgcagtggttgattcattaaaaaaaaaacttaagatgtgttgagctcagggctttcccttctgcctgtgttttcattcatatcacttccaccacggaaagtatgtgttccgcacctgtttcatttcagagcttaagcatccttccagttaactgtgcattttatgcaatgctaagtacttgaaaccaagccacatggttgtccttctggaactactttccgtttcagacttgctgtttattgacaacgaaaggtgaataatttatcttttcactgaatttagttgtctgtactttaatctgccctttggaaaaaagtcacatgcattctatgtatcctcattctcaataactacaattggaaggaagagggaaaaaagatctgtccaccagtgagccagttcttttgtttaacatctggaactgatactttcttttattttctttttgaaggtgcagatgatttgtttaaattaatagatttaacctgtttactagatacaaaataaatatgcaaaaatcaagtgaatttctgtattccagcaaacaatagaaaaa

SEQ ID NO: 50560 - DNA, 964 bp, Bovine  19866881013364
taggataacctcctgattttaaagtcagctgacatccaacagtcgtaattcccctttgccaggaagcctatggaatccatagtcagagatcctgggattaggacatggacattggagggggaggcactattttatcacccccaccagttaggtgtattactttaggcgttacttatcttgcctaaattctcctttcctcatgtgtaaacagtatgaatacgtatccacatgttgctgaggtgctctaagaattaaatgaaacaattactcatcgagtacttagaaccataccttcttccttcttctccaggttgctcagttgtgtccgactctttgctgccccatgggactatacagtccatagaattctccaggccggagtactggaatgggtagcctttcccttctccaggggatcttcccaacccagtgatcaaacccaggtttcccgcagtgcaggcagattctttcccagctgagccacaagggaagcccatacctttgcatatagtaaatgttcagtctttgttgtgcactctttccttcctctaaaaccaataagtacccaacgtagaattccaaagcctatatcctgaaccttaatgtccttagctgtgatgtcctggaacatcgaggcctctgctcggagtctgccgtgtgcagagtcacgtgttcctctccggcactctgggctacccccgcacaccatcctcgaggtttttggcactcagcagtgattgttctgggaaggaagtgctcttctggtgtccccttggggggacaattgaatcactgagtgtgggcctggcaaatggttcattcttctaagaacagcgacagatatccaagaggaaagagcactgagagcccagagacctgctctgaacacaaacgaaaataaaagtgatatttactattccaggtgccctcacacttctgatgtcacttaagcctcataattggg

SEQ ID NO: 50561 - DNA, 2586 bp, Bovine  19866881064935
gtctccttggatgggacaggagaggcatcacattttaattgaagacaaggtttaaagctcaagagaagtacttgcctattgggtgaaatagaaggtatcagggagtgggtagaaaagactctagggtccttcttgatatccttgaaattacaatcctaagtaggaccctgcagtagtcctggaggtacaaggttgaaaaacaaatagttcctttcttcaaggaccttatgaaaaataatatctctgacacattgaataagccccttctgcttttgatttgacatacattattcatgactctgaaatgtaggttcttttgcccctgttttagaagaggttcagagagggtaagtgcttgctcaaggttacacaaccaatagatggagaaactggcttctgaggctgggttcgtcttacaccagagcccaggctttcctaccccccgggtcagcctccagtgaggagccctcactgactgtgcagcagggaaagaataagctggtggagatttagggcagctgaccacaggcatttcagaggacctggctcccatggctcattctaattagagtcttcaacccacaaagcaaacagggcaaagaggaatcaggcctctcctggaaagtaaatagcgtccatcctgctgaccagggcctcaccctgcagattgacaaaacagagtctacggaactgagtacaagttggtctttctttcttggcatgactgggggaagttagggcttctctgggtgaaacgtttagagattctcaaagtctgtggctcttacatctgtgtattttgagacctaatggctatgccttaattttgtaaaataccagttacctgggcttcccaggtggctcagtggtaaagaacctgcctgccaatggaggagacataagagacgtggatctgatccccgggtcagaagaaaaccctggaagaggaaatgactaccctctccagtactcttgcctgcgaaatcccatggagagaggagcctggaaggctgcaatccatggggtctcaaagagcagggacacaactgagcttgtaacataagcacgtacccattaattagttacccaatgagtagttgttgggtaccttccacgatcatcattcatttaacaaatattaatggcatgtcttctaagtgttgggtgttgtgccagattctgggtatacgatggtgacactggataggttagagggaggacagtcctgtgggggactcttccgtttggccctccagatctattctccacccttgttggtctgttctctgtcctaggaggctgacccccctggatgcaccacccaggtcgctttcccagtggtgcaccccagcacgaggtctgggagagggaggtcaggacgtgtccccaactggatgatggttgacccccttctagggcagcccatgggacccaacctcctctctcctcaggtcctagtaactattctctctcctcatctggagggtctccgagtggcatcagcttggctgccatgagctccagataactctacaaccctttgtggtttttctacacccacacctttgtaaaaagtcctcagaacatcctgtcctggttgggccatctgttatccatgggggccctgatgagaaaactgtattacaagtggagaaaaagtgctggaaagaaaacagactgtgtgcctaaggggagtctattggaggatttcttttagtgtggttcgagaggggctccatcggcgggggaaatatttaagttacaacatcgaggatgagtgggagcctgccagggcagtgagagcaactcaggtggagcagcctgtgaagaaaaactccaagcaggaggtggcttgttagaagggatgggagtgagtaactagaaagcaatgagggcaggaccagaggagcaggtgggccaggaggagatggcagtcaggtaggtagggaattagagtcaatggcacccaactccactactcttgcctggaaaatcccatgggtggaggagcctggtaggctgcagtccatggggttgcgaagagtcggacacaactgagagacttccctttcatttttcactttcacgcattggagaaagaaatggcaacccactccagtgttcttgcctggagaatcccagggacatgggagcctggtgggctgccgtctgtggggtcacacagagtcggacacgactgaagcgacttagcagcagcagcagcagcggacttcagacatattctaagtgcaaatttccaaaagaggggttttcaaaagagaaacataatcttttttttttttaaaaagaaggttacagtggatgctgcttggttacttgattggtaggacacagtatttcagtgactgaatgaatgagggagtgaatgaatgaatgagggagtgaatgaatgaatgagggagtgaatgaatgaatgagggagtgaatgaatggatgactgagtgagtgaatgaatgagtgagtgaatgaatgttggctatggatgaagcttcagctgactgccttcccacctccaggtcggtctcaccctcctgcatataaacccctacagagaagggtccatgt

SEQ ID NO: 50562 - DNA, 1307 bp, Bovine  19866881136639
tgcttacaggactgaacccttctaatattcagacctcagccccaaattctcagagaggtcgttcctgaattctcagtctaatgttctctcttgtcctgctatcatgggaggttttggagttttttgttttgttttgtttttaccttaaaaatagcttattactaaaattctaaccatcatctgagtcttcagctagtcagaatctttttgatggtggtacactctgcccgctttatccccctggaaaaagtgcaggcgaagcttccacttgggaaagaactgcttgacaactgtcctctgtgtccccaacaggctgacctctccccccatattttgtttttatctctattgtttatggtttgtttgcttatgttttgctcctgctggaccatgcatttctactggagacatggagaatcctactgagatgacatgaataatatggggcaataatggcacggttacacttggcctggatcagtggttttcaaagttctggttgcatcccaagtgcttgttagagaggtgtactttaatccccagtccacatagtctcattcattttgaggctgggagatctgcattttaacaaccctggtgtccctgatgcaataggtcaggtgactccattttacaaaatacagtctgggttcctccagtctcctctgtcctcttactactttgggctgattccctccagcaaaggaagagcctaggatggtatttggtgaaattcaaatcagggggacacatttgggtaaaatgtcctgtcctaaaagtcaaaggcacaggctaaaattataaatatttgttgatgttatttatacccgcttgctctgatttacttttccactaacagtaaagaactggccgtatttaaaggtgtgctggttgacttttttttttcaaggcacactgtgaataactcctcaaagctagaagaattcatgcatttgataattgaattgtgaggagcttatctgtcagctgcatggtgtttccgcagtcttcctgttctgggcaataaatccatcgttattgaaggcaagagctgttcattagttatgttcatacagtccagttggaagccccagattatccaaactgacagtaattacaatagctgggttgcacagtggtaaagaatctgcctgccaatgcctgagatgcaggaaacccaggaaatactgattcaatccctgggtggggaagatccccagagtaggaaatagcaaccctctccagtattcttgccggaaaattccaggccagaggagcctccggtaggctaccatccaggggtcaca

SEQ ID NO: 50563 - DNA, 810 bp, Bovine  19866881176558
tatgaaacgagatgccagtccaggttcaatgcacgatactggatgcttggggctagtgcactgggacaacccagagggatggtatggggagggaggagggttcaggatggggagcacatgtatacctgtgatggattcattttgatatttggcaaaactaatacaattatgtaaagtttaaaaataaaataaaatgaaaaaatatataaggacatagctcagttttgaaactaaaatatttgcttgacataccactttttaggaaccttttggtgtgtgttaaatttgtaaaataaaggaattgcaaaataactgcattattttgggtttgctcttatgaacttgtatcagttcagttcagttcagtctctcagtcatgtccgactctgtgcgatcccatgaaccgcagcacggcaggcctccctgtccatcaccaactcccagagtccacccaaacccatgtccattgagtcggtgatggaatccaaccatctcatcctctgtcatccccttctcctcctgccttcaatcccttccagcatcagggtcttttcaaatgagtcagctcttctcatcagatggccaaaatattggagtttcagcttcaacatcagtccctccaatgaacacccaggactgatctcctttacgatggactggttggatcttcttgcagtccgagggactctcaagagtcttctccaacaccacagttcaaaagcatcaattcttcaacgctcagccttctttatagtccaactctcacatccataaataaccatggaaaaaccatagcctgactagacggac

SEQ ID NO: 50564 - DNA, 1419 bp, Bovine  19866881220437
ccctttttggtggttcctgctcaggtgttattcctagcagcctgggtggggtttggggcttgtggagtttggtgggagggaaaatctgttgaagtgggaggtgccagcatccatgaagtgtacacagagctgtaaggttcttttcataggcatttttattgctggtgagcttgggtaggtgggtgagggtgggcgtgtaaggaggcaaccgctgattatccgcaaggctgtcatccacttgaggacaggggtaattcgtggattaggcaagctccaatcagaaaataaaagcccaggaatggttttatggtggaggggtttacgcagctcctttcatcagaggaccttgggagcccttcatcttgctggatggggtggggaaaggtggctttggggacaaagctgtgacaggtacccacttctggaagtcgaagattcctgcctcatgctttaagaagcgtggagtccagtggtgctcctgctttggtcagaaacttcctcttgaagctttgtttttgtttccctgaaggctgaactcacctaggggtgtccctggaagaaggggagggatgctgtggactgtacccctcacactcaccctggggagggacctggtggcggggctggggatggaaacctggagagatgctcggacaggctcccccacctcctggtagaagccaatcagttccagtgtccacaggaaacctgaagatatgacagaatcagccataatcacaccgctgatggtggtgactcaacatttccagtgtgtgtctatctggtgtgtgatgttttctgcacaaagggcttttcttttatgttttctttttcacatggttctggatcctgaccatttctaaggtgacattacagctcgcccagatcctttgcagttgtaatcgggggttatttgtttggggagcccttgctcgccattctactttatctggttttcttattgttgttcagtcggtaagttgtatcctattctttgtgacctcatggactgcagcatgcctggcttccctgcctttgacaatctcccagagtttgctcaaacccacgtccattgagtcggtgatgccatccaaccatctcatcctctgtcgtccccttctcctcctgccttcagtctttgccagcatcaggtcttttccaatgagtcggctcttcgcatcaggtggccaaagtattagagctttagcagcagtccttccaatgaatattcagggttgatttccttgaggactgactggtttgatctccttgctgtccaagggactctcaagagtcttctctagcaccacagttcaaaagcatcaattctttggcttctactgaacccagatataaagcaggatccagcctgcctactgggcttcctgcagcctagggccaggtctgtgtatcttgctg

SEQ ID NO: 50565 - DNA, 591 bp, Bovine  19866881345706
gcttagtgactaacgacaacaggcagatgtggagcaaaagcccgggctggggggtcagtcctcacgtcataacatccgggcacctgagaggtgtaaaaggcatggcatccccgagccaggcacgcagcccgtgcaccacacacatgccaacgtcagggtcctgggagcctcacggtccagcgggtctgggtctcactgggtgtcacgcttcctttccagggcttggaagcctctgtgtgggcgcagctttggggggaaaaaataaccctaactctgcttctctcatccttcccttttctgtgtacacatctgtctctctctctctgttgcgtgaccttcctcccccctgcccccaccctcccccatctttttattttttacggatgttcttttttggtggcacgtggtcccctcgtgtggtccctcccctgctgcagaactcgtccagctcggcctcctccgaagcctcggaaacctgccagtcggtgagcgagtgcagctcgcccacctcggtcagctcaggctccaccatgggcgcctgggcgtccacggagaaggtgaccggctggggtcccagcctctcccccaaca

SEQ ID NO: 50566 - DNA, 1584 bp, Bovine  19866881361345
catgccctgctttacccctgctgtatcccacagcccaaggctcccaatgtgaaactggcatccaatgatttgcttaaggaatgctccttgtcaaaagcctccagtgaacctccactctatacacagtaaaattaaactcagcaacacattcaattcccaagtcagctttccaatcctagctcacaatatccgtgccctcccctcgcccccgccccccacctttcctgagtgcgtggtactaaatgcgcgtactcctttagttcctgtcgaattcttcctctcttgttctaccgatgctgaaaggttagtgtacttgccaagtacagaacttgtttctcttcccattgtcctccagtttccccaccagatggtgatgccagcagattaaggacagatctgtgttcctaggacgatgcctggcccaccagaggcgctcagtaaatgttatatgaactatgatacgaatacagtgagtgaacacgtccctcgaagccatacccgtcctcctctccgccaaacaagcgggaaggggtggaaggtgcacgtaggctagaagcgaatacaaagtctggctttgagttttttagtggttgttctttttttctttttattgaatacaacaacatattggaaagagcacaagtcataactgcgaagttcgtcaattttcacaaataagtacaccggtgaagccagcacccagactgagcaccagaacattaccagcacccagaggcctccccgcgccctcttgcgcggagtgcacgttcaacccggcaaagagctggagagctcacgtcctgtgccctctagcagcggtgcgcgatgcccgggaatcgaaatgccccaaatcctggcaaactcttacccacgaatttgaaacgactcatgactgcagccccaggttctcctcggcggaagcggaaaaggccctctatcgccccgccccctcgccgctgacatccggtttcccgggagcccccagggccgctgaaggtgagccggccatcatggcatttttgtcgtcgggggcctatctgacccaccagcagaaggtgctgcggctttataagcgggcgctgcgacacctggaatcatggtgcatccacaggtgggagatggggacccagagtgcggggaggtgaccccggggggctcccacagaggccgagaggccctggtaccgggcggctcaaggacttcggggacggggtgggaacgcagctcctcgcccccaaagcccgcctctagacccgggttcgaatgcggaattcatcgcccacatctgggagaccttgaagacttgtttatctggctcgggcctcggtttcctaatcaggaaaacggacgcggtacccacgcagagggttgcataacaagagaaagaaagtaccacagatggactgtgttgtgcctccagcgctcactcaataatagcttccttcgtgaccgcgttcctaatattggcagtcataacaagtgcgttcttttctttagttctcgcacctctgggagttagggatgatttagccttattttatagatgcgaaaaggcaagagaataacttgctcaaggccctacag

SEQ ID NO: 50567 - DNA, 772 bp, Bovine  19866881418291
agtttcttgaatgtgaaaattttaccagaatccttcctccctaagtcttcatccttccaccacaatcttctcactttcctcatttatgtccgtaagtttgccttctcttagctcttctggctaagtatctggagtctctcaaatggcaggagttcaacagcagtatgaatattcccaatgtcagctatttcttctataacctcatttacatttgattaaaatatcacatcagcattaccacttttaatttctttgttgcattttcaccctttttttggtcaattctcttttgattatcttttttttttacatgtgaagcatgggacagttggaaggtcaaaaataaaagtaataaactgtaacctattaaacaataagaatttatgaacatatattgatatgaattcataacttgaatagttgatgaggactggggtatttcatagactcaaagtacctccccacaaaatactaaccacaaaagggaaacagaaactctacagtggataaatcagactgatactacttagttcagtgttcaaaggacatggttaaccaaagaagtggttaatatcatcaggaataaataaaaatcatgagcaactgacaggatggaaaaaagaacataaaattacttctgtgatattcttgcctaagatgcttaactggaaggtattcatgaggaaagagaccaaaccaaattgaagtactgctacaacataactagactataatcctcaaaagtatcaacgtatcaaaggcaagggaaaga

SEQ ID NO: 50568 - DNA, 1125 bp, Bovine  19866881429167
ttggtgctaagcttcggctacatagtcttatgctttaatacataactgcattggatgtgaaagaaaccatacctgtatagtcactgttctatatattaacatttaacactgctgtgatcgctcaaggacattttatgttatggctttaaagcaaaggcatgattattagaaactatttaaactttttttctttgaaaaacaagctccttttacagaatataagcaacagtagtgcctgtggtttagcccaccaatcttgatgactaaaagtagctgatgcattgtgcatatgatgcttgagatggtttttgcaaaagcagaaatcactgcaaggtaattacgttagataaaagtggtattttaaacctttgaaataaatggatgtaactgtaccttggtacagcttttcacttgtttagtttttaaacgttagtataatctgaataaatgtaatataaaatgttgccaaattcaatgtagaaagaatgtgacaaaacaccttgggtagttctgtttgtgtttttgcatattgtaaaagcagtgtcacagctaaaaataaagaaattgtttctaaaggtaaattattgtggtttagttgctggtttgtactgagagttgacctctccctgtgcagttttttgttctaaacttgtataaataacaactgtgtgacgcgtctcccttctaccttgtaacagttgcttcagcctacattataaataaagaaccactagaaaaaaagccctgcatttcaagtcttattaaaatttaggctgaggtcttggtcaaatgttagaagatgggctgaaacatttctgtgcaccctaagaacatttagttgcctgacctaagtgttaggttccagtgagtttaatgttaacagctccagtgagttactaagaactgcaactagcagggttcggttaatttctaaaacggctttacctttaggaagaaaaccaaaacacttcatttcgtttttgccgcccttacctttgtgtctgcagacaatccaagctccagtagagggagcaaagctgggaaactgcctttgaaatgactgtcacaaaagtgccgttcagatcaaacactttaaccccagacaccaaactccaatcctagaac

SEQ ID NO: 50569 - DNA, 3064 bp, Bovine  19866880350458
gcctgttgtgctaacaatgcctgctccttcatttttcattaactggattagtggtaggggtagggggaaactagaaacaaagaaggatatgtgactctcttagagcacaattgtgagtcagtcaggtccacacatcttctgagagaactccatcaacatagaaatcagttaacacatgtttagtgctctttggtataactggaatagtttaccattgcatttggtttaatatattaaataaacatttaattttaattaaattctctttacttttatcttagaagaccaaatgccaagtaaattttctttagggaaaaatcaatcttacatttattcccagttctctaaactcccaagtcgcctgacctatatttcttagatctgaactctttgaaagtacttatattttccaaaatgaagattgaaagattgactccatgactgggaaccactcttaactgcatccaatttatcttccttggagctgctggactttttttttttgacccaaactaggtcatatttttccttttcttaaaacttttctatggtttcccaatactcttgcaataaaatctaacctttcaaccttgacctataagatatagtgtgacctggtcgctgcttgccatcagtcttacaccactgtctctcactcctgtgtcattgtcaccctggtcttctgagaatatagcaagctcttttgagcctctgagctttaatgcttctggcttcatctgctctgaagtacttgctcttccttgattccacccattgctgctgctttcattatttaggtcagagcttaaaggccttcccttcatggatgccttttcttcactctacttaaagtagatggcagaatttccttctccctattttcagagaaaaattgtgctgcgaaattaaacagacaaagaagacttgttcaagactattgcaataaaggagagagattgaactccattgaaacaaaaagcagggaagtgtttaagttcggaggtgagctaatggatagcttttggaggaaatttggtgagaagggttgtcaggccagctgtgttcactgggtgaagttaggctcctaccctccaacagagcctggaagatagggtatctatttttcttgatcattgcagttcaaagggatacccccggtccttgatgaagacatccttgggttgtaaagctggtcagaggctgcgagaagattttcatctcaaagggactgagaaagaattgcaattacaagttttctaaagtaaatcttctaaggaaagggaattcagctaactatagtcagaaggaaactggtctaaagcttggttaagaagaggggaatgttcagtgttggtcaccaatatgccttatcacagcattccagttattttcttcatagcattttaaaagtagttaattattgaattattttctgtctattccactaaaaatacatgaaaggagggactttgttatatcctcaattccttggacagtgcctagaacacagtaagtactcaagaaattttatttaatgtataagtgaatgagtgtaggcatagaggcaagtggggtcttatagagatattctgtacatattaatgttattaacaactgggtcagcagctagacttctttgtgtgcttatgtatgtccatggtacaagaatactgaaaatctgaattaatgactactaatttgaaatttgcttaaatgaaaaccgatgaataagtattaaagcacattgagtgggaacaataatacaacagtacatttaattacttcatgtcattcctttatgtgctgctccatattcttccatggcagatttgctgctaaagtgagaccttatactttttatatccatggtaaacatgtccattccaggactcagagaatgttaacataatcaaatacaattaagaaagattcactctataagaattcttaatattagagctaagacccttaaagaacttgggttcattccagattcgtgaaatcatcaaggcatcagtgtgactgtcataattaactaaatcacaacatccaagttgtaatatattcattttatgcaaatgcatcagtaaagagcaaaatgctacagtactggaaaatcatgtttttcatgaaaaacaaggatgactcattaggcatgcatcccacaaagtctgttttgtattcagaaagccaagaaaatatagatcaaatctaatttctgaaaatgttattagaaacactggttctggatgactgacttttgaaagctgagataatcaatcagaaaatgatgacatccttttcttcaggttaattgtactctcaattgccttcaaaagatcatgattctatggtaatgaggtaaagctaatgttcaaaaatttagaccacttaagtgaagtttttaacaaaaaatgccagtaaagagtaatatgtacttttacaccagacaacttttatgcatcgttttttccttaaacatacactatgtttgattgagaagtgaagcacagcctttaagatcttaaaagcttcaattaaaagaagttaaagtcacataattgcttaagaatatacaaagtgatttacttctaatggaaggcacagaattttatgaggtatattcaattatgttttaaacctgaaaaaaaatttacaggtttaaatttacatattttcctttaaatatccaaacacatactagtaccctggttattctagactctattctttttatcttttttctttatacagttttgctagtagatctcacccctcccttagtttgggagccatctgggcacatattttttgtttttgctcttatcagaatataaatcacaccatttgcaaggcacaacaaatcagatcaaaatatgacaaacaggaattctggcatcaggaagtaaatctacttgttctgcagggtctccttagatatgagggagttgaaggaatggatgggatatctgggaagttagacagcagacaccatgtgaaaatcaaagtaggcaatggcatacaaaaaggaaaagggtaggtacaggggcagcaaatcagggat

SEQ ID NO: 50570 - DNA, 1306 bp, Bovine  19866880507625
atcctaactcactcatgtgaccttagacaaattatttaaccatgcctcagtttcgcatctgtatcaggggataataatagtatctgcctcacaggattattttagggactaaagggatctacattgattaatgtgtagaatagctcctgacacacattagttactatataagcatttattaaatataaatcaatcaaagtcttaccccatgtatcatgaaaacatgctttctaagaaaatcttttttttccatgagaaatattttttttaccctcccataaggcaagatagtcctgactttaaattttcttatgcaacttaaatgttatctgatcagctaatcccatatctttgagagttctagacactgaccagtatggagcattttatatatcacttcatttaatcaacaatggaaatcctacaaaagactggtgatttccctattacaaatgagaaaactcaggtttaatgaagttagattaatttgcacaaattcactgagttggtaagtggcagagatgggtcagcagatgacatctccaaagtcaatgtttttaatcagtccattaccatcaacaaaatactacattaaaagataatttcacaggacttgcctggtggtacagtggctaagatttcacactctcaatgctgggggccccagttcaatctctggtcagggacttagatcccacatgtcacagctaagagcatggtgcaacaaagaccaaagatcctgtatgctgcaactaagatccagcacagccaaacaaaattttttttaaaagagagaatgtcacaactcttcaaaactataaatttgttccatccaggtactcttagcctgctcctggaaccccagcaatgtaaaatttgaatttgtcagtgcctgcgggcgtggttcctctgcttcctgaacaccacagacttgtgtatgtgattgattctcacagattactaaggttctttggtggaaatcaagcctacattggcagcaggctctagatggtgcctggaaccatatgaaaaatgatcttttgcagcttgcccatacatgtctgtaaaattctggcactggagcgttcagacgcagcaggagttttttctgaagccactgaacagctttgaaaagtgcagtttatctcatcctgttagcctaatgattagtcagttctaatgcagcagtctcagtgatgaatgtcctattactgatgggaaatactgactaactctgggatggccttttttaattctgaagctccaataaaatgtctccactcacttggctgggctcaatcactaa

SEQ ID NO: 50571 - DNA, 1553 bp, Bovine  19866880602275
caatctgacttgcttttctgaaactgctctctccaaggttgctaatgatttccttaccaccagatccaataatatcttctagcccctcatccttttaaaacctcctagatataatttatactgatgaccactccctccttgaaattcttttctccctcggggtctgtggcacatggtgcttcttcctttcattttcttctagctctggttcttccatgttccttcttgtttcctaaacgtaggcattctttttgctttttagtttgttcacaaagagaagaatgggcatgtttgtttacttatttaacctcaactttatctatcaatgggcttccctgggggctcagacagtaaagaatctgcctgcaatgcagagacccaggtttgatccctggtttgggaagatcccctggagaaggaaatggctacccactccagtattcttacctggagaattccatggacagaggaacctggcacacagggtcacaaagagctggacacaactgatcaacactttatctctcaagagtctcacttggcaatgttattcaacagttaacctacttccaccatcacctacctgtaagtgcttcctgaatctgcagtcttcatttccaattgcatatatgacatcagcatttaaatgttccaccagcatttcacattcaatctgtctaaaattaactcattatcttccttaccaaaccaggcccctcttttttaacttcagctcccccacgttagggcttccctgatgtttcagtgggtaaagaaaccacctgaaagtcaggagacctgggttcgatccctgagttggaaagatcccctggagaagggaatggcaacccactccagtatccttgcctggagaatcccatggacagaggagcctgcggggggctacagtagtccatgggttgctgagtcagcaggactgagccactaacactttcactttccccctagttaatggcatctcctgaagctgaaactccagtactttggccacctcatgcgaagagttgattcactggaaaagactctcatgctgggagggattgggggcaggaggagaaggggacaacagaggatgagatggctggatggcatcaccgactcgatggacgtgagtttgagtgaactccgggagttggtgatgacagggaggcctggtgtgctgcgattcatggggtctcaaagagtcgaacacgactgagtgactaactgaactgaactgaactgaacctctcagttatccaagctccaaaccttagagtcaattcttattcctcaatttcctttgcttacctacctaatcatttgattttaaaaaagaaaaatacagcttctacctcctcttaccccggatctatccctttgtctctgttcattctacctcctctacttctaaccagttcaggcttcccctacattgatgcaacctgctgtacatcaatcctatctcttaatgtttcatttcttgcaagatctagcatagtgatttctacagagtaacctcaacaaatgtttgttaaatgaattaaataaag

SEQ ID NO: 50572 - DNA, 2652 bp, Bovine  19866880657915
cctggatattaaattgggaagaaaggtcttagagatgataactttaaatttttaaatatattaacactttgtagcctgttttgtgacagagtaaagagaaaaatctgacaaatgaatttcttttatcattttgaaaagaaacatgacatagtcttaatcctttaaaattcctttaaattataaagaaatttcactgaggtattcacaattatgattattcaaaattccagaggtatgatttttaaaatctagtggcaatcttttcggtatagtatattctttcataattttgttcctcaagcagaattcccaaagccctaactttcagtaacttagatgtcagtatgaaaaaggtcattttttttgccacagattaggaggtgaaaaccatttttaaaatagaaatgcatactctccctttctgttggtcacttgttctaggttagtgacttttttaaaataatctattaaaaaatccttctgtacaaaaatccatagtgagagtcattcttatcaagataacttccagaaattttatggaagcttctttttcatatatagctttagattttagtaacagttggggctgttatatacacatttttaaatgtttagtgacagctttagaatggagagagagtgctttaaatgaatgactgcaaaatctttagaaatttatcctagcctattattctctgcatttgggaaggattgtttacttcctgacacacattttcacataatgcatagaatgaaaattctgcatttgtctatcatgagattgtgcatttggcaaaaatctgaaatgtctgattaatttttaaaagaagataattgctacttgaaataaaattatatatatttattataagaaccaaattaaacagattgcatcagtcttcctaatccactgatcaatatagtaaatataatatgccagagcttgaaaatttctacatttcttcaaacttttagagtccttcaagtgcaatgtacatagtattttgctgtttgctttgtctctttactcttaacctgacaaccaatttttctaagtttggtgatataaggaatcaaaaagaaattagctatgaacaaataatgttttgatctgaacaactgaagtgataattttatatctgagaatttgtagatgatataaagcttttgactattactgtattaaacatactttaaaaaaaaccctgttggtggaagattcagacttcaatgttttctccagtggggttaatgaactaaatggaaaatatctcattaatttcttaaaccccccttgtgaggcaagaaaatgacattctcgtctaacagctggaaaaaccgaactagtagatggaactgcactcaactgcaaaggaaaatagtagctttaatataccctgagttgtggatatgaaagaatactgcatacatgcagtattccctcccttatttttaaggaatcaatacctgcttcttacaatttaaggaaagttaaactcttggaacttggccgtatacctttttgcaaagtaaattattgtttcaaagccaggctgtgcagttaccctttaaatttacttttaaaaagtttttccctaatccatacaacctaagattgtacatatcatagattttcagcaaacttatttgtcacttatcctatagcttttttaaaactgtaaaaattcaggaaataataactcttttgcaatgtacattgggacagtaattgggaagtaacaacaaattgaattgatttgtagttctgcagaaatgaatttgacatttcacttacaagttgcaaaccaatgtatagttttaaacacttctgaatttccttgttttgcgaaaaagtagaatgttttcactagaatggaaatgccctcaagttatttccagtactgctgtagaattgatttttctagtttaagggaatgccaaagttaggacatatatatatatatatatacacacacatatatatacacacacacacacatatatatacatacatatatattaatcattatctatttttcttaactgggtttaggacatggcaaaacaaatcaggaaactataactttgtttcaatattaccaacatagggctttgtgtaatgactgtgacatcatgacagtgaagtattcaattttaagctttaaaccagagaaagctttaccttggtatgtccaatagaaatacaatatgcaaattaacccatattatctgtatgctgattggcttgagttcccccgaatgtcacaatctcaccacccagcaatgaggtattttactgctgtctggagatcaaattattgctgtacagaagatctttattttttctgtttcattaacagattattataaagcaataagcatgcaggaggagaagcagaccttttaccttgggaattaatgaaagcatttctgatcatttttttggaggtggggaattgtttaaaatcttataccacccccacaaattcttctgaaatggtaaaataaggaaatgtatgattccagagacacgcttaactaccaggtgtcaggctatgtgctgtctcgtgatatcatcggaccttttgaacgggtgtaagttttatgaatcgttatattcctagtatttttcttccgtaaaacaaaggggag

SEQ ID NO: 50573 - DNA, 1229 bp, Bovine  19866880701304
gacacaaacttaccaaagggtaaagggatggagaagggacaaattaggagtatgggattaacagatacataccactatatatgaaatagataaacaaggatttattgtataaaatagggaactatatttgatatttgatataatatcctatactggaaaagaatctaaatacacacacacacacacacccctattcactttgcggtacatctgagactaactcaatattgtaaatccactatacattagttaggaaaactcattatagaacagactatcagaataactttgatatttttggtctcaaatttttatagcaaaactttttacaaatatataaaaggggtgtagaactatattaaacccttggcattttcagaatatttgtggtattctctgcattcattttcacaaaatccacatcatatgggtttaaattaagataataaatgcactgcagtctataaagttgtgaggattaaatgacatatagtagagcactgagcaagactttaaatgtcagaggctgaaagtctgcagttcagtcttctattagggaagaacccactgacgggatccactaattgaattaatgattggctccattgtaaagattcttcaagacttcctgcatatactagaattcctccaaatgtgcttctgtgcctttgatgatagaaaactttttgccctcaatttgaacaattgaagagagacagcacattggttagaaattagatttctcagccagaccacctagatgggatccttctgtttcctactgaaggatcctagtgatttatcatagccctctgcctcattttctctttcctgaaatattgataacaacagtacctccttcacatgattgttgaaagaaatcaatgagttaacatataccaaggcttacaacagaggttggctatgttagctatcctctaggggtaaagtaaaaaatatctcccaaatcaatctggtttctggacatttatttttaactcagttgcagtaatggcaaagctagccttaacagttttgtcacacctccaactataaacaaactatcaaaagcatgtttgaaacctagttttctacttttaaaaaatatggctctctattaaaagcaaaaaagagctattccaaacaactctaaaaagctcaatggattatttactgagactaggaattgacattttaaaaccattggaaaactaatgttttggctcatt

SEQ ID NO: 50574 - DNA, 2858 bp, Bovine  19866880738001
ggatctgtttatgggcctggcaacgaggtcggattctcattcttattcaacaaatgtgtatgaagtactctaaatgatattgaattctctccatatgttctaccccccaattacctatgaataattctcataggttcaattatgtctaatgctggtagtcccaggtgtctgacttaactcagatctcctccactctagactagcatataactgtttacttgatatctgctcttggatatctgagtcgcttgtcaaatcatggtaatggaactcttgacttcttcctactccaccctccccaacctgtatccatctgttcctcccactacaataacacatcttccccatctcctcattataagtagcttctcaagcctgagattatcctggattccttacactgtcagtgtttatgttcaggtcctcagtacattctgtgaaataaatggctaaaattcatcttggatctgccttcttctctccatctttgttgccttcatcttggtctaagtcttcaacatctctcatttgggatcagttaaataacctgctaaatctttccgacataccaatccattacccacatacaagtgctcttctcaaaattcaaattaggtaatatcaggtggtttagtcgctaagttgtgtctgactcttgtgaccccatggactgtagcccgccaggatcttctgtccatgggactttccaggcaagaatacaggagtgggttcccatttccttctccaggggatcttcctgacccagggatcaaacctggtcttctgcattgctggcagattctttactgactgagccaccagggcaacattgggcttcccaggtggcactagggtataacactgcaatggtcttctattgtacttaaaataaaatccaaatttcttactatagtttctaaaactatctacctccttacctcattctagaccatgctctcttcatttattgcattcacactcactggccttttaaaattatgcaaataccccaagcatttcctgattcagagccccagcacatactctttcttctgttagctgtttcccaccacaaaatgcacacacgctttttacatagatagctatttctcttccttcagatccatcttttaatttcttctctcagaaggacatactttgattaccctacctaaagaagcctctcttctactattccctatttctgctctttttttaatcatagaaattattttatcttgaaataattaaatgttttaaatcccctgttgaatgtaatatacaaaaggttagagactttgtggtcttgttcacctatcttctgtacctagcatagggtctggcacatagtagatgttccatgaatattttatgaataaatgactcttggggatacagagaagagtaagacaaagcccctatattcaagccatcactgctgagtgagaataatcctacagaaatagccaacccatacctctttagtgctgaatacaggcttacacaaatttctgtgcatgtaaaagaaactgaaagtgtacagagggagggagcatatggagaaatatagagaaattaagtacatgtcattattaactgatattttaacagagagggaacttctctgtgactaagattcagcccttaagaagaatatgagtgattctctgaccgtcccttctgcccactcctaccatgactctggaactatatatgtgtaggaaatgaaatctatagcaatggatacccaggcaagtcactgtgggttacatatcccttctataattttttctaatcctctgtttagaatctttcctaatgagtgggcagccattatttctaatttaattaatttactccctttgaaaacttcatgtttggttatttttcctgtctcagaaagaacattatttcaagctctttgcaggtctagtaattgtggacttgtatttttcttctgctcagaatatcaggcataaaaactcaaacaatctctgccaagagagtttgttttctatttgttgcgtcttccttactctgacacctttgtaggacataattatcaaagatgctgacttcttttcacgtatcttcatctgtacctgactatgtaaaatagggtaatgctagttgctgtaacagctaaaccttagagttttaatgtgatgtgatgaaactcacgttttagttctcacaacttagtggtttatgtttcacaaacttaatggctctctatgaatattcctgggcttctctggtggctcagtggtaaagaatctgcctccaatacaggagtcataggagatgcaagtttgacccttgggttgggaagatcccctagaggtgagcatggcaacccactccagtattcttgcttggagaatcccatagacagaggagccttgtgggctacaatccataaggtctcaaataattgaacatgactgaagcgatttagcatgcacacatgcataaatattcctggtgggctggagtttcctccatgtggtaattctgggatccacactccttccatcttgtggtttttacatcccatggggatcttaggtgaaaagacaaagagttagtggataattaacatttgtgtttttaaaactataccatgaaggtgacaaacatatctgcccacatccacgagtaagagctaaaccagtggttcttggatgcaagaggaatctgggaaatgtagtttatgggtgagttagtagctcacagcattgaatcttccatatacaagggaaatacagcattttgttggagattagccatctataacttctggagtggtgcagtggtaaagaatctgcctaccagtgcaggaaatgggaggagatatg

SEQ ID NO: 50575 - DNA, 1248 bp, Bovine  19866880898900
ctccggaatgaggaaactcagaactctagaacctgaatccgagatctaaagaatgttaacttgtttttccttaaacttcctgtttttccctacaaacgtattaaacactttccaaaacgtcttattaatcatattttcccccactgcttaaaaagaattaacaaatgtcataagacatttaaaagatggtgtcaaaggattccctccttcaaaaatgttagaagctgctagtttaaatgtatctgagagattttccgctttgttccaatgatctcttcagactgaggtgcatgcatttcagtcaaaggacaaaaattcttgtgtgtcttgaaacctttaacagcattaaaaaataaaagaaaaacacttgctgtcattttttgaccttttttttcagtgagcttccgtacaaatacacaacaccactttaccagtaacaggcttggccacgtgaggaaaccctggagctcgcctcttcgcgtcaccggtacagccggaccgtcatcccacagccagttacatggaagcgcgccggagaaccctgggagttgtgggcaccggggattgtgggaaatgtagtttggagacatcgccctgctcaccatttctgtaatggctgcttccttgaaggtaatgtacgagcttgtctccgaaggctccttagcttgcccagtgtatttgtcaaacggggcaaatttgcaccttgccgggccaaagcagggattgtttttaaagtcttactttcaagtcctgggacgaacttggttttcggttgactttttctttttttttttttttagctttttctttataggcgaacaaacgaacttttaaatctagttcccgtttgaacaaactgtttgtctttagtttttacccattcttctcccttccatacaacctccccgctctgcgctgactctagatgcctctttaaaataataataattaataatgtgtaatttttaaatcctgctacgcccctctgatagtaggcgctgtcacgtggaatctcttagcctctgcatccggagctgctggaagggagtcagatagaattcagtaccgctttctttggtaagtcttaactatttccccacgacttcacagctatatgttgtttgactttgctagatttgtctgcatttcctggatggggagaggtcctaagaaaatataattttcactctctaggacaatttccaagttactggcttgggcatcatcatctatctttcttatgttcta

SEQ ID NO: 50576 - DNA, 1841 bp, Bovine  19866880969690
tccctgagaagagaaagagcagtaataatgtgcaccctatgacttctgagagaaatctagtatctcatatgacatttactttttccttgcctgtaaagaggaatgagataccttggtgatgaagataaatgagatcaactaccgtgtatcatttatatctcaagttgcattttttttttaaacaagccacatggacctgttaaaattggaatttaaacaaaactgcagggaaataattatcttaaggtgaattgcttaagagggaaattgcagtttgacactgggggctgggtagtttatgagtgtagaatcatagaaatagtctgctctgaacaaaagtagcatttagctgcaggttctattatgtatttgatattactgatcctagcaaagtgaggaataaaaattgagcatttatacacaccaagctgaagaaagaggcctttaaattacctttcagactgtgagtttaattgaatttctcacatttatttcagtataatgacagcaggtttgttgtgtggatgtcaccattctttgaaagctgctttattcttcccaatagcacagaacctgcattcttcatttttagagagcattcccaacaataagtaatgcttgcttataaattggagtgcaccagagtcctatttaaaggccagcctcactgacagccttgcaggatagaaggggagaatatatgttttatgctcatacagcttcttgaggaaatggagtatatatagtcaagttatgattacagttatggttaggttcatttatttgtcaagtgccaaggaatacacttgaaaaagcaaaaaaaaaaaaaaaaaaaaagacgaagaagatcaagacaatatgcttgtttcatagatgatgttactatagaataaaagtttgtatgaatccccaagacagatacatgccattattttttatcagttgagtattatgtgaagttgttttatattttttggcacataaagcttttccccattgaaatagttgattgtctttatcagttcaatgtaaaatatagtggatgtttgctcttcagagaggatgatccttataaaaactccccaaattaaaaatatatatattgtttatatactcctggatttcctaaaagtcatatttccattatgctacacatgcctgctatgcaagttgacttttcacaggttgctaagactttctctctcatttaatgagctatctctgtcctagctggaatagtcatgctaattctatctgaatttatttaaacaaatacttatatagtactactgtaaacgctttataaatattaactaacttcaatcctcattataacactttgagagatcattattttcactttagagatgagaaaaataagcaggtactgctgagaatttgccagaaatcagtttgattaaaactcaagaagtctggttccaaggtctatatgtttaataattatgctatgcccaggagtttatagcacatacacatttcttcttatcaatgatatgctattctttaaaaattctttcctgcaaagatctatctgtttctttgactttttatttacttctatcaccaattttaaaaactaactttgatgtggtagtgggggatggtgcataagtattattccacatgtataattatggtcatgttttcattgctcagctgctgcccaggtgccttgatggactgcaagactcgctctgatattctgccctttcaatacatgtaatcaaattgtttctcatcaaaattacagattactgcatgcaagggacccaggtcagtctacagtagtcaaacctatgaatgttaaacccataagtgcc

SEQ ID NO: 50577 - DNA, 1980 bp, Bovine  19866880977121
tataggaaaaataacaaggaagctgtaaaacaataaaactcagtaaaatcataattgtagagacccagagaccttgtgaaattctcctttaagttaagacacaaagtctttaattgaagaaataacacatgtcttcatggtgtccactatatgcttgatatttagcaaaagctagagttcaactcttgagatggctaattagttttctgttttacctagtacgttgcactgcagagatgacctcctagaagtgtaatttaggggttaacaagactaacataaaattttttagctcctgctcattcttgctggtgtttcataatctacggtagaactttagtgttctattttaagactttaatctctggcaaaattcaaatcctctcaagatttagcatgcatgagtttctgatgcttcctgagaagtctctaaagtaggaagaaagatagaagctctttcttgagagtgtctaatatagaagaaagtgaccagtgatcagaatgggggagtggtgtgaaatcactgagaattccaaactggggagaaaaaatacaaagtaatgactacctgatgagaaaggaaaatagtatgatggggaaggtgatgtatgtaggaataaaaaatagactcaaagactcattccctactatataaagtttcccaaagccctctgccttcatactataaaaagaataacattctaaatgtggctctttaacttacatttctcagttttgtcccattccatgttttttctgttaagaaaagaaaggaaaagaaatggaggtggcagaagttcaaccaaaactattaattagccagaaagaagagaatattattctatattgaacataacgttaaaaatactaacttactgaatgcacacttatcaattgcttatatacaaatgggaaagacaagcaataaacacatgcaaaagtatattaaatacaaataagatagagatgagtgctaggaagaaaaatgcagaagagggataagaaagttgggggaattggggcatgattgttgttgttggggttattttatatggattgacagagagggctctaaaataaactgatattggggcctagggtcaaacaaagtgagggaaggagctgtgttggtaggtgagtaaagagatttccagttagagagagctgtaaagtgcaaaggctctgaggcaagtgtatgcttagtatgttcaagaaatgaaaaggaggccagtatgagtggagtgatgtggtggagaatggaagtgagagtaaatgaggttcatgaagcaatagcgtcctggtcactcataccttgaggtaattgtaattacttaggctttacttcagagaaagtgatggcaccccactccagtactcttgcctggaaaatcccatggacagaggagcctggtaggctgcagtccatggaactgcgaagagttggacacgactgagcgacttcactttctcttttcactttcatgcattggagaaggaaacggcaacccactccagtgttcttgcctggagaatcccagggacgggggagcctagtgggctgccatctatggggtcgcacagagttggacatgactaaagtgacttagcagcagcagcaggctttactttaaatgggatgggaaatcattggagggtactgagtagcaatctgatggctttgctgggcaaagactatggaaagatagatgtgtgccaggaaacttagtgattgatttggattgggatcagggtggatcaatggaggtggtaagaattggtaaaaaaaaaaaaaaaatgttcgtatgtttggtcacaaattcatttattaaagcaaatattagtgacagaagtcacagatcatgttccatgctggagagataacaaacagaacaaagtccatgcctgccatcagtaaactcatggcttaataggggcaaacaggtgaacacctgcctttaatgcctggtaagacaaatgaat

SEQ ID NO: 50578 - DNA, 847 bp, Bovine  19866881030267
tgttttgcctctgtgtggtaatcttgtctcccctcttagggataatttccggagggcagcatgtctgcatggtgaaaagacactggaacttaataaattcttgttgtttcatagaagatacttcccaacagaggcctgacaatcacttaccttgtgtggaccttcctaaaagcggggtcagagaggctccttccagggaatttctccaaatccaaaagaactacaagcccctcactagagtcagcagaaaatttctccctcacctcaaaccctactcaccttctttatgtgaataagaaaaggaatggccactctcattaaccacgttcttaacaagtgctagatgtcactctgtccaatcttcacggcaacactgtgaggtgggtatttttctcattttatagatgatgaggccaaggctcagaaaaggtaagtaactcagccagtgtcacacagctcgtgagcaacaggtccagattcaaaggcaagtccttccattccaaagcctaccatcttcccaccatgaaggtggccccctagctgggtggctgtttctcccaggtgtggcccccagctgtcctatgtctgatgcaaccattcactctcccttcagcatcacactgtattttaactcttgccttctttcttccttcaaattgtcctccttcctccgaaataaccaactgccaccagatgtccctcctctcctattagtccgcaccacttggttctgttgcaagtcgaggcaatgcaggcagcctggaaacccatcctagcttaatccagttacacaaattcccattattgagccatcagttatagcctggggatgcccagatgcgaacat

SEQ ID NO: 50579 - DNA, 1983 bp, Bovine  19866881114578
caaccagtccatcctaaaggagaccagtcctgggtgttcattggaaggactgatgctaaagttgaaactccaatactttggccaccgcatgggaagaattgactcattggaaaagactctgatgctgggagggattaggggcaggaggagaaggggacaacagaggatgagatggctggatgcatcaccaactcaatggacatgagtttgggtaaactccgggagttggtgatggacagggaggcctggcatgctgcgattcatggggtcgcaaagagtcgcatacgactgagtgactgaactgaactgaaagttcaaaaactaacctaaataacgtgtagagaaaaaaaataaacaaaacagcatgatatttgcctatggtgggaattgtgggtgtggggaagtttggagatgaaaattgatttaaaggaggtataaaataaataactttctgggaataaaacaaattggggtattttttaataatcttgatgattatgtcaaacatgattgatcataaatataaggtctgtgtatttcattgaatataatgtggtaaattggggagaagaaaacatcaaattattctttcagttgacatttagattcattatatcaaatttcaaaaagaaaagcatctcattgggattgctttgagttgctctcttttcttaaggagaattaccacgtttataataactgcacaatttgagggttctccactcttactgaaaagttttcctacccattttgcatctattgttgctgatataatgttttcttttctaatgtgtcattgtttctctgatggagtgcaacatatttactgtataatcagactctaatatcaagattgctatcagtttttatttgttttgtgttctaggcaaataatcatatctaaaaataataatacatttattttctttctgaaaatgcattttatattgatgattgattatctaatggaaactatcggaaaatccagagcagttataaattctaacagagagagaggacagctttattcaacactgcatgatctctctggttactgcaggatccttgccacatttcaggtgccctgctctcaactgtggttgatcaaatcaaaagttttttttaaaagtactgtgtctttattggctctctatttatctttgcctctaaaactctcctcaaattaggcaatttatgttctccagggtgttctccattttcatcttgggaatactgactcattttttccttgtaaggcggtgagtcaactttcaactaaggactctagtctggactcatccattattttatatcagaaattcctgggagtttctgacatccttatggacctttctcagttttcagacatgctatatgtttgcccttattttcatagtttgttagtaattgaattagcaatctaagaaagagacagtgaaaattctgtcattagtcacagaactcagaaatcttgatatattttatctggggatgcttcttcttccttatttgaaaagaagaaaacataataaagcaatcaggttcattagccagtggatgcattcatttggccatatatttgtggctgacaaatagattcagctacaaatgaggaccaaataatgatcatgtattaccaggagaacgtgagtgcctgctaagtcacttcagtcgagtctgactctttgcgacctcatggactatagtctgccaaggctccactgtccatgggaatctccaggcaagaaccctggcgtgagttgccatgtcctcctccagggcatcttcgggacctagggatggaaccccagtctcaggtctcctgcattgtcaggagggttctttaccactagcgccacctgggaagccctgtgagacaacactatggggcaaatggaattggggaattcaatggagaaactcctgctaaaatattcttggtgaaaggggttaacatggactctggagatggttgatggtgtg

SEQ ID NO: 50580 - DNA, 1461 bp, Bovine  19866881137027
tttaagttacttttacagccatgttaattgcacagcctcagttgactctgtaaagcctcaatatctttaaaaattattgatttatttggctgcactgggtcttagctgcgggacacaggatcttcactgcagcatgaaaactcttagctgtggctgtgggatcagttccttgaccaggggttgaacctggatccccctgcattaggagcacagagtcttaaccactggaccaccagagaagtcctaaacctcaatatttttattacatacaatcaaacaaggcttttacaagtaaaaatttctaaatttagaatttcctttagtggacacaaaagttccattataatcgtggtttgcaaagggtggtcccaggaccagcagcatcaacatcctctaagaacattttagaaatgcaaatgtttgttccccaaccattgcccatatctactgaatcagaaagtaaagggtagtattcggcaacctctgaataagacttccatgtgattctgatgtttgatagcacatcacagagagtatttataaggtccttgaaattaagaatggtgtctttttcatctatatcattcccatgtgtgtctaatactataccctggcacataatagatatttagtaaatatttcctatgtgaataaatttaatgtgtaatcatttctgtgatttgtttgacactgtcttctcctgacttctctcttcttcacacttatcatccataaaattggggtgatagaataaagaaatgttaagtgtgaaccgaacatgactctcaccaggctgtcactgttccccccacatgatattctcacagtgtccagcgttttaaattctccatgatctgtattttttcagaatgcttagaagtatcttgcataccaagcaggaagaaaacaaagaaactgcaggattttgtactgtgcagagcactacattacacttatattatcacatcttatttctctgcacagtgcaagagagaaagtctgtcatcaaataaacatttagcagtttctgcaacatcgtacccaaaatatatagccataaagaataacaatgatatgtgaaactgtagatataattctctgctccagaagtagtatttgcctgacctggaaagtatacaaggaacatagttaatgggtctttttcttcaaagaaaaaaaataccttcatgaagctatcaaaaacactgtatttctatttttcatgaaatatttacagataatgacaggtttagggaaattatgtaatcagcaattcctaaattgctaccattataattactgtttatttgaaaatcctcagagaaagacagaagacatgtctccagttttgtaatgatctgagatagtctcctgctgctcttccacacacctgggctaataccaatgtaaatcagataatgctaatttgagcatattgatgagggtcaagcgttactgttc

SEQ ID NO: 50581 - DNA, 1824 bp, Bovine  19866881215213
ctgttctgtgacattggcacaagtcaaggtacagtccgccctctgaaactgcagtttccatgcccacagagctacactgtatttacaactatgtacacagcatttacattgtattatgtaatataagtaatctggagatgatctgaaatatatgggaggatgttcatagattataagcaaacagtatgtcattttatataagggatttgagcagtcgagcattttggtattgggtgggggaccagtcccctgtggaaatcaaggaagggctgaataagttagtcagaagagagcctaaggctttaaacagactctccctatggctttaaacagactctccctattgttccaaagccacttggagacacattagaaagaggagggacctggatctggctcagacctccaggcccatttcagaaagcatctcaggtgggagacactcaaccaccctgtacctcgactttcccaccaattagatgaaatgaatcaggatgcactgctcagggccttctcacagctaacttcatacggttctctgactttgctgacgcttaagttctgggcaagatttgtaaggcttgactcagaaacacttaagagaagcaatccttcactcttcctgtcaaaaacgaacaataagattttaaatatcttattaccttaataagatatctttttaaatcagataccagcaatgaaacaaaataaaatttaaaaacaagacaaaataaactgtagcaatatccactgccactgatacttagtatttataatagtttgtgggaagtcaccaaatctgtatttcttcattctcctccctttctctgaaagacttatatcccatgctcatcttttgggaaagtctctcgtgggtggggtcttagtcctatcctcattctccatccccttttatgattgcttctgacttctcttcaacttgccccgttttaactctgcatttaccataaaattcaactccttctcctctgctcttctttctgtatattcacttttcggggaaaaaattcacactttctcatctattaacctacattttctgttgtaaagatttttccaatccacatccctgtgcaggttctgccctaatcacatgcatctgtctctaggacagatatttatatattctgacatcatgtcatcctaacatgatcaaaattaaatcaattgtttcctgccaagaaaaatccaggctagatcatctctctagttctttcattttcattaataatactgctcttctctcaagttattagactcaaaagctttggctttttttttttttgtattctgttgtggttaagggggagtcaaactacctatgtttaaatctcagcgtggccacttgctggctttatgacctcagaaagctattgaacatttctgtgccttagtttcctcatttgtaaaatgggaatggataacaaatgagaagtgcaagaagtaaattctaaacatgctaacatatttagcatatgccttacacccaatgcataaaaaaggtagagatgtctaagtgacagcttaactttttgaggtatcatgaaaggcaaccatgatctctgaataatgtcccttatcactgtgaggaatagaaagccaggttgcaaggaattctaaatctgaccaacaatccaacaattcaacaagcagggttttttcaagtatgaatatgtattcaaatggtggtcaggcccaagatggtttgggtaatatgttttaaaataattttggctaataactttttatttaagcatgacaattttcatttttattggtttaaaatatttccttcaaatatca

SEQ ID NO: 50582 - DNA, 1425 bp, Bovine  19866881244487
ttagaactgtgaactgtgtgcatcagagcaagaaaatataaatgactcagaacgtgggatgagagagaacacatgtggggcatgattacctaggcatttgtatattagatggtcacatttcatacactgggtttttcccccaaatctctagagcagttggagacagtttcaattaaccgtatgtccatttgtgtctttgccagtcttggagaacttaaaatatgtctacattaaatttgtgcaacatccctgagcttgatatttggtgactttagaaatattatgtaagtttttaagccaaaattcaaaagaatattttggcttcagactggaaataatgcaagattgtagttttcttacagaaattcctaaagttagagtttgacttgcctcaggaagaaattcataattcagaaattcctgttagctttttggaaacctagagaagcttgagtctaactcatatactatcaaactatttttttttttttttttgcattttctcccccaggagtcatttaactataaaatctcattaatcattttcataaaaaggatcacaatatacagaagagattaaacatttttaaaaaatcattctaactcatgttacattgattatacccttgactcactgtgcttacagtacattctgttctgaatttgtgccaaagagctagaggaaaaaaagaaaaaagatagaaaaggatcatggtaccagaaaagcgaatacacttccataaacccatggaaaagaggcatagataagctcatgccaaataaatgtgcatgtcttaggaccaaatataacatgaatcataacccgattcccgccccaccccagtgtatatcaatgtgatttgccttcttattgctataatggattatgtttagagaaggtaacaatttcttccagtttaaatatttttctttttttcctattatgagtagcatttactctttttgtgttaaaaatgtgtggagttcatatcacgtttaaaatagccaaacagtaaagaaaatgggaagagttgactcattgcaaaagaccctgatgctgggagggattgggggcaggaggagaaggggatgacagaggatgagatggctggatggaatcaccgactcaatggacatgagtttgggtgaactccaggagatggtgatggacagggaggcctggcgtgctgcgattcatggggtcgcacagagtcggacacgcctgagcgactgaactgaactgaaagaaaattgaggcaaggaaagaaaatcgttacatttggcttattagaattgtctttcttctagatttttgtggtctctgtatgtccctcacactatcactgtggcaaaactatcagaaagacatacttcctcttctaacaagatgtattcagatctaggtatgtacacttaaagtggggg

SEQ ID NO: 50583 - DNA, 891 bp, Bovine  19866881276214
tgaggaggggggttctggatggggaacacatggtgcgcccgtggctgattcatgtcgatgtatggcaaaaaacccactacagtattggtaaagtaattagcttccaattaaaataaattaattaattttttaaaaaagagagactcactgaagatttgtggcttggaattgttgctttctaattggagactgagatgaaagtaaggatgctgagcccactagtgtcactcatctttaagcgctccacttgtcgatagaatgttttatgggaaaataagtaggcgtgggagtgaacttgggttaccatacttgtgcatttcacacctatacagcaaaaatgtctttgtcatctctttgggaagaaacaaaattgacagggacagatggaagcttcgccttctttctctgaagaggcgaattaatacaattaaaatgagagatgtgcttacatggactgacttgctaaataggctaaccttgatatttaaaacatataagtattttaaaaatatagataaatatttatacaggttcaacattaaagggaaaaattaaatgaatcgataagtggtaagggtgagggtcttcactaggcttctaaatactagtagacatccatctgagaatatagctatagcttaatttaataaaggcaaacaaaatttatgaaaatagtaatacagaataaaaatccttaacaacatgagagaattcaatcacctaatagtaactgaaataaagcattataaaaatgcctgctttaatatagaaaatattgtctattgaccacaataataaagccctacttgttaatagaaaaaataaaaacaaaattttaataaatgaattctagcttcttaaggtgataaagggcaacatataacaattcaa

SEQ ID NO: 50584 - DNA, 970 bp, Bovine  19866881292931
ctggtctggaaaatcccatcgacagaggagcctggcaagcttcattctgtggggtcctaaagagctggagatggctgtcaattttaagcaattgacacagtagttcatcagctgttcttccagagctcagtctcaccatatttagtattcacagagggttcatttcagctttcctcagtatcttgctgagttcctcccggctgcagctctcattgacagagataagtgctgtggtgtcagagaataggtgaaaaatagtctcataatctctatcgacacagggattgacatgctacattaccatgggaaggaggactcagttgagagctttggaagagctggtgctaagtacagataggctgattttcaagtagaaatgtgtgctgtatatgtgaatcttccccacggagctatcatggttaattaagaacagggtcataagatcctcgataaccaataataatctatgctgtttggcatactgaggtaagcagactcctttctttagaaaaaaattgagatgaacaaaagtttgtcagaatttgttaatttgctacaatgtggagtgacttttaatgagctataaaaacccattgctgctgctgctgctgctaagacggcttcagtcgtgtccgactctgtgcgaccccatagacggcagcccaccaggctctgccgtccctgggattctccaggcaagaacactgacgtgggtcgccatttccttctccaatgcatgaaagtgaaaagtgaaagtgaagtcgctcggtcgtgtctgactcttagtgaccccatggactgcccaccaggcttctccgtccatgggattttccaggcaagagtacggagtggggtgccatcaccttctgcgataataaacccattacatgttaccaattattttctagaggatttatggaatgtttaggatcttagaaaccggactatttgagtaattaacagatataga

SEQ ID NO: 50585 - DNA, 942 bp, Bovine  19866881552284
agaaattaaactgcacatagaggaaggtgacattattgatcaaaaacagagaaattttaaattttgttctttctcttctttacttcaaggttggtcttgccaataaagtatgtagggatttttctgtagacaattgcttttaggccaggaatgtggggcttcccaagtggcacagtggtaaagaatctgcctgctaatacaggagacacaaagatgcacattcaatccctgggtcaagaagattccctggagtaggaaatggcaacctactccagtattcttgtgtggaaaattccgtggatagagggggctgagggactacagtccatggggtcgcaaagagttggatatgactgagcatgcacttgcctcgtgaggagtaggatgtaaatgttaataagggtagaaaaggcccctttggagtgatgtacatatcccacctgtcaggctgtgacatcttttcccagatggaagctggcaaatgctgcctgtgtcttctccacacataaagaataaatggactgtggaaacagaagtcatgatcctaatttctctttgtttcttggcctcctctgactctcacatcctcttttgagttgtgaaacatgattcattcttcatgcatgaatcctcaaagaaatggattgtaacaagcttattccatgaggaatatccttcctgaatgtggaatactgctgctacagaacatttattgtctgatgaacgaacagggcaggtcaaacaatcaaaacacaagttaataattgaattatggtttcttgaatgctaaaaatgtctaatgttccatgccccaaagtggtttcaaatattgccaccaaaaggctaagttagaattctattccacatcctcctcactgattccacccaacttagcaaacttctttaatatcgatgagatgggaattcgaattaaattaaatt

SEQ ID NO: 50586 - DNA, 690 bp, Bovine  19866881619016
aggcaggtcggtggtctggtattcccatctctttagaattttcccagtttattgtgatccacataatcaaaggctttggcatagtcaataaagcaggacaggttaggtcactctaaactgtgatcctagatagaacatttagtctgactgaaaaatgaaagcctagagccacaggagaaagccagcaaattcaatgattcaccactacaatgaataacctactggtaacatactaatttatcattcatgattcctgggggcagtgggacagtagcccagcttttgatacaaggggtttcataaatcattaacctctatcttatttgtagtcatctcttctcctaatcaagcaaaagcacagtgaaaaccaagctggaaagaacaatttcgaactttagaataaactgtttttcaaatatcatgaaagatgtttacaacaaaaatgtttggttggaggagccaagatggcagaggagcacgacagggagaaaactttctcccccacaaattcatcaaaagagcatttaaacatcgagtacattccacaaaacaacttctgaatgccggcagaggacatcaggcacccagaaaagcaatccaactcttcaaaaggaggtaggaaaaaatataaaagacaaaaaaagagacaaaagagggagggaccggagtttctgtcccaggaaagggagt

SEQ ID NO: 50587 - DNA, 774 bp, Bovine  19866881642466
atgttgactttgtcatgcataagagatgttaaaaaataataacaatgcactttgaggaatgtttgcatatgcctctgattagaaagaagacttgtcccagccctgcagcggccaatgaagaattatcaatgccttattttctaggcatagattagagaatgtaaaccagacaatttgtttactgttataagaaaactaccagtttgcttacagaagattatttttgtgaacaataggtttgagttcaaaaccatttgaagaatttcagactcacactcagaaaagggaaaaggaagaagtctgcttaaaatgagtatgtaaaatttgcttatcgtacatcacatttagacacttggctgtgacctgttaccagtatcgcagagaaacccaaagcactgtttaggtacaaacattcttcatataggtaactgtaagaagctagagcctacaacttgctcctccatgccttgctgggagcctctgaaagcactggcaattttaagagtctttctcagggtaacaatgttttcttaataaaaatgttttcagctacaaattcctcccaaataaattgtcttccctttcaaaatgtaattttatgaaagaaatgtagccatttgtcattgatttaggctattttcagtattgagaaatgattttgatctctgtagagttaatgctctgtcatgaaaacaatttttcagatctcctttagtggtaacacttttttctatttgaggtcaaaggattggaaacagggtcattttttttttt

SEQ ID NO: 50588 - DNA, 928 bp, Bovine  19866881654030
gctcctccccctggaattttctaggcagagtactggagtgggttgacatttccttctccggggatcttccagacctggggatcgaacctgggtctcccgcattgcgggcagatgctgtattagtgttgcagtaatcactcccagagggtaccattccctaagatgtgtggactcaggcagagaaactttttgcacagagtgctggtttagagccagctcgctgattttctgaaactcacaaacataccactgccttcagctgagggtgcttttcacttggaatttggatcaaatttagcaccaaaagtcttctgaagtgaaaggtcagctatttaatagaatagttttaattaaatgataatggcttttgtgttgtataaaaagaaagtaagcaagttccaaaatggaagcctgaatagctaattctagtgaggaaatcagacttatgaacacagcaaagttcttattaattgctttctttaatgaaaatttgttttgttccatttacctcggcattaacttttataagtgagtgtatttttatcctctatttatattatggttttagttacaataggtgttgctgagtcatctcactcagaatgtgaaaaatagaataggaatactgaagatagattgttgttgcaacttgagatgaacctttaagtacattgattaaaactcaatattctatttcaatattctttttcaaaaccaaatttttaagccagatatattattttgaagttaaaattatttttccttcaaaattacccatttatattgtcaaaactgaaattgtttatttctgtgaatagaattttgggatgttcattattgagtttatggttactatggttaaacaataagaaccagaatgatgttgtgaaaatttgtacctcaagtgaaattaacaatggaataatca

SEQ ID NO: 50589 - DNA, 1124 bp, Bovine  19866881774386
tagacaatggggcgattgaccagatcactgaacacaaggttaatattttaaaagtcaattgttttttctatatacaagaaatgagcaaatataaaatgaaaatttaaaacaattctatttttataaaagcaaaaaaaaatcaaatagctagaaataaatctaacaaagggcttcctaggtggtgcagtagtaaagaatctgcctgcaggcacccaaaactggtgctacgtgacaacctggaggggcagggtggggagggtggtgggagagggtttcagaatggacaggacacctgcatacctatggcaaattcatatgacaaaaccccccacaagactgtaaagtaattatcctccaattaaaattaattaattaattaaaaaaaaaagtccacctcccaaggcaggagacgcaagagatgtgggtttgatcctcaggttgggaagatcccctggaggaagaatcagcaactcacttcagtattcttgcctgggaaatcccatggatagaagagcctggtaagctacagtttgtggggttgtaaagagtcggacatgactgagtgcatacacacacacacacacacacacacacacacacacacaaacacacacatatctaacaagagatatgtaagactgccaactgattgcataatggattaaattgcaaatacactcagtggaaatttatacataaattctttaagtcttatattagaatgcaaagggtcaaaaataaccaaagcaatgtaaagaacaaacttggaagtctttaaacgtcaactttttagtccacagaattatttcactatcatatttattctatcagtgtgctctacttagctgagacaaactgatgctttgcctaaagccctccagttgtttgaactcattggtcctgtactatgttactaaagatctctgaagaactgtgtagcagagcagttaataccatagttacagtaggggacccaacccttcaggaaaccagatataccttgaactttgtcttgggcataaataccttatttcattttgtaagttttccttttgattttttttctcttataatcgctaagcttcttgcctttactttagccttttatcttaactttaatattt

SEQ ID NO: 50590 - DNA, 2191 bp, Bovine  19866880607295
tttggagaagtcggtcgatgtcttttaaatcttaccacataagcaaaccactttctctgccatcgtgtagggccattcctccaaggatatttgccttttaaaaaactaagaaatttaactgtagaagactgttatttaatgcaaacttagttgtgatcccacccacaaattgccccccacagtttcccgtaggcacccacagtctagccctgcttattttatgtcttttagaaaagccaaaagtgacctgtaattacaagcaaaaatcactagtgtgagcttgtgttaagtgtttctcttacactttgaaaagaataattgtatcattaaagcaattcctttggacggtaaagacttagatttttttatttttcagagagtagcagcctaacaaaatatgggccccacccgtctcagactcctcctggagcagggacatctagacttaggtccaggtgtcctacataatcgccatgatatttcgtcactccctccctatagccactgtctccaaaaatttcttgagatcacatgttatttggtttgtaaaaatcaagaaaatgaaacagaattttgcgttgaatatttagaagaatttcctaatacctttgagacaatctcagtgcttggtgttgcaaaatcaagctaggagatcattgacacagaagccagataagggatctcatttttccttaaccatgagcctcacaataatttctcctcaatcattgcatatattcttatgcagggtctctcttctagatatacaaccatcaaatgaaaaggatatgtgaatgctgaagacacaggtgatgctttctttcataagcaacaatgtgctgaagagaagatcagtggaatacttttatttgcaaatgcaaaacccttatttggaaatacatatatgtcaggtcagggcttccccagtggcacagtggtaaagaatccacctgcaatgcaggagccacaggagacatgggtttgatcgctgggtcaggaagatcccctggaggagggcatggcaacccattccaggattctcgtttggaaaatcccatggacagatgagcctggtgggctacagtgcatggggttgcaaaagagtcagacatgactgaagtgacttagcatgcacacatacacatgtcaagtctcacactctttatattttctttaactcccttgccctccacacggagtgttgaacttgtttgtccataaagattcctacctgtcagtcagtctgctgagtgaaggactcggatagctattgtccaggctgctgagaacagacatgatcatgggccggtgtcctgctcttccctcccctgcagggaaagactcaggctggtttcacagctttttgttcacatgactaaaaatgaaaggaaaacctgagggagctgttacaaaaaaaaaaaagacttaaaaagtttctggcttagaacatttcaacatccagccattagtttaaaaacatcttcttgagtgcactctgggggttcttctcattcttctccaccagtcactggaatgttctttaaaaagaatacccacctaggccattaaagtgagagtcaaagcagcactgggctgtgacctttttggcagggtaggctgtcctcacacattacctttacagtgatagaattttgctttttccccctttttcctgccatggaacaaccccaaaggaaacctgagaaagatcccaattggctgagtcccgaatgaagtatttcaactggagaaggctcacttccccatctttgctttgtttctcatttgttaacttcattttgctccactataatgaacaatgtcatgtggtaattcattagaggttatccattttttgctaattaacatctttgatcaatgcaatgaaaatttaaacatttatcaatatgatcaataagcttagaactccaactattgggctgatccttttatcactaaatatttgtgcaatatatccatggagacacacaaatacatccatgcaattacatgagctgtagagcaagaagcgtgtaacagaatttaaaaaaaaaataagattgcaattttcaaaccagattaagttttaaattgaaaggaattgagattggacatcatttaaaactaaccacttaaaactatatttaaatttatacattatatacagtttttcatattacaatgatttaaa

SEQ ID NO: 50591 - DNA, 1419 bp, Bovine  19866881239344
ctgtatgcttggaaatgtacaaaatttaaaactacaaagaaaacctattgtgaaaaataggcagtttttaatacaaaatactgccaactagcactattgtgaaatactattttaaataaagttcattctagaactcaaggttagtttactattagaaatctatgcttacttattaagtaaaaaatttaaagaaaatattcataaatcacaagtatactgcaaagccgtttaatgaattcacctaggactgtaatattctagagggtatgcagaaaaaaaaaaaaaaaaacacttaagtatgataaaaatttagtgtggcccaaatcatatatgtgtttaatttatccccaaagttgagttcatgttccaaaaaataaaataagtctaaaatacattcatgttcaagtgtcaagaaaaacatcataggaaattaagatacaagtacttcacaagaaccagatttgaaaatgaaaaatgaaatctggaaatattactgtaaatgtctctttttggtgtgcatgaagaaaatattattctgggaaaccacaaaagccaactgacttaaattacagaatattttatatcagaagtagctgttctgtgaacttttccctttatatttcaatttttgctcagaataaatctcaataccagaatactttagatacctaaatacaagacatgatgccataaaactcctagaagagaacacagaacattctgtgacataaatcatagcaatattttatagatcagtctcccaaggcaaaagaaataaaagcaaaaataaacaagtgggatctaattaaacttaaactaagttttgtgcagcataggaaaccatcaacaaaatgaagaaacaactacaaaatgggagaaaatattttcaaacatgcaatcaacaaggtatattatccaaaatacacaagcagtttatatagctcaccagggattatctggtggttcaaatggttaagtgtctctgcctgcaatgcaggagacctgggtttgatccttgggttgagaagatcccatggagaaggaaatggcaatccactccagtattcttgcctggagaattccatggacagaggaacttggtgggctagagtccatgggatcacaaagagttggctatgactgagcgactaacacttttcacactttcatacaactcaataccaaaaatccaaacaacacaaacaaactgagcagaactaaacagatatttttccaaaaaagacacataactgaccacaggcacatgaaaagatgcttagcattgctaattattagagaaatgcgatgactgtgaggtataacttcacccagtcagaatggctatagtcaaaaagactacaaatgatgaatgctagagagggtatggagaaaaggaaaccctcctgcactgctggtgcg

SEQ ID NO: 50592 - DNA, 1654 bp, Bovine  19866881333604
ctaccaggctcctctggccatgggattttccaagcaagaatactggcgtgggttgctattttcttctctagaggatcttccccaacccagggatcgaacttgcatctcctgagtctcctacactacaggcagattctttagggctaagccactggggaagctccagaagcttcttgaggagtgttatgtgactttggccttacgcctagccccaaccattcctcagtgctctctttcttcagtcagtgtaaataggttgtcaaaaaagatttcattgaaaaattgaggaacaacatgcccccaaatatgtttactcaagtgtccaccatatgccaagcactgtatctgggaatataaataaagactcaaggataattgatgctattttacatattatctctttttattataatttgttgtttttcggtcactaattcatgtccaagtctgcaaccccatggactgcagcatgccaggattccctgtctctcatcatctcccagagtttgcccaagttcatgtccattgaactggtggttccgtcctctcatcctctgtcaccctcttcttcatctgcctttggtctttcccagcatcagggtcttattttattataaaattatcttatttactataataccaggaaaatatttaggaaataattatttattgagttttctaccatgtgaacatcaattctaataataattctatgaattaagtgctgtattatttcccattttcagatgaagagactaaggcacagaagaattaagaaactttcccaaaagcatacatgtggttgttctagagccaagatttgaaccaaggtagcctggctgtggagaaggattctaaaacactaaattatgtaatgaagtcttgcttggtgatgatgagaaaaatcttgccatgttaggtgattcgtttgagaagtgtatttttagactgtaatatagctctttctctggtttagccaagagtttcatgtaaaacaatcacatatttgctaaattgcccaaaagaaatgtatccatgtgataaaggctttttctctgaattatcagtttaacattattcctttacaagccttcgacaaattgtagcacccacacaaatacagtaattagttttaatttccctttgtcaatctaaaataaaagtggggtaattgatattccggtatggagaatttcgctctacctaaaagcaagttagctctttagtaatttggaagagtgtttgataattgccaataatcttaaaattctaatgacctctgcctgaaagtgttgttttatgaactgaatttcctgttatgtattttacaaatagattctaccgcttagattttggtgatatttatttctgtttggccttggtcttctggctctaagaacgagatttgaagactataaatacaaagaactgcatagttctttttacctgaaagtgaaatgacatctggctgagtggattcagtggtctaagaaatgcctctcagtcataaactttcttttacatttaacttgggctttgtgctgtatatcaaaatacttgattgttccacactgttttgccctccttttcatgggcattttgaagtctttctcaaatgaatattcatattcaaaatgtgttttaatttctcatc

SEQ ID NO: 50593 - DNA, 608 bp, Bovine  19866882117855
aacatttttaattactcgctttctttaagatgaacttttcaaaagcttaacacactaaaagatacaatgaggcatcttatgttggctttggtcaaatatatatgttagtttttcttttaaaggtacatgttattcggatttgaaaagaaaaccatgaagtttttgatatttgaagctgctaaaaataaccaggcttcttctaccagatgacagaaaggtcatatttgtgatgtaaacctcacaattacacgcaattcaaattttacaaatggaaatttgacaaatttttacaaatcattgtaatcagtgactaaacttttattcatgtaaaaatacaaaataatacgtcagatagtcttcccccatctttttaaaataagttgttaaatatgctgaaccttaatatgtaaatccttggaattttagcaaaaagaatattttgtttttactgtatttagccactttccagtttaaaaaaaaggaatttgatttgagtgtgtaaaactgaattttctttttagtcacaaagtcattactttttcagaaggattcccctttaaaactactaatacattttattttcaactaaaaaccataaaggaattcta

SEQ ID NO: 50594 - DNA, 1156 bp, Bovine  19866880349010
cattgatgtgagtactgtgtagtgcctaacctagggcagcatgtgattagtgataaatacatggtgtgctcagccgctcagtcatgactgactgtgcagccccatggactgtagaccaccaggctcctctccccatggaactttccaggcaagaatactggagttggatgccatttcctactccagaggatcttcctgacccagggattgaacccacatctcttaaggctcctgcattggcaggcagattctttaccactgcactagctgggaagccatatgtctccttaagactaaggataacctactttaggtcctccatgtcaggaactgtgaagagcctggtactttaccttacttactagctgacaagttagcccaccataatttcacacttgctggcagaagacacgagactcctggatcagagacatgaacatagctcaaggcacagcagatagcatgagcttcatgtttgcatctgtttctcttgtcccctaagcccacacgggcaatgtgatgacagacctagatggatgcaagatacacagtggatttgtgtcagttgtaagcttaggaacccccaatcttttgaaagaaaacaaaccaaattttgccccagaaagacattttatttactatactggtcagcacacatatctgttttctacttcagaagagtgcagtatctttatatatattccacaaactctataaaaggttaactcagaagccaatgcctccacttccaaagtgtacagaaatgcaagaaactcatgaaaaactgtctcccagcaccccacagcacttagtagtctagatacactgtaggaattcaataaatgttgaatgaatctgaccagagaatcatgaagtcattgctaaaattgacatgaccacttatttatgtgtcctctgtgctgatttccctgtcacttgcgtttctgaggaagacactaagaactcaaatatttgtataaaaatgatgttttccaatactaagggcccacgtcaatcaaagatagcgatgaatgggaacaaaggaattagttcagttagtattaccaataaggagttcctcattggttatattaacaagagttataattagtggtatgcggtgttttacagcggcttatgctaaaggaacaaggcc

SEQ ID NO: 50595 - DNA, 1385 bp, Bovine  19866880361692
cacctggctgccctgccccaggtagaaggccttctctgatcacccgtcactgcaaaggcccagctccaccccaggtgcgggggtgcttgggcagacaggactctatcctccaaacgagggctaagtaaaagtcgctcagtcatgtccaacgctttgcgaccccaaggactatacagtctatgaaattctccaggccagaatacttgagtaggtagccgtgcccttctccaggggatcttcccaatccagggatcaaacccaggtctcccacattgcaggtggattctttaccagctgagccaccagggaagcccaaacaagggctaagcggccagttatctctgctagggaaatcctgtgtctgcttcgtgggtgctttagagagcttatctttctgtttgtttgtttatcttcccaatccagggatcgaacccaggtctcccacattgcaggtggattctttacgagctaagccactagggaagcccaaacaagggctaagtggctagttacctctgctagggaaatcctgtgtctgctttgtgggtgctttagagagcttatctttctgtttgtttctcctgatcgaaaccgctttggcccatggacaaaccagcaccagaactgacccagcagcctcaactgagagttgacttgggggttaaaggttacagtttttgagaaaggcagtcaaacattaatgatgggtaaagttctttccctcttgccccatgagctgactgggcgatcctgtttgttctacaacgtggacagtatttgctgagggtaattgaaatccaccgcacaaacaacctccctcatctcctgccgcctctgggccgccgtgtcaggtgagcaccgccaggcgttatcaggcagccggaaacagcctggtcctgtccccgacctgctcttcatcagctcccacactggacagatgctgcgtgttctgcgagacccgctggaccagagactggagtgtctcagatgctaggagcctcatgggtttctagagcttagtgttgttgttgttcagtggccaagccttgccccactgttcgtgatcccatagactgcagcacgccaggcttccctgtccttcactatctcccacagtttgctcaaactcatgtccattgtgttggtgatgccatccaaccatctcatcctttgttgtctccttctcctcctgctctcagtctttcccagcatcagggtcttttccagtgagtcagttcttcacaacaagtggccaaagtattggagtttcagcgtcagtccttccaatgaatatacaggggttgatttccttactgtccaagggactgtcaggagtcttctccaggaccacagcctagagtttatacctcacttgcaaatatgca

SEQ ID NO: 50596 - DNA, 1904 bp, Bovine  19866880658016
attttcacataaagaataacagaaaaaagtaagaacattattgaacttagttaatttaatttgctgacttgtcctcttggttaaaaggataagacggggaaaagaaggcccaaaattgtaatagaattactgtcacggggacctatagggcttttgtggagaaagatttttttttttttacaacagagatgattaactgctttcataggtttatttcaagcaccaaaagtgatctttctgcccattaaaaagtcaacatagctataatgcttttcagttcctacagacatgccatctaagttgtgagatgttggccctgagaaggagcctaactgattataaacactcatcccaaaagtctttgtgtgaagttgcgccctcacgctgagcagttccacacaggtacctctgcctctggtcaggacaggaccagtgaagtcctgaagaaacaccccctgctacttgtagctccccttttctgttatcccaggctagttttggggttagcacttcttcctgtgttcagagcattttctgatgtgccaggaacagtaacaaagattttaggtgagaaatacacaatatagtacaaggcaataaacagattcaatgcaatgtctataagtggcatttttcacagaactagaacaaaaagttttaaaattcgtatggaagcacaaaggcctcaaatagccagagcaatcctgagaacgaaaaacagataagtggtcaagatggtggagtagaaggacctgaagctcagtttctcccacaaacatatcaaaaatgcatctgcacatggaatgagtcttacagagtgcctgctggatgctggcagacgacttcagagagctgaaaggacaaagagaatcttgggcttcagaaatgagacccgggagaggactggggttggctgtgcagaaacagccggggagtggtgggcatctgctgcgactacagagggtgtacacggaggacggctggccacccttgagaccaggtgccagtgtctggggatgtgcaaggcaaggggcaggacccgccgttttccccatatgcatactcacagagggcaggacacagcctgcacaggatccaggagccgccatgagccaccactgctgcctgcccagacaccaggagggtcacagttgctgccgtctccttctcggactccaggtgtggtcgcaagacaccatcatgtgagccaccacccgcccagatgccagaaacagccacaaaccaccatcgctgctcccctgggactccaagagtggtctcgagctgcctccacacccaccacgtgctctgggggtatgcccaaaccacccctgccaccagaaactccaggagcaggccagccactgcatctgtacacacccatcaaggggacatgaccggcacacactgaggagaggcggcaggcattcatgctaaagacagccctcgcaccaaatatattaaaccttcacaagtgacacagggatgccccttcatataaatagccccccaagaccacagtttctcctaaactcagaatgagagaaatagaagtaaaataaagcagaggaaccgtttcccgttaaaaggccaagcgaattcccctgaaagaacaaacagtgaaagacctcttcagtcttatagacaccagttttaaaaaggagatgatgaaaatattgaaggaattaagaaaggctatggacagaaatgcagagtaaaaatgaactagaaatataaagaaaaaccaagaaaaataagaaagctcatttgcagagacaaaagctgagctgaaggcaatgaatagcagaatgaataatgcagaagaatgaataaatggcctggaagaatgaataatggaaatcacccagtcaagacagcagagagccaagttggggggagggggg

SEQ ID NO: 50597 - DNA, 1256 bp, Bovine  19866880698503
aatatgattgcagagttcaggctggaagggcaggccggtcaatggctgcagcaaagagaggggtggccctggaccccagggctgccccgagactctgttcggcagttcctgagactgcagactgggggtacctggggcagcaagagagaggagtgatggaagctactgtgattatgaaatcagagcgctttcctgacttttccgtctcttgttcacctttaggcagaaaaactgaaccggggtccggctcactcctgtgtctgagcctggcttctcagaggaagacaggacaggatgttttcctctcattttcactggaagtgtgaggagtgaggatgcccctcctgagcatgtcctgaggagagtttaagttcctagtttaggttctaaaactgcaatctgagcccattagagagagcctgggctgctgactcgcacgggaaaacagtgcattagcctatttccttcccgtaaagacctgtgaaagccagtgtgatttttgcagaatgaggttattgcagccagtaatcagctcgggcagcaccagcaggcctgaaatcaagcagatggggtcaaggcaggtctgtgtgccagaaagggggagcagggaatgaggctgtctgcctggtgtgggatgtgagcgaatttatctgcatagtcacagttacccgagggcgtcgggatcagccccattttacagacagggaagctgaggctcaaccctcttggattctggtccctggcactgggagtggagcagcctgagggaggaaaagcctcccaaacgagatggcccaggctggaatccctcctccacacccactggccaggtgatctggggttgcatgttcttgatttgtgggaacctcagtttcctcaggggcagaagggaagagagaatggacgttgacagtggagactggagtgcgagtttgaatggggtgtggagacaaacgtcctaagtaacgtggttggctgggcacactgtccctcttctgtttgaggccctcttctctgtgtcttcttggccgttctgctgttgcgtgaacatctcacgtgctccgagttctttacagacctggaatatttgttggtgtcccatgtgttagaatcccgaatgcctgaacccttgtctcagctggaagaggggagagatggtgggtgtggccaatgggcggttattgagtgatatccacagagcagcccaccccctccatcccatccctctgggccatcacagagcactagatagctcc

SEQ ID NO: 50598 - DNA, 1238 bp, Bovine  19866880716456
ctgaaaaatacatacaggtgacagcagaaccccatctggggttttgtaaagcaaatacagcacctgagctgatgaggcccaaaaggaaaacagtcctgggaatattcagatttccaggcccatcagaggttcaaaaaaaaaaaagctcacagtaaaaacagctgggattgtgggtatgtgggtggggggaggattccctttctgtttgttttattagaagtggaaagggggtgcagcagctgacagctgtcccctcaggtcactagaaaccgcacacgcccccccacccgggctcaccggcgtatccggtggaattctaagcaggggtctagcaggccgctaattcctctcgctggggacgctctatacctgggcgaaactgggttggcacacttttctttttaatcctccatttatttctgctgcaaaccctgccagagctatcctgaccagtgatctactgctcattggattgagtcaacatattaaaccttgcattgattgttttactgaagggccttgacaaatagtgcgactggagtcagagcagcccggagccccgcgtctccaccgagtctgtcccgggtcgaccctcggcagaatcccccaactcaagagctgttctcgctcggccccaggtcggggtcttctccccaaaagaacaggttcaatcgcccggtgccccggggctgcagaaagatctaaagggtctggggagttgctcggaggtgtttaatgccccgcaggccgactttgttcaggtaaaaccctttgcaaaccacaacaaaagcgccctgggaagatacaggccggatcagagggagctccccggagccgctgaaaggagaacacagcctcaaacaatgcaggacaaggcgatcttatcaaagaaaagccctttcaatgccttaataacaaccgcgttctgtttgaattaccactactgagcaaatggcgggccggccttcatccccctccccgccaggcgcattaacatcaacacggcggcgggcgcatttgaatgcgcgcggtggccccgaccctgcgcccgccgggaaaggaaaggcagctgacacgtcctgggaacctgcgctaccgcccccagcccgcccgcggtggtggcccctgtgtacagaggggcaaactgaggatcagactagatcaccacgcagatggtgtacgggggccaggtgggagccacaaaggacacctccccgggccggagagccgggcgcagg

SEQ ID NO: 50599 - DNA, 1368 bp, Bovine  19866880741021
atgcctttagtagtctcagacttatgtcttcatctatgagtactgagatgaaagtagatacaaaataagccagaaaaatgaccttttaaacagtatcgtttgaaatgttggcacagatgaaaatggggagcggcttttccacactgagcaggcggccactcacggcactggccacccaagtgacagcccacttggcctgtctcgggcacatgaaactcattttatgactcagtgactgaaaacagagctactggaagccacctgaggcagccggctggctcacagtttgggcagacttcattctttattacagctcacattctgacaactgagaacctggattctgaaaatgtgaccccacgagggttaggggaagacgggttctgagctgagagaaatgtgacaaactcaggggaggaggcatttaaatattaataacaaaaggacaagcctagtgggtttggccctgtgtgtcccagctgcgtcagcaggccctaacagaaacttgacaaaaccaaaggggtttctttccaagacctaaaaaaaaggaagctgttcgacttaacaccaaattcaaaatctacaccaggctgccaggccaacagatgacggtcagtgtgactttgtttctctgctccttcagcatggggaccagtgccgagtggctcatgcccacggttgacaggccgttcacagccacgatcatgtctccacatctggacaacaacagacagaaagagtcagtgttttcacggtatcagaaaatgttgtcctgagatttgtttggcacacttacccattaactgtcgatgatcaggctatatgactttctttgagaaatatctgggtgatttttaagcctatgttggctttcccttgtcaacacccccatgccagcctctcctgtaactggtggatgatttcaaaggaaagcagagtaattttcacagaagcttaagcaatgtatagttaagagaatacatctgctgcctcctttaaaaatatcacatgatacatttggagggggctgctactttcattcattttttacagcccattcattcgaggcttcaattaaatgagacccacacctctttcagccaaggatgcttactgtccttcggctgaattatcacaaatggatggtgaatctgaaggcctttctatcttttataatttttagtctttattttgaatatgaatatgttactttcttgtgatctagttcaacttcttttaggaagtggaagttaattagtctaaaattcacatgagacccagactggttgaacccttggctgagagaacggttatttcatccccgcctcccactcttttctctgaagtgatttttccatctctaccagg

SEQ ID NO: 50600 - DNA, 742 bp, Bovine  19866880750244
cagaacttgataacactttgctaggtcaatgttcccattccctgtataactcagcaattctatcagtaagtaccctacaactgcttctgtacatgaacacaaggagacatcccataaggacattcatagcaggatgaaaatggtgtttccaccttcttttctgcaagcattgaatagatgcagagtctatctctgtggatgaagtgacctagaattttagttatatgaataactcattagggaactgcttaaaaataaacagaagattttcatagaactacacattccttttttactctgggtaattttaacatggcatcagactggcaggtcacctctaataaaatataaactgaaaacagatttttttccttcattgtctagactgtttaattttgttctcctttgctattttgtctagtttcaaaaggagcagcttcatgtgaaatttgtgggaaggctgctattcagagtttaatgccattatgtagtagccctgtgaaaatccagcaggaagaatgtagatacttctagaagatgctgaaaactatttgaaaaatgaagaattcatagacataatttctctaaagtcattgagttggagattgaatgaatggataattgaatgaatgggtgattcaaaatacatcattaatgaattggaagtaatcaattatgtcacctggtcctaaaaatattcctctaagggcttccctagtgactcagatggtaaagaatctgc

SEQ ID NO: 50601 - DNA, 764 bp, Bovine  19866880792296
ctgtgttgagagcacatccctcccaatccaagggtcacaccagaaaatccagggtcaaccagatggcctgaaatactcagatatgagcaagagcagccatgacgtacagagaagtcatcagaagcccctaactggacccatgtccctggatttctaagacacctgcagccaggagctaacccctgtgacctctgagctccaccaggacccagggacgcaagccagggttcagtgacctcccagagctgagcccatgggcttcagccggatgagggccctccccacccccgtgggaacccctgcttggggagcagcttcaggaggagcccagtcagctcttcctgcagccccggggctctggcagcaagagaacgataaacagggctggcgcagctggtgcagggactttgtgtcaggtccctgggaaaagaggactggcctcagcatagcagggtgatctgtcatcattttctgggggctaattttaagccggaaaccagaactttgccaattttgccctctcctctgaggacagcagacagctgacaaaggtttcactttgggcaaaatggtccgacatgcccgtgatctagatttcccggcctcaaaaataagatcaaatgatttgtttgaaactgggccaccacaacacggcgagaggtgctggacgagccaggggctggggaactggtggtgtcctgggagcctgacagatcacccagcttgtcctctgccttcagacaggcacctgctcatggagtctg

SEQ ID NO: 50602 - DNA, 1668 bp, Bovine  19866880988770
tgtgggctgcacattaaaaagtgttattcgctttgaagtttttgtctaatggctctaaactgaaagaaaatgttttcctattacttaattcaatcatagcggagagacttggtaaaaagcccacggattctgccccaaagtgtgacagagttctctttgtgtttgcttatcctctgctgtcacacactttaattcgcctctctttatctggcattcaaaactttcttcaatgacattcaataaggtccagaggctggagggaaaaaaaaaaaaactggttattcccccccacacccccagatattctttcccagtagctttggccttgctcacattcaggggctcttaaccccttcctccctgggcgtgggctgcagtccctggagagagctcctcactgaccctttgcgggctcccagctgcccctttcaggcttccgggtcctacctgcaccctgcacctctcccacccacctctgcccagaagagatgccctctcccagctctagtacccttctgggcccagtcttcgaggtcctggccagcccagattttccagggggcaattagaactggcattaagctgaactgatgcaccctggcttgtccgccaacacctccccctgccccccacatagtaggagccttggggaagagaccttggagttgagggacgccgctggcaccccaggcgggatcgatccatcaaggaagctccgagtccttactcttcctgataggggacaggccctccatctcgattatttctcccctgcccctctcttttatggaatctgttatttctcctcaaataaactctctttgctttttgatcagctatcatctgctgctgtttctaccacagagatgtctcggatgatgaaaagccgtgcgaagacttccattcgggccgtcttatttcgtgcactgattccctgttcagaaagcttccctctccatctctcgcaattcctttcagggctcagagcaggtgactgcagcgactcggttccaataaaatcgaaagtaaacgtcttcctcaaaaagtctcaggctgtacattcgaaaaatgtatgctaatatcccattgtatgggaaaagctcctgcctgaagtagcttggagcccagaggacgattttagaagctgaagctgtgtacacaacgccaggcgtttgcagttgtttaaccattgtgtgaccagaaagaagagactgacgcaggtgacaggagcaggttttggggagagagaaagtctggtagagcatggccagagtcagcagaagctgggcacagagctgcccctggagccgctgctcctctatggctaacttcggggaaggcaacgacttcccagcgcacccgcgggtctgttggggcgcgggcccgtggaaagagcgcccacactctccatttctggtgttgtgtaagatctaggtctttgccggccaggctgtcctcccattccatgtctctgtccgcgattctccgtggctaatttcctctttacagccacgatcatctcccgaacaaagactaaggcgttacaggcagcatcaaagttaagagaatttgagaaacttatagaaaagagggacagcgatgcggctagtgctggatagcaaataccgaacccttctctctgcccagcgacgccacccctgcaggagc

SEQ ID NO: 50603 - DNA, 1771 bp, Bovine  19866881013563
agagctgcacccttacctgagccccttctctctgccacatacagcctgctgtgtagggcttcccaggaacatattttcatatgacaaacaaaggtcatcactttaggcatgagacatcggtaagggaacaagcggtaactccgcgccaaagccatgtgatagcatttaggtgttgctggcccgggggctgggtattctccatagtgagcgctccctctcaggctttcaattcttgctctgtgctcacgcatcacacagaattagaccaagtcgtacaacatccacagactggattctagcagggtgggttgggagggtggggggggaaagaaaatgggcaaccaccatttattcccataatttgcagctagtgggcaaaaccagatttctgcacccaaatatcagcccttcgtctgaggctttttattttcctagctctccttgagcggaggggggaaaaattatttcttgccctggatgagaaagctcactgttttatccactctcctgcactctgagtgttaaacatctagcccaccgatgacctcccacaatttcagaaactctcccgcaggtaggcaggaccagagactcagtttgcttggggggaacattcttgactcccttgggtggggacgagtctgtgaatgaagccgggcagctgtgggcagctgcagcccctccctgctgttcaggatgaacacgttgtgctcctttgtggcctgatggaactgagcaggcggcggactctggggagaccctacagagaggacactgtgactgatctccctcccagagatgctagcagagctgcagggcaggatttcttggggggtcaaaccaccccttatagaggcttcctttatgtgaggggattgctgacttcgtgccgttattggccccaaaactctccaactccaaactacacagcgaccgagtagtttttcccacagcagtgtagactgccaagctgaatggttttatcagacaacactcttccttgttgctcttccttatttctcctgggaattcaggtcagtgcaggttgaaagcttcctgtgcagggcaagagagggagtttgcaagggcagcgctctttggatcatttccttgatctgaaagggtttcagaaagtaggttcgcttgctaaggtggaacagacagcctgccctacctaggtgtcaagggtcacaggtgccccagttccaggagccacaaatacggggaaaagcagagttcccccccaggctggagcaaacactggggacctttgagcagagaggcagccctgtcaatgatctgtggattcaaggagtgtctcatctccctggaagaatggcccgccccttccggtgcctcctgctccccacccggctcagtgcccctgcccttgccagcagccaggattctggaagcccggaccctctcggaggaatgtggagtggccccgacgctgtcagtaacaaagagacgtccctttgataacctaagtggagcctgccccggagtcttctggacccttttatttacctggtttctttcttcccaccctgtcctgccctaagcagcctactcaagctccatggggtcacagcctcaggcccagccccaccccagccccaaacttccctatgacttggagacccaggtactggtaggctgggccagagccttgaagagtgaaggctggggacaaccattgagggtgattctcagctcaagccaagaggctctaagaaatgcaccaggcaccttggtctctgctggaggc

SEQ ID NO: 50604 - DNA, 1205 bp, Bovine  19866881084764
tatgttggggacataatgaatttatgaggctggagggacagttgagggagagcttgttgaggggcctggtgtgtaaagagtgttgggcttcagagtaagactggtctcacggttggtagtaggaataccaaattgtcattctgtgtctctcattatcttcttgttcccactgactggtttttcttttcttttcttaaatttatttggctgtgctgactcttagttgcagcatgtgggatctagttccctgaccaggcccaggccccctgtattggaagctcagagtcttaaccagcgggccaccggggaagtcccccctctgacttggtttgcaacccggataattcccggggagaggagtagctgatggtttctctaagccgggtaggaggagatggctgccggtccagtccttgctgcctgctgcctcctgcctccgaagggcagggagagagtgtcttcccggtgctgtccgtgcaggaccagcggaagacaggcgttagcataaaatggagagagagagcacaggccggactcgcattagcagacaatattgctttgattgcagacaacacacatgaattgaattgataaaggaatcttcccatcaaagccagaaatgagtggaaattaactttaacaaagtaagcaactgtgatcgagacagatagaagaaacccaactgcatactttgtacgtgtcagagacgtcgagccgcagagcgttcaggcccatcagcgcgcgggcgtgattaataaacacttaccgggacattcatctgacgggcgactgacaaagccccacaatgatggagagaaggggcattgcctcttgatagatgcatctgaaatgctcatttactcctttttgatggatttaaatgtccaggtactctctctccatataaattgattctgaaatggggctgggttaaaaataagggctagagatgtaactgcgtcaacatggcagaaaatatattccttctagacatccatgcagagatggacacatgctggagttaaccaaggtttgcgagatgctggggtggggagggctgcttattttttaagtgtgaagtgggatagatggacacaaaaatccacctgagagtctgtaaataatgttggaggctgtgacccaaacattagcctttttctttcttgtccgaaacggtttaaacattatctgtggggaaaagatct

SEQ ID NO: 50605 - DNA, 770 bp, Bovine  19866881095565
tgccacagccacagccacaggacagacagcccagagtctgctttacatcaactgtgcttcccatcgcacccctccaccctgtattttatttctgatgtgatcacaggtgtttttttccgcacacaggcgagtgaggtgcaactgaactgatgcctgagatttctggtaaagaaaaacacaataatttatgaaagggacctgtgtgtttgccccacttctggctggctctggcttgtcgcctgaatgaatggctccctttgaactatgccatgtcttagctcataaacgtaatccagtatcaaaggtccccaggcctggtgatgcaaaactgtttactctcgggtttgatgtatacaaaaagatgccctttatctccctgagctccagggaaagatgcagaatagatctggagaaacaagctgcgggttggcttgaaaaggccgagctgggagcgcggaggcagctctgctggcgaaacccaaacttggacacgcatgggtcactggttaggggtgttgattgtgaagagccagccagtcacgaaatccatctcgacagtgtgtgctgatcgatcgtgaccttgcagcagcaacacttagcaggctgggcgccagagaccgagtttgctcgtttcacttgaacatgacgctccccttgggtcatctaaagccacacacccactgtgtgactgatgtcaagacaccccaaaaaggaagctggagcctgggtttccactgccaaaggggattatagccagtacctccttccag

SEQ ID NO: 50606 - DNA, 1257 bp, Bovine  19866881109510
gttaagagtggatacaggatttgcatcggacagcctggccccagagcccaccgtcttggtactttatatgaatgtggattctgttccctaaggacctatcaaaaaggtgttcataatagctaccattcactgagtccctgctccatgcaggcgcactgctgagacagaaagcaaattctagaaagcctggactgaactgggcagaggggaagcagagcgagcaaggcagccaggggcctgaatggcgcgtgtttccaacatcagagcacctttcaacagtgctgggtagcataattttcctctctttccactgatgtattttgaaattgtgattgatagatgcattctttttgaagttcagtaatccacgattctttcttgtacttctgtctaaattattctcttaaattgcttcatctggactctccctttgttttatgttgagaatactgatatcatacaaatcttattcatcaaatgcttagattaattctggaaagtacttactcttgtacttgtcttactgactcatatccaaactcatcacgagacaaaagaacacgaagtataataaaaatacagtaatttctcagctattaacctgcagatattatacatgacttaagctacaaataaagtcaaataaaagattcttcgatgtcacttaataaactaacatttaaaaatcatccccttttagactaataaccttgggaaaattcaatactcaatatactcaataaacgattgatgggcatgtgaaaataaccattcttttttaattctcctttagctattctttaacaggagaaaactcttctccatttgcattttgaacaattagtaaggtgaactttcagtccaaattaagctatctttccccatgaaattctgtcatacatttttatgctcctctgcttcttgaataatcgatctcaccatctttttaattgagagccacatatgaaagtgtgactcatgagtataaatcctacacattgtaactttgaaccaatattgcaaattagattctctgagccatttttttttcatgctgatgcactgtaatgatacaaataatatcagctgcaggatataaaagctatttttcatagctaaattagttatagctttgaactacccaactagtacttgaatatgggagcagtagagtttctatagtatcgtgcagtactgtaagaacaaatggtgaagcataaaaaccactccttgtgttcagtcactcagttgtgtccg

SEQ ID NO: 50607 - DNA, 1608 bp, Bovine  19866881139274
atttctttgaggattgactggctggatctccttgcagtccaagggactctcaagaggcttctctaacaccacagtgcaaaagcatcaattctttggcactcagctttctttatggtgcaactctcacatccatacatgactcttggaaaaaccatagctttgactagacagaccttagcatgaaaaaaaaagtgtgcactgtttactctggacaagagaaaggccactgcaattccaggtgggtttctttttccatcctgggcaggtatgtgctaattcctagcctgagtgccttgacccaccccaggttaaaacgcccatgtgagtacagtgagaacatcagcatgtttggtgagaaacaggctttatattaaagctgcatctttttttaaaaaaagaaacctgaccaaaaagaaagattgactttctcaggatgctttcttttcaagatgagggggatgctccttgctgtgtctatgcagagctcaccccaggctagtacggttctaccggagatgccaaggaaagaagatgcactgagtttttaaaatgagatgcaggacacatctgtcaaacccacagtccccaaaatgatgactttctcgctgaaatagcaaatcaacatttaaagaacctttcctagttcctagtccctttcataggacaagatgatttcttttctccacggatacaaacagattttaaaatcggcttgttcaataaaatcacccagatgcactcctgagtgtatgtaggcccaggccctgcaaaccctggagaggaatgacagataatgtactaataatgtgatgtatcgggcgggggggcgattcataaaatatttatcctaaagcagaaaatgtgtctgtctgccttgttcatttatcaaataatagtttaggggaattaggtaccagctgaatcccttagtcagtgtggttggtctcacccagagtccattagaccaggttatgtatctgctgaggacgaggcatcctgtcagcagtggtgcataatggatcatgaaagataaatgggattaggcaattgaataattagaggagcgcccaccagcacggttctaagtaaagggccgcagggatttccattagaaacctccatttcactggttagaaatccatctgggaaaatttggccaatgctgaaagttggagcccagtgcggaactaaggaaaaagaatctcccccagggagtatcctggcacccaaatgccaaagtaggggtgatctaggagacaagatgttggcgagccttgagccttgcccccttcctccacctgagtaggtctcccaagcacctgatttgacggaattgagcatttccctagagaaggggaggtctgatctgctcctctgtcctcaggcttggagcccttggccatgccttagggaagggctgtgctgtgaaggctgtagcctgggggttgtgcaatagacaacttatacaaccgtattctgtcaccctccaagggcgagacctccaacactgaacgtggtgcctggcacataaaggctgctcaaaaatatttaatgagtgggcctcccttggtggtccagtgggttaagaatccacctgctggtgccaag

SEQ ID NO: 50608 - DNA, 2297 bp, Bovine  19866881334542
atttgctgaatatgctttggggggttttctcagtaaatccctatagatagattttattgtattttacccttttgtctgtttttttgtgtgtgtgtttgaaatttctcccttattcattgaccagtaactttctgtcacccatctttgacttttctccttacatctgcatttaagctgtcatttacttctgctgttccctcctctcagtatctgacagccaaagccttcatgtgcttttatccctttgtgtttgcattatgacataacctgtgcaaagtggcctggctccccaattcttgtgtgtaaaatttgcaacattttttgagacgggtcagtgctcatttttgggatcctttctttatctgagtaccgtgttaaaactttttgcagatgtggcctattcaggagcaggctgtggctgcacgcagagatggggaaaagaagaaaaggcctccccattttgcaattgccatagtaactcagacatcgccagtgtgtctgctggtccggcggccgcagcctgcgaggttgatgtcctgtgcaatcaagccctctaccggagaccccggctcgtgtgacacagggctacacagaggacactgtgcttgttaggcctgaaattaagcatttcactttaaaataatacccatttgtatccattttgttcaacataacaacagctgctgtccctggaatgacagacttgcctttttaaccaaagcttcatatgacatttatgaatgaggctggttccattcacttgcagtttgaattcacagtagttatttttgctgttttttttttccttccccagcatatgggtgaaattcaacgtgattcaagtaattatatacacagttcatggggaggaaaaagcctgctttgtttgtatcatctcttttaaactagttagtgggctttagcttttttttttctttaagaaggcaaaatatagaaggtgaattgatggtaactttaaaatgatgattgcttaaaaatagtaaacgataaagaaagaagaggcaatgtggtcactacgttttgtttattcgtttttggataaacaactaaacacatcaatccaagttcctcagtgaaaaggggcagagaaatcctggacagaacccgccctccggagtcattacaaaaccacagctcccaactcccgtcttgcctgccaagtgcccagggcccagaaaacggacaagacaaaacgacagagtgttacccaggtgaacattcctgacttatcacaaaagaccaagtagaaattcttccagaatcttctgtagtttcacaatatttctaatattaagaaaaataatcagtgttgccatcaggttcagcaataaatgcagcataatggagatgaacaacagctggataggtagctcttctgctcttcgtccttctcttctttccctttctccttcttcctccccttctttaccaccagcgtcttcaccatgatcattgctatcttcaccatcatcctcaccattctcaccgtcatcaccatcaccctcaccatcagattaacacagccctggcagaaggcaccacttttcatatcgtatcatcaaaaggcttcactcccaactcgaggattgaagaagcaaaaagaaatcaatttgggcctaatcctcactctttaaaccattcggctcacgataaaaaacagcgctgtgaactccacatcacttaacgatgctccccaacctgaaaagaagaagaatccaagaggatggttttcataataaggaagttttcatttctctcaacatggaaaaacatttagaaaatgaaaatgattgcctctggccacaaagttttggatgagctatcctgcttcctgctctgtagccctaatttatagaaaataggattgaaaagtagcttttataggagcaatttcaacagaaagtatctttcttcaagacttacagttttttgtttcccagatctttttaaaaaataattttatttatttatttttggctgtgctagctctttgttgctgagaggacttttctctagtttcagcaagtaggggctactctctaattgtgatgtgcaggcttctcattgcgggggcttctcctgttgtggagcaggggctccagcgtacactggctttaacagttgcagcacatgggctccaggacgcaggctcagtagttgtggcacatgggcttagttgctctctggcatgtgggatcttcccaagtcagggattgaacccatgtctcctgcattggcaggcagattctttaccactgaaccatcagggaagccct

SEQ ID NO: 50609 - DNA, 829 bp, Bovine  19866881367470
cttaaagttctgctaaagctttgtgacctggactgcctcctctttatgtgggtcaaaatgcaaggcaaagccattgtgtcaaacggccttcattaaattcattgatttgacctgtattttaaagaccaaaagtcaaatggaatgggaagttaaagttcccatacaaaaatcttctcctgggcacttgtcggcttccttgaactctctggtgtggaggcaaaggacattggcgaggctctttggagtctagctcgcagctacacaagttttttggcgaaaagttggagtttgtgttgcattttatgtaagaacaaaacaaacgctaaggttgaaggaagctattgtcttgaacttgattttcttcccaaagaggtactgatagtttgtctgccttatacagcatccttgcgagggtctgttctgtgttgctctgcacagaggtctctgttcctgctcagaactctctgaatgaattgtcattcttttcatcaatatgcactttttggacttaaaatgaggttaaattttctggacgttttgaggcacgtcagcattcaaagccctatcttttccttgtgtgtgtttttatggctaaaatggccacaaacagtgctcgttgaaaacagggggtggggttctggtggagggagtgggaaacaagggaagaggaattttcaataaaaaaacagaaaagggcccttcatctatgagtctacatcagcccgctatttctcctctctctcatttttagccttcatcattctcctttactttccaatttaaaagaatagaaaaactggacttctctggtggtccagtggctaagaat

SEQ ID NO: 50610 - DNA, 1297 bp, Bovine  19866881513788
atgaagacataagtctgagactactaaaggcattttttttaaataatgtaccattattagaatactgcagaataaaagatattatccaatgaaaaaagaatttgggaggtaattatagtttagtgctagagatgataaaagctgcatttacttgacagtctaaaagatttcatttccaaaggaatgttttgttatgtaggaaaattttgaagcagtttttgctaaaaatcattttctagagtttgtattatacttctatcagcaaacttggctgggaatgtttttgtgatttatgcaattagatgataaaaataaaggcatattgctattaaatgcacactcatatatcacagctaagtagaagataggccttttaaattttattctcttgagtgttttagaagcccttaatttcccccattattgctttacttatgttatacacttacttgtttcaggaaaaagtctgaaagatattaatgtctgaaaccacctactccagattttaaaaaaaacttttcaatcagtccttgatcactagactgtctcatgttttctgacatgtttttgaaaactgaccagcccattttgtttatcctttaatcatcacagttgtcccctggaagaacacatggagtgaataagaggaaagtctctaccttatggatattatgcatacttgaaaagtttcatttataaacctagttcagaatctgagctaatttacaagtgccctctgtaataaacggtgttaatgatcagagaatgtattttagaacactacagtatattgtgaagcatgaccatgttactttaaaacctagccattgcatcatttctgtagcgtgtcacagattattccagttagtttttaaattgtttttttaaacatatctctttactaaataagaaatggcaacaatgactgttatgacactctaaggtcaatagttaaccaagatagagtggaatgccccttgcagtgtgttactattctatggtgactggcttctgaagcagtctggtattgttacttgttactctaattgacatggaacaagttttttgttttttttttcccctgttccccaaacagaattttgtagcccattttgcgattttttaaaacattttaaaagaatgtgtcatccttggcgagtggcagtccatcagcaaacatcctgaccaccactttgttataaataaaaggcttacagcggacccaggggcgacttttttccaatattattttactgtggaaatcttgaagtcaacttaagctaatttggttttacta

SEQ ID NO: 50611 - DNA, 3269 bp, Bovine  19866881151372
caacttttgtgctgcctagtggggctgtgtccctgcccagctagttggttggcctgaggtgcctcaagagtggcaactgcaggctcttaggccagggcaggactgggtcctggggctaataagctagagggaggagcagcagtatccctgtggtagaaggagctccccaaaatggctgccaccagtgtccatgttttcagagtgagctgcacttgcctcctgcctcttggggagaccctccaagaccagcaggtgggtcttacccaagctcctactcaattatggcttttgccctgggttccagagcttgtgagattctgtgtgagctcttttgtgaagtctctattttccccaatctaatgtcatgtttctgtctcagcttccttgccccctgcccccaaatgtaaagccccttttggctgaactctatatgcttcatctctcttttctaggtcagacttgctttcattatttatacaaaattctgactcagtagtagcattccaggatcctgaaccaaactctaaactctctggaatataacctaggaaaaagaatctatttcattattatgtgagctttaagctcttgcacacttttgctttctcagccaggactagctcatctccacaccatccttttaagtctgagtcagcagtagtgtagaacattaactcattaacaatgaaatcctctttcctaactcttgccaggctaaggttgttttcaattagcaaatttggagagagaggttttttccccccctttattgcacagcccttccttttacagggtaactgggatctctgaactctgccacaaccacacaagcacggaagagagtcctgggcttccacacgaaaatgcagctcagctgacagcttagaagaccctgagcagaggttcctattacaccatgatacacttgtgacctacagaactgtgaatgaataaatgggtattattttaagtcatgaagctgatggtaatttgttaggcagccagaaaaacgaatacattactgaattctgtcccaggatcgtgaagctcctgaaagcatagatcatgtcatcttcatggaaaaggcccacagtccctaatgcaaagtcttgtgtccagtaagtattccagaactgctcactgatgatagatcagctcactagtccaggtgcaattgctcaatctgctcacaagcttagagtatcattgagctgcttctctgatttcctgccactattaaaatactggctggaagacaagggccagagagctaagttgctcagcttcggttctctcttcccctgaaacagataggaagtgtccctcaggcacacacgagtttaataacaatattgtgtggtcttaaatacgacaggctgggcccctctgggatctgggaggtgatgggagtggtttataaaaataaaccacgaggcactttctgccctcattcttgggctgatgagcctgatgatgaacttacactttaaacacgatcatgagaatggaccactcatctttcagttcccattagggtctttgtccagaaaaagtttgtctatgtagagatgctttgcaaaatgtgagaagggtatagcaacccactccagtattcttgcctggagaatctcatggacagaggagcctggtgggctacaatccataggattgcaaagagacaaacactactgaagtgattcattaggcatgcatgcatgcaaaatgcagctctcttcctattcttggcaggaagggcagcacggtgctggaaatggcttggctttcccttccaccttcattgctttctttgcttccttcttccctgccccctatacctaatttcactttttgctattgagctgctttttggggacagtgagagccccagagctgcagcaggcaaaaacaaacaaacaaaaccacaaaaaaacctcagcctctcagagtaagataaatacccttcaattcttatttgagtttctcactgcctagagtgtaaggatagaaaatagaactgtctaagagaagcagagagcaagaccttttccattgtgtttggaaaatactgaaaaagggagcagaaagggggatgaggtgaccctgtttctgtccctcagcagtcagtcaacatttctggagtgctgtgacatttactgtcatttcatgtaatgtcattaaatagggcataaggtggttttagtacatgtgtcccctgtgtgcccagatgtttgctacctgttctggtgctccaaaagaaaaagatgatttgggctatgcccttgaggagctaatagggtttcttgggagcatagaacccatgtatgaaaaacacatgcagaagataaagacagccccaggaccaggccacaaaactggggacagggtgtttgggggctggagtagaagggatgtgacttgaggaagcaccaatgatggttatagagatgtgtgtgaaggatctttgtggaatggggttgggaaagaagttggaaatgcagttgcatagatgcagggagcgacttagcagcagcagggtgaatgaggataaacattctttgtacccagttgtcacagttttcatgttcttttggactgatcttgttgttgttcagttgtgtccaactctgcgaccccatggactacagcacaccaggctttccctgtccatcaccaactcctggagcttgctcaaattcatgtccattgagtcggtgatgccgtccaatcatctcatcctctgttgtccccttctcctcctgccttaaatctttactaggatcagggtcttttccatgagtcggctcttcacatcaggtggctgaagtattggagcttcaacgctaatactttggactgatctctgttccctcaaatgtatatgttgaagccctaactcccaatgtgacactctctggagatagggcatttacagaggtgtgtggctgttaaatcatttcagttgtgtccaactctttgtgaccctatggactttagcctgccaggcctctctatcagtgggatttcccaggcaagaattctggagtgggctgccatttccttgtccaggagatcttcccaacccagggatcaaacctgtatttcccgcgtctcctgcatttaccactagcaccacctgggaagccctctagagaggtaactaaataaataaagtcatgaggtgggacctgaatccaatagtattagtgtgtgtacaacaaacaaacaaacaaacaaacaacagacaccaggaggcatgtgcataaaatgtg

SEQ ID NO: 50612 - DNA, 876 bp, Bovine  19866880372188
tttgaccccaatctgagacttgaattcccatgttcttcctgtaccctgcacgccttagtgttggtaagtggcacatctcagctaagatgatgaaggataatggaaagagttgcagtataagaaggggtcaagtctctgaaattgcagtcttggcctgaaacaggaagccagcccttggaagggaatctttaattagatgagctcaacttcctctctcaggagtgtctggctggtgctctcactgccagaggaagccccgtgtcagcttgtcctcccaaggtgcagtggcttctccccccaccctcctccccattgccagcacgccttttccaaaggtggtttattggagtttgttcccccagggccacttcctgagcagaacacagagacagcagtgagatgcttatgtggtagttttcttcctcgggcaaacgttagaaggggtgggcagcccgtctgagtaagcaggtctgggtagcctgggacttcaggggccaggatgcttggagctgctaagtcaggctgtccctgcctctgccttgctgaaccctctgtgggaccaaaattggaaatggcctccttgtcgcctccctgcctccttcagcagccctcccctcccctttggtggcatcacactgcatcctggggcccttgaaaggaggaggggctggaggccacggatcatggcaccaagagccaggggtctaagaatcttgtgtcagctgcagcctacgagctgtgcagcctctgggcagttactcaatctctctgaaccttgattttcccatgtggaaaattaagaactgtaagtgctctgggagctagaatttagtatccaaaataataataaaatatcttttttttaaaaaagtcacc

SEQ ID NO: 50613 - DNA, 2553 bp, Bovine  19866880478582
taaagttccttcctttctgcgacattcccacttacggcttatattttgatgccacttgctgatcttatcttccacttctgctgcatgaaagatgcagattctttttttttttttttctttttcaaaatgtttatctacagctgtgctgggtctttgttgctgcacttgtgctttctccagctgcagagagcagcggctactgtctagctgtagtgcacggccctagggcacatggctttcagcagtcacagtccctgggctcagtagctgtggctcccgggctctggagcacaggctccgtagctgtggctcaccggcttagttgcactgctattggtggatcttcccagatcagggatcgaacccgtgtcttctgcattgacaggaggataaagaggcacactgttatactgagctactgggagggaaatttctcttatttttaaagacatccctcttactccccaccgcagcttgctttctttttgcaccaagaagcacaacaatgagactcaaatgagtgtttccatagtcctgggcacacttctccatgctcagtttaaggcagattcctagatggattatttctagatcaaggcattgaactgcagcctggccctgggagccagcccgctccctggagtgccatatgggcctgctgtcgaggccatcagcttctacggagcatccttcagggaagggataatctgagtgacgactgtgtagggggatgccagcattttacgactgagaaagcaccttacttccaacgtctctacatagttgctaccccttgaaaggtagcaagatcacatggataataacagggctgctggttaaacagccatctctgggcatagagttctaaaaggcagagtttggctggacccagttctgggactcccactctccctctctgtcttgtacaccaaactgtctgtaattacagaaaagcacatgaggtcctaggtcgtcctctgttccctcagtgagccacatatagcgagaaagcatgaaaagggtttccgcttggagcctggatcatccggaacacccagctgtagactgcccagctgggcttctgggcacctgtgtgtaagtggctgacctggccttaggttgaccattcacttacacaacagcagagtcagggcagagcagacctggggggcagcaggcagggaaactagagaggagtagcttctggttctgtgtgagtcactgactcactgggtggcctgaagcaagcctctctgcgccagtatccttatctgcatctttatctgtatcagcatctttatttcctatctgtaaaacaaagggtttagaatcattgccggccaacctcctctgagctctgacacccatagcacggtgatctatctttagccatctctcactgggcactgtgatcttggccttcaagtctctgggtttccttttccttctccacaaatactgaggcttcccaggtgcctcagtggtggggtatacacctgcagtgcaggaaacacaggagacttgggtttgatccctgggtcgggaagatcccctggaggaggagatggcaacgcattccagttttcttgcctgggaaatccttggcatgttacagtccatgggagtcgcagacattaagacatgattaagcatgcacgcttgcctgactgcttccacaaatacttacggcagtcacaacactggcttctgacctcatgtttggtcttctcccttccctctgctcacagcagaacctccccattctttatttgatattttttaggggctggtaacaaaaaagtcacacaaaacattttttaatattaaaactattttagtctgggtccttcagaaaaacaaaatcaataggagataaatatcaagaaatttaccgtaaggaattggctcacatggttaggaggctgagaagtctaagatctgtggttggcaagctgaagacccaggaaagccagtggtgtaagttgaagtctgaggctgagtccaaaggcaggaggagactgatgacccagcttgattttccacatcctagctcgaagactacttcttccctggtggctcagatgataaaggatctacctgcaatgcaggagacccaggttcaatccctgggttgggtagttcccttggagaagggaatggctgcccactccagtattcttgcctggagaatctcatggacagaggagcctggaggtatgcagtccacagggttgcagagctgacgaaacaactaacacacacacacagcttgaagccaatcagagagaaagatcgaatgatcccttcctcagcctttctgttccatgtcggcctccagtggattggatgatcttacccacagtagggagggccatctgctttgttcagttcatcaattcaaacactaatttcttctggaaggtccttcacagacatacccagaaatcacgttttaaccaaatatctgggtaccctgattctcagtcaacctgataacctaaaattcacggtcacagaaatgtaattgatttgtgcatcttaaaagtccagacg

SEQ ID NO: 50614 - DNA, 1925 bp, Bovine  19866880478900
tctacagtctgttgctggctctttgatgctgtaaatttgagatgaaacaaagtccactgaattaagaagtggagaataaagaactttgtgatcttgatatcttggttttagatatcttgataactagtttcatgagttctccccaaactgctaacacagcccccaaattataccaacggatgaagtaagagctggttcctaaataatttatgtatgatgttataaggaatcatttggaaactttatgcaaggtgatgcaatgtaccagattaaaatgcctgtaaggtattccaatttttgaaggtgctggcaacagaatattgcccagagtctggtagacagccagattttaaatggaaaacaaagaggttttctatttctctatctctttagatataaatctcttttagttagaatgtaccttatactaaatatagtaccaatcctctatataacctagagggttatataaaaacaaaaagctagttcccagtgttatcttggttttggtggttacgcattcattttttagtcttttcttagaaatctcatttagtttctggttttgaaggaaaggttgtttatggggttatagtttggttgcttatttacagtttaaaaaaacttctccaggagtgtacttcttgttgccagatggaattctgcctgattcatgagctgcctaattaaattaaatctcgagagaaaaaaaaacttctcaaatgaacactatgtatttctttaccctcaccttcttccttaatcagctgaagcactcggcttgatttttattatgactaggttgtgtatgtgcgtctttgttgaaagtagggtgcagagtaattttataaatgagtgtataaatggaaaaataagccgtttttatctaaattacaagtactgtgcgttagtaatgctgcaagtgatactgatttaaattttttaatttcaaaataaacatctcagagctcttgaaaacattaaatgttatgtgttatggaaaataaaggttaaactagctttgttgttattgtttagttgctaaatctttctgactgtttgcaatcccatggactgtagcctgccaagctcctctatccatggaatttctcaggcaagaatcctgaagaaggttgccactaccttctccaggggatcttcctgacccagggattgacccgtgtctcctgcattggcaggcgaattcattaccctgagccaccagggaagcccaacctaaagaggacatggcttgaaactgccatttgctttaaaatttaggcaattttgcatcaaacttcataatattgttactttaacagtgatacatatttccagaagtgtctaccatgtttatcctgtagctttttgcccagtgtcatggagctaacttaagtactatagcttgaaaagcagaaagtactttttctttggtttattcatccagaaagtattcattgaagacctgctttatgccagacactgtgctcatgatagtcataccacagacctccatttgccatgaagtatgatatgtacagaaaggaagcaggatatagtggttaactccaccttaagatcagatagagaatcctaaaatacatgtgtcagagctgaatttggaaggattaaaaagtcttaaagcagtgttaaaatacagttttttaagtaaaatagtatgggtcttatacacatatatagtaagcatgtgtcaaaaatgtaattaactcattgatgaaacaacaaacaatatggtaaagttgattcaaagtcatataagagagacgaaaatcaatgaaagacctgatgaaataagactgcaggggcttccctggaagtggctaagattccgagctcctgatgcagggggcctgggttcaatcccggtcagggaactagatcccacatgccacaattagggtttg

SEQ ID NO: 50615 - DNA, 1269 bp, Bovine  19866880504202
aaaaaatgtcctttagaggattgtgtgtgttagttgctcagttatgtctgactctttgcagccctatggactctagcccaccagactcttgtgtccatggaattctccaggaaagaatactagagtgggtggccattcccttctccagcgaatcttcctgacccagggatcaaacccaggtcttctgcattgtaggcagattctttactgtctgagccaccagggaagtcccatactccttacattagtttattgatttagttcactgtggctgctccatgttttgcctggataggaagcagcacttttctttgaagacaagaagcagactcacagtgggttctcgagtccctcagtgccaaatgtgcttaattcttcagactctgtaagactgctctctcccactgaaatcctgggggttcaacattgtgagttgtagggctgccaggagggtgaactcaaaacatctattcccaaacctcttgcttcttgggattttaccacctctgagcctggggttcttgtgggaacctcctaaattacctccctcctctagactctcctcatcaccactcccatccccaccatctcccctcccaccagagtgagggtaaagttcaaactgcagagcagacaacacacgattctctgagatctggcctccttgagtgctggaagcagggagaccagtgagatggcttctgtatgctgggggagggatgacagtggcccgtaaaaaggcagaggcagctgagatgctgagaaactagctgttaagaaagctcacaggaggtagaatcaacaggaagtaaagacgaatcaacaagaaataaagtaaaatccataggtaggaggataaaatcaacaggaagtaagatagagtccataggaagtccaatcaaaccaacaggaaataaagtggaatcaacagaaagacaatcatatggatgggtttacgtgggggaggagtaacgaagggaaaggaaatggagaggctctcttcctagattgtttcctgggaccagcgaggatgatgttgcctttacctgtgacggaaacacaggaagaggagcaggatgacttagcctgggccccctggaaacagaaccctgagagaaaggttcctagtggggctgtttattggagaacatagtactggagagcgggagggagggcttgaggaaatgaaacaggaagggagaccccaatgccaggaggcctaattaagttggccaccaccctgagtgactggctgcttgatcccatgaa

SEQ ID NO: 50616 - DNA, 994 bp, Bovine  19866880568012
atggactttcagtttccgggatcatatatgagtcttcccagagctgatattttgtggtctgagtgagctgccttcaattggttggatgccattgatgttcataaatataccatcatcttgatagccagcctcaacttataaaataattatgaaacacatcatggacccttatctattccaaaacatttaactgccaaaggtgaatcggacctacaaagagttggttgcagccctgggctcagattggctccattctgcaccacagcactcttaaagtcagctcttttgttagaaatcaaatattgatgtgacaagtgaataattcatgggtgagccttagtgcctgagaagctctgtggaaatccctgagaggtgcttttggtgcactgatgactctgtgggcccagctccctctgccaagttcaaagtgagaggcgctggttccaaacatgggccctgggatcaagctgcctggacctacctgccaggttcatcacttattagcagtcctgaatgtcttccatttgcttctctgaatctttttctactattctccactctgttctgtgttccaagaggctgaactctatgacccgcagcaatgcctcccttgcctctggcttccagttaagttcaggcaatgggaagccccagtggagaatgcaggaactgagaagaggccatccagaaatttattctccctgctccctccctgatggatcctatgtggcccatccaagggccacattccctcttgggtggcttcttcatacatgtctctgtatctgggctcaggtaaccactccctcttgctttttcagacctagcagtggccttatctccctaaattgctagcttcagtgttctgcatgatcatttattgctttctctaaatgctgcctttacatttgtattaagtttaatcttataaaacttgtcattttgaaagccagttgaaagatgatccgataccacaatgtcatgttttaaccaa

SEQ ID NO: 50617 - DNA, 3396 bp, Bovine  19866880611167
attgagcgcctcctgtatgccggcaggatgctgggtcctgaggatggaggagcaggacagcaggacagcgagcccccccgccttcctggggtttaagtgccggtgggtagatgcacaatgagtcagcaacaagttaaacatacgattccacatgtcaaacatacgcatccacaaatgaaacatacaattccgcacatgccaggagaccagagcacggagcaggccgcacccacgcaggagcccccgtcgtgtttgctgcgttcatcatgccaggttgcaagttgggtcccggtggccgtgagctctgtctgcggcgccctctagtggccacccggatccttcttgtgtctgtgctggactgatgtccctttaacggtgggaccccaaggtggtctggagagtgagatggctccttcaaaactgtcctgagcacaagctgaaatgtctgtcccagccctaccctgacaacactgattcaagtgaagtcctgggtctgcatttgtaacaagagccccaggtgtgcaaagccagctctcaggcatccacagctcaggaaagtgtttagtttaaggcaggatttctcacccttccgaaccctgtgtgtcctattttaataacaagtatttctggcatcgtctttgcaatcttgaaattcatagatagtacaaattacccacatgatttacaaatttaatataatgctttttctatcatcaaaaagagaaataaaagcaaattataagaaaataatatcttaatgctgctgctgctgctgctaagtctcttcagtcttgtctgactctgtgcgaccccatagacggcagcccatcaggctcccccgtccctgtgattctccaggcaagaacactggagtgggttgccatatccttctccaatgcatgaaagtgaagagtgaaagtgaagtcgatcagtcgtgtctgactcttagcgaccccatggactgcagcctaccaggctcctctgtccatggggttttccaggcaagagtactgtaatggggtgccattgccttctccgtaatatcttaataataacctataatggaaaaagactctgaaaaagtaaatgtatatatacagacatctgtatagatgtatacatatttatattgatagaaatttaacaaaatcacattgctgtacacctgaaacattgtaaatcaattattgttgttgttcagccgctcagttactcagttgtagtcaactctttgcgaccccatggactgcagcatgcgggctaccctatcctccactatctcctggagtttgctcaaactcatgtctattaagtcagtgatgccatccaaccatctcatcctctgttgcctccttctcctcctgccctcaatctttcccagcatcagggtcttttccaacgagtcagctcttcacatcaggtggccaaagtactggagcttcagcttcggcatcagtcctcccagtgaatagtcagggttgatttcctattcaactatatgaaaaaataaaataatgcttttcaataaagtaagtgcttctagatggccaaagacacaggcggcgaccagaatacacccgctctcttcagccgcaaagtgccgttcgcgcctgttgtgctacatgcaggggtgaagtggttgtgccgcacagatgcctgtgttcggctttagtaggcaccgactgatggtcttcccaagtggttgtaccagtttacaccccacactggtggtggatgagagcacccatcgcccacaccctcacccagacttgatacttcccatgaaagcagaacaggcttagaggcactttaaaacagacttggtctttctggggtcaatttcttgcactgtgcagaaaacatcaacctctcatgggtggggagccctggaaaccatctcaccctggggttctggcagggctgagggtcctgcagggtggggtagctgagggtttcagcccgggttcccctggggctgttccacaggacctcctggaaggacgccagcagagcctgcgggaacactgcaccttcaaccacgagctgctgaagctgcggcattggatctctgtgatcacacagaagctggaggctcatcgtggggacacgggcccatgggacacccagtcccgggaggctgaggttgaggtaagatgactctcccgacagaggtgcttattctctcccctgcatcccaaaggcaggttcgggggcagagggtggtgaacggtactctcataccagggagcagacaccaccccaggacttaactctgtgtgtgtgtgtgtgtctcctttagagactgctggctgaattcccggagaaggaagcccagctgcttgagatggaagcgcttggccggctggtgatggaggcgtcttctctggagggagctgctctggtccagggggagctggaggagctgaccgagtcatggagggccttgaggcagctggaggagagcctgctgaggtgagagggcctcctgggttggagcctggtctcggaaaaccctccttcccagtagggagagctcagccgtgttcttagaacagatggctggggttctgctgtgtgccaggcgtggtgccaggcgcctccgggcatccccaggcaattctaagtagaggcagtaagagcagggaagcgtcccagcttagcctccagcccctgctggctggggcctcacctgcatcgatagatatatgccccttgatgacagttacatgagtcttgagcagggaactggaaatgcaggtgccctggggagcttctgaccaacctgaaggacaggcatgggcttgttaggaccagaagtcacctccctccccagttctgttacttctcctgtgatctgggaagtccctatcttgtcatcacgttgactgggcggatttgacttctcagcctcatcagaaaccggcagctgcagaggatgacagaagtggattcagggaagaaaatgattttcaccaacaacatcccaaagactgggtttctcatcttccccacggatcttacttcccggcatcgccgtcaggtaagtccatctcatgggcttctgaggagggcccagatccgagtcagttgatggtgggaaggtgtcaccagcaaagccccctccccatctggggccacatgctcagctcaggactgggccctgtcctgtcttgggtgagtctgcccagtggtgacacaagagtgccctgtgccactgggcagagggactctgggaccccagacccagtgtctgcactgaggaaggtcctgggcatctccagggcaggcaggccctcaccctcaaaaaatccgactgcttcccttgcagggaagagagtgtcagagtgtgaagcttcctagcagcactagactgcaaactaaaagtactcaagatag

SEQ ID NO: 50618 - DNA, 1524 bp, Bovine  19866880611636
atattccttatattgtcttataaaagttcttaagttttccttttcgcagttgtctgtaatccacctggaactggtggaatttggtttgatttttttctatatagttacgcaattattccagcactgggaagctgggataaatgggaagcccaagtcccccagtgatgagcagtgtccatatatgtgtggctcttcttctgttctttggacgtattttcctaagggttaactcctaaagctgtacaataattcatgatgtcttataaggcaagttccctttccttatttttccttaataaataatttgcctattattatctctctgcactttgatatacattttagaatcagcctgctgctcctgctgctgctgctaagtcacttcagtcgtgtccgactctgtgcgaccccatggactgcagcctaccaggctcctccatccatgggattttccaggcaagagtgctggagtggggtgccattgccttctccgagaatcagcctgctgggtagcaccaaagaccctgtagaaattttgactgtagtagctctgtatatagatcaccttaggtagaaatcatgttttctagatactgactctcacaatccttgaagatggtgtgtcttccttcttatataggtgcaactttatgtctgtaaacttttctttttaaagaattttacatatttttgttagattgatttctaggtaatttatatttccactactgttgcaaatgctctctttttgagataaacctctttattgagataaaatccacaaaccactgcattcacctcttcaaagtgtacaattcagaattgtgcaaccatcaccaaaatctaagtctagaacatttttatcatgccccaaaaaatgcctttctcattagcagctaactctcactccccttgccccactccagttcctggcaggtaggaatgagtgagggaatgaatgaatgaacttatgcctatgcatctggcttcatgtcagacgttgcctagtccccagctttcctttctgttttattttggttctgttttcccctcccatctctgttattggtctagttttcagctaatctcccaacctctttcattctcctccactccctgaccagacagcttttcccaaggaaaaccgtgttccaatcacttctctcgaaggaaaccctcggtggctcccttgggaacccggctgcactcccaacgccatttctctggggagattcaggctgatgactcaagccccttggaggcagacttttggaatgtagctcttgggagtcggagaaggcctcttctgggctcttggtttgctgcagagacctcagaaagtaaacacagtcgacctgattattctcctccacttcctcctgagtcagagctgtcttgggttaactcggggaagaggctaaattaagccttgaaaccaagcagcctccatgactggtactttgttttgcttgagtgactgcgatgatgggtgttggggttttaagggcagaactaattgtgtct

SEQ ID NO: 50619 - DNA, 1057 bp, Bovine  19866880611918
ccaaagattcctttcagctcaaaacttttaaaagtctgtatgggttgcagatccacagaccgcgtgcatgtgatatgtttcttagtggacccactgttctaaatctgtccctcatcaccttggcctgagatcgatctaagcacctactctgtgcccaccaccaggcttttacatattttattgtactcaaacttcacaatgactctcccgtttttgtgacagaagacacaggctccaagaggttacagactcgcccaagtttgcaccgcacataacgaaattaaaatttagtccttggtgattcttcaagctcttggcagttttagggtggaaattccctgacatagcacgagcagaaaaacactctccaacacggatatcgacacaaagccactgcgggcatggacccaatgtcacgtgtagatccaccgtgcatttccagtgctcagagggttgtaacttgatcctcttcagtgaggacaaccccgcaggcattatcagggctgagcgggtatcagaggcccctgggccagcagtcccttggctgacttccagcccataaattgtcctaaatggcctcctggttttggctgttggtggagggtgggagatggagaggccctgagaggcagtatctttcccatctgttccacattatgatgctgttaaatatttcatgctctccattgtcccaacaaacacaaacagaactaatctctgtgcttaagcttccttgactgacattgctggtgattaaacaacgtacttattttcccataactggggaggactggttcttcaggaggtttggaagggaaataggttctcacccacaaagctgggtgagaattctcctcatgctgacagggtagaaaaaagtgacatctctaaagatgagggtggggatgagacaggctttgcaactgtttctgctttggagatgaaacctagaggaaacgaaaggttttctgggatgtccatttatccatctatccatttatttatccatccaaccagccagccatgtatcattttatcccttgttgctgcaagggag

SEQ ID NO: 50620 - DNA, 1471 bp, Bovine  19866880713971
tcctatttggccctctggggaagcgttggtcaacccgtgctcgtggtattgcttgcacaatttcccacccagccactccatgtatctgagctgttgaccatcaccaccacccgccccctgccatacccacagtcccatccaggtccttctgtaaaaccagtttccctggctggctggccttgactcccttgaaggggatcagggaaagagcacattggacgcggcgtcaggagaaattgcttccagctcccagcaatggccactaacttgctttgcgactcttggttaactcaagtagcttttctgctcctccattccctcactgtcgagtggggagttcgggagtgaattactctggagactgcccacagcagcgctggcccttttcaaaccatcgaccacgtcctcacaaggaacacgtggagagaacaacgcaccacgcagggctgaggaaccgctggatggagcccacgactcgtcctttacgctgggaccggggacaaggagccgtggaggcacgtgtgcacgcccacacagacacacacgctacacacacatgatagctgcacacacttgcacatatgctcaacatacacctgcaggcagcacacacatgtcacacacgcaccaaacacacacttacgtgcacacatacagacacactcacaccacacccagacatcacaaaccgacacacagacacacagaggcagacacacatcacactcagaggcacaccccacaccatggatgcacagacccacagagacacctgtgacttttcatgggtcattaaacagggagctccccccgcccctgctgctctggggcatatccctggggagccctccttgactcctggcttgattaagtcaggtcttcaagaaaccagaaaattaaatttggggccatttctctgttccggatattgtgcataatttgaggattactctgggcaaggaaaagagaatgaactttctcttttaaaaaactgggcttgaaaaggaaaaccctgttgtgagggttaacaagtgtgctggcgggtgaggtcaggaggggtggggccacagagccatagctgagcaccaaccagatcgcctgctggggtcaggccagtaatgcaggggctataaagaaagagattgcatttaattaaagaaacatcttcttacaatcttcattttgctgaaatgcaagtccaacccagaacaaacacccagaggccaaaacacaaattttgtagttggggttgctagaaaacctcccatgagttaccttttaacacgtgtcagaaccagaattcatccagaagttgggggaagggagggagggagcccttcatttgatgggtcttgcataccataggcggagaaggcaatggcaccccactccagtactcttccctggaaaatcccatgggctgaggagccggaaggccgcagtccatggggttgctgagggtcggacacga

SEQ ID NO: 50621 - DNA, 1714 bp, Bovine  19866880736523
gcacccccaggacctgcagctgtggagggagctggcccagagactcctggatgtcaccgccagcctgccagacccgccctccatccacaccttcctgccgcagatcgaggtaagcctggttctgtcgggagggatggtgggtgcccccgggggagaccaccagccaaatgtggcatttcagccatccccgcagggaaagaaatatctctcggttctccgggtatctgggtggagctcactgtagcagtctggcaagtcccacgttcacacttgtaattatcagggacaaaagtcaccctcaattcttagagaaaaggcgaagcctggtgcctggtgtggccccaggactctgcccacgccggttctcttcccgaccctgctgcagacagtcctctgctggaagtctgaggatgtcaggccgttatctttactgtgtacccattgggatgcatgtgacaaggggcagaaaacctgactttctggtggttccagagctggcttgatagctcaatggtatgttccagaacccaggctctttccagctctaaactgcatctgccttcatggtcctggggtggctgccagcactgcctgtgtgcatcctcacaggtgtattgggctcatgatatatggctgtttgtcctcgtattttcagttgacacatctgagctttttctcagcatcctgtaaaatggttcaatagcatggctcaataattcactttaaatggatgcagaatattccatttgggggcatgcccttttatttattttttaaagtagccataattcgattgttgaggttgtttgcaattttcactgtcataatgaatgtacactgaatatgtatgtacactgatttttatttccattgctaccattctcctcattttactgatgagggatctgggccaaggagaagtgagagagtgtgttcaaagtcttgctgctcaagagaagcagagctggggccagaatggtgggttatagagtcttggctaacattctcagccctgtttacactttggcttctggaaacagctttgcgaaacaagcagaacgattcttatcatttgactgttgaggagccacttgcttgaggttaacacagccgttaagtgacagggctggctttgacccaggcctgtctaactttccctgctgtgtcaggatattgcctcctgtgcttccaactggggcagaaagcaaactgggaccttcttgaggcaggagagaggtcctgtcgttctagagtgggacccaggactccagggcaggactttcactgagcagtgggttggaacacgtggggccaggactttgacttactcacctttggagtctgtttgctggttgggagtgtgtcttgcggagaaggcaatggcacaccactccagtactcttgcctggaaaatctcatggatggaggagcctggtgggctgcagtccatggggtcgagaagagtcagacacaactgagcgacttcactttcacttttcactttcatgcattggagaaggaaatggcaacccactccagtgttcttgcctggagaatcccagggacgggggagcctggtgggctgctgtctctggggtcgcacggagtcggacacgactgaagcgacttagcagcagcagcagaggaacaggagatcaaattgccaatatctgttggatcattgaaatgcaagagagttccagaaaaacatcta

SEQ ID NO: 50622 - DNA, 846 bp, Bovine  19866880787853
caaaatatcattttctaggaaatcagaatctcctttcttttaaatcaccccacgctgaagatgctttttgttaggaagagaatggagcctgttcctgtatttgtttatgtgcttaaatatcttggaaacaagtaattgttacattcatttgctaacggtttgtcctcttcgttggctggctgttgcaaacaaggaatacagtactatttcagtacttgtttttcatgtaaatactagctacgtaatatataatgaactcatttttatcagtccatattaataatataaatagattcaatgaagcagtgaatttaaaaatttgtgccagggaaactagttgataatttgtttccaataaggctagtagcaagataattactacaaagttagtctgagctagtagtaaacccctgatttagcgagctgaatcaaagtctgaagttagatcattttatttcctctattactgtgcaaatctagaatttcctaggtaagagagagcgctggcagcctcaaagtcctataataagctaatgaaatactgcttaggtttctgaaatgcagagatactatatgaagaaatctgaatgtcttaatgatggtgtcacagcagtgaccttaggatttctatttcctaaatgaatcagaaactaagaaagacaattcattgatcaatcatcaatcaaaagcctacatgtgaagcaaaaaaaaataagatacaaaatcaaagatgcattttctgctatgaccatatgcagcagtttcaagctgtatgtcaaccttggggtaccagcagcgagccccctctaacaggaaaaagcttagtcatgactgtccctctctttt

SEQ ID NO: 50623 - DNA, 1440 bp, Bovine  19866880834885
caacaagatcgttattagcaccaaagaaaacacaccttgttgtgcaaggggaagacatggcctactacatggccctacatgtcagtagcatttatctagtcataataacatgaaagagagtaaaagagctggcctaaaactgaatgtttgagctttaagccaactttttcactctcactttcatcaagaggctctttagttcttcttccctttctgccacaagggtggtgtctttatacaaggactggagagttttaatgaatttctttgcattctattcctctgctattagacatttacccccaaaatactgttgtgtgtgtgtagcacgacaaacaggttttgtgtacaggaattcatttgaaacttgccttagacctggataattgttctcgggcatttgggctcctaaattctcttttcactctttgttagtaacatctttttgacaaacttgagcacttcgggttcataagtttgttttgttttaccttcataagcattttaaaaaattttaattcagaattataacaaattcagtaagtctaacaaaattaaatattcctgaattatctccaggatatgagtatgtattggacacaaatgtgatttttatgctttttgaaactaaaatgacaataatttcagtgcaaaactccgattaaaaaaataacccatagtttttcacttctgaaagttgttcccctttagccctatgctcctctctgagtgaggactgaactccctggctacacataggcctttaaaatcagacatctgctggacttttgtctattcagaaccttatttcatttcgagggaaagaacccaaatgatatctcctataaggtcatattaaaaattaaaagttaatcataaagcatgctaagacttgagtaaaggtgataaaagaattgaattctgcttagctgtttagtgaaacattttaatgttttgtgttatgtttctttattaacaggtagattccataactcaaactgttactatgttccagagacttctgagaaggtgcctagaccacagaatttcagcagcaaggagccagggctgttgtgtgttgcgcattaggacgatttatctgttggcaggagtctatgtctccctctgataatctctgagctcgcagccagacgaacactgagaaaattttattgttttcctttgaatgatgactaagatatattaccaaggccataactactctttatgttgagtcagaatttcacttcatacttcagcctttgggccttaataattacatgcttcagagttaaatcttgctctcctgggcatccatagctctagcctccttcaccagagtagctagcaaaggactcttgtttctcagagtagggggagtggtttgggaagtgggatgacattaactggttattttccttttgcaggaaaaataatgat

SEQ ID NO: 50624 - DNA, 1615 bp, Bovine  19866880850913
aattgatgcataaattgtcatttaataacttgaccaaggtcatagctagttaagtggagaagacagggtctggacccagggagtctagttctggaccggctgttcttaccactgtgctgtgctgtgtactggacttactgaagagtagttgtgtctggcatgttataagctcgtaaggttgtgatggtgaatcatcttaaattatgagcgtaaatgcttccagtgacaattgatgtttgtaaagatgttatgtttgaagagttatgatcccaagttttgcctaaaacatctgtgcatggaaattattagtaacctggtatttaattaacaagaatactttatatgttaaccaagctgaggagacatactagtacattcctatggaaagtgaaatattttacccttattttaaaaatatttcattagaaggacttttaactttaattttagaaggcaataattctagtaatctcttgtcagtttgttttagataacataaggaagtgtgatagagttcttttataaggatatacctggaaaggactttacacagtttgtgtgttccttctccaaggctgctcttctggtttgtctgcatttatactaaccttctaaagcccacgtcggctgctacctctactttccgctgaattcccttaactagaagatttagcctcttctcttacctgatatgatattttctgttgacactctgtggttgtctattaattcttcttatttatatctcgtttcttccactatcttgtagtctctttgagggcagatttaataattattgtatttttctaccctataaacggagtcagccaactatggcctgcagatcaagtctggtctgttacctgtttttataaataaatttttattgaaatatcacctggtgtacgtattctctcattcattaattctctctggctgcttttgtactagagtgagagagttgagtagttgtgatagagaccatatggcctcaaagcctcaaatatttgttatctgatcctttgcagaaattttgttgacctctgttctacagcattttgaacaataccacccatataaaatatccattaaatacttgagtaaatatgtgaataagtatttggcagatatataccatgtaatgagaacatgtgtctcaacttctttctgtgatttttttcctcccttcttggatattataagggtgatgtttaaatctcaggagtaagttctagaatactgtatccctgggtgataccatgatgctaaatatctcttgggggattaagaacttattagtttgaaatgtgtagttttaaggaatggcttagttgtaaccatgagaagttattgaggatttgtctgtattttctgcagcatctgcttctgagcccatgtattggtcaagcttcatgaccagcagtatgcaattggcaaaagaatgtcttagccagaaactaacagatgaacaaggagaaggatctcagccttttgaaggacttgaaaagtttgctgaaaccatcgaaacaggtttggcattattgagtatttaaaaaaattttagattgtatttaataatttagtaccttgatttagtatgtattgtgtaagaaaa

SEQ ID NO: 50625 - DNA, 1193 bp, Bovine  19866880892042
attgctgagcagaagaaaaatatgaagttatgctgattaggtctgctaaaaattcttgatcctttcctaatgaggccacccacatcactgtcaaaacctttcacttgtccttttttcagcctccatttccacttcatttcctctttcctttctccatggattctctcctctttttcctgcttctttaacttcctcctctcaactgctttcatgctcgggtctctttcacttcagctatcctccaatctcactgctgtttttctcttcccaactgtcaagagttatctttaatgccattcacagatttcccttcatttctcagcctatttaaactggcttttacctcccagaactggtcctgggaagattatcactgaacttctgagaaccagtgggacgtgtttcttctgcacctcgtcatgatgcttgtctccaagatcagattctgctgatccctggattttgttgaatatcctttcccaaggattccacagcattgaagcttcaggtttatctcatcccactttcatcctttctctggattcctcataggctccctctcttcccattccaaacgtgttatttcttaacattctattctcagcctgtgggtctttgaattttacacacagccttgtctaggagctcttgttcagttgtttttagtcgctctgtgcgaccccatggactgaagtatgccaggctcctctgtcttccactatctccaggagattgctcaaactcatgttcattgagtcagtgatgctatctaaccatcttgccctctgcctccctcttctccttttgccttcaatctgtcccagcatcagagtcttttccaacaagttggctctttgcacctggtagccaaagtttgggggcttcagctttagcatcaatcctttcaatgaatatttgggactgatctcctttacaatggacttgttcagtgccattgtttaagtgaccaactaaatacaactccaaagattgtatcatcaaccagagctttttccagtgagccagacttatatctatctgcatatcagatctttctactttgacacatcattggttcctcaaactcaacttgtcccaaagtgctgtcttttgatcttaaatggtggcatgaccatctacctggttaaacctggaagtcatccttgactcttcctccccttactcatcacatt

SEQ ID NO: 50626 - DNA, 720 bp, Bovine  19866880934515
tataggactgagggtcttggttggttggctgttgctggccagaggccaccttctgttcccgcctgtttgttggctgaggttgctctcaattccttgccacgtgagccttcccaacatgtccactggcttcatccaagccagcaagggaaaatatactaacaagaaaggtgttaccgtcttctgtaatataatctcagacgtgacatctcatcacctttgccatatcctgatactgagaagcaagtcacgggtcctgcccacgttcaaggactacggatagtagttcacacgtgctggcccctctaagcatttaagccttaactactcaatggtttcctgaatccatgcattaaggattgaaataaaaatatctgatgtaccaagtaagaactcagccaggcgaaagtattagttttgatgtgattaacagtttcaatatgtatgagaatcatatagcacatcccgcttatggctatgagtacataattttccttaatgcctgtcagacaaggaatttagattagttgctattttttaacacaatttcagtaattcttgataatcaatttgtttcagaaagaattcagcattcttgcagttcaatgttctaaaaatatgctctaggaaaaaaattatagcctaatgcagagtgcatgtcttttttttttttttttgctgaataatgctactttgtttctgcagagtcatgtgcgttcccca

SEQ ID NO: 50627 - DNA, 3457 bp, Bovine  19866880948551
ttggcagccggtctgaccctgcctggaagctatgggaaagtctgtctcttctgtggacatcattcagctatttaaatgacttaaatggcaccccactccagtactctttcctggaaaatcccatggatggaggagcctggtaggctgcagtccatggggttgcgaagagtcggacatgactgagcgacttcactttcacttctcaccttcctgcattggagaaggaaatggcaaccactccagtgttcttgcctggagaatcccagggatgggggagcctggtggctgccgtctatggggtcacacagagtcagacacgactgaagtgacttagcagcagcattacacacacacatacacacacactcctgaagtcactgctgagataaacccagccaggagtgcttctccgttgtgtgggttataggaagtctgttttttataaaatcagtgcctgggatctttggtgagtgagaacacttgaagctggaggcacagggtcaagtgtgattaacctggaggagatagctgggacaggagagtgggtgagatcattcaggcatgagggagagagacagaagcgctcaggtcagaacatcccaggaacacctgcgtgtttcctgttaccaccatgcccaccaccaccaccatcactcccgtcatcctcaccagtatccccatcactatcatcagcaccatcaccatcaccgatatcaacacacgtaccatcagcactctcaccgtcactgtcgtcaccatcattatcatcctcctcctcgtgaccatcatcggtaccatcatcatcatcacttgacttggtaccctggaaaatgactctttggttcctcacggagctagtagatatattctataataatagtactagccataagagcatatatactttttaattggtgtgtaattatactttgcatccttgccaaaacctggaaaatagaggtaggtgtttgatccccattttgcagagaaggaagctgaggctcagagaagttactgacttgcccaaaggcacatagctattgtgggacagtgtgcactggagcctagatggccaagttcctgagagctgggcctctgccctgcaccatgctgtcccttgacggtggggcctccactttgagtggacagctgttggccctgcctgcccatgaagctgcaactcagccagtcccttgagaacttgggaaatattctttggctgctttcacggatgttgccgcaaagaagctcattaggtatttggacatgtgagggtgttgatgatgaagatggtgatgaggagcaaggagagggaggaaaagaagaaggaagagggagaggaagatgaagaaagtgatgatggagaacacagtgatgggtggcagcgacggtgctgctggtggtcatggtgatgatggtgatcatcatggtgatgatggtggggatggtggtgactgtgacctagatagtggcaataatttttgtgtttttttattgttcttttttcgaacttttgtgttaagagctgacttttccccccttgaatgtgtcttgtgtaacagatgagggggacagcctcctttcaccagcaacccgtttttcctgggaacaggggggctctgcattggggcacatggtgagcccagaggggcactggctatccgaggccaactgggcccctgcagggctgctgtatggtcttgcctgggagggattctgacacagaggtctttagtcataaccccgcagatggtagcttcaccccactggccaaacacacacaccaaagatggtgacgatagtaatgatgcataataatcacggcagcagctttgagtccctactatgtgccaggctcggtttcattgaatcctcactacaactctgtcaggtaggtgccattattcctcctatttatagaggagaaatctgaagtttagtgaggttgaatgacctttttcagattcacacccaggattcttataaaccaggcaaagattaatgtgacaacggacaaagcctgtaactgttttatcctcttcctctcttgccttgagtggtttgagaaaactggagatctttgtttctgggagaacagacattagccccacttcacagatgggaaaactgaggccgggtgcagctggagagtcagcccggagccagtgtggctcctcatgtcgcccgggggccctccccgcccctcgcctcccgttgcggagccccgagcccgctcacgtcttctgctctgattttgcaggccgcgcgctggcgagggctcagctcgctctgccggaaggtatgctgcgtggcgctccccctgcagctgctgctgctgctcttcctgctgctgctcttcctgctcccggtcggggaagagaaccgcagctgcttcctggccaacaacttcgcccgctccctcacgctcatgctccgctacgacgggcccccacccacctagcccccttcgccccaccgggggcactcgggggatgctcttctccaaaattccagttgccccagcctgggggacctggaaacagaggcaggccagagccctctgggctgcatccatgtaaatactatatcgatgttctcagaacaaaattacttttttatacagtgttgtctcagtctatttatactaaatgtgtactgcgtgtgactgaggggataatgcatagccatttcttttatatgctctgtatgtaaatgctcagtatgtatcatttcacatatgacctctatttgtcattgggaaaattcccaacagtgtttttgtccgatgggatcttgtagcattttggccttggtctacagtcagccctggaaagcagggacaagaacgtgtcgcttgtatggccatctcctatccagaaaccaagccccacgtccagatgttcgtgaagaggactctgagccgtcgacacggaagaatggcgttggccctcgctcagagcccactgactcttggtctaggtacagtcaggacagccgtgctcctctaggcttcagagtgactgcagactagacgctgtgggtgagaagcagagaaagggctgattcggggctggcccaggagcagcagtgaaacatggcaagtgagagtgaaattaatggaggaaagaagaactccaaggagcatacccggagctaagcaaagcacagcagaagggggacctcggggagcctgaatagcccagaccagtgagaaaggtcccgtggtctgagtcctcagggaacggttaggtcatgctgcccatgttctctgctctgcttgggaataaaatgaaggagaaggagcttattgtcaagattcccacgtggaaggataagcacaatgtctgtagcacccaagtggctgacagtgccggaaagatgtgttacctccatggcgccgaggctgagtttttcatcatctacagctccggctgaagggacacagggaagcatctga

SEQ ID NO: 50628 - DNA, 1132 bp, Bovine  19866880979112
tcaacttacagtttacagtccaactttggaagccaactgcttttgtttgatgtgtataattgtaatttcattcagaattcccaagtatgtcagtatcccgtttacaagcattaatttcaagagtgtcagaattcaccaatgtagatggggtttaaaaattaactgataaagacacttaggctcagagagtttaaattacttgccttgactgtatcccatataactgataaaactagggttcatgtctgggtcttctggaggtttgtttcatcatggaactaaaataaataccttagctcttcttttttacttcttggtgatgattatattatttggtttaatcttgaaagttatttttgttagtttactctctgtatgaattgaatacctgccagaataaatttctctaacttaaattttgtttagtaaacaaggaaagggtttttaaaataaataaaatttataagattaacattgtttagttggtatattgtcttaagaaggtatacggctgaaagacattctcttttatttagatcttaatatatccacattatttattttgtggtttttattctccagttgaaaaggttaatttacatctaatttcagctattagtaatttttaatataaataactcccccttctttctttatcttcagagaatttagattcacatcagaagttcctattcgacttgattatcatgggaaacacgtatcaatggatcaggtctggaaattttgcacagatatactctacagaattatctcatttgtttttctagtggactcagtttttaggaaactttttcgatcatagtttatgtgtttgaaatgaagtgtaagattttaaaatttaattctatttttaaagtaaatataatttttacttaaggatccaaattttacttaagtaaattaagtaaaattacttaatttacttaagtaaaatttggatgtcagttgggtcttataaaatacatatatttttttgctatacatattttaggtgttttagcttaattagtgaaatttttttttattttaaagggtacattagctgggattttgattggtctcgcccagttaaactgctctgaactaaagcgaagaggcttttctatcggca

SEQ ID NO: 50629 - DNA, 1715 bp, Bovine  19866881014315
ttcgctaaataagaaaatgtgtattaaggctgggctggagctctcatcactcactggcatcatctgcatttagcaaatgggcctgagctccactcacagccttaatcggagactggggaggaaacaaagcaagcagggtctttgggcagccacctcagagaaatttagcatgaggagtgtttattaaagagcatcttcaggatccactcccatgggagggagggaaaggaagggaaaggggaaggaagcagagggcgaaggagagatgcgatgtgggtccactgagcacccatggccctgaactcagtgctagctgcagctgaagcatccctgggggtttgctaggggcaggctgtccaccaacagcacaccggtatttgggcagcaagtccttccctgaagagggctctgggtgttgcatctcccagcctgagatccctctgcccacagcaataacagtcttccgtttttgtacacagatcacataacatcttggggtgaagcaactgctccagattgttcagggctactctgggtaaaatctgtcactacgtttgcatgatcaaatggactgtccaatatggtagcttctggaacaaagctggagacagattccggttccacgcccagaatgaacataacctgggccatcagaggtgtttctctccaaagctttggtcacccaaggcaagtggggggagggctgtatccgcggaggtcctctcaaaaacgttcttctgtgggctctcttcttggggtggcttccccttgcagatggcaactccaggcttaaacactctacttttcaagagagagggtctctgtccaagtaatccacacacctgttaagtttcattggctctgattggtctggcctgggtcatgtgcccatccctgaaccaatcactatggccagggcagcttgcactgctctgattggccagccaggcaaggcgctaggcccacaggtggagtagaggatgatggagtcagattcagagttacatcgtggttaaaagcgaggagtggtggctcccaaggatatttcccggcacggacacacacgaaaaagaggaaatggttgctgagcagacagatacgaaggggagtgactgagtgattgaacgtttgcccccaaaggcggcctcagaactaggagcgctcccacaccccattacgacccaggtggaacttccagggttagattcaggccctgtcttgccaccgtgactctggtttgtcatcctcacaagcaccagtgttcaccctgggtttctgggagttcatgctttctcctgtgaacccccaaacttgggactacagctcaacatttctgctgtgtcagctagctttgggtgagggcgtaggtcactgcttatgtggactggagccatgctaaagtgctggctttcacccaccagggcaggcatcccatgagcctgtcccatcgggcttgtgattaagggaaccgaacatgcagtcagcagcaaggccatgtcccacactcaagcaagtgtgttcgccttctgagcctcagtttctttgaaagtgaaagtgaagtcgtgtcccactctttgcaaccccatggagaatagcctatcaggcttctctgtccatgggattttccaggcaagagtactggtgtgggttgccatttccttctccagggaatcttcccgacccaggaatcaaacctgggtcaccagcattgcagg

SEQ ID NO: 50630 - DNA, 1828 bp, Bovine  19866881049530
atcagccagcttcctgaataaagtcctattccttgccttaaaaccccctcccttctgtctctcagattcattggcctctcgtgaagcaagcagaacaaggttggcctcagtaacaatcctatccttggcagtagtattgatgaatattttaaaatagttgccagtttggagaatagaaaatggaatagttttaatttgctatcttttaattcctttatttactaatttcccccatctaatgtgacacgccttgacaaatccttgctcttttttctattaactaaatttagcttctctataaagtaggaggttggatcacaaccaatcaacaaaggtaatgtgagagcaaattctagtggaagacgttgtctaccatcactattaattataaagctttaagtattcctaagaacagaaaagcgtcacatcctcatttatgcttaccctccatcccaaccagctgtattttgatcccactctcttcctttttctttaaagccctgaagacaactttgatgaatgccagctgtcaactgctaaaatgataatcaagctcttttgagagaaattgatcttctagcaaaaaggcacttagctccttttgagatgttccaaaatctggatttgattactaaatcttttgcatctcaaaaaaatgtacttgtgtactagcctctttttaaaaagctgtttttttcccttaaggattaccttctgagcaaaaaagtcacattgtcaagatatgagacttttctttataatgaatataattttcaaatgttggttatagtaaaagtgttctgagaaaggctcttgttaaaatagacttggtggagctgaaactttgaaaatcactcctaagtaagagacaatagactattgaagatagaaacaatgaagcatcttgttgtcacagccatttaattcaatttcgcaagtgactgttgagtttctgccatctggaaggcaccagactaagctctgttgttctctatgccgcattccttgattcagcatccaagggccttccatgctcttgcacaggctaccattccagacttttctccagccataccccatatagtacagccacacagaactctgagatgggcctccagggtctccctgtccccattccgctatatttgtgattgaggttttctctgattatcctctttctccctacaatgtacagcttctgagacctcaggccgcagcctaaattccctctctgtataaactgttctctctcctctgtccccagcaaagttactcttccttctctagtttttgtcaattgttctttctcaccatcaacagaggctacaggttcttcaagggaatgagctgtctctccaaatcgtggggaagccgcaggcattgttaacacgagtttgtggatgggcacaggagcagatctgaaaagcagtcagtatttacaaaatgtcttcttcacagagttgaagtgatttaattataacaacagccatgcaggctcgatactgtgttatcccatttttgttgttgtttagaaataaagattgagagaaagagagtaggggaggggaggcagaaacagaaagaaaaagaattaaagaagttcctcccttcaaggggtttacaagctagtgggagaaagagaaactgtgtgcatttattagtaatagggtcttccagggggcgcttggtggtaaagaacccgcccgccaatgcaagagacgtaagagatgcaggttcgatccctgggtcgggaagatcccctggaggtaggcatggcaacccactccagtattcttgcctggggaatcccatggacaggggagcctgg

SEQ ID NO: 50631 - DNA, 1435 bp, Bovine  19866881057702
ggctgacggacgatcccttcccattttaatagcagtctggtggtgatatcatagcaaataaatttaagtgacatgtggagtgcaattgcagaatttaaactctaagcgagcactgtattttttttctgaagatgtgacacatagctgattgacctgcattcctgagtcatatttataggacagaagccttcttggcagcaacgtgaatcagtttgtgatcttcaaggctaataggataagccagcaagaaaagctgggtctgtgcggctctttacatctaaatgggctggagtcattgtaattcttgctcagtaccacggagtccattgccactctgactcagggtgcctactcaaggcatcgttcccattaacgagagttgcctccacaggtgccgggatggccaggacgatgtgagggtcacttgaagggtgttgctgaattgcttcgttcaagcctctccttctgttgatcctgaaatgccattagagtggttcaagtcaatttcattcactgacatccaagctggaagggagcataaagggtatctaaactgacatcttcataggacaaatgggaaacaggcttgcaccaagagtgtctcacccgtgatcacagttaatgacagagcaagaactagaccccagttctagaccctacacccgctgacttttcctggaggtctgactttgccatgtcctgtagtcttctcagttgaataaaaataccatggggtatcaacaggctctgaggtggatgacacagacacatattcattctttccacaaatactttactgcatatctattagatgtgaggcattcttctaagcactgaggacatcatgatggacaagataaaggctttgctttcacgagcttctagggaaagagatgaactgataaactaatgaacaagtaaacagatgacgtcaatgaactagataacaatgaataagaaaaaataaagccatgcaaggacttagagggagagtgatgattctcgggagctattttggagagactgatcgggaaaggtattaaagtttcactgtgaaggtgacctttgagcagagacaaagtaatgaaacaagatgtgtgaagagcacttccggcagagtggagagcaagggcaaaggccttggggtgagaattagctcagtgcattcaaggaacagaaagcagattgatgtaaataaagtcaaaggaataagatgagagtcttagagcaagatagctcaactcaaataacattgagggggaaagggggtaaggaagtggagatagcagaagccgatcctgagtgattttgatatgaatgggaagagggaaaaaagtgggtgtctggcagtggagtctaagagagctcttctgaatttgggagatattccagcatggttgtgtgctgatggaatgtctagcagagaaagaaaaag

SEQ ID NO: 50632 - DNA, 2001 bp, Bovine  19866881140510
cttatggctctcagaaccttttgttgtgctcccccgccaccctcgacagtttgctttccagccgctgccggagggagccttccaaaggatcggggtcgtctctgctcggagctcgccagtgtccccgagagcactgacaggggctgtcttcagggccctgcaccgcctggccctgtgtccgaccttgcctgccccgcccctcgcttctccccttctagccgcacaccggcttccatgctgttcctgaaaccgtcgcagctgcccgaagccctgtcactctccaggagcccacggggcctggaggctggaggggaagggggctcagcaggtggggagcagccctgatgagctgccatgctccgtgcccccacggctttgaaaccttgtccaggtgacgctgtcatgctcacggggccagtctcagcttccaggccctccgccacatatgcactgttttaggagcagccctttaactcagagcaccggattatagggtgattcatccctgatggggtcatcgaagtgggtctggagttctcttccacaggaatttttctagaaagaccctgattccattccttccactgggtgagatgtttcttcagccacagttaatcctggggtgggggcctgctgtccctccttctctttcttccagaaacatgcccagagcaccagctatgtccaggcaccattgcaggccccccttacacgggagacgcagtggctctggcgtctgcttgctttcatctctgatgctggctcttgctttcatgcagatgcaacagtgaggcctgggctggagtcctctggcctccgtcttccaccgaggaagaggtggaaggtttatcagagtgactttcttgggcctgcgtgaagcaaaccacactcagaaatattgtgtgctgagtaggagggagagatggaccacttcgtaagatttgtctccaagcagagctgagtgcgtgacctggtatagagatggaagatataaagatgatcttagatgggtcaacacaacgttaattcatggtcccttgaagccagtctgcctgtcagtgtatcacttgaaaaaggccatgcaaacctcaggaccttctgggtcctgcccacagtaggtgcttttccttgaatcttgtggaaggaagcctggtcactcttagcatccatcttgcacatccctgcagtggacacatagaccaggccatcactaagagcccatcagggaggatggtgtggggatggagacaggcaggatgctctttgtcctcaggggactcagagacagttggggaaacgtgtgactacctgtagctaattagattggttgatgtgccctgcgaaggcggaggtgggtttagatgggggagggtggggggcgttttgccatgagtcttgagagacaagtagggatttgtcaagcaaagatgaagcccagaggcataccaggcaggagggaagaggagagcaaaggtgcagaggctgggccattgcaggtagatgagcaggtggtgcaaggctgtagcatcgagctgcaggagcacaggtgagtcagttctggccctgcgggagtgtgtctggaagaccgggtctctcaggtgatgggagccatgggaagtgcttgagcgagggtgtggcttttaaccagatagctggtgatcctgtttcacactccctttataaagtctatattaccgtgaaggtgtgtagaacacacaggcgtgtaaaaagaagacattgtctctgcgggatgagcgtgactgtctgtgacctgcaccctgctagtgctctgtgtctgctgagggatagatacagtctggccccactgcccagaccccagctccaccgaccctgccggactccgagggagagcgaggtagccgctggctgcggcgctggctgcccagccatcgtggcctccagccaacaggaaatggagcgggcagtgtcccagcctattcactagccgtggtctccctgcgcctcgcaagcgcattcagg

SEQ ID NO: 50633 - DNA, 1501 bp, Bovine  19866881191048
ctgggattctctagggaagaacactggagtgggttgccatttcctcctccaatactaatgtctatttaactttactaattaaccttgggaaattccccacacagtcctgtggttaggactcagtgatttcatagctaaattcagcctctggtcaggagctaagatcctgcaagtcacacagcacatcctaaataaacaaatagccttcgagcttggtcagaaatctctgacttttctgtttctaaatccattaagagtagttctcccaaagttgcacaggatcatgaagtagtagagcacatggtttaagcaagtaagaatgtcatgtgatacattaaacaagcatgtgagcatctcttttatttcactggattcggtttccctaagatgtgtgtgagtcacatgttctgtgtgtcccctggtggaggctcacttacgttgaaagccgagttgtaactactctcatttcccacacaactgcatcttggctttgagaataatcctggaattaactaatctttatgcttcccttcctaaatccctaaatttgtaccccaaacttgcagtgtttagaagtggaccttaaatagaaataggcaaagcaaaagtagaaataaataaccctaggtaaattcattttctctgacactgtttcatttctggtaaggtaggaaaggttttattgacagttagaaatctttgtgaattagtgaccttgggtgagtcagtcagcctgagtccctgcttctttatctgtaacttggagatttaaaacaaaaactgaaaaaagatttgggggatgttatgtgaataaagtttgcacaaagatctgggtcagttataaaacctggcatgtaggtactcaaatatttatttttttctgtctgattcagttgacatttattgagtaactgtcctgtgtcggaaattagacatcaaaccatgtaaataagacatgatccctgttcccaggaagaccacagataccaggcataagagaggaacaaacaaaatcatagtatgctgtagactggactgagacagagtgtgcacgggttcacagtggtgcagttcatcttccttaggtgtctgcctctgcttttcattagaaacaacagcactgcttctgtttctagcataaacatccatctcctatggcttgagtagatgtcataaaaatttagagtttgtatgaggaattcacaggctttagtgaagtcagcaaatccgatgttgattttgccctacactgtgctggtgaaccagggtataggtcttataatcttgttggaaaaaaagctttagctgtgtttaaaggaaaaaacaaacaggaaaaacacacacacaggatagcattgccttttatctcacagaattgagcagataagtcatgtattagtaacatgaaagtggcatttcagataactaattataaaccagaattaaaactgtaagtaaattttagaattcttattttaaaaaaaagcccaaatcacataaa

SEQ ID NO: 50634 - DNA, 1728 bp, Bovine  19866881292087
tgttttctaaaaatattaatatatgtcccctaagtcattatatatgacaggacaatttataggctactttgaagttaaaatagtagttacatgctaacaatattacacatagtatacatttcgttatctccttatctattaggactcaacctatggaaagacaggtagctatttgaatagctttagttttttttttttaagcagcagttgaaaatgtagcatccacgctcaggatgggcctcagttatcatttcccacccaacggttagtggcacaggaatcactctcgagtcccttttctctagtccatctactctcaccaccactgccatctccgctacgccactgacagtaagaactatttttatgatcataatggtgtcagtggagaatgatggcaaaatgtggtcaaagaaacctgagaagagcacctcagggagctaaagataacttagacaactccaaacaaatagatcttacatctatatatttcacatgccaaataacctgaatgggagagtctatggtaaacatcttacagtatcgcaagaaatcctcattcattccactcatttacaaatcaaatgtgacttaaaaaaacaaatggagataggtagatagataaatgtaaaattcacatctggttctttttcaaggattattaacaaatttaagagtttacctaaggtgatcatgtgagcaagcttctgcaaatactgctcggaaagacttaaaatcttctgttgaaaattgtgctggatcaatcttttctatacaagtaaagaaagctatcgccattggtgtcaatggattaacattcagtgatgattcaggtggagataaaggatcaatgtgaagcacagagattgaaaacgttcccacagctactctaaaaataagttcaggcctggattcatccactgaaacagacctagaggggagagctgaaatacatgtgttaaaattatatttagaaagttaatacgtaaacaatccattatatcaaagctataaaacatttactcatgtgttagttttaaaactaaacttgagattttagtcttcaaaacatatgatcacacacagtttcagtgatattaaaaaaggaaaataataaactgtaatctttctacatttgatatgcaagatccttgatatgtgaagtacaaaaaaaaccctgctacaatacaaacaaaacttttgaattaataaaactatactgtggaaataagtcagagattaactagaagctgctcatcaaattttcctttaatcctgtgtctatttcaattaaattttgccaaaaggaaacctgaggttctcttttaagggatgtgtaaacagagaaacaaaaattagaccagttgattgagactcctaaattataataataatatgaaacttagggtgtactttttactaaattatttaatacacgaatacaataaataggcaactgttctaaaacatttcatagtgaattgttcaacagtgcttcattttctttctaaactttgttaaaaggtctacaccaaaaaaatatttatgaagaaagagaaaagaatcagtagaatggcatatttttttaataattatttttagattccagtggaaactatcaacaaatgtctttttttcttttttcttacataccagtcttttgtaaagatgctgggtgaaccaggttggagggtaacgctgatcctctgactggctgttccttatgat

SEQ ID NO: 50635 - DNA, 1728 bp, Bovine  19866881341961
tgattttcagatagtatcttgtaatctctggtgtcatggatacagctatttcttgaaagaaaaaaaaaagagttgtaaattttatttacaattctatttatgttttacttctttctgcaaattgttttaccttcaggcaaatgaagtttgttatggccaaaatttcttgaatagattttaattttttacttaggtcaacattccatattgaaattgattcttattatttaaattgatttgtattagtgcttacacattaagacacacctataaatgcaaagtaaactgggtaaacattatgttgtttatttacatataactgacagaaagattaatggacaaaggtttttatttaaaggaatctactgtaaatcattacgtaagcacataatttgacaaaatgaacaattattcccattttatcttttgcataaacccacatttttaattgactttccttagaataaatcatgttttacaaaacaagactacacaatcaaaaaaggatcccgcaccacttgtgtgccagccactatcaagctgtggttcgatcaacttatacatttaaatgttcttaaagtgtagaccgttggttttttcattactcaactccattttatggcggccaaagtcaaatgtactttgctctatgatgatgatgtatcaatctagagtcaagtttttgagttgcttaccccggctagaaggtgtacgagccgtttctgtctcataaaagctttgctctgaggacacaccggcagagagggagtctttcctcaaataataccggttcaattccatttgaattcgatattcatcttcttgctgcatgggtcggttttttctatctttattagctaatccaattttgcttgaattttctatgtgtatacaaaagaaaagcaaaagagtaattaaatttggagttacttaactaagcattctctcccaacccacttatccaatgccaatggcaactcagtaccagtcagtgcagaaccaccagtatttaatgttattcggagatctaggcaatagctctaaacagctagctaggaatcacaagatcttatctattattaaatatacatgtcattaaaaattttttaagtgtgtgctatttactgagtttaacaattatactttctcagttgtatgaagtactacctccaaccaaggaagtcagtcagtctgaatgctaatctgttgcatcataatgcaatttgaaagaatcaaatttaactactgaggattctaattcacaatacatctttaagttcatacattcctatacaataatataatttcccatttctatgctatatattttaactaaattttttttaaagaactagaagtaacaacaattatacttgcctggcccagcaatagctgctaacatgtccaaaagtaagtgcacctgcctgggtgacaggaacagatgtatagagtctatctgcccatcaatatccagcttcaaaaaaagaaagaaaggaaactactcagaatgaacactctttataaactcatcaccataaatcccagtatttttcagaacaccgagaggaatactaattagttagccttggattccttcacctcagattctctctactaattcacacaatctaaatgaaaagacatataaggtcatcaacttttattttaagagggaaaatcctcctgagaaattccatgtcagaaagaccaatgtcactctttgggtct

SEQ ID NO: 50636 - DNA, 1526 bp, Bovine  19866881761418
ttccctttgacttaatcaatagcttgtaaatgacatgggaagggaattacatccttcatgttataaaggcaggcagtccaccccttggaaaggtgcccaggccccagcccagcagtaggaattagcacttggcatgatgttcccaggggcttgggaaatgcggcaaatgtttccttttcccctcgtgttttttcctcatcctctccccgctctagggcattgccaatgattttcctaagggtgaggagtccctgaagaggctggaggagcaggccgtgggggtcacccagaacacctctcctctgggtgcagagaagatcaccagagacctggaggagatgcgggacgtcctggagaagctgcgtgggctctgggaggaggagcagggaaggttgcgggacctggtcaagtccaagggagccttcgagcagcagagggggcagctggaggccgagctgacagagttcaggaaggaccttcagaggctggcggaggagggcctggggaccatggccaaggccgcgaccgaggatgagctggtggcccgctggagactctacttggtaagcagagtttggcgacaccacggggcgatccaggtgctgtgtgtgcctcaaggcatccccacttggagctcctccatgtagtggaaagatcatgctacgtctcaagcacacttgctctggttttcttgattttggatcatctaagttccgagtatagtaggcaagttgagtgcttgtacccattttccagatgaggaaactgagacctagagatatttttttttccctctcaacacccccaagatgacatagtaaattggtgggtaaataagaggtgtattgactccaagtttgccatttccatccctaatagtgggatatgggggggacactttctgagcacagagcagggactatgacatcaagggaaggctctcagtgtagggaagatgaggtgcggacacagcaggatttctgaagaggccgagcagacgatgcctgtcctggggagggtggagtgggttccaacccaaacacggcatccaatcagagcaccccttcccccctgtgcacaccccaaccctcgtgcacactcgtgagaggtttggcttgaggacagaaatttttcaagtaaggattgccaccactcctttctttccttattacatcagcaggctagctcgtcagttccgttaggagaaatacctaaaagaaaagccctcgggccttacctccactccacactgttctgtttttttctctcccttctaatgttgcttatgcgcagaaatatttgtgtgtagatagaaacaaggtacacacacacaccgtagcgccagtcagccttgcaggagaccagattcacctccagggtcaacttggtgccatggtgggaattgcatcctctgtgggattgtcctcctcggcacagggcaggggtggtgtggtgcagcggtgaagggcgaggacttgtggatcagactgcctgggttcaaatctcagctcctctccttgccaagg

SEQ ID NO: 50637 - DNA, 1920 bp, Bovine  19866880352402
tacagctctgttagtggaggaaacattcattttaactgcatagtcaattctcaattaacaagggtaatggagtggaaggaagtcagtgataatcaaaaatcatggtgaaaataaaattgcagtcaacagtggattttctgggggctcattaactggtttgtgaattaattgaggttaagccacagtggatcccaggatgtcattgccatggtaattggtcagcagctgctcaccacctgggctccacccaccctgtctgtcccagggaggagaagggtttcctggggactggtcaagcaaagctagctgaccttggccagactagtaccatgaagacacagatttcagtgctgggagttagatgaagactgcttttagggcttgttgccccaccccttgagaagtggttctcaaacttgagcttcatcaggcccacctggagggcttgtgaagccccagattgctgggccccagccctggtttctgattcagtagatgtagagcggagcctaagagtttgcacacctcacaagtgcccgggtgatgtgatacctgccagtccagggacctcacttggagaactgtggctttccagaccattctggttctcccagctgcacattagaaccacttggggagctttataaacctactggtagctgatacaacttatccagttatacgagaggctgtggaggtgggacccaagagcaggtgactttaaagctccgggtgatctgaatgtgcatctagggttgatgaccactactctcgggaatgttctccaacatctcagttatctgcatacaagtctcatggtttttcccctatctttactccctgtacatttaatatttctttaaagttttttatgtaaataaacttattttaaaagaaaattatattcccccttcatgtaggaaaattagtttcacaggccagctgtgcctgttacatgcttgtaatagcaaacacattaaagagtgcttaaatatgtatggcttagaatcatcttgcaccccatcacactttgggagtctctactctagaactatgctttttactcttttttcataaaggtgatggaatacagtatttctgcttttcctcccctcccactggtcaggcaaggttgtgctaactcttggcacacctggtcttttcccctcatagatacaggttggaatgcaagtgagtgtgatttcattacagaacagccttggttgagagataatctttactgttaagaaacgaattcaccagtgggaaaagaatctagataaactgtggtatggccagagaatggagtactacttggtgatgaaaaggaatgaccgatggactcaccccctgggtgactcccagatggtgtgctgcgtgaaagccagactcagagactagacactgcaatttagaacagtagttgcttgtggggaggggtactgggagattgagtaggaaggtgcatgagaggactttgtggggcagtaggatgttctgggtcttgatacggcttggagttacatggttgcatgcatttgtcacagtttgttgaatggtaccctcaagatctgtgcatttcattctatgttcaaaaaatggggaaaagagttaaaccaatagtgaactccagtcagtgatatccttgctgctgttttcagggagaagggtactgctttctgcagcttactttgaaaggcatccaaaagctaagctggattgatgaatggatggatggatagatacatgacaaaacaaacacaataaaatatgaatggtagaatctaggtaggagatatccaggtgttccttttaaaagtctttcaacttggcaggatgtttgaaaatctttcccatgaaagattgaagaaaatttgacatatgcattcaaaatagcaaaccagcacttcccccacatgt

SEQ ID NO: 50638 - DNA, 1087 bp, Bovine  19866880387531
agacaggagttcaccttccctgcagaaagcttgagtttccccctctttacattggttcctctctgggaaggacatcagcgtcccttgatcgacccaacaagtctctcccttggagaagtgacaccctgctccccaaaatagcatatcctgcctgaaataagcaaacctcccacaatccactgactctcacattcccagggaacccctgtttcattcagtgtgccatcactgtccaatttcacccaatcacattattaatgttgaaggatgttttcattagcatttgaggcttcacgggctcattagatagaaatactcacttgcaggtggcagctgtcagctcctaaggagggtggctgcagttcagcacacttaacacagtgccgtggggtctcgtttctgcagtggcaggtgtgagatgccacgtgctctagtcccacctctggccttcactctgtgggaagaaaggcttcccttggtttagtggacattggagctggagaatttgcaataaaggcagctaaactgattcagttccttgatgcagagtgaaaagcaaagccatccactgagaaggttggtaatgctgtatcaccctacatgcccaggaacacagaggtccttcccatcaggtcaggaggtagggggcttatgtggccctctgagccagtcccttcatcctctagacttcaccacttccatctcaaagatatgggtggcaatccccaccaaacctaaccctatgggaacagagaaaaccatgcgggtgacctgggatcactgatgtcaccaccaacacggatatcttggatctgctactctcggagcagagactccagtaatgtcagcctgcaagtgccagctgcttgctgggcatacattttccacagttcattctcacagagactctgtacagaaggctgcactgtgatccccattacagatgaccactgagacacaaaagggaaataaattttttcagtcaccccacgagggggtggcagagttagggttagaccccaagtctcatttgatgtcaaagccacgcccttaacttcctgctactctgactttgttcgtttgaatc

SEQ ID NO: 50639 - DNA, 1419 bp, Bovine  19866880512889
attattatgcacagcagtgattttcaaactactgttgtaagttagcaggaccctttcattgaaaatgatcttaatggaaatgtgcctatatataatacagtgaaggtggagctgctttgcttgaagtaaagatgaaatctcctccctcacccccagcccctggtatagcagccctacattacttctggggaagctgaggttctgaagaaaccagtctgaaaaccaccaatgccaacttttcgattcttttgtgtctgtaccctacctcccatttgtggtcttgccctaccccaagcccaggaagtcagcaggcagaaaaccaaagaccagaatatttcccaggtctcctctcatactcctgtttttctcccacactcgtggtggccgtggccatgcctgaccagctgggacataacgggcagctgctaggagagctggacgcaaggctcaccggttttatctgagttgcagaggatggtttccttctcagctctcacgccagggctggggccatgcttcatccacatggtgatggtgaactggtcggtcaggttcttgggcacaactccatcagggatcttggcaccctgcctgccatcgaacttgaagatcatttcactgctatccaccagcagtcctatggtccagttggtggcagcactgggggatggcaagaggtcaatgatgccagaggaagctcctacagggggcggggacagaaagaacaaagggtcattcctcccaggccgggtgtcctcatgttctgttttctgctctcagggccacagtgaactaatatgcgtactcacccagagctaagagctctgtcctgagctgggtgacttggggaaagaagggttaaatgtcattcttgcccaagttgcccatggcggcttggggaggcatcggtaacttacagacaaaagtattgcatgtgggaaaacagtgcaattaaccattatacaagaaaaaaagtgctgaaggaatttagagaaacgagattaccctgggggcttcgaaaagcaggcaaggttcctggagaaggccagggcttgattccaaccgatggattcattcatgcacttatccatgcattaacctgtcagccatttatcgagcacccagcaggtgccaagacccctcctaggtgctggcaaagtaaaagtgaatcagcgcagtccttgatctggaggagcttggtccccacaaattgatggacccctggggtgcagtgagaccagggctgtgatggggaaagttctaggtcctgacctggaagagctcggtccccacaaattgatggatatctggaatgcagtgagaccagggttgtgatagaggacacacagcctgattccaagaggagtgtgaatcactctgcactcatcatacttttttccaatcatttgtttaggccaa

SEQ ID NO: 50640 - DNA, 968 bp, Bovine  19866880575272
ttgtttgggccattatatgcagggtagctgcatggacttggctaccaagaacattataaacttgaaaaaacaatgtaatatctgtctgatgaatttcatggcaattcaactggcatggaaaaagcatctttgagatggttagactcatatgaacacttgcaggcctagggggatagtgacacaagaagaggtggcagggtttggggctctgtcattccctctgatcactcatattctgtgtattgatttggaagaggcttttgaatgtctccactcacttctttggatgaagacccagcctgggaagccatgcattgtttcagaaagctgagatgatgggttattacatctaagagcaccatattgaaccggcaaatgcagataatggagttaccttcaaattgatcattcacagtgaaagactttggatttctttaaatgaagaacagctgtgactttaaagcaccacctgggaaacagagattcccatttccaacctcattctgaagaagttgaagaggcttcaaagcctgtaagtctgtccccttcaccctccttactgcctctggaaagttccaaacagagatgagcggtggtcacatatgttactgcttttaaccacatgcacagccttctgctccacactcccagccccacaacctttaccaacaacaacaaaaatcaacacaggaacatcaatggcaaatcgatgacagatcctgcataaaacagcctgtatctacccaatgcctcttggcctcaaattcaagcctactccttggggaacaaactggcagctaatcagacccgctcctcatctaagtcaggataggaggaacaacattcaaaacaggcaagtgaggatctaatgccctccagaacagaacctaagccacacaatctacactgattttcccagtctccacacgcctccaaagcagatggcatttgttggatagttacatgtg

SEQ ID NO: 50641 - DNA, 1611 bp, Bovine  19866880585640
actggcccatccgggtaccccatgctggaaagctcctttatgtgtcctcctcttttctcgatcttccctgaggtccccagggtgaaatcatggatctcctgatcagtcttaaagcaggaaatccaggcagccaagggaagcagaagggtggcctctagacagatgatcatttgggcatcatccctgcccccaacacatacacaaacacacacatacatacacacacacatttctgatgactctggttcctcagggagagactaagaatttcacttacagaatagttttccccaagagttatggaaaaccacccaaattccactgtcttccaagtcctaatttacccagagttgaaggtggccttggaggccagggttacaagctgcttaaaataaatgcatctatttccatctctgggcccctctccagggaaccttgtccctcaggaattctcaggactgtttttaactggagaaagctaggagatttgtgagctatgcccagctgaacataggcctctgcttttgttccagcctagggcttcagaattccctccggtgttattaaaaccacttgagttgtaattatagttctttggcccactgaccccttggagtggggggcacagaagcgagaaacagaatgcactctttttagactcttcagctcttttccagtaataactatttaaagccctgtcaagctaaccaattgctgccatcttgtcagaaaggtcttttttcatctttccaattgcaagacaagattggatgtaggtaaaacttagctttaaagtccttaatggctgtttgaaatgacaaagaatataggagcatcaatacaccatgcacagcctgcctctgctctggtttctgtctgggtcagcttttccagcacctttggtattggagaatatatttgttcagatccacagaacctagtagaacaaagtatgaacatcataatagcctggactctaagacaacaaatttgaaaacatctagttgattgtttaaaacaccacccaagtaataactgccatcatttgtccaaagcagctggctttctattatatgcacttggaccacatgatggctgagagtcacgtgggtaccacatttccagggcttccctggaccacgtgtggttcccttcccgactccaccccaagccactgccgtcctctccactagaggaagcttctcacactgctggggagtaagcatgatgctgtcatgaggatagcaagaaatctgctctcatctgctcaaaaagtgattcatgtcacaaatcatgatttttaggggcagactgagttgaatcttgggcaaccaggaagccaccagccaagtgggtccagggtccccttcacacacatcatgcacctggtctgtctttcgctcagttagtaccactcagccttggcacattcaacatgctggtgctagctgggaaaagggcatgcaggtgcaacattccaggtagaaggtgtggctccagggaaggtcaggaactggcaagaggaggcagaggaggacctttgggcggaagagccaatcaaggaaggaaccactgtactgggaggtgggcatgccaagaagagcaggagag

SEQ ID NO: 50642 - DNA, 1696 bp, Bovine  19866880592631
aataagaccacatctcatatggaccacgagtgcaggttcgagagtcaactagaactgagtcttcatctgcaactacctagttgtgaccttgtgcaaatccactttgggcctctatttcttaaccgctctgggcctctatttcttcatccataaaatgggagtaataaaaggacctctcttacaaggctgttgtgagccttagaagttggtacagagaacatgctcagttgcactaagtattactaaggttattattactgtatttacacctctatgaacagagcttaatgtaccaatttgggcagagaggcagaactgcatttctgtggacaaacccagacaagcagggaccacttacccgccatgccctgagcagttacctatgaagcaactcgaatgtgccagtaacagttaccatttccaccaggtggtccaggagcttcccagaagggaagaacatcttcagtcactgcccaggccaaggcacactgccaactgggcctgctgtgcaaccccctcataagcagggggtaggtaggccaggtgacaaaatctctctcagatgccatagggccaaagaatcaagacaaaaatgggtgataatagtcctgagcagaagtgggcaattcttttgaaattacacatattaactaaagaaaatcaaaggtcacattatagatgaataaagaaaaaaaaaacagcagctttgacctcagtttttatgccgagaactttggggctggtgtttcctgtgccaaaaacagaggaggataagctgcctgaccagccaccgccagcagcatcaccagcacagggacctcatgcctgtaccttcagagagcctccagagagcggggccaggcaggggaggactgagttcacagcttttcaggcgagttctgccagacccaagggccataaatcccaggaatggaaaacaggagtaagaaataaaacccttggcttctagtgaacagccagccacttgcttagggccataaataaccacagttaaaccaagcaccccttgcacttctcggcagggaagtgcatgaaaacatctgatgtaaagattttaaatgcttaactgctctctgccaacatctacttgaccatccagagatgcctggtccagatctttgaagtgagcctggcatatctctccctccatggccctgaccactgcctcagggaactctgactggtggagtgctgggtagcatcatgggtgaggaggaggggtcaattagggcctggcagaaggaagtgggtaaccctcagctgtgggtccaggtgccccagtgccaactctggcactcaccattctgcaagccctaaatcagtcggctggtgagtaagtggctgagcccagatccaagcctgtgttgtctctgctccaaagctcaggcacagtttcaacatgcacatcagaggctcccaggagagacatccccagatggtaaccgtgactacgactttggagctgggactacttatcctcttaccaccttctccagcaacttctctggaactcttagatttcaccaccttacagtgagcctggtgcggtaggcgctcagactttggggattatgcattttcatttttatggaatctccgaagtcaaggagtcaaagccatgtttgggatcatctggatggccatctttaaccacaaagtgcccaaagatgcagcc

SEQ ID NO: 50643 - DNA, 505 bp, Bovine  19866880610131
tctcagtgagacagaagtcatcatggaggtagtgaccaaacattctctactttttatcctctctaccttctaccccagactctgtaccacgctgagcccattgcacagacttgggaaactgacctgggttgtgaccttgatgaaagacgtcagctctgacttgagacttttgctcagacagatgtggtccctgggtccctcagaaggcaagctgcaaggaggatgcttcattttcaggaaacgaccactccctggagtaccccccaggacactggaactttttaattgccctttactaattgaaaaccagtttaataactaaaggacttgagcaagggaacaatggacggtctcacatttggcacatggggaaggaaaaaaagccccagcagtgagggataacagcatctacatgaacaaataaacattttcataatttgcctactaattaaaatagcaaatacaatcaaatccaattaacgtggattggtctatggggctttaa

SEQ ID NO: 50644 - DNA, 1693 bp, Bovine  19866880614426
catgtatcccagtattcaaggacagtataacataaaggtatctattaatatatcacattactaagacaatatatttttatgaaacttatcatctcagtacacacttaaaagccattccataaaattccacagcacctactcagggatttttttttttttttacagctcttagtaaattagaactaggacacttatttagcatgatacacaatggaataacagcccttcagaacccttgccacagaagcaagaaaatagaaaagaatgcctactcaccactatcattttctgatggcatcattcaaaaataagaaatatcaccatagaattgagactcagttttcattattgcaggtggtattactatatcactagaaaatccaggagaggcatttggaaaactgttagaactagtaagtttagtagtgcagcagagttttctgtataacagctataatacaatgtaatggaatatatagatagagagagagataaaatatgaggggataaaagatccattcacatgagaaagagctaaggacatctgccctcagggctaaccagaaccaaaaatgtgaagggtactgaaggcagtggctctgtcctctgctgagagacttgacccagtgaaatatgaccaagtgctcatgagaactggcattcattgattggctttttagtgaaaatgccaatgggtatttttctttatttaactcaaaaaagtatgccaaatttctcctggaagactaaccatgtgctcagaaagctctcttaagacattaaaatgtaattttaaaaagagatcagggactaccttgacggttcagtggttaagactctgcacttccaatgcagggggcatgggtgccatccctggttggggatcccgcatgctgtgaggtaccgaaaaaataaaatgaaaataaaaacagattaaatgagtgtgacggggactcaagacagcacaacagaagctaaaatctatgtgaaagaaaatatgctgtaaggaaaaaacaaaaaaatcagtgatgggggtacagattatttagttaaacaggaaatgaggaagtcacctaagtatttgaagaaaaaaatcagtaatttcctaccttatgaaattcagtcagcaaaatgctacagataaaccttagaagtagagaaatccctgtcaatggtgtctcctttgacctgtagctcccccttgaaatacttctaagatggaaagaacgattacaaaaagcctaaatgttgcctgaatcctttaactatgaagaaaataatgaaactaagatctacccagactctgagatggtcgcccagccttcccactgacagatagacctttctgaagtcagctgactggtcagagggaagtcacgaatcataaaaggaattgcatttccaaagaaggccctaccctgcaggttcaggccacctagccttccacttacagagataaaaattttaaatccctggttcttatgagattcaagagcagaatgtgataaagcgtagcctgcttgaggacagggaagggcttttggaatgaaaaatggcatcaccacattcatgctcagtggagacagggagcagggagacaatttctggcaactgaataggaaattaggtcaccagcgcaaggaattcttccagaacacaagaaaacataaggataggaaaattatgagatgag

SEQ ID NO: 50645 - DNA, 854 bp, Bovine  19866880657722
cagaggtcacctattatgtgttcctatctccaaaggcttatagggaagaaaacagagtgctcatggaagaatgacatggtatttagagaactaaaccagtacttggccaaggctggcctcttggttggcagtgatgtgtgtattaaaagatgttcaacacagttctacagatttggcaaagtccttggaaatactgagaagataaagtaagaacaaacactctgtgggctgttcttcaccggctgcctattttgataaggaaaaatggaaagaaagaggaggctgacgggagatcagggaacctgattatctcttccaatgctaagtttgaaaaatgaactttcatgtgcaacccaaaagattacagaatttgccaaacaaacaaaaaatgtgcttgggaatcagcagcgacaaatgaattcgtctagtgtctgtgtcgtgagaaaatgttggacaaaacaccacagtcctttcctcctagcatcacatgaaaggtgtaacgccaccacgaaggacaattcagcctgcgtgggggaggacagtagcactccgcagggactctatctgcggtcagccatcaaaaaagatcccgactgactacaaacagctctacaagagcacctacaactaggacagccagaatcttttccccgggagcccggctctccggggggctgccccgccttctgcctgcatgcgcctccccttctgctcccaagccccgcccactcccgctgtcatttatttgtggatttccggagtacagttctaaggcgcttcagtcctgtccgattctttgtgaccctgtggactgtaacccgccaggctcctctgtccatggaattctccaggca

SEQ ID NO: 50646 - DNA, 1212 bp, Bovine  19866880661447
gcctggttggggtgggcagctcttctttggagagcagaggcccgggacactgaaggtcccctgaggacaaggttgccccagctccttaagatctgggctaaggcagattccccctgcccccaccctagggggaatgagttaaattaggctgatgcccgcagcacacatcatccccacgtctggggcaacatctggtgcctctgatcgcagccagattctcgagagtctattttcagcattctcccagagcacctatgagtgaatttgcaaagcagttacctctgtctgcagtgcttccttcactgatgtgaaacagccggtagagctgaaaatctctcctctccacccaccctggcttgcctgtgtgtctggatgactatggtcattctgtcattgcagggaaggcagagaaaaatccggtggctacaaattctgccctttctctgagagacttagtgcactgagccactgtcggctgagcgggttgacaggaattagtccatccgcttagcttcagtcacatgggtcggctcaaaggtatgcgatttggtgtttttttatttttttgacagccaaatgactttatttcagggtgagtgttctcagcatataaatatatgtaaataggccatttcaggtgctgaggacaacacctgatttattttaaaagttgtcttaactctgggtgattgactgattcatggtgtgtgaatggtgtgtaaatcttgatttggtgtattggtcctgattatgttacttagaacagtgggatcttggaaacttctctgagggtcagatttctcatctttacaatgccaatattaaatcctaccttgagacaccgttggaaaataatgtaagccaagaacataaaaaccttggcatagaaggggctggagtatgattatctattgctacctagcaaactgtgtgctgtgcttagtcgctcagttgtgtccaactctttgcaacactgtggactgtagcccgccaggctcctctgtccatggggattctccaggcaagaatactggagtgggttgccttaccctcctccagggtctctttccaacccagggattgaacccaagtctcccgcattgcaggcagatttttcaccctctgagccaccaggaaagcccacctagcaaactacccctaactaatgcatataaagcagaaaccgtttttttaaattgttttgggagtata

SEQ ID NO: 50647 - DNA, 1125 bp, Bovine  19866880710772
acaatgttttctttccttgtggagctcaccattaacaaaagaagaaataatctaaatagttttttaaaaaatcaccaaacctgtaagggaaatcaatggccaaaactagttattctaatcaagcaggagagtagagttctggaggacctgtctcatttctttggagcatggaatctccagcatggaatggagcttggagataaagactcaaaaaagaacagttgcttcagtgtcctggctaaagaccatatatttgtaatattgaagttcatataataagcaaaattgtttattggggtttccttcatttgcctccattgtattagaatcattattactactgttcactgtatatagtatactgtatactctcttggctttcctagcaaagattctggttctgcctgtgttttcccgtggctcaaaatttgaagcctcacttaagctaaaaaatatctgacttttccaaggaaaatacaaacaaaactctgacttccagttattgtaatcatttctgctcaggacatgcactgattcatcctcccaaccttgaactcgtagatccttatggtatacaagattaactggtttacagttaggtcagccagttatgtattcttcacaggcaagggtttagcttttaatctgatgccagatccatctcatgaagttttaagatggtccagtgatttcactaccttaaagcttgcacagagagggagacatgactaacacagaggggtcagagagatgcagtgttactgtctttaaggataggggaagggggccatgagctaaggaggaatcacctgcttgcatggaagtaggaatagctgaattgggtggcctggactgcagagaagcgaagcactttgtcaggaaatggttacttggttgtaagctcgtctcacagaaggttccattaaccttcaatatatattttttatcaatggtgctgtatagaaggagaagttttgagactactgtaaaaataagaccaataactggaagcaggaggcttaagtccaaaccctgactccagggaacattaattgacaggagctcatcaaatgcctccatacctacactgaaaccaagcaccacacaagggccaacaagttccag

SEQ ID NO: 50648 - DNA, 1641 bp, Bovine  19866880736220
cagcagcctcaaacaccaggtaaagcaccagggcaaagggatgtcgatgcagacacacagaagatgctggcttgctaaacgacgagtcctgagagttcagggcacagctcggacagtgtctcctggatattcttccctaaacaccatgagaatgatcagtgcactaaactgaaataaccaaatccatggaacttccctggtggtccagtggttaaagaatctgccttccaatgccaggagcgaagtttcaatccctggttggggaacttaaatcccacatgccacaccgtgtggccaaaaataaaaaccaaatctgtagttctgtgctgaatcagacacctacttatactaaactgaggactacattaaggataaccaaccctcagtttatgaaaaatcatacaacgaaaactttaagtaagaatactactaccatattttcccctgtacgttgggctagacttccaatattttatttgtcacagaacataagtattctgcagccatgcactttgagacccaacactttaaaaaagggcctgagtatatagtaagatttatctttattgtggcaatgttccccctcttttgctgtagctagatttttttcctgttatttctcaagtacactaggatgatgctaaaagaaaaaaatcattgggagaaaatattgaacctcatttgtatcaactcataattaaattatatttccagtgtcatgttttaatattaacactggattcaccatcctgacactaataccagaggatgggagagaatttctgtagttatggccttagacactgtgataaatgttttgtagtcattgcctctatatagaaacactccatctccaattaaagatttagtaagctcttcctcaaaatatctgttattgaggcgcacactacggctgtgctgacatttcaacttaattcactctatagtttaactcgcattccattttatatgcctgtttgtatttttttgtacggaggaggaataatggcagaaatttgggcacatattgaagattctagaaatatttccatgtatttattattattgtctattggcatatttgtcactacaaatgaaggcctttctccaagagatgatttaaaattgttcatgtagcaagctcaataggatttagtagctaaatctcatatgctttgagttatgggcattttggtatttgcataaggattcaagatcctggtgttttagagaaatgaggccatttccctttaaggtatggttttgatacacattccataaacactgagatggtgaatgcttggtgcttgcaccctattcccatgtcctgggtatataacagacctcattccctgatacctgaatctgcatccttgtcctcaaagtgctccctgcggccactccaggtcactggtactggctccctagatgaggcctatgggctccccgtgccatggcccaccttttcattgtgccattgctgtgaatgatcaacaaaggaatctttcacagtctctctaccaaaataggaaaataagaagaattccagaggtggttggttcccttatcttgtactttttcagccacctcagtgttgtgcagaggcagtcatccagtgtgttaatgctgtctccttttttc

SEQ ID NO: 50649 - DNA, 1117 bp, Bovine  19866880740468
tgctcagagctacgaagcatggtgcttcttcaggcgtcaaccccaatgctgtatttgcatcctgtttcagttctgtggacagaatacatttctcttgaccctttggggccgcaggatagattgccagagcctctactggtgacagattcttgtattgaagagaaatataatctgacttttcactgctatctggaaaattcctgttttcagagcacaaaccatttaaccaaacagtaaagagattatggttcactgtctatgctgaattatgcatggttttcagctaggtaaagttcgctgtgttctattttaagaatattttctgcacagagtagaaaaaaaaagtctgtactgtccagaagcaaccatttttgatgtattttacttctactagggaaaagaaataataagtctgaactccatccatttttcttgcatcacgttttgtaattggtaataagagatttctcttcattttagaagtgcaactttcccttcatgttccaagacattaaaaggaaaaaaaatagaagtaaatttggcccaagttttaaaacatctattgcagcatactcattatgacattttttagaattaggctgactaatcttgcttaatacatgagaagtgtttgctgttaagcactgtgccttctcagaacaccatgtcaaaaccattttaatttgagttaggggtgattaaaaaatgtcagctttaaaaggactatttcaagaatgcctcagagccttggattcagctacaaagaaatttgtgatgcattgaaataatagaatgactaaggcaaggacttaaattccagattttaaattcagcattcatggtgtaaagtacaatggatgtgaacctaaaagggaaatcagattccctagctgaattgaagacattcatttaagggggagtgaaatcaaagtaggaaaaaacatctgtactattctcaaaagtactctgcctctcatcattgatcccagcaatctttgtcacatttagattgcaggaatgccttaataattatagtttttgctgccagtctcttcaaatactgactgtaaggatggggtagggtgggtttggtggcatgaaaagcaaaatgagataa

SEQ ID NO: 50650 - DNA, 1509 bp, Bovine  19866880752150
tttataagaagtccttttttttttctttctgcaaagctgtttttgtagtgcacctcagctggagaaagtacatttctcagtaatccaaaagggggaaaatttgattaaaaactccaccaatgattccacatatattcatgccaaatgagtccaaagccagaggtgactctgagaggaggaagtctgcccaacatccgtgatattaagagagcggaagctaataatgtgcggcactttatctaagacgataccgctgacccactgccaatggctctgaactgctttttcatcagatgatgagattttgggctcctgagaatccaggggtgcggctcaaaggcagctgctggagttaaggtggtccaggccaatggcacagtgcaggctgcctatgtgggaagctggcaggtctgttgctgttgtttagtcactaagttgtgtctgactctttgtggccccacggacaatagcctgtcaggcccctctgtccatgcgattctggagtggattgccattcccttctctgggggatcttcctgacccaggaattgaacccctgtctcctgaactgcaggtggattttttttattgctgaccgacagggggaccccttggcaggtcctaggacagagcacaccagagtcttggtctcagaatcctggacaagggtacaaaatgacccttctttatttttcccccactcccactcaaccccctaatgacctgtcagagcttctttaagccatgactcagggctcctgttccagccacttctctgttgttccaaagtaagtatttctctaaatgccctctactcctcccaggtgttcaggaatctcccttctactgatgggatatctggggcccactgcttgatgtgtccagctgtcatcttccacccggcctcaggcctgagcagtgaaaggtccaggtccttacctggagcccaggctggaggggatgcttggaggacagaggcctggagaagacttgccctctggggtccaccctgagccagcaggtgcctgggccaggtgtgggctcccagaggagattcaatagcatcttagtccagaggtggtccatggctggtggaagagccccatgaaccataatccgatttagtgcaggtactcatgaaatgcaaaggggcccagaaacaaggctaggcagctctgtgtgaatgagccaaggaaagctggggagttttgcagtggcgccagatcatgtaactactgggggtttcctgggtggctcagcagtaaagaatctgcctgcaatgcaagagcaatctctgggttgggaaaatcccctggaagagggcatgacaacccactccagtattcttgcctggagaattccatggacagaggagcctggcaggctacagtccatgaggttgcaaagagttggacacgactgaagtaacagagcacacatgtgtcattcccatttatggggcaccgttgctaatggcttacgcacgttatttcaattagatgctattat

SEQ ID NO: 50651 - DNA, 1400 bp, Bovine  19866880756708
gacaggatggatagattgggctgaccttaggcatctcccttcttccatgtggaaggctagagcctgctagaattgagtatatcccttcccccagctcatttaggctctgataagaataccccagcaggttaggctctggataactagtttcccctgaggacagggcttctgaagaactgagtgctctggtgtatttcaaaatggttccattcccctcgccttgctggaaggtctacagagattctttcttctccagcatctactgtgagaacctggtggagctctgcaaaagcgggagccacctctatgcccaagtcctccaaggcatttttaactctcaggcttgtccacactgagcctctgtcaattacagttcaggcgtttcttccccacccttggttcctgcagtgatttccactcctctctgttccggtaagtcaggactcccccatatccacctgtctctataatattcggggcagtggcttgcccagtgtccttgcctctcttccagaaaagttattgattcttcagtctgtttagtttttacttcagggccttgtcgattttcactgagtccattaaattgatcctgtctggttccccttcccctcattcctcatcctgtaatttagctttctcttttattcctccatatccctgcatatgctattttcactttacattacttccattttccacatgaaaaatactgttgtttaaattaagattcttttggatacaagcaggaggaaaaaatccactaaagccgacttaagtgtatgaagagaatggagctgaatttccagggtaagctggcttcaggaacaactggattcatggcccagaacttgtcactgagactttgatttctttcatctctctgcttacccctgctttttaatatgcgttgacctaattttcagtgtcattgccctgccaaagtggctgtggtaattcccacctcatattcttgaggtttgagtccagctaggatgagagaatatctcctcctagacatctaagcagttctgattgacttaagtcacatggccagccctgacccaattgctgtgcccagagaagcagaaagcatttattggcttagatcttggttacctatatgcctatcccactgttcccccaggacacaagaaccaagaatagcagagagacatcccctgatgaaaataccagggactattaccctaagtaaggcaaataactattggatgactgaaacacatttatccactacattatttttttttttaagattaagtttaagcatccccatgagactgagatctctgaggtcagggactatatctattttatttttgtaccttaatgccttaaatgtattgagcactcaaaaagcatgtgctgaatgaagaata

SEQ ID NO: 50652 - DNA, 849 bp, Bovine  19866880809260
agagaatatctccccccaccctctccagaatatgacactgtattttatttttgaccgtctagatatggctgagtatacttcctggttcagacttcatttgatatctcctaactaagattctgagatcacagctaagatgctttcttcaaaaggaggtgaatgcataagtcacttatccatgcagctgatggaaagataaatgtataatgtctaaatgatgccacaaagagcctgtgatgatggagctagaggcactgtggcaggagggggaggttgagggaaaattgtgaacagaggcttcctgcgtcccctgagagctcactgtggaagatgtggctgcctcccctctactcacagtaagccagctgtgcatcacttactcagttctgcagcaggtgtgtgaagacagcgtgaaggcaatgcagaaattagcaacccctggcttagctaaagggacagccagcatcttgtcaaaaggagatttctccaggcattccatccagctgctgcagaccccaaactgagctataactgatgtctggactctgtgagcacggtcaggcccaggagacgtctgccttcaaaggactgtgaaatcataaagtcagctgctacctttaacggagcatctattctctttcaggcaatgagttacgtgattttcatactttatttcaaatattcacaacaaagatagtaatatccctatctgacaggtgaagaacctgagagtcaaaagaactgagtaaattgtcgatcacacagtatgttttagaccttagatatggaaccccaacttgactccactgctcttttcaatgactggtcgttctgtaacagttacaccta

SEQ ID NO: 50653 - DNA, 1848 bp, Bovine  19866880925706
agccacagccctgggagagaggagatgctaattcctttatcagagggtaaaactgccccagccatgaagataattactcaccttgatgagccattttactaacatatgccaatttatttccctggctgtctcattaaaagtgagtaatggtccttcgccaggcctctgcctccaacgttggtttacagcctgagatatagaggagagcgggcactcccagggattgtgggcccttgacggcaaggtttacaaaagcagttctccagtaatgaagacaggacctcagggcagacacagaagcagctcccattctaatgagctttccagttggcccttatccatcacttctcccagcgaccttcccagctccttgaagaagttcttcacatgcacattagaaaaagtactgctgagttgaggtccactcattcaggccccaggcctttagggagattggctccagggcccttccacctgccagactctttgcttgtgggggaaagaagggaaacagggcatcagggaggatagatgacatggaagtgatttgacctgtctgaacgcaagaatcaacctcttccaaccaggggtccttggcctcccttcccttgaattcctcccctgagatatcatggcggtagcagtgaggcctcgaggagaggcagtgcctgtggatgaagttaacagcttacccgggcatagagtgttccattcatgacacccatgattatcagatacttgcctgggtgactaggacatgaaggttactcactccccatggattttcaagctgaaattatgagcatgtaactaagtttgtggcattgccacctcttgggatattctggatccatttcagatggcttccagtcccctgtatctttctagcacttggctagtctctctcagattgctaggttgtagatcctcactttcgttgaactgatggaaaaactgattcctaaagagtaaagagttggcagagtggggactggagccaggtcccctgaatgtttatcccaaagctttttcaccagtgatattaccactgtcctcagtgatattaccactgtcctcagtgatatttgacaggaatgtatgacaatggtatttaagttcaaaaatacaaagtttcgtcttaatcctctgcccaccactatgagagagagggaaagaaggagatccttgatgaattacttaaacttgatgtcagattttcattgtaaaatgggaattaaatactgtgcctaagggacttccctggtggtctacttattaagaatcagccttccagtgccagagacatggttcaatccctgctcagggaactaagatcccacatattgtggggcagctaatcctgcatagtgcaactggagaagcccacattagccacaaatagagaaaacccgagcaccacagtgaagacccagtgcagctgaaatagacaaataaataaatacttgtgcctgtgtgagagggcggatctcacaaggcagtcctcagactgtcggcacagagcaagcactcaaccaggagtggggatgaccgcacagggaggtgcggggctcaccgggacacccgcctccattcagcaggctttcgtaccctccaagcagtggttggtttcacacagcctctgctgagccctccgcaggctgccctggagagtcagggcccttggctacctgagagtgaggtgtgagcccaagtctgcttatctccaagtatgtgaacatacttcccttccacctgaatagaaaaggaactgctcgcccctggtgggaaactgggcagcatagaaaagtatgaaagaagtcacttttgtaatcccaccaaagagaacta

SEQ ID NO: 50654 - DNA, 926 bp, Bovine  19866880941273
tccttattaacatgctacagtctgtattatgagtcaagtgcatgactgtgggaaagatttggaaaaccactggtgtgatggcaagggcagagcacaaacagatgactataatgcaatgactgaacaaaatgtaagatgaatgaagtaggatgagcagaccatcaggaatcatggctctcatatccctcctgagtctgattccctattcaagaagtgatttccctgacacgtatgaatgaagagagccaggctaatatcaagggcttgaggagactagggagagataagaataggagattgtggggttatcgtgagcattaaatgaattaatatttgtaaagcagtttggagagtcccaggcacagagtaagggctatctaagtgttcctgttgttatttttctttttggtcatttatgagtctagaaattttgtgtttcatctcagatcctgggaataccacactgacttgtaaatccaagcaccatttccatttaatagtaatagtaataatactaaataatcatcataaaacatttaaaactgattatgtcttagaattaagaagcaaatacattataagagagtctttgtttaataaataatggattgattgcaggggttcttagtctatgctttatgaactgtctgaaaatttatgcaaacatttgcaaaaacatgcatttgtatgttttgctaggttgaaggtctatagctttcatcagatatttaaaaaatatccatgtccccataatagtttaggaaacattgagctctcccaattaaaatagaatttcatttgcaaaaaaaaaagaaaatcaatttaagtagatttgccacaagtccagctcatgggcaagtgaggagatgtccagtcaggcaattcccaccaactgtgggcctgactgctctgcggttgatactgta

SEQ ID NO: 50655 - DNA, 1025 bp, Bovine  19866880947709
aatctgcctgtaatgtgggagacctgggttcgatccctgggtcaggaagatcccctggaggagagcatggcaacccaccccagtattcttgcctggagaatccccacggacaggggaacctggtgagctacaatccatggggttccaaagagcaagccaagagaaagtcaggaccctgaggacctagattgctgacctccaggtgtttttgttttttgtttttttaaactgaggagagaaataatctcctaaatcactattattttctattttctgttatatgcaactaaacctaaatcagtttaggttgagggaatggctacccactctaatattcttgcctgggaagttccatggacagaggagcctagtgggctacagtccatggggtcacaaacagtcagacacgactgagcaacttaaccacacacacaaggaatgtttattgaatttggatataaacaatgaaaagtgtgtaaacttttaagtttctattgtccctgttaaacctattttatatacagaaactcaaatggatattgtttgaagggaaaatatacctaacaaaaaattctaccatcacttaattttgtatatgaatttttcataggaggaaaaatccctactcaggactctagaaggctgaaatgtgcagtagtgaatctgcttttctgtggatcacaaaagccagactctgtcctatctccttccccccaaaacagattcattatggtgcgctgtcgcactctgcttcgagtgggcatttgccatatggcttggcagtttaatggttttctgatactcgacaaaaatgaagcgcaatcattttgcaaggagtttgcattcctagatgggtcttttccaaataacagctgtgcctcaaaattgagttactcaatttgcaatttgtggacacaatactcaaacatttacaagtgagcaaaacctcaaatcacttgggctatttccagacttcagagtttatgaagtttttagcaatgttagagtgtgcagctgtcaacaag

SEQ ID NO: 50656 - DNA, 1255 bp, Bovine  19866880988083
ctcattccttagctctctgtgtcttcttgtcttcatccataaacacagatgagaccagcatcccccataaagttcttgtgagcgtgaaatgtgatcattgggcaaaatgctcctaacgcatagcaagtgctttgtaaataatagttgctattacttgtggcaggggacagaggggacattctgaattaggtgagaacaccttgctgctgctgctgctaagtcacttcagtcgtgtccgactctgtgcaaccccatggactgcagcctaccaggcttctccgtccatgggattctccaggcaaaaacactggagtgggttgccatttctttctctgccctagcaaagaccaaaagacgagggaatagtgtgtgtaaaacctgcaaggagcccttagttatgtcctagttactagttagagtgtgtggtgggcttccagtgctgaaggaccccagcacttaaaggaggaagtctgaaagcaaaacagagtgctgagaatcagtacttgcttcatagctgagcgtgctggaaagttgacactgtcagatctttcaaatgattattcttataaatgattattctgcttcccttgggagctcaagaggcgcttataagagagaaactcggcttcccaatgatgggactgttttcgaatcagagttggcatttgcatcaatttagctgatggagaacatttcttttttcccactccagcatgatggagtgcgataaaagagtttggttctttgcacgagaggaaaatatgtctgaaactgcagccctggggaaaagatgaagggttgttggcttcaccggtgtgatgggaaagatgactgtgagggggaacacgatgtggggccgatggggtccaacagggcacagtcagctggtgacgttcacaacaaagacaagttcctatgtattttattatttttattgatgtagattttgttctgatttcactgattcaccctgccggtgtgccctcgatctgcccccatcacagatatgggaaatcttcccagggctcttatctgcatttgatggttcatggcttggacacttcgatggttctcctatggcttcagagtcactttagattttcaaacctcttccctgcctgaagccaacttgcccaagagtaactctgctttggtaggatgctattcctcccttgtcttcaaggccctccatgatcttgccctctgacctgaactccccatgggctcaggacactctgcagatctctcctcatta

SEQ ID NO: 50657 - DNA, 1771 bp, Bovine  19866881055230
ccccaggatggctgctaccccgagggccctctgcctggcaaaggttaggcagtccccagcttcccagaggatgacttttcctgttgcctacatttcacctcaatcaccaggtaatgtgtgctggccagtgaccccacacgcactaaattctaacaaatgtaacactcagcccatttgtcacaggccatcgcagagacacagaaaggaaaggcgagccgggaaggttaagtgttgttgctgcagatgtaatgtactaatgctcattgctgggaaggcagtcaatttacctttccctgcagagagtaactctaatgcgacttggcctggggaaagtggttgaaaacatccctgtttattttagacataaagcagatggcttcgggcagaatagaaatggattccacaaacatctttcattacacagacctcttgactggactcctcgtcttaaagaaaacaagagacgcagtatgatttgttgagttgacgagcacagttttcaggacccagggagatcatccccatctgcatgactgcgtcaatttctccagggcaatcaaccttcacgcaaactctggggcactttttctttcaactttaccagatttgctcgctgttgctatgggcacgcagtactgctaagaacaaaagcagacccggcctcctctgtcctgtgaggcgcctccgccaggctccccttggaggaaacaaacatgccaattaagcacttgtcctaattatgaggatcgcaggaaagcaggaagcctggctcttcagttttgagaactttcaaaagatttggaggaggccaaggaatggaacgcggtctcttgcaaccccacactcaggagctgggactgatttcactgttataggagggaggaagtgagtagcagctacagggtttgttgagtgacaggctgggcactgtgcggaaaccttgcacacgttggtgctgattcttccaacgtgcctggaaggaaagggttggtgcctgagttctggtgaagagtctaatcaacttctccgagcctcagtcacatggaaaatggagataattacacatacctcttagggctgtcttgagggtcatcggagttgacccacttagcacagtacctggcccacagtgggttctccaggaatattagctcctttctcttcccttccattatacttaaaacagaattcatcaacctcacatccacttccacatacctgttcaccttgcttgaaaaagagcctaccatttcagccacccatgatcaaaacctggcagactttaggaatacgtcagcattcccaacctgggaggtaactcactaagatcagcttgagttgctgccataggagagggctcccctaaaagaccactctcacatatcactgctgtggtttcttttcatttgtgtttttagttgctaaggttgtgtctgactctttttgtgacccccattgactgcagtctgccaggctcctctgtccatgggattttccaggcaaggagtgggttgccatttccttctccaggggaatcttctcgacccagggatcaaacccgtgtctcctgcattggcaagtggattctttacttctgagccacctaggaacacctaggcaagttctagctgtaacaatcaacttgaagcattacttatcttagaattgagttgagttgatattgagaagcagaggaatgaatagtttaatgtcactcaggtagaaacagcatcttcttaagttgaagaaacctgccccaaatcacagccaa

SEQ ID NO: 50658 - DNA, 1648 bp, Bovine  19866881141029
gcctgtagacaggctcagagtgctgtgatgggggttgggaggcagcatttctggcccgagtcttcccccttgggtgccctgtgggctgcattcctcccagatgtcaggtccaaggccagcaggctttctgttgtgactgggagccgcatccctcctcccgcaggttggccggcctctgaggcaggactctgacactggggttataaatgtttctgtctgggtgcattatctaaattgttatgtatcaccctgggtaatggcaaaagtaaaaaccgctgttagctcagtgaataaatcctcgatgttgatcaatcatcgcgtggcgtcgactcttttaataggcacaatttacatggagacttggcagcctgctccgtcttctaattgcagatggaaaacggatgccgatctctgctgtgccataaaaatgtaaactataaatgacttaaacacttgcgtgctcccttccccacccagcactcatttccacctcgtatttagatacaaatcggagaaaaaaactactctcatgtgagataataacttttatgatgcggggctcccagcttctcccatctgatgccctcagtccttcttggagccatggtttcaccaggtctctctccatggggaaagcatcctttgtagctacacagacagtcccctgcctcttaagtactttgatggtgttgcatactgttaagtactctgagttattgcccctgtgctcattaatgttcctgagggctgaagggattggaatcttccagaagaactgaactccagcacagagccctgagaagaagtggattctaatggtggctgcggtgatgatgggctgaaagcgagtcaggagagccaggtccacgcaggtgactcagtgacgcagtgcacctgcagcctcgccaggagccaggcttctttctttctacgcttagccctgggacacctgcaagccctattctgttagaaaattcctcatcagaggtatttacctgatgttttagtacaggctgtgtgggctgtgtgtacatgagtgtgtctctgtgttttggggctagtttctgtattccaagagcactatgggagtccctgggacttttctgggatgatttgagggagccccatgaagtgccctgtccttatgggtccaaatactttctctcacccacatgccactgtacctgctattctacccataaggggtgcatttcttagggatttaaggcaagaagaccccctttcacgtccagaatggagttctcccttgttcatacattcaagttcagggacttcccaagtggtccagtggttaggaatccgcctgccaatgcaggggacacaggttcaatccctggttcggggacgatccctcatgcctcagagtagtgaagcccatacaccacaactactgaagcccagacacctagggcctgtgctgtgcaatgagagaagccactgcaatgagaagtccacagactgcaacgaagagtagcccctgctcgctgagactagggaaagcctgtgcacagcaacaaagacctagtgcagccaaaaacaataaataaaatttaaaaaatagattagttcagattacagtgtgcagccattgatcgttaaaaccatttttaaaaggccatccaacaca

SEQ ID NO: 50659 - DNA, 772 bp, Bovine  19866881169400
attctctggaggaagaaatactcactccagtattcttgcctggagaatcccatggacagaggagcctggagggctaagtctgtggaataacaaagagtcagacacgatggagcgactgagcatgcacacacagagaataactctgtactgcttattttccaaaatgctttccttttacggtagaaatgtccataactaattaaattaggaggtgattttaaataattacttctgaagtatcaggtgaggacagttttatgttttttttatgtaaaagaccacgagttgattttctctggttatttcttggatcctactgttgagaggaaatcagatactcctttttgtaagtgaagttacaatatcttccctgaagggttttagaaataagctccatctctcctggaatgatgtctgagacttctgcttccaggaaaggaaatatagtagagaattcctccaggccctttccaatctcgtatttctctgaatttattacctgtgcaaaaggagtcttctgcattccctgcttttgttccaggctgctggtctcattaggcctagtgatgaggattatatatcatgatgcaatccttggataaaacctaaaaatctccataacctaagagcttggcttataaggcagcatcacagtatgttagaagtctcagtccaagctctgattctagctctgttactaacttactgtgtgaccatggatcagcagctttgcctctctggtcctcagtttcctcaactataaaacaaaggg

SEQ ID NO: 50660 - DNA, 721 bp, Bovine  19866881333431
aatgttcaatccacaagtgattacctgagggtctcctgagcagcaaagcagtcccccagggacaccttccctttattcacagctcctgaggcaatagcaacttacaaaacctcattagcaggcaggtctccaacaaacaactcggcctgctttcccttccataataccctctctttgaggccacagctactttcaattgcatcctaatttcaagaagtgataaacatatgctcatgtttccacttacaagtttttgattatcagcctggcatcgtagctgcaaattgcccatcttctattataattatttttacttctctagatgaagaaagaaaaaaaccacttttaaattactaaagtgcccgagccacagaaggagggaagaattaagcactgccatatctattgccaatggcaatataaaagtaagggtttgaaaaatgaagtgctggcttgtgggctgtgtcagaccaggctccctggattaagtgcatttgtgcactgtgatcagttcggttcagctcagttgctcagtcgtgtctgactctttgtgaccccatggactgtagcacgaccaggcctccctgttcatcaccaacacccagagtttgctcaaactcatgtccattgagtcagtgatgccatccaaccatctcatcctctgtcatccccttctcctcccaccttcaatctttcccagcatcagggtcttttcaaataa

SEQ ID NO: 50661 - DNA, 1178 bp, Bovine  19866881353430
ggctttttatccctcttaagccctgtcacccgtccctatgttatgtcttgcccagagtgacaattctgtgatttttcatcagtttagtgagctgccctggctgtccaaaacaggaccttcaccttgcacaacctcagggaattctattcactcaaagtcgggagaagaaaagagtggctaacagccacatcagtatggtagccctgccccttgaggggtaacatctcacttcctgattattatgagcaataatgaagtcttttactccataagtggggatctctcattggttgactgaaatgtcttagtatctatccatcagcaaagtctaaactaaattagacaaacacaatcttcaactggaccctagggcagggacagcacctgttcagaggtcatgaagcctggccctgcagcgctctgttctttttttcctggctgtggctggctgcaaccctgctgatgggagccactgccctcccagagacaggcagtcttgtgtgagactcatctagtgtcatgttacatgaccgtgtagccacacaggcgggtactcacttcctccaccagaggttctaagatgagaaaactcacaggctggtgactctttggggagacagtataaatggtgtccaagactgagattgttctcttaatagctgctttttggaaaaaaccatgagctcttgcttagaatacaaggcctgggagtggattccttccctctagagtctttcatattgaagaagattaacctgacccaccaggactggccttaaaccctcctacatctgccttcaggagggaccctgggtccttcctcagtgaaagagacttgagaagggacccctatccctcacttgcccctagaaaagccaactgggatatttcatttattacatgttctgttagtttcctgggactgctgaaataaactaccaggtggcttacagctacaaaaatgtatttcccttacagttctgaaatcaagtccatgcttcctctgagggctctagggaagagtccttccctgccctcctagcttctggtggctctagattccttgccttgtgccacatcactctaatgtatgcctccatggtcacactgcctcctcctctgcactttttcctctatgtatctctcataagaatgcatatgatagaaattagggtcca

SEQ ID NO: 50662 - DNA, 1193 bp, Bovine  19866881407104
tggagtagatcgattgatataaagaagatgaaaaggaagactgccaagaactgagtaagcttcttcactgctctctcaatgtcttgggtgttttgaccttgcttcatgaatatgtcccattcgtcccctgggcacagcagagggctggcctgggaaagagtcttcctggagatgccagggttggggcctagactcaaaggactgcacttaggggaaccaccttaagtgtttaatcaggacactcagagaccacataaagtgaaagtcactcagtcatgtccatctctttgctacccaatggactatatagtccatggaattctccaggctagaatactggagtgggtagccattcccttctccaggggatattccgaacccagggatcgaacccaggtctcctgcattgcagggggattctttaccaactgagctatcaggcaagccctgggacctcgtagtccaaggtcaaatctgaaccttggccaagaaggaagccagaggtaaaccccaaaagacaggactgtgctttatttctgaagggtgcacaaggtcatatgtaggaaaacaagtcccaggtaaaactcccaagaggtctgagcaagtggaacagaaagtcaaggggtgagaggggaccactgagttcagactgagtggtacatgagtagactctaagctgacaggcctcaggaagtttggacacagactaaaaggctgagaaaataggagaatgggcaagcatccatgaattcccgactgtgggtcttgcctcagataacctactgcaaggtgtgagggcctcttcagcagcgcagggggagccccagggatgaggcatgacatcgccacatccattgtggcggaccacatcacccttgtaatgaagttctccctggcacctcagagacattgggtggaagatttggtgtcgggggagcgataagaaggggccaagtgacagctgccctggagagctggcttcttttgtttttctgcagttataattctgggaaggtcagttcaaattaccttgaatgtcagtgtagacttggtgcacataattgggaaatgggatggggctgtgggctcagctgtagtctagattaaaaaatataagactttgagaaaagtgtctcccccaacaagttatgccatgtccaggtgtcacataaaagtgaaccttgatgtatgtg

SEQ ID NO: 50663 - DNA, 710 bp, Bovine  19866881416874
cttcttccatggacatttgcacaggaaccaaggaaggtcttcccagctagaggatccacatactgaagaaagcctgatagatttttaagaaaccaggttttggatttttcataagattattttagatttgtgggacaaagattattataaaatctgtggccaagagtttttttcttgcaatttaaatttttcagaaagaagaaaacaaaatatctcacaagaaaaatgtctgatttgatttaaagccatcggtcagccttctttatctgctcatgaataccacatcctcattaagacccagggatccatggaaaccctactgagaaaccgtgaaagctccacagggattgcactgggagccacttttctgagaatgtgtctgttatactgaatatcaactctggctcctgaaccatcattttgctaatgttagtagcagtagcttgaatgaacttagatattgttaactccaggctaaatcaaatatacaatattgctccaacgaagctgtcaacaacagaggctgtgagtgatcaccatgctggtatgtgtcagttggcacacctacaactctgtttatcatgtcatttcttttactatagctgtttgccagccaccttgccagttggagatgacattggtcaaagaccaacactcagggaagacacacctgtcagatcaagatctacttctcccatttcaaactatat

SEQ ID NO: 50664 - DNA, 908 bp, Bovine  19866881422015
gtggcccatcagtgggtctcctctgctgagtattctgtgaagcctgggtccttggtctctcacagcgtcaaggagacatggccaaccccataccacctccccttggaaaaacttcccagaagtttcctggctttaggaagcagtgagagctcctggaaggggctctgggctgaaagtccacagcctggctggactctggccccagtttgtggctgaatagttggtgaccttgagagagcctctggattgtccttttgaggaggatttttcatctattaaaaattgtcacctataaaatggtgaaaatagcctatcttgctgtaatattagtatttaaagatgattcccttaatgaatatgaaagcacttagaaaagcataagccaatatcaaaagtaaggcattaagaatgccttttggccatggaaatgattcgagactgtgaccctttcttggatcatgtgttgcatatttgaacctctgcacagagctggaaggtactcagaatattattttagattaatgttattctagttcccaaccctggcagctcttgggagctttttaaaaagtaccattcttctaccaccacctcccatcccatcactccaaccctccaactctcacatttggtcctattagtctggaggtgggataacagcatgagtggtttttaaatgccacagatgttgtgcacctggagagggaaagcctggcttggttcagcccctggtttttggaggtactgatgcagtgaatctgggagcggtgggaccccctacacaggtacacaggaggcagtcaccaggaggccaaaaaatagaaaatacaagccctcccaggcaggccagaaaccaaaccctctgacatccgggcatctacacctagcagcagaaatcctgccaatca

SEQ ID NO: 50665 - DNA, 1794 bp, Bovine  19866880439450
tctcggaaagatcccgtggagaaggtaatggctatcccctccagtattcttgcccggagaatcccatggacagaggagcctggagggctgtagtccatagggttgcaaagagtcataaacgactgagtgactaagcacatggcccttaagggttacgtcctttagtatacttagaacagtttgctgtgtcctccgtttcatcatctgctttgcctgtggttcctctatgtcctgaggctcctcgctgctttctgctgtatgaccactgtcattttattgctagtctgaacactgcattcgtgggctacagtccccttctctctttggggtgtgtgtttgtattggttgctagtataatggcggggaagtggtgaggctattaacaggacatttctctcttgatttttaaacctactccttgttgtatcataaggttgataacctttaccccatttttgtgtcatggaccctttgacaaaagtgatggtctctttatcagaatagtggtttaaatacataaaatcaaacagattggattacaaaggaaacaaattatattgaaatacaatgatcagaattgcaatgcacttctttattaacttccctggtagctcagacggtaaagtgtctgcctacaatgtgggagacctgggttccatccctgggtcgggaagatcccccagagaaggcaatgcaccccactccagttctcttgcctggaaaatcccaggacggaggagcctggtaggccacagtccatggggtcgcaaagagtcagacacaactgagcatctaacactttcactttgtttctcaacttaactgtggctcgctcttgaattctttcctgctcaaagccaaggaccctcaattggtggccagtcccagagattgactcgaaacctgggacagaagcgctcatgttctagctacagagagtgtaaatctgtatcatctttgccctcgcctcctcttcccttcaaaatcagtttgctaaaactcactgattgcatgcatgctccccctcctctatgcccatggcattattcacatcctgtttcttatgattgcccagccagaactttgaaaacaactttacttctttcttcatgaacactgttctcaaactgatgtccttactctgaaatcttctgcactcctccccaattaatctgaccgtgtgactctccatttcataaaccgggaatgattcttcattcccaaccaaataaaatctaggctttgtagcttcccttttctatgatctgaccctgaacctccctctttttttttttctctttcctctacaatgccttctccaccatttctccccacaatatggccccaaaggtcatctctccacttcagaactcttccagaactttatctttacccaacacacttctgtgcaaacagtaaccatccaataaccaactgaatgaatgaatgaccttcagtcttgaattctaattctgaagggtctgggggctaactctcgtgaatgtccctacaactggtgttctcaaccatagcattttggttcttgtgagttatgttataattaatttgtttctagtaacaaaacacaacatttccaaatgatttatttttctcataactagagtagattcaagatgatccctataagaaggaaggaggtccttgcttatttgtactctggtatgatttctaaaacataaagaatagcatgcaactctaattaatgcactgagaatacatggatcctgcattttatgtatgcccagtctttatgagctattattactgacttct

SEQ ID NO: 50666 - DNA, 1091 bp, Bovine  19866881142497
cccagaaagttcaccaatgctctttcccagccaatcaccctctccagaagcaacaagtattttaatttcagccactctatgtttgtttcacccattgtagaacttcataagaatggaattatacattatgtactcttttgcgtctagcttctttcattcagcataatgtttgtgagattcatccatgttgtgtgtacagttcatttcttttaattactgagcagtgttccattgccatccatgacatcccacactacagttgatgttcccattttcctggtggacatcacttatatattttaagattaaaaatgagatatagcctccagaaaggaacaatggcccataatcacacagttctgaaaagatggtggagagatggtcacacatctgaaggagagttaagtgctagtacagaaaatctcatatacttctctcagctcctcattttgctttccctgggaattccctattagagaggctggtgagattgaaagattttgacttttcaattaagatggtgctgagacctcatgattttgtttgctactttaattcttttttttcaaaaagcctttcttctctctcttttactgcaggctttgcacttctgggaggacacccttgttttcttactacggacgatattcatttgggtgtgaatgaaagtctcacagatacagcccggtttgtaaatcttctcttggaagcttatttcacaatttatggatacatcttaaaaagaaaatatgcttcgctttaactagcggttttccctctcagcatcctttggactgttctgtttttgttctttacctttttacctgatgtcctgaatgaatttctctcatcttctggccactttccttgggttaatttttttttttttcttagcaatttgaagaggcttctgattatagaatttcaaactccaggagatttagtcatcaagcatgactcttatgtttttcagctgaagaaatggaaggccaggaaaattgacatgttcaatgacccataacctgctagcatcagagcaggaagtaatattgagggctaacatttattggacatttattatgtgtaaggca

SEQ ID NO: 50667 - DNA, 1710 bp, Bovine  19866880158521
agagataagcccttctaattgccctttcttggagaagactcttcagagccccttggactgcaaggagatccaaccggtccattctgaaggagatcagccctgggatttctttggaaggaatgatgctaaagctgaaactccagtactttggccacctcatgcgaagagttgactcattggaaaagactctgatgctgggagggactgggggcaagaggagaaggggacgacagaggatgagatggctagatggcatcactgactcgatgaatgtgagtctgagtgaactccgggagttggtgatggacagggaggcctggcgtgcttcgactcatggggtcgcaaagagtcggacacaactgagcgactcaactgaattgaactgaactgatctgtggtatcagttcttcattagtttggaaactcagtttggggtttgggtctcagttttcttttgcctcttttcccccttcactccaattctgttttatatttgtgaagatttcctcaaaggttctgatggtctgcaaggacctttgcttatatgttacatttatttacagtttttattcttacatatacctttataaccaacaggtaaagtcaatagattgtttacagcatgtttatttaaaaccaataagataaatacaactaacaactttgattaaaccacttggtatgatatgaggcctcagcctgctgctccatacaccatttccccctctcttggatgacacagatgggaaagctgagaccccaggtggatcaagcaaggctgcagggctgtcatggccagtatctggtagaggaggctttggagatgtatgaatactgttccaaagttatgcccaaaggctcagtgccatatagagttggctgctgctgtactagaaaaatctgcattgcttagtattcaagataaccagggaggcactgcaatcttgttagcctgaataactacttatcttacccaaatccagctatttccaaaaaaaatggaagaagtaaggtttatctttcatcactcaggttttgttagcatcctttcccagtaaacagctttagattgacaagtcacagatcagagcttgctctatcccttgcacactgtatttaggaggtgatttgcatacagaatttacataaatctacataattgcattcctttgatggttcataaatggatttctgtaatcaggaaacagctctcaggatctctttgttaatggtaccatgtacacttgtaccctctgtgaaatcactttttaaaagaaaaacattattttggtaattttaattaatgagctagaatgtaatcatcttcatgctgaggtcagagtgtcctaggaagaccaggatcatgtgctactaggaaaattctgcctgtttgccctcccccttctctttccattggaaatatccattatccacaagaggacgtaggtctgctatggagttccaccttaactctggggtaatttgtcttctacctgagtgaagactgtctcagcattgtcaagctaatctttctgtccacccagcaagaggggtcctgccctgagagcagtgccttatgtgtttctgcttattataaacattcccaaaataagttcaccaaagcacacacttgtgtcctttactgggtccagctcaggagacccaggtctctatgtgctctctctttcagcagtgtcatagcttcaggga

SEQ ID NO: 50668 - DNA, 1612 bp, Bovine  19866880402211
tgtataataggattccccaaaagcaaaaggataggggcagaaataatatttgaagaaataacagctaaaaactccccaaatttgatggaaaacattaactgaaacattgaagaagcccgataaacttcatgtagaataaattagagagacccataccaagagaaaaaatgaagatgaaatcaagacattgccagataataaaacctgagcaaattcattgttaaaggacttgcccaatatgaaactaaaacaaatcctttgggataaaataaaataatgctagatagtaattcaaatatacattaaaaaaatatgcaccggtaaaggtagtcacatagtcaaatataaaaggcagtgtaaatgaatttctgtttataaatcttttcttcccatatctgatgtaaaaataactgcatgaaacaaaaattttaaagacatgttaatgagcttattatgtataaagatgtaatttatgtgacaataatagcacaaaggagtgggggaggagcaagccattttggagcaaatttttctgtgttttgttgaaattacactggtattaatctgagttcaactgttttaagttaaaatgtcagttgtaatctccagtgaattatagtggatcgtgagtagaccactagaaaataactcaaaaaatgaggtaaaagtaacaagggaattgaaatggtgccctagaaaatgtctactcaccaaaaaagaaggcagtaatggaggaaagaaatttttaaaaactttattaataaacagaaaaatggtataagtaaatcccatctcatcagtaatgacactacaataaacattaacacaggatagcaagaatgtcctcatttttctatccttgaccattatccacgccatatgtttttctattgtttttatgcccaggctggaagaacacaaatataatccccaaacattgctaatatcatgcatagctggaatcaggttatattgttgatctttcattataaacagacttttcataaacaagagcagcagaaggataggggacattttataaaaataagacattgcttttctttatcattggttaaagctgtggcaagtggtgcagtgataaagaatctgcctaccaatggagaagacgcaggagacgcaggtttgatccctgggttgggaagatcccctggagtaggaaatggcagcccacgccagtatttttgcctggtaaattccatgggacagaggagcctggcaggctacagtccatgggtttgcaaagagtcggagaagagtgagcacccacgcatgcacatgcactcggttgtatggtgcaagataaagcaaacttctgtctctgcaacaggctgactgcctttctctatcaaactttcactcattatatcctgatacccatgtatccctgagtttaatataaggatatatatttcaaatcatgtcagtatctacatttatcaaaaaaacttaagctatagaaaataaaaatatttgtagatttttaatactagagattcctaataatagtcacatggctccttactgggttaatcatagtcttaatgttaaatcagaaataacatgttaaaaggaagtagcagcgcttggtaaa

SEQ ID NO: 50669 - DNA, 2191 bp, Bovine  19866880651946
catagtgaatgaaactgaaacgaagactagaatataagttgtgcagcattcatttggtgcttagtgctgccacatattttctactgttcatttttccaacaaaatgtgacatgtatttaatgtagtttgcttttctgagtttcttttctgaattcaactgccagccttataaaagtaaaaaacatcacactctttttaacaaataacaattttctggctagttttatctctattattctaactatatattaataaggtgaaaactttctaaattatatctatgtatgtatattattttacataatatacaatagtaaatatacaataaattatgacataatctaatgcaatataacacaatatgaaataaaaacctaagagtgggattgtgctctaatagtgatttactcttaggtacttattggataaatactctggttcacatttcttatttataaaataaaggcaatgatcttaacattcagttacgtttaatgctcagatttttgaaatatttaattttgatattgtttagaattaacacattataatgtggttactttaaattgaaaaaaaaaaaaaacttagtcttcagtaattcatatctaatactctactactcagaatgtttttttttttttccaggatattgcttatagctgaagaaggaaaccagagcctttgctcagtcttatactcatggatcataaatgtacaatcctccaccaggcaggtgagctgtataaaatgggaagggatacagagtgaattgaggaggaaaataccaacagtgttcaaataccagtaaaccagagtataagtaaaaacaggtttcatatgtattgcttgaataattttatattttcacttctatttgaaatttatattttagtttacatttaacatttgggacaaatgtacaaaatttatgtgaatagcataaggaaatgtttgctatctagccttcagtgagtcaaaatctggatattccaataagcctggaaggctcccttttaatctctgcttggcagtggcatgtggaatgctccacttcttttgaatatgattatttttcaagctcttgcatatggtgatgagggtctgcagattcgagataaagccagtttcttaaaatatacaactgaacatcctctaggcacagaggggaaaatgagagattccagacagaacatggcacccacataccagtactcttcagtgggaaaatgccaagaagcattagctatatctaaatccaatttttcctttacattcataaatatttaaaagttcaaaagacccttaggatcactttatttgatagggggaagtgggcacattaagggatgcagtagtttgggggggggggacataatttgatcctttacaggaaacccatggctcttggaggtgtttagctttctgaaaacagaacaggacaatgggctgcaaggagttgaatgaagcaccttgagcactaagtgccatgccagccactgctcatttgctaccttaaaatctgttcttttatttatttaattgaagtaaatctgatttgcaatgttgtgtgctattttcaagtatacagcaaactgattcaggtatatgcatatacacataaaaatatttatatatatttatattcttttcagattcttttcccgtaggtcattacaagatattaattgtagtttcctttgctatacagtaggtccttattaattatctattttatatatagtagtgcacatatgtcaatccctgtctcccagtttatctcctctcttattaccaggggaaaatccctggtaaccatggatttgttttccacatctgtgactctgttactgttttatttttaaaataagttcatttgtatcttctttttttagatggcataatattctatgatgtttgtctttctcagtctgacctcactcgtatgacattctctggatccatctgtgctgctgcaaatgatattagtttgatgtctcttggttaatgatcagattctgagtccagaattctgagttctgagatcagaacaaattctgagttcacgtaaaagtttcttgagtcaaaaaagaatataaaatgctacaagactaacagaaaataaatatttattttttgatcaggtaaacatggttatataactgggcacttagggtacatatttttaacaata

SEQ ID NO: 50670 - DNA, 950 bp, Bovine  19866880708983
cctttctttgcttgtgttttataaaagtggagacagtgaatgaaaacacgaagctaagaataatgagagcctgggtggcagtgtctgtatcctgaattgtggcaccaggaacccacaaatcacagcctgaagcactcaggaccttggacgtttgcttttgtttatgaactgtgtagggtgcttattttctgcttttcatgatggctacaaccaatcttttcacactgtatttatggtgcttttctttctttcttttttattaaggttgttttatacttggcagtatctaaatgttgtatctggaatttaaataggagaaaccgtactttagttttatctaactgaaagaggccgagatcactgctggacagaaggtgattttcctttgaagagtgagcagggaggtcaccgagtggatgctgttatgacttggtgcctttcgcagctcatctcagcacatcctcacatcccagtgggctggggtctataaagcccagtttgcagctgagaacacagtaaggaatggagcaggcttaagttttggttggttggccgactgaattgaaaagcatgtatagaagacaaaagcccatggttggttggccgactgcgttgaaaagcatgcacagaagacaatagcgcctagttgttctgagatcaaatatacagacaatgttgcacaaaggtctcaggtcaagaactttaaagccattggtgtcatgtatgctaacatcctctgtttggagctctgtctaaaggtgtatgtcacacttgcattacttaagcaccttttgaggtaatgatcagatttttaaactgcaattgaaaataatgtgtgcatgcatgcatgctccgtcacttcagtcctgtctgactctttgtgaccccatggactgtagcccaccaggctcctctgtccatggcattctccagggaagaattctgaagtg

SEQ ID NO: 50671 - DNA, 1529 bp, Bovine  19866880724458
cagattgtgacttcgtctgaaattaaaagacacttgctccttggaagaaaagccatggcaaagttagacagcatattaaaaagcaaagacattactttgctatcaaagctttggtttttccagtagtcatgtatggatgtgagagttggactataaagaaagctgagcattgaagaattgatgcttttgaactgtggtgctagagaagattcctgagcatcccttgggctgcaaggtcatcatacaagtcaatcttaaaggaaattaatcctgaataatcaatgaaggaactgatgctgaagctgaagctctaaatctttgcccaccttatttgagaattgacttattggaaaagaccctgatgctgggaaagattaaaggcaggaggagaaggggatgacagaggatgagatggttagaagtcatcaccaactctgtggacatagtttgagcaagttccaggagctgatgatcaacagggaagcctagcttgctgcaggccatgggttcgcaaagaatcggtacgacggagtgagtgaacttaattgaattggaaagatttgggtgcaaaaaacaaacaaacaaaaaaaaatgaacaagtttcatttcatgaaaagttcatatcacttttccttatgtaagtgtagctctcaaacaaatcattactagaagatccatataaaaactctgaagtttaactagtgtctcataaaaataaaggattgcctgttttctaatcttatagtactgatgtctgttatggacctcttatcatataaagacacagaaaaagcttctataaatttctgtactacacatgtagcaaaaaggttgttagacttttatttgaaaagtaaaaaaaaaaaaaaaagataaatgctgggaatttttaatttataagaatataatacatatataattctatgtataattatatactacaattacaatatatgagaatataacacatatatattatatataagtatataatacatacataatatataagaatataatacatataaatgtgctaataaataattgagatctgatatcaacattatattgtatagctatcataaaataactttgcactacttcaatgtcattttttccacagaaaataaatcagaaataagaaatgcagtattcagttctgtgtaatagtttatgctttggagtttggtgatatttcaagctataaagaataattccctacccctgaagtaaaagaaagtaagctgctttagataaacacataaaagtgtattctaacttccttgttcttgaagtacatggctaatcttaaaaataactagcaatagctagtaaaattcaaattactggttgaaatggaaaatgaggttttgaggaaggaatgtctaacataagcatagaaatcagggttccacagagaccaaaaatgctgaatttgaaaagggacaattgctcaaaagtgcttgcagaatatgatttgtctttatgtaagttttgctttctaactagcgcagttttatttgttggct

SEQ ID NO: 50672 - DNA, 1389 bp, Bovine  19866880884883
gcctggcgtgctgcgattatggggtcgcaaagagtcggacacgactgagcgactgaactgaactgaagtagtagagggagccttgaggtactggacccccagccgctacccctcccaagtctgcattggccaccgtgtaaccctatggactgtagccctctaggcttcaccttccatgggattctccaggcacgaatactggagtggtttgccatttccttctccaggggatcttcctgacccagggatccgacccagatctcccacactgctggcagactctttactgtctgagccaccagagaagcccttagtggatcttaaaatattggaggtaggttcgctaaggaactatctatttccatagctttctttcctgagttttgtggtatgtccgactgtggacccctggtatcagatacatctgtatttacctcagtaaattccaaggcagtaagttgtcattgtcctttttattgaggttaaaattgtgattctttttcctacaaagttggcattattgatgcttagctcacacttcaacatacatttcctgatgggacaagaaggagcacattggtcagtgagtatctttaatacagacacacaaaattggacaattcaagctctctggctcatatagtcatttaacctaatgcctgtttccatttgccacaatgcccaactagtttaataaggctgggtccccaatgagtggctgaggattgagtgttcattaacttcacatgcttgttctataagtccacatcactttaataccagaacccggcaaaaagaacgcctcaaacctcatgtttttggctcttcaatttgagagggctgtttcctttcacacttttccttcatgatcatttactaacaaatatgctcatggcttagtatgttaacagaagagatggctaatgaaatctaagtagccataaaaggaaaattcccatgaactgaataaacacaagaattaaaaatgtgatggataggaataagatgctagagaaattgatattgccaaccgtatcatttcagccacatttcaatactcataacaattacgtagaatcagcaacaccacacagctcatcaaaggcatctgttcatctccacagctgttatcccagaaaaaaaaaaaaaaggccactctcctccccattcggctccaagcacactgtgattgtaatgaacacctctactgatgaggaaaacagcctaatggtttggagaaaattcaaatagaggtccatttgaaagtcagaaatatgtagttaccaaggaaactcactgatgaggcaatgcgagggtttaacttcaagctatagaagtttatcttacatccaaatcaacttgctattcattttccacttactcttctga

SEQ ID NO: 50673 - DNA, 836 bp, Bovine  19866880916700
agtgaatgcagtcatgtttgcttgcatagactggtaaattatctcatagtagatcataggaaataaatttggggttaacatacaatgtcatagtgaatctattttcgacaaggtggctcatatatactcagcttcatcacagctaactatccaatatcataccctaatcttatttggagttaacttatctaagtggcatcacaaagaatacttatttccactatgctttttttcataaactgcaagctttctctcacgttgactttgggtataagcataaatccatttacacaaagacatcatcgggccttaaattttgtttcttccaatcagtctttttcatattgacagttgttttagctatagttaattccagtagctcacttttgaactctaatataatgtttttagcaatctgagaggaaaattttattaattaacaaccagttcagcttgccaaaattcatcaagttcactgcctctaagatggaaaatttcaatatataatgaaattcctgtggagaaatacatcagaaacagcttttacatcatgcgcatttcaacagtgactacaaaatgtactttactttgcgtatttttcacagatgaatgatatacagactgcaatttatttgtaaagatttattgagtttattggatgcttaactctgttggcgttcatctcactcagagcatcattagaggcaaggagtgttgatatgcatatttacattatcattcttaaaaaatgtaattatcacctggaagaaaacttgcagtgaaaaattgcagcttctcctttactgtttaagcttcctcacaacacgttaggtcac

SEQ ID NO: 50674 - DNA, 3778 bp, Bovine  19866880918635
cttagtgcctgcataacaacaattaatactacattaacgtatattgacaaaagccatagacttcataacaaacatagaattgaaaagtatcctctgattttaaaaacatagttttctctttaactctgtgtgcatgaacacatacacctgcatatataaatttaaagagctgaaaaaaaaaaaaaaaaaaaaacactcccactctaggcctgctctgctaaccttttacaagtactgtgttggtgtttttcattattcatttcaacatgggttatcttccctgtcagcacgggctttaaaactgcactgaaacttgacatgctggcactgacatacacacctcaaaatgtccaataacagagacatgcgcacaaaagcttcaaggagaccacataaagaatggtgaatgtttcttattttgctggtttcagaagagaagaatgtaatgaacacagatgatgcaaatattaaagagtcaaggaatttctagaacaagttgctagaggagcaacaaagcaccttacttgaggacataaagcccagcactggataaggtaggtgggagaaatttgggtggggccctccaaaaaatttagaggcttcccctgccctacaaatagccagcttaactttttttactttccttgggaatagacatggatttctattacagtttgacagctgagaacagtagaaaaatattcattttcataagtcaccttggatttttctcagcatcagtgtttcctgcaatcctgtgaaatcctaatgctgattcctacagcaattatgcaggtatctaggatgaatttcctccaagagaggaagctattggatgataatagacacaccttacttttccttaatttctcatatagatgcatatactagtcctttagtgaatgcatttgcagtgttaacaataaaagtaatgcaaaaatgaggttaataggatgggatttttaacgtgtgttgttttataaaaaagaagtatattcaaaacagggaactgctattttacacttgctttgattcaaaatggtcactcactaacttacactcacgaacttatctcttcctaggtttcttctgatatcaaactgaagtcacaaggacaccatttcactggccaatgagaactctgtcctattagctgtatatgcttacatgtggttaattactgacttcttatctccagtagtctcaatttgggaaattttaagataaactttactgagaaaataaagattgactttgatattcaagcttccttgtctaagagtatatcctaagtaatcatacaaatgcacaaatatgtgtttggaacaactaagtaaaaaatggtcggttgataaagttgaaatattaaataggcatttttatgttgctgtatttttacatctgtattttacatctgtattgatgcaacaatgcttataggaaataagttaccaacatactgaaaggttagaaaggtagtctgtaaattattatgcattgagtctttataattgttaaaattatatatgtatatacatatatagtgatagagttgaacaaatattcaccaaaatgttaagatttggtagtagaattatagaaaaattttaaaagttttccataatatatgtaatgtactgttataagaatagattaatctcataataaaaatcattaaaactattttaatttttcaaagccaaaaaataaataaaataaaagttaaaataagtacaaaaagataaccattgagttaaaaaaattataaaattattatgtttgtagtcaaaaacatcaaaatttcttctcaggttgaactaatactcacagatattgatggcaattccacagtgtttctgaaaccatttaagcacttgtatatagatgaattgaaattgtgtattgtaatgtgttttttaacattcaaaacttgagaaacagagcactgttctctttttttacctgccatgggggatcctgttctgtacttctaagcatcactgtggtgatgaccagtctgctcatctcctccccaagtccagcacaaatccaggtctcctagcctttcctgattatacctgttcttattatcttggagagaaagtttcataaatacccctaaagagtccaagcttgaacttggtgccacatttgactatggtttctgatgtatctaagaactcagaaagtcttgagcctgaacaaatgaaagaagaactcagaaggaggtttccacaaggactggaactttctagagcagcacgggtaggccttggatataaaagtccaaagcgaggatcagttatgcatacatttaatgatgattgtgagccgtttctcagagtcaggagaactcgctaagcaaaatttgaagggaaaatttttctgatatttggactcattgggtaattatgggtaaaaatactaaacatttttttaaactcgaactttctactttgacttggatcccaggtagaatcagctggtactcatcaagcaatatgagaagaaagaaagggtgatatgactatcttaattaactgctttgattgggagagtcccccggctgagctcggagaccccagggaatgctgaagcagggctgcagagcacaccaggtgcttgccagtcaaacattctgcagccatttcgaggagctgggcctcttggccatccatgcaggggagaagtaggcctcctctttattctggctcaaatggaggactgcaagtggaaaacgctcccagtgttatttatttagaggaaatttcagtgtcatggatggttgtcaaactcattcctttgttttaaatgatcaaaatttaaactttggtaattcatcctacattgagttaaaaataaagaaaatatacaatgtctaaactatacaaagaagcttaatttttaatccaatgcttaataatattttgtggttatattttggctttctctgccattttaatttgcttatctcagtagcctaataaaatgtctttggaagttccttacctgtgttacctatttacacttcagtattatcttcacatttcacatgtgcaaattagaacaggtgcaagaattgtggattaaaatgtcaaatgggctattgataatatcctatatgctgcattgtctctgctaatatcttaattacttatgcaaaataaagctctaaagtatgcaacgtaccccaagtacttctttagcttaagtgtatctgagaacaaaaagggaatatatgttctgggcagcattctgagatggtcaactggcaaatctagaaaaagaccctacaatctgcaattttatcagcattttcaggtaattctaagatgggaattccaaacccaaaatctgagaaatgttgctgtatagattgaaactcgattcctttcctgaaggcatccacaaagaaacttttattgaaatgacatgtaaagaggcattatttcttcattgattgtttcttctttttgtttaggtacatgttatgagcaaagcattgtgtgggaccctggaagtaatagaagaatgtcttaagtatctaaataattctggtagtttttaaattagtgcacaatctcaggttttgtacactgggttataaaatcaataccataggaatttagacattggttaatttcacttaattaggaaataatagtttcatggaagagcatatcttcatccaggaagattgaattaaatattgtggatgggataaagtagatgaagaagaatgcagagactgaaatttcacagcgggtaggacattgga

SEQ ID NO: 50675 - DNA, 770 bp, Bovine  19866880982091
ttatagtattgaataacaacagctacatcttattgaaagtttactataggagtcattgtattctatggtcatgatacatcaactcattttttcttctataaagtgctgttatttttcataatcgactatgcataaatcttggaagttaagccactttcacaaaattttacaggggatgcagtttcagttgatcttgaaagtcgggtctgaatgatgtctaacaacttttccctgagcacagcagtttatagcccttactcccttaccttctttcatgggagcccctctccccttttctggtcccagatttccccgtgtatagactccatcccctagactctctgtggcccctatacactcaactcatttccaggagaactgagctgtcattatctttaagccaatttcacattggatgttccctgacttttatctttttgttttctagaatgtcatgcacaggcttctgtatctcacttatgaacaaacccaggagctgtctccttaaaatcctttgtgattaaagaattcatcaactctctaaacattcttcagaactaggaagactctaaatacaagttatgaaagctctgtcatccagccacctccaatccctgtaacctctgtgtgatggatcctccctgccatctgtgtaatcatttttgacacttggtgatggatcttttcgagatctccatagctcttccatttcaatgatagaatcagaccctatcattgtaactgacattggactttgtttcttatctgag

SEQ ID NO: 50676 - DNA, 659 bp, Bovine  19866881047201
ataagaagtatgttaagcatattttaattaaattaacagttattaaaatgattgctgcttctctgatagctcagttggcaaagaatcttcctgcaatgcaggaaaccctggttcgttttctgggttaggaagatccagtggagaagggataggctactcactccagtattcttgggcttcccttatgtctcagctggtaaagaatacacctgcaatgccggagacctgggtttgacccttgggttgggaagatccctagagaaggggagggctacccactccagtattctggcctggagaattccatgagattgcaaagagtccaacacaactgagcaactttcactttcaaaaagattaataagcaaaatatacaattgcaaaggaaccttcctaatgcaacaaagattttcagatttcaatatttttttagataattcaggattgtttttcttctgaacttgcatgtatatcaaggcttctaaaatgtcattttcgttcccatagcatttaaagagtgttttacttgctttatttaaaacataacattttatgaactatcagaacttcttaaatgttgtattagttttctggtgttaccataacaaagtaccataacagagacagggtgacttaaacatcagaaatttattatctcc

SEQ ID NO: 50677 - DNA, 941 bp, Bovine  19866881142518
atatataaataaggtaattattataacagtaaacatgaatgccgtgttaagttggtgatattttccattattctctatttaattttctttgctatgtatcattgatctttttaaaatttaaatgtaagttttatttattattaaacaactctctttaaagtgctaattgccagtctgcttgaaatataatcatgtatagatgtttagaactctgtgttccaaaggttatttatttatttattttttttttttggtaaatatacatatcacagatgttataacaagagtgtgtcaatgctaatcacacttatcacagatggcaatttttaaagtcattttttgctgcccatgtctttcttgctacatgaaacctactttctgaaaactgctgattgccattatctactaagatattctaacatccacatgtgttcatttcctgctttcctgccgaactccatgatttttggttttgattactcatcaatgtagattcttctttaatattttcttcatgactttttctaaatattgaaatgaaaattgatccccaaagcaaatattcttgacattcatatattacttaaaaaaaaagaaaagaaaagaaactaggaaaatgtaagcttagatcctggtgtttagatgtgtctaaactccttatttgaatcactaatgttatagtatgagggcaaagcatttgagctgaaaattggttgacgatggcatcacattgtgtatattttgcttatagtttgccaaaagcagtgcagggtcttggaaatctgcaaagagtgcaatgagtaaataacaaagcttcagtggcactgcttgctctcaagatggtacaaggcaaggatgcgaccagagcttctagttcatacactttgtcatttgtgttcaagttctcagaacgacacaaacattgaaatctaaaggacaaa

SEQ ID NO: 50678 - DNA, 914 bp, Bovine  19866881216536
atttgggttgtttgtcttattgaattttatttattaaaataagacacacatatatatatatatatatatatatatattttaaatgtggcttcccttatggctcagtggtaaagaatctgcctgccaatgcaggagactcaggttcaatccctgggttgggaagatctcctgaacaaggaaatggcaacccactccagtagtcttgcctgggaaatcccgtgaacagaggagcctggtgggctacagtcccatggggtcgcaaaagaatccaacaggactgagcgactaaacaacagtttattttgaatagcagttgtttgtcagatacatatcttacatcttttttctcccagtctgtagctcgtcttttcatcttttaaatggtgtcattttgaaaagaaatttttaattttgatgaagtccaaattatcagtgtttctcttattgtttatgttttccatttcctaagaaaatatttgcctactccaaagccattgtgaagtctactgataaactcatcaaaggcattcttcatttctgttataagtgatttttatctctagcatttcttcttggttctttcttagtatttctacatctctgtttatgtcgtccagctgttcatgcatgctgtctgctttatccattacagccatctcagccaccgggaagcccgtattactcatagttgttttaaattcctggtctgctaattccaacatccgtgccatttctgattgtggtgtttgctttgtgacttcaggttgtgttttttgccttttgtagaccttataatttttacttgttaatcagacagatgtatcaggtgaaaggacctgctgtaaatgtgggcataaagtgtaggaggaggggagcgttgtatatcctggactaggtgtcagtctttcagggag

SEQ ID NO: 50679 - DNA, 1182 bp, Bovine  19866881558165
gcaaaatgcagaggaatccacgcattggtgtgtgggatatgtgtgtgtgtgtgtgtttggagagtggagagagaaagataggagtgggaaaaatgaaagaatgggtgaatctcagagaacatgcagccctatataatggttaagcaaacagatttgggcttggtaaattatgtctcctgtccctcatccataaagcaagcctgctgctgctgctgctgctaagtcgcttcagtcatgtccgactctgtgtgaccccatagatggcagcccacgaggctcccccatccctgggattctcaagaacactggagtgggttgccatttccttgtccaatgcatgaaagtgaaaagtgaaagtgaagttgctcagtcttgtccaactgttagcgaccccatggactgtggcccaccaggctcctccatccatgggattttccaggcaagagtgctggagtggggtgccattgcctcctctgaaagccagcctaatatcattcaattgacactgttctaatgatgaactgcaaaggtgaataagagcttgcagcaagtcatcattcaatgtccatatagtaagaaatatatgtagttacggagttttctctattttatatacttatcaataaacatatatagctctcattcctatgtccctggggtagaagaaatagggcagctccagtgtaaatacctctatctgagggctatattatgtcatcaagtgtggaaggattttaagtgacagacatattgtttatttaggcacagagggaagcttgtgaggcagaatgagaaaaaaaaaaaaaaagaatcaacttttatgcggtcccttttatgcggaaagttacctttctatcattgcttaggttacatctttgggcctggactgcgggaatcttgaagagactggtttcccagcaacatctactcatacgaataagcctgtaagaacatgtttaataaagagaattgtctgaattcctcaaacaaaatcaactctagtcagaggtggtatatggatttttctttcaagagataagccaagaagaagtagaggattaaaggcaaaatatatctacatgtcactaatattgtagagacgtagagagtaccaaaaaaaaaaaaaaaaaaaaaacctagatagcagaccttttatcctaaagaaaaaaaaaaaaaagtcca

SEQ ID NO: 50680 - DNA, 1804 bp, Bovine  19866880166458
tggtgactgcagcctgaaattaaaagacgcttactccttggaaggaaagttatgaccaacctggatagcatattcaaaagcagagacattactttgccaacaaaggtccgtctagtcaaggctatggtttttcctgtgatcatgtatggatgtgagagttggactgtgaagaaggctaagtgctgaagaattgatgcttttgaactgtggtgttggagaagactcttgagagtcctttggactgcaaggagatccaaccagtccattctgaaggagatgagccctgggatttctttggaaggaatgatgctaaaactgaaactctagtactttggccacctcatgcgaagagttgactcattggaaaggactctgatgctaggaaggattgggggcaggaggagaaggggacaacagaggatgagatggcaggatggcatcactgactcgatggatgtgagtctggttgaactccaggagttggtgatggacagggaggcctggcgtgctgcagtccatggggttgcaaagagtcggacacgactgagtgactgaactgaactgaatattgaatgaaatcttcttgaagaattataataatacttttacatagcaatggaaaatgcaaaaaaaaaaaatgcaggatattgccattttactcaaaaagagagaaagagggagaaaactaaatggataataaatacatatggttttgtggacttggccggataggaaaacccccaaatttctaggctctggatgcctctcaagaaagagaggaatggaattggaaagaaattccatgggaacattgtatttataatagtttattttcttagaagtaacattaagtgattttgacaacagtccctttattatacatgagtggtgggcacaactgacatcacatcttatttttgtagttttctccatgtttggatagtaatttttgaaaaagaaaaaaagaaaagcaatgtttgtctctttctatatgtaaatagatttatataaatacatatccatacacagatgaaaagagtgagaaaaagtggtagaggtttgattattcaaggcaaaagtgtgcaaagaaagtaaattattgagaaatttcagggctgcaggtacaagataaggtttgaaataatagtaggtaatagatcatggaaaggattgttaggcaacagaatttcattgaaggtttttaaattgaggtgggagagaagatgattataataaattctgttctaaaggatcttggagaatgcagaaaatggaaaatatactgagacatatacctgcacattgcaaaatcagctacttagaaatctatttcagtggtttcaagaagaaacaatggcagcttgttctagttgaagatatatattaatagaacttgatgataaattgggtgaaagtatcaaaatgtttcagagtatctggcctacactctgccatcccattaggtgaaggatataggaaaaaatgaagatcataatttcagtttgaatatgtttagttagatatgaacttgaagcctctaagtggagatatcaggttatcccagaacttagtaatagagttttggttggagtttgagaattttgcatattttggtaatcaatgtcatggactagcattgtataagcctgggagagcattgaatcagagggaatgtggccttgaccttcaaccctgaagaactccattttcaaatgtcaaataagatgaataagaggtgcatggaaataagactgagaacctgtcagggagttaggggaaaagcaggttatagatgtgtcattag

SEQ ID NO: 50681 - DNA, 966 bp, Bovine  19866880436615
ccccagctctcacttaacagcaaagggcaaagaaaaacttacccaaagcgagaaggtgtgagaaggtgttggaaaagaacccaaattccttcaacagtggtaacatgaaaccaagcccttgctggctggatttctgagtgctcagtattcagagaaaaagcacttcagagaattggattcactctcacttatagcctcaattaaacagcatacaggaaacctaatctatggaaaaccacaaaatattccactttacgtatttttttaaagtagtgatgaaaagttcttagaccagtatacaaatctccagtggggcttgtctatctggggcacatttctcatcctgccctggtgacactgagctatatcagtgtgttagcatgaatgccacacatgctcagttctctggaaagtaagaacagaaaagtacaattattttgataacctccttctcaaaagaaatgacatttttgctctaaaatttccccttcaagtaaagccaagttactcagtggaatttatccttagaataaatgaaaatttgtgccagcagatatttttaaaagtccttttatctggttgccaatgctatgatagccatttcttccccatcagtttgactcctgccaaatgcatcctttgcaagccttactgccatgtccatgtcagcaaagctgcagaggtattttggcatttgaccaaataattgcaaattgtcccagttattcaactggagaattcatttattttggagctaatgacagattttaaaaaacgggttttttcaggtaaagcactaacacagatgaaaagcctgctgctgtgcaagtcctgagggtttaccaagtcttcctgcccctccctccatcctcagtaatcacagtctcccagaacagtgctttcagctttccttggctgttgcctgagagagatttttacaactgcagtggaagagccttgtctata

SEQ ID NO: 50682 - DNA, 1645 bp, Bovine  19866880479311
tggactttctttggaacagagtataattatctgtaaatatgagttagttaggcagggtacttccatgctctcttaggtactaatatgtcattggggggaaaaataactcaatggaattctatttgttatatgaacaattgatgatgaataattccctaagcaacattaaaagcccctagatgatgtttttaacttgcaaagcatatttgttgtaataggttgacaagggagttagcaaaagatagattttattagctgagaacctttagaattaggctatattcaggtggatttaactgccatagtttgttacaatagctaaagtaacctatttgtcatctgtgatctatttcaggggaaaaaatcaaacaaaaaatctgttggtgaaatcatcccctcatcatctttgtttttctttttgatatattcttgatagtaggattaactgcttaaaagggttggcattattttggatatcttgcttattcaataaatagatttttatataaactagaattttaaatgaaagtaaccttttaaaatcagaggtattatcataaacatccatgaacttttgatgtcctgaaaataaatgaaaccatatgccacactgctaaagtcaccaaatcccaaatttttatctaaaaagatacatattttcagtcctcagtctccacaaactcattttgtttcctagctgcatttattgtgtagtaactcattttacccccaatggttaaccactcttcacaataagttttttataattccagcctatgacaaagttcatgctgttttcatcatatctttggccagggaagcacagcatggaattctttaaatgtattgaaatgatgtgtagattctttttctgcaattgcgggcgcctgattgccaagatacattgagaaataaaggaagatgaatggaaataaaaaggcaaacaggaaggagtgaagtagggaaaaagaaaagggaaagaaggagtataaaaaaggagacataagaggagacagggaggaaaagaaattaagggagacatgacagtgaaactaaaggatcagaagttttgtcaatttatttatatttatgacagatggcatgtttccatttacctttgaatcctttccctttaaagctgaagatattttcaactgaggaagtttaaaaattcttttttatttgaaatacatagtaactctaggaataggtgtttttgagttaaaagaacattgtattcaaaggatttgtagtgttcaattgcagtctaaaataaaggtagctttatttttaccttaaattgcttatgtttattgtcctcatcatggtctccttttggatttgtcaaatagcggacacagttttttcattgcacattcactgaatcataaacaaccccttccctccctcatcctcctgtatgcacacagtcagttttctccattataggcagagagatttaaaaacaaaacaaaacaataacaatgaaaaaccaaaaaatcacaacatgttacttctttctcaagccctctagtgacttcttatcctgcttgggataaagtctaaactctgtacccactgcaagcccttcttttcatggggtcttctcatgacattctggaactctcgtctatgaaaagccatg

SEQ ID NO: 50683 - DNA, 1280 bp, Bovine  19866880519721
tgctaattaaaggaaaaccaggtattttaaggaacttagagcttttctatgtatgggtagatgcaggagtctgggctcactgaaatctttcctttggtatacatctcgtatctggggccggtatcctgttttcacaccctgggtttccttaggactcacggtagggactggctgcagcctgatggctattagagggcgggcttctttccctgtcttctcaggggtcaccattggtggtggctgcaatcactgatgactgtgacatccactgtttactgatatggcaggaaatattccacttgtcgtgggggaaggacagtcctctaccccaggtcacagcgagcaggagatagaaagtgagcacctgtatggttcctgacctgtggctggggcagaggtcactcacttttcccaggctctaagtggttaaataactcttaagtggttatttttatttatttatgtttatatgtatgtatttatttttggttatttctattttattttttgttatttttatttatttttgattatttttatttacttttaagtaaataaaaatttacttttaagtattttcagataaaatactataggtttatttaaaacaattctcaccttgagtatgcaaaatacaaacaccacaaaatgttcatttttttactttatagtttaccaatatacaaaatagaagtttgcttaaatttaaagtacatacttttttaaggcaaagaactatatagaaaaaaaaattgttctgcttaaggcatacttgggaataaaccattgtacaaattattgcacatctgaaaccacggtgcataagactgcagagaaaggttaaagtaagccaggtgcgtttacctgacttaggtttaagtgtttcttcctttttctttttaatttatttttggctgtgctggggtgttggttgttgctcaggcttttctctggttgcagcatgcgggcttctcattggggtggcttctcttgtcgtgcagtctaacctctaggacacatgggctttagcggttgtggtacatggtcttagttgctccgaggcaagtgggatcttcctggatcagggatccaacccgtgtcgcctgcattggcaggtggattctttaccactgagccaccagggaagctgtaagtggttatttttaaaagtgctctgggaaaagcaaagcaggaacttggtgggggtcggtggggtaggggatggggaatcctaaacccagagcctagaagtccagactactgggtgtcagcagggttgt

SEQ ID NO: 50684 - DNA, 824 bp, Bovine  19866880591937
atatataatgctttaattgtaaacattttttctacttactgaatctaggttgatatttcaactgtatggtatctaagatagaatgactcagaatttgtgctaaacagaataaggtgacatttttcccatgaccagacgaaggatgaagattcagataagaaccatagcttcactttttcttccttatttcaggccaaaagattgcagggacttccttggccaccctagtacacacaggctcagaaaataaattcattttagtcaattccagtgttttatggagctgcgtctagaacagttccttgtatgtcatttagcttgtttcaatttcatggccacagcttacacacaagagcgtagccttgtagctacaacagcactgagaagcaggacactgattagacaagcctggccgcactgtgcagcctcatggcaggcagagggtcaagatctgttaagctttactggacactaatttctaggatttcactatagcttactgtggacccaatggatctattttgggaagtacttacacagtatctttccaaatgatgaaaatagctagtgaaagttgtgcagcttcttcctaggggtgggaaggaaagctcttaatttttaagaaataaatgttattttaataaccttaaaagacagacagaactacgaaagatggtgaaaacagagtgtgtttgcccagtcaggcagctcaagctcagggatcatatttctttctttcttataacattgcatccttgggcaagttactttactttcttaattttgtcatctaaaattgagaacaattatatggaaacaagttt

SEQ ID NO: 50685 - DNA, 1145 bp, Bovine  19866880685325
ttgaggtatgattttagaaacagagagacacataccagtcagcttttctcttctgtgataaaattaaactctacatttattagttgtatagaaaatagtgctcttcgtgcattaattttttgagattcaagcaaaataaatcatcagctctttttgacatttaattcatctcaatttcattatatatttgaattatgttattaattatccttaattacattcattttaaatggtggaatttccatttctaagtgcttatttcataattcctggaagatttataaattctgctcaatttaacaaatatttattaaggtgattttatgcaaagtatgattttagatgttttatgtaaccactgatttcatatcccttggaaaaattaaacacacatccatctcctataactgtttattactaccattagagctttaggcttggtttttacattctggaagacaatagcaggtgtgggggtaggaaaaggatttttcctatatttggaagaaggaatttcaccacttctgagaatgagcaaacatactggagtttaaagaatcccataaatatctttatttagggagcactgggtgatggataagggattttattcccaacataactgttttattagatgtcataatggattttacatgcttttgtttatcatgatcatgcattatgaataaaaagaaaatattagaaatgacccagtggaaggatttactcaagttcttctaagaagtatggcatctagtggcctgtctcctgccaagcagtgagggtagagtcctagggatgagtggaggcatgaagggatttgagtttctgtaaacagcttctctctgtgccttctcttcccatctctctctctgaacctaccttttgagagattctagcaatacccagttggacccatgggatatggcatggatgttaagaccattactggcaactgatccgtatactgcttgtgttttacttttcaaataaaacaaatgtatttcttacttattgttttttattatattttcctattattgatgtggggatggaatatgtgctgtactccttgcttttatgaatatttctaggcctgattgatgaatgatgatgacccacagcccttgaaaccaaatgagcaa

SEQ ID NO: 50686 - DNA, 880 bp, Bovine  19866880702810
ggatccatctgccaatcaagatagatttctctttcagggacaaaagaaaaagaccctcaaagaataaaaagctttcacactaattaatatccattaaagctcccaccagtttaaagtcttgagcaaagtcaagaattacccagctaattcaattccagaatgtgtttttgcatcattcatctggattgacaagagaaagtgcttccctaaaaaggactaggataattaattccaatttgcagttcatatttgcaaccacaacctcagtatgtcagcctttacaaatttccttggagtatgacattgtaatcaattattcagattcagatctaattccatatacatctagtgtatacccacataataccatgtgctgtgttaggttctagaaacagggaaatgcttaattcattctcttccctttgaacagtgtagaatccactggaattatcttcctgaacagctttcaaacatccaattttatacataccaaagtcagccaggttagaccaaagctactttatatcttgtgcctgaattccctccacatcatgcctcccaagtggttatctagctcatactgcacatttctcaagaaagtctgttggatctttggacagctctaatcattttgatagttgccaatataatggctgataacagttaactacctccaatttatttgggaagcccattggggcctgcaggagagtagagaagaaattttacagtggtcaaaagatgtatctacttcagtagctatgaatcaaatgcacagagcagtagattagacgaaagcttagcaatctaaagtcaatttggaagttttctcctcctttagacccgattttctctgtcaccgcaaatatatagtatgcaa

SEQ ID NO: 50687 - DNA, 1785 bp, Bovine  19866880718358
atgaactgggcttgggcacagctcctggatattgcaagtttactggctctgagctcatgtgaggggattctcaatagaggagcagcactaacattgaaaaggaaggaatagatgcaaccatggtgattaagaagtaactgatagaaattactaactacttaagtatgttggggatatgagaaaaaagtcagcaatgactttgatacatcgagcttgagtgacagggacgctgccataccttagagcagaggtcacatgattaggcaaggtgaaagatacagtgagttcatttttagctctattttgagaatgaatctatagccatgatggccatgatacagtaccttgcttctcaggaaagaagtgagggtgatatatttagatttaaaagaatacaattgtgatggtggtaatttgataattaaactcttttacgggaactttcatctttgtatcccacagctttcaacacaactcttaaacatgttagcaatgtaaaatgattgcctagtgaaaataacagatgcctgaaatctcaaaggaagattgtatattcttttataagcagaaaattgaaaattgattcttggtagaggtgtatatttgaggagtagggaccagtccagaagcttagaagaagtacatcaaaagatgataggagcataaagtaaagagattgtagagctaaggaagctaagttaagggagtagaaaactctaaggaaaaaaaaaaaagtggaaaataaagtagaactccacggagatcaaagagaaagagaatagaaaatagatcagagcttttagcctaaaggactcttttgtggccatgtaaaaagctggtgatcttaatgagggaaaaagagggaaagctggattgtaaaggagtttgagaatgagtaaattcttaggatgtaaagacagtaggaaagcttcttgattcagaaggcaagggtgaaagaaaaaagagaaagtaaccatgattgttccaagcagtatgggggttgagggaaaaatatttatgaagttagagaagatttcagcataacaatggaggaaaagcagatagctcttaagacatttttttcatcctcagtttacttaaccctaatagttttctgtcttattatgctgcatatctcattgcacttctatcattagctattagagaaaacagtgagtgcactttccttctgttaatccttctaccaatgctgtaatctgcttgaagtgttaaactgattcactctaattccctgggatggattatactggaagagaataaactgattagctaaataaagaaaaagacctggaaaactgaacaaaaaacacatttgttttactcagtaacatttggttagtggtaatcagtgcttttcatactgttcatggggttctcaaggcaagaatactgcagtggtttgccattcccttctccagtggaccacattctgtcagatctctccaccatgacccgcccgtcttgggttgccccacgagcatggcttagtttcactgagttagacaaggctgtggtcctagtgtgattagattgactggtttcctgtggtgtgctgcgattcatggggtcgcaaagagtcggacacagctgagcgactgaactgaactgaactgaactggtccttgctgtgcaaaagatcttgaaatcctgccttatgaactttaatgggattaatggaattggtaagcattgtttaagggttttggtttatttactgttactgaagaaatgagatgtacattggacaaatcctaagtactggtg

SEQ ID NO: 50688 - DNA, 3034 bp, Bovine  19866880730835
cctttccctcctccccctgccacgtgtgcataagtctgttctctatgtctgtgtctccattgctgccctgaaactaatttcaccagtaccatctttctagattccatatatatgcattagtatatgatatttgtttttctcttttttacttacttcactctgtaagataaactctagaccacctcattaaatgtgacttaaatgctttcctttttgtggctgagtaatattccatggtatatatgtgccagagcttctttatccattaatctgttgatggacatctaggttgcttccatgttctagctactttaaatagtgctacaatgaacgttgggattacatgtgtctttttctttttctttttttttaagactgtgaaaatattttttattgattgcttgtaaactgttacaatgatgtgtaagactactgcatgctcaataggcccattatcttctttgagaaatgaaggtggtaataacatgaatttggctaaaacatttttgaatgaaacctaatcatctcagatggaagttttttaaattaaacttttataataaagcattttaattatatacgtgaagttgcaagaaaatgcaatagcaattaaaggattccatttagaatgacagaagaaaaactttttgaaatctattatttacaaattctagtcatgctgtgatacaaaatggaagggaagtcacaattcttctcaaatacgacttgtcccctcctgcaacagttgttttatttaaaaaaatttttttaaaataaaactcgacaaaaacatgtagcttgttaaaatatttgttttaatttacaatattagatctaacaagtgacatgtgaaactgcagatgtgggcagcaatttctgagaaagcaatttaaatggttatgagtaaatgtcattgctggcagtagcagttcagatataattctacccttctgctgctccaagaatgccactactcttgaggaattaaatacatatgctaggattatttttggttaaactggaaaatgtaaattgtaacatcataagccagttgctttatttaagcctgtaaacatttgtgtttttatggatttccaaatgatcatcaaacacacttgcaatgttgatttcttgaagagcaatgatataacccaccattgaaagttttagggtcattaacattacatatcagtaaaaatagtttgtgatgcaaatctgctggcttatatacaacttgaccattttatttagtattaagatggcattattgagaattaaaaattggtaattttttcattacctttaagatataactgacagcagcctaagtttatggtgctatctgccgaacaaacatttagtataatttttactgtcagtatttttcagaaaaaataatgcatgtttcaacagacatgtaagtatttttcctatacatgtacgctttgcattcattggacactgggtgggttaaaattcaaaatgaaggattgttagtgtctcagaaatcaacacatttgtgtcttagagattgatctctttacgtaaagcttcaactttatatacatatctaataagacaggacattgttaatatatgtccagtataattctgttgccttaatactccattcttttacttaaaaacaattctgctgcctatcaactaaactctcatcacgcccactaaaaatgttagagtaggaagctccaaatcgtcatctctccactaaagcaatgattaagttggcgaaactgtcagaatcaccttcattagagctgtagaatctatatcttaatctaatattgatggaggaaaaaaatagaacagtttgaacacaggtaaaggaattaatcagaaataagtacctactgatggaataagtgattttattttaaacaataattttcagattaccttctgctgttaaatggtttaaaattaaaatatcagaagaacagctaaaggaattagaaaatcaaatgacaattatatataaatacctgctagagatattagccaacactttggggataaaagcagagaaaacatcatcttcacatatttatgtcataatatgcacattcctcagatgtaaaatttagaaaaataagatatctttttagtattcttaaaagcatccttctaaaaccttaatggtgaaaatggggttactgtggtttagggttaaagactaaagttaggtgcaagactacttttttagctacataaataaacatgagattgatttgaaagaagaattttgctatgcaaagaatgaaaagtataggaaggggctatataaatatattaggagtgaaatgcataaagacaagtaggcatgaaattaaaattacttttaaatgctaacctaattcatttaaaggtattgaattcatttaaatacctggctttaataagaaaaaaaggcaagagcatttggcataatcaggtagtaacaggaaatttgtaagataactattaataaaatgtaatgaagtgaatattttttaaaatgagcattaaaaaccattaggtttagataaagttattttaatgtgatgaggaaattatctcactaatttgacaaaaagaatttattttgaaatggcaaagtaaggtagaataaggaatgcaattaggaaaagtacaggcagttcagttcattcatcaaaagtgctaggctagcctgaaaattatttctattcatattactagaataaagattttaaaataaactgaaatattaaagtggtaaatgatattgatcactatacagtgattagaatttataagttagagttggaagaaatcagttgtcctgttgcactaatcagtgctctcactcctgttctgtccttttcctagtgtactgtacagaatttccattttcagtagatagtgcccacacatgctagggatatgccccgaggatcttctgtctataaataagaacatgccatatccctgcaccagccagagaaattgttttatttttttttaattcctctgttcaaaactcctgaagattttt

SEQ ID NO: 50689 - DNA, 993 bp, Bovine  19866880809482
aggagcctggcggggctacagtccatggggttgcaaagagttggacacgactgagcaactaacacacacaaggtagacaggcaattaacaaagttgtgatagtgtcaggcgaacagtgaagggcctcagccgtacacatgcatgtatctattctcccttcccattcaggctgccgcatagcactgagcagagttccgtgttaggtgcatcattctttcattaatagctgacttacggtgtttgtgaacacactcatgtttatagttttcggtcctatgcactgagttttagacctaattgtccatttcttaaaaatctcagaaaccaaactctggaagagatctagtcagatcaccattgttttgggttgtcgaaaaagttcgttcggccaacccaatatatctaaatatgctctgccataatattagttaaggaaatgaggcttaaccactggcagcaacacaaaattgaatgtagagacatctggagtctgactgttccattatctgtttggtttgctctaaagaaacatccagcatatattggagctgatatcacctcggtgtaacttctaccaacaatcctaaaagtatcccataagaatatattcccaatttctcttctatctgacagtcctttcaatatttgagaatgactcacacatataatcagactgaataagtatcatttcaaatgctctcacgtgacatgggtgtaagtgtccccatcatcctggttgtccttcatcaaagtgatatttatttataactttcattgtttgcctagactccagtagtctggctagaatagtgtagaagagaatccattaaatccactataatctcagtaattcagtttaaactttaatagtattttgagagggagaatgacatggttttgtaagagctccaacttgaagtcaaaccacctgggttcataggcagcttcatcctgtgcctgatttcttcatcaacaagtctattcaaagaaatt

SEQ ID NO: 50690 - DNA, 1381 bp, Bovine  19866880821550
aaatgagaactttccatttattcttagagaaaatggctggtccatgatgaaaacaacaaagctgtttacatttactgtaaaggactttgaaaacttatattccatattcttactgctttacaaatatattctaggtattgttttatcgtctgggctatacatcctattgaactcaaaatcagaacattcctgctccctatcaacaggacatgcttttggttattggctgctttattttttatcactgataactctaaataaagtctgttttaccttttaatttgcatggactgacagaagagtctgtgtaagagaaaaaagtttcaaggttgcttggtctaaatgtctaaatatttctcatggtctattggtttcttccaaaaaatcctatttaaaggttgaattatttaaactcacaatcatttccaaattaaacactttaatatggaatatgtgacaaattatgctttaatttctgctcttctctccaacattttctaccatcactcatcttgaacctgacacttggtcaggaaccaagaattcaaaacatgttttttttccacttttattacctggtggatcaatcattttgtctgcaaagcccattaagccttctcactttcttgtccccctaccctaccttattttaatattttatgactacatatttgagtgatttttgcatgttttactcttccttattctttaggttaatcaaaattaagtttttcttaaatttctattgaggtattattgatttacagtgttgtgctatgccttttcttgtgatacatttcattaggtcaggtaacatatttatgttactgctcatcactttatagtcaccatacttgatactcgctcaggacagtgcctatatgcctatgtttaaatgcttagcatgtgtttgtcaaaagagtgaatgtatgaattaatacattcttattgattaagtaaaataattctgtaatatagtatttgattgttttccccttatagcttcacaattcccatcaaaactatttacatccttttcttttctatgctcatgttatttatatgtcttgttagtatattttgtgtgtgttaaaatattatcttgaagaagtgtctaatttgggcttcttttgctgacaacaatgtctgggtatagttactcatgcagcaaatattttttgagcagctgatatgaaccaagtcatatttataatcagaaaatagtttacctgcccatataaaccagtatgtagctctgcttctgacttacaaatagtaccaatgatggtgtgccaaagaaggaacggatgagtcaccgtacccatcactctgtgtaacacatttccacacatatggctgagtctctatagcatttgcagta

SEQ ID NO: 50691 - DNA, 715 bp, Bovine  19866880825080
tgtctttgtcctcgaccgtaaagtatgaaaggaaataatcgatctgtgtatttaaaaatcatgcttgaggctataaaaatataataacatacagtgctattttcagtaaatcacaatgtgatcttataaatatttaaaataagtttactgaccaaacaagaagtatattttagtgacagtgtgtccatagaagagtttaattgaattagggttttgaacattataagtagatacacaaattgcttcagacagtttatgatcctgggatggtattttctgtgtgcaaagagaaacccattcttcttgttactgtcttcaggaccacagagcatgttatcagatagcagtttagatggctatgttaccagggtacagctgtattgggtaggggtcaggctgcattagagttatttagaaacttgacttcagctaaccttggcagagtaactggacctcagagaacagagtgtgtggagaatccaaaaacatggaaaacaggcagagcaggacagtgaaatgatagctgctgattgtcaagacttgtgaggtggaacctggtttctgtgccaggaactttcctcacctgaagccttcctttgcaacagtcctgaatggtagctgtgattttacctgcctctatcttgggtttttgctggacaactcattgaatggccctgaattgatcctcctgcagtcgcttattacctgagagaaa

SEQ ID NO: 50692 - DNA, 974 bp, Bovine  19866880833854
ctgacatagtattaatagctgtgggccttgagctcaatgctaatgaatcaacaacatttattaaataagatgcctttaaatagaaacacacataaacaaggttatgtattgactagttgatgaaaatcttgtgaccggaggctcacagaatcctaactcaatctggcatttccctgaagagcaatggttcagtggttattaattcagtgttcacagcaactttatagaacaaaactacccaaataatgagaaccaactgtataacaaacgtaattatatgattttgtatttccacactttgatcttgtagaaaataattttccagtcggcacttaatgttgtccttaaatagctatctaatccatgtatataaaatacatcatacatgcacttataaatcagagaaggcaatggtaccccactccagtactcttgcctagaaaattccatggacggaggagcatggtaggctgaagtccatggggtcgctagagtcggacacgactgagcgacttcactttcacttttcactttcatgcattggagaaggaaatagcaacccactccagtgttcttgcctggagaatcccagggacgggggagcctggtgggctgccatctatggggtcgcacagagtcggacacgactgaagcaacttagcagcagcagcacttataaatgtatatgtaatgcttacaaaacaagttattctaaatcataaaaaatcaacaatttactgaataacaaagttatatgactctggacttgcttcagaataatctggggagttgagcagtggataagggtagatgaaacaagactggttatagttgaaaaccactgaaattggggagttgagcagtggatgatggtagatgaaacaagactggttatagttgaaaaccattgaaattgggtgatgatatatggagcttcattatactctactcctgtaaatgtttaaatttttcca

SEQ ID NO: 50693 - DNA, 973 bp, Bovine  19866880872468
gctgtgagtgatacaattggctactctattagataatcctagagccttacctctatggataattgttgctctgtggttccaaaaatccaattaaaaaaaaaaaatctgcattgtgtatgtgaacacaggttctagaatcagactgaagacttgcctggttttaaatcttttttccaccattgttcagctatgagaaccagagaaagttacttaaatgttctcatatttaaaaggaagaccctaaaaatagtactattttatggtcattgtcatgattaagtcaattaattcacatgaagttctttgcgtggtatctgaaatacattaaacttaaaaaatgttaaaaatcaaattgaccagaaaagaaagataaacattaaaatatctgtcaattccaagtcatgccatcttagataccatatgcaatgcatcaacatcacagaacaggaaaatctctctaaatccaactcatttctttttaatgattagtcctccagtaggatataaaatcattgctgctcattcttcctgcaaacttcagggttctcagtccttgatttcttgtgagtcactttctgaaccagaacacacatatatccgcatagataagaaataaatgcaggtcaggcacagattaaatgaggcttacaaaagtaacatttctccaaataaaagttagtgacaagagatttaagagtagctacaacatgttataactacttctcaaatattctcactaaagaggatagatttttgtcttgttttcacaaaaataagtgacctgtttgggtagttttatgagaacaattaaattgcccacataataagtgtattctatttgaaatacactaaagaatatgaagtggcaatttatgttttctacaattattattccactttcaagttcttagcattatatgtagccaaggttcgattctaactctcgattcctcagtgacaaacaaaagttttc

SEQ ID NO: 50694 - DNA, 1726 bp, Bovine  19866880933347
cgcgcaaaggtgcagcatattgcccaagtccagagactaaaattcagcacacgagcagtctgtctataccactttcctcagagaagtcacctcatttttacccgtgttctctaaaaaccaaaggcagtgcctctgaagcgtaggcttagagagaatgtagtttaataggctctgtccatggtcctgaatagacttgggcttgttaacagtgggtttgactttctttatcttgctgccctgtagtttggacagcgtgtgtttgtgctttcccttcagactcacccagtaagcttccccaaattcaccgcagcttcagggccccagggaatgaggactgaattggggtcatatgcatcaaccgtactctgtcaccaaagtgatgctagaggaatgaacagatgtgtatcaatgcctgtggtattcaaaacaacatattaaaccatagatttattttaattccctgtgttctaaagctggaaggcagagatacaaaattcataccctgtggtttctttgtgcttattttcttcttcacagtgtatttattccttgtgagcatctttgggcatgcattgtgttttctctaatgaaagtagaaaaattgtatcctcatcacttatttttagcactgttgctatgctaaactgtagcccaggcatcttattaaaacaaattcaagatttgaattttcattctctttaatacagtggcattgctattctttccgaaaagatgtcaccatatatgagttatctatttaaatatttcctatcagttgttggaaaggtatttctcatctaacaaataaaagattggtacatagaaattgggagcaaaatttatcaagggttcttttggattgtttttgtggataggtgaagggtcaattatttctttcataccatccttaagtgtgatttgtggtatctttagggtgatgttcacagtgtaaaacttactgtgctaaataaagtgattggcaagtgtgctgttaattgccatatgtcatggttagaagacttcctgacatatagattgagtgagctgaagttttctacatgacattgaggttttacagtatatatcgttgagacaacaatctgccttccaaggctgcttatgcagttgcacttatgtgaagagcgatgatgtgtatttgctgtttctacagtggagttcctagttgttcgtctattattttgattctcagcagtagaatcatggagctggattcctccaaatagactttggaggaatctggatctactcacaggggctttcagaaaagagaggaggtaattaccatgagacaatttctggcaaaaccgcacttaacttaaaaggttgacttatgttttaggtcatcatattagagttatacctcactttaattttgataaacatgctagcataaaaaataactggtgataaagggaagaacattaaacttgaagggtatgtgttctgggccaagtgttaggctatttgctttcctaattgctatctcatttaatcttcctaacagccccgaaaggcatggtttgttatccccatttcacagatgaggaagccaaattcagagagattaagcaagttttagctgtaaggggttggcctggcattcagagttaagcctttatgactcatgacttaaagcctaagatttattatatatgatgctaaagtcaacatgcactttctttcctatagaaggccacctaccatt

SEQ ID NO: 50695 - DNA, 2014 bp, Bovine  19866880951838
agagccagtttctcccccagacctccaaatatttatctttaggatgtaaaaagaagtgagagactggatgaccttgtttttgctgaatttgatctctcttgcctttttttctttctcttttgtctttttgaggggggatcatgtgtacttttttatgctgaaaatagaagattttttcccttgcagtaggcatggaaggtttaaaaaaaaaaaaaaaaaagcgccatagcacatgcaaatggtgttagagaatacgaacaggctgctccatgatcatggaattccatggactgactctccagattctcaattatgccatggttgctccttcaaatagcctagcatctctgtggaccacatttacagacacagcttagccattaagcaaacttaatctctcttgcttaaaggcaaactgaattggtattgtgactcattttcttccttccttctttccttcctttcttcttctcttccttcttccctccctccttcttcctttcttttcatctctcatctgtccatctacctacctacctgaatttttttttggatgggtcttatacagagttatacataggctataaaagggttggatggttttatctaccttgcttatttaatctacacaacaatcatgttcgatagacatcattaccctcaagctccaaataaagaaactgcagtgtaaagaagtaaattatttacctagtttcacggcccgcaagtggtgaagacttggagctgggtctttctggttctgaggagttcatgttcttgactgctcattacctagagtcactacatacattttgtcctaaatttgtgcaatttttgccaaatgacacatggctgccaaaaacaaccatctgaaaattgacaaattcattcatgcagttacatggggaggtttctctatctgtttatcgtcgttcccaactttttgttatattgatagagtagtgccgtgctgagagtagagaagggtcattatccccagtatttctcaaatttggggtgacatttctgaaaacatgagcacctctcttccagtttggggtagaaatggtgtggttgcagactgagggtgaaggagaaagaaccctgtgctctttggtaagaatcccacctctgccgttcccaccttgcagtccaaggatagagttgctaggaaagatgacataattaactcctaaaataaatgaatgcttttaatgtaaatgaaagtattattttaaattaagatggattatgatggtcctgttggaaaataacatttcacctaaaatgaatcagcctgctcaagaagcagtgatatatacggaacagcttctccacagaaagtccgagccgtttcttctccagcaagtgacccagtaaaagtgctatatatacacccagggcctttccaactgtataggcgatgatggaaaagaatgactcagcctagtaacgacaggagacccatggaaatggtttctttttctggatttggtctaaatctctgagtttctttaaaagttttaggccatttaaaatcaatagtaatatttaatatacattttataaaaaggaagtacatcttttaaaaaataaattcagggctatcccgtgagtcacaaatgagcttattaattggggtccataagagaacgtagaaattgtatgcattatacaatacatgatgccttttggcctctgttttcctcttcactcaaattatgtaagtcaaatcaggtattaaatttgctttgctacatgtttaaatgagcattaagggatattgcaaatgcattaactagaaacaccacctttagcagccaatattgaatttatcatttttgaggactaaattggacaaggattaaaacaggacaggaagtctagttactcgtataattgtataattgagtttgattgacattttagtgccttaatattgagagtcatgaaatcagttgccaagagctgtggattcagggccatccatgagcctaccaccaccactgccctg

SEQ ID NO: 50696 - DNA, 1498 bp, Bovine  19866881136313
tgtgtccaactctctgcgcaccccatggactctgccaggctcctctgtccataggattctccaggcaagacactggagtgggttgctattcctttctccaggggatcttcctgacccagggatgaaggcaagtctcctgaactgcaggcagattcttttgctgtctgagccaccagggaagccctcagtggaagagcaaggatttatttgcactgagggcctgtgtttttacttctgcttcaagtgttaaaaattcacttcatccaaatgatgcccctgctgatacatgaactggtcagagtgcatcaaaccagggaaagcgtgttctgcaggaaagtaactgccgtctttctcttgatggtgtgtgtttatggatatcgtcagttgctcagcatttctgttttatctgaaaagtattttgtttattcactgacatgttccttgtgaataaaatgacaagaggccattattgaatctgctgctttgctgtcttcatagaaaggatgattcagatcaaaaatcagtattcatcgcttgctaacatgtctctggttcatatgtgcttttattcaaacatatattattagtgaatttaactgtaaactaataactgttgtgtttgaatttttaaatatcacattcttgcccttgaggaaaaaaattgaattaaaaagtgcttagtttgtgtttatgtgtttgcttctactaattaggatgtgcctctaaataattagatatctcagattgatcattggaaggttttcgaaggtcagagtatcagctgatctatgactgattcagtcagccagtatgtggctattgagcttttcctgtaaatcaccatttttcatctttataagtagaagacttgtgccaccattcaaattagcattgattaggaagggccaggggaatttccttctttttcagaatggttttctcaggcagaacagagaagcttcaatggttcagcagctgttgtctgtcctcttttctcactgtaaaatagttcctggtttgcagtcatcttccttccgccagacctgaaccataaaaatagaaacaaattagatgtgtgtcagaaatgaaatacctcctgcttattgagagtttaaaaataatcttcataattagcatttcatatcctggaaactcctactgttgtgcttgtacacacacagggacttttcacccccagtgcatcctgcacctggagaaatcaactgctcctgtgataggtattgatacattggaattatttgattatttactttttataaaaaaaaattggagtatagttgtttacaatgttgtgtgggtttctgttgttatagcaagtgaattattttattcagtggttaactgctcattgaggagccccaacctgttgagggtatgttcttgttgctgttcagtccctaagtcatgtctgactctttgcagccccatggactagagcatcccaggcttccctgtccttcagtgtttcctgggagtt

SEQ ID NO: 50697 - DNA, 2522 bp, Bovine  19866881142899
ctccttcttcttttagaattttattatactaaattgaaaaaaaaatagctagcctgaaatctctcaacaacattggttggacgaagttcactgtgtccaaaccctttggcctaaaagggctccacttagaatcctcttacctaatcatcttttcctatacatggcttcttggctgatttgtaccatcagatagaaattggcctctgaagcaccccagttgacagggtaaggagaaaagagaagggaatgttttgtggtgtttatttcgcatttcttccttggagggaccacctctctccaaatccatagtcctggtaaagctatgaagactatcctgaacatggacagcccagcgaaaaggtagagagtagctgtcctctggacagccagagcacttcactagacatttctgagactgccagtggggacaactgtttcctgctttggagacataaggctgacaggatgtgaatttggagctgcctgagccagcttccctcatgacatgatggaagcccatatgggttgggaaagaattaggtcaaccttcagaaagaaatagatccaagaaattgagaaacttaataacttcatgtgaaaccctggatggaactgtttgaaaccatttcctacgcctcctccaggagcttcccacttaactgaagccaatacactctttttttcacctgttttttggagttacatttttgtcaattttctacaggaaatgtcctgattagctagggagaaatattaagacagctttgattttaattattccttagtgtccagggaaaggaaaggaaaagttaaaagggaggccatgttctagaaccaagatattttcttctttcagttaatcatacatttatgaaatgtttattcagtgcttagtatgtcccaggcatttttttctagttgcttgggtgagatctgttacagaacagacagatattcttgctcttgtaacacttacattctaacagggagagaaacaaaatagggtagatgcaatatacttgaccatgcactatatctaggaaaggatggttaaggaaagttgtaaaccattatactagagttaatgtgttggaaaaagaaaaaaggtacttgctgagagtgcttagagtgaaacacagattatggaggggtaactggtaattgtaatgataagatctaacaggtatgaccaaggggatgagtgactgaggtacattggagaagagaatgttaaggaagtagcaggtaaagacattgaaagcattatttccatttaggttggaattccaaacaattaaggcagaagtgatgttagcaaaaactggcagtaagcaagatactaaggtcattgagacatgaggggaaaatgggtattaacaaaagaggagaataataattccaaaggacctcagactcctgcagaaccattctgagaggaatgttctatcatagaaaaatgacttttttggccagggaagaatggatacatgtatatgtatgattgagtccctttgttattcacctgaaactatcacaacattgtttgttaatcagctataccccaatataaaataaaaacttaaaattattcacaacctaaaaaaaaacccaatgatttatgagttatattaaagaacaattacttaatgactttatatctgagtctcagggcctgtgtggattcttgatttaagatgaatttaagaaatttggggaaatttggtaatttgtgcataattgaccttaatgcatcttgtacccaaacactctgctcagatttcaggaatccctttgtggtttgtaggggagctgatgatcttctttgtcaagtctaagacctgaattattttacatactgatggctaatgagaaaagaagacagtcaacatttgtccattagtatttcttttcttttcattcttttgttttttctgtttgagagaatgctacagagtatctctgaagtcttatgtaattcatcggtagctgatgaagagggtagttggggatatggactatttggtccaattagctaatttggatgatataatttataacaaaaataaataatagctacaaaacagatgtgtactcaactgaaactatttttctaacagaatttaattttcttcatgagctctcatttccacttggcagtgaacactttaatttcaacaccttcaggaatactcagtctgattcagcagtttttttttttttttcagtcaaattaagcactgtttctgatttactgcccagttctatgttaccacatcagtactgcctcttcccttcctttgcggttttctaacgctcatgcagaaatacataccgctataggaaggtattgcaagagaacaaggcatacgtatggtcttaggcatacaatacatatggtttgggggatgatttaaggggataagcggctgagataagttgaaagacaagatcatttgaggaaggcatttcaagatgttagaaaactaggatacgataagaatcttttacatgtatgttaaata

SEQ ID NO: 50698 - DNA, 843 bp, Bovine  19866881167886
ctactatcaaatctatttacacgtcagtgaaaacgcttaatctcatgtcagacctggtgagaggaagcagagtattgctgctgctattgtctatgagctgtttctctaataacgagcatctcctccttgtgctttttaaatggatttctcattatcactatcaattaccttcagacttttaaagtgaatatgtttccaacgaaagtagaaatgcctttgaagaaagtcagtgagtctaaaaggtctagaaaatccaatattctagaaggaaaaaccataatgatcaagcacattaagataggtgattgttatgaggtgaaattttaatttgtgtgcaatattgctcagtttctgcatacaataatgtcaataagttcactgttcagtaatggaacagtgtgttcaatcggtgtgttcaattctttatgtttgcatgaatactcggcagattgttatatgtgcgtttaagagttattttagtcaaactaagaaacctggttggagtttttgattaagatgggaaacacataattatttctccatttacagcagagagatacatgacctttcaatccccaaattcactattctacaaacattcaggaaaggataatatccagctaatgggggatgtctaaaatccaggtggagactatggaccagtcttcaggttaacacattccaggacttcatgcgtttgtggggcacactcttagctcatatctgccttgcagattttggaatgcccataactctctgtgtatcacagagagcttgatacacagagagttatgggcattgatgtattgcttcgttaaacctcaactttatacttatccacca

SEQ ID NO: 50699 - DNA, 1060 bp, Bovine  19866881275472
gatgcatttcttttgtggtagcttaatggacttctgtagttcacctattcaactctgggaagacttgttagctttacagaagaataaacctttcctgagttgtggtttatctgtcattcttaatcacttactttcggctgaccattgcttctggttagaattaagttgtcacttcatcatttgatatttgtattatccatatttttgagtttattttcctggactcaaaattagacacataagaattaaacttctctgcttgaggaaactctgaccttggtataaggaactgttttctttccagcatttggagaccacgcatttagagccattggtcaggtctttgtcagtgccctttacagatcaaatcaaatgtaattttaaatcacattagataattaattaggcagatgagattgcaatttttccttagtgttctgttgagagcacacgagtggatggctgccaatttgtctcacagcctgtctattaaccgtatattaccccagttttcaaatcaactttcaattcagttattcaattttgggactgataatgattctcaaagatagccagtgcctcattttaggatgaagatgctgagatctgatattactcaaaagacaagctgtaaagctggcaacagaaatcacatctcctgaaccctcagttcaggtttagggtctgggaagttactaataagttagaaaaccatcaggtcattctaatgcagagcacagtaagtgtatatagtacagaaagatttatagtgataattaaaagcaaagtgtggcattgtttcatttgcttaaactacaaaaggaaaactgcatatgtttataagtttatatatgtacatgtgtttatgcaatatgccctgatattatctaaagaatgagatgacttaaaagagtagtttgaggatttccacttttaaaatttaatgaggaacattttcacgtatagatgcttagaaatttttcttgaggttttaattcagaaacatagggtagatcccagtaatattcatttccccgaactcctgtcgaattctggggca

SEQ ID NO: 50700 - DNA, 861 bp, Bovine  19866881355157
ctgaaaagagaaatctatcttgattggcagatggatccctttgtttcatgttttattgtttttgaagaaaggggctttgatttcctgccagggagctttcataaaaggaccttagcatgctgagtcctgattaaacatcagggaaaggggatgattcttttgtatagctctttcctgaaaggtgaggaagccaaaattacagtgactctaggacagttatctgctgaaggaccacattcagctacaggaaaaataaaaaatcaaccattgcatagacagcagtaatagtgggatgcaaatatcatttgcccctattttatgaatcctttaaaaaggtctgtacaataaagggtcatactgatactttagtggagagaatatcaggttagttttatttattgctgtagagtcttgacctatatagagagctttttataaagttaaatagattttcatttaaggattctgctaattttagcaagtaaaagagatttactttagtgacaagtgtttgtctaaattaaaccactcacgttgttttggatttacaaaggttgtttttaaatcttctgttgtggcaatcctgttaactaagtctgtctccccactcccctccaaatcaatgatcaaattcaatttataaataaacagagctggattgtcagcaaggttgagtgtcagagagagtggagttcttgagattatagtagtctcagctttaatcttcaggtatagcctggctatgccacttgctagtcatgtggccttgggcaaggttttaactgctttgaatcttagtaagtgtatacattgagataaacatatttaccggcagagggattgggaaacttaatcagataa

SEQ ID NO: 50701 - DNA, 1930 bp, Bovine  19866881445694
cctggaagaatcccgaacgtgacttctgaatacacatcaagaggtgtcttgttctattcttttgtgggtatccctctccatgggccactgagacacataaacaggaaccatgtttaacaagttaggtaacctttaaggcctataaaccatatacaacctgaacatggctagccagtgccttgtcactgaagtgggcaaggtgttaaaatcatatttgcttagaatagacacttgaatttattttacaactgggttaagctcctcaaggcttgacacaaggcagatatcaaactacgatagaacctagggaaatacttcttcagtattaaccatcaatgcaaatatttaaagtatactgtttctaccaagagaatgcagagacaaaaagactaacataaccttcctatttccagatcctactaaaatccagctccaaagttggaattgtttatgtgtgtgtgtgtgtgtgctcagtcactcagttgtgtccaaatctttataaccccatggcctgtagtctcccaggttcctctgtccatggaattttccaggcaagaatactggagtgagttgccatttcctactccaggggatattctagacccagggactgaacccgtgtctcttgcatctcctacactgacagccacccgggaggcccggaattgtttataaagaactctattttcagtatatattctactcagataccattcagtgtgtctggaattttatcctggaaatccactgcaagcagtctccatgttacttgtcttgactcctgaattctgatttatcatctctagtaagcgagctggtgagcatcatacaggaggttcacagggcttagctattcaagaagtgtggattgaagttcaggcttcatgtacaatcttggtgacaagctgtaaaggcatgttatctgcctaaaacactatagaacaatcctttgccataagactctcctccatagcttgtgccttatattttatggggagatgtcaggtatatgttgggtatatgctctatttatctcagttcttaaaagtcctcagtggataacagggaagtccagtgacgatactgaccataacataccttactaatgcacacagatacacagtagtaacttctttagttttggtacttgggatacaggaggaggtggaagacagggaatggggagagagtaactcataacgtatttggattaagctggttatgacctgactgactgtcagcccacgctgctcgcaaagacagttgtttctgatccccattacagggcctgggatgtggtttacacagctggccgaaagagtggaggtttctctgataaagagtgaagcctggtgacagaagctgacaaaagtgaggagactttctggccccaggtatctatagaaggaaaaagcagaatgacagttactgcttatgggagttctgctacccagactttgatccacatgagtgccagaccactgtcctaagttcctgatacacttccaggctctctcagcattctttaggagtcaggcaggaccagtttgtaggttgaaggtcctcaatgtttgtgtcagaccaaactggcctaagtagacaccaagaatcacttataaatattctgaatactgaccattctctccaacagtcatatggaataggtattactaatatccttattttatagatgcaaaatctgtgatttgtctgagtagctgttaagtggtgcagcttgcatttgatctcatatttgatttcctctgggatccttaaatgcctgaatcaggcttgatgtaccttgcctctgcatgtggtaagtaagggcatctgaaagtacaaaaggtacctactttcctagatccattagattaagagggaaatcagagaaacatggccaggccatttacctgtaacgttatctgtggta

SEQ ID NO: 50702 - DNA, 1118 bp, Bovine  19866881463107
attcctgttgtgggttgttatttagtgtatgtaaagcaagaaaatagaatttagttgcctattaaaatgtattgaagcttctgggtatgtttcttaaacaaataattagaatgcaaggtaaatctgacaccatgctattttattttgtgaaatgctttaaatttatcagcagtttaaggcaaaacactctactgcagttaagattgagtttcaagcaaagagacttacatgtctctgaaccattaaaaaaaaaaaagtttctatttcaggcagtttagaaacaggtaaggcaaagagtataacccaagattcatttagcagactttcagcccataaaataaatacagaccaaaggaagaccacagtagttaagaggggaaccatggtgccgaatttgagcagaggagatattttgctattggcaagatgctagaaagagatgaaagcatgcatttaaaaattcaggttgggatctggagagaatgtccttactgtttctttgaagataggcccaataggaaaaagtcatttcctaaaagagacacagtaagggggaccctgatattcttcacagttaatagattctgatgtaagattaggtaagctcacatccagcatttgaaacaacactggttagtaaattaaggatcagagctcatacaaacatgaagattaatgtggtgtattcctgaaacaagctctttcctagaattaaaagaaaattaccattcttattttatgagatatttatgaaaggagatgattcattgtagcagtaaaatatttatgttactcaggtaaatgtacagctatgattatacaatttccaacagctagtgaagttaaattccttccctgttatggaacttaaaatcctaaggccataactgaatccctttagtgtatagtagaaattaacacaacattgtaaatcaactatatttcaataaaataaaattttttaaatgtcttctagataaaatattactgagtcagcctcaaagttgtcatttgtacgtgctcaaaataagcactgggcttccttgatggctcactggtaaagagtctaactgcaatgcagaaacccagcttcaatccctgggctggggggagatccc

SEQ ID NO: 50703 - DNA, 1517 bp, Bovine  19866881931935
cattctctgaattttaaaaatattacttcttatattgcaccaactgaatttctatttcctagggctccacaggaatagtagacttaatcatctcctggaagcattgagattttcaaagacattttcatatttccttagatttttcaaactttcttcttagaatacgtttctgcatcttttcatcagcatgatccattcatgattctagtttaattgtatgtcaaatttctacactatttctcctcaaggaagcagatatgtcatcgtacagattaattatacaacatacaattagtaaaaatttcatgtacttgccaaaatcaagctataaatgtggtataacaagtccattgtttatagttcatgcttgttattttgcattgactggtagaaaggttgacatatagagaaatgatcttcttaaaatctatgccaaaatctttaaggacactgtttaaatttaaggatggggaaaatgcattatgatttatctcagatgaattattaacaaaattgaaaaattaccttgatgaaaaataaaacaatcacaaaaaagaaaaaaaaaaaagaaaaatgaaacccaggaggatataacatgtattaaaatcataatttttgtattaattacaacaaattagtgaaccccagattgaaaacagctggagtcaatcagttaattagaataaagtttctagaaaattcttacaccactcctatagactgcctagaaaatttgtttttcaaccgtcaaatctggaaaatgcattttagaagcagagagtcctagaagagaaatacttctaccaagaaaacagcaaaatcccatgaaggtacaattgccaccactccaggttcctttggccaagtgaccagctggacaggaaagaagcaaccatccaggctgatgtaattgttcttgatcatcaggagaaaataggtcttttaagacacactgaggaagggaagaatatatttggtaatcaggtggtcctctggtaatctggtgttctcttgaaacttccaaacctaattttgatggtaaatagacaaatacagtgagtggtctgataaaattatataacccaagagatcagatctctcaggaatcaaagtctgggttactggatcaggaaggccttctagggatttattggaaggtaagagaaatctaactctcaaggccagaatactggagtgggtagccattcccttctccaggggatcttaccaacccagggatcgaatccaggtctcctgcattgcaggcagattctttaccatctaagccaccggggatgctcagatgagcagcagaggaaataaaaatgaatactggttgtgttctcaaggtcaactatggtgatgggtactatagtcattccactaaacttctttcaactttccccagaggacctgttcccaaatacagaagacattatataaaagtggaaccaagaggcacaaagaatggactgttattgatgtgccctgcaggaccattcctccagcttgccagt

SEQ ID NO: 50704 - DNA, 480 bp, Bovine  19866882041666
ttgagggacaggctaagctcaatagaggtgtcagtatttgagagattttatttagcctcaatccattttaaattagccacattttccatattcttttctagttgccataaaaatcaacattgcacataaaggctgattacactggttttaagacaaacaggagaagtgagctattatagtttcccctttaaagtctcttcctcttgtgggcatctcaaatgtatagctacacagtaccacttacttgggggatgcaatttcttctgtgactcaggactttcctgaacccagggatactcttagcaattaccactcttcccacaaaaaccttttgttaaaagatcaaacacagaaagtccaaaaacaatttctcaacattaaaagaaaagattatgtaacttaggtagcttacaaataaatccagacctctctcataaatggctgctgctgctgctgctaagtcacttcagtcgcgtccga

SEQ ID NO: 50705 - DNA, 2273 bp, Bovine  19866880183486
ttattttttggggctccaaaatgactgcagatggtgactgcgccatgaaattaaaagacgcttactccttggaagaaaagttatgaccaacctagacagcatattgaaaagcagagacattactttgccaacaaaggtctgtctagtcaaggctatggtttttccagtcgtcatgtatggatgtgagagttggactgtgaagaaagctgagagccgaagaattgatgcttttgaactgtggtgttggagaagactcttgagagtcccttggactgcaaggagatccaaccagtccattctgaaggagatcagtcctgggtgttcattggaaggaatgatgctaaagctgaaactcctagtactttggccacctcatgtgaagagttgactcattggaaaagactctgatgctgggagggattgggggcaggaggagaaggggacgacagaggatgagatggctggatggcatcactgactcgatggacgtgagtctgggtgaactctgggagttggtgatggacagggaggactggtgtcctgcgattcatggggtagcaaagagtcggacacgactgagtgactgaaatgaactgaacagatacacattatttttcatattattttccattatggtttatcacaggatattaaatataattccctgtgctatatggtaggaccttgtcatttatccactctgcatatacagtttgtgtctgtgaatcctgagctcccattcccaccctctcccaccctctccctttggcaaccaccagtctattctgtttgcctctgattttgtttctgtttcatagaaggttcatttgtttcatagtttagattccacatataagtgatattgtatgccacttgtccttatctttctgactttctctactttgtatgataatctctaattgcatccatgttgctgcaaatagcattgtttcattctttttcatggctgagtagtattccattgtatatacatgtagcatatcttctttatcctttcatctgttaatgcacatttaggttatttccatgtcttagctattgtaaatagtgatgctatgaacataggggtgcatatatcttcttgaattacagttttatctgactataagggtattagtttttaaaataaataaagatggtagtggaatttgaaggcaaatcccaatctagatctcacaatatacactactttaatctattatgaagttgacatttcaattcagtgggagaaggaagatacaggctcatctgaccatccatctggacgaggatggaagtgtacacatctctcagcatttgtagaagtaagttctacagataattgaagactttaaagcaaataattaaatgtgaaaataaatcaatgaatatataatgaataaattacttatagaaagaaatctaggagcgtatacatacaatgtagggattgtggagattgttcttaagtaagacaaaaaaccgacagctatagaaaatgtaaataaggtcagtgggaaattataaagttaaaaatgtatttgcatcacagatgattaaaataaagttaacatctttaaaatactgagttcctactaaggagcaacagataatagaatatagatatgaaagaataatttatccaaaagtaggtataatggccataaacatatggatactcaaaattatcagtaatcaggaaatgcaaattaaagtaacaatgcattttccctttataaccatgtatttaataaaagcataatagaaggataataccatcactctcttaagaggtaaggatgcacaggaaaaggaactgtcatactttgcaaattaaatgttagttgcagtatggcacagagaagacaatggcaccccactccagtactcttgcctggaaaatcccatggatggaggagcctggtgggctgccgtctatggggtcgcacagagttggacacgactgaagcgacttagcagcagcagcagcagtatggcaatatcttctgaaaataaaaattcacatacagttggatctaccagtctcattcctaagaagctattccaaagaaatgaaaacataatataatttcataaaagtatatggaccatgatgtttattagagcattgttcatacaattaaaattctgaaacaaagagagtctccatagaagagtggttgaattgatcttcgaaagaaactttagaaaaatttcataaaatagtatgcagccattacaaaggataaattttagcagagtctgtatagttg

SEQ ID NO: 50706 - DNA, 1310 bp, Bovine  19866880466261
ctctgtccctagagacatcacattgcagtgcctggaaatacagcagtggccttctctccagctccagcatgttgttgcccataccccaaagctacattctttgtgtctctaaactcaaaagtccataaaagcaagccatcttgttgctattccaactcctctctccctaaaggctgtgactctatctggagggcctggtgggaaagagataccacacttttttccctgctgccttgatcctcatctctgtcttcacttgggccatcagagacacaacaaaatccagcacacccctctctctaaacataccctctggagaactgtgccctcaagcacatcaaacacacatttatgcctagagaggtcagcagcccagtcaatttccaaagtctaactcagaaggacacagtatgggttcaacggtgacaccctgtgacatacagcttcccaggtggctcactgaaaaagaatctgcctgtcagtgcaggagacacaagtttgatccctgggttaggaaaatcctctggagaaggaaatggcaaccgaactctagtactcttacctgggaaatccgatggacagaggagcctggtgggttacagtccatcgggttgcaagagtctggcatgactgagcaactaaacagcaacaatatacatatatatacacaagtgcgtgtgtgtgtgtgtgtgtgtgtgtgtgtgtgtgtgtgtatttcaacaaaaagactaaaaggaaatataccaggatattaatactcattccctctgtggagtaagattccaagtaattttaattcttggatgtttgtataatctccagattttctagattattaatcatcagaaaaaagtgttgattaaaaacatctatatcaagcctgcaagatagccagagagctgctcttgtgagtactcctgcagaagtcagcgaggcgaatgaggaaaccatgaagtgaacgcagaggtgttaccattgcatggttgatctgcataaaatccagccagatagctcatgtcccaggaaatgtcagaatctgccggggtccgtccattatcttagttcattaagagtaaaaagcacacaccaaaactgattcctggctggcttgttgcttgatgagtctcaagattcacaaaggcaaggaagttcattgtaggggaaaaaatatgtaagccattcatgtgtaccaatagctttggaattagcggaaacctcacagggaaagccataggagttgtcagaggcagcctaatgaagacatctgccgaatagagaaatttggccagaaacataacaagacattcaga

SEQ ID NO: 50707 - DNA, 1079 bp, Bovine  19866880480535
tgcagagtgcagcaggcaagagtgaagctgattatctggaaatgagacaggtgtttgatggggctgctagaatctccgagagccagcctcaagcagttgatatgtcctttgggtgaccagttttggtgtggacattccaagagtgcacaggaccacctgcctggagaactttggagagggatgggagagtctccagtatgtgaaccaggtcactttttgaccttgtgaatcctggatcatttcccaaccacaactcttagataaatacgaaggcaagggaaaaagaagttcatctgtcagaagtctaggttctccaaacaaaattaaacagctgattataacaggtctctacccaggcccctttctctgctgttgggagagagcccggtcaggtcattgcattttcatttactctgacgttcatttctccctgtagccaaagttggagagtacagggtgttcttaggtcgctgcactgaaacaatccatgctagcatcagctgtgggccagaggctacagtctacattgaaagctcaatgtctatgcagcacgatgttcaatgtgacagagctatctgatccatgttaggaaaacagaacaaaggccagatcatccacaggctccaagggaagaggaaaaacttataggcccactgatttggttggacatgggttgagatatcggagaaggcaatggcaccccactccagtactcttgcctggaaaatcccatggacggaggagtctggtaggctgcagtccatgaggtcgctaagagtcggacacaactgagcgacttcattttaacttttcactttcacgcattggagaaggaaatggcaacccattccagtattcttgcctggagaatcccagggacgggggagcctggtgggctgccgtctgtggggtcacacagagtcggacatgactgaagtgacttagcagcttagcagcagggttgagatatatcattaaatttagggagacacagtgtgctgtggcccccatcccagagtccctgcttcttttggcatcctctaagcccttgccatttgagagactgacaatttctaaat

SEQ ID NO: 50708 - DNA, 1295 bp, Bovine  19866880561256
acttttcttatgtaatcttttcagataaagaaagttaagaaaaaaacagtcagtaatccaagtgctccagccagttaccttgatttacttcaaactgagaatatattatagtaggctgcctctacctgaaaacataacaggcttcgcagaactttccatgttaaacaatatgtactagaaacaaagagaaaatttgtaattttgtaatgaaaagtaacttttcactagaaaaagaaaagggattaatgtagtagaaattatatgatagttttgtgtttttttaaacctgtttgtgtgttagtcgctcagtagtgtccaacacctggggaccccatgggctgtagccctccaggctcctctgtccgtgggattctctgggcaagaatactggagtgggttgccatttctttctccaaacagagctttagggatgttaaatgctagaaaagggatttggggagagtttgtttttagagcacaacataaacttgagcttgtttggttttcaacattacctggaatgtttgctactgaaattgtgttggaggcacacacagtatcctgagaacgtgaaaaccacaagttgcaacctgaaaatgggttccatgaccccagagactgtgggtagtcacagagccctctttgtgcacacctgctcctgcctgtgcctgactgcaggacccctgcagactagcacacgccgctgcttgctcgtgctccgaaggcacatgcatccacgcaactcagtatccgaatctgaaagctcaacgttttcagtgccataagtaaaagaaactcaaccgtagaaggtggtatttattttctgcttaaaatggggtataaaaaaagcagacagactcccgatacctgtgggcatgctagagggatagtctgtcacctacagcaagtacaggaaccaaattccactcaattttttttaattattgtatttttttaaactggaggataattactttacaatattgtgctggtttctgccatatatcaacatgaatcagccataggcatatgtatgtcccctccctctcgaacctctgtcccactccgtcccatacctctaggttctcacagagccctggtttgagttccccgagtcatagaacaaacttcctctggctatccattttacatatggtaattgatatgtttccatgctgctctctcaagtcatcccaccctcccctactgaggccacaagtctgttctctctgtccgcatctccactgctgccctgaagataggctcatcagtatcatctttctagattccatata

SEQ ID NO: 50709 - DNA, 2272 bp, Bovine  19866880725762
taaaaatctatacagtgcttcgaagaaagtaggaaaagataagaattacaaacaaactttttaatggacaacttcaatagaaaagaaatgccagactggtagagaaacaggacagtaatacagtaattatgctaagttgttttgggaattatataagaaatgaaatatgaagaaatggtaggaaaaaagaaaaagagaacaaataaggtaaagaaccttaaactcctaaaaaatgaaataaatttaatacactaattataactgagattccattattaacaggaaacaacttcagaaaatatgaaaatgggatggaaaaagtctttactctttaacgtctttaagttgttcaatatcttgtactttgacataatccggatcatgcgccaaaaggtgaattgtatatggaacaacatattcaggtagaagagacaataatttttctgaaaaagaaataaaacaaaaacatctaggttagaaaaccaaatcttactcgttctctttctctctctgatactctatttcttgtatcccaataatataccacaatatcactggaagaaaaatacactgaaaggtccagtgctgaggtacatcatagtttatccagttatccatcatggccaatactgatatgcctactaagtgcaccctgtgccgagcctacaaagatacatatttcaattttcaacagatatgaggaaaaagtgacccaaactatactcaagactaaggaacataaaatctatttttcttattagtaactctatgttcaatactcccttgtaagttgctgtgcaaaaggtaaacaactagtaaatctttcagtcagtatggcacaaaaataggaagtaaaggttgatactatttaatacaatttgcaacataaaaactgacagaaaggaacagacattgtttctagggcattttacataacaattaagtatcttttcagtttaaattcaaatgttttgattttttgactgaggatcagtaggggccattacacatagaaatggaaatcctaactagttttaataaaggttactcgaaagaccaagattcatactctgagcaattctttttatatttcctactcttgcaattttaaatcagatgttcagtctagagtaaaataatgtatgtgtcaacaaggcaccaaattttctttattcctatcactgaactcaaagagaataagcttgtgtgtaatattcatttcaaggtaggtccagaagaaaaaaataacaaggttcaaaattcagtgaaatctgaattaaagtctatctaacatgtactgagtgcttactcttttccagacctactattttagtagggcttactattttaaatataaagatgcgtaagactagacacacacacataaaaaaagactagacaaagacctcacactgagcacagacaggaccaggacagaagccccacttcaccatggacagtaccctaaaataagaacagctaatgacttctgagtacttttttgaaccatgcattatgccaggtgctttatatatacaactttttaatcataaccaccataagatacaagtaaaactataccaatcttacaaaaaggaaactagggcctcagactgcataaacaacccacccaaatacaaccggtaaatggcagaggtggcagaggtgagatttaactccagaactctcaaggcgaagtaggaagagaaagaaagagggtctcaaaactgtattttaaaggattcaaaaggggcaaacttctctccttggttttgtttatttgtttggccagaagggggaggcaaaatttccagagttgacaacagagaaaaaagctggctagacaaatttcaaataatccagagtacaaggagcaaagaatttacattctggagtagctagagagaaagtttaaaactcaggctgagagttcactacaaagtgtcatgctaatgagcttctacttgatcctctgagcagaaaggagccaatcaaggtttcaagcaagaaaatgacgtgagcagatctgttttaggaagataattttgacagtggtgtggctcggctggaggcaggggaacatttacaacacggagttagtcaggagtagatatgataattcaagtgaaatacagcaggataggggagttggggagaaacagtgaagacacccaaaagaagaattaagaggatttagtgaccaatgaaaggaaaaaaggaggcatgaagaatgcctctgacttctgacttgcgtaactggatggcttttaat

SEQ ID NO: 50710 - DNA, 2196 bp, Bovine  19866880785372
aaaattagctggctagaagaaacctggtttaccatggaaagttgagggcccctgtattgatgttgttcttacaaatctcctggaatgttgatggacaaactgacctcagtttaaaaatgtcttaaacattcttaacattcattcttaaatactcattaaaagtactcaagacaagtgggggtaaaaagaattcatggctctccatgtgattttaaaaagtgggcttgagaacagtggttttttttttttttttttttccatttaaattggctgacagggtgggcaacctgcttctgaaagattatggatgactcaaccaccacaagatgtcttcagtcgacacaattatcactattaaagcatatccaaggtattaacatttcaacaggctcatggctgttggcttaggattgtttacatggctgagttagcttcattagtaacaaacctcttcagacaaatgactcctttgtcttcagatggaatttctccagtgaagtccctatttattgaagctgtatttatgtggccataggctaggccagggcttccctgatagctcagttggtaaagaatccgcctgcaaaactggagaccctggttcaatttctgggtcggaaagatccgctggagaagggataggctacccactccagtattcttgagcttcccttgtggttcatctggtaaagaatcctcctgcaatgaaggagacctgggttcgacccctgggttgggaagatcccctggagaagagaaaggctacccactccagtattctggcctggagaattccatggactgtagagtctatggggtcgcaaagagtcggacatgactgagtggctttcaccttcatctatcaccaccatgaccctctgatgcccgcagctggaggtgccagaatcagggctgcaaagacccaggaaacgggtgcatcatcagggcccctgggcctggggccagtgccctggcgctgagactgggcagggagtacaggaacaaaggccttcctggataagcttcagggcccagcagttcccacaatggggtccagtgggggtccatttgccagaacaaagcacaggagcttcatggagaagaagagggctcagagaagcctgagagtgtgaagcttcaatccctcctgtctgcgagggagcagggatggcccagctcaggggagaagctacagtccagagcaggaaaaggatgctctgttctcccctttccctcctgggatacctccagagtagccgatggacacaggggatttacctgtgtcttgaaatacgagggaaatcagatttttatagtcactcttgaattggtatagtaattaaacactcaaaaggggagatacctgctaagaaccacttctaggttgtcagcccaacccacttggtctctgggaactgcacttcgccatcggcccctgggctgctaggggctcctggcggacatgtgggcagcaaccctgattctccctccactccaccagccacaagtcagtgttaggggggtgttggggtgaatgtcaccctgccagagccaattggaatcattccacatgaatttggggcacgtagtggggaggagagagcaggtatgggaaggaggttaggggaggagggaggctcaagaaagagaggatataagtatactgagagatgattcaccctgttgtatggcagaaaccaacacaacattgtgatgcaattatcctccaattaaaaattatatttttttaaaaagatacactagtagccccaaggatgaaaatgtacaatgcccttcctatatgtaattcaaaattaaaaggtaaaattatctatggtcagttaataaagaaaaataaaactaatgttattaatactttttaaaaaatttttccagttggagcagaggggcattcagctccttctgaagtgttggctttgctccatgtgacctctagagtggcaggggccgacttctctgctgtgtggaccagagacacaaaagaagctggtctgcagaggagggaaaaaagaccgagacgggggttcacagcaaggaacagagacagagagagatgctggtggagctccagccgacagttctggtcctatcctgaggaccagctgcatccctccaggagacactcagcatccttagagcagagttcccattatgacagagctacgttaacaggtt

SEQ ID NO: 50711 - DNA, 1671 bp, Bovine  19866880795559
ttcaaccagttgatttcagcccccaaacaactgttgatgtgagatcccaaaagctccttggtccccttggacttcggggaatggggcccttttagggagcagatcattcccatgtgggcagtggtgatcagttagtcagttcagttgctcagttgtgtccgactctttgcaaccccgtggactgcagcacgccaggctcccctgtccatcaccaactcccggagcttgctcaaactcatgtccatcgagttagtgatgccacccaaccatctcatcctctgtcgtccccttctcctcctgtcttcagtctttcccagcatcaggggttcttttaaggagcagatcattccatgtgggtggtggcgatagagccaaggaatgtggttggaggggaccaggagtggcggccccacctgaaccagcagaagaggctctgttattggagaaagggggaaggacattgggcaggcaaaaatagatactctagagtaaaacggaaattatttttacatgtaataattgcagtagttctattgaaatcctatcatgatcccgagccaaacaattttctgtagtaacagtgcggtaaccatgcctgagatcaataggctagtctgtcaagggcattctctggttcctccccacacttaagtttgctgcaggagacggttggtgttttgcctgatagccctggacctgctgcaggaccaagtgtgggttgcaaatggagaacaaacaaaaccgtcacaatataattttgtgctggctatcaacagctcagcagaaaagagattttcacattctcctcaaatgtcatttatatctcttcaggtagatatttgtgaagtgatgacaactgtcaataatgattccttcctaattctccagtcattttggccattgcagagtgacattccctgggaaacattagcatttggctgataggtgttagaaggcactgtggagaatcagtagaaattatgtcttttttcctccaactcaacttaatgggcaaaatcatctttgatagtggttaattatgctccatttttgtttgtttgtttgtttgctttggtggtaaacaagagtgtgttatgcccttaaactgaaatatcaagagttgggatttcctggtggtccaatggttaagacttcacactgacaatgcaggggtctcgggttccatctctggtcagggaactaatatcccacatgccttgcacacaactgaagtattaaacacacacacacacacacacacacacacacacacacaaaacaaaataaacaagcaaacaaaacccagaaaatatcaaaagtagggggaatgtgttcgggagatattccagatatagaacagcaagttgggtatgggaagtgatggttgaggagtaggtatccatcatgactgggacatggcttcttctcattatttactaattgcagttttctattgtttgcctggaagacttaaaacaaaatgtctatccattgaaaacaatcagtttatttaactgggttctgattaagatttgactattcatgtttacatatgggtagagtttcggttcattatctgtgttgctgttatgaaaaaaacaaaacaaagttatgtagagagccttgtaaataaaatctcccaggctagcccaagccctgtttcactgccca

SEQ ID NO: 50712 - DNA, 1485 bp, Bovine  19866880877929
atcttcctgaccctggatcaacctgcatctcctgcatcagcatacaatggctcgttacttctcaatcacctgggaagccggaaaggaggtggtggtgtatgtgcaaatatctagtgtccagagtgtgacccactgcaggttgacaggctgcccaggtttccctggctctgctatcagggctgccagtgtgatcaaacaacaaggttacgtgatttggagccctctcgggcccctggagtctttgggccttgtcctctttgttttgcctctctttccaaatgaatcacttcatcaaaatgaaacatctacgaacacagtatgcaaggttcggatgattcatccagcccagctgcggtcattgtgagaaaaccctgtgccttcaagacagttacaaagactgaatagtttctgcggggtttttggtttcagtgtcatttatttttgtattttcaaagaggaagtgtgcaagacatcattatgtcagcagtgggcaaaaggctggtagactcttaataagtggacatacatgtttacacttcccaaagtttctctttctgtcaaaaggtctaaccggctgttggtatctctaggttgggttatttcttcccttgatggtaagcttaataaaatacatttttaagttgtaggtggaattttgaaagcctgtttctgcaaacctcagatttggcaccttattttgcttgtcaagatttctacttaaaataaataagtaacatctaatcctggacacggattaacaagttaattcctttccttttcaaaatggaccaattagcaaaaccctatctctgcagatttctgataaagcctaaaaatcaaacaaaagttgtattcatcttgaaagggcatagccataagaataatcacatattaaataaagtattcagatcattgctatatttaatatttcccatatgatacatggccctcccgtacctaaaaaagaaaacatcatcatctcctaattcaatttagtctgcttaaatatatgatttaaccagacttcgagcagctttgatgtctcagaagctgccctttatttggaattccctgcctttaatcccttcttggttaccacacccccacgtactgcctatttttgacaagggggcgatgagaacatgggtgaggctggctggcgtggcctgagggcctcaagaggctcctccagcagcagcgataaaggaacgctagacattccattaggaacactgaaatagctgcctagcagtcccctgtcatttgttctaaccacactgagtgactaaggttttcactctacgggctgtatttagttttctcttcctcacacttttacatatactaaacagctggtttcagctttgaatagttctcacttcataaatcctaatgtttaaggtctatatagaaggtttctaacacactattggagctgccagaagaaaaccaattttgtcactgtaaagagtacgatctagcagg

SEQ ID NO: 50713 - DNA, 833 bp, Bovine  19866880979707
tctttctggctgaaagtacaagactgtttctgatgcctcttagaaaagaggttgggatttttgaggatatcggggacctctccaagagggtcctgaggaggccagctctgggtagctgtggccaaccacccagacaggaaagtgaccatcataaactctcattttgaagaggctggattgtgtgaagacagctgggcaaaagcccactcttcaatgtgagttttaaagccttcaggagtccctctcccactccagactctgctaatagagggggagacttgggaaagctgactcatcctggttagctcggctttgctctgcctcccactcactcataaattgctgcacagactgtgctggataaattgacattaaaagttattaaaggaacaaatcgacagtttagaagatgtgcattcatggcaggcatctgcagaactctgggagagctggggcagggcagagtgatgtggtgagtcatagagctggggcctcacagctctgaaagctggaagaaatcccagtgctcacagaggcccagcatgtccccttaaggagaccacctgaaggaaacccagaggtgactcagtatagccttgtctgtggtcctgggtctcactgtgggtttatgtgattatttggggttttacacagatgtttgcttatttatatcttttaaaaaataatattgctcttattttgggcagcccagtggtaattaatcttggtgggggtgggatccgtcctgtctatatgtgggcatatagatgtctagcttcctgtctgctctggttccaagggtcccacacgttccaggaggggcgcttgcttca

SEQ ID NO: 50714 - DNA, 2004 bp, Bovine  19866881096852
tgtctgccagagacattcatgatagagaaggttctcaataatcgggtaaaaaagataacccattctttgcacgtcagtcagccaccctagggcttgatccaaagaggttacacaacatagttttgtcttcaataaatctaacctggctgccaccactcctcagtacctgagctgtcagaaacagaggtcaaagctgagaggccaaaatggcatcattacctgaaggcagcagtcagcaccatggaagggataatatcagtcctcatgtgaatagactccaattcagggtatggatcggagaaggtactggcgacccactccagtactcttgcctggaaaaccccatgggcagaggagcctggtaggctgcagtctatggggtcactaagagtcggacttcactttcacttttcactttcatgcattggagaaggcaatggcaacccactccagtgttcttgcctggagaatcccagggacaggggagcctggtgggctgctgtctatggggtcgcacagtcagacacaactgacgtgacttagcagcagcagcagggtatggctttgccttccctctcagcacttctgctagcctctctttctcagacatgcagaatgcttaattcatcctctaatattctttaccttgaagcatataaatattttagctcaagtattttgaaaagaatcatcttttgcctctatttttaacaaatatttctacaagaaaaacctccttaaatacatggtctctatttatgattatgttcaaggtttcaccaaatgaagacgctgcaaaatcaaagaccttctaaaatcattccattctaaaaccgaacataaatgtttaattaaagtaaaggttccatcaagagattcttcccacagttcaatatattccaagatgcaattacagtaattcaaaattaaattttaaatatagtttgcgatctcattgtttcatctgttctgtttttctcttgccttttatagagataatttttaatgccttcctattcacaagcttttttctacctcagtaattaaattttaccaaaagctttcaaaagctgaagtttttggtatttcataacctttgaatacagtaatttaaaactttcaactttatttcgaacaaaatacaaacaaaatttatcagaatcttttgcagaaagttcagtaccattgtacaacacacaggttggttttcaaaggttcgagcaaacatgaactatggcttatagctggcagccgagagagaaagcatgtttgatcatctaaaatattgtttcatattcatcaaatgcatcattttttgatgaacacacacacaaaaatactttaccacaaaaattttgtcactcaattacaacaactctgataatgtataaatatttgtaaattttgacaactaaatcttctgttttgattagtaagatattatagcttatttggatgaaattataaaatgtatgtgcatcgcaatcaatcacaaatatgtttatgctccataagcatcttaatttactaaaagcattgttcttacattacttggccccaccacaatttgtatttgtcattaacaccataaaaataaagcatttttctctaatgttaaacatacatctgaatttataatagcattaacaatcatgttcccttcaacagaatgaacttctaaaagcttcattttaataccatggagcagatgaaaaaacacacacactattggaagtgacttgtttgaggactctcatgccattaatatgaatccatctttacttaactgtttatgaatttcctccaatactggccgaagatatcaacagctattatttcactatccataaataaagaagaaaatttgaaattgaaaatgagcaaaattcatttagaataatagttatttgatctaaatgataagtcatgatcggcagagtgatgtgtagaagcaccacctacagctgcagatgttagctcatcatcttcaaggtcttctttttt

SEQ ID NO: 50715 - DNA, 980 bp, Bovine  19866881101744
ctgcctttatatgcagatcattcgttatgcaataatttaattcatgcttttcataaagaatgtcacagaagggctgcttcatgtgtgttactttgttgttgccctggtgacatttgaggagccctcaggcgaccatggatagctgaggattccagagagcagctccatgtgaacaaaaagggtgagtgttccaatgcagctgttcagtggagagtctcaagttgtgcaccatgaagtagtacttttcttctggcttttttttcccccctcttgcctctagtcagcatgttagataaatccagctttacatgagcttatgcataatcaaagaactcaactattttttatgaaattttataaaacctttttaaccattgacctaaaaccattctacgtatatactaaaggcagagagtcatcagatttcttataagaatcactaatagttggaagctccttagaagaaaatattttatcatattcatttttgtgtcccctgttccaggcactgtaattttgcataacgtgggacatcaataaatgtttatgaatgaataaatacagcctgtgagatctatttcagatctattttcaagagggtccttttaaagtaactactgcccaaaagccctatgaaaaatagatcaagaactcacattactttcattgcagaaattatagactatcaagtgtctgtaatacatataccatgtatatttcagacactcattttaacgttaaatctgagtaaccgcaccgagatttggagtgaaaaagccccagtaagtgaggctgaaaacttgggagttcacaggagctcttataggttctgccaatttaacagaagccgtctttaagagccacagaagacccttaggttctctgcaacacccaggcaagcaaagaggctctaaccattaatcaagttgtaaagcaaggcaacttagaaaagacgcatataaaatcagtaaaggggagga

SEQ ID NO: 50716 - DNA, 1685 bp, Bovine  19866881150945
tgagttcttttccctttatacacaagagcagagagaagagagatggttgagttgatccaaatttggggactagcaggatagactggagaggtcaaagtggcagatgaaatgaggggctggtgaaaatatggcttaaaattacttcccatgggttccaagaatgatggaaagggaagcagcagggtttggtaagcttcatggaaggtcctctcaggtctggagaacaaaagggaacactttatcatgtaccatctcttggtagagtcctttcttgggatgtagttggttgtttctgcactttcagcttcactggcaaccaatgagaatcatcaaactggaaagatttaggttcattagtgatagcaatgatcacatttttctttccttttagacgactaaatacattgaacaagtgtgcctcaatgaaacttgatgtgaacttccaaaggaaaaaggtaggtgcaatttactataccttactaagaccatggctgtaccagcaggacgagctgcgttcacaaattaaaaacaacacaaacctaagcgaaattctgaaatgactgaccgtaatatgtgtttattctccaaaaatctcgtcttatcataagcatcatgattcagcccgacaggaacctaggctaacatctgtttcactttgctttagttttgatcagagggtttgcatacaaacgtaaaatgccttgtttatgataatctttcagaagtttgtttagctgtaaatatccactctatattagactcaagttctccggtgatttgtagattaagagaatgcaaaacagaatctatggggtgggctatgcccggtgtcttctgcttcattctttcctatggcattttatttcaagtgcagttcaggatgtgatcattgtcaggctggttcatgtcatcgtggttgagcaggtggagggagagggtaacaacaggattcagaactcaccccatctctccattctcaccccttgcccttttctctagtcacagggagcgtccttcagtttcccgaatcactacacttcctctctcttataggactttgcaggcatttttccctctgtaggagtaaggctggcgatttcagttctgaaacaaagctatactttattgaggacttaactgttttccacaagctatgttatggcatttcatgcattgtggcagagggtctctgttttctagagaagggaaataaaacctgaactggctaagtcccttgcctgtgatctattagctggtggaggagcagggtttcaacttcaggtgtgtctgactccaaaactgaggctcataaccactgtgctgaaagacctctctttctcactgaattgatccttttaggaaactcagaattaacatcgttagctacttttttcatttcacatcttcagtatgtaacaagtcaagccgcactatattttgaagaagcagagaaaacatccctgagttgtaagaaagtgttctttattctggtctacacagagaagtcattacagcccatggattttaagtcactcccgagtaaccaaatctttaaaaataactttagcctgaatttctgctctaaaatagcacccaaaaaaagcgcaaatgaattttggttgacctcaccttcaaaacaatttggggtttgagctaggaaccaaagattcaagctaaggaggtaa

SEQ ID NO: 50717 - DNA, 1035 bp, Bovine  19866881163566
tcaagagggagggtttttttttttttcacttcttgggataatccttgaaatggacccctaactcgtgatgcccttccctgaagctcttggtaaagaagctggagcaaagaactgctgacgggcaggacatttcccccagcgggcctggccgccttgtcttaaaaagggcagaaaagcgtatgccttctttaaagacatttctaaatggtcctgttgggcatactgcccaccaagtaaagcaatccctgcttcagagcactccctgtgtaaacagtgaaggaatgccaacttcaaaaatgaatacaaacccagttgataaacaggcgaataaatccccacatgggccacaaccagcccaggagtaaatgtcagagcatcaggtcatgggtggagggagcagggaagagtggagaggaaatcctggaggaaatctgaatcttcataatcaggaaagctccttgaagtggcttccttcttagttaagctgtgagagtgaggagaagcgccttcccagggtagttgggtgtggtggcctacaccctggcgtggcagtttacaccttggtggcagctttcgaacgccaagtgaaggtggtcagttttgtagcctgagtcgagccaggctggttgcctgagctagaggcgtgtaagagagccagctgctgaaatccccagcgcaggaagctctgacagaataccaaggaagggcgtgagtgcagacagcaagccagaggggagggagttagttcaaggcagtagtgcccttccccttcagcctctgcacaggaacctctgggaggcccgttactctacagtctgcaaaaggcagctggatgctgtctgaattattgcttgtgggtctagaatttaagctcactctactgcctcagagaagattagtgctctaaaagcttcttggaattactgggttctgtactcgctgcaagagaacaatgatttagaacacatctcctgagaaccactgttctttccacatgtgcttattatccggcacattggaccgtttgtactgggc

SEQ ID NO: 50718 - DNA, 1881 bp, Bovine  19866881176243
ttcctcgattacaattcagacagtatgattttacttgtaccatccagaactcatttatagcatttttattcctctcaataaaagaattgcacaatgctgataaaagaaaacattacaatataaaaagaaaacactcagttttttttcccctccaacaccaattgctaaattatgataccaatctctccctgaaatcaaacacaataaattatcttcctctttagagttgctgaattacaattaaaaaaaacccaacttaaaatccatcagcgattggttaaggatagtcaatttgcttagtccatacaataataaataaggttcggtcaaatgcatagctagcttgactgactaatgaagaaacatggacttaacaaacctgtgtatattttctaaagctaactgaagaacacagttttggtcttaatgttagtttaaaaccctgtctttcagattgcagaactttaatgagtaatatcttaagagcatcatacgtagcaatattagaactccctgaagctgtaatggtccaggactcttgagtgaccagcatctccctttatctggtgtccagagttaaattcagtgcaagacgttggtaagaaaatgtcaattaactgtgaccattaaataggccactggtcaaatagaatgacatttaagaacattatgcaatgtatctatgaaacctcaacaaaacacagaggctccctttggctgtgaatatgccaaggctattatattcagctctaatcagcagggaaatacaggttctgtttcagtcactggagctgactccagtggtccacgggcatctggcatttcagtgaaactgtatctgccggccccatggcaactggtaatatagtcttaaacctggtaacgactactcacccacttcttggctttaaagaggactattattttccgcgctttatccaacgccccactctcaggttttgaatgatacacgctgacaacacgtgagaaccatttaatgtgttttcctttggttggctaatctttggtaaaatatcagggcggacaacttgttttcacactttggtgttagcagcagattctgctcagcttacagggcagcggggacacagggcccagagaggcttggaaagaaccgtgtgccgaaagggctcacctgatcagatgcactccttttcaaaatacgcaattatatataaaattgacattttacatatatacagtaaagataaagatatacacacatatgtacatacgctctacatacatttatttacagttaatgatagtgcttcttagaagcctttaaatagcaaaattaggcaacgcacaaggaataatcgatttaattttaagtaacatagataaatgttcttgatttttaaaaatattatattagtagggatgtagccatctccaggaaggctaggaaaagttctcagaaattcttgcatcttcgacattccgacttctcagtgcttctgcttttgagcagtaaccttgtcaatcggtctctctctctcccttgcttccttgcactcacactctctcccacagtttgcttccgcttcctcttccctgagtttgatgtcacacttgggaaaactcagattttagtctctggaccctcagcaatgaggggctgaaaagagtttctaatcctggcaacttccgccgcacacagatgtccaaagcctttattgtaccattctggggagtgacctctgtggggacaaaaacgggcagggaagtgggaaagcctcttccacatcacaacagtctgtcacggtcaacatggcgcgcccgtgcccggcctgtcagctcgcctgccttccccgaggggctgctgctccgaggacctgcgaacctcatcctgtcaat

SEQ ID NO: 50719 - DNA, 1240 bp, Bovine  19866881211547
aacaatataaaaattgaccccaatactggtactgtttctttggtgattatgaaggacagtatgttacttgtagaccatcattatgaatgtcattttgggggaaagtcagcagaagggccactaattagtgctttctcagcaacttatgggggtcttcccaggtggcttagatggtaaagaatctgcctgcaatgccagagacctggattcaatccctgggtcagggagatgccctggagaaggaaatggcaacccactccattattcttgcctggagaatcccatggacagaggagcctcgagggctacagtccgttgggtcccagagagttgaacatgactgagtgactaacatacacaatggcagcccacttagggtgtgcagttccattgaggactctggcagacctgttaacaaggaaccctttgtgttttgttcatcactcagtaaactcatttccattggagggagaactttatttctattcctttcagtctagttggaatccaaacatcatctttagattattactattttgaaagtttcattccagagtttgatgatatgcttacaaatcagagacacacttgacataaatcagtagaatttacctgaaatgttggtggatcataagtggggccccaggaagcacacaaggcctcctgtccacagagctggctgagaagaccactctgacctcatggctggacgcacactctcatccttcaggagagcatcttccttgcccaccagcactttggttacatccaaacatcatgctcaacatcatggtcacaaataagtcctgtggcccacgttgtgggcagagcactcgtttagcactccacctcagctctgtatgttcactgggataattctgttctttccagatgaaacattctaacccagttgggacatgatcaaccatgtttatgctgtctgtcagcttaaagtatttttttaaatgatttttgtgttagaatctatctttagtttggaaagttgaagagtgagataagaatagtagcataaaaaagaaatatagtagctatatttccactagggtctcagacatctattaggaagtgtaagttgtccacagacatcttcttaagaccccagaagccatgctgtctacaggactgtggagatgggttgggcagggcacaaatacggtgttctggaatataaaggtaggattcttttttggttcttagagataccataagccactgtgat

SEQ ID NO: 50720 - DNA, 1151 bp, Bovine  19866881252007
ggtctggaactcaactcacaaatctattagaagcaatatttcagcagatgagagcagagtctcaagccttgtcaggccctgaaatctttctggacattcgagtgtctcagcatagttgaatcttcagggctgggccaaggtttccatgcatggggatgacttataaacatgtaagggcttccctggtggctcagaggataaagaatttgcctgcaatccaggagacctggattagatctctaggtctggaagatccctgggaggagaccaaggcaactcactccagtattcttgcctggagaattccatagacagaggagcccggcaggctacagtccatggggtcgcaaagaattgcacacgactgagcatagtctgaacgtgtgaagttatacagatgaattctgaagttacacacactctggatggacagccacaccactgaagacttgccttttccaggcggagaaaaacaaaatcaagagaaaagccagtgagattcaatttgcataatttggcagaaagttcagctggacaaacagcagctcttcttgggactctgttctaaggaaatgaacgatatttatggcctaataaaccgtatgctccataatgaaaggggccataagagagcatggcagaactgtgaattgggtgaaagaagcaggatgtcgggcatgaatactgcagtcagttttcactgagggaagtgaactgagggccggagccagtgtttccggtggaggctgaacttaggtgggagaatgcagtgacatgcttccatctgcagctctcaccctgcttttggagcagagggtcaggcttacctgagaaccacgaagtccctggaggggtggggcgccatgctgttcagcacgtactgatagacttcagtctgtttgtccaacgtttccacaaccttccactgcacgaagtcctcgtcccacaggtggcgctccctcaacacgcggttcagaaccaccgaggggggcgcctccacctcagcggaagccttccacagcctcagcgggggcccgtctcccacctggggaaagacacccgcagcggcttgagaggtccctggctcttcagaacctaccaggcttcagtggggtgttcaagaagcctcatcgattatggaacttgacagt

SEQ ID NO: 50721 - DNA, 1841 bp, Bovine  19866881272033
tagattatgtgcagctccccaaagtctcaggtttctcagtatcaccctatactctcatggcccaaaggatgtcatagaataaacataaaaacttgaattacttcaatagccatatctttataacaggaactattaacacctataatataataataatagggtaagtagattaaaatcagcagatctgtgcatgtcactcactttgaccattgtttcaggtgaaacctcttcatctggaacccaaagcttagttgtcttttttcctggaagctaaacaaaaattaaggactttaagatacaaattctcatatgtaattaatatatagagaatgaatgaaatctttaccttctacagcaacagtcattatatatgactatgttttctgttacttacgcaaaaagtttgaaagacctgtcttcactagcaccaaaatgaaccttatgcttccagctccagttggttctttgcaagtatgagacaggactgactttaacaacttatgtacacttccttgcttaaccccctttaagactaatgtttcatttatttaaggcagccggcaaggaataggataaaaatcaatggagccaaaaaggatacagatgagccttgaataagacaagtttgaactgtgcaggtccaccaacatgtagattttaagtgaatacatactacagtaatacactatatacaatctatgtttgactgaatcacaaacgtccaaggaaccacatacagagagctgactataaactgtaaaaagatttttccacaacacaaagggttggcagctttaactttgattttgctcaatggtcagctatagttcataaacaaggggaaaggtagctgcaaaaagtcttgagcagggaacaaatataaaggcttgcatctgaagtaacagaaaacatacatcagtatcttcctacttaaaggcaacacacactcacacccacacaccccaccccacacccatccctcttaccccggtagctgggctgggaagcaaaaaagtcagtgttagtcagtcatgtccaactctttgtgaccccaaagattgtagccggccaggatcctctgtccaaggaattctccaggcaagtatcctggagtgggtagccattcccttctccaggggatcctcctgacccagggatcaaacccaggcctcctgcattgtgtactgtttgccgtctgagccaccagggaagcccagaaaacaaaaccaaaaccatagaaaaatttcaaaaaacagaaaatacacagcaaaaagaaaacaaacaaaaaaacagagctagaggattgacatctccagaaaaacacagaaaacaccctccaaaaagtcatctttttagaacaatcatagagtaatatggagatgataaactgaaagtattaagagatgtgaatttacactagcagccagggaataagtaaggtgatcaaagagctgaacccaatcttggaacacaggagatctcattttcacctcaacctgacatgcgcaatttctagttggaaacagaaatttgtcaaagagcacctcagatgaccttctagcaacaggataggtagttccaatacagaaggcaagttccccagacacacagagctatttacaaatagtttaaggaccaagtcttcaggagagaagcaccttcaaagcatgaagtggaaataatgaaaaaaagaatctcattagaaacatactgacgaaatttctgaaccaagaacatcccccaaaatcccaaagctcccatagaggaacctaccaaaaaaaacaagaaccagatcaacttcagatttcttggtggcaagaccacatgccaaaaaacaatgt

SEQ ID NO: 50722 - DNA, 811 bp, Bovine  19866881299413
agctataaggaaggaagacggttggagcctttcactcacctcaaaaagtctgtcacattccatgatcatgtgggccagcccctgagccgcggccagattctcactgaggtccttttgatctggcttcccagcggcatattttttctggatgactctgtaattgaaggggacaacgctcagcggatcccaaaccccagagcatttcacaggacccagttcacccctctgctatctcttcatgcctggatgccacccagatcccagactttctcatttccaaataaaaacagtgaccacacatcttagatatcccgaggcaggttacgagtctgacaaatggaaaaccttggaaaaacacaagggcaggaataactgttgggggagaaattaattcatttttccccaagtttgaaactacttcactgcaggctgccatgcttgggcctgaaatccagtcttttcaaattgaagattttgtaaaacacatacaaaacagaattccaggttttctgaatcacagagaacactcttcaatgctaccttggtaattctctgactctgagccgcaactccaaacattttctgattataaacgaagtgctaacagatccccaggttgaagtgcaacgcatgtatttttcttttttttttagtagccctggggaatacctgatttgggattagcattcccgtcgagaaaaacccacctgggggagctttctttcttcagtaaattcaggtggaagagggagggggccagacacacggccaggttcatggggcgtcatctgattctcttccaccgcatgaa

SEQ ID NO: 50723 - DNA, 707 bp, Bovine  19866881855817
acacacacatgaatcttctggcgagtcttgttaaactgcaggatatgattcttcaggtgtggggtggggcctgagagcctacatttttacaaagtttcaggtcacgctgatattgctggtccacagactacactttgagacttgaagcactaggtaagcagcaggcagggccagccagtgcagcagttcccctccaggaggcaaatttgagtggaccagggcccctgtgtattaggagaaaagagaaaactaacccttggtcaccagactgttcagagtgaatttctactcctccctcaagaaatgttagaaagggtaaagaaatctcagtgctgatttttgtgatctatttggagtcaaatagatacactggcagcccagaggaattatcaatgaattgataaatgggatgtgggcaacttgccaattcttattagcctccctccaggcctcagagagggagcacatcattgaagtggtcaactcagaggcagcctttgctgaggacagacctactgctgtctgctcggctttgcgtggggcagagtgcaaactactctcgctctcctgcctctgctgtgggagtgatgcttgcctcaattctgccctgggtcatcaggagccctttcttggaagaaacttgaccctctatgcctattttccttctatctgtggttttgcctttttatgtttatttccaggatctg

SEQ ID NO: 50724 - DNA, 1273 bp, Bovine  19866880488985
tcccacctttttaaacctaatttggtgtttgtgagaattaatagcctactttccagagtttctgaaatgagattgcaaaaaaatgaaactgagcatgaaagtagtaggaaaaattaaggctctaacatagtattatggaatgcccattcattaatgaaagagctgagtgtttaaagtatgtgtgcaaatctgggcctccatttgccctgcttatatttatttgtgaactctcaatcttttatttaagcacttcatgtaattaactgttggtaactacatttttgaaacaacaccttctctttagcctcctgatatctgatccactgttcttgtgaatgtgatgacctaagtagtaatcagatcacccaagagtagcttttcaaattgtttttcagaggtatttcttttctggaatcataactggtacatatttcccacttcaccatttaattacctagtttttagtatttgtattctcgataccttcattttcattataatttcttttccggagaagccagagccaaatgacagacacctggacaaagacagtctttttctttacctaccaattctttcctctcattcccctccatccctgactgtccctcccacctctccctctccttgtcccacccctctatttctcttccctattttgtctcagtatatagaaaaataaaaactagaatgattacaagaagaggtagatgattccttgcaaagataatattcattgacagaaacgtattagtttcttagataaccaattcaaattactttgtggttcactagacctgtgttagactcctgctttataaaaatagcacatatccattgtagggagaaaaagtgatacagtatcagtgaatataaagcagaaagtaaaagtgctgttcttttctgtactttccagagatactattaatggttttaatatatctttttgaaatatctgctctctctatatatttatatacatgtttaatgtagttaattagctccatccatttgccttttataagtaggtcttcagaatgtcataaagcagttagttcaattttagtgtgcttgatactactaaattataatatctcaatttcttttctccttttttccttaaaattatttttttaaccactttcaggacactggtccctcgaatattttctttattttttaattgtttttttaaaccaatcctaacatttgcatcatatggcttagatgcagttgaaataattgattaaaagtgcttccaggagtgttatgt

SEQ ID NO: 50725 - DNA, 1650 bp, Bovine  19866880659939
aagagatcgatattatgctcattttcctttggataattaactctcacttgtaagttagtgttttcctatagagattgttgcaacaccttttttgtgaaacctcggaaaagggaacaggactcttgacctcagctggtgtctctattttccatgaaacatacctctctttcccaaatgaagctgttttcccctgatactgctctgtaataagcagtattccttctgttttagctgtgttacaggtttgccccatgcagacagaatttcagctggtgccaatacccaagcacatacatatcaatagtgatgtcactttaaaataacagtaatagaaagaatgaatgaagagttaatacttacagagcaattcttaatgccaaggactgttttagtctttttatgtatgataactcatttaattctcagaaccatcctgtgagttcaactatattattatcctaattttacttttgaaatacagaaagtcagagaggtcagatagttgtttaaaggtcaggacagataacaatattacatagtatgaccagggagatcttatcatttattgactgatccaggatactcttgaccatgaaaggatgcaaaaacaggaatgaaagttcactctatttatgattgaaggccagacacctggcaatacccatatcatgctacacaattagtaaatgaatgagtttttattacatttctgcttgagcactatattgtcctaagattctcagatgatcatcagtatgctgtaagtaagttgttcttaattaaagccatccatgcttatggtaaataaaaatggtttgagcttccaacatgatgagtttcacttcagagacacaggctcggccaatattttcatatgctacctataacctttcacaacagaaatatgatcaaggtactggtccattaactctgattgtccttccttaccatggtcattagttgatgttctgcctttcgctgtatctcagacacaagattgagagtttaaggaacagatatccctggggcataatgaatggtgaagtgtgtctttgcctctttatgcagatgaaatcaattcctgatttccacagggagtgcaacaagtccttgacaggcagtttccccgctgggctcctgtcttgaaggggaaaaggaaaagaaacaggtttctatatggtcagcatcttgagggcatgcataaagacatcatgcactactgatatctgaccccaaaaatagttaacctctaggaactcagacattgacattgaacacaagtcaacctgttagaaaatctatatccccacaaacctggctctccccatgcatataaataaatgatgacaaaatgaattgtcattgttttaaagagacatataccatattccattaattgtaatacacatttttcatattttaacatttcaaaaattagagaacatgctatgtcaaatggagttaccgtttcaatgctagagggtttttttttttttctatttttctgtggttcataaaagacaggtgtatcttactggaattttaaattttatgaactacattatataccagatgttaacaagattttagcaccacttgcactgaatcagaaagaataagtaatagttgaaagctgcatcagcctttaac

SEQ ID NO: 50726 - DNA, 1519 bp, Bovine  19866880739652
tgtcatgaaacaggctggatgacatggccatattccccagatgcctttttatcatatagaaaatattgtagataatcctcaggactccagagagtcctctggggtaagaaaggaagctgggaaaataggcaggggtaaagtgagcaggaacctgagtaccacctcacacctgcatctctgttccatcaaagcagctttgctttttcttaattttttttaaatgttactggggtatagttgatttataatgttatgttaatttcaggtatacagcaaattgattcagttatacatatacatataataattatttttcagattctttacccatgtaagttattgctgagtattgagtagaattgactgtgctatatagtaggtccttgttgattatctattttatatatagtagtgtatgtggtgtgttaatcctaaaactcctgatttatccctccctgccatttccccttttgtaaccacagtttgttttcacagtctgtgacggctgtttctcacaaataaataagtaaatatgtttatttgtatcatttttaattagattccacatgtgagtgataccatatttttttctgggtctgacttcactccgtatgataatggtttaggtccatccatgtcactgcaaaatagtgttattttgttctttcttacggctgcgtaatatttcattgtatatacgtaccacactttctttatccattcctctgtcattggacattcaggttgcttccaagtcttggcagttgtgaatagtgctgtggtaaaacactgaggtgcatgtgtctttttgaattatggttttgtccaaatatacgtcgaggagtgggattgttggatcatatgatagttctgtttttagttttctagggaactccccacaccattctccatagtggctgtactaatgtacacccccccaccaatagtgtagtagggctctcttttctccacaccatttccagaatgtattatttgttgattttttgttggtggtgcccattcagaatagtatgaggcgatacctcctttagtttttatttacatttctcttataattagtgatattgagcacttttcatgtgcaaagcagctttgcttttttgtatgcctttctgaagtaaaatttcatttgtaaaagacttcccattgcttattgaaaagagggggaaccatattattggtagtacggttagcctttgccttgttttctgtaactagtcagtgtggtatttttggtgattctttgatgtcttcttctctagttacttgtattgcaaaattgtctgagtcctacttgggacagaggtcgacagtatcatggatattattgaggtataggagcttttttgaagagagggagtgcaagaaggatgtacagcaagtataacccagccctgaatgcagagctttgtgattcagattgtggcttagactctttttgtggggaaaagaagtctttctgaatgtcagctaggagttgagatagtgaccttgaaca

SEQ ID NO: 50727 - DNA, 973 bp, Bovine  19866880832966
ctttgaagtttgtttcgttgttaagaaaatcttaactccctgtgtactgatgatattgaatccaacccctgctgtcctgtccttcagaagtctgcagtgtattctgtaaataatcatctcattaaaaaaacatagattggagtaaataaagacccagatgcctcagacagctggatctactgttcctctttctctttcatatatttacatattaattttaaaccataggtgtaaagtcaagtctgctctctcccagtctctctttgatgttgcaaagatcaaaggcttcctaagggaaggtttcttgcagggaatattgattccaagtatgattggtcccctgaatctgactgctaagtcagtgtgaggactgaagtgctctgtcggcctcaggaatttggccacactgcccaccactctccaccaaagcctggggtggggatggcgcttctactgagagtcgggtcaccaaaagctgaaactggaacatacatcatagtcacatcctgtttaagtgaaagacaagttctatttccagaaactgctttttgtctgaggagagggagaaggaagtagcgttgggtactggattgcttcagttagcaacgtgcaaccagccccttggaatgagaatcccagctgaatgggtaggcaggggactggcctgggcatcctctctctctgagctttctctaacatttctcctcgtcactttttctcctctcccaatactcactggagagcatgctagacatggggaagttaagaggagaaggggagaagagttgtggtagggaataatagagacaagagatagtaatggtaaggattaagtccttttcaggcctttgcgtccgttttttcctccattatgggcccctcctccatctctgtaagcgatgttatgagagcagtagagaaaagctttgtttttcatcgtacgcagtattaaccacaagtggaatagctcccg

SEQ ID NO: 50728 - DNA, 796 bp, Bovine  19866880856995
aaatgaaagcatggaaaaatcacacatggatagaggctgggaattgaagtatttccctttcatgcttgtatgattcagaaaagaacttcacacttgtatttagttccatgttaaccactctggtggttgaaaagcaaagcaaatccattgggatttccattttgctgccagcctgtggttaaggaaactggcacctcaaaacacaacagatacttctccatgatttgtgatgcctgagccatgctggattatctgaatgcaggctgggattggttccacactgctgaggcctgtccctggagtcctacagtactcctgggaggtgcactattaggctgctgtagccaaaataaaactggctggccactgaccatgtgccctgatatctgggagttccaatctctggctgtgcacatgtggaacagaataagggagcagcttataagaacatcttcagtggatgggatggagaaggggaggtgtctgataagatggagaaaaagccattatgctcctgctatagggtcttcttcctagtgtttgttatcagaagcacagtgtaaggacagatgcactggaaggcatccaatggctatgatattctggccatcctgagtagccactaggtagaaagagttgtactaagaccgtggaggacagagagatgattatgatacaatgtgacacccccaggtgtttacaatctaacatactaaatttaactatacactgaactgaactaagtgttgtggttaaacatctttcaggagaatctctacctcatgatatatacaaa

SEQ ID NO: 50729 - DNA, 1507 bp, Bovine  19866880867866
aaaagaaaaagatgggtttatttttccataatttatgtgatttgcaattaaaggaaaatttccaactagtaatatgttgtctcccttccaatgtcagtatgcccaaagcctcatgacatattgcagcttttcccaaatatctgtgtatcttaagaacactgtgtcaagaggcctgatccaaagacttgatttatgttgctgcctgacagatgatgtctgcaaggcatgccatctaaatggactgcactccagcagttaccttaatcatcaattctcagagaattaatgactaccattcatcccaataatagaaatcaaggtcagggcctcttccatgctttgtaatctcattaactatgcacagaaagtgcttaggtcacaagctctgtagagctcataactgagtgagtggagctgcatcttgtttccagagggagtctcctctgagcataccccttgttgtacaggagcagttgatgtccttatgtatggagtggaaatgccggtaaagggaagtgaggctatctgcacctgccaagagtttcagatactggttttatgacagtaaatgccaatagcacactatttgaataaagccattccaggcacttcagtgatggggcatccatttctgcattgtatactcattcagatattatgtaagccactccatcattccaggacattgtcgtagaatttagttttcattcttttatcttggtttttagtttttatgctacctgccctaataaaatgaaaatgagcttaaaagaattatcaccatacacatatttataatgaaactttcatcttaaaatctcaagcatggtttcctaagctaagtttcaccaggcagtccttcacttctcataattcaaattgctttcagccccttgtggctcagctaataaagaatccacccacaaggcaggagacctggattcgatccctgggttgggaagattccctggagaagggaaaggctacctactccagtattctggcctggagaattccatggactgtatagtccatggggttgcaaaagtcggacatgactgagcaactttcactttcactttgtcacatatttcaaaaagggagtaaccccaagtttccaagtcataggctttgacattttttattgttgttttctcaacagttaaataagcatgattattaaaattttacagctgtttcacattgaagctgtaaagagttaaaataagtgcctaatacagtgcctggaaattaataaatagtagcatagtgtgcctgtgtgtgtgtatgtgaaatcttgttttgaaacatttggagttttatgcccagtaaattctaaatgatgcacagtaatggtggggagcagaggcatgaataattcaaaacagcgaatcacctaaatatcatttgtatgtgttttgaaatgtattttttaatttcatttcaaatgtgactgtttctaatacccagagaagtgcctcaaaggaagacactgcaatgtaagtcc

SEQ ID NO: 50730 - DNA, 563 bp, Bovine  19866880996097
tatactgctactgagtatggaaaaaaatttattgtgatgcttatttaataagacacaaatagtttgggattaaaaatgtttaagaaagcaaagtagttattttccaaaataattttatgataatttgaatgtgtggattgctaaagaaaaatacaaattgagaggatttttaaaaattacagaatctcttccaaatgtacccctacatatatggacacacgagtctttttttatgaagccttagggttcattcttcctttctcagcagtattcttttttttcccttaaccactgttttctgagactgttctcattctgggttaaaattctgtgtaccatgtctaagagcttgttacagatgctcatttaatacaaccatccagtgaagcatgggtactattagtatgcctagcctatagacaatgggacctgaaggacctgcaggtccaaagttacatactcaccaagtgtggcggtccaggttcaagtctaagcagtctgacttcagcaccacatgcttcgcagctgtggaatgttgcatcccagcacagcagtgttccagt

SEQ ID NO: 50731 - DNA, 1274 bp, Bovine  19866880998837
acaaccacaaaaaaacacatgtacatcataggctatctccctccagaccaacaaatatgttactattctatacttccctccattcaaattgcaatagccctcttgccaaaaaaatatggatatagatgtagataaagagagaaagattactaaaaaaagtactcacaccatcattaatacaaaattacaaacacatggcaaattttatttaaaacactttagagtgcttttaaatacagtttcaaaagaagggaatacgtgtatgtattctattctactggggcttcccaggcagcgctaatggtaagaacccgcctgtcaatgcagaagacctaagagacacagattcgatccctagatagggaagatcccctggaggagggcatggcaacccactccaatattcttgcctggagaatcccatggacagaggagcctggcgggctacatccatggggtcacagagtcagacacgactgaagtgatttggcacgcactcgcacattctattctattaagctctaatgcttcagagaaccacaaaatgctcatttcatcacctgagctcctactgatcatagaggtggcataagaagccatgactaggagaataaaacaatgaatctctgtgaccagctacagcaaacccagatcacaggcactgactggtagcctgtgctcaaaacagagccagtaatcagaagagccatcatgagttatggagcacacacaaccagagttcaaagcaagtcttgaatcacataaaaaacagaggccaaagtaaggcacggaatcaagaatcaagacaagaattcagaatcatacatatggagcaccacactgtccactggtcatttgagtggatctagttgcagcaagaatagtatgtgttaacagcaggtagatgagttccagccttcccttccataccagcagcctcccagagactggtaacaaaacatgccactcatttttcccactatgcattagttgggcttcaggaggaaagccagactaattatagactaaataaagaacttccattttctctttgcgtctgaactgtagtgtgagttaaacttctaccctgttacattagctattggctggacttcaagcggaattaaagggcaaagcaaatgtgaaattacgctgggaatgtccagctagtcagagaagtaataggagacaaaattaaaagaaaagaaccacattggttcctttttacaactttattaacatataattcacatactgtacaattcacctattta

SEQ ID NO: 50732 - DNA, 1827 bp, Bovine  19866881092189
tagggggtgaggaagcgggaacataggttggggggacccaccctaaagggtcctgtagacatgttatagattctgatctttatcttaagtgtagcgaataagtttttgcagggttttaagcttatgactgacatccttggattagctttgcaagactatctctcatttggccccttagagagcagactggaggctgatcaagatgaacatggttagatgtggctaccaagtccaccaagtcactgatggcccagataataacggtggcatggaggaggaaatgctgaagaatttgtgagcacgaatataagttagtcttttcactgcattctaccttatgtccacctacccacagtctgatgagatccttccgtctcacatcatgaacaaatgtgatcaggtgctgtgaacttccagaataaaaggatgccatagaaaatcaatgccgtcttcctattgagacttgtgtgtaacagggagcctgaattaggtggagccattaaagacagagatgaggacatgctcccatgttgttttcaccctttcaaaggagaaaaatagaacaacccataggaatatctctgaaaacaaaaccctcactggtcctttccatgattctaatgttttctgaacatctgctacccatctcctgcctcccctgttagtgaagatgaagtgagacccagtttttgagtcccagaactctctaggtttatcactcagaatgttgcaaagcaaatattttccttgtgccacaagtgttctttccatgaagcccagtcctattctgatttctcccatttcctttcttagagaagtaaatgtctgttgtcctctgctgtttatggttttaatatagtccagagaagaacaaagactaagccccaaaaagtaaataatacagaggcaagaatccgagagtccataagaggattgtgtcctgggtgccttggtaataagtccccgatgtgcttggtttcaccgtgcatgctttggacagatcacactgactttccccaggattcattttagacttgggaggagggatccaagtgctcctgcagtttctgagccagcttcagacgccgctgcttcttggctctgcctctgtcaattagcttcccagacacaattccatcttccctttgtggattggacttgctggaatcaggctcttgcttctggcctgggggtgggtaatctcatcgctggagtgtaatagttcagtggggagaatggcactggggagaggccactaccctgttcccatcagctactagtttcaacagggactcagcccctgtgacagaaacagcgcgcctttggatgttttgtctgtttgttttttgtctgacttcaggataaaatatttcctaactctggaattaacagattgatccaatttgttttatagattactaacagatatacccaggattcttagctgtttttgcttcagtaatagtaaatgtctcgaatgtgcccattccaattctagggcccttttcctgagactcacgtttcctggcttaattttttgattgctagtaggcagatctttttccaaatgaatgaaataattctaaaatcttacagaaccgtttttctagaaccatttttctagcttcatttcaagatgttcatggtgtcagagagaaactctgcctttttctagatcaggctacagatgtctgcaaggcaacttgtatgccaagcacagtatgaatttcctattagttcgtttgtacaagtgcccacctacatgtcaaattgagccagtttccatgttaaagtagataaaataaaaggacaatcgctgcaaatttt

SEQ ID NO: 50733 - DNA, 1234 bp, Bovine  19866881096726
cccatccactgctcccaggacaacttcttgctgcttctcacaagtctattcacagccagtaaatttcttaagcgaaacaactgtcatattttcagttgccagttctaaacacagtgcctagggtgtagtgagtagatgggaggaatcatgacagaccctgcatttttgcatttcttcagagcctaccagcagaactactcaaatgttgttaaaaagcttttcaaatgtagattacaactaaaaacacttattacaggaactgtaggtattagcatgcatcccaaagcctctgagattaacatgatccacattccacattctctaggaaaagcttttagggaacaactacttatatctcccataagccagttcactgacactctaatcttatacaaatggaaacgatatctgtgttatttcacagggaaggaggtaactgtcaaggtttgaatgcatgaatccaaaaaaattaaatactacaggaaatatgaaatgctgggagaggggttcaattcttgtttggaagactagtgatttagaacaagtgcgtttatcaccgaacttgccttaacaagtcttcaactcaaatctaatgaaaggctttttctccacagtattaaaattcaaatttgcaaaggagagcaagtgctttaagataaactggactaatagatttatctcagaaagtgagagttaattacgattctcgcttctgagttctgggtgaatgtggttaagttattctaaatttttagtgtcctgatcttcaaagtactggactataaaatagaaggaaagttttctaagaaagcggaaaaatatgttcagcagtacaaacacagataagcatttttcaaggatgagaaacagctcattccagaggaaagaaaggacacacactgcagagtacacgagtttaacactggaaaggtatgagagactctgttaaaggctctggaaggccaggttaaggagcataaactttatcctattggcctgtgattctaaaccaggacaaaaactacataaaggggtagggagaaggaggaagggaaatttgtaagagggacatataattacaatttgaagaaaagcagagcttgggtttaatgctttgagttgccttgctgctgctgctgagtcgcttcagtagtgtccaactctgtgcaaccccatagacggcagcccaccaggctcccccatccctaggattctccaggcaagccttaggcat

SEQ ID NO: 50734 - DNA, 1993 bp, Bovine  19866881125711
tgaagtaaattttactataagcattctgtgtttttatgtctcttaaatacatgacaaaataattataatgataatgatatgtaattaaaatgagttttcatttcattctatcaaatattgaaataaaatttatttatttgacaaatgcatactgaatacttaaaataatcaatgtatagagtgaggatataatgggaaagccaacagaattaataatttaattcatggaggtacacccaagagagcctgtactgtggtcatttgaggaggtggaattgaggtccctttttcttgacttcatgtgatggcttctggatttaatgggggagaagtgtggaaaaggccaaggatccaaactggcgaatttcctgatcttcgagcccctctccgctctccagacagcagaattgttggggtatattttccttttttcgaccctgcaacagcttctttaaattgtttaaatgagaatgtccttggctcagagagtactactcacctggcttttcacattactcttcttgatcatgttggtgttgaaactggatgagaaggcaccttggaactggttcctcatatttattccagtctggatatttgatactatccttcttgtcatgctgattgtgaaaatggctgggcgatgtaagtctggctttgaccctcgacatggatcacacaatattaaaaaaaaagcctggtacctcattgcaatgttacttaaattagccttctgtcttgcactctgtgctaaactggaacagtttactaccatgaatctgtcctatgtcttcattcctttatgggccttactggctggggctttgatagagcttggatataacgtcttttttgtgagagactgacttctaaggacatcagctcattttattgctgttcagcaagctattattaaagtgtactgaatctttgcaagcttgaagaatgccagagaactgagaaaaataccaaatgtaattttatactgctcccattaaaatagtcttggtgacttctacttgaccccaaacttaatcattcaatatttgagttattaatacccttattgttctatatgaataaagtttgttttggatcttatgtttctacttgactcttgaataatctgttttaagtatgtggtcaatattaaaagtacataaactaagtaaaagcctttagtaagtaaagtaaaagtaagcaaaagcctttaaagtaagtaaaaagcctttagtctacacatttgaatagacatttaatatatcatggccccattatgaccatgtaaatagtcatttgtgcttctcaattatgaagaaaacctagttactgaaataactggggtgccacttaaggtttatattcagaaagaatctaaaagttttgagttttttcattttttttatctaggctaccttcattgttatcttcgccttccatctggaacaaataaattagagatagaatattaaaaactgagcagaagcttgcctcttcctcatgttaggggaaccatccatcccatttatgtcaggacagtccaggttatgcctattggtctggggtctcagggacatagttcccctttaattcttacaagtgtcttggtttgaaaaattacagatgcccctacatagtacttaaacaattccagtgaaacataggtggcagtagggcttccccagtggctcagaatctgcctgcagtgcaagagctgcaagagatgcagggttggatccctgggtcagggaatatcccctggagaaggaaatggcaattcactccagtattcttgcctggagaatcccatggaagcaacttagcaggcacataggtggcagtacttaaaagaattccggagtccacaaccctaaagcagggtcagggtgattatttttgccttatacagccctcttagctttgggagtctctaaagtagtattatgttcattttaaaaatatctaacaagaaaatgatttctggctgctagta

SEQ ID NO: 50735 - DNA, 1639 bp, Bovine  19866881132173
ctggaaggggttgtagaatatgaaaagttagaggattcatggtgggatactcagtattatatgttgcttaggagatgcctagggcctagctctttcccttagagctctcctcctctccctcaatccttcctttgctttgccccagctaactgacagacatatctctgttttataaattgggggaggcaaaattatgtaggataattgtaagagaagagaataaaacccaaaactgcagttattattgtaaatttttcaactgggcacaaaactaggtaatatgaaataatacttttcctatagatgtctcacaggtctgtatctaggctccatccaacctattgtagaagttctttttcatcactcggacttaaagccattattgaaaagtggctttcaagctctcttttcaagtgaaatcttttgtagaaatagtatatcagaaatgtaactgtattgattgagttcaaatatataccatttattcattctaaagttgttgccaaagtttcatgagaacagtgaggttattttgatgaagataaaaattttaaactaggatgtatggatgatggttgtatatgagcaaacagatttctttccatatatagatatatagtttaaaatcctgattcagtaagaaaagtggattcaaattgaacgcttaaaaaaatgttttggaattacaggacactatagataaacagatatggtgccataaccctaactgtgaaatctaccctaaaatgatttgaccttggcagtgggtcagtcataaatagtcattgaacacttaatatgtactagatactgagactgcattagagaaaacagacacatggaatttatagcctaacaaggaggatagtcactaaacaaataattctaagtgattataagtacttaaactgcaaggtgaaaggaattctaagtatgctggggaggtatgacaggagacctaaccttgtacaaaagtgatcagagatgttcttcttaagggacatgatgtttaagttgagacatgaaaagtgaataggcaaagggaagagcaaaaaagtattccaagtagataagctactatgtgtgatggcctaaaggtgggagaatcatggtttatatgagaaactaaaacttgtcatggcttttctccaacaaagctggagagactagtgagctgttcattagaggctggagagtataagactttctagccaatgcagtggagtaatttataaactattaattgatgtgtttttagtgcctgtactgtattaaccatcaaccctccaccactttggctataggcaaaaaagtatttcttcaagatgtaaaaagaataccacaaagaaaacaaaaaacagaagcttcaaattttgacttttaaatctaaacaacaaaaaaataatagtaagaggccagaaactagaagacattgggcactgtagttgctgagtaaggttatagtacaggaccgtcatagggtgcctaaaaggactggcagagacttacagataaagatgacctcccgcaggctgtggggaacagtcagatactatcctacgtggccagaaagtgacacataagcgtaggctgaccttgagggtactggggatgcaatgcaaacactgactaagcaggt

SEQ ID NO: 50736 - DNA, 1395 bp, Bovine  19866881151416
tgtatattgtactataagagagtgccataaagtccgtggtttcatggaaggagaattgagttaaagttcagaccagcatttgaattcctgttttgctttgtgacctggaacatgatatcaaatttcattcatgtttagtttccttatctgttaagtggagagaataatacttcaaaggggagtattaatattaagcaaaatatgtaaagtactggcttattggtatgtggatgaataaagtcctgaatgaagaataagaaacaaataaattgaagagttgagatgggttggaggtttaccagggtgactggtaactttatctctggagccttacagggtgactgataacttttattagtggggaggaagggcatcaacacagatagaacacacagaaccagagtcagggtctcagaacgggaatatggattgttatgggaatggcaagtaattgtggctctgtatacaaagtatttgcaaaggccaaatgtaaatgataattgtgtagaaatgtggctgggcaattttagtagttagaaattatatagtttataagaatatctcaagagtgtgaattgttacttttttatttaatatttactttttaatacttactaaaactgatttccaaatgtgttcaggcaagcaactatttcattatttcattatgatatttcatcctaaccagtaaaagaagactaaggcagctgtgcctaattcaagggaagtattttgggattattttaaaaagaaaaataatcttgagaattccctggatgtccagtggtacacttccagtgcaggaggtgcgtgttgtatccctagttgggaactaagattctgtaggatgtggagtgccaccaaagaaattaaagtaaaatagtcttaattaagtgattgcctttccttaacctgacctaccccgttgccatgtagagtcaatattgcacattacccttggcatatatgttaccatcttttctgacccaaaacttgagatgtgacagtctaacagaatgttttaaattgagactgtccttgaaaacctgagaaaaattcccatgcttatgtcttctcctcaggacagcacagaaccataaatactcacattgaatttataaatgtggatcacttgataaccaaaatcatatgactaagttgaaaatacttagtcaaatgatgtttgggaaagctgcctttttagtccaacttgttaagtgtcatgtggatgcgtaaatgacacaaaataatagaggtgagctttcagatgaaaaaaatggcttccttaaacaggtaattttagaagactaggaaagaaaatatgttggacttcattttgaacagaaactggggcaggaaatggctgggctgaaccactaccgataataatcataa

SEQ ID NO: 50737 - DNA, 1406 bp, Bovine  19866881168638
ctccctgttcttctcaagttgcttcagcatcactgaggaggggagagtgactcacttgtgggtttttatttagttcacagtcaaaggttccttctataggaacaagacactatgtaagatgtttgtgatttattactgacctttgggctattgtttaaaagtatacacacaatcatgtgtcataaatagtttggaaatccaggttcactcaagcatgagtaggatgagaaagaaggtctgattgatggtgtaatgagaacaacctataattgtaaatagatctagttagtactttacattctaaacttccctgatcacttcaggtactttctccatgaataaaagttagtttttaacatcaaagttttagatcagcagaataatggatgtccttggacctgattttaatatgcaaaaggagtctgtacacaaggcagaaaaactcatgtctctggggttgactgtctttgtttggtcatattgaaaacaccaactttctttaatagcttaattttaagacagctctcccgagggtctttactcatccatcgctgccatattcaattatactggcactgaatgtgtggattacaataatttctctattgatatgctaacactgaataaatagaaaggatagcagtgtattactattattttgatgcacaaaataaacattatccaattttctttactacttaaagtcacatattaattacttaaaatttacaactaggaatgaagccgagtgtctaaaaatcttgttcctcttcaagttaattcagattgtccatccatgcatgagaacagctgagctatgaaattgggcagcatgttttctggcaataataaggagataacattccttaggagtatttaagtgacatcagtattgataggttaattggaaataaaaatgtaaagctttcgtaaattgctagaataaagagcctctggtttattgtagcttcgcaatgcactttttgaactcttccccctttgcagtttaagttaataactgtctgattaatgtaactgtggcagtactcagaattccatggacatcctatggtaaatcagctgtttttaaaaacagactctcccacctatatcctgagaaacaatcattttgctccctctactcctttaccaaattcttaaaaaaatgaccccacatgggatgaaatgcagagaatattgggtggagaaaagaaatgcaatttgacataaggtcataagagctgtgtttgagaatctaagagaaactctccatcttcagagctcagggtaccacttggtgctaaatatagcataattaataacaattaagtctcataattaattttgaaaaaggcaagtaaagtgatattatgctatcatgcatcttaactagactcaaaattatt

SEQ ID NO: 50738 - DNA, 847 bp, Bovine  19866881380652
taataaaactgtcattgacaaagtaactggtcaccaaatcagtgtgtttctctaatagggtaaaacatgtaagatatgatagaagtctatgagcatctggtcttactaaatataatgtggccctcagtggattggagcaaagaaagcataacctttgcagttttcattacttcatatacattatgtatattcttattttccacatgcaaatgttaggataaggaaatggctacattcttttttttccaaaatcataagtcacccagtaatttcttcttagcaatctgatgttcagtgttttattgaatctaagatgtcatctgttataaaatatatcattattctgtgtattactagaaaaagcactgtcatagattgagagatgttaaatgtgaaaatgtgagtcttgaaatcagtcgaagatggtacagccttctatgtttttacatcctttgtgtctgtttgctcacagtaatacttaaagacattagttgaccagtttgagagaatcaatcacaattaaaatatatgttccactttatacaacacaaatacagcatttcactgctggatgccctaatcataacattttaagtactaatgaaatgaagctagtttatattttttgaattgattaaataatacaagggctcagtcatcaggcagattgagacaggcatcactgggaggactggctgggtcttacagtgttcaaagggtttgtaaacggaaatgccattttgttgttccttctgtcttgcgcactgttcctaacaaatccttgggataataccagattccccccatccctgccttttaaagaaccagttatagaagagcttcagat

SEQ ID NO: 50739 - DNA, 2247 bp, Bovine  19866881411894
tatctctataatgtatccaagtgtcaatttgtttttattgtggcttcttcttcttcttgtccttccctaaacctgaaaattaatgtcttctactaattcagaaaaactcttatgtcatcatctctccaaatattgttctctctcttctttcaatatgaaattcctattagatatatgttggatctccttttcatatttccatctcttcatctctgttctatattctgggtaatttcttccatctcccagctcaccaattatctttgtctccaatttgctgtttcttctgtttgttgtgttttttatgtcagtgacttttttttttaaacttctgtgaagcaatgcttgggtatttttcaaatctatcttctcttttttaaatagtgttatctacatcttcagtcattttaaacaagcttatagtttctatctgatcagatctgaagttgctggagatgtattcctgctgtgtgttaatttgttgactcgctcatgttagaaacttttttcaagtgttctgagacctgaaggggctttaactgtgcaaattctgtgaggattagggtggatgttatatccccaagaacagtcttggtttagcttctttcaggtatccaggagtctaggatcttgttatattaacttcttgacacagcggctacaagacaagatctgtaatgtacacttgaaccctgaatctgtattaaaagctgacctacatttatatattcttaggagagactttctctgcctccttggccagaatcctggcaaaactgaccaagcttccttattgtcttcctgtgctgtagggcagactttttcttattgcaccttttcaccgagactgtaggcctttgaggattttggccttgtagcgtatatataaggaggtacagcagatcaaggcctcatctctcacatactaacacaaacaaagcacttcaacctaacattaacacatatacgtaactgctctgtttttcacttttatcctcatttttggccccttactgtgttataaactgaaatatacaagcaatatgtatatttataaaacacctcacttacacatattacgatgctgggtattttcccccaagtattgtatgttttaaaccagaagaattttcaggtaatctagcatgtcttattacttgaaacagaagtttaaatttcatagcacagactatattctgagatacttttgtgcttcctgactaatcttggtcaatgagaattcttttttcagagatgagacagttaagtcacagtgataattcaggtataaaatgaaagttaatactaaatgtgaataaagcagagatcatggaaaatagtctgaaaaatttcataactctagacactcatcagtttgttttggaaataaagatgaattgtagacaaaaactaattattttatgttcaattaatagacacctgaaaataagttagttattgttcatcatgtaaataagtaagatgcatttacttactctactgaaaaaaataaactgtaaaaattcaatttcaaattacttattactttgtttattattagaaagccttggaggttgaatatttatagatctgattatctaagttctacacaaaataaggtaactcacctgggcacaacagataaatacaactgagatagtcaacaagaaagcagatgaaactatgacatcaactgatcgctgaggacctcgacgctggtgggaaaaaagtgaaaacacttttaaatatatttactaattagcagctaattccatgctttcaactaaggtactgatccatcactgcacattgaccatagcttatgacattgaaaatatacctgattagtgagatgaattttaattataaactgttattattgcctgaggatttgcaacaccatgaaaaatggtgaatatatagcctagaatttgtagaaggataaatcccaaatattccattttgtcaaacactaaccatttactgaacaggttttttgaacacctgctcagaatgagggacagtggtaggtgctggaaatatagtagagaacaaaacagacaaggagtcaaacatcaagctcatagacagatatacgtgcaagttgtgatgagagctatgaaagaaaggtacagaatgctttcagaacattggtgacaagtttggtacaaatagcatttccttaccagaagatcttcccaggcccatacttctaactctcagaaagattgtgtaggcctggggaag

SEQ ID NO: 50740 - DNA, 1539 bp, Bovine  19866881507949
aatatagtttaagtagctttgtaacattcctcagtgcctgtccataactgtgaagtagcaaagcacttagggccagatgcactgaaaacactgcaggtttaaacaaaagcagtctttgaaaaatcatttgagtggagttgtaggttttagaatagagctgacattaccatatatatatatatattttgtaatatgagccagaattcttttttgacaattaagccttttccatagagtttatttataccagtttttttttttttttcactttaaatgtgtcagcactgtagtgtaaatagcttttaaaaaatctttttagtgtgatttatactgaaatgtgagccacttaataaaggttcataacaataaatatgttttctgttgagtctgccaaaaaaaaaaacccattcatttaaatcatttatttcacctgttacgtttttgctggtatatcaagtgctaatggaatgcaagtgtatgtattcaaatctagttaatatttaagtttcccacactgtgcaagcatttttaaaaccaagattcagttatgaaagtatatttatgtgtgtgtgtgtatgtatgggaatatatatatatattaccatattttgcataacttcttaaattgctgaatgagtatgtgaaacttcctatactctctggaatatattttaaaatatttcaatgttaagaaagcagtttaggtaatagaaaaatgttataagttgggagaaaaaaggtattttagtggtatctaacccttctaactaatgaagttatgtggccagattatatagccctattaacgtgaattttctttgtagtgtgtggaataagaagttgagaaaattttcttattaatcagcatctatactgtatctaatagtagctgggaaaaaatgttgagttacagaaagtttaattgtgtgcagttaaaatattttattacatatttcttgaggaacaggagaaaaagatggcaaatagagcatattaaaacaagagcagtgacttaactaccatatacagaagtataattaacaaaataaaatttgttacctgatctttctaagcatccctctccctaccttactaaagtaaacaacttagattttttttctttgaaaagaagctctggaaagtaaaactggcataggaaacaagattgccagtgcctcgccaaagatgattaaaacaaatctcttcaatgatggactttagcactgtttcaaattgctttcattattgtaataaaagtcaagcaaatgtctctattgtttgctttgatgttaagaactctgcatttgcaatttattttcttctatttgaatttggtatttttctgggcacatgctttggttgattactttcagctggagttctttgtgctgctgccttttgagcttgtgtagctattcccattcagtggcttctactctggcccataaagctgcttatctctctgattagggagaagccacttaaaggcatttcgctagaaatcataaactgtagcaatggtgtcatttctgacctcca

SEQ ID NO: 50741 - DNA, 739 bp, Bovine  19866881620759
aaatgtttattctggaaaaaagcatcctgtgtaaatcttggcaaatcacctgaaccattttaattaagtttccctaaagatttgaaagaaaaagtcaatgaacagaatccctgtaatggcagttgtcgattataccagagacaaggctatcacagatatataggaaatgctagttccttcccaaacaccatttaacctattattaaatttccattgtcttttaaggaggaaagcaacagctgtttcctgaaaattgttcaaattgcagtaacaatgctaaaattgcatcaacagtgtggtcaactgaggaaaagtgcaaacaaatccatgctaactcagaaacccagaatggaacgattgctctttttcttctatcccacagcactcatccctcacctctcattatgcagatccacaacaaatgttggttaactgcctgctatgtggtggaatggcagttctcaagtgtggttcctcagaccagcaaccacagcatcatctgagacatctcattagaaatgcaaaccagaaactggctgtggagcccagggatccttattttaacagttgctgcaggagatgcccattcatattagaggcgcctcttagagctggaatttcacagggtaacagtgaggtagactgggctgtgcatcatatgggcagtgtgtccgatgggcggtgcaggtagtggctgatcaccagggcagagcccatccctcgcactccttacagggta

SEQ ID NO: 50742 - DNA, 1469 bp, Bovine  19866881814519
ccgggtttcttttgagttattttggaacaatgccaggatctaaactgataaagctgcagtttaagcacccttcagtattaatatctatggtattacacaacaggtcaacaagtgctctttgatgataaaactcttaatagagcaataattgtaaatggttaccatactgtaagatattttgataaaaattagtaataattgtatttatttgaaacactgggctgtttgcacagctccaactgtgcatgctcaaaatgtgcactttttaaaattgttacttttaatgtgtgtctttatatggggtatgttatagtgtactagggcatgatatggtatccttttgagtgaggtatatactcatctcacaagtgaagtgcctattgatattactcaagtatgttatgtttactcaagtaaaataattttctccccatggtacactatagtgtatgctattcataccacactcaaatgaacaacttaagaataacattgagaaccaatcagatattcctgattgctagctgtaaaactatatatgagttttcaggaaaaatagcgatagcttgcaaattctgctatctagtatatctccctcctcaactcgcagttacataagggctattttagatgcttttaacctagaaagtaaccccctccctcccctccaaataatttgccaagtgtccaaatgagaacttatctgttggcatgttaggtaaatagggcaaatatgatggtctcttacattgggccttgattttaagttgttatatttgtacaatcaaattttaggagtcacactgaaatactaaatgttttagcaaacttttttttttttaaactgggtgtctagtttttaaaagactttatttgaaacaatctagaattttcttggtgcaagttgtatcatgttgaatatcctcacctttttttaccatgttttagagaatttaaaataattaattgtaaatgatttatttgactggtgcagttttaatccccaaatcataatcttaagatcaggaatgtgtggagaacagagccatatcataatatcactttgctctcaccattccttttgatcagcctcaaatcagcctcattgtatagtatattttctttctatagaaaacaaaaacattttgttttatttgcctatgttctaatatgtttaataatgaccaaagtgcattctgagttttttcaaggaatgtattactggagctttaagaacatacttattttctcctgtgaaaaattaggctttgtctgatatgtttattcttcctctattgtctaatgttgaggttgtttttaggaattatattttataaagtttttcaagataaggtacatacctatacagaacttaacattttgcacagaatatattgaatatattttgagaaaaaaaagtacagccatgagttctgttaggaataaaaatgaaactattgtatctcaca

SEQ ID NO: 50743 - DNA, 787 bp, Bovine  19866880418876
ccgagcctgagtttattcctcatgcctgcctcaaaggatttttgtgaagactgaatgagattttgccctcagtacagtgcctagtagagtaagtttcaaaatgttagttctcgttatcatcatcctcatcttcatcctccccgtggtggttatggtatgtgtatggaaggggagccctgcccatcctcctgcttcagttgtatctagtgatgatacaactcaaaagccctccacgcagtgaggcccaagaggctactgggaccggctacctgcaatttgattcatattccaaagaatgtatttcacttctcattttatttcttcaacacacatccacataatttttcacattcctcttcacacttgattttaagcatttcatttttctccctatcctttgagtggagaaaaacggcaataaggtgctgtttttgcaatatacagtagcctgggatacttgtcaccatgcttctttctgcatccagcaatcacattcacctaacccaaccatgttaatggattcagaagaaatccagtcaaattaaaagaatgatatacaggcattcttaccaataaaaagaagaaaaccctttaccttgattaaggtaaaaagagggggaaaacatcaaggttttaaaaaaattttataccagtgtcttgaaacaaattctcaagggcttttctgattagccattgatgctgcactttgtcccatttgattgacacttttgaacaatactggaaatgctaattattctgtgtttttcttaggagatttgcatactgt

SEQ ID NO: 50744 - DNA, 1441 bp, Bovine  19866880450186
atgtagaaaacaaacttatgggacttccctggtagtccagtggttaggacttcaccttccaatgcagggggtttgggttcaattcctggtcagggagctaagatcccaaatgcttcatggccaaaaaaccagaacataaaacaaccgaagcaatattgtaacaaattaatgaagacttttaaaaatgatccacatcaaaaaaaaaaaaaaaaatgcttcaaaagcaagaaaacaaactcctggtcaccaaaaggttggtacaaggacaaattaggtgtatgagactaattgatacaaactactgagtataaaatggataatcaacaaggaaatcctatatagcacaggggattatagctattatcttgtaataacctgtaatgaattatagtctgaaaaaatactaaatcactatgctacatacctggaactaatataatattataaaccaactaaaacttcaattaaaaaaaaaaaaacagaaaataacaacagcaacaacaaaaaatgtgcagtaaatgtaaaatacacactggatctcaaagatgtaaacagaagcaaatggtgcaaaatatctcagtaataaatgttatactgaccaaaagaaaaaaaaaggaaagaaagcaagaaagggtagttgtgattaattgcacaacacggtgaatgtacttaatgccactgaattagttggattcttgactaaaagtcttatatctcttttaccacaataaaaatagtttttggaaaaaaagccctttggacattatgtactcacattccaaggtaggagaaaaggcttaaagaaaagtcttatagatagatacatatatatgcatttaccttgaagggatgcaaagtacacatttacatcaattctttggaattctttgacaatctaaaaatttaaaaaggagaatttgtaacaatgagtaactttacctgcctttaactcagtagcattcaactacttgctcaggagaaactttgaacactttcatggtgaatcaggagtctgaagaaagttcattattggaaattggaaaaccaccgaagtttcaacatacagtgatgatgcttaggatgaaaagaccatgtctcaagaggtggcaacatccagtgctcaatagcccagcactggatagcacacaagagcttcataaatacttgaggaaggaaggaaagaagggataatgcaacctctgctggttggagagaagagtatgagtttacgtctctgagtggaagagatatggctgtggatatgcggccaccagacaccaagtgtaaacactggcctagaaaccagggtctctgtatttgactgtagcagtgtcagtatagtgattgtgctcttacactatagttttgcaagatgttaccactgaaagaaactgggtaagtggtactgaggatctctctgtattatttcttatagttttat

SEQ ID NO: 50745 - DNA, 1154 bp, Bovine  19866880450900
aaattacttgaaaaaacctgacttataatctgtgatcttattcagtataatcactaaaaatattaagtcatttatttgctttgagctatttatgacttttatccatggacttaattttatcaaaacccattagaaatggctcacttaaaagtttatcatgtagcatctcaaaatagaatggtcaacgttaacctcatattgaattcaaatatatcataatataaagtgttccatttctggtcaagatcactgcagaataaagacaggcaaattcccaaagctgaatgactgtcaacatgtagtacttcagtcaggtgtctctcattcgaagttcataaagaacataaaatatatttaagcagaaaagttgtgcagttgtaaaacatgtaaataccgtaattccaggaaaaggagtgacttctgaacctgtggctataagaatgttctttgtatcaataacttgagtgctgccatcggctttcgtggcggtgacctgatttttcccagttatctttccatatccatttacatgaacaacctttataaaataatatttaaaaattcacaaagtttaaaaataattttttgggtaaacaaacgtgatttgtaagaaaaaactattaagtaagttatccaatacaaaacacctccttacttggtaacactacaaatggcgcagcaaaaattttgttacatacatcagggaaatctattttaggctaacatactgttttaaattaaatatcctcctgcagccaatttctaacagcatcactgtcagcataaagcaatgtttatcatgtatataaaataatgcaaaaatctgaacataagacacactaaccttattctgtttgaataagtgggcaattccacctgttaaagcttttactgcattactcttctgctccatcatcttctccaaattcaaacgaacttcagacactgtaatttgttaaataaatctttagtccatagctaaattcctgaagcaatgtgatatttttcactaatcaaggtctgaaaaattgcagcccaatgtatacagaactgcataaaaggctgtattaaaattttttaatctaataactgatacaataatcatagcgacgaaaggccaacagcatcctaggacaataacagaacacatcaca

SEQ ID NO: 50746 - DNA, 1029 bp, Bovine  19866880459107
aaaaggtggtttctgagaaggcatacacaacaaattattctagagctttgactcttggcttgattgaatctcacattgcagagaacaatgtttctaacactcatatttctgtgtgctttgcttctatggactcctgaggagcccataatttaacttcctagagactgaattctattctaaatgctcagaaggaagatgctctttgaagtaaatctgacaaattctcttggaagcctatgatcatttgctgatcatttttataaatgcagattttcacataggctgtttaaaagaaaattaaatgcatcaggaattaaatatgaattactcccctgttttgtgggtaaattctttgtagtagaaaatgtatattagcaagtgactgaaatgtgttctttgtatgaaatagcctctagctggaatgaaggatttccagcttatgataatacaccttccccagcaccgataacaagcggaaaacacaattcttcatgtcatgtcagactccatttctcattttcacggtctcattgtgattacacagagcttggataccttggcaaaatgcatttggaaatgttactgtgaagattatagtcatctgtgacaaggcaggagggacagccttggatgtgattactctgggtcttccgactgctcacccccatgcccaggcccatgtttggggaaacccaatagacaggaaagaatgattcagaaatgcagctggacggaaggcagaggaggtggctgcagccaacaagcacccacacagcccttgctcaacaccaaaatcctgccccctggctgatcactgagagcaaacaatagaacagtgtagcatgtcacttctgaaactctttccagaaagggaccttcagaatttactgtgaactgagcatgctgtctgtggcaatgatagcagtgccctatagatatttgtaggcactagacatttcccagaatcccttgtggttagtgtcattgacttcttctggtccatgggttaggagcaaaaactgtcagcat

SEQ ID NO: 50747 - DNA, 904 bp, Bovine  19866880564960
agttctttggcccttttttgattgggtctttatttttctggagttgagctgcagaagttgcttgtatatttttgagattagttgtttgtcagttgcttcatttgctattattttctcccattctgaaggctgtcttttcaccttgctaatagtttcctttgatgtgcagaagcttttaagtttaattaggtcccatttgtttatttttgcttttatggtcctacctctcaacagactcatgtggtgttttttaatctgcagtactggtgaatttattttctctgagattatcatggcaaccgtgcctgcaaagcgttattagaatagttatcaggttgcctattcaataatggggaagaatcaattatgtgctatgagaagttatttcccaagaatgcatcaaggatctgttgtccaggaacaaggatgggcctgggtttcctggaatgacaaatgactgatgattgacctcttaaattgacaccaaaaaaatagaggtctgttatgtatccaagtgcaatcaagccaaactggccttactctagcagacctagccccaaaattttctttttctctgccgtagctactaaacgtatttggttttagcaaataattcttatttctttcaacaggactgagcagaaggagggaggtgggggagcattgtgtgcccatgaacaggctcttgcacacatgcgtgcagcaagcacacattcagagtgagaagcacagacccagactatgggagatgtgtgtgtctttcaggttgccggcatcatctcggctggggttgtgatgatcgccatcgttgccctggggaagctgctggaacccctgcacaaggtataaccttgcttctcgccacaccaattgcttactttccctttcctgctctgctacccaa

SEQ ID NO: 50748 - DNA, 1104 bp, Bovine  19866880652451
atacatgaaagagtattattttaagagataataagataattatcccagaactattaagttattgagtagactgtattttgaaaaaactactcttcttaaaagaagtaccagcatgctttgtttgggagtattctgttaactatttttcactgtagtatagcttttccctcttttcaacatgagcattttccacaaaatagctctaaacacagtttgtcttcctgctcagccttttccgtcatatagcaaacctgtagtttatcgatttgccatatatattctacaaccaagcctttggaagtttctggcaggtgagagaggaggagtctggcaggggctttgggggttatttggaaaaattgtacccacctttattttctctcttcctctcccatgtggaatgttccccacttctgctaaaaatctaaccaacccactctccttccccagctacaatcctcagtaatctccatctgctttctttcttacttgatctgacctatttttggcctttttccctagagttaacgtgtcttcctaactagacataaagttactaaaaggcctgattatgggtcttttatatcaccctttttaccagaacagttaacaggctactaggtccgttctcgataccattttttctttcggtaaattcaaccagttaggagacctttcaaaggatgcattctttggctttcatatcagcagacttcaactggatggagcagagcccctacgtgtggtattagggcagaaggtactgaaagcactgatgcagggttaaatcactattgccttggaaggaagcaagctggcttacccctaagctctttgctcctctctatcctgaacacttttccaagcacccttgccgaggaccacctacacactctcttgggccacccaggccctgcacagctgttggctaccttggactcactctgcaccccgtgcttgttccttggctttgttgcagacgtgtggaacgcctccaggggcctcctgttccgagacggaatgtggcggcccaaactgcagaaccgacgaaggagaaaaaaagtgtggtgggcctggctgtggtgggctggtcactgttgcaca

SEQ ID NO: 50749 - DNA, 1250 bp, Bovine  19866880674714
gcaggaatggaaagtgagtgtttaacagggtgacgaaaaagctctagaaatggatggcagtgatggttatacaacaatgtgaatgtacttaatactactgaactgtatccctgaaaaaaaaaaaatggcacattttatggacattttaccacaatttaaaaaaagataaattaatttaaaaataaatgaagggacttccctggtggtccggtggctaagactccccactcccagtgcaggagcctggccagggtttaacccccggttagggaagtggatcccacaggtcacaactagaaattcttatgctgcaacaaagacccggtgcagccagacaaatacatatttttaaaaattaatggaaaaattaacaaaactcactttaaagcttctcagctatttatgaagagctcacctgacttaattgaaattcactagaatgtattgaacaaaaaaatgttatcacggtaaaattccacatgttaagtctcataggcttaaaatatttggctaggtttaagaaatatgtgttatgcagggaggcagttcagatgaatgtgttgtagcagacagttttttttttaaatggtgttagacttgaattcatctagttattgtttgaatgagggtgggtgggtagaaggataacaaaattactgttagtgtttctttccttaaggaaaaagatgtgaatcccagccttatttcagggaatcctttgaagctatgatggacgtaagtctaaattaaatgtatgtatgtttcattatattgctcttaaaagactactgaggtggcagtttaattcttaaaaacaataaaatgaaagcataaatactaaaaaaaaataaaaataaaaattaatggaaagctgaaagaaagaagaaagcaaagaagacagacggggaaggagcgaggaaggaaggaaaaccatcaaaagctacatgcctcctgctcctttcggacaaagcctgggggtgacagagggcacggagggcggctcacaggcccggccctgagagggcctccgcctctcgtgtgaccctgagatctgggggatgctgacccaggtggaatgcaagaaagggaagcctgctgtatgaagcagctccacggacacccccagggcagtctttctgctccaggctcaggcattccagtctgcttagatgggcacccgcagtctttcattagcacaaatttcccacttccttaattttttggtctttctcatttttctgcagttcacg

SEQ ID NO: 50750 - DNA, 1218 bp, Bovine  19866880709013
caagcattctggtaagatggtttgatcccagtgaaacaagcagatagtgctgacagttaaagccctcaactgtcacccccaccagcaagaactcggagggtaacgtcctagaaccctcgtgtgcaacaaaggagcgggagacaggaccaccacatgtgttaaatgtgacgaaaacccagattctcccttaggcttgtgactaactaggactttgagggaaagcttgatgttttcttaagaacaagatattgctacaggcatgtgaatcagaaggattgcttaatttttatgctgttgcagtatttttcctgccaggttatttttcagatcttaaagcattcttggagaagattttagtagactgttcctatactgttttcctcttctttctttcctacttgggttttcttccttatgttttaagtttataactatggataaatatcttctgtactttcttatttgctctttgatatattttcttcattatacgtatgaaattctgggtccctgttggacactacattttttaaaaaaatctcttttttagactgaactgtagtgagaaataatataggttagcagttcattcagaatcttctgctgaaagtcacaaatctagaagctgcatgttgtttcagagtcagctcatatgttccttaactaagtccaaagattcaagcagtagacatgaccagaaccaatggcctgtgatttgtttctttcattcgctgtgtagccagaagggtctgcgccagtatcttggatgagacgaatgtttgctccacagaggagatgacgagggctgtgtagatatacagatgtattcatatatatcattcttcagtccccgacgttggttcttaatggaacctgattttctcacttcctttagaaggtccatgatattcagtggaccacttgctctaggaggtcccttgcaagtaaaatcctgcttaaaatctggtttcttcaggacttcaccactattttgttaaatttctcaatcgtatactgccccaggggccttgattttctccagataatggctctatcatgcttatagcctgattctgtcagcatgtgtcattggcaaaatagctttgactgccaaagctttctgaccttttgctccatctaagctttgttagcatgaaaagcctgtttcccagagtcagagtcaatcagaggattgttcacttaacactcagaacttta

SEQ ID NO: 50751 - DNA, 2167 bp, Bovine  19866880747541
ctgtcaggtaccctgagaatgcagcatccctcagggaggcctgtgttccccgtcctgcattccaagtctaggatcatctcggccttgctggctcacacattctcagcaatgtcctcccactgcctcggcacagcgtgttaggacagagcgggcgtctctggagtctcccctatcaattattctcagtgttttgggcccagaagttgggctccctgtgcattctgactgcacatggatccaccgggcagtggagggctgggagtccctcccaggtccttgaacatatcgagctcttaaaacctacatcactgtgtatttaatggggatagagttccagtttttcatggtgagaaagttctggagatctatttcacaatagtgtgaaagtactgtactaagtactaagtgaagttgctccgtcgtgtgcgactctttgcgaccccgtggactgtagcctaccaggctcctccatccgtgggattttccaagcaagagtactggagtggggtgccatttccttctctgggggctcttcccagcccagggatcgaacccaggtctcctgcattgcaggcagatgctttaccctctgagccatcagggaactgtactcttaaaaatgatgaagacagcaaattttctgttatgtgtgtgtgtgtttttaactgaagtatagttgatttacaatgttgtgccaacctcgatatacagcaagtgactcagttttacacgtatgtacattctttttaaaataatttttctatactgctttatccaggagattggatagagttccctgtgctgacagtaggacctgttatgtgttttttcaaccacagtaaaaagttacctcgccacgaacatggaagaccagctcaactcacaaagccagtaggaccatcttcccctggtgggggttcatcaagcagaacgtacaccatttagaacagcttttatgtagcccacggcttgtttttttccctgctctcaaccctttacaattttttttttttctttaacttgagaggcctctgagtgtatctgccttatttctgctaaatggagcagcctcccaatatttatttttggtgatgtatttaggaatcaaataacccctctaggtaagagtaataagagtaaagaagcacatatttctccatgggggtttggtctaccagccaaatgctggtttggttttccttgagtacttactaaagaaacaccagcaaacccgggaccatcacagtgacatacgcgagctcagcaggtactggacaaaaaatgaaaccactggtgcagagagatttgaagcctttgaattctgtgccctggctactgagtgggagtaactctccagtatctaaacccaaattgcccaaagaaataataattaattccaggaataccaacttcggttgctatacatgcacactggatgaagacacttaagagcacagacatgaccactgtacaaagccccagaggtgaggttcagaactgggctgacagtcttccaatcatactttcttttattctacccttcctgacatggctggccaaaaccatgaatgtttccaacatttagaaaataagaaaaacaataagtgccactatacaaataaaaattactatcaaattttaaaatatttttgtttctaatgcatagttttattttaaaaagagcttcatgaaacagactaaggagagagaagtatatgtatctctaagatgagaaactagagacttagtggtttgtttaatgtacacttactgctcagatttcctgagttagtctcctctataaacatctcccgaaatctgaacagctgtgcataatgtagaacaaatctctgaatgaagagatgaattttcttcatgtaggtattacatcccctgtgaagggatggccactgagccctttggaaaaaagatgacttggtggaatcttggggagtcctagaccacatctcctttcctctgactgcttattatgtatcactgtctttcaatccctccctccaatatcagcaaaaatacgtaactgtggcaggaggaggccttctgtctactcttattctcttcattccatccccttctcatcttttagagaaaaggggacttttaacataataatagtatgatcttacagatgctccacttggaagaa

SEQ ID NO: 50752 - DNA, 1660 bp, Bovine  19866880783071
tttaatactccaagtattattctgtttaattcaaattcttttctttgaagaaaaatactgatcatacctcatcttggacatcaagttgttcttcgatcatttctgcttccattaattcaagaggatctttacagtcttggatgagggtgatcttgacaaaagagaacacagagactatttattagcagcctaatagcatcaacctacctggttcttcactgaaaatgatttgcagcttggctggtgcctctcatctaaaatctacatacttcaaaatccttttcagctttcttgatctttcatatttcccacttagaattctccctccaccatttttttcacattcaagtgtgaactggtatagttcattgtctaacctcctttgcaactctcttccccaacctctgaagtgtacacttagcaagtcatctggtcggcctaaatgattctgcagtcaatggtcattttctttcaataaccaagctaagagcacttagtaaagcattgagcatccagggaactcgaagtgaagggctcctgactgacaacaataaacaatctcaagttgaattgaatgggaattaattttattggagatagaaaccaatatctatggaccaagtaggttattcaggaaaattctgctttttagccataatgtgtaatttaatctacacacaaaggaaaccagtaacaatctggactttgtcttacccataaagcatattcccaaagcaactctaaatgtacattaagataagagtaacatttcattttagctacttttaacctcacaaataaaaaactcaattctctttacactatcctgctttgttgttgttacctacggggaaaacaataagtcaatttttcagttatattaaaattttttttcatttatttattttgggtactgctgctgctgctgctaagtcgcttcagtcatgtctgactctgtgcgaccccatagacagcagcccatcaggctccaccatccctgggattacattgggtcttaattgtggctcgccagcttctctctagttgcggcacaagggctcagatgcctcgtggcatgcaggagcttagttcctcgaccagggatcaaacccatatcccctgcattagaaggtggattcccaacctctagacacctgggaagtccttagacatattaaaaaatatttgcaggttttcaaagctgagcatcttgagtgtagcaccttttttttatttatttaagatccacatcttggtatttagaagtagtattttctccaacaccattaagtagaacaatctttctactaacaataggtgaattgaataatgtactattgttttctaaattagtttcacttcaaacagtaactttcaatctacactaagaatctacttatcctacttttagaaaaaaaggaagcaatttaaaatatagtggactgtgttatcagaatgattattattgttgtcatttttatagacattttagtttcccaaattcattgtgagacagtccatgagagatgacattcttgtattaagcagtaggcccagcccaatgacgcacatcagaatcctcaactctcctgggtattttacaggaaaaagataaaataaggaggccaggggaagtcagagtctatccgtttttcggaga

SEQ ID NO: 50753 - DNA, 1995 bp, Bovine  19866880807272
taagtaaatagtgctatgtatttaaatgcaaggtcatcaaaacaccttgaagagcactgactagcagatgtctgtcaataagatgaaaatatgatatataccttggtgcttctgattgtccattaccatgatgtttcatttttataaaccttaggacagtaccaagctataaattaagtataaatgttgactttcagtaaaattgtgactgcttacagcacaaaggttagcaacaatggataccagagggcagtaataaaatgttacatacaatttctcttatcatttttgaggaagaaattaatttgtcatattgccactgtactagtaaagtaaggatatagttaaggggaaagtgaatatagagcacagatgctatagaaatgcataaaagcacgaggtcaaatcaaataatttaaatgtttacctaacattttagcaataagaaatctaaacatgtgagtttccttttagtaaattttcataacttgaagcaccataaaatgctgacataacttctgacttacatattaaattacataaaacacagtttgaagactttttaaaaaaaattctaattctttaaatagcatcagcagacactaatattattattctgaacctggatctgcatcaatctgaagtatgactgagtttatggccataccaccctgaatgcaactgaccttgtctgaaggatggttgataggctaaatatgaggatcaaaaaaaattaaaaaaacaaaacactttctaggtgacaactactttcttttacacacaaaattggtggaaaatgcttgattttcattatcagtattgtatttagagaaacagggaggtatggaagaaaggttgtttcctccaacttgcaaaacacaaaaaatgcccagcaattgaaagcatcttgaaaaccacttagggatacagaaacttacattttaacaaaagcaggagtaactctgaatcacaattgtccttagttgtgaatgcacctaaaaacttgtttataaagctgcacaaacggtaagtcttttaaaagatcccaccaaaacattcaccaaataacacagaacacttacagtattactcatcattattcttccaagctctcactggttaactatacagatagagcacatcgctacacataacttgactccgaattcagcaccatgaaaccgcttctctaagaggtcgacacaataatctttaattgatctaggaactctggcactgaaagcgtgcataacacaaggtaatgatgtcgtcaccaagggacgacaagaatagaacccaaatcccttgactccccagcttgtgttttccactaattgtgctcctttctactcattcgagatcatcaagtgtgaagggctggagaagggagtggacacatgcgccagggtcgcgaggtggagacggcccagaaggtcctcaggaatcactctttggcacttgtcttttgtttcggctgagaacgatgaaagctgcagcaaccaccaacccttgggaccaagaactggaactaggtactgcccgtggcggtaacttgtctcttcattttaggcctttcccctttttcacggctccctcgcggccagccctaacgttctctccccatcctcagctctactccgcactggagtccccgctgacctttattaagagtcggctgcgccgcatccgtcctccacctggccccgcgtacagtccttaggacaggagttctagggggaggggggaggtttccctagaaaatgaatgctaatcaagcgttagaaatgggtttcaactgttagcaacttgagagatgggaaccggggtagatacccaagtcagctctgagtgggtctgtgcagctcatcacggcaaagcaaaatgtagacatatatgcacagagcttttctctctagctggtagccttacacagctcaaccgtcccctaggcaacctcccgctggaggacgctttccggacgcgcgtgtttacact

SEQ ID NO: 50754 - DNA, 845 bp, Bovine  19866880822837
actgttttctagcaagatagggctttccctattcagtgatgcaaaggtttctcccttagctttcaaaatactatgctattaggtggctttacacctaactttttttataatgaagaggagaaaattgaaagatggttaaaaaattatagactaccttcaaatcttgccatgtttgacttttcaaaaatgttaacacatttgactctatttagaaagtgttctaaaatgaaaaatgataagggaaaagaatcttgaagaggtctttgaacctgttttgctagattaaattagctttactaaattatgttcatcaaatacatattcattgtcttattaaagaacgtagttattttaagtcactaatatttgaagactgggaaaattatgccaaaacaatttagaaactaagcttggctttccttcttggtatagccccaaatagatttatttcctgatgttcctgaaatttgaattttcttctgctagaatgttctagtaaatgaatgttttaatgctattttgcaacgttgacatttatacttgagataagttttcgcctacatccatctgctggctagacatgtctacctgggcaatcctcttgaaacaaatagagccatctactgctctatctccaacccttatccttatccttagttgtataatatttctgccagtgtctggaatatttccttgtctataaagggagatcaggaggagattaatgattaaaagaacttccttacctgggagagttgattagtaccaaatgcatgacaaggtaaggaacatggaagttgattttttttctctctggtattctatacatttagacacttcagatt

SEQ ID NO: 50755 - DNA, 1649 bp, Bovine  19866880864651
ccccacgaatgcccatgcaaagtgatcccttggcagaaggtttggggataatagcattctggtaagctaatacccccctgccacacactggcatgtattatatttaggaatgaaggatgccaggatttcatactgaagaatgaaacaagcacagaaatcacttggtatttaattactgaaatgtatactaaattctggggttaaaagtctaagtgtctggactaaaatccaggaactaatgaccaactaaactggcaagtcttcccttgttctttgacttttcctgcatttttcgtgttggggcctcagtttcagtatctatgcaatggggggtaatcattgtatccacctcacagggacactgtatagattaaataagcaactgtttataaaattctggcacatacatgttgactgttgattgttccagtcattaagttctcaaggtaagaataatgccttagtacctatgacacatacattgtacctgacacataagaaacatatttgctgaatgaatggatggaatcatgagtgtcagtggatatcaactaatttcagcacatctatagatactcaacattgcaacctgtgctttctctcatccccatctgactcctaatgattcatgaaaaaataattctgatgacaaactattctctagccctggttatcttctcacttaacagaaaattaattgtctagcaactgaatctgctcatagatacaaaatatacagcatttcttgtcaaataagtaattttcccgtataaattaagtacaggtagtgggtccccttgtagatttaaaaaatagtaaccaaaattagtcttggtccccatcagttcagttcagtcgctcagttgtgtctgactctttgcgaccccatgaatcgcagcacaccaagcctccctgtccatcaccaactcccggagttcactcaaactcacgtccatcgagtcagtgatgccatccagccatctcatcctctgtcgtccccttctcctcctgcccccaatccctcccagcatcagagtcttttccaatgagtcaactcttcgcatgaggtggacaaagtattggagtttcaaatttagcatcagtcctttcaatgaacacccaggactgatctcttttagagtggactggttggatctccttgcagtccaatcccagacagcatattaaaaagcagagacattactttgccgacaaaggtccatctagtcaaaaactatgggttttgcggtagtcatgtatggatgtgagagctggaccataaagaaagctgagcactgaagaattgaagcttttggagtgtgatgttggagaagactcttgagagtcccttggaccacaaatagttcaaaccagtcaatcctaaaggaaatcagccctgaatattcgttggaaagagtgatgctgatgctgaagggaaactctaatactttgaccatttgatctgaagaactgattctttagaaaagacactgatgctgggaaagattgaaggcaggaacagaaggtgacgacagaggatgagatggttggatggcatcactgacttgatggacatgagtttgagcaagctccaggagttggtgattaacagggaagcctggtgtactgcagtccatggggttgtaaag

SEQ ID NO: 50756 - DNA, 740 bp, Bovine  19866880921723
agtacagtgttcagtttgagttatctcagcagccgaaagtctagttttcaggccagtaattttgcattggagatttgtggctgaataaaacagaaaccttgttagtattagcctgatagatgggagggagtacatttgctccatcctttccccagagcagtcgtgacaccccttggccagttcccaaggttttgctatttggcacaatcctgtgatagaaccacagagaatctgaatgtgaaccgaccacccaacccacctgagctggtctagatctaaaccaagcctccagccggcagtggaacccacttcacagcacacgtggaactcaccaaatgcaatggctgcttagcttatataactgtacttttgacactgagtttttgctttatttcttttaatacagaatcatgctgcttcccacacccatctgtttagaaccagatgtacaatattcccttgatgtctatttttcccagcctttagaaggaaggctcaaggctcattcacacatcctggttgattctgtaagtactacaaagccttgtgggtgcttccttctgaactgagttccattctaattgtacatgtcgggttgtactttgcagtgtttcgtgagaaatagaaatctatttgtttcattatgaaaatcatctcctgtttatgaaggtcatcgcataacgatgggaaatcttccataacagcacttgtcagccccagtttgaagtgttttcgatatt

SEQ ID NO: 50757 - DNA, 1392 bp, Bovine  19866880947571
cgaaaggaaatgaaaaagctgaggctgctgggaacgcacacaccatccggagaacccctcgttgagctctgcttgtatctttttcaaatgaaactaagtcccttgtcaccaaagccagtggaatggacacgtatggttctccagcactctcagtgtgtgtcttttcataaacatagacgagcacaaacagaaacagtaatatggaagctgaatttctagcaaatgggaaacagagaatggcaaacgctgaaaaacaaaatacaggtaaatgcatgtactgttaaaagaagctgcaaatattctttctgaaacatgctaaactacagatttgggggcacttgaagaatattcatatttttaagggaattataaaattgatgctatgcagctagccctcagcatgcataccttatgtgcatgctcagtactcgtcaggcatatggggagggtgtgtttattctcagaggacaccggggtatagacacctgttgggatgaaggtgtcccagaagcatgtctgcctcttctaatggtgcacttgaaatccagagagttaatgttccccttgggtcttttcctgaccttactcttggcagtacctctggctcttggacaaaccagaagccatataaaaatgtaagcacttctttgatattagtaaagaagcagtaaatgtctataaaggacagctattctatagtataattcatggtatctgtaaaatccagctgagtttctgccacaaaattaatttttgtatttaacactgaaaaaagatgagggttcttcagtcaaaaagatttctggaaaaaaattctgatttatttttccaactcagaaaaatcaacatgatatggaagtgtcctcttttttgtctatctttagtgatctatctcctgtgaacacagtgaattggtggttttctccgacacaaaggtcaaatgttgttctagacatccattgttttcctacgtaaatttcttgaaaagggaaccccccaaacaacatttagctttccaaaacaacttttaatagattgaaaatctaatttttggaatgatatatgaaattgcttttcctgtctgtaaaaggtggacaatagcttttgaaaagcactatgctactttacaaagaaatgatatcaaagagggactttcattaaattcaacgactttgtaataacacatgaaatacttggaattgagtggcaatatatgcagtgagaagttccagggttacaatggaaaaatgattcacagcagtaaatggacaacacagctgaacatctgacagagcccctttccttaaagaaacacaaggacgtgatggagataagaaagtaaaggaatttttctgcacgtggaaatgttcaaaagaaaacagagaaaaagga

SEQ ID NO: 50758 - DNA, 816 bp, Bovine  19866881053133
tgacgatattgctaaatgtgaaagatatacatactttcattcctctagatgcaaaatcttttcctgggccaaatggtaaaagtgagagttattcaataaagcctaaaggaaaaaaaaagactaaattatcaaatttcacaaactatatacatgcaaaaaccacttacaaaatgacagtctctacatgaaatagcatataggactacaccaattcagtttctgttcttacatatttaatgtaagaaaaacagtaacaacttaaacgttcagcaaacaagaatgaaaaaactaccttactttctttaaaagcaaaggattaggtatacaacttcagaatgtcaggttaaaaaggaagttatttttcatacataaagggcttaaaagaagaatttactgcctattaattgtttcgctggagaggaaagccaaaaaaatggaatctgatcctgtcatcagagcctagctcaaaggctaggcattctgagacaaggaagttatttcaggaatgtatggcagactgacaacagtaacctaaattttaacaaagaaaaaaatgtgtttttatcatctctgggttattttttaataactgtattagtttaacattctaatctcaatatatccttccagttggtggctaatgaaaaaaatttctaccctgtacaaaacatatgctcaccttagaaggaatacaaccaacattcaagcatgttccaccgagtgtttcatttttctcaacacagactgtctataagcaaagaaaacattatttattgcacataacctgcaatgtttcagttcactaaaattccaaat

SEQ ID NO: 50759 - DNA, 1433 bp, Bovine  19866881106121
ttttaaaatgtatcactgaagtgacacaaaaatgagtaatctacagatatcaaaactgggggtaaaggagtcctgaggccagctggtactctgaggctttctgctggacactggaggctttgagcttgcactttgacagttgcttcaggtgagagatcggaagacaaatcttagggtccacccagtgatgtgggaaaaaatgcatgtatatatatgtacgtaaattttactgacataaattggtgtatggctccaatttacaaataataataaaacacacaacacaccttattataaattctatatagaaaattgaaacacttgctgatttttgccaaaatgtttcatccatagccaacctatgatgtaattcactgtagctctaatatgaatgttggctaacacttatttatgttaaggaggaagataaaatgaaacaagacatatgttggcactttctttattagtcaataatgtaatcaatctctttattcaatcagataataattttaaatactggaagagtacttcttcaatttttctgagctaatctcaacgtaatgggtacagacacaacatacttttaagtttaatttaaattattaatatttcatcactgtcttaaggctagacaattaataaaacattacaccaagtcttcttttgtagcatttgttgattttcaggtgtaaatactttcaccatggctgatttcaagctaccgatgtgatttcactgaacatgaagttgggaagaggtacacaatactattattaatatataggattttcaatagcgaatggtttaaaccaggggttagcaaactttttcttcaaagtgcaagataataaatattttaggctttgtgggctacataggtctctgtcaaacaacattatttggttctgtccacaacacactaaaatattttaaattacattttaaaaaacattcttaaattctaaattcttaaattctaaaaaattttaaaaaacattcttaacttgaggactatataaaaacaggctatgcaccagatttggcatacaggctatagtttgccaacctcaatttcaaataaaagattagatatagcataagagagaattagtgaactagagaactagtgaattagcaacaattgaaacccaaagtgggtggaatgatatctttaatttgctaacagaaaataactgttgacctataataattctataccttgtgaaactagctttcaagaagaaagatgaaataaaaccatttcaaacaaaagcagaatgtgctgccaaaattttttcactaaagaaaacctaaagaatgtacttctgataccctggatagaagaaccaagtgaaaaaaagaagaagaaatggtgagaaaagatgtcagtcaacatgtgtataaaactaagcacatattgtcggataaaaata

SEQ ID NO: 50760 - DNA, 702 bp, Bovine  19866881151614
tattttgtttgacgttactggagccaagttccaatagttcaaaggagacactgaaggaatacctgccacacactgcttgagcaatccagatgggcacactctgtcctttctcaagatcaagttcaaaacaagtccagagcaactcttaccgctccaaaaggctgggaggtgcagtttgtacaaggagtttgaaaatgtagtccattgcctttattcaattgttgagagagatccagttttgtgctctttcctctctctgccttctgaccatcgcatcagtttcttccagcttgcttaccaaggaaacattttattcctggtaatgaaacaaaatgaaaacaaaaatgaaaaccttccctccttccagtacctaggaatatttaagaattattctaggaataagaatttatatgcatttcattgttgacttaaaaataactaacttctaatagaaagtgaaaagtgaaagtgaagtcgctcagttgtgtctgactctttgggactccatggactgtagcctaccaggttcctccatccatgggatttgccaggcaagaatactggaatgggttgccatttccttctccagcagatcttccggacccagggattgaacttgggtctcccgcgttgtaggcagatgctttactgtctgagccaccagggaacttctattagaagcaaatatatatttttaagcaa

SEQ ID NO: 50761 - DNA, 815 bp, Bovine  19866881198530
agagttaaaaatccgctctttcctttgtcctccaaacttggcagcccaccgtgacattttagaaagaaaaaacaaaaacttaacctaataaaagaacagtgaccttgatgtgtctgaagaaatgtagctgataaataagaaacatatgtctgttacaacatagtttgtgctaatattgtaagtcgctttactgaaaacacatggggatgaggcagaggaggagggaaaagacagcaaggagaaaatatgaaaagggaactctaccacaggacaggtaatctagaagtttcttgttggaaggtgagctgggccaagttccatgaccatgaacgggcaacacaaaatagtgtagagctagtgaacaggtcaacagagacaccgcatcagatcgttccagacaaaccttagactcgggctgactttttttcttagctagttaactgccattgttcttgcaaaaagaaactaactgagcgggggccactattggggaatcttgtccatcatggctgagccaaggcctctgcttggtaccccgtgcagatctattgatggtgcaccgggggtcagcattacagcatatgctgcctcgtgggggttctcacaaccccagccctgagtaaagcagctcagttcacattgcttttgccgaaactgaagtttggtttgtggaaaaaagatttcaaaagcccttagctgtgttacataacaaattgtgccaacttttaatgtttaaaataaatctgagtaaaactgggcataaaattgtaccaagataacaacaaaaaatatgggtacttaacaaacccatttca

SEQ ID NO: 50762 - DNA, 2639 bp, Bovine  19866881204035
ccctttactgcctgccgctcgcgcgtcgcgggccccagcccgggtttggggagatttcaggacgcggacagcgccctggctgctcatccgaggggaactgggtctggctccggcagccccccagcgcaggactcactctcttaaaagtccgggagccccgggcagcagatgtaggctcgggacgggaggtcctcagggcctccaacgggctggaggtgcgcgcccagccgaggcgggcctgggcggagagtgtggcagagagcggatccctctctcggggatcaactgcagcaggtggggccgggaggcagctaactagcggtcttcacctcctcttctcttccctcgccccatctcctccctgctcgtcgccctccgcctcgcaggtcatggcagcgcccggcgacaggttggagccgccgccgctccccgagtacagttgcagctatgtggtgtcgcggccggtctacaacgagctcgccttccagcagcagtacgagcagcgcccgaaagagcgcaagacgctgagagagaacctggcccagggctgcaggtagcgcccgcggcggacggggcgaggggcgcagtgaatcccggaatgtgggcgcgcagacccgccggcatgcccagcggcggagagtgggatgccgctcccgccctgcagggacggcttcggtcaggtcacggactctggcctccctggtgggaaggtggctccatcactctcggcccgaatcgatcctagtctcggaaactcaactttggagagggaaggttcggggagcgccgtctctttgcgctgctctcgagggcacctggagtgcgccttgtggtacagcgggtccctacggtcttcttgtgatggctaggctgaggagagtgggagaacaaggggctttactacaaagaggtagtgggtaactcgtcacttgagcaagagtccttgaaagccctaagcgcatccaggaagaatgacactcagaggcataaaatgaaggctagaacacaggagagcacgctgtgctcctagttgtccactgtgcaggaagtagggctctccaagaagaacctccatcagtctctaaacccactcgggccacccgtaagtagatatcgcaaacagaaggaattgtcagctgctgctagatttcttttttcttttcttaaaacatttcaaaccgtttaaaaaaacatttcaaatatattcaaaagcaggcacagtagtgcaatgaaccctctcccatgtttttacccatcacatggcttcaaggatgattaactcaaagttaatcttgtcttaccacatacttgccccactccacttttttttttttttggagcaaattccatatagtggtccccccccctcctgcccccccgcccccgctttggactgtatttcagtatctattgttaggaactcttaaaaaatgcaacccacaatttcattatcacacacaaaaatgaagcaattccttaatattaaaaaattaagtcaacaaaatttcaaattgtctcataaatacaattttttaaaataatttatttgaatcaagagtcaaatagtgtttgaaaaactaaaaatgttaattgctctgtcatgtccagctctttgcaactccatggactgtagccctccaggctccctcctctatccatggaattctccaggcaaaaatactggagtagccattcccttctccaagggatcttccctactcagggactgaacctgggtcttctgtgttgcaggcagattctctagcatatgagcaacaagggaagcccaaaatacgtttttttcttttacctctaggttgttgaattttaaaaagtaggtagtaaggtacaacaagatatgtattcattatgttaagagttttgtaaaaactggctccaagctcctattgccagaatatacagagtttgtttcttgaaagaaaaagaaaacacctaggttgaaagtccaaatgtaatctccatttaaagactccacattgatcaatctgtggctggaccagaaaatgggttcttgtttggggatattttctcagaggattaaggggggtggggtggttaacacttaatcctgtgttttctagtacagtgcatttaaaagggtaaaaagagttattggcaaagacatggtaagcgcttcactgttagtatttttttcatgcaattcgtatgcttttttctaaatagttagagacattagcagactttggttcaaaactttgtgatttgcagtgggttgtgaccaagattggattggaaatcttttcttgccttttgacagttgttcaagaaagagaacccttcgcatggtgaagactctcctgcccatcttggactggcttcccaaataccggatcaaggaatggctacttagtgatatcatttcaggagttagtactggtctagtgggaacacttcaaggtaagatgatggtggtctagctccgaagtgatggagaatcacagcctccagcagccattcctaactcccccctccctcccatgggtctgtaccaaaggcttgctcacccatcatagcctgcatttttcctccagagcctgccccttagtggtaagattcccttcttcctcatcttccttacacttctcttctcaggaaac

SEQ ID NO: 50763 - DNA, 1706 bp, Bovine  19866881270283
ccatctgtattgtgctgacagatgcatcgaccatgaacctgcatgcgtgaggaacgtgaacagtgagaacacggggctcatctttgaactttgaggacgttggggttctttaaatggaaaatgaaataccagcccgagggggtctctctgggtcttagttttctacgtgttagttacaatacgaaccctgactgtctactattacttgcttaattagcttttaaactttttaattttaaaaactttttaaattttaagatgtgtaagtgaacatctacaaggaattctttgtttttctgaattttggtatcagggaacacatggcctgaacacaggcccttggcaaacttagggccaggatggagaatgtgtatgtgtgtgcacaagtgcgtgtctgtgggggatgatttaggaacttcagggaattagaaaactaaaactggaaaaaggtgtgggattctcttgatttttcacaaaatgccctcagtgcccacattcccagggaaaagttccatttctggtgaaacatatgaggtgtctaattggaaagatctatagtctcccacattgtccgttatgaccaatatttcaaaactatttttagttagacacactcccaagactctgcacaaaatcaaattcttctactgtattattcctttaagattagtcccaggagtggagaagatctgcactgcttaggacagagtcattcatagcgtgtcactcgaggtgacagctttcaacagcatcagatgtcactcaaacactttggcactgagcccaggctctcacatgaatagaccttcaatacatttttatgagacaatgtatgtgacatggttcctccccatcaaatctccattccctaaaacaccaataaatgagagagataagatggaccatctggaaatcataaattacaaattctgcccattagctcaatgatggccacatgtggcagaattcacaagaacttctgtccagagaaccaaaggcccccacatggcctgatgggccagactgaatgatatctgcctggcccaaagagggctcttggattgttgatccccacatacagagtctgacatacattcagcactaagacagtgaagggaagataggatagccgatcttgctctcaggtgagtttgtaactcaccatgcctggagggctgaaaacatcaccgcgcatcttctgtgttgaaccacattcactagcatggccattgcaaaaacagcttccttgaaccatcatctcatacacagcatagtagtatttatcaagggaatcattttgccttcttccaagcaaagtatccccgagagtatggagcctggtaaagtttatcctcaggtttgttaatgtcacaaggtctagagaaaggaaaataatgaaattaataaatcaaagtgcattaggttggatgggttcacagcaccctccttgaccgatactctcttaccatcctatagacatgcaatgacaaggaagccccctcacatgaagttttacaaaagaagtcggtgtgaaaaatataaagcaattcataccctggatgtaagggctgtaagggttttctatttcaaacctgggatccaacacctttaaaacaacctgtaaaacaaaggtaggtaaatttagagtgttttatccccaaaacgtaagtgttcaatatattcttaaggaagatatcctgacctta

SEQ ID NO: 50764 - DNA, 698 bp, Bovine  19866881328121
accagaggtttgacccaatagcctgatctactccctgggtgcaaacctatctcatagttttgggttgttaattattgcatagggtgatctaagaaactagatttaattagctagttaaatgttccactaatattcatggcttgtactaggaacggttccgagttctcaattcagtattttcaccctgggaaaatggggtctttgctctgagcacatttcagaagtgatggaaatgctagtaaaagccatctctactttccaagagatgcagtcttgcctcatctctccaaccccagtgcccttggctttctagaagcattaacacgactgttgttcctctaaaggaataagcctgctcttctggaaagcgagcatttatctcatcatggctgttgtgctgttgcacaacaaagcagctaatcagatttatgaaggccagcccacccagagcagtggctgcgtttttatcacatcagagacaagttagcactaggtttcactctaggattaggtgctgtctcacaaattgggcttttcgccagacaaagaagttgcagcatgcatttgcccttttcaagatcgctaataaaatgctgctattaacctctaggactgcatggatttctcagtgatcctatttggaaaattgtggaatatggagctgacaatggagttaccaactcataggactttttaat

SEQ ID NO: 50765 - DNA, 1062 bp, Bovine  19866881333467
ctgagctagatcctggctgggggcttcccatgcctgtaggggtcaggaagtgtatttagcttctcagctccatcatgaattcgtctgtagctggaaatagtatttccttccctgcctcatggattatgacgagaccagaataagatcttggttgtaaatactttgaaaacataaaacattctctttctgtatgctcattattgcactaagaggtctagtatcactgttttccatctctttttatattgatctgagtttattttcccctaatgtccctattagattgggattgcttcagttttctaggctcaaacaggtgctggactttctatagcgtgctggaagaggcctcagcatttttgaaagttctttgtcatactgtctatatatatgtacataaacctgctgaagattcttacctgacattcccgattacgtaatcctccgtttgtattgatggtgaaatcatcaagttttgcttctacttcctgagaaaaccaagatggaattaagaattaggaatatgctttttaatattgaaaaataaagagaaatttaagaagtacaggtggttgtttatacaaatgtgaaagttgcccaaaagttgatacctgactgggattaaactttgaagtactgtaatctttcttcatcaaaatatgcaaaacagcatcatggattgttaagaaaaatattgagtccttgacttcatcatcaaaaaattcacaccgtttaagcttttcaatgaagtcatctgaagagaggaaagaaagaataacagaaagaagttaagtgtttgaccatgggtttctctttgaggttggggacttgaatgtctgttttcaaatgtgcatttcactgatgttcggtaaagtgtttgggagttgccctagtacaatattagcataccattagtacaatgtcttctggaactgacgggcatctttctaataaaattacatgtagaatacctttatgtaaacaaaaaggatcaaatgagaaacacttttaggcaggagccttgtgggttatttctcttattaataacaggagcttcaaagg

SEQ ID NO: 50766 - DNA, 1152 bp, Bovine  19866881370107
cactgtaagatgttttaagctccttttgtatatttcctgcctctgccctagaatcagccatttctttaaggagcactggttccttctattggagaatgatgttagaaaccaagatctgggcactagaggaccatgactattttatatgctcctctcccactcatcacacctgcagccaccaaccacagaacatgttgaacaaattagcagattgccatacactgcttggttccttaattcatgaggaagtcctcatgctcatgacatcactgtctggtatgcttcttagacttttggggaagcatatttgtaggagcacttggcaatgaccacagttcagccatggaggctaagggaagcctccagagctgaaaatcagatggtgttggtttaaccaaagacctgcttatgacaagggtatttggggtaatctggtccacaggggattccttggggaagttcgctctttacaatcagaaacactttcattggagtatagaagagccacacgatcattgagatttccagctgtttaaacaactgctgataaatgtctctgtgtcggcccgtaggtggtccctagtgcattcttagagaagcaaatatgctctgcaatattttcatcagcaattttgatggagaaacatatgtatcaaatttgcggatactacaaaattataagttaatatgatcaagacagaacaagagacaagatattttacaactgtcttattgactggaaacaggatgacatgtcagtggaataaaaataaagttttgcaattgggttttttaaatccattgcacaaatacagagagggagtaataacttggcaccagtttgtgtgaaaaacatctgggagattttctttgtgtgctgcaagtgaaccagtggtgcggcttggggatgcccattcaggcaggagtgggagtgccacgcccagctccagggcagcctctctcgtcccacttgtcctctgtactggtcagatgactcccaggaacattgtcgtcatttctgagtaccacattttaaggactgaattgacaaactagtgtttgtggatagtggagaagcaccatgctattttgggatgaagtcttaaggggtgattgatttaaaataacgaagcatatacaagttgagaacgg

SEQ ID NO: 50767 - DNA, 687 bp, Bovine  19866881413466
cagttccctatatttaagcaaaagccgtggttactccagagatgggtagaagttttagtagtccagtcgctttaagaattcagctacttctggagtcctctttgggtgagcagatttggtcaagtataatgtaggaccacaacaatagtgactggctttgtgtttttccccattaattttctaatctcctcagtgttcagaaaatctggtcaagaatccagttgggaggatacagagaagttcagccctctctccaaaatacagttaaataattgtcactaaatgattaagcttcatttacaaaaaaaaaaaaaaaaaaaattgtggaggaaaaacactagcccaattgggaaagactccaatttacatttcataatggaaacatttgccaaacttattgatggatgttaaaaccaggtctttggtctctctctctcaggggagaactctcagaaccgtagaggagaagaatgtggcccatttcctattatgtattttgttttcatttacatctgtggccgtttaccagtttggggccacctgtccctgaacagctggaagcaggcggtatattcaagagccctcagccaaaacgcattaactcttgatccttgggtgttgtcgggggggtggttgctgccatgggaatcctcctcctgcctctgcacagctgtaagtcctaaatca

SEQ ID NO: 50768 - DNA, 1817 bp, Bovine  19866881465485
cctctttcctatgtttgatggctgccctgggcgacagtgcctcacctcattacaggacggcccgaaggaatgagcagcatcacagctgcaggggtcgcaccccgtcccactggccagttgccaggtgttgggcgcacagcggtcacagttctggccaatcacgttagggaggcagaggcactgcccggtggttttgtcgcactggcagtcagagccgttacagtgctcttgcaccgtgcccaggtaattgcagacacactctgaaaaagaacaacctggtcagatgcacttacagaggcccactcagaaaatacagacagtgcggaagtcagctacatcaaacaacgaccactttctctctctagatttcaacctggaaatgcgaaaagaagagaatggaatggaagggattttaaaaaataataataataatctaaaactgtggttcttatcttatagtgttccacacagctctgacatttcccaggcagacatgtaaaatggctggcatgtaccttcaaaaatacttgatttaataagtggctggtgaatcattgtaagattgaggatttaactggaaataaaaaccaggctgtgggagcagagatacctaatgatttcaaactctgggcagggaacagcagtcacggctgtgtgagccatggcaggtagagccctttaaaccaggaaggcttcaaagaatccagtcctgctggtcctcaacattccgcacgcgtttgtatcaacaaagacaggggcctgggggccgtgcagccgcagcaggaaatgctggctgatctcgcgataagagagaaataatgagttctgaaagagatacttcagagatgttactcctttcttttccttaagctggaaggctctatccatcactgacaaaagggtagaccaaagtgtgtatttgggatgcagaagtctcagcccatcaacaagtccacgggcagaacataaaatcaatccactctagacttgtggagatgatttgtctgtggcttcctccctcgggcctggtgtggagggcagtgcaggtctggggcagtgaggagctctgcgcctgctggggagccagtccagaggctgaggcatgtggcgccggctactggtgagcacaaaggcatatccagcctcagatagctgagctgcttagttacctaagaaaatcgacctgcatatgccagatgtttatgcaatgcaaggatgcactgtgcttattttaacaaaactgttttcaattaaaaaaaaaaaaaatcaatccactctatcgatggcattaatcatggggacagtggcacagcttttggttccttctcaggtgctgagccacagctcaacacttcagtgccaggaacgaggctgtaaaaaaaaaaaatcatccttatctttctcttgtggttagtgaaattttctctttctgaagaagtgttttacctgatgagataatgggcttccctggtagctcagtcagtaaagaatctgcctgcaatgcaggagacatgggttcgatccctaggtcaggaagatcccctggagaagggaatggcaaacccactccagtattcttgcctggaaaattccatggacagaggaccctggtgggctacagtccaaggggtcacaaagagtcagacatgaattgaatgactaacatagatgaaataaatcccctaagaataaaatccctcaagaaggaggcaggggaggaggagcaggagagttggaagtcattcaaggatggggcagagggagcgtgcatcttactacgacagtccgtggcggagcgcgtcgccatagtatccaaa

SEQ ID NO: 50769 - DNA, 1229 bp, Bovine  19866881568756
ctctgaccccctgtcttctccttgggtacaccaataaccagaaagaggaatgatgcagcttttcaacttttgttgggaggcgggtacctgaaattatgccccaccaagaagactacatgtaatgggagggatgtgattcccccagaaaaaaccgaagtgctgttaggattctaggcagcccaaaccagcagatgtctaatatattgtgtgacttcacttaacctctctgaacttctgtcttctcatatttaaaaaccagctcttaaagttataagaattaaacatgttagtctattgaatatttagatttcctagaacataaattctgtttcataaatgttgtttcccttttcctctaacttttgggctatctgaagcgtatacctctatcatttgtttactcagttaaaggcttaatctttttcctaattccccgagctagaaccacagagtgagtttcagtctattttttctgttattttcgcctgctaaatgcaaggtatccatctccccttgacatcagctttgtaactggtccacccatctcccttttgctctgtctctgtccctgaggcactgtagcgtaatggaagtgtgtgggctctggagccaaacagcctgagtttaaatcttgattttgttccttaatagccatacaatctcaatcaagttacataatctctgtgtgcctgtttcctcatgtgtaaatggggataacagttctttcctcaaagagttgttatgaagattaaatgtattactccatgtaagcacttagaatagtatgggggtcatggtgagggctacacgatatatggttattcaataaatctacctcctttggattccagaattatctttctaaaatttaaacatccactttcaacttgggggaacctcagtcattcccttcggacctgcttctctgactgcccagccaaggctgaaactggggcccctctgtgcaccttgcactaaactcttttattgcacttggctgatggttttgtaactatttgtttatactctttctctacactatcctgtgaattcttggaaatatagacacttacctgatttatctataaatggccagtacctatctgtccaaaggaggtgcttaataagtgtttgctgattgaacaaaatgagcaaaaaaatgttactgtttcatccactgaacaaaatataggctactgtcttcaaatatacttttacttaaaatcaag

SEQ ID NO: 50770 - DNA, 814 bp, Bovine  19866881694141
tacagacaattgaggaattagcaaggtaaacagttgtctctcaaaatcactgattttcttctttctggattttcctttaggtcttgatcatgtcagcatcagactggacctagaggccttatttcagctcagtcaccttattctgacctttaagctacagatgagtagactgctgcccccttatctacttaccaaatgcttggcataccttagatttcacttccttgctcccctgcagagaacaaaaagctgttaaaaatccagactggagctttgttatctgggctttttgctcttgaaagaaaaacaaaaaaacaccagtgctcattaaataataacttacatgattaacaaaaaagaaaagacagagtgagtcttagaagaaagatacaggagaaagaaaacctccacactctggggtgctagagatgacaaaaactagaaagataatttggaggataaaaggccaggcactggaaattatttaaggaaattaaaaaaaaaaaatgtgatcaaaagaggaagaaaatttaaaggctctttactgacttagatgccagagaaaatctgtgctatcgtcattctttaatcattcatcagaattctaattttgtcaggcctggtgctaggttttagctataaaagatgaacataaaattaaaagttttaaaaatttaagaaagtagtctttgatttcaaagaactcacagtctagtcataggtataaacagatatataattttgaaatcacaatgcagagtgacaagtgcagaaatagatgtacgattatctgacaggctaaggcaactcgggg

SEQ ID NO: 50771 - DNA, 941 bp, Bovine  19866881723198
tctgagggatgtcatttccctttttatagtatctttgaagtacccatttttacattttgatggagtccagtttatgtgttttaaatttggccacttatgctatagatgtcactaagaaacccttgcttaattcaaggacacaaaggtttatacctaagttttcttgcaatagttttatagctttagctcttacatttacatctttgatacatttgagttaataaaacaagttttaaggtgcaatcttaaataactagaagaccctaataaaaacttctatgatccctttgcatgaaataaaaacactgatgcttgtatatttacaggtttagcatttgctctgctagtcaccatccccccaggctacgggctatatgcagcctttttcccagtcatcatctactttttcttgggcacttccagacacatatctgtgggtaagtgaattactgggctaattaatgctcattgctttttctttatgaatgatgttatccatgcattgtatatgcgtgctaagttgattcaattgtgtccgactctttgcaaacctatggactgtagcctgccaggctcctctgtccatgggattctccaggcaagaatactggagtgggttgccatgccctcctccaggggatcttcccaacccagggatcaaacctacagtcgcttatgtctcctgcactggcaggcagtctctttaccactggcgccacctgggaagccccagtcatgaattgtatcaattccatattgtgcaacatccagaagaggagtcataacttcttgtaattacaaattagaactggggcttgggaaggagaccagaactccagatggtaatctttctacatgctacattttggttgaaagacaactgtgctatggggaagcataatgactacaattcactctgtcttattaggtccatttccagt

SEQ ID NO: 50772 - DNA, 665 bp, Bovine  19866881752295
gttttctttaagaaaaaagaagaagaagaaaatgttattttcaacaagaggggaaaaaagcattgaaagcccatgagttaaaccatattctatcttaagtagcttttctttctttttccctctttttttctttttccttgctctctctctctctctctcttttttttttaaattaaaatctctccccaaaccatcatcacttttaatattgcccagactgggcttcatcttcagacccttcatccccgaatttctcatgtggagggcttgaagatgttttcttttctagaggactttctggttcctcatcttctttgggaagaggagtcttttcctttgagcctgtgaagctatggggcgacccactttccctttgcctttcacaggacttggtgtcactgtggcctttatttatgtatgcaatagcagtttctaattgctgaaaaatcacttttaagttgtattgtttcaagggtacttttcagtgaatacttaatgtagctaactcttaactctctaatattggaggccaaggtagaaagaattatttcagtatacagctaattcaaaattttcatttggcttctcaactttaaatttctttcacagcaaatgttttatcagaaaaatagaaatagaccatctgctgaaaactccccatcaaa

SEQ ID NO: 50773 - DNA, 972 bp, Bovine  19866881801853
ttccacatataagcgatattctgtctgacttcacttagtataatatcaaatatttaatggcacgttcagccttgtgccatttctaagtgtgctctgggagacctgtgctccctgctctcaaaatccagttgcgagaagtgtctgcacacgttccttgaccaacacttcctgggtctctcaatggactcttaagtttgttccttttgggtggtacttgttttacttggggaatgtgctgccattagaattctattgtgtttgctgttcaatggcatcagaaaacctatttctatattaaacaagtatccattgtaacagatcatgctttggatttactttgtgatcaagggaacaatatctctttagctgtccctattgttctgagtcctctgagactcacttcagaagtgattgtgcctcttacaacagcaatcaatttgaggcttagatgtcgttaaatatggcaggagagctcgaagggagcacagttgctcttctgaggacttccacagagatcagctcaagggtttctaaatactccagctgctcttcaagtttgttttttggcctcttgtcaataggcacttgtgctcgttctgtgcaggagaaaatgctggcattcagaaattccattcagcgaagtagtaccacaatttctctgtttagtttttgcttttacaaagagcctaagttgaatgcatggcctcatagactttctctttcaacccacagctatttctatagtcttcattgtatgccgtgcatatgttacaagtatttaaaattgtatctaggctttgaaagtatctgatgtattgggcaaatgccccattgtcctgtgttgtaaattgtaagaatccatcgacagaaatgaaagaaaagctcagaaagcagtttcaggctatggagctaaaagggaagggcaggtagactgtttagtaactcatgtttagcaactttagtggttaatga

SEQ ID NO: 50774 - DNA, 1652 bp, Bovine  19866881813447
ttactctgcttcctcaaagagattcccgatgttcttcagtggctcggcagctgggctctgggccaggatgtctctgatctcgttgactttcttctccaccgagtccacagtctcccggtaaggcccaatcacaccactgatcttcaaggccttggctttctccaggaacttctgggtcctgttggtcaactcagcgatgatcacgtcccaaagagcaaagcactggtggcagggtgtgcagtcgggaaagacgcccgagtagccccgggtgcacttgtcacagcgtgggccctccacgccctccacacacacacactggccagtggactggtcacactgcggtgtctcgatgcctctggggtcgcagtcacaggctagaagggagacagcaatgctggctgagccactagagcccaaacagccactaggcagttataccctcagccactgttacacaggaaggtctgtacatggcctacggcagtttaccaatgaccctcacagagactatagctgctcccccaacaacacgcggtacctcaaccctggctagctgctgcttaacaattatagtgataataaatttttctttaagtgaacaccattgtgcatcattgtacttgcctctgtacaactggtttacatgcatcgtctcacttaatcctcacaataaccctatgggatccaagtattacaatcatcagttttatagatgtgaaaactgaggtctagagagattatgtgactgccaagtcttgcagcagggaagcggccaagccaggagtctaactcagcactttgcagctccagagtctgtgcttttaagctctgtcttgcctctgctcccctttttttgacctgtctgtagatcctgtcaggacaggacagggtctgtcaggtgataccctaaagatgtgaggcctctggcctaagatagagcagtgatgagcaagcaacataccaacatccctctacccgttcacagaacagtgaacggttgatgaaatgcaataaggttgataaagagaaaactaaatgagaaagaagtctcaggaattctaagcgtctggttaaaaggctttcaattaagtatcatctaacttgtgtgtgcctgccattgcactaaccacccccagcgctaagagcagaggctcataaaacatctgaagtgcaaaggccttgggagccattcagtgccaacctctcactggcccagtagggttggcatctgaggcactgcgccactgaaccccagctcagagtcccaaagctcggatgactaacttggttttctatcaacacttgacatttgtattgttcagtgtttgaataacaaaggcctgcaggtggcactaggggtaaagaacctgtctgctggcgcaggaaacgtaagagactcgggtttgacccgtgggtcgtgaagatcccctggagaaggaagtggccacctgctccagtactcttgcctggaaaataccatggacagaggagcctggcggacctcagtctatggatcgcagagttggacacaactgagcatgcacacacacacacaccccttatccctggccttaaaccccttctgggaaaaggtggggataaaaataaaaacaaagatcctatttccctaagtagattgtggactccaaggg

SEQ ID NO: 50775 - DNA, 1785 bp, Bovine  19866881948690
ggaaaggggatataacgggttgaactttctcctccaccaaatttgtattttttaaaggatttttttgacctgttcaaagcaagggtaaatcacccactgttggtcattactgaccagaatcctcctcctaccctctctcctaagaataaaatataccaaatgccagtagtctgacaacagtttaaggatacaggaaaaaattatttcacagaatgcaggaagaccaatggtcacagttacccccaggtaagctttaagacatcaacatacaactttacttatgattacacaagaaatttcaaaaaatgtcaaaacatgatttcaaataatcaatagtcttggtactgggaagccaaagtatcttattataaatccaagaacttcctgttttaaatacctttttttaagtacatatcctttatagaaacttcaaaaatacagaaaagtgtaaaagaagaaaatattcataatccatagcttcctttcagggtacatttttctaatctttaaaatgtgcttttgataagcccattaagatttccattcagcacagaaagagatgtctcatcattctaaacagtgttaagcaactaacacactcagtcttaccagaggacagaattaactttttattttcttggcacaatatgtaggctcttagctcccagcccagaggctggacccaggcatcccgcagtagtagtccacaactttaaaacggaaaccccctagccacaataaccttcttgctattccttaaaccacacaactcaattcctacctcagacccttctcactgctggttccctctgcctgaaattaccttctcacaccctcaccttactcaggcccttgcacagaaaaggcctgatacactatctaaaatagtcaccctacccccaattaccagacttcattttcaaccacttcccaaattatttccctgtttcttgtatactgtttgtatttcaccatcagacttcaagttctgtaagagcaaggctttttcttgttcaccatctggaacacactacctgttcaacagagcatttaagtgaacaaacatttgaacaaatgaattctatagctaattactttgctcttagttactcttaacattcacttgcttttacatttaaatataaaggaaatatgagcaaaacctgttttactaagtacttacttggttgatctgcataagttcttagtggcactacagaaactccttgcagaccatgagatattcgactgaaatggcctctctgaaaaaaagaaagaaaatgatcctattatgtaaaatatgaattgaaaaccactaaagatccatgaagtcaataataagtcaaatgtatcgagcaatgattgctaatgtatcttccactgacacagggaggttacacaacaatttctgcttttgtaaaaacaatcagcttgccacactttttttatacatgttcaacatatcatttcatttttttacctaactaaaacatgttattaaatgctgccttacgttttattttattttcagaaggcatggctaacttttggcgccagagattattttaatggcattaactaaagtgtttaatggagaaggcaatggcatcccactccagtactcttgcctggaaaatccatggacagaggagcctggtagggctgcagtccatggggtcgctaagagtcggacacgactgagcgacttcactttcactcttctctttcatgcactggagaaggaaatggcaacccactccactgttcttgcctggagaatcccag

SEQ ID NO: 50776 - DNA, 2046 bp, Bovine  19866881976635
ccaaggtcaccaatgtggaatcactcagtttatgacacatggggtacttcacgtgctggccagtgatcttgctttccaagtggtcattctatacagtaacatatgtcccacagctgcagaatcagcactttattctccgtggtattctggaatgtgtcctggttggaataatttatccgggacccagatggatcatatacacatcaagaaatacatgaggttttttattttctcttccaacccttcacttctaggcaaagttgtgttcattcctcttctattttagggctcagtgacttctgaccaactgcctgctgtttccatctttctccgagagccagttcctgggatacctgtttcatggacgggagctggagttgcaagggttctccctggggctggtttgagatttgctgtagggaacatccctgttcccatggatttcacagttgccattcgctatgaaactcaggtatccttcaactccccttctgtgctggtggttccaagctgaacgaaatacattctcaagctaagtgtttccattccagtcttgcctaggttcatcataataggatttacagaaagttgaacatctggagagcattgtaaactaaagtgtttcctgaagatactaaagcaacacagggagccatatgtacacacacactattccatggagagaaactaaagccggagctatagatttaagatactaagtctagggaagtggtgatgaaatatttgtataagaataataaataactcaaataatgcaaatcctgccctcctaggacatttcccccccaaaagtgtaataagcaacatatgtgcagagatttagactcatggggatgcagaagaggcatttatttgcacttggattttaccaggagacaaaaagaaagctcaaagcaacctggtcctcttgccttctccctttcgagcccttcccctgccttttgagaaatatctaagaaagaagagaaaccaaattagaaaaacacttgatctagagttttctttgcataatcttttctttggtggtctgaaactccatagaccatctccccaggaaaatattttaggtggctgggggtggtctcagagcccccagagtccctctggggaccacattctgaaagggctcgttgtctgttgtttgaccaccaaagtggatgatctactttgaaactcttaatatgacatacttcttaatttctcacttaacaaattaaaagcaagggacttgaaggcactttgacatggtatgacaagaacgtcatttttaaaaaagatacgtgtatataaacgtgtatgtataaatataaataaatttttgtatagacagaacatatctctgacagctttaaaaagcttttccagattgtgagacttctagagtttagataattaacatatatgcactctctctctctctttctctctctctctctctatatatatttatacacatataaatatatctggtaatataatattaaaattatttaataataattatataaataataaatttatataagaatatttatacaatggtatgaaagaaatatgtatccttttgtaaaagattccttttttcccctttgtgctgtgatccaagaacatgatgaattaattgactctttgggagacagatgttaaagattggaccttcaggggatgtttagggagtttgagatggacatgtgcatacaactgtatttaaaatggaagaccaataggttcctactgttgagcacagggaactctgctcagtgttaggtggcagcctggatgggaggggagtttgggggagaatggatacatgtagaggtatgactgagtcccttcactgttcacctgaaactattgctacattgtttgttaattggctatatcccaatacaaaataaaaagttaaagaaaatagaagattagaccttcaagagtcccaggggttttctaggcccaggaattacatctatggccataaacaatattctttctacctggatcataattcaaataccaaaaagttag

SEQ ID NO: 50777 - DNA, 1027 bp, Bovine  19866880698224
aaactattatgatcctttatcagatgaagctaaagaagtcttcgctgctgaaaaaaaaaaaaggcaatttataccaacataagtagataattagtgtatttaatccaagaaacacttttatattggattcatatattgtcaccaaggtgcctcaaaaggtatgaaattttatgcccctaaaaattggaagggtgactaaaaataagatcaactgaggaaaaaacccattattcttggggtatatattagcagtctatattcaatagccacatctttgcatttaaatactaaacactgagaaaatgcaaaggtacagccagggaagagctgaacacagcaactagagaaagcttggggacgtttaaaacaataaatacggtgtgcctaattcacacatttgtgaaccatgtacctcaatgttatgtattactattctttctaaacctgtatgttctttctcaatgcattaaatcatgataaatcttacttgtttgaagagggacctaattttttgcaaaagcatttctagtcatctgaaaccaagatagataaataagttagacagatggtcagctaggtatctggttttaaaaaatgacatagagcctataaagtaaataatgtggagtggatttgatgccagtagcatccctcaagcaaaaaaccagtctcccgagatacattctgccagcaggcaccactccgaaaagctctgccacaggatttctcagaaccctagtcagccacaggtggcttctgccactcgtaaggaactccccaagccactcagaagtccttggtgggtgccctcatttttgtatgttctttaaagcaaaatcctaaagctcttaggactttaatgcatattaaggataacttttacagctactcttaaataagcagtattttcctatgcaggtaagcattcctattgtaatctttcccatactagcaatacgtttctttgggtaatcttaggtcctcaatttattctctctgtagacttcgttttccaataaaaacaaag

SEQ ID NO: 50778 - DNA, 2176 bp, Bovine  19866880427336
atttggacattttgccagctttgaggctcagggtgccctggccaatatggctgtgatgaaagctaacctggacatcatgataaagcgctccaacaacacccccaaacaccaatggtacctctgctccagtcctcctagacttgggaattgtagctttaaacagatgcttgagctctttgtgttttgttactgagactttcccctcaggacctattattgtcgtatgcaaaccccacattcttatgccaccagcccaagaacttcaggagttttctcctttcttgatgtgctaagatcttgtctttggcaaccacagtctgtcataaagcctttgccctgagtccatgctgggggagccaggaatgaggtccttgaatatgttatgcccagtaccggttccgttttcatgggggagggaataacagctgggtatctgagaccatggcatatattcccaagacagttttagctgctatgtcagcctcgatgggacgaagaggggcagggctaagcagggaaggctaatttctgttgcttgtctcccagttcctccagaagtgactctgctcccaaacaagcctgtggaactgggagagcccaacacactcatctgcttcattgacaagttctccccacccgtgatcagtgtcacatggcttcgaaatggcaaacctgtcactgatggagtgtcaccagaacggtcttcctgcccaggaatgaccaccttttccgcaagttccactacctccccttcctgcccacaacagaggatgtctatgactgcaaggtggagcacttgggtttgaatgagcctcttctcaagcactggggtgagtaccgtccttcagtctcctttacttcattgttcctcctgtgatgcgtgtgtctggtccttagggaccccgaggatctgcttcacgactgctccagttctggtttctggtcttctcccattgctctgctttccgctcttctcgtctataattccctgacattgtcctgtcttcctctcatttaattgatgaaaaaaaaaaaaatcttttgactaagtatcatatgttttgtgctaagtgctgctccctaccacatgcatttcttatgtactctgacttatttttccccagagtatgaagctccagcccccctcccagagaccacagagaatgcagtgtgtgccctgggcctgattgtggctctggtgggcatcattgcagggaccatcttcatcatcaagggcgtgcgcaaagccaacaccgttgaacgccgagggcctctgtgaggcgcctgcaggtgagtctgctgtggtcagaggatgacatctctggaatgattcaagcggaggaaaagagtgaggaaaaggacatgtgatgcctttaaaggaaaaccattccaaaagtcatggctcctgatttatcacaatggacagaatcagacattgtcatcatctgatattccaaagccctgcattcctacaccccattccatacatgtcaccaaagatcatgccttcagtcttggaaactatctccagtacccaaaatagttgtttcacattaaaatagtgagtccaatgatctgggaaagccaacctcaagattacaacacttcctggctttatatttcctgagataagacatcagctttgaagcatttccagagtgtcactttttgggggtttagggtaactgtatgaagtggaaatgtcttggagacccatgcctgcttttgcccctccgttctggaaaaaaaaaaaatggtgtcagaagatctaagagaaaatgaaacatggcctgctgcttcattctttcatggaaggtaggaaatagcagttcatgttgaaaaggttgcatttatgaggggtcacacaaatattaagagacttttccaaagtcaggggttaaggagtaagagtaaggaatctgaagataagagctcaaaatattcattttaaactctatagtaactatgtgtgttctgctacaggtaatggactttgttacagagaagatcaatgaagatatttctgccttaatagctttacaaacctggctattctccaattgttcacctcactgaagaccaccatgcttcagcactttcccagtcctttacttaccctaagagtaagatgccttccacaatctccagattctaatctctagttattccctgtcta

SEQ ID NO: 50779 - DNA, 749 bp, Bovine  19866881579357
aaatggagttttgcatctttgcaggaacattccccctccctccacctttccttggaagaaaaaaataagttagcattcatctctaatattttctcttcctttccctatttgaataaaaaaaaaaaaagaaagaaagttagattttctttttaatggctgaagttgctgttcactgtagcactgttagtccagctcaggtgtccaacttaaggttgccagatttagcaaatacaaatacagaatgtccagtgaaatttgtatttcagatgaactatcattgtttagctggaattcagatttaactgggcatcctgtattttatttgtcaaccctagcccaacttactaataaaatctcagaaggaccatattgaatgcttttctgtattcttcaacacaaacccaggacagtctgcacatagtgtgaaccctgatggaatttttcaaataaatgcaaaatgatcgtatatattggaactagcattccttgcatactcctcacacactagtacatgtgaacctcagaaattttaacagtaattcagacttaactaagccactatttactaatcacagttcaggttcagttcagttgctcagtcgtgtccaactctttgcaaccccatgaaccacagcacacgaggcctccctttccatcaccaactcctggagtttattcaaactcatgtccattgagtcgagaagcccaagctatagaattaggaagtgtaatttgaaacacgagctcat

SEQ ID NO: 50780 - DNA, 1383 bp, Bovine  19866880534218
tagatatatttaagatatagttataaaataggagaggctgaaatatgtggagctttgcctctgtgatcccaaacaggtttttatctgaaaatattttctgattatgtgtaagtcagtggttacatttaagtgaatacctggtaagtcatgaaataaatataaagacattactattatatttcctaagtacctgcaatcaaatggatgtctgatgctctttactcattcccacatggaatacactattaaaaagaaagaattaatatgtaactaatcttcagggatgatttttacactttgcagaatctctgcttaactttgtatttgaaaagccagtccagcttttcaagaatttagctattctttcaatgatgacctatcactaccacatagcattttaaaaagctgcttcacacaattaaatcctataaggatttgttttatcataatgaaatgataacttggtgtacccaactgtagaagtctgggcatatgaaaaaaatctgaaacatatttttaatattacttttactgtgatgatgaataagggaagaggaaaaaagctatatgaattcatttgtaatgataatagctgtgtttttctgcctagaacaatattttataaaaatgtgataacagagaaaaatataaaaactaaaaatgttttatattactcccagtattcataatcacaattatcatttgcttatgcctttctagttttcttcctgtgtgtatcttttaaagactaaaattagtccatattaatatgatttttcaaattcacaacatattgtaaacttttctccatgtcattgaatattcttctatgtcattaattttatggcttcagacttctcccatcacactgatgcacttagcttatttattttacatgtttccctctttttgaggggggagaattttgaccccctagatatcttacattctgtcttcaccccagccttcaccctacctacctgcccatcacacacaatgctgattacagatagctcttaactcacatcaatgttcattgcataaggttaaatttctggaagaagaatgatgaggccaaaggttatataaaattttgaccttattaccacatcacagtatgccagcctaatgatgcaatatgtaataattaatcagcaatgcttagaagtgcccattttccacagctttatggtggtggaatctcttcattaaaaatttctttctaaatttgattaatgaataactaattaattgaatgtatatgattgataaataatgaggctaaatattttataaatgtcttatctaattatatttcttattttgcaaattagttacatttttgggtacatctctggtagcattcttagttttctatttttt

SEQ ID NO: 50781 - DNA, 2490 bp, Bovine  19866880565481
gtgactattatcctaattgcattgttgtcgtaggattttgattattggcacatacttttacttgttaactttaacagttggtctttctaaaaaggttgacctgttcatttgcacactgacagtcacacctgtcttggaatagtagacattctgcattcgggtgcttttctgcaacagggctcattaaactcttagcaaggcaagcactcaggacaagggttaagtgctgggcccaaggaaacattattaacaagagcagcagggtctggactctgcatggctttagtgctttccatgacagtaggtacactgccttagaagagactgacattagctctaaggaaggacttccaggagagccactgaggccctaacatggtttaaagagaggggacataatgcttctgaggactctgagtcagagagctggggatcctgggtcttggtgctgggaccctccccactcttgccctctggtcctacaagaagaggttctcaggctctgcctctatgcggcaggtgcgcttcctggagcagcagaacaaactactggagaccaagctgcagttctatcagaaccgccagtgctgcgagagcaacctcgagcccctgttcgagggctacatcgagacactgaggcgggaggccgagtgcgtggaggctgacagcggaaggctgtcctcagagctcaaccacgtgcaggaggtgctggagggctacaagaagaagtgagtgtgggaaggcgccagctcccggaagggcttgaaggtggctcccagcacaggggagcatccagacttgtggctgggtctctgcctgatgatcaggaagagcctgtgctctctgcccctcctcgaagtacatgggttccatgggtgggtcctggccccctggggacggagctcagcctgacttcctaccagcaggtcagggaaatgatgttctctccctttcttctacccatagatcttctcttaggaccccagaaaaactaacattgctgatccttttgagtctagctttcaaagtcctggaccttcttttgaagttcaccccttcactcagctaacactttttgagcacctatcaggcaccaggcagatccggacagggtgatagcaatccaggggcaaatgatagagccagctcgtgtttctgtggggcttacagtcccctggtaggcagagatggcagagtcacagacagagacctccgatgacaaagagtgacacagaatacgaaggcacacactgggtactctaaaggaacctggtttccagagctggccaccatccttcagttatactcttagccatgcactgccaggccactgtgctccctgcctctagctctgagcaggcctgcccacagagcaggaggaagcagcaggctccacatctcttggctgagccaggaggaagatgacagaggggagatcctaccacctgtagcaaagccaggggcaaggggaggagtcagaggaaagggaaatgcatggtgagaaaagaaggcacctgccagccccagccacacacacacgcacacgtgcacacacacacactcgcacacacacagcttctagatcctacccccggccccccttccaccctcaccccactgaggagctcagaggtgatgtgaaggtgggtgtttcaatagtcccatgtatcccaggaggcctggagcacctggtcccaccccatttcttttggaggtggggaaatgagtggaggcggggagctagaaatcaggcttatttgcttgcgtgcttcatggtcaagtttagagttgctcagaaggggccctgttttccccatacccctcaggtatgaagaagaagttgctcttcgggccacagcggagaatgagtttgtggctctaaagaaggtaagtgcctgagccaagcccctccctgagcccctggccaccctgtcctctctgtcctgcgatgctgcagccaagcccgcagagtgaccttgaatctcacagccccttgaaccccacacaggatgtggactgcgcctacatccgcaagtcagacctggaggccaactcggaggccctgatccaggagatcgatttcctgcggcggttgtatgaggaggtgagagggttcttggtcctggtgggcatccctgagcccctgtccagccctcccactggccggttgatgtgggaacacaggctgagattgaagggttaggcagaggaatagagaagcaaaatgggacagaattagtaaggggcacggaattagtaagggtgacaacctctaggacagctgtgccttgagaaaccaaagcccaggcacacaccttgaccgcactttctctagctcagattttctctggcagccagaagcctgtggctggtccatgagaacaagaaatgggtctccacacaggggcctggaccccaaagaagtgtccccagcatgcggctgcagggacaagatttacaggggcctgaaaaatccccaaagcaaacatt

SEQ ID NO: 50782 - DNA, 1699 bp, Bovine  19866880598678
aacttctgactgtagtttctttggtgactgaactttcagcatctaaagtcaacagctagcaactagcaaaggagattaatccaagccctgacacggcaccttgaaaaaacgttcagctgtgctccaagtgtcctgcaagtcagctgtaatgtcaagaaaaatatattttgatggggaaaaccactgcagaatcagtatattgtgataaaaattggaccaagaatcaaccgtgcagtattcttttaaaaaatgtagccttggggcattgtgccccaattttggttcatcgtgtctgaaatgggagcaaggaatccacattttttaatatccacccagatgattactctacagttggtataaggactcacgttgagaatcagtggtttaccataaacccattgactcgcttaagacatgacagatgcctctcagctcatagtctatcctgaaaccattgttaccagggattagttttaagagataagaagcatcagagccttaggatatacaaggaagagctgttttttggaaggagaaagagagataaattcggagtttgggattaacatatacccactactatacgtaaaataggttaacaacaggacctactgtatagcacagggaaccgcactcaatatcttgtaataatctataaagggaaaaaggctgaaagagaatatatatgcatgtatcagaggcttccctggtggcttcccagtggtaaagaatccgcctgctaatgaaggagactcaggttcagtccctgggtcgggaagatcccctggagaaggaaatggcaacccactgcagtattcttgcctggagaatcccatgggcagaggagcctggcaggctacagtctatgggttgccatagactatataggtctataggcatcgtctcttgtggcaactatgggttgccaaagagtcagacatgacttagtgactacgcaacaacaaaaaatatgtgtataaatgaatcactgtgctatacacctgaaactaacataatattgcaaatgaactatccttcaactttaaaaacatgttgatttttattttccaaagaggggctgaagaatttctcccctaagagaaacctgagtgcggttggacaaaccctcaggaaaatgagattttccttcagcatttatccttgggctatgtctgtgtttgttttttgaaaactcaaatcaatatacctataggtagcgttttctgtttttcaggggttttacttcctcagtcatctgccaaggggctgagagagacttcgtgtgccaggagcacatagcctcaaataggaagtaactatcgggtgactcagaaaatgccggactcaaactgataatggttctttctgtttttcgtgagtaggttacactctttgaactgattaaagagttatcattgtgccctcaagtctgctgcttgcttcctcgtcctccatatcagcatgatagcacattcactcaagggtaaccagaagggtctggccaagaatgatgatgcctcctggactcacctgtacccatcatccaggccactttgctcacaaggaaatgattttcgagagaaggtccacgtacatctgatttgtgggtatgctttaaacctgacagaaaaacaaaattcttcatactggtcaatttcataatcttcatttgatttggaaacgtttataaatccctttt

SEQ ID NO: 50783 - DNA, 895 bp, Bovine  19866880752418
tgctatgagcataaacatgtggaggctaaacaatatgttactaaacaaaaagcaatcaatggatcctgggaaaaattaaagaggaaatcaaaaaattcctagagttgaatgaaaatgaaaataagctgattcaaaccctttgggatgcagtaaaagtagtttttttacatgctttaaaaattgcagtagagttgatttacagtgtttcagatgtatagcaaagtgattcagttttgtaactgcaaaagcagttataagggggcagtttatagcatccccgctggtcttgttgactgtgtctccaacctccataaatttcaattgataagaaagctcctggttccctttcttctgcatctcatctccccatggagggtggaggtgaagtcagacagaaattgttagatcttcttttgtcttgctgacttcttgcctcttgcagtggctttaaaggatgggagagggagagaggagctgaaatgtattctgtttgtgttttgtgcatgagaagccaagtccccatgtggtaaatgaaagagatcagcattgtctagctagagagaagcagagccacattctgtggtctctccatgcaggggtcctttcagaggtgcagcctgtggcttggcagattctccccagcctgaaatggcaacttggcactcggagcagtggttctctgttctctgtactatttccttattggggctgaggccagggagtgggcctctcctctattgagagagtgtttgagagtctcagtttccacggggaacctgtgaatcatagcttttgttgatacaggccaggaggagcgcaggagttttctcgcttggttgccaaagtgtccaggtcccagctggggtggtgcatgtgtctgggaagaaagaaaaaa

SEQ ID NO: 50784 - DNA, 1246 bp, Bovine  19866880806451
ggggagaagatgggtggattaaaatggaaagttttggcctttttgcccttacccctctgttaatctgtttaaagtgaaagaatgtatctgtgaagtgggtccagctaaactgtaagccccagaattgtccccatgctgctgctgctgctgctgctaagtcgcttcagtcatgtctgactctgtgcgaccccatagatggcagcccaccaggctcccccgtccctgggattctccaggcaagaacactggagtgggttgccatttccttctccaatgcatgaaagtgaaaagtgaaagtgaagtcgctcagccatgtccaactcttcgcgaccccatggactgcagcctaccaggctcctccatccttgagattttctaggcaagagtactggagtggggtgccatcaccttctccgattgtccccataggtaagtgcaaaataaacactcttctttgcatgttcggtggtcactggttgctctcatgtcagagctttacaagttgaactttctctaaccttgaagtccatggagtaaattgtgtccaactgagcctagctgcagctttcttcacttcttttggtatttctgtttaacctgattttccttttttatcattatttattcccatttatttgatccaagtttcctaggagttattggtttaaaagacctattggaacaactttgaataacatttaataactctgctctctggagtcaccaaaccactggcttgtttctttagatcagactaattaagttgccataaaatggttgtattctattcctgtattttcttacttctgtccttataattttcattgccaaatagtttaatcagggtttatttgccactcttcacagaagcgcacacaaggaacacatagacatttttcccaataagggattttccacatctcgcattttgttcaggacagtttcattctccgttgtgttcagagctctgaacacaataatgagcttaacgactcattattaccatcaactcccacaaatacaattagtaaattgtattttaagaactccatagaaatgcaaatcacatattcaatctaattttgagttaaaaacaagatgtttttctttattgcaactctttgcctttgatacaagatcattagttaccattgggggatatttcattctactcagcattattccctgacccagaacatctaaaaaatgtagctagtatcagatatctatgtaatatattaaaata

SEQ ID NO: 50785 - DNA, 1443 bp, Bovine  19866880877547
ctgtcaatttccctgtatgtttttggttttagttacaagtatggcataagtgactatgtcagaacttcaggtttaaaacaaacaaattaatagatacttaacccactagacggaaagaaattcttgatttttttcaaactataaatacagtctatccaattttagttcaagtcttggagaaaaccaacacatattttttgtatgttatttaagttcatatcctggtggacatttgggatgttcacttttcccagatttataaataaaggtcagcttccctgaactttgtggactataggtcactttatattttccaataatgttccttaatgtcattcagcttttttaaccctgttttgaatactaggcaaaagtattcaaaagagtgttctctggaactgatttcaaatattggctctgatacttactgattgtgtggtctgaggctagttcctaaaacttgctggttcttagtttccttctttataaagttgacattaaaataaacttacttcattagtttactttatcagatgtataggcaagcttctggctgattggatctagatgtatcccaattgttaaaacaacataaagaaagattgtcaacagaggactgcaacaaggaatttctggaagaaatagaacagatgagaaatatactatgccatccaagtgaaaaaaatgtgaatatccccaaggaaattccagaatactatcaaattctggtgtgtgttaacaaaggcctgggccataggcagttagcattttaattgaatggggggatgattatattcagcttctactttgaggtcaaagttcactagtgaagtgctctaaacagggagttttgatacttgagccatattatacaatttaaatgtctataagtacacaaaatgtgagtatgcaatttaaaaaatgtcaataaggaaagtcagtgttttgaaagagaggcttggacaataaacaaacaaacaaaaaatcacccagaggaaacagagttaatacagggggaaaaaatccctaagataaacagaataagcagcattaggaatttaaagcatattttgtccatcataaagaaaatgctattatgagaaactactttaatggaaattaaaactttttgataaaaaagagaagggaatagatcagctaaaaaatgtagtagagcctgaagtcaggtaggttgattactccagttccattcttctttctcaagattgctttggctattcgaggttttttgtatttccatacaaattgtgaaattatttgttctagctctgtgaagaatactgttggtagcttgatagggattgcattgaatctataaattgctttgggtagtatactcattttcactatattgattcttccaatccatgaacatggtatattgctccatctattagtgtcctctttgatttctttcatcag

SEQ ID NO: 50786 - DNA, 1204 bp, Bovine  19866880919906
cgtatttatttaattcctattatgttaggggaagaaaattttgttctactcttttggcaaggttatattataggacaatggtatcaactatagtcagcatattttatattagatcctcagacttcatcttacagttgaaagtttgtaccctttaatcagcttctccctatttctcccatcccgtagcctctggcactatttttctgctgtttaagagtttgactttaaaaaatttttcacatatacatgataccatacaatatttgtctttctatgtttggattatttcacttagcataatgccctcaaggcccaactatgttgttccaagtggtaggatttccttctttcttacggttgaattccattatgcaacggaattatatatacacatacacacaccacatcatctctatccattcatccattcatgggcacctaggttgtttccatgtgttggctattgtgaataatgctgcagtgaacatggacgtgcaattgtttcttcaatatcctgttgtcatttcttttggatatatgcctaggtgtgggattattgaatcatatagtagctctattttttcaatattttgaggagcctctatactgttttccatagtggctgcaccaatttacattcctattgtttgtgagcaagagttaccttttctcctcatccttactcaaagctttcagacaggaaccagtcttgaagaagcgtgaatttaaaaaagatctctagctgagttgtaaagaatgagttagagaataaaagggtgaatgcagggagaagagttaaaagccttttgaacagatttacacagacttgggtggtttggattagtgatgatggaaatagaaatgagtagatggattggaaaaggattttggaaataaaatttatggaacttgctagtgactgggtctaggggttaagacaaagagagagataaaggaagatccgtggtgatagctggtggattgtagttatgtttgctgagatgggagcaccttggtggtaggaatggggaggcaggtgagggagagcagggaaagaccctaggttcaattttgaagtgtctgcaagaaagatattcaaatgataatgttgagcaaacataagatatatggtttgagaggttattagtgctaattgaagcagacatgaagtccttaaactttttaaaaatgtggtatttaatga

SEQ ID NO: 50787 - DNA, 1902 bp, Bovine  19866881019313
cttataaatggtggtgctgggatgcaaacacattcctggtcttaattacacaaattactagattattaatatgatctggaggtggggataaaagaccagaggactggaggtggagaaaggaagaagctaagtgaatgtagggggaaaaatgactgaatgaagaaaacaatattacaatgtcaccacatttatacatctgtaaaattagtatatgtatataaagccattttttaaattttaaaattggaggataaacgctttacactattgtgttggtttctgctgtacaacagtacatatcagtcataattatatacatatcccctccctatggagcctccctcccctctatccctctaggttgtcacagagtgctcagccatttttaataaaaagcatattaaatattgtaagagaacatattagaatttttaattggtttattccacacaaaaactgtcttaattataactgaatcattatagttcctattcttatcaatgtttcagtcattcaacaaatatttaatgagcatctactatatgccaggcaatgtgccagattctggggaaaacactgtgaaagacacagcctcagtttcctcaaggtattgacagcagtggaagatggagatcaggaaacctgccacgtaatgaaatcacgtgactctccttacacctgtaatcccaacaggacagatataatttgtttcaaatcacactgaaaaaaataaagactacattgatatctgcaaatcaactacgtcaaccaatcaatactgctaactctcctcaattcgccctgctaaacttttccaagttgctggctcaaatactataggtgtacctagcattaaccccataggctccagtgaccataaaatctaaaccaagaaaaatgaaaacaagaagcaaatattatttgtaagtctttttgaggtttttgaggctcagaacatgatcagaacttcagccatagcagaaaaaggagtcgcatatatcctttgatccaggatttaagtggtttggatttatacacagaagctaaacccataaatgcacaaatccacactgattccatttgaatggagaccttctgcagtgtcatgcgtccgggttcacacagggattggtcagagactctcttcagaaccactcttcaaattactttatacattgaagccgattatactaacaaagtatttgctgaatgagtgtctcagaataccaaatgctgattttgcaaaaatcctctcaattaaaatccctttgtggaagccaaaaatctgccaagtgaggaggtatttgattattagagactcactggaacaaactgtgcttgtattcatttctatttcatgaactaccttaaaaataggcatgaaataatgtcctagggttttttctatgagagtacattaagggaaaatagggtcattaagcacctcactgcagaacaggcaagagagaaacaagagacggaggcccactgggcagagcattttctctcttcacttttatcattttggggaatcttgcaaaagagccaacaaaagaaggcttggaaccttcctctgagcagccccgagtacactgacaggcaaagagtactcagtctttggaaagtgcatggttctccagctcctttttctaccactcgccctccttatgatctagccacactggtttccctttgcctttcctagccctgtctcagggcctttgcacttgcaggcttcaccaaaaatctgtccctgattttcccacaggtttccacgcccataaagaatccttccgggctactttctccaaagaaaccccacccttcagactcacattcttatctttttccttggtctgcttcccacagcaggcaccactctgggggtctctccttcatgta

SEQ ID NO: 50788 - DNA, 987 bp, Bovine  19866881030467
aatctactaatgcatgaaagagcaggaaaagattttaaaaactgaaagaacatatgatctgatttttatcaattgaaagatgaattgagagaaggaggcaagtggggacaggataaaagaatcctatgtcagaaaattttgacagagaggtgacacatttgccaaaatcatgaatttatcctagggggaaaagagaaataattttggaataaagtattcaggtggtacctaaaagtggttattagatcaatcatttaaaattgaacttactagtcaagtcagtcaaacacatagtccaagacttttacttttttttccatttgaccatgagtagtttgttttgatatgtgacatgaagggaaaattcctaggtgaggggaaaagaagaaaaattatagccggcatctaaatatagtccgccagatgaatggctcttttgtttgggagattcatggacctttttaattatgcaaaggatgccccaaaatctatacagggagcagtgaggcaagaaaaaaaaaggacaaatgtctctgcatgttaaagtgtaatgacaactgtaatttactttaaaatacttcagcacagatagagcgacattacgtgtcagtaaggctaaagtacaacccggcactttcagatgttctaaatgggatttcactctgaatgatggaaggaagcaggggacgccccaccctccagagagaactactgtgagcactctggtgaccctcttctctgatcagcaactgacacgttgttaatgaaatttgtaattatcagcataaatgaagctagaaacagactctcaccagtgaaaatagtgctactcaagatttgtaaactggccaaactgctttagcacagggattggcacactatgacccacaggccaaattcgggctcccttagtttcagcatgaccggttcactaagagtaatctttatagcttttaatgaatgggaaaaaaattttaaagactattt

SEQ ID NO: 50789 - DNA, 1433 bp, Bovine  19866881171186
gtgaaacagttttgtataaatccaggataagaatcatcctaaaggaaatcaaccctgaatattcattggaaggactgatgctgaagctgaacctccaacacttgggccacctgatgcagagctgactgattggaaaagaccctgatactgggaaggactgaggtcaggagaagggggcgacagaggatgagattgttggatggcatcattgactcaaaggatacgagtttgagcaaattccaggagatagtaaaggatagggaagcctggcgtgctgcagtccatggggtcacaaagagtcagatatgatggagtgactgagcaatgaacaacaataacgataaatacaatactggagtcaagagggaatagatggaaactttttcagattttaaaagtatatctactctcatttttgcttgtggcttttatagaccaatttatgaaaaaaaattttatcatgtgcagtttcccagtacaaacgcacatttcctcttctattgaggtaaatagattctgttcatggcaatatttacaattttttttatactttgaaaagtaacttttatgtctgttattttagttggtctttgcacaaagtctatgaaatactatcatttcctttgttttatagatgaggaaactgagacagagtttgagtgacttacaaagtacacatagccaataaacatgggctgagacttaaacttagagatgaaactcactgatggatccaactaatatgcaattatatttgtgttatctacagacaagtttataatttgcatgtaagctgttactttcttggtggaaaaataggaaactttcaaatgtggaaaaataggaaactttcaaactctgtcccaatagttaaatacctagagggttcttgcagctctagtgactatcttaaaaaggactgtcaatttctttgggaattctgcatactgtattcctcacttaaagatgcataattcacatttatatactgaaggctctgagaaatctcattgggaagaagtcttttaaacttcaactgggacttgactaactcatttactaagtgtatatattaagtgtatatattaaggtaaaatccactttatgaagtcttcgtttactactagccagttcagtttctgctggagatgtaaaatgatggtctaaaacttgaatgcatttttgaaacaataatttaatgagtttcttaaaccacaagatcatatacccacaaagatgcttggggatttgaggtatgtgggaagcagacaacttaatgtcatttttggattttacagacatcagttcttgggaaatgctttttatggatttggcaataccagttactcctcagggaagttgtgtctgctatacatccattctggattactaaatttttttagatttttctgacacaagatgaggtgattttg

SEQ ID NO: 50790 - DNA, 1250 bp, Bovine  19866881184452
acctttagatggggtcatgaattatttatttctttggtttaaagcaacccaactttcactgcatatttgcaaatttgcacgtttctaaacaaggaaattttagaacttggtcatatcaatgaaattatgatttgttttccaaaatatatgtgaatgtattttggaacaagaagagcaccctatttctactgccaagattatttccttgctttgaacataatacatcatgatttcaactgaaatagattttcaaggaaagcatattttcccatagaatttagctttctatactgaaatctttggatggagaaggaaatggctacccacttcagtactcttgcctggaaaatcccatgaacagaggagcctggtaggctacagtccttggggttgcaaagagttggacatgactgaatgacttcactttcactttcactgaaatctttggaaaggattccattgactattttaaaattacatttgtaaaactgctatataaagtatattttgggttataaagttattttacacacaattttattttataacaaaatctctccttgtaacatgcctcttcatctagtggacagtatttagggaaattctgaggctagtaaagttcaagaaagaatataaaagaatactctatcaaacagcatttctagatatttaaatataaacattttatggaaatcacttagcactactggcgagtagaggacttctgtaaagttcaacaaaataatggaaaaagcagtatcatgtgacatgtctaaaaaagtaaataaatacaagcaaattgtacctgtttttttctgaaggtagcattgaccttttacctcaacactctgaactaatttccactgagagcaggaactttgagagtagggacttcagttcactgcttcccttagcacttagcatatcaaggtgagcaaagccttcaactagtattctttttatatttttttaatttattttttctgttgaaggataattgctttacagaattttgttatctgtcaaacctcaacatgaatcagccatacgtatacattacatcccctcccttttgaacctcctttccttctgccgccccaccccacccctctagattggtacagagcccctgtttgagtttcctgagccatactgcaaattcctgttggctatctattttacatttggtaatgtaagtttccatgttactctttccatacatctcaccctctcctcctctctccccacgt

SEQ ID NO: 50791 - DNA, 797 bp, Bovine  19866881201588
tataggtgactgacatcttacagaatatctactcaagtgatatctaaatctcttcaaacatatgttggaagaggataagagataattagactgtgaggagagaacattactgtaacatgacgtatgttattttattttaagctaatatgtttgttttcaaggtcattttccactgtcgcacaaaatgtatttgtggactttgttgcttattgacaagtgtttctgaatttgtaaatgtcccttaactccaaagatgtccattcagtcatttttgaccaagattcatttggagatacaagttaattcagatagcaaaaaacttttcaattacctctcagtataactttgtaaatattcatcttctctccagatatcaaattgtacactttcttttccttaaaaaacttaaaccaaaacaatgaagtaaaactaatcaagaatttcaggtatataagtactgttttttaaaaaataaaaatatgactaagaattttgagccaatcagtaaatactaaaatagtctggagagagacaggtacagaaatacatttctgcctctctgaaaccaaaggctcaaatttgcataatcattcactttacctatttctggtcttaactagttctgtaaaatacccattttgtttgacgggggctccaaaatatgtttgggcaacaagaatgataaatgtttaccctaaaagactctcactccctggaaggaaagttatgaccaacctagatagcatatgaaaggcagagacattactttgccaacaaaggtccgtcagtcaaggcta

SEQ ID NO: 50792 - DNA, 1355 bp, Bovine  19866881223425
gtcctatttccagtaaagacactttacaggtattcaacacattttggggagcactacagttcctccaataacagagtctatattttatttcagctttccttcagaagggcccgaagtaaggtactagatgtttaagaatgatgggtggtttgaaagttagggagagagcagttcgggaggagaaaaggacagagttagccagccagggggtcatctgtcacttggtctatcaagagtattccagccctgccttgggattcagagagcgtggactggagggcacaaagggaaatgtacccacaaccagctgtgagcttccagaaggaagggagacaccaagaccagggggaggtggccacaaaacagcaggggaatcaaagggaaggcaggcgggtaaaagagcttcccagaggacgggcatcccagtaagttctggaaggagaagagaggcaccaagtagcaggggagaggcaggaagccattcggactgggaggacacctggtgctgtggggcagctgaaactagactgagccacgggacagtgagctcacgaagtgggcaggaaactggaaagaggcaaaccaccggtccccaccccatggatttcggggagctgtccatgatgccccaggtgtcttctctcctgcccttggttctgaccacatctcctctcttccggcagctgtggtcacctccaccgtctccagtggctacggaggtggcagcagtattggcagtggaagcccgggcctcagtgggggcagcggctgctccttcatgaccagtggtgggcacagcctgggcggctccagcttcagcaacagcagcagccggggcctcgggggcagtggctccagcttcaagtttgtctccaccacgtcctccagccggaagagctataagcactaaacacagtcaccctgctccctcacccctaccctgaagccagctccgcccgctcacctggcctgtctgcactcatccctgctcacctaggtgcttttccttgtctcccgtcctcgaggttcacctgtgctgccaggaagcctggcatcctgtctatatcccattccccagcctaagccagcctctgccctccctcagtccccagactgctcctagaacccactctgtgccaaacccgctctctttcaaaattcactgtcagattgtctttcagagactccccatcagctctgcctccctcctcccttcctccaaatgcagtctgtatctcccagaccatctcagtgtcagcccacctgtctcacgatgcttacgagctgcctgctggatgagagtgaagcctctctctctttcctcccaggaccgtgtctattaaatgcatgtataa

SEQ ID NO: 50793 - DNA, 1315 bp, Bovine  19866881224341
ctagctctctacaactctccttgacttttatccctttcgagaactgggtttggccagagaagatcaaagaccactctgttgagttcatctcaatggtatgtctggccatgacccatcttcctgcactgctcatcatcacagggaacaccccacccagggcaggaccaggcctgggaattgggacctggggcaggcctggtcccaagcccccccacccccaatcatcccacgttctcagccatatgctgcagatattcccatggcttttcttctcctccccttttcttgagtcttggactctgaaaccatacacttgattacagtcttcccatcatggtcacttatgagggaaaaatttttttattgaggatttcatctgtgccagaccacaggcaggtcagttataagcattgttatttgattctcattgtgaggttggacaacaagaataataattgccaatatttatggagcagcaattataagtagtgctttacacctgtttctcatttgaacttcacacagcaggaaggggtaactcatattattcttgctttgcacatgaagcaattgaggtgtagagtagttccgagacttaggacccagcagtctgactgcaggtcaccagctctgcatcactattctcgtaccgatggcgaggtggcttgttcgagggaaggagcaaattcaggatttcactccgaattcctgtaccctctacccctcaccccagcgtctcatcccgtggtcaccctgaggaccagggacatattctcagtgtcatttctctccttccttccatcctctccctccaaaccttccaaattttagcccctggttttacattcatcttttctcatcctagttcatggccccttccttcccttccatttaacttcttgctctttcaccctggacagctgtgtttgagatccctggttccaagagcccaccaatgtggtcctgagcactgaccccatccctccaagcccactcaggctgcctcaactctgggtgatgccaggggctgaggtctgatgggaggtttccagaggctgtacactcaggaatgtgggagctgcctgcaattatgggcctaaatggcccttctgttgggtgaaagcactgcccccagggctgacttctaactcctctcctggcctgttattttcctgctcacatctgcaagttggaagctgtcaggaaacaatcagccctttgctggcagagggctgggctgcccaccctacgtcagtgtccttggaactcagtctggtttggggagggggaaggcattgccctgcatgacatacag

SEQ ID NO: 50794 - DNA, 1163 bp, Bovine  19866881309496
accgctggatcgccgggaaatctctgaagcttgacttctttatccacatgcagaactaatactgtccagtctaagtgtttgtattaactgagataatgtcttcgaagtgctcacatgaactagatgttccctaagtgaattcccctaggatcttcctttctcttcatcctgcttttgaggcacctctcccaacttgggtataggactgaggtttataattttgtctcctacattcttaaaactaaaagtcattctttgtacttaccatttagagcatgaggttatccactcgtgttttacacagtaggataatggctaagcttttttttactcacattctaagtaactacttaagtaactgtgtcacctcacagacaaaaccaggctactgtgcttgcttattcttatctattctactgtaccccttttcctgattatttatttagcatgcatgtgactcacagatctttagagatcgttaacttgcttcttaaaatagagcaaataatatgtttagctgttagtcacaaagttagtccagcgtttgttcaacaagcacctcacgtgtgatcatttgtggccagtcattgactaagtgctgtttctgaaggggagataggagctataatatagtgaatcatgggacctcattttaagggcatgaaacttgattgcatcagtactttgcatgcttcaactccaaaccacaatcatactcacaaattgttaactttcaccacacccctagattaacatcaaattgatctagtttttcaacctctcatttgttattttccacccaactcaccaagattctttgagcacgtcatgtgggaagaaccagattcatgtattcacctcaggactgacaagagatcaatgcccctagatactgctcagtaccaccagtcattgaaacaatataactcttctcactgacccttggcagaaaccagatccctcagaggaaggtaaacagacaactgccaaaggcacgagagattatctaatgtcaacttgaggtctgatatttccagttgactttttaaaaaaatcattgaaacttaaaaaaaaatgaataagaatcacctcaaataaaaccaataatagatggctagtctgattaaagcaaaggtgagggatcagcccttccttatctattt

SEQ ID NO: 50795 - DNA, 1270 bp, Bovine  19866880195487
ttatgttgccctctgtgcttccaaggctcgccacagactcggcagtgagagtgtttcctggtgtttggaaacttctctctttttaagactcctttcccgggacagagctccgtccctacctcttttgtctctttttttgtcttttatattttttcctacctccttttgaagacagtgggctgcttttctgggtgcctgatgtgctctgccggcattcagaagttgttttgtgaaatttactcagcgtttaaatgttcttttgatgaatttgtgggggagaaagtggtctccccatcctattcctccgccatcttaaaaagaagatctattagctacttattaaattactttagccacctcatgtgaagagttgactcattggaaaagactctgatgctgggagggattgggggcaggaggaaaaggggacgacagaggatgagatggctggatggcatcaccaactcgatggacgtgagtttgagtgaactctaggagatggtgatggacagggaggcctggcgtgctgcaattcatggggttgcaaagagtcgcacatgactgagtgactgaactgactgaactgaatagagcatagcatggatttcccagtcctgaaattttttattcatagtcttattttccacagaattattaatgaaaaaacaacctttgtttatttgtatatccttacaatatggcactttgaagatgtcttttatttcatactcacattttgtagctaatgttgcaaagcagacattcctcactgtaactataatttattgatgcttaaaggttcaatgaattattcagcccctttacccttcttgctttgctgcacacctattgagttttcagagcagtttcatatcaataaatttgttcttgctttgcagctccaatttcatggttggccttttctaagcaacatacaagaaaaataaataaccagaaggaataaaatgtgtatacaaattgctttaaataactcaatatccaactccaagttcccatgggttttaaaaattaagacatgaaagcatgatatcagaaacagtctacatgcaaatgtaatcagcaaaaaacttgttaacatgcagtctgtatagagtgacatgccttcattctgctgtactcagaattgaaagcactcttaacaagtaagcccctaagtgttcgactcactgccactttgcaccttatgttatcacatactcacagaaacggtagacaacaaaatgatgaatggctaatctgatcagaatga

SEQ ID NO: 50796 - DNA, 1955 bp, Bovine  19866880486847
tctctatgcagatttattgatctaatgtatatctaatccattatatttattaaaccaaatctttgccaatatgtgaatcctgaacattagcatgacctgtacttttcttttgtaggctaaagggaatgtggtcagacaatattccacatgggaaaattcacagtgcacttgtttgaccatttctgtatggcagtaggggtagacaatcacaaataggacccagaggaatatcctctgcaacagttgatagaaaatataaggcttatctgaatttatgttctcatttttaattattcaaaagtgttcaattgaaaaatgaatatgttaataatatttagccattttaattcatcctcctatttataactgatgctattgtcaaacgaaatcatgaatataatcctgtacttgattatgtacaagttatttaaaatatcaagttcagttctgttcagttgctcagttgtgtccgactctgcgaccccatgaattgcagcatgccaggcctccctgtctatcaccaactcctggagtttacccaaactcatgtccattaagtcagtgatgcaatccaaccatctcatcctctgtcatccccttctcctcctgccctcaatctttcccagcatcagagtcttttcaaatgagtcagctctgtgcatcagatggccaaagtattgaaatttcagcttcaacatcagtcctaccaatgaacacccaggactgatctcttttaggatggactggttggatctccttgcagcccaagggactctcaagagtcttctccgataccacagttcaaaagcatcaattcttcagcactcagctttctttatagtccaactctcacatccaagactcacatctcacatgactactggaaaaaccatagccttgagtagacggatctttgttggcaaagtaatgtctctgctttttaatatgctgcctaggttggtcataactttacttccaaggagtaagcatcttttaatttcatggctacaatcaccatctgcagtgattttggagccccccaaaaataaccccaaaaataaagtctctcactgtttccactgtttccccatctatttcccatgaagtgatgggactagattccatgatcttagttttctgaatgttgagctttaagccaactttttcactctcctctttcactttcatcaagaggctctttagttcttcgtcactttctgccataagggtgatgtcatctgcatatctaaggttattgatatttctcccggaaatcttgattccagcttgtgcttcttccagcccagcatttctcgtgatgtactctgcatataagttaaataagcagggtgacaatatgcagccttgacgtaatccttttcctatttggaaccaatctgttgttccatgtccagttctaactgttgcttcctgacctgaatacaggtttttcaggaagcaggtcaggtggtctggtattcccatctctttcagaattttccacagtttattgtgacccacagagtcaaaggctttggcatagtcaataaagcagaaagagatgtttttctggaactctcttgcttttttgatgatccagcagatgttggcaatttgatctgtggttcctttgccttttctaaaaccaccttgaacatctagaagttcatggttcacatattgctgcaacagaatgatctctgttcgtttccaaggcacacaattcaatatcaaggtattcaaggttacactggcattattcatttggcttcccatgtggctaactcagaaatattaattggaacttgttgtcctttccttctggcccaagtacagcaggctctttccctcctcttaagtgtttagggacttggtaaatgatgttttcatgtggctcacacattttttagatatataccaccacaaactattatttatttttttagattccagat

SEQ ID NO: 50797 - DNA, 988 bp, Bovine  19866880501378
tgctgtgtgtttctcaacttgataattaagtgcagtttatcagatgctgtcatataagattgatgtgcttttaaaacacattttcctcaagatttcctaagagcaatagaattaaagtgtcacgctataagatgaatttgaaagttaaagccaaaacaaagttttctctaagaatgacattcaaatagtcaaggttacatgatgcatattttagtctgctttccataatacttagaatgacacatttatttctgggaagttgtgggagaccttaaccctaaaagaagttaaacatgaagctttattttcagctcgtcttcttacagaagttaaataacccttcatctgatccaggctttcagattttcatagccaaatgtcgtctctatctcctgaatacctgatttttaaagacataatactttcttatgttatgcaaaatatcagtacttttaggaaaaatatcagataattcaactatatatgaactaggttctatcacttgcttaatttgtcatgaaaaagctaatgatagagaaacagctcaaattttgtttttctgtttctgaaaaaatgtttcactcatttcttatgttagaattctgcagtaagttcattaccaagaaagctctttgtttcttcattacatcatatgatcaaatagtggaagtcatcagtccagaatatttcctgattttgtgctaataaatggccaagaagctctgaatatatttagaaattagtaactaactcacctcagttatctggtgcatgtattttcctgtttcctttagtaaattattgttcagtttttatctaatttcctcctttagacactgtaactcaatgttcaggcttatgtcaatttctaaagaaagtacatgttatgtaaaaaatatatacactgagtttcttggttctcatcttttatagttcatagccattttttttctggacttgatagtcagaagtaatcctactttaatga

SEQ ID NO: 50798 - DNA, 1554 bp, Bovine  19866880622377
gttcttaggataataactgatgcagagtaagtgccgtgtaaagtgcttattaagtagatagaagtactttattatatattcatatcagcagatattataagttgagagcaaaaccatcttttaaagatacgttagtggtttcctgggtgtttcatacagggttgcatagttcaagctctaaaaggtactttgcaaaagggaattttatggagtcccacttccctggtgcctccaacagtaaagagtctgcctctgatgtaggagacctgggttcagttcctgggtcaggaagctcccctggaagaagaaataacaactcactccagtattcttggctgggaaatcccatggacagagaagcctggcaggctacactccatggggtagcagtgtcggacacaactgaactactaactcacaatcaaccagcaccatgaggcagaaaacaaaaatggcaaagagcatcagtttttgtggtgttgaccacacttgaaaaattctgactttgctactcattgcttccatgtcctttgaaaagttacttatcttctttaaaacctattttctacttctttattttagctcagtactaagaaaagaaaaaaatatatgtaatttgtatcatccttatttactttctattgaaattcaacgactccttctctatcacccgagtgattgacttgccgtctttgatgtatcaaaatataggccccaaatctgttactggtcattttatacttggatgattctaaattttattgtatgttagatagcaaagcatctgtattagttatgtccaataaatatttgattttcttgttgatatattctagactgaattactttcttttaattattgtttgctaagcaaaggggcatgtgattgtacgtatgggtactccaaaagtagaagtagaaattttaggaaattgtaatgaacatcttatctgtctgtcttctcctttgtggttatctatttatggaagaggtaacaactgtagttatagagattaatcttcaagtttcttggagactcaataacttcataggaagctaaagcactgaatgggaaataaaattttgtggataaacactttttatatttccccagggaatgccttctgtttatatgaacaaaagcttcattcgtaattatactccagtgctttgttttgcatgacatctaacttgaagttttctagttgatataagtgttagtgtcattttgaagatgagtattatgatcaactcgtttccaacacttttttggtagaaggtgttttatatagagaatttaagtagattgttcgaattttgaaatcttgataatatagcctcatttcctccacaggcagtctaggtaaggaaaatatgctctaggattcccagtggatgtgccagtcggtgtttaaaagataaatttcctcctttaacagagatgggaaaagtgttactgacgttgcaatctgcagttttgatactcatgtataaaagggggcagatgttcttttctgccaaatcattcccataacacatttacccaatatttgg

SEQ ID NO: 50799 - DNA, 1201 bp, Bovine  19866880647064
actcttcttagatatatcagaaaagtgaagtcataaggcaatatattgtccccaaattggagagacaaacaggtgaatgctagtgtgcatactggtacacagtgtataaggggaatgaatgatatagctactttcaaaggtagtctgacagtttttttaaaaaattaaacactcttaccacaggatccaataataccactctggtatttacccaaatgagttgaaaacttaggtccaaacaaaactcagcatacagatgtttataacaaaaattgcccaaacttgtaatcaaccaagatgttcttcaacagatgaatgcataaacaaagagtggtacttccatagtatgggatattcagtgatttaaaaaaaaatgagctatcaaattatgatatgacaagcaggaatcttaaacacatattgcaaagtaaaagaaaccaatctgaatagtccacatacattccagctataagatattctggaaaagacaaaattatgaagacagtaaaaagatcagtggttggcactattaaaggggggtagatggagcctgaggatatttagagaggtgaaacaatgaagttttaattgtagatatatgtcactacacatctgtcaaaacacacagaaggtataaaaccaagagtgtagatgaagtatggactttgctaataacatatcagctatagctattatagctcaactgtaacaagtgtaccacactaatgcaagatgttaaaaaccagggaaattggggagatggtaatgggatatatgggaacactgcactttccactcaatttttctgtaaacctaaaattgctcaataaataaataagtctattaatcaacagcatagaagttcaattcattatcatactttctcttaatcaataattattaattaaaaataatttgtactctgagataattatattgccaataaagttcaacaatctctggaaacaatcaggacagtaataactgctaggaacctagtatttataacatttcaacaacttatgttcatttcttcttaatcctcagagaggctatattgttgattaatattttctatttaagttggcacatgctcattgcccataaacatttaggaaggctgtctaagtacatgatactacttcttattgaagtaatcagtatcaaacatttatctttatagttcatatattttggatat

SEQ ID NO: 50800 - DNA, 1463 bp, Bovine  19866880739679
gcagagagaagggaaaagatgtatgatgtgttttggaagtaacgtcaaccagccattgctatgagttgcagttgaaaaagcaagaaagaaaagagaaaaagcaaggataactgagagttgacctttgagtactgtgcagacattattgctcttttctgagagtgggaagattaggatagggataatctgtgtgagacacaaagggaaattagagttttgctttggccaggttgaggttgagatgcttacttagacatgcacatgttaggcatcaaatagaaatttgaattaatgtgtctgtatgactcagatggtaaaggatccacctgcagtacgggagacctggcttcgattactgggttgggaagatctcccggaggaaggcatggcaacccactccagtattcttgcctggagaatcccatgtacagaagagcctggcgggctacactccatgcagtcgcaaagaatccgccacaactgagtgactaagcacaaacccagaaagatcagggctaaaaataaagattgtgtattcttgataatatagattctattaaaagctatggaagagagaatttgtgcctaaaaccagaatgggatgctccaatattaaatgatcaggaaagaaaaaaaaaaatcagtatccaatgaaaaggaaagaaatgccaagagtgtaatatcaagaagctatgggaaaacattgcttttaagatagccaacttgaggaatgatactgagaagtaaatatgataagaaaagataaacagtagatttgtcaatccagtgattaattccaaaagcatattacccaggctttataaatttcaaatatgcagagcaacttattcagttaatttgtaaagcaaaattctaaaatagaaatattttttgcagcttgttctcagctattaaattattggtttatttcttttcaaatcattggtctatgaattttaaggatatgaaaatgaataatacatgccctgaaagaatttttaaaatatgttttaaagtaaaacatgtcttaattttggaaggaaattatatattttattaggttaaataagtatgatgaccaaacattcatcttacatgagtaccctccatattgagatgttattcttttctttaaaaaactattatttatattacttaaaattgttatttatactgcagaggcaatctagtatagtgatcacagtatactagtctgtgctaggacaggctgctcaaatttgaatatcaaatcacagtaagtgagtatgactttgggcaatgtgttaatctcaccatgaaaatctagtctctctctgcagtggaattactaagtaagtgcatgtttaaaactactagataatatcaaagtttttccaaagtgctttccagattgctctccctttgggtatgttcatgtaatagaatgctttatgttcatgtatcatcatgtctcacaaagcata

SEQ ID NO: 50801 - DNA, 1201 bp, Bovine  19866880801410
tctatatagctatagtatttgaaagagtaaacatttgtatttctaccagtaaatttatactaaaagtcaatactagttttctcaagttttcatttttatcaagattaaaaggaaatagttaaggaataactggcctgcatctaaagagttactagatgttaaaacacctttacacatctataaacatgcaaacactttatgggttattattattcctaaacaactacattatgttgtcaaactttgtaacaccattttttatatacttgataattaaaaataggcattttcaatgtagttaaatatggctatgtttctgattttcaaacctgaacaaaacacaatttaaggaaaaatgtgtctcagaggaatacaatcacaggctttccacagcgctatttgcttaaatggctctctgctctctccttccctcccctaccagaaattctgaacgtgcttagcatcccccagagatcctgtagggtgccatctgctgtgtatctgctatgttgcagcctgaaaatcttgatgtcagatttagccccgcaagttacacaacggtatgtgagttgtattacaactgaggcattaatgcttgactcaagcagaaaattaaaagttagacatgcatagcaaaatcatattagtggttatttgattaattattgaatatgattataacacacataaccacaacaatatatttgaattatattcaggtataatgagggtggcagttattattaatactgtgggttgtgttagtgttagtcgctcagttgtgtccaactctttgcaaccccattgaccgtagcctgccaggctcctccatccacacgatttttccaggcaagaatactggagtgggttgccagttccttctccttctctgtgggttgtaatttgtttttaataagtaaaaaaataatacatatgactacagattacataggtatacataccaggaaagaattctctggctgactggtataccctttctcaccacgttattttcagctcaacattaaataaataccaaaataaacactgatggcaaagaaatgatcaaaatatttctgcaattttcatgggaagagaaatacagaagaaaatagcattgtaggagatggagttggtagacagggagccactcagagtacaaacaattggaaagacagagattttaaggcaacataaagat

SEQ ID NO: 50802 - DNA, 2827 bp, Bovine  19866880884608
actaaaatcaattctagatttcctaattccataattattcataaatatggaacttataatatggtggattaaaggggttacaaatcctttgctactattccaaatgaaagatggaatctaatgttctcttcttggatacgggttggtcttatggccttgcttgaccaggtgaatacaatggaagtaattctgtctgattctcaggacaagatcagatttcagttcccaggatggtctcttagaatgtacctctcaagttcctcccctgtagaaggaacacagcagtcatgctaaaaagtccaaactacatttcattttctttgacagcctcttaaggacacacccagcatcagcggcatcaactttcgatcctgagaatgagtcatctacatacttagcctagtgaagtctttagatgaccaaagctctgaccagtatctcatcataactgccagagctaaatcattcccaaattcctgacttgtaaaattgtgaacaaaataaaagtatagttttaagccattaagtttggggatgatttgttatagagatcatcagaacatatggacaaattaaatgattacaattagaattagtgtgaattatgactcataggtatataaaatatatacagctaattaaaaatattttttgatttaaagtatgatttttgtgattaaagttatatttattgtaactttcaaatttatttcatgtgtaatataaatatattctcagtatttaacatacaggagaattaaaaatacagatgtaataatttcttaaaaattcttattttacttttattttctaaatttggaaaattaaagccagacacatgaatatttggttaatttgccccaaattcatttagctgacttcactcccatatattcctatcatttatttttgcctgaattagaatcacctcattgtttgaaacatgtatgaatagaaatcaagttccaagaaattaaaggcaagcagatactgtaaatcatctcaaaaattatcttatgctgaaattagaaatgcagattaaaaaattaatttctaactcatgaatcttcacataattcttcaggtaaaattataaacataattcttggctaatatttacaaaaacatgtcaaaattggtactgagtcatcatgactctctatttatagacttgtggtcctttctctggagggctttattttatgacttacaagctgttccctcattctggtaagtgaaaaggtcaaaagatcaaaaaataaaggaaacagacaattctatcagagtaaacaaggacagattgttatgaacaagtgaaaacagagaaaaaagaaataggaatatggtaggagaagacagaaggacagagatcagaaaacacaaaatatacaataattgacagtgtattttgcagttctaccgaaacacctgacttcatgtaatcgttatgctaacaaagcagcatgttacctgcaacaactgggtagctagtgaaataaaccagtgcaggcatataatcatctacacagagctataacagagcctgcttttcaaatcctgaaagcacagtcaataaaacaccaccctaattgtttatttagtttaaaacaatttttaaaatattttaaaagtcatttcagtatcaacaactgctacaccatgctacaaaattttcttttcataagcattcaatttaaaaagattctaggggcttctgtggtagtccagtggttaagaatccaccttgcaatgcaggggacactggcttgatccctggtctgggacgatcccacatgccacagggggaactaagctcgtgtaccaactacagagcctgtattctggagcccatgagcagcaactactgagcccatgtgatgcaaccactgaagcctgtgtgcctagagcctatgtgtcacaacaagagaagccacagcaatgagaagctctcacaccacaacagagagtagccctgctttctgcagctagagaaagtgtgtgctgctactgctgctaagtcgcttcagttgtgtccgactctatgcgaccccatagacggcctcctaccaggctcccctgtccctgggattctccaggcaagaacactggagtgggttgccatttccttctccagtggatgaaagtgaaaagtgaagtcgctcagccgtgtccaactcttagctacctcatggactgcagcctaccaggctcctccgtccatgggattttccaggcaagagtactggagtggggtgccattgagaaagtgtgtacacagcaacaaagacccagcacagccagaagtaaatacatattaaataaataaatatatatatatacattctagatttgatttataatgtcattgacttcagagatgaactaacattccattgaatatttacaaaaacattgtgttttttaaaaatattgtttacatagcaatacaaaattttaaaaaggcataaaaggtgttcaaagtaagcaccttagacatgtatttctaagaatataaatcaaatcagtaaacagcattatcccttaacatagtggtatattggctatctttcaagataatgataataataccttaagctaaggctttctaatttataaaacatgggctttatttgtggttcagctggtaaagaacctgtctgaaatgagggagacctgggttccatctctgggttgggaagatcccctggagaagggaaagactacccactctagtattctggcctagagaattccatggactgtatagtccatgggaaggcaaagagtcggacacaactgagtgcctttcattttccatgcatagaat

SEQ ID NO: 50803 - DNA, 1137 bp, Bovine  19866880938211
atggttgaatggcatcatcgactcgatggacagggtttgggtggactctgggagttggtgatggacaggaggcctggcgtgctgcggttcctggggtcgcaaagagtcagacccgaatgagcaactgaactgaactgaactgaaccagaattcagcttgtattaattttgcaaagttacattgtaccacattttctaggtgtacaacttcatctctaagaatggcaatagtaataaaaggctaaacattaagttttagcaaaattataactatattacaagagtcataaaatataggatgatactaattgccactggcagcactgatttgtttagcaggatttttaggtataggaggacatcaaggagaaagatgcagagatttaatatgtgttgagaatgatgggagaaattttattttgcttggaggttagctaagtgaaaaatttaatacagccatagcaagctctgggataatgtgaaggacagggaatcctgacattctccagtccatggggtcactaagagttggacacaactaagcaattgaacaataatacgtatcattaactgtgagagtctagactctgcacaagttgttgagaatactgataaaaaatagtaagccccatccctaattccatgaaacacacaaattactggggaagactaatgttaattcaagtacataaaaaggaattcgtaagtacacactaaaataaatgctcttaagaaagtgctcttaagagcataaaacattcaatacaaaccagtgggctccaaatttctattatataactccaaatagaatttttaaaaattacataccttctcacacatgtttaacttggcacttgaatttatttatcttaaatttttcatagttgcaaaagttatttcccacttatgggaaatcttagctaataaaatacagtgtctctctattaagtctctgggagaaggcaatggcatcccactccagcactcttgcctggaaaatcccatggacggaggagcctggtaggcctgcagtccatggggtcgctaagagtcggacacgactgagtgacttcactttcacttttcactttcatgcattggagaaggaaatggcagcccactccagtgttcttgcctg

SEQ ID NO: 50804 - DNA, 661 bp, Bovine  19866881172497
tatttacttctattgctgctatgtccatgcattgatttaataggatttagtggtacaccatttatcttttgctcttaaataatccccaaataccttctggaactgaaaaagataattacaggcactgactagcataccaatgtcttattaatttctttaaaccaacatcactaatacagtcttctgaattagtgaatttgcagacatgtgcaagagatgtattagaatactaagacaatttatttttaagaaagtactgatttatttattaacagtttaataaagttattatattttcaatcaccaagggccaagtacatcatttttacattctggcacataaaagggagcacaactttgcagagaaatttacaatactattttagctcttgggctttggtgtgggctgcagaaagtaatttaattgaaagttagcatttttttctttatgtgaaatatttgttgaactgtcaaaataagattgtaaaacatgttttaatacaagatgacttccagtagcgctaaatgattttagaaaactttgattcaaatatctacttaaacaaagctatgaaattttcactttgcctaagttcacaactttaaattttctttcgagaaaacataaatgagttatcttctttatgtgaacctaacattt

SEQ ID NO: 50805 - DNA, 1525 bp, Bovine  19866881275676
ccagtatttatatgctttgaaaaggttttccaatttaaatgatcactactcatttttctatcaaattttgcttttcaaactaaagtacgttggcttttctcctttctttttatgtatattagttttgactcatctaaggcttaatatttagtaccattttgacgtatgtcaaatgacatcttcgcttataaagtaaaaatgtagaagcacagttagctagctaagggactctatcagagatgagcactaggataatagctctgaaaatgtggggtcagttattttacagaattcagtgtcctcaaatattttgcagtctgtgtgctcacagtgtaatataactttcaagtgatatctatttaggaaatcaatattttttttattttactataggcagataaagaaaaatgaataaacttgaattttaaaatttggcagtaggctataaaaatgtaagtgcagaatatcatacttaaaatgaacctactttagcctgttacaagtagaaaaatgcaggtactttattttcacatgagtcatatttggagaaaaataagcattctgaaatagtcactgccagagtgctcaaattactgagataaataactgaactttaggcatagctaatttgtgtaccttttgtcacaaaagtatttgagcaagcagcaggtttatctgtcactctctctgaatacacatatacacctagtagcatgtatgtacattgcatatctcaggatattttcagacacgacactccatttgtttcttaaaatatcctcatgagctaggcaataccatccccatttaacagatgatgatgcaaaggtccagagagcataatgacttggagaaagcctaagtgtcactaatactagagcaagtgattttgaaggtaaagggatataggttgtgctaagctgagctaaactgagaaattaaatgtctcagtaatttttttttcatgtaataagagcctcaggcttgaattacagggaaagaaggttaacaatcatgctgttatataatgttgaactaggttagaaacatttttgaaagttttcttttatagtatcatcctattcagacatagtaagaacaccatacatgtgattagaaactcataaaaatgtaaataaaaataaataaaaatagatgtattttataaataaaatagctttctaagttttaaaagtttaaatactaactggaatttaggttatttggagagaatgacatacacctgtattttaggttctactaattagaactatgaatctataattacaatgaggaaagttatacaagttgtgagataacattcactaatttattcactcactcattctttcattcaacatttattcagcgaatagctacaatgtgcaggtcctctctaaattttagtaatgtattcaattatgggtccctcaattgaaaagaaagcatatcaccacactttgaatgcctaccaagtgggccaggttattttcacatctaatgcaaatcattgttattttaataa

SEQ ID NO: 50806 - DNA, 700 bp, Bovine  19866881307717
tttgtcacttgagaggtgcagacttaggcttcttaaagttctctttatgaccattatgagatgctttctagctgtcaatgcaaattgccccacagagtgattgcccttgtcttttcctttgtttccagagatgtaggaggaatgtccactaaatgtcaaattgagcctcatcctttagctcatctgaactcaattttagctaaaatctaaattatgagttttctaggaaatggtctcatgtatttaagcatatatttaacaaagaaaaacttaacaaacagctttctaataaaacaccaatgaggcatattttagcattggtatataaaataattggtatagagtagacatttcacaaatcattttcctctgaaataaagtaaatttgtaaagtcacataaaatttagaagcaaattatcttctgtctagcaagtcatctttaatttgaaatctttctctaaattaagatcagtgaaagtatatctgataatgtttagcagatctgtatcttaagagaaaagctggaatgatttccttggaatgtcctttttttccgaatgctttctctaatccagaattaagtttttgaaagtataagccctatttttgatgaagaatatgtgtctgagttcagttagtctagaatacagctcaggtagaagaaattagactgagaccaaaaatacaggtcaataaaaa

SEQ ID NO: 50807 - DNA, 858 bp, Bovine  19866881404460
cagcaagaaaatagtttcatgaaatgttgaaaattcactagcatttagaaaaacagtaaaaatagtttcaaaaaatgacttgaaacataattttcaatttcagttccttttttaattcattaaggccaaatgattcagctaactttgtcatttttcagtgagaagaaaccacagtaggagacctgaacaatggacacgtgggatagaagaaggttaagaagcagatagaaggaaaaaagaataatgacaaaatgtgtgatgatgtatataatcttatagcatatattgtgaagaataaagcaaggctaaggttcgtgaacatcccatttagcaaatgatctctaagaaatgcttactcttgtaccaaatccacctctacctaacctgtaagcaacctaagatgcaggatgtatttgacttttgagggtcaaatgagggtaaaaagtagatcactgaaagtcaaatcccgagcttggtgcattgaaattgccccagaaaaggatcctgttagatttgttatgcaggttgttcgtatctcttctagccctatcctcaatgagtccatgcttggttcagacaaaagctctgaattaaaagtaaacaggcaagctatcaaaatcaaaagcaaacacacacacacacacacacacccacccacccacacagagcaaacttaaaagctgaaggaactgatttaacagacaatcagctgccaggagtacattacagagtctgaggtctattgcaacaacagtattgacagaaagctcaaagaaaacaatgtccctttttagccagagtactgtttctgttagaacaactgtgtctgcaaaacactctacatcttggcaccactgt

SEQ ID NO: 50808 - DNA, 1726 bp, Bovine  19866881418248
taaaaacaccagcaataatttgtttatcttaacataatcaaaattctgtgctagaagccattataataaataaataataaagatattcttgcaagagatttggcaatgtcagtagcttatttgttttgtttttctcaaagcaaactaatcaacagctgtgaccacacacagcctaagttagaaaatgaaatattgacaactgagataagatatataatatatactttataaatgtatcaaggcttccatttagttattatttcagagcccaaatgttctgaacacgcttgctaatgttttaaaaacttctttagatagactgttttgagaaagatcctgaagttctgtggatatgaaatctttgagacatttttctattgtggaaagagagattttatacccgattcctgtgtgtgttcatttgcacgtgaggtgcacatgtctacacactctttaacaattgtctctcagtcttctctatgaatattttagcaagagtaaacataaacctcattatggaacagcttggattgcttgaacatatgaccaatatggatatttgtgaatctttgtttaccatttctatgtctttcatctaaatgatgaaacatatctggggtacaatgttttgaaggaaaataaaaaaatatctttttatccccaccccaaatatattttatccatctctgtcccagcatctgaaagggagaaagtaagccatctggaaaagtttgtgagaattatagcagttagatgaaggatacagacatggctcagatggtaaagaatctgcttgaaatacaggagaccaggttcgatccttgattgggaggatcccctggagaatccactcaaatattctttcctgtagaattccgtggacagagaagcctggtgggctgcaatccatggggtcacaaagtcagacatgactgagtgactaacactttcacttttctaatctaaaggtaaaagaaagactgactttaatggaaaagtattttcttacagtaagatgaatgaagttccttttgaaatgaagcaggaagaaggactagtaatttcagatgcgtaagtagagatgcttcattgtcttaaatttatgggaattgttttcattctctgggttggtgcctcaaatgtttgaagtgttaaaaggtcccccaggtaattctaattgctagctatgtcaaaagccactaacctggaaaagtaggtcttagatttgccaggagagaggaatagagttgaaatacagaaattgaggaagaaaagaaagggaaagagagatattgatggaaaggagatgatctggaaatatataaagcattaatatcagaaatcatatggttctagctcttagtttttgattcctcgggactttaagtggcctaggatatccataaaatgtcttgtcccatgtattagccctggatgcgatcttgaaacataaaaaggcattaagagattgtgggataatatgaagttctaatctcaaagagatatctgcattctcatgctcatcatagcatcattcatggtagccaaactatggaaacaacctgtgttcattaatgaatcaagtatttgtggaatatttttcagcattaggggcttccctggtagttcagtgtggcttccctggtggctccgacggtaaagtgtctgcctgcagtgctggagacccgggttgatcccgggtgggaagatccccggagaaggaaat

SEQ ID NO: 50809 - DNA, 1273 bp, Bovine  19866881421801
tgtaaaatatatgccctgagtggaagatcttaaaacttcaatgtttctgcctaaaagagcagtctcaagacattgtgactgttctgagtcaagtttaggaagtaactgaaaggaaaacttacacctaaagttaatcagtcactttgaaaatgacaatcttctgtagaacaacaaagtgttagtcactcagcggttgtccgactctttgcgaccccgtggactacagcccaccagtctcctctgtccatgagattttccaggcgaggatactggagtgggttgccatttccttctccaggaggtcttcccaatccagggatcgaacccaggtctcctgtactacaggcagatcctttaccaactgagctacaagggaagcccaaggaagttaaaaaattgtccataatggtgtcaaattaattaaaggatctgaatcttctcactgtcagaaaattaaatttcagtgtagcattttggtcattcattctcaactgctttaaccaaaatgttatttgcagtagttcaaactataaaatttttataggcagcaaatgtgctttgttgaagtatctatttatacagctgatgtaatcagaagaatcttgcctacctcttaacataatcttgtaatcgacaacattgctacctgactacatctattcatcttccattctgttgtaataacacaactgacacctaagaaattattctttgatctttcaataaactaaacctgtgcagacagaggagggtgaaagaggttaaattggcattgattatttaagacacattcatcatttatttaacaatctccctcatcataagaactattgtgtttataggcctttgctgagacactctgaaattatttttaaataattcttgccacttgcattagaagtcagagcatgttgtactttaacattagttttaagactcttgataaatctgtggcaggctagaagttgtttattgtacaaacctttgaacttaatcactgtagtgaatttggaaatttggaactttcttttaatagttttcattataattaatatcttttgggaaattaatatcttttgaaattttgaaatttcttttaatagttttcattataattaatatctcctggggattctatttcccatcttaagcaaaatgtgtagtaacagctatcttcacaaggaaattatattaatagatactgtagtctcttatagggcttccctggtggctcagagggtaaagcatctgcctgcatgcaggagacctgggt

SEQ ID NO: 50810 - DNA, 1342 bp, Bovine  19866881442866
tattagcagctctttctactatagcttcattcattctaaaccttcagcattctttcatggaaaaggagatagtaaagtgcatatttctgctttttatttaagcatctttataatggtataaagtgtcacagttctttttttttctttccttttttgtgtttttgtaaatgattcacagatccttctcagtgaatgtcaccgaattacgtatttcttttgtcaatagtgaagaaaaaactatacaaacaggtctgtacctctgaatcatctttaacaccatattaagatgaatttacttggcatttattgctaggcacaacaattagcatcacgtgatgtatcgctatagcactctataacggaggtaaaacaatcatgattttctgatggatgctggcatgggaaaagagaaaagacataggtggaaatgggcgatgaaaatagctcattctcaaagtctgatggcacttaggagattctacatattaaatttacatatacatctctcattgacaaaatgttcatgttaaagcagacaagttgtcacagaaatctcctgagatgaagagcaaacatctgactctctgcaaggtgcatatatttataatacaggtaagccagtttgtaaaatccatgttttctatctaaaaatttacagatcattttacattttctaaatatgatgacttgagaaagaaagtggttggaaagttaagcttgtttaaattcaatagaaagagtatttttttaatggattttttttccttttcaaggaaagaggtctcattagctatgactaaaacacagctgtgtatgatataagggtcctttgaacaagtctgtaaaggaagttaggatttaagaaagcttactgatttggttaccaaagtgctattattattgctaagtgaaaataaacttaaataagagccacttctagtcttgccccagactttgagccattcttgaagcttcagcacacttggccacattgcactgcagttttcttaaatgggctggataatgacaaacaggtaaggaaaaggcaaagagaaccatttactacaaacacactgtaggtaatacacaacagtggggattgcatattgaccttggggcatttggtctcagtcagcatgccatgctacagcacagaaacagactgtcatgtttacaacacagagctgaatataagagactcacataattgcctggcgtagtaaggtacaggagcacttccataagctgtgccctgtaaataaaacacattttttttggagcaagtgatcattagtaacagtagaatatggtggagaaatgaataaagaaaacgaaaagaaat

SEQ ID NO: 50811 - DNA, 686 bp, Bovine  19866881464577
ttcttaatcccaaaatggcttaatacacaattgattgatttagtaatttaaaacaataattaccaaaggtattttatcccaatttttgctttcttaatcttttctttccagataatttttaaacattattttcagaaaatccctacatgaaatttctctttcagtgatttcttttggctttcaaaattttgaaagggttaaataagtgtaaacatatggttattgtgtgtaaattgaatttcagttggagaaaaaaaagcacattctgaaacaatgattctcatcgaatcttactactgctacatataaaattgaaccatttaataatttggacaaaaggcttcagaattttcagactaatatgaggaaataatgagagtcacagggaatttttttccagctcactcctaacattgatcagcagcttggtaaattctgctctgaatatgctacatagtaatttttgttctttttttttttttttttttcctgttaggaacctttccctgaaattagcaaaagacattgatcaggaagccagatgttcccatatcaggggagtgcctagcagtccatcttcagattggcccctgccaagtgtggaagaaaatggaggcatagattctctgccattcaaactgatgttacaagactgcacggccgtcaagacattattattaaagatg

SEQ ID NO: 50812 - DNA, 560 bp, Bovine  19866881756748
ttttgattttaatctaagtgactgaattacagtggcacgtttagggactgtcaaagttgtacgaacccgagcttgaggcaaggatgatttctatacttcccaaatcacatcaagtataaatggttcatcattcagatttaactcttatgatgggaaaaactggcttaaagagagcagaaaataaaaacaaacaggaattcccaaattttaattactcagaatatttaattgtccttatacagctagatctcaaatctgtgaaattgtgttaacttctaaattttaaaaaggcaattttatggaaaagcaggtaattatttaataataactttaaaggcatgagttagtgtcaaggcactgcatattcaagtaggtttccagctgccattaattgaaaaaaaatcaatacatttttcactattgctttcaatcaaagatgcaaataattatttgaggcacaaaatacaaatttatgtgctaaatttgctcttctgtgaaaagaattgttgttgtaaatgtattgcatgaagtgcagacaattccatcataggcttctgtta

SEQ ID NO: 50813 - DNA, 1221 bp, Bovine  19866881778679
ttgagagagagaaaagtagaagaaaaaggaaggaaggtaaaaagaaataattaggtactatgatcccatatgtcactgcaatttgcatattgttccttccacatacaaaaactactcccaataaggaaaataccagtaattgaaacttttgttgtatttattgttgttttgaaaagttgttcagtcgtgtccgactctttgcgatcccatggactgtagcccatcaggctcctctgtccatgggattctccaggcaagaatactggagtgggttgccgtgcccttctccaggggatcttcctaacccattaacttgggtttcctgcattgcaagcagattctttattgtctgagccaccgtggaagccctttattggatttgcaggagggagcaatttgttccattatctcactttctaaatagcagtatttctagggaggatagacagatggacagactgactctagtgccacaagcatatttgcaataggcatgtgaagaaagagagagtcttctctcatttaattattcttagtatttattggggatttaacgggaatccctcctcttttaatgtaaaaagcatttatgataataaaagatgagaaattttttcaggagataaaattttgaatatttcctagatgatcatcagtgctacaaatgaagctaattctttttatcaaccttaactcagatctgggctccaggatgtgccaagtgcagagcaatagaataaaagcttactaccatagcaaatccttttagattgtggcttcactgagagaccgacaatcattactaaacaaaaaaaatgctttgtattttatttttacttaatgtcttgggatttagcaagaagtgcattgataccatatttgaagacttagttatggacattatcatatgtatgaaatattaatctgccttcagatcttctttgttaaatgaactatttcactttaaaatttctcactggtactagttacttctttgctatcagtaataaatgtagttttgtttttttttttttccccctctttcagggtttgaacttgaaaagattggagtcagtacaaggagggagagaggtaagaaaatcaaagggagagggatggagaagaagagagaaggggtttcagtgttgccctgatgtggtgggtgatgctgactgatgctgatgatgataaggatgaggggggatgtgttgaaagggattt

SEQ ID NO: 50814 - DNA, 1422 bp, Bovine  19866881797907
catagagtacttgctttctgtactgtagttgggatatattaacatttatttttgagtgttactgtgataatttgatgaggtaacatatttgaaatcccttctaaactgtgtcactgcatacaaatatataacagggttactatcattattattagaacaagctcgccatctaatggctatcaaacagataacaggtctaagccttttaaggcagaaatgaaaagagcaatagaacctggggattaaacccatgaaaagactttgtcacaattttgtctccgcgtgtgcatgctccatcatgccaactctttgccaccccatggaagtagcctgccaggctcctctgtcagtggaattttccagacaataatactggaatgggttgctatttcctactccagggaatcttccagacccaaggatcaaacccctgtctcctgcattggcaggtggattctttaccactgagccatctgggaaacccctaatttggtcttcaccgttttgctactcaagcactgtattacaaaacaacattttccacttctgttataactgcttcttctcacaactaaatgtcactgagaagtctgtgaaaacattaggcagcatcaagtcactacaatgtaatttaacactatctctaccactcactatcactgtggtcctggactagtagtagtactcctctgggtctccatttattcacccacaaagcaagagtagcgatgacttctagcaaatagctgttagaattaaataggatagtccaaaatgcttataaattatagcaaacaaagcaaaatagaaacatgttaagtgtctagacttccagtaaacaaacataagtaagtctcagctttttgcataaagtcaaaggcaaacatttataagtgatgctttcgattaagttaatagaaagaaaagccaatttaaaacaaaagcttcagtgtattagttatcttaaaattttatacaaactaattttattaggtcaaatgatttataacaattaaacatagagtcttcagaattagcaaaactgctttggttctcctaggatatgcactacctatataatattttaacaaaattttaattttctcaaatgtgaaaaagactatctcatcgaattgacacatatattcaatatatgttatttattttttcttatattattttacttagtgctataatttgtatgttttgaaataaatgttatgaaattaattgtggcattctatattaaaatttgagaaatactatacctggatgctgggagagactgggggcaggaggaaaaggggacgacagaggatgagacggctggatggcatcactgactcgatggacgtgagtttgagtgaactccaggagttggtgatggacagggaggcctggcgtgctgcgattcatggggtt

SEQ ID NO: 50815 - DNA, 1275 bp, Bovine  19866881819870
atgcatatcacttttgcaccattgtaaagctgaaaagttgtattaattagttgagccatcataaatacaggactgtcaatataaacggcatcatgagttcatactgactcattcaattcaaatttgaactagagggttttaacataatctttttgaacttatactctcatcttgtttctcttatgctgaatatactggttcttaatctttaataatctgtgtatcattaagttctccatttggtttatctcattctatataaaactcagtttcagtattcatgatcagtaccacataaacaatatgattatcaaatacactttgttttttgtttatgtttgcatctgttttatagttgaaagtcatgctataacttgtcaattgtcagtaatcataattagaggaatgtcaaaatatagaccatacatattaattataatctttagtttgtaagaatgagattcatagaagtttcctagtaaaaggcagattttttgtgtgtataagacacaggtgtcctggcaatagaactgaaaattaagcaattcttgagattttatttctctgactctttctgtagtcatttttctggaatcttcacttctgttttcatatttgttgtcttctctctttgccagtggacttttccttctagtcgcagtttctcccccccttataatgttgtcttatacagaaaatattatagccactctcacacattactatggcatggattttcatctttccactaccagtggcttcccactctcaatattacctggtcattatctttgggttattagttacctcatgtgttggatgtccttgaaacacatgcactccattaagcccgcatattatcctagagaacatcttttggaactggttcttaagtagttgtgaatattttatacagagctctgtggatggcaaatattctaacgcaagacctggcgagtctaacatgattgcaggaaatgttttgaacagtcaacatgtcttagttagttagtttgaatgatatttattcttagcctctttttattctataaaatatatgggaataaatgcagtatgtacaattttattgtgtgactagttggtaaaaataatgatatattttcctatgagtagttgcattttaaagaaagaatttcttaacttgtatgaagtaattttgtttcatagctgttattcccttctattttcttcctagggtgccagatgagataactagaactcttatgacaagcatgtggtcagatccataactta

SEQ ID NO: 50816 - DNA, 1573 bp, Bovine  19866880411358
ttgatgtctgtaccatgggagtgattaagacatggatgctggtaatttgaagaagtgcactgtcaccataagaacctgtcttgtgctaaactcttgtttccccacactttttttctcttgggtttgattgacttctttttaaggaccaaatttagtagaatgaatatgttaatagcaaaaaaaattattatattttgatccttggtttaaaaatttcataaattataaaatagaatgaagattcatatcctttaatttcttccttgtctttttgtctcttccccctcacccttaatcttaatgtcagaatttctttctgatgaacctattttcaactagagatctgtggaatctgatgccttcattctaacatctgtttttcaatgccttgcaagtagatgatactttatacatttttttggttactatatacttcataatgtttggaacaaataaactcaagcaacagattgatagctaacccataaacacatcagagatgtccaaggagagtgtgggataagtgatgaagattactgtggtttagaggaacgtgcctggtagtccagtggttaagaatccacacttccaaggcagggaacaagggtttgatccctggttaggggacagatcccacatgccacatggtgtggtcaaaaaaaagattggcaagggtatgggcttatgaaacagataagagaggctcctgttgacctaataaaaataaactgatgaaaaaaattaaaaggtagatcaactgaaaataaacatggagaaaagttgtacaatctggtaatcattaaaagcttcagttgcatagagtcaagaggtcagctgcaaatattagaaaagctcgatgtccctttcacgtgctatcttcttgctatttgctgatagtaccccattcacctatcaaaacaggtcagatagggaagagtccaattccaaacaattccaaacaatctggaattgttaaatttttcagcgtgtgagaccagaagtataacttggcaaactgagaacacaaaatgcttcttgctctattcattggtctaaaacatccataagcctttgcccagtcttcagaataaatttccatcccaaatatgggaagacaacagaaacttgcttctcaacttccaataaagaaggattcaaagggagagattttttttcccttagagatatggcctttgtgatattttccagcaactggtatggttggagatatttgtcaaagagttggttgagagaaacactttataaaatgacatatgagaataagggctattttgagaaatctatggacaatttgttaacatgttcagtataaaactggggcttctggttgcatggatttttaaataatagcagtttattcatgctttaaacagagagctgatatagcaaaggcagagaaaaaagacatgtcaaaaagggaaactttttttacatcagcagttggtttctaagtcagtgcaagtagtttgtttaacaagatgcaggctgtagaaagtttgagaatatttacactgaacacacaattattttcttcctataacatatgtgcccc

SEQ ID NO: 50817 - DNA, 1155 bp, Bovine  19866880728151
aaatttacttgttttaaaaaaatcaaatgctggcattgtccagaaaaatttaacaggtttatttataattgttataaagttgaactgctgaaacttgttcactgaaacattttgactttccttaatgctttatgtccccgcatttatattaaaaattcacacacaaatgaaaatggaaaaactgccaatacctgatttctgtcccctattttccacttgcaatcatatacttaggtaccttgtgaccccatgaaaaaaaaaatatctaacgttcagaactaccaataacaggaagaagagaattttttttttttcaaagaatgaaatgtttcccatcatagtggattcttaagcacgttctccacatttgcggcatgctagctgaatgtcttttggcataattgttacacgtttggcacagatagcacacaggttggtgtcttcaaaaaggccaaccaggtaggcctcacttgcctcctgcaaagcaccaatagctgcactctggaagcacagatctgttttgaagtcctgagcaatttcccgcaccagacgctggaagggaagtttgcgaatcagaagttcagtggacttctgataacatctaatttcatggagtgccacagtaccaggcctgtaacgatgaggtttcttcacccctccagtagagggcgcactcttgcgagtggcttttgtagctgcttgcttcctcggtgctttaccaccggtcgattttcgggcagtctgctttgtacgagccatggtatagagacctccttacttaccccccttctccttcggctggagctcggcgagtagaggcggcgctggtgttggagagcgacggccagggtttgtttttaaaatgattgtcaggttagaagacatttgctaattgatggtctgcacagaaatgaagttagatgttacaccaaattagagactccaaattagagacctactaatccatttaagagcttccctggtagctcagatggtaaagaagtccctgccaatgcaagacatgcatgtttgatccctattttgggaagatcccctgggagaagtgaataccaacccactccagtattcttgcctggagaattccagattgcacatcaacagaaagccctctagcggtgaacacttcttggtctg

SEQ ID NO: 50818 - DNA, 888 bp, Bovine  19866880736312
atattgcttagtgatacatgtgataaaactatgatgaaaagtgaggaatttattatagtagaagtcagtatagcaattactactacaagacagaaaatggtacgtgatgtaggagagatgggaagtgggagtgatgtttacagtactggtgtttttctttctcttaatatgagtggtaatagcaaggaattccattaatgattgttatttcatctttcatctatctctcctagacatatttcacaattaagtagagctaaaaaattatatgacaaaaatatctttgtactaacaaactaattaggagaattgctgtagaatgtcagcttacttggcagtgtcttctgggctatttcatataaattagtacacacctaaatgactaaatcactctgaagacaagatttgtttagagagatttaatatagtatttgaaaagataatccttgaaagaagaggtttatgccaaagtactaattaatattttgtcttaaaaaattattgcagtggtctgtcattactcttttctcatataaaataaggaaagttagaaaatatacatttgtaatttagaataattgattattaacaaagtattccttcttatgtctctgttacttttcccagatattaaatcccaaacatgcttcttggtttgtttgttatgctagctatgctgttaggatttaatcaaatgaatgtcaacagtgagcaaactatcaccaaaggccattgtgaagctcccctcaccacaggaaatctcagagacacttgatttgaattctctcaagttcagaaataataaattcagccccacaaacttacagagaatgagtcatttaaaaataaatactaaaaacccactttcagaaaaattcagagggcaga

SEQ ID NO: 50819 - DNA, 1176 bp, Bovine  19866881173378
ttcgagtcttctagggtgtctgaggaagatccaagggcctggtgtggccacgtactttcttttggcacccgtgtgtcacgttcctctctctccccaggttacctgatctgcagcatgattttccttctcatggtgatgttagccttcttcccggtgttcagcttctggtggctgagctattggctgggccagggctcaggggtgagtgccatgtggggggtggggtgcatttctgtggacctgggtggaatgggggaacttctttttccttggggccccatgggtatgggttagagaagcccatggcaagcccagtacctgcccttgccatgctgatgaatggggccctagagggaacccttgggagctgaaactctggagcgccctcccaggtgggcatcctgtgttcacagagcaagaggtcacctgtacagtctcctaggaacaaaaccaagaggcctctgtccccaaacagctcttgacaccaagaatgctttacagtctgctctaatatgagttagagaagggaaaagaagttctatccatcactcctgacagcagggaaagagctgagctccagtatgacttgcacagaagtgatctgggcttttgaaagggagaatgagagaggagggaaagcaggggctctgctgggccagagaatgaaaaagtacaaaaggctggtgagtgtcagtacaattaagctatcagtgtctgcagccagctttctcctcccacagagagtgggggacagaggctctgtcctttctgaggattacattttaaaggaatcattctcagatctttaagaaagatgcttctgagttgcaagagatacacagtcacagctgtgagtgcttcttagtaagtcctctgaggaagaaagatcaggggcctgccaggaaaacagtaaattttcctggcagaggcactttaatgaaggtggggggagctggggtcctccgagggacataccttagcctctaggagccacgctaaggttcggtcaagtcttttagtgcaggagttcggacagggttgtttgtgttgagggttctggagctctcagccattatgtatcagattaattcattaatctttccaacctcattctgaggtaggtatcactgtccccattttatatttgcagaaattattcttagagaggagaaggag

SEQ ID NO: 50820 - DNA, 2413 bp, Bovine  19866881341048
taaaatagtatatattttggatattttactttcctttgatattttgactcttggaatacagagtagtcaaaaagaatggttgtaatattagagttcaatgtaaataaaatcatgatataaggttcgatgcacgatactggatgattggggctggtgtactgggacgacccagagggatggtacagggagggaggagggaggagggttcgggatggggaacacgtgtatacctgtggaggattcatgttgatatatggcaaaaccaatacaacattgtaaagttaaaaaataaaattaaattttaaaaaaatttaaaaaaatcatgatataatttaatgccatttaaaagctatgaaagacttgcatttgtcatttaatccacaaatttataacacagaacactaaacattgtgaacgtttatctatttcagtgaaattgaagttattttaaagtgttttacattaacttggctttggctccactgtaacatacacaataatctcctcacattagctaattttatctaagaagcatgtcaacaatgaaatacaaaactgaagtcttttagcaacttactaaagagtccttaaggtggtagcgttttgtgttagaaaaaaaattaaggaaagaagtcctgacaattaatgcctaatcaaacaaggaactctccaactcaccaattctcatgccactgctcctccttccccacaaccaaaaaagaccaccaagcataaagaaaaacgtctgatgttaggagagttatgtattatgactgttctcaggggcctcataaaatcatttatacttcaacttatgttcacccctaccatcatatgactatggtgaagttacgctcatccctatagcaccatgcattttatagatgaggtctgagtgacaggaatttaagcatgacttctaatctatctaccatatataacctaaaagtaactatctagaggtttctgaagtttacatatgattaccatatcagaaatagcaccgataaagaatgtggagaccagggccctgctctagaccctgtcataactgagctgtgtcactttgatcgacccctcgtctctggttctaagttgacacacatgtgtacaattaaggtattatgtgagaagatctataagacagccccttgctcctctttaactctacatactcataatttttcctgtactaatgaaatcacctactggcaaatcttacgagatgaaaaacacatctatacaatataaagttactccaggaacatatagtgagacaagatgttgctattcatatgtaaccaagaaaaaaatcatgaattatattgctgactacctatttggatttttacacataatacagcatcatataatataatataaacataatgtaatataagtgacacataagtatacatacatatatctcagccaggtaattctaaccaaaagaaaataccaaaatgtttcaggtcctagacctctccttaactaggtatctgaaaagctttcaaccttgcttttatcttttttgatatttgtgtcagataataaaagagttttttgtacagtggttggtaatcattttgttttcctttaggggctcacaaatacaaaaataccattacctttcctatgttgatatctggttgcagaaagcgaaggcagtctgaataattagaccatgttttatttaaactgtgcataaaatcccatgttccattggggttacagtgtcggaaagcaactcctataaagatgtgaagaaaaacactgagattgctcagttcttatagagtctattatttttaaaaaaggaagtttctattccaaataaatcatttcataaaaaattaaatacctttatgattgaagtcgtaaatataaggaggacatgggacagccaacgttttccccactgttcctctaggccaacagatgagtccatcccattctgggaaacagtttccttctgataaggaaaaaattaaaaaacaaataaacaaaaatgcagttagaaccagagagttaatgcatttaaaatacaaaatttcaagtcactgcctatagcaaaatgtaaagcaaactggtagttttgtaaactagaatgggatggacatatgatgcaaacatctcaaaattcatccacctagccccatcaaaggcccattgctaggaatatttgatttgcataaattaaaactatttagtgattctaatatatatgaatcatagcaatgaatatgtaagaaacaccaaaatccactgagaacaatttcctttagtaaaattctatcatagttgtagttacatttttttaccctaactttttcaaattactgtttaaaaatatgacacatgaaaaagattggaacgtcacaaataagctccaagatctgggtttgccttttta

SEQ ID NO: 50821 - DNA, 1775 bp, Bovine  19866881706379
ttgctgatttctttgtctatgacagaattttccaaatatctgtgatgctgaggctcagggctggttgtgatcaaatgtgccaattggcatattgatcattttgaactagcatttcttaaggaatagccagtgaaagaagggcaatctggtcctcctttgtccccctgaaagcagaaaataaatctcccatgtggagatttctacaggaaaataaaacttccctgtggcaggaggtagagagacatctttattgctagagatggggacttccaggttgagaagctgtgtaaacaaactccgcttatatctttcaggtgaatgtttcctcctcttgtcagttcttcacaaatttattgtttctctacctaaaagatacaaaggttgcctgatttggttacttttctgagtttcatgctgggattccctggtgcctgaaatgtgagagacctgagttcgagccctggatcaggaagatcccctggagaaggaaatggcaactgactccagtattctcacctggaaaatcacttggatggaggaaactggcaggctatagcccatagggtcacaaagagttggacacaactgagcaacttcacctgagtttcatatctttggggtccccatatgtacaaaattaaattggattttctcctctttctcggtttcaagttctagatcagccagaagaactggaaagtttgacggaaaatttttctactccaacagtggtgaacacacacacacacattattatttttaaaataaatgttattgattggaattggaattgccaatgagatactttaatgtttatctacttgaagttttctttacatacctaagtctccctaagtactaagttctgcctacctccaagatgacatgccaccctacaacaaaataaagtgaaacattttagcattaatattaatgtcaaatacttgtctatttttgaaactttctgaataaaataaaggaaataaaaataataagagaataatactactaataagaaagggtataatatagtagaacatcagcatgataaaactgtcttccatatggaaacaaagctgtaagctcttctttctttttcctgtgcaagactcaagcaccacaagcaaataaaatgtaaaaagattgtagctactaattagaggtaaagtttctgacaatttaaaaaattctgaaatcttcaggttttatcacagatggataaaatctaaaaaagtacctttcaaagtatttgaaagagctaaatttggttcattgtagataaagttaatatttcctctccaaattctctgcaatagaaagttcctgatcacagagaaaggagccaaagcagagggagtaatgagtgttgacgctgggcagcatctcatctaccaagctgtcagttttaattagtagatattttttgccatttcatgaaaacaattcctgtccttagcttattactggagaaatcctagataatacaatataaaactttttaaaaaatgtaaattgtctagtagaacacaatttccacaccaagacaaaggggaagataagtatgaatgttttctgaggccttctcaaatgaataaaccaaatgagttttgtcttgaacctgtgctttgagacctctcttcctttttgaaaacaatcacacacacacacacacacacacacacacacagtcagtcactcgcttactcactcttatattactggataagaatatccagaacttgagaaaagcaaaaaggtatctttgattttcactt

SEQ ID NO: 50822 - DNA, 1399 bp, Bovine  19866880386308
cagctgttggagtccatccaaacgtcagccataacaccaggccagacagcatggtagaaaccatcctggagaccatttttaacctgcagaaaaaagaccacacacagatcgattggccacaatcgtcaactgtgatgatgcaatcatgtgattccctccagggagtgattcaaggatcgcccagggagagactgcaatgaaaagttttaagggtttgcttaggccttatgtgtccacgctacccaggacatcagctgtgagaaggtattaaagaaacaaactgtccgagatggccagttccctgtgtcctcacatcctggggaagactagactataatggcagttctgtcattttttattgtcgtcatagctctctggaagttctgcaccattcctactccaccactctctcctgctttgaaacaaacagaaacaaacaacaaaactttgcttccatcttgagaaagggacagggagagtgacatcttgacttttctagtcctggggaagaaaaggctcatgggaaggcgttggaagacatacatggtaaagaagcacagaaagcttggggctggtagaagagaccatcttagcttagcaaacatggaatacacttgagatcctgggtggggatgaagatacacacagctcacactgccctgcaacttgggaaggaagatgagggctgcttgctgcaccaaatgagagcaggggatggtaggcaaagcctcagcttccttctctgcaaaaagggacgagaaaagcatctgtcttttagggtcactgtgaggatacgtgtgggagcatgtgcaagagcactgagaacagtgctgggcacagagacccccagattgctgttattatgttggcaatattacctcactgttttggaggttggaattggggggaatcgaaaggtgatgagagaaaacagaacaagtgaaagaggtgaaagtctggggagtcaacctgtcctgaacgttggctcctatgcaaccaaaagcctgcagaacaagagaacaaatattcacacagattccttctgcagctgctggaccttagggcggacatctcaggcaggggccctgcaaaccctcttctgccatccttctctgggagccggcggagacggaggcggcgtgcatttctcccctgaaaaggaaatatttataaccccccaattctatttctgtaaaggaaaggcttttaagaagccactctcagatgtaaaacctttttctacaaagagctgagacagcagagcccgcaatctgaccaaaaggcagggatccgcctctccggccatctccgtctttccctccccggctctgcacgcaggatgtctttgtttcatttacacccccagccaacatcgttcagatctgatgagctacccaac

SEQ ID NO: 50823 - DNA, 1868 bp, Bovine  19866880706634
ttcaatccctgggtcgggaagatcccctggagaaggaaatggcaacccattccgggtactctttcctggaaaatcccatggatggagaagcatggtaggctacagtccatgtggtcgcaaagagtcagacacgactgagcgaattcactttgactttcacaggcttagtcgccttgcagcttgtggaatcttcccagatgaggggttaagcctctgttcacccctactgataggcagattcttatccacttatgcatgttttatgcctctagagaagcctctaaaactgtcttctgactttatcccctgggcaaacaggaaaccagcttggctgcctgggtggcccttcaggtaactctccccatagatgtttgtggccgtgcacccctcctccctttcagaaggtggtccagccttgtgggtcctcagggatgttaggtttcaccactaatctgacctcttctgctaattctcccatgttctggtctactggtggcactttttctagttttccacggcatctgggtgtttttttttcttatttttattggagtgcacttgctttacaatgttgtatcagtttctgctgtacactagaatgaatcagctatatgcatacatatatctcttttttggatttccttcccattcaggtcaccacaaagcagtgagtagagttccctgtgctatgctgtaggttctccttaattatctactttacacatagtatagtgtatatatgtcgatcctaatcccccagttcatcccacccctctccccctttggtgtccatgtttgttctctacccctgtgtctctatttctgttttgtaaataagaccgtctatacaaaggatttgtttttatatttatcctgctatttcagagggtctgaaatagagagttggatgttgaatgagtcatcttaagtccaatgcatgaatgaatgaatgagcaagggctcctggaggagtgggggtgtcgaggagggccggggtctgtgcagacactcctctgaggcagggatgccatgagggtcagagggcatgcagtttggataggaagtcccacctgtgtaagagcacctgtacctcaggtgaggccagggtgttccctgaccctgtctgttgtcatccaggagctcagcgattggtggaaatgctacaggtccctgtgggggtggggggcagggatatcagcccctcctttgggcttaatttaaaagatgtgtttaagccaggggagggcagaaataatcgctagaaggaaagaaaaggtgattcccacaggagatggtgagggacagggaagcctggcatgctacagtccacagggtggcaaagagttggacacgactgagcgactgagcaggaacaccctggtttcggtccagactcttcaggaaaggtccagctgtgtctcttgggcaccaggcccaacatgaagagggaggaaagaaaaagctgggggcaggccagagacccatctgaccacatgcgggggatgctgagtggaggctgggagcagtgcccccccaacatactcacacacatacacactcacacacccgccctgggcctgattgcttattaacacccagtgggtcccggctgcctcctcaggaaaaacaaacctttaaagatgtggtcccggcagctgcagggggccggggtggccacggagcagatcagggaaggaaccttagatcagctcatgttttatttcaaacaaaacactttcctcctgaagccagagagctccgtgccttggcaaactcataaaaccaaagctaacgctgtgaggcttcgtgggggagtctggccacaccctccggatatgggaaaggctttcttctctatttcaaatgac

SEQ ID NO: 50824 - DNA, 1706 bp, Bovine  19866880801089
tggagagggttgcctttcctcttccgaggaccttccccactcagggattgaactcaggtctctggcactgtgggcatattctttaccatctgagctactgtggctaatccagagagaagacctggaggtaagacagaaccaggagtggcggttggtctctgagctgcttttggcagctgtgcagcaatggagaaaacagtcacaacatcagatccaacacagttatcgggaatgtggatcctgttattaagccaaatacccccagggtgaggcttccaagtcctgggctgagacctggctgccagcctgcccagcacaagtaaggccccactcaccaccagcccctcttcatctttggggatttagtggccctatggaggatgcacaggggcctgagaagggcacaggatcctctacacgcatgtctgagaagccccaaacatgtgactacgcaaagatttatagtgcaaatgatcatgagtgagacagaggctgtctgtctcacaaagaaccaaggtctgtttcagaatttgtttggaactagttagtttattcttagaaactccaaagaagacaagtttggtttactccctaaatcttgtcctcatcgggatgtcagagaaacagtaaggagagcaggaaaccaaagtcaggctgtgtgcttccttaacctggagctgggggtgcaggtgtgggtggggggagggcaggaacagttccacagggcaccgtgctgtctaatgctcaacctcaccaggccggcatccatccttttcaggtctttgcagaggggaaaactgaggctgagagaggccatgaacttgtctgtgtccacaggaagtgccagggtctcctatttctctccaagcatagggtctttcgttcaggacccaattgggccattgcagttagatgggaaaggagagaagttagggcaaaacagcttggggttctttttggggggacctgacctggccaggctggattaggaacaaagagaactctcaggagatctgagcaccacatgctcctcaccccacaccagtggctccaggcagagctgggcagggcctgcaggcacccaagtcgacagagggtggggctggaccgcacatccctcttgcccccgccccctcctcccgaccaggggggcctgaatggggggggaacccacctgcctgctccagggccaccatggtcgcctgttcgatcaagtctcgttccacgaagctccggaagtcctcgctgtacacactcaggtctggaagctggaacgtgtagatgggcatctccagcgggaactgctcgctgctgcactcgctcgccacgtgggaccgcgccaaggacacgatggccgagctggcgtgggagatccccctcgaaagccgcttctctgcgtgggggaaagtgaggggggttgagtgaggggggctctatgggcgtgcacactagcccacatgacacatcccacatgtgtgcacagcagcacacaggatgcatatgcacatgtaaacacacatggcacactcatgcagcacacacggacacacacacatgtacacacttgccacacacacatgtacacacttgccacacacacatgtacacacttgcctcacacgcagaggcacacccatggacacctgcacacccattacctctccctccccagccttgctggcctcccagtgttctcagcaggcctc

SEQ ID NO: 50825 - DNA, 1390 bp, Bovine  19866881173902
aagcaggcagggcccctaagtggccagactgcctatcactcaccatacagcttagattagtatcagtggcaactgtgtaatgaatccacacttactatctctccccctagtgaaaacctgtaaggttcgttactctaagatgctaaccccccagctcccagaccctcccccccatctcagacgaacagctcagctggccaaaggcccaggcaaaacaccactgtccgccaaggacatgcctgggcctcccaaggccctggtcggccccttctggcggctgagtgctgaggtttgtgtgtaccttttatggttcctctctgtttcccaacactttcttgcaaaaacctccactcttgatctgccattaactttagcttcttcctctagcccccagacactttatcttttttatttagtgaaagtgtgttagttgctcagttgtgtccgactctgagatcccatgaactgtagcccaccaggctcatctgtctatggtatttcccaggcaagaatactagagtgggctgccatttccttctccatttttaaagtgagtgttaatatactaaaagagttaaaaacaaatgagctcagaaaaggaatgtacaggggaaggaagttcctgtcctgctcccatcggaggaggatgacctccaacttaacccaagggtataaggagccccgtcctgggccccagaccccctgccaggctgcctagctgtcaccctgctggggccccaggtgggagccaggaagccccccagctcctaagccccctccctctcccacacctgtgcttctttccagctggccgcgtctgcaggacatgggccttgccagaagctccttccgagacaggacccagcacaggccaagcctcataccccccagtgagtgaccgccaatttgggccccaaactatttcttgcaaagcgctttctctggctccaggaggcaggcctgtgctcagggaccataggccacccacctgtgcgggacaggctacggcacagggacacttaatccaagcctcaagtctcagcacttttccaaacaggtcaccttgggacagactggccgatggccacggagggcggccaagttcctggttagcaagtgtttttgcgtgatgaacttgagaaaaggagaacaatcaacagatcactcccacccccactccctctgcatacagtaaaaacctggagtgtggctccccaatccatgctgcaggttcagaatgatgtcatgcagatgccacactgggccaggctgccctcactgtacacacaaggcccatggtgaacagggaggacacccaccccatccaccgcactgggccaggcccgcccccttcactgcacacacaaggcccacagtgaatgggggagga

SEQ ID NO: 50826 - DNA, 1443 bp, Bovine  19866881248608
gctgcatacagagcattttctggaacaagcactgcaccctgcatgggaacctgccttctcagagctcctggggactggattggtgaggctgagctttctggggtgtggggaagctgatgagccaaaggcaccagggtagtgggccaccatgttgttcagtcactgtcatgtctgaccgtgacgccatggattgcagcacaccaggcttccctgtctttgaccacctcccagagtttgctcaaattaatgtccattgagttggtgatgccatccaaccatctcatcctctgttgcccgcttctcctcttggcttcaatccttcccagcgttagagtctttcccaatgagtcagctcttcgcatcaggtagccaaactacttgtcccctgcaaagccttctccccctcccccatgtaaggcctgccagttctgagctgtctaccccttgggccagttatatccaaattcttaaactgggccattttggttccctccccttccagggccttgcccatcagagaaacagttctggcaaataatgaatcataaattttatttcaaaatgtaaacgtcactaaacatgcatacacgtgaaaacaataaaatttacagtttcgttaatttttttttctttttgcataggacatcattacaatatagaatctatgccttacaaaatacatacaaagttttatccgagcaagccaaggccagattgggaactgtacaactgtaatacttcactgtagtgatctgggaaagacgagacgtggccttcggaagcatggtgtggtgctggttaaaaaaaacaaaacaaaaccaaaagttcctacagaaaagtgtgctcgatggaaatggtcttggacccttggagtctaccatggggtttggcaaacaatcccagagaagctccatcaatggctttgggacgaggaggggtcgtctgttaagtctagggttgctgagacccctagtgcacccagcacacagagattcccgggtggattcctggcctgtgggagccataaaggctctacccccaacaatgcacagctgctcagctaccctctagccctcagggtcctcggtgcttggcacagggactctccaaggtaagcctcctgcccacacgcccagagacaggcaccctgacccaggaatggatcctgggaggtggccccctgctccagggatggcaagctggcctgggacaggtgctcctgggctgagtaggggagacagccttcacccagacctctggttgcctggcaggtatttggcttggtttccaaacaaatatgtgcagcagcctgtcatcatatcaccaggaagacatcctggagccctgggagaaggctgctcatgcacccctccccaaccccccatgtctcctgtgtcccccacagggaatgcaaaggtgttcagggtagggggaagcaacttg

SEQ ID NO: 50827 - DNA, 1965 bp, Bovine  19866881539268
aaacacgggaggcagatcatcttttcattggagccagcttctccttctccagaaaggatgcttttccccgacataaagagcagcaaaaaaaaaaaaaaagattttttttttacttgtttgaattattataataaactaatttgaatatctcctgtgagtaattcatttttgtttttaattatccacagcaggtggagttttcagtcatttattcaagttttacataagtggttctttaaaattatttattaaataggaagttaaattttttggaagttttacttttcatgctaaacaatactttcaatgtgtggtaatcactaacattcatgaccctcatattactggggtttcttttgttgaaagaaaaaaaaagcagtttttaaaaaaatctctcatcaagagggtttgtggcagctttttgaactgattcttcacatcatgctgaccaactgctttgccatccaaagctgtgaggtcacaggaaataaatactgcttcgcgtgtagatgccggctcctgccctgcatctcacagaaggtggaacagccagcttggaaagagcttccctgtgcattcataaaccaaacacataggcacagcaagtcaaggcagaaagtaacttcgtgtttgttttttaattttttaacatgaaaacagccaaacagaaatttccaaaactggctatgcaaatattttatctttctcatgttctccgccaagttaaaaaaaaaaaaaaaaaactaaaacaaaacagaaaaaaaaaaggcagtctattacaaaacagtctatttgtaatacgagaggaagagctaggcagtgtaatttgtacgtattataaaaaaccagtgatctgttctagctcctcgaatttcagtcacctctacccaacccccatctgacatatgtgccataaataagagccctgagatccaaccccaaccctagcccccaggctcctcctctctccttagagtagacaacccctctgtctctccattgtggtcactagccactccatgtgcagagcaccttgtgggttgtcgctccctggtgggggacacgatgcccttggtcagcattgtttacaaacagccatttcctcttgtgagagatctggatctatccttcctctaaacagtgttaaaaacagaggccccactgttgcgctaaatgtgacggtccagcccctccgtgttcacaagagctttacccctcattcctggccagacatctcttagaccaaatgaattcatcaggctgcgcgagaaccattagaaacagctgtgtttttcacatgtgggtcaagagatcccttaatgtccttctgtgacctgggggcccttggtggagcgaggggaaaggaagtggggtggggcactagagaaaaggaaaacagccaatctatgttctagaaaggccatgagccccaccagggcacaggtccccgacgcagacagtcccacctgtgagctgtcttcccctccaacctggtctggccaaacttccctttctgggaatgttggatgtctctacgtgacagcaaaattccagaaggaaccccagatacttctaaaccccagtggaggttatctcagtcatttgcttcgcactttctgcatctgcgtgacctgggtatatgattttttaaaactaatatattgtgaaaggaaggcgtttttaagtgtattctgtttgtagattttatgctatgttgatattttacaagccaagtttaaactgtactatagaaattatttttatattattttcagaatatgccacagagcaatattttgcacccttatattgtcacgggggttgtccccttggagggctaaatttaggttgggtagggctccggtgtggactctgggggatgaaacactttctgctatgtgttcacatctgatctgaaagtggaactctgtgaatgtctcttcctttttccatggaaagctcgat

SEQ ID NO: 50828 - DNA, 1223 bp, Bovine  19866881798109
ctgtagcctcggcgctgctgatgctgctccgcctgagaaggaacgtggcatcacactccgaggaggcccgggaccgcgtctgtatcaggtcagacttgtcgattcccgccaggttttccagcgcattcaccattctgttagatagttcttccagttgggagaggcgaaggtccacagtctgtagggaagttttcataaagttttctctttcgttgatttcctccaacctcattgacatgttttcaactctagtgaatacaaagggaaaggtgtattacaccgagatgaactaaagattaaaaccaaaaattaacgttattgttgttgtatgattttttcaggctttggggaatcatgggactcaggcatatttttaaacgtcacacactcctaatataaccacctaaaattaccctgaggaacatcaggaaacaacagaagtacagttaacacatacggtgctctttaccattcatcacaccaagtaccttatatatgtattaatacatactcaccaaggtcctactctaggcttgtttaatctcacagcagccctatgaggcaggcagtcttttcaacacccccattttattgatggggcttcccaggtggctcagtggtaaagaacctgcctgacagtgtagaaagacacagattggatctttgggttgggaagattccatggagaaggaaatggcaacccacactagtattcttatctgggaaatcccatggacagaggagtctagcagctgcagtccattgggtcactgaagtgttagtgactgaagaacaacattttacccatgaggaaatagagtcaaggagagggtaagtaatctgcctaaggatgcacagcgggcaaacactggggctccagcatgagctccagctctgctgtctaagctggcacatcacactgcctctgatgataaaggaagacactagcacttaggtttgtgagatttgagtatagctgtcagcaaggaatggttacaatgacaaaataaatacattcaaatccttatttgaaattcaggggattcagaaaatacattgttaatagttcagtttaggttcatcacaaattattagaggaatgcaaatcaaaactacaatgagctatctatcaccttacaccagacagaatatccctcatcaaaaagtatacaaataacaaatgctgtagaggggtgtggagaaaaggaaacttcctacactgt

SEQ ID NO: 50829 - DNA, 1021 bp, Bovine  19866880483851
ggtcgcgaagagttggacatgactgagtgacttccctttcatttttcactttcatgcattggagaaggaaatggcaacccactccagtgttcttgcctggagaatcccagggacgggggagcctggtgggctgccgtctatggggttgcacagagtcggacacgactgaagcgacttagcagcagcagcagcagcattacccccaccttccaagcccttgccagacaccagtatgatttctgtctataaatttcccaattctgcatattttatataaatggaattatacaatatgtgatcatttgtgactagcttctttcacttggcgtaactattttttaaatgatatgctcttaatccaacttaatagcttttttagttttaaaggaaaataattccttgattctagccctctgaatattctccctgtcactgagatgtgaagtttagtgtgtggcccgattcttgggcattttgcaacactcaagacagctgaactgccatctgttctggggaactgtgtctcattagtggtcactgctttcagtagtttgctcagtaaaaacatctgataatttaattagaaagagccaaccaattactgggtgagagtgaaatattctagtcttgtgcaacggcttattcttccatagttgtattactggcaacagctctaagtcccttatgaaaataagcttgttaagatggctagaaggcaaaaatacattcacctagaagataggagcttcgattcattaagaatgtgatgatttctttgactttgtcccgtctacaacttactagaggactttcttatagttatttaataaacagtattttagagcttccttacatgtctaccttacaaatgtatctgacaagaatattcagttcttaaagaaacgattctgtatgttaacacacaatactgaacagaccattaccacttgatgaagtgccaaatacctgaccataatacaaactacacttgcgaggcattgccaagttagaaaaaaagaag

SEQ ID NO: 50830 - DNA, 1257 bp, Bovine  19866880535291
tagaaaataatttgatttaacatgattttccttcccatgtgaacatgccagggtgccgcctcccctatctcataataccctgtagctgtctttcatctccactctcttccagttcctatgagttgaagaaggacctaggggttacagtgtttagaacagaaagggttatagcactcatctgtgccaagcctttatttattttgatgtggaacttttggaactttctggaactttttttccaaatatgccattggttgaatccatgggtataagaagggttgattatataagtaacaaataaaaatagcctatttctgctgctatgtaatagaatatgcattgtgaatattgcgataaagctaatgaagctctatgccatcacgtaccctagcttttcatgtagctggtattttacaactctttattgtttgtgaaattgtgacacatgttaagattctcttacgaacagcagaatatcagagagtgcagaattagtttattgaccctccctcctcacactggagctccgcacacaggcagatttataaagtaataaaggcagtgaaaacccctgagcctgttccaagttggaattagcattccaaagaattccacaccataataggttacatgattgagaagccttggtgacgttagcgtgcccacacactcatgcctgaccttaaacttctggcgccccatgcattttatttggatgaaaagtatgcatggaagcagttttctgtattccttctataaaccacatgctgagatattgacctcctcctggcttttaggtgatgcagatgtttggtgttttttttaaatactgagataattttaaaatctcacttcatgtacaatatttgcagtcatccccacatttgatatacttgccttgggcagctttatgtaagtttgtgaagacaaggctactaaataccaatcagttataaggtttttattaagattgtccaaccaggcatgactatatctaattatgttctcatctaactcaatatagcttgtccaaagaagtgtcacgagagtcttagtcgtatgttctgttaaagtccaaaaccgccaggccagccatgcttatccaatagaagtgagtctggcatgcatttcctgatgaatctgtgccaactttggcttccagagattcctgcttctttttctacctgttctcatgtcagtcttttaataatcaggtctacatgtttgctgtcacttgtgtggaagtgatcttatttt

SEQ ID NO: 50831 - DNA, 1356 bp, Bovine  19866880657843
tgttaggagaaagtataattaaggttgcctgctagcattggcactacataataataatctgtttattcagaagctccactttgtcttccaaaggttgattcaggagcttcttaatctgacaagatatgttttattatgctttcctttgtaatgaatattggaatagttaatacagctactgattctttattgaaaacaatatattacagagaaaaacttttactccttctgagaaagtaatctcccagttccagtgtgggcatattaaccatctaaatttgatcttctcatgaaactaacttttaattgtctttaacaatacatgctaggttttatactagagaaaaaaataaggtgactattttaagctaaatacttattaagtagcaaaagcaatgaacttcacttagtttatatttaataggccttatatttactgaagcctgaaactctggttattactacttatataacagtgaacttggggcttgatagaggtgacattaaccaaattaaatagagaaaacttctcatgagagattatctattcatcatcaagggatattttagaactccctagagatttttaatattaagattagcttctggggtaattcagaaaaacttccctagaattttgaagatgaaccattcaattttgaaacgtcaatttcccttcctataactgaggttattatggaagaagacatttttagtcccacatatgtagcttctggaccctgtaacaaattttttctttctttaccactcaaaacatccacagttttcctgggaacagtaagtgatttttttgtttttgttttttataaaaaaataatatatatttttaaattccaaagtagtcaaggcattgtttgggcaaagaaatcaaccagttcaacccaaattaaatcaatgatagcatgtaaacaaaaacagaatccttggtgatggtatttaattatttaacccatcatttaataacttcactggtttgagtgccaaaatacgaatctatattttcaacttgaacccagatctaacttattctcaatccaacgttgaacagggccagattaaataccaaagggctatttcaaggctagtccactagtgtccattttaaggagtgaagaatctggactgttttttctcccaaactcacctgaagcatttttaaagtatacacacatcttatccatgaacgtgttcaaaacatccttctgcttgtgcttctcagcagcagacaattccccctggagctactctgaacatgttcaacacgatggacctgccaatacatggaagaaaaatgtcagactgaccctccagtggaatcgatctgttcttttcaac

SEQ ID NO: 50832 - DNA, 1191 bp, Bovine  19866880665092
ttcttgcctgggaaatctcatggacagaggagcctggcgggctacagcccataggggctcaaagagtcagacacatcttagtgactaaacagcaaaaacaaccaggagggcggggaattttgtctgttttattcccagcaataacttcagggtctggaacagactcactggaacctagaacccactcaaatatgttaaatgactaaggatcatatattgtcaactttctatcccaaacacacacaatcacgtctttggatatgaggaatttgctcaaagttttctggcataatgtctagttaaccaagattttgtttcatgtatcaagatttttaaatgactctgaaactcgttaatcaccttaggtgcttctctttagtccgggttggttcatgaagctgtcaggaaaataatctgcttttgattatatatggcttttcttgcctccgagatagtcatttaaaaaagcaattttgtctcgtacaataattatattccagccttagtatttcttaagtcttgctagaatatcattttctccctttccacatatttttatgattaaagttaagacagcaagtatactaaatactttaggctatgtcaaaaatctaagaacatttttcaacagagccctaatgacattatctcacccacaaaattaacagtatttttgaaatatcatcagatagttagattttttctaaacctgagaattggctttctctgcatgtttttccacaccagatcccaggcaagaccagaccttgcatcttacatccttaactcttaggattcagaacagcccttttaatatcatgacaccaagttaacaaagaaactgtaccagttttcttagaaacagcccatcctctgatttgtcttatgtccttgagattctatttagattgtttctgtgttcctggaatatttttctgattatgagtatgtattgagaaaatgaagaaacggtaaaattgtttttcagatgttctaaatgagcgctgccagttacatcagaccttgctttaacgcttctcttatctcattgctgttctcgtgttttagacactcactagattaaacagggcagcctttaaaagttgatacaaggcaaagttgcttttatgctaagctatcattattataattttccttcaattttctttcattcctagcatcctacagtga

SEQ ID NO: 50833 - DNA, 1619 bp, Bovine  19866880714555
ataggaaaattctggggaaattaaggatcataagtaggtaattacgactttcataatgtggaaaaaaactttgatttgtgaaacataactgtaaacaatataatgtgttccacctgattcactggaaacgactgtgatgctggcaaagagagaaggcaaaaagagaagggggcagcagaggatgagacggttacaaagcatcactaactcaatggatatgaatttgagcaaactccaggagacagtggaggacagaggagcctggcatgctgcagtccacggggctgcaaagagtcaaacatgactaagcaactgaacaacaacaaataacatgttcagagattaaaattagtctaaaactctggtcagaaatcccaataagcccatttaaaaaactaaaattcaatctaccaaaaatggtttcccaattttctaacttgtgtatttgcaaagaccagtaaaatactgtgtggatatggttgactgggtcaccccacagcctttgcaaattcctctctgtgtgctaaactgcagagactagacttccgtgcaggaatacagatgtgacttaggttccagaagtactggcatgagcgttctacttggaaatgagttaagaggggacaagcaatccatcgttggctgatgtggatcactgtaaagggagcatagttccaagtcaacagctatagtgatgcctttcagatctggcattttccagatcccagcatagcagcagcttccttggcagttcagttctgcagtgtggctgaggcacttctagaaagtcaactggcacatgttcttccagccctccctgggattctgttatttactatcctataatatatcctttcctgattaaagcaggcagaatgtgttatacaatttgcttcatcctgacagataaaacaatgaaaagcatgaatatttaactataaagtcacattaactaacttagacaatcatctaaaacttttaaaactgagttcccatattagaaaaacacgagttaaatttttaaatgacaacactaaaattaacttaccttggtaagaaattacctgtacactaagctgtacagttccatctgtctttactccttggtcaaataaacttcgttctggatccagctaaacatgggtaaaaggattaagattattttagctcagtcatctggtttaatataaatggatgtgccaaataggacttaattactgaggtatactaattaaattgcaagaacacacttaattattcaagttgtcgtatcatttaattctctgccaaaactgaaaaggatttcaccactgtgggtagcaattagggacaacacaaataggacttgtttaaatagtggttttctctagctctggagtctagtttagaattttaaataatgccaaaaggcaaatattatttctgcagaagtatttctggtagaagataatgcaagttatctgccatgaagggttttttattaggggggacaatttatacaaatttatttatatacttcttgccaaatctcttcataaccaaggatacacatttaagatcagggttaattcaatttctgatcagaagttaataaagttaaaggacttacaaccatacta

SEQ ID NO: 50834 - DNA, 638 bp, Bovine  19866880769313
tgggattatttccctctgccctggaggaagatggttaccaataggaatggtactttaggtagtattgaaaacaaacatatcattctcactgcatgaagttaaatcccctcaaaacggaaagaccagttgctgcatcttgtattaaggagaagaaaaaatgcttcatgggcccctttagtgttgatggcaatggatatcactctggggtactgctctgatccacttactgggtgaccctgtgggctactgggcttccctgtggtccagggaagcttcttcagtagggcaagcaactctgctgtttgggcattttgaatcagcagaatcaattttatttgaacttcttttagctgattgctttgttctgtggttcctataacagatcccaggagggggataactgagccctctaaggcagcatgtttcacactgtgtgttgtgaccctttagtgagttatgcaagatccgttcaacaggtcttgagcagcgtttgaaaagatatgaaagagggtagaatagaaaggaaaatatcagagtacatagcctatagtaaggcaacatttattgaaactttatttttgttcagggtcttctgagtgcattgttcaagttcagttcagttgctcagtcatgtccga

SEQ ID NO: 50835 - DNA, 3272 bp, Bovine  19866880772371
gggtgcatatataaaaattttaaaacttctctataacaaaaaataagtcataaacttaaaaggcacatcagaaactgggaagactactctcaacatatatgacaaacagctaactcaactccttaatttataaagaactcatgataatccatgagtaaaatgggtgaagggtatgaacacattatataccaagcacattacagcaacagagacaaccaaaaatataaaaaaagttttttaccacttccctggtgatacagtggataagaatccgcctgccaatgcaggggacacaggtttgatacctggtccaggaagattccacatgccacagagcaattgagcctgtgtgcatagctatggaagctagtgtgcctgcagcctgtgctcctcaataaaagaagccactgcaatgagaagtctgtgcactgcagtgatatccccattcgtttttatgctggcttcgaagatggaggaaggggtcataggccaaatacagtcttttctagaagatgtaagaggcaaggggatggattcttccctgaaggcctggaaggaaccagccctgctgatatcttaatttttagcctcatgagacacatttcagactgccgacctccagaacagatttgtattggtttaagtcactgggcttgtggtatttgttagagcaatgacaggaaactattagagattgtcttgaaaatcattatgaatcaaaatgagactaaaataggctattaaaatgtaaaataaaaagataaagtattatacagtttaaagtcaaagaagagggtaacttcaagtgctttgggaaagtaacttaatgttctcaaaagaagctttctatacctggtccagactacatctagaaaaaagatcaccaactctggagagctggtgggattgtttgctttggaaaaactagctagagaaactagccagctctctcatcaaacactcagggtggagattctaaaaaccaagaaggctgtctggtgcaaaggcattggtggagtggtggcatggctggaggctgagaaagctgggtagggaggagatgatgtgtgtagggggcagtgggtgacaaaagatgacagcaagatcgggagattatctacacagagcaaataagatcattgaggaaatcaagttgttttctgcctgagagagttttacttacacagagagggggaaggctcaaaataaccctgaagtgttaggttttatatatatgtatatatatatatatatatatacacatacacacacattttatacacacagggacagatatagaaatacagatgtgtgtgtgtgtgtgtgtatttttcctaactctgttgaggacctagaagcaatgacacccctgtaacaatgagcacactgagctccattcttcactaaataccattctttacaaaaggaaatcaaccctgaatgttcattggaaggactgatacagaagccaaagctccaatactttggccacctgatgcaaagagctgactcattggaaaagatcctggtgctgggagggattgagggcaggagaaggcggcgacagaggatgagatggttgggtggcatcactgactcaatggacatgaatttgagcaaactcagggagacagtgaaggacagggaatcttggcgtgctgcagtgcatgggattgcagagttgaatgtgacttagactgaacaacaacaatagagatgagacagccacatgtgcaatatatattcctgaaaagttatgaataaaatggggcttccctggtggttcagataataaagaatctgcctgcaatgcagggtactcaggttcgatccctgggtcaggaagatcccctggagaaggaaatggctacccactctcgtagtcttacctgagaaatcccatgggcaaaggagtagggtgggctacagtccatgcggtcgcaaagagttggacaggactgagtgactaacactttttactcaccccaataaagtaaattatgcaaaggaaattaactggaactctgtaacgaatccttttgtagagcaaaatcattgccctctgattttgacattacatatatggtattttcataaacctgatttatatatttttatttaaacctgattaccctgttttgggtcagcttctctaattctcaggtcaggctggggtagcatggcatattcgctacttaatgcacatgactttggggctgtctgttgcttactgcaactgctgggcagcaggatcgagtacttaattagctgcctttgcagttatcagactgcaatcacatttgattaagaaggctgtttatttcactcaaagctgagaaagctctcctgaggagagacgcccatgttttagccgagaggaccaggaagatagcctcacatgtgaagggtccctctgcaactcagccacgggcttactgaatgaccttggagaagtcgttttgtttcccatcttctccctctttccccacacaccaaatgttttcaaaccacagtgttttcattaatgacaggagcataattcaaagctcttctaagtacttttatgtgcaaatatatccttccatctaattctgtgagataggcaagttgttactattattccctctttacaaattaacagaggttcaatgatattagaagaataaaatttacacagcatgaaagaagaggagctccaacccaatttggtgaatccaaactttctcagctgtccttctacaccccttatttttaaaactactattaattaagaacagaatcatggagagttgtttcctgtttaatttcacctgacagagggcaagaaagtcaatttacttaatataggctgggtacagcttgagattgaaactggaaagaagagtcctcaccatgtatttgatagtataaattcaaatatttccctacatgcagctatgttggaagttgaccttgtattattcctggggtttttaaaggaaaagtgttgtatcacatgtatggttgctcctttgcaaccatggtagcacttatttttttgcaaaatgaagcacaaaaagatagtctgtttacctttttgacagtatgaattcctactgagtatgtttgaagtaatttgtcatgtttttctctatttcagtcagatttgtgcaaaggcatagatagaaaagcatttttcttgttacctgtaagactttcttttttctctttccttaagaatgaatatctaaactacaaattctatttatccctgagttactgggggttaaata

SEQ ID NO: 50836 - DNA, 4104 bp, Bovine  19866880782047
cccacccagacccctcaaaaccccctgctttgctgtccctaaggattgcccctatcctttcttgcttaaccctgcccacttcattgtacatgctctcattacactcccttcagtggtccctttgagagtgtgatattatgcctgggcactgggtgaagcaataggatagcctaacttggctaacactggaatggaaaatatttcttactaggaaaaaaaaaaatgaatctggtaaaaatatgtaagtcattcctagggtatctgattactcaggaactccaatactcattgttaccgattgatgttttgggttatagtcattcaatcattcctgttttcatttattccataaccagatattgatcaccaactaagattgatgctctgtgagctatggtaaccgtgcaaggcacagaaccatagtgtcatgcacaacatcataaatttctccctgtgaatgatgcccaggttacctttgaacagtgactgtaggtgaaagaaaatgctaaagaatggaagcaaacattctgacccctgtttggtattgaaatgagaaagcccagggattaaaggaatgaaagtgatttgtaagacaattgcttttagaataagcagctggagtaccgctctggagaggtttcaacagatgaagaggtgatcaaccctttgtatggaaaagtcggcaccctagaagatgcctggtagctaagtgaataatcttcaagctgagctgaaaattggggtgaaaaaagctgtgagtcccaaatgctttggaaacgatttcccaggctgtcttacctaaggggcatgtcgttcaacagggactaaacagtcaatttggtgaaagtcagtcaaataaactgtttgatattctcaggactaaaaaaccaattgtgtgaggttttcatttttcaaggcagtcattgtagaaaggatgtaaatttttcagatgattgcttttagaataacactgatgtttaatctctgagttctttccactacagacatcttgaaacagaggaaataaatgctgcagagtcaaaaacaagtcttcagggcaaaaacctggcttagggtatcacttataaaacatctctgcattttgctgcatgttctatattgctggatcatagctaaatatttctcccccaaagtgtatttctttaaatgaaaagagctagagaaatgctgatataatcaagaaaagggattgaatttaacaaaagcatggagggtggccttcattcttaacccctaccatttgatcaggtttctggcacttttgatcatgccaagcagattgttgtatgactaaaagcaacagaagttacttgtagatggcaataattccatctatgtataagaagatgaagaggtatctgacaaagatattgaccagtatagcaaatatttgagagctggccaatccatgtcatgtaaatttacttgaaattacattacatgtagatatgtaagtccatgttgaaatataaagatttgctgatatttttgtgaaatacagtcgtttctagtctacactcatattcatcacacatgctatatatattctgaagacattgatggcaaatggaaagcattacatgcccagatacaaactgaacttcaagagtgggactaattaatcaacactctattggctaaaacagtcaactatggcacaccgttggttggctgatcactgtcaaatacaagggttccctcatatgataagaaatttgggagtgaagcaggttgtcaacacagggtttctgagtgccttgggagttgaactgtatgccatttatcttgatagttcaaaacctaggtcagtgtttggtatacactagacacagtatataaacactggttataaacatttgtggggtgagtcagtgtgttttgagttttagcaaagagtaacattcactgcacctctccagggcatgaaagtgtcaaaacaataaatgacctcgtttggcaggataggaaacagataggcccacaatttgacatggagtaacttcgtgagaaataaacatagcaggcatgatgtatttgtcttcctagaaaaccaatggcttccctttatatccaacccaaagggttccattctttatacatagtcctcagtggccatctgtggtagagatgaatttcgtccacactaagtgagagaaatatcacatttttgttttcttaaatcaacttagttcaactgtgacccatctttgaattcccacccatgcttgaccccagcctccagtgcccactcccccacgtgtgcatgaacatgtgtgcacatgtgcatacacacacacacacacggatgaggctctgatgaggcaaaaataagaataaaaccaagttctcacctttggaaaggtccttctaagatccttcaatttactgtctactttcaaggatgcttaatatggccctttgtgtcttgtaacctgcgctgggtcacacttagggtgtacggatttgggtgggcctacggaaacagagcccctcatttctgaggacacttcactctgctggtgctgtcagactgaagggcttgagtccttaacaccagcagcctgtggtcctttctccccttttcattctgacttagctgtttccctgcttccaatcctctccctcgttcctcaccagctctggcactccattatttctaaaggctgagattttttatataaaacaaaaaagaagcttcgggtttactatggcttgtgttttctgccaggctaacatcatccatgcagcaacaaatttcaaagcctggattctgccttgaaacacagcaaagaaaaggcagaagtaaaacaaatatgattgactgtcttaaatgttgtgtgctgtaaaacaaagccaaagtgtttttggtgaagttttagggaatggtagacggatatttgcaataactaaagttggctaaaaatataggttcatgaaagatgaatttttaaactgtattttaattagtctttatgattttgaaagagtcactttaagtcgacattctttactcatctcacctgaaattctagtggatgatctagtggtaggcttgtggtggaactgtactcagtgtgatttgtgaggtgtgcatctgtgtgcttttccttataaactcttacctggcagtataatttttctcccctagcagcttagctgctttgaaaaataaatttagaactcaggtgagatatctgctaaatacaaccacagaaggcttggaaaacaattttttctaatactggaatatatctacagttggcaggatttatcatcattctgttcttaacatgacccaacctctctatacatctatacatatttttcatatgtggcatgctttaacaaatattttaaacacaaagaaagtttctttataaaaaaagcacatatattaaatctttttcctaactgagatgttggtctaaagtaatgtttaaaatttatgtctaatttttattatttttacaagatcactaagacttctcccttgccttgcaataaaaaaggaccatttatagtaagtaggaaagtggatggatagatgtattttaattaggaaagaacaataaatatttaagacccatagccacatcactgtgctaggctaagtagtttgtgtggaggacattttccttaaaatttgactacttttttttcttgaggaaaaaaaaaaaaatgcccaggtaatgtagtcactaagcaatcaactggatacctgttttcaaggacagtcacccacatacacatacactatgtttgcaaggatttaccaagtgtttccaaaacactttgaaacccaaacacactctaggaattagcactgctctcaaatgcatcaagcactctgcagttcccagtaagaatctggatcacaggccattgcgcatccccagctgggctcaacatctgctctgaatatgtatttaagaattcagaggctaatctagaaggactagatcaatttgacctctgttttagtgttcctgtgtttaatgtgatttgtatttgaactctttgctgactctgcactttttcttgaagttcctgtctagtatgaagagaaaaactgtgtgggaatct

SEQ ID NO: 50837 - DNA, 1037 bp, Bovine  19866880824583
ctcttgcctgctttatttttctgcattatacttatcacagtctgacatactgctgagctcatatacttatttactttccgccttcctctactagaatgtaagctccatgggacagaggggttttttggtctagttttttcactgctgtgttaccagtccctaggacaagactggacacataattggtatccaattaaatgtaaaattgactactagagaaaattttacttgaacattttaaatttagagaaacatagagaaaaaagctttttcacgtagtactgtgcaaatgcctaagaagtcaaattagtgactctatttcttctctggtggctcagacagtaaagaatccgcctgcagcgtgggaggcctgggtttgattcctgggttgggaagatcacctgaagaagggaatggcaacccactccagtattattgcctggagaatcccagggacagagaaacctggcaggctacagtccatgcagtcgcagagagtcagacacgactgagtgactaagcacagtgcatttctcttctagataattaaacatcattgacaagtaggcatgaggtgggatgtgtttcttgatgaatccaagtcacttgcccaaagaattaaaccctcacaaataacccaacttcccacttttgactttaaacagatgattaacaaaaaagcagttgatatgggggaaagtatgcattaagaaagtatacttactggaaagatgtttcttctacaaaagaataagtaaatatcattaatataacaattaatagggtatgatacagattcatataaaaatgagtttggaattaattacttgttttcaattttgattctcacttgctgacatttataccttctaaatggagggttggcaaactttctgtaaaggccacaaggtaaatattttaggctctgtgggtaaagaggtaaaaccaaggatattaagtaggtactaatataacaaaagagaaacaaatttccaaaatttgtatcaatgaactaagaaatcataataaaacggaat

SEQ ID NO: 50838 - DNA, 1030 bp, Bovine  19866880856752
ctgctgctgcatcgcttcagtcgtgtccgactctgtgtgatcccacagacggcagcccactaggcttccccgtccctgggattctccaggcaagaacactggagcgggttgccattttcttctccaatgtacgaaaatgaaaagtgaaagtgaagtcgctcagtcgtgtctgactcttagcgaccccatggactgcagcccaccaggctcctcggtccatggggttttccaggcaagagtactggagtggggtgccattgacttctccaagcacaacatggtaaagaaatcatcctccagtttgaatttaaaaaagaagaaacatagaaataaagaagcattcagtcagaagaagcagttcacctaccaaggaggaaaatcagagtggactcagatttcttcacagcaatatttagtatccccaaacgtagctcagcaggcaaagaatccacctgcaatgcaggaggcctcggttcgattcctaggtcgggaagatctgctagagaagggatgggctattcactccagtattcttgggtttctctggtggctcagctggtaagaatccacctgcaatgtgggagacctgggttcaattcctgggttgggaagatcccctggagaagggaacaggctatccactccagtattctggcctggagaattccatggattgtatgtccatggggtttcaaagagtcagaactgagcgactttcactttgaaaactgtgagcacaaaagtttagatagcccttcttgtggcataaaaaaaattacttgatgagacattctcaccaaacaagtgctgtaatggaaagaattgaggaaggaagaattcatggcataaaagtatttgtgatttgcactgaattgattagattacagaaacaaagctgttataaacattgagatgtgttgtgttagtaagaatatagctaaggaaaatgggcaatggtgggaaaaagcaatcagaaaaaattacaaacatgctaatttcttaaactttcatatcaggagttaaaagatat

SEQ ID NO: 50839 - DNA, 1566 bp, Bovine  19866880908845
tccggtttatatgaggcaccttttaaatttgtattttccaggtttcatctttgcgaggctcagatcacagtaaaatattgtagcactagaagtcagcttcattttatgtctaaaaaagaaagagtaaagttgaatttatttctccatagaaagatttcaggaaactaattaaataaatattatggcagtgcatttgaatagttttgttatcagtgaggaaagaaaatgctcaaatattttatgtcactgttaaagaagggcaaaaaagccattgctgaataaatggtttcatcaaatctatatctgatttgaggaagtcaacttttttatgggaactaaaaaatgcaaaatacacataacccagtccctgaacacaatctttccctttgagttttcagaagaactcccatttcagttttggagccatctgctcttgccttttgccaccaagtatgtggatagataatctctcagggtgcagttaaatgaacatgaagaaacgagttcatgctataaagggatgcaaaaaagctaaagcgtaaatgatcacatctgtgcaaggtatggagcaagggaggagacagaagcatgcaaattagtcactcactgtcaacacagaagttcaagttccaagcaaatacactgaatgggacaatgatttacagcacacaaactcatccccgtcaggagggcagaaaggatgaataattggtcagaggcattcgtgtggcatgggaaagcaaaagcaactcagatcgattctgtaaacacaaaagaacagaaacaacccagcctgaatgaaagactgattacaactttccaatcttagatttgaaggactcaatttgctaacagcaaatttcattaagtccaaagtatcatgatggagattgtctttccccactgggctcatggtttttgttcttcggctgctgcatcaattaccccctccccacccctcgccagtaaaacgttggcagatgagcactgcggcaacccttttccggaaggtgggctccgattccctcatacgggaaagtcacaagtttggcgaggtgtgaagagatttaatttcactaaaagcctataagccgaggttgcattccacacaaaggatgctttctggacgattaatgcaacttttacatcctcttcaatttggctttaaaatatctcttccaatgaccataattctcagcctgagaacttttaacttttttggatagactgttttaagtgtttttcaccacttcaaatgaatgttgaagaacttcttcattaagtctttgtcatggaagaaaatctagaataatgtgcccttggtcctaagcatcttaattttagggtcatgttcaccttagggcactgcagtgtttagacctcaagtcctaagctaaggattaacccagaggcaggagcttccactccttatttctgtatccccgactgcctctcctcttcctcataccacccaccttctacctctttcaaggcctcaatccatgctcacttctctctttaaaccttttctgagtcatgctagtatttattagctacactgaatta

SEQ ID NO: 50840 - DNA, 1292 bp, Bovine  19866880979600
atcggatactctcaactttgtcctgaaacagtttttgtggcataaactggataacagctgcagaacgacaaagtgtccttttttacttgacttgaggccaatctgctaaggagtagattttaatgcaaagtcaaatcactggaagatatttaccttggtaaaatcaagtgttcatcaaaaggacacgtatgacattaatttaataaaaggatatttgatttgtattttttatttggaaaatggcacttcatttcactgtgtgaagatgcccttaggtttctaatattgcacatagtcaagaaatatatgtccctcaaatgagattgcttttttaaaggattaatatgggttatttaataggccctcgggactaatggcaaaacagtaaactcattgtattctaacattaaaataaaattcatcaaagactggattttacagtcttgtttatattactttcaaaactgatggcacatactagaatgttacacattggaaaggttaaagcaattaaaccacaaaaatctgttaaaatttatttaataaggaatgaaagagaagtggtaaaaatataacaaatcctttctcagaatctgggtttagtttaatacggtttacctttgctctctttttaattctaaaaacattattcttaaaaatctatgatataaaaaaaaaaaaaacccaactatgatgcaacaggggatatgtggaaactctttgtagtggccactcagttttgctgagaatgtaaaattgctctaagaaatagctttttaattaaaaaaaaaaaaaaaactgatagtatatttggggagtttccacatagaaccatgctcacttttatttttatttatcttttgcattttatttatatatgttttttaaattggagaataatcactttataatgttgtgttacttttctactgcataaccatgtgcattagctctatgtatacatatatacatgtatcccctccctcatgagtcttcttcctactgctccctgctgccccctaccccgtcccacacctctaggtcatcacagagcactaagctgagttccctgtgttatacaacagctacccatcgatttgttgctattcagtcgctaagccatatctgactttttgtgaccctaggacagaaagtgaagaagaacaaaagagcctcttgatgaaagtgaaagaagagagtgaaaaagttgtcttaaagctcaacattcagaaaacgaagatcatggcatctggtcccatcacttcatgggaaatagatggggaaacagtgga

SEQ ID NO: 50841 - DNA, 3446 bp, Bovine  19866881030372
ctaaatggtacagctattccaaagtccctgatggtgaagaaactgaaggggaaagagattgtggttttaaaagaggcagtcaaaatatcatactttgtgttacaaacatgcaggaccatgtgagtgcacctcttagatacaacgtaggggccctgcaagataagagtccagaggagaaagcttcattaacatcacaatagattctactgtgtgtagagtagtccagcaacaattatggatgagtactcagaaaataacttgttcagctccaggaggaagctcattgtggcctgaggctgcctcagaggatattaaaaaggcacaaacacaatctggtggaaataccagcttcccagtgtgaagacaaggcagacggtaggggaacctgcaggtgtcaaaagctgagtaaggctgagggtgcaactttgggggttaaggagcctcaagtgtgagcactcatttttatttttcttaaaatagcacagaaaggacccagcctgtgcagcatctaaactaagggtcttatcctttccggctgaagactgtaattctattctgactttttttggactccctctgccaatgaaaaaatcatgtgtcaaccaacagagcttccctgttgcactaataccatgcctgatttgcctatcacatatgagataactgatgtgatggaagcacacactggagaagagtagatggtagccgataactactggggcttccctttggctcagtggaaaagaaactgcccccctagcaggagatgccagtttaatccctgggtggggaagattcccctggaggagggcatggcaacccactccagtattcttgcctggaaaatcccatggccagaggagcctggtgggttacatagggtcgcaaagagtcagacgcaatttagtgactgagctcgcatgcacacatgcagtaactactgagcaccagctattgttctaaaatggttcctaagtattaactaatttattttctgtagccacttacgggacagattctaatggtctcatccttttaccactctatttttggttatgctaaaagctttgtaatttgactgtccatggctcactgagaactcattgatctccccccatattcaattactttgatcaaacataaattttataggactttaagactcctgaatatattcaccacagtcacatgaaataaccctttatatgtctatgcatgtgtgaaaaatttatagtttatgaaattacagttatatctcttaatttgattactaaacaggataataggtgaggctttccaggtggcactagcagtaaagaacccgcctgccaatgcaggagacatagcagaggcgggttcgatcagtgggtcagaaaaattccctggagaaggtcatggcaacccactccagattcttgcctggagaatctcatggacagaggagcctggcgggctacagtccatagggttgcaaagtgttggacatgactgaagcaacttagcacacgcgaaaatagaataataagagttcaaaaagggaaaatttgggggggcatggtttatttagactagtgtggtccgtgggccatttgttctagaatttcctagtgggaggtggttaaaaaaaatatgtttactgcccctatttggaccaactgtacctgaatttatagattacattctgagaaaatggatttttggcaagcactcctgggtgattataatgcgtacaaagtttcgaaacccctaatttaaactaatttaaatgctgtgaaatctctactttccagtgatcaaacataactaatgtctgatacttataatcgcaagatatttaaaagtttgaatgtgatttaagaaatgaataaatgtttttgtttcttgtatgctaatgtaggcttaaaagcggtatttgaaataaatgatgcagtgaaggaagaaaaaaaaactacaagattcggcagatctttaaatcagatcatcgattaattgaaacacctgggaggttagtcttcttaataacataatctgaaaagcagaaccggttttactggctttggattaatcgtttcagggtaagctcttttcccttgtgaacgacttcctgtctgcacccagaaaggagtgaattttggggtcctgcattctgactaagctctcccttctcataaatatttagattagaagaaaaaaaccaggatcattcttttaaaaacctcaatgaatttttaaaaatgtataaacatagttggaaaagcctgccagtgattaaagggtctcaaatgtaatattacattcctttccctttccaaattctcttccacatttcaagagacaatatatttgtcttagtaaatctaagttaagattaattattttagtaattttcatcacaatatttaattatctacaagttttctgttgctcctaactttgtctttattctctgtcacctacagggcacactctccttcctgcaagttaaattaatatttctaccatcactgcagtggctttttggtgccatttgtgtgggccatttccttaaagatctcatttcctagttgaggtgtttacacataaaaatgccacagactgtcaagttccagattggtttaaaattagaatagagtaaatataagcttccaagctattgtctgtaattcactgacatgactcataatgaaaaatgaagaaaaagaaaacgtaaataatttcacttaaccatccatgtaaatcaatgtacacatattgttattcttccctttggaggttagtttcaacaaagaaaattaggtttttttttttattgctacttataaaagccaaatatcaaaattttaatctctccttttgatttttatgccttctgtgggctgtggtttcaatgcgaatttcatttccaaagcctctgtggggatgtctggacctgtcccatgtggacaccactcaactatcaatctaggtcttgggtggctgtatatcctgtattcgattcttaaggtcagtggtgtactgtttaggatcagctccattcatgtgcaatctgagatgagcccaggggttcacaggcaactttaggggtcatgtccttgagttcttctatcttgatggtctccctagtactatctggttccctggggccatattttgccgtcttctggtcagaaagatggactttatttactctgcttttttgcatacttacacaaatgggctcatttccagggttgaacagtagaaagggaaagaaaaaaaaaagcaatggggattcactctatccttctggtattacatcattctgatcaggaaggaagccttctattcttagacttgcaggctcctgtcaggtcctattgctgccattgctccagcaaccagaagatcacttagaaactgctcaagagaacaaagaaaaacactgggagacttccaccaccgtctgt

SEQ ID NO: 50842 - DNA, 493 bp, Bovine  19866881075911
ggtgtccagtggacctacggaggagccctagggtttataccataccatgtacttgattaatggtcacttgtttcctgagcgtcagcatgtctctaagatttgctctagtcaatcaggcaaatgcagaatgccattaaagtgataaattcaaacagcccacacagaattgttgcagtctgtcatgtcaggtcccactttagagagatttttaactttatggatcactgatttgataaaccaaaatgagtcctttaaagctctccttttttatcaggttgttgaacttatcaggattgcatgctcaatgaaactctgtttcctggagtctgaacacctcagaggtgaccagtgtctcttcttgattgactgaggtatttacttgtttctgctgttcattccatgaaggtgagatttcgtgtttgtctcttttttttgaataacattgctgagaaatgtgcttctactttactctggaattcttgaaatgattttt

SEQ ID NO: 50843 - DNA, 1064 bp, Bovine  19866881077280
tataataataatgagaaggaatggaatatcaaaataatgaccaatatgtgacacagagacatggagtgagaaaatgcagttggaaaatggtgttgatagattcacttgagacaagttgccaccaaccttcaaactgtaaagaacgcagtatctgtgaagcacaatagaggtctgcctgtattgagtctggaatatgttgctgagaatcagcagacaggctactgttaggtttatgaatataggatttacaggagttaacagcagaatagcataaacaaatgtggttctcaggaaagtgcggtggctgaaaatgagcagagctggatctcagtggcatggtgaattctagactctagtcagtcttactttactgactttttgatgccacaaatttgatgtcagttctcacttttgcccttttctctttgccgtggctagcttcttcctcaatttcctccatgctagagaattctaccctcatgggaacataaattacccagagtaggtaaacctacatcaccaaagatactggcagtttctcagggctgttgaaaaccctttatctccagagcaactattaaccctcatgtgacaaaactactgtatttctctcccgatgttttacagtattaaatatatccaaactgcctgtgtttataagcacaaacttttatacaaaaagcatgcatttgtaggctcttttggatcctctccttggaccagtggctcggaattttagtatccttatttacactgaactgactccaaatctaaaatttgattatagagaaaacacagatgcctgtacatcagactaaatgacgaagcttttatgcagaaacaattaaatgtacaagacataaactggaagacaattgtgaagattctatgtagaaagtaagcgacaaatcaacaacttctattgtggaaaatttcaagcatatacaaaagtaaagagactactacaaagaactcccactcagcttaaacaattagcacccatgggtccgtctttttcatccatttggttggtgctgagtcgccaagtctgcctctttgggaac

SEQ ID NO: 50844 - DNA, 1678 bp, Bovine  19866881112433
atgatggagtcctgacctcaattcctccctctctcctgatgctttagatagattccagaccttattcctgagcccaggtagatcctcctgctcactgtggatttttcatcttgagaaatacccttacttatagcccatttgaggagctcaggtgatctacaagcccaaaacataccactgtcctttacccatccaaatcgattttgactcctacctgcaggatgctaactcttaccacctgtgaatatggcacaaaaatttgacataagaaaaccctccctgtgcattcaggaatgctatcatgcataaagacaggagaactattctctcatatcccttcaggaaggaagatagatttatggactttgagtggaatttttcctgactcttgatgactgactagacagaaaaagggaagatttattttctcactggctctcctgtgtacaagctcggtcatctgcaacccagctaattagaaaggtcagtggtaccttctgagcaaagcagagaaggaaacctgagccaaactgcaaatgtacatattactgatgactgccgcactgaagcagtgggaagatggagaataatgctcacactcagtggacgacctttatgagacatttttaagacgacgcagtgaaggctactgtggaagatgtcactgtcagcaccctcagggcaaaattaataacgcagcaaggctggtaccgtgtttcattgttcctgcagaagggaacagcgggccattatggatacaggaaaagtttaagaataaaaaaaagatgaaatattcctcaataagagaccatcactgagcgcacagaagctacagcgtgccacctgactccttcctgtagtgcaatgaggggaggcatatttcttgagcattgggtatgttccagacacagttattaaggtaattttctatactatagaaataacatattattgtcctctcttcatagttgagaaagcagagatttagagatgttaaatagcctgccgaaggttacacaaccagcaagcgggaaagccaggaccaacgcctgtctgtgtgccaagtgccaccccaaagaaggcaggtgaaacgtctttcatgtcagatcgctcttgctacttcaatcctactcttctatcaaaagtaaatactattaaaattgtaaaagcaaggagatcaaaccagtcaatcctaaaggaaatcaaccctgaatagtcattggtaggactgatgctgaagttgacactccaatactttggccacctgatgcgaagagcccactcattggaaaagaccctgatgctgggaaagattgagggcaggaggagaaggggacgacagaggatgagatggttggatgttatcaccgactcaacggacatgagtttgagcaaactctgggagatagtgaagcacagggaagcctggcatgctgctgtccatgagtcacaaagaggtggatatgacttagtgatcgaacaacaacattaaatgactataatttaatactatagttataatgaaatatcagattaaattataattaatatcatatgacatcccttatatgtggaatcaaaaaagaaatgatacaaatgaaattactaacaaaacagagactcacagacttagagaacaaacttatgggtgcctgtacacacactgctacatttaaaa

SEQ ID NO: 50845 - DNA, 1323 bp, Bovine  19866881118086
catgggatttcccaggcaagaacactggaagtgggttaccatttccttccccaggggatcttccctgactcaggtatcgaactcgagtctcctgtagtacaggcagactctttaccgactgagcccccagggacgttactttttaaataaagtgggtgaaaatgtgaccacgtgaaatttaagttccaggtgactttctaactttcttggatgtcagcatctgtctatctctttgtatacatggaaacaatctaaaaacaatagaaaaaaatacaagcaataaaaacagaatatacttttcatgagttaagctgctgtttataaaagcaaacagtacattattgaggtcataacttacttgtatgaagaacctctaataagctcaacttaaaaaaacttcatatcccattatctcttggagagagtcaccatacatatatacaacttaaacagtgctggtatttcatataaaaatggcaaccagagcagcagatgattccagagtttctactcatcttttttttgtgtgtattattgaattattagcttttactggacagtggcaaatgcagaaaagcatcaatttcaataatggatctatgacaccaggaaaagtagtaatccaaatggaaaggagtcaaacattttgcaaagaaaatattctccttgaataataacgatgtgcttgaatcctgtatgagataattaataaaatgttcaaatgactaagacaatcttaccgtctggtgcctgaggcataactaaaagcaaagcgtgaaatgagaaagccagctgactcccaagagaaatcatctacttcatgggaagaaagtgacagcaagcaacctaatgcactttttccatctagacaagggatacaagacactgtagagcagggatgcccacggcaaatacatggcttagagaaaaacaacctagggcggcactttccctgcacctgataagaaggtcaggaaggttacatgctgaatgtgacaggcatttttctctcttctagctttgttttgaattttaatacgcttaatattaaagacaatcttattttgctttccaggtagtctgagaattaactttaataaaataatctcttttgtgtaaaggatttatttggatacagccagcaattttagatggtacttatggtaattctttattcaagcaggaggtaacacataaatgttcctgtgtgctcagtcgctcagtggtacctagattgtagccctccaggctcctctgtccatgggattttccaggatactggaaatactggggtgggttgccatttcctcctccaggggatct

SEQ ID NO: 50846 - DNA, 843 bp, Bovine  19866881141126
ccatgacattatatataaagtgtttaataaatagtttcggcactttattttcagagcatttttttttagcactggagaagctggtaggttcccagactgagagacaagattctcatcttgagcagctaaagctttggccttgtagctacaaacagtaagagggagtagtttcctgggtttcactgaacaacaataagtggatgactcttcccctgcaccgttaaatgggctaaaaaattgaacacttctgctatttttaatgtagactaatcagacaaaaccaactgtgagatgaaggaagctctttgcaaggctgtattgaaaaacaattgttccagatttagttaggttaaactccccactaaaaataaatctaattacaacagtcaatgatataattaaaacaaaagttgctattagattctagagccctaacctttatacaacacaattttactttatggaaacgaaaagtgctctaagaattataatgataaatgttttgtttttaatgcttgtccactggcagttggaaaactctgcatttgggccagatcctgactgcttgctgtttatcacgtcactcagttcaattgctcagttgtgtccaactctttgcaacgccaaggagtgcagcacaccaggcttccctgtccatcaccaactcctagagcttgctcaaactcatgtccatcaagtcagtgatgccattcaaccatatcatcctctgtcgtctcttctcctgccctcaatctttcccagcatcagggtcttttccagtgagtcagttcttcgcatcatatggccaaagtattgcagcttcagcttcaacatcagtccttc

SEQ ID NO: 50847 - DNA, 768 bp, Bovine  19866881155480
cttacaacaaaggcctgtaaataaattcttgctgctggtgcccagcagaaaatcaagagttctcttaacagaaaagtttgctattcaacactcatggaattaattaccaatgtttacagcacaaattttaggcaggcccaagaagagtgatgcccactgcctggaatagatataaaactggaattaaaaaaaacaaagcctcatgtaggtcaaccaaccaaactcttaggccatagttttctatccaattaatgcccatttagtcctaaagagtaaatgtccgatcttttaactgaatgcatatatacatatacatcatatacatactataccacgtataattgtgtttattgtgctctgatgtaacaatcaaaattcttttcaacgtcggtcactttgatgtttatctctttaattctatcttgtagttttcctgccatgtttcacatacaaaaacatactgtatcatgatttttctattattttgactgtcaatattgctatatctcattagcccttgatcatatgcacatgaagatagaaacagagttaagggcaaaaatggaagcagctgcttaggcctttctcatttgactctcagaagaaccaagataattcacttccacatctacttagataatcagaaatgctcaaaacctccctaagagtctaattactgttgtttactccaaagtccacgcttactctttttcatagttaaccagctggcattcctgctactagttctcaagcattttattttcggtt

SEQ ID NO: 50848 - DNA, 1732 bp, Bovine  19866881159621
aaaccgcttcctgagaatccacccgagagctggcagagaccctggcagctggctcagtgctatgtgagcaggaattccctgatgctgtggtccaaagagacagagcacaggttcggtggggcacattcccttggttccctggacccagggatgatcatctgaacgatgagagatgggaacgttattccactggctcctcccattggacatccatcctccttcagccctgcacctttgggttccccagtgtgacccagctgggggacacatgcattgaataaggctctggggaggactgcagagagatgatgcaagggcttgcagcaaaatcctggcaggaagagaagaatctgagcttcttccatgttcaccacagctgtggttaaaatcagaagagacctgagtaaatgcaacatgggccccgagggtctctatttcagacgaggacagcaaaggagacagcaggggcatgctatttacaactgactctcacttaatgaagatttcttcatcttgacatatggcttaaaagcaataataattcctaacatttatatagcacgctcatacatatttatatgtcccaacttccaccaaggtaactattaccattacttttcaagggttaaaggaaggaaaggaaaatgaatatgtcttacagagcactggtataagaaatatatcttatgtatcagcgatctttgactatcagagacaaagataaaaataattaaaacaatcggaggcagttttgcccagcattgtttttagcattatattctgaagagtacatgagaatacaatgagatagcacccttgtgacagggagaagctgatacacttctttcagagggaaagttgaaaatacgtaccaaacactacttttaaatagctatttatatggaatactactcagccataaaaaagaatgaaattttgtctcttgaacaacaaggatgaacttggagggcattatgctaagctcagacagtaaagcatctgcctgcaatgcaggagacccagcttcaatcccctgggtcaggaagattctctggagaaggaaatggcaacccactccagtactcttgcctagaaaatcccatggacggaggagcctggtaggctacagtccatggggtcacaaagcgttggacacgactgagcaacttcacttcactatgctaagtgaaataagacagacaaaaaaagacaaattcagtatgacatcactttcatgtggactctaaaatatacaacaaggtagtgaatataacagaaaaggagcagacttacaaatatagagagaaactagtggtcatctttgaggagatggaaggggaaggggcgatgtaggggtagtggattaagaagcacaaactattaggtataaaatgagctataaggttatactgtacaacatggagaatatagccaatattttattataaatgtaagtggaatataacctttaaaaattatgaactactatattgtacacatgtaactcatattgtatatcgactatacttcatttaaaaaaaggtaaaaataatcactcatgacatttgatccagacatcctcaaagctgagtagaaagttgatatacaaaagtattcactgtagtcttatttttaataacagataattggaaacatctgaaatgcccccaaatatgggatagtaaaataaaatatggtgcatccatatgttcttatcttctggatttctcaa

SEQ ID NO: 50849 - DNA, 1007 bp, Bovine  19866881160379
aaccatcacattctctgtcagccccttctcctcctgccctcaatctttcccagcatcagggtcttttccaatgagtctgctcttcacatcaggtggccaaagtattggaacttcagcttcatcatcagtcttcctaatgaatattcaggggtgatttcctttaggattgactgatttgatcttgctgcccatgggctctcaagagtcttctccagcaccacagttcaaagacatcaagtcttcagtgctcagccttctttatgctccaactttcacatccgtacatgactattggaaaaaccatagctttgactagtcgtacctttgtctgcaaagtaatgtctctgctttttaatatgctgtctaggtttgtcataccttttcttccaagtagcaagcatcttaatttcatggctgcagtcaccatctgcagtgattctggagcccaataaaataaaatctgtcactggttccacattttacccatctatttgccatgaagtgatgggaccagatgcccttatcttagtttttttattatagctagcttcacaaaatttcacttatgtgaatatcaatatactacattttttaaatgccagcttttatcatatgtactgcttcaagtaacattcaattattatatataactcatttttaggcaaatatttttcattatttcagccatgaacacatgctgaagatagagatgacattattcaagcatgagcaggatttgaagaatatatttgaaagaccagttggcagtacactcaataatcttcagaatgtagaacataattgtgtgagggtgaaaagaatagatcacccaggtctgatgatgaaactgagaaactctaacttccacgcggtgcagaatgttcttgtgcacaagtcataagaatataaaataagagatttgaaaatgaaatttttcctcagcagagtggataccacactgcatttctcagctgcctggatatggcaagtgatgtatgttcataaca

SEQ ID NO: 50850 - DNA, 2126 bp, Bovine  19866881174911
tggtttttccagtagtcatgtatggatgtaagagctggtccataaagaagggctgagtgctgaagaactgatgcttttgtactgtggtgttggagaagactcttgagagtcccttggactgcaaggagattgaaccagtccattctaaaggagatcaactctgaatattcattggaaggactgatgctaaagctgaagctccaatcctttggccacctgatgcaaagagacaactcactggaaaagaccctgatgctgggaaagatagaaggcaggagaagaagggatgacaatggacgagatggttggatggcatcactgactcgatggacatgagtttgagcaaactccgggagagggtgaaggacagggaagcctggcatgctgcagtccacagggctgcaaagagtcggacatgactgagcaactgaacaagtctttggctgcagtgagggagccagtatccatatctggacccagtacatttcagactatccatatcccttagtatctttaaagtttctaatactaaaatagcatgaaaatactcctaaggttgaagatccttacaaagatgctcattttccattaagatataatgctgtccttcaatgataaggataataaaatctcagagcagtggtgtaaggagagaatgggacaaattgttgagagtaccactaaaacatatacactgccatatgtgaaacagataatcagtgggaattttctgtatgatgcagggcacacaaacccggggctctgtgataactgagacgggcaggatggggtgggaggtgggaaagaaagtgaagtcgctcagtcatgttcaactctttgcgaccctatggactataccccccagactcctctgtccatggggagaatacgggagtgggttgccatttccttctccaggggatcttcccaacccaaggatcgaacccaggtctcccacattgcaggcagactctttaccctctgtgccatcaggaaagcccagggaaggtgagaaggaggttcaaaagggagggtacatgtgtatacctatggctgatttctactgatgtatggcagaaaccaacataatattgtaaagcaattatcccgcagttaaaaataaattaaaaaaaataaagttttgaacacatttcaaaaaagaaatctcagagcagctcacaggagggatgaagggcactcatgtgaacctcagagccccactaaaccctccaggaagtcatttccatcagatttcctactagcctggggtggagcggttgagacagctggcatgctgttatactcgcaaaatttaagatacttgtatatttcagcatgggcccgacaaaaacaggggcttgtgttttataagatgataccaaccagtccttgccattagtacgtgaccttcaattaagagtgtgaggaagatccgaagtggaagtggataattaacacctttcatgaaaaagtttctgaaaaatctttaacacaagtcacattacaggtgatgaggtaaataggaagaggatgaagaagaaataaaagaatttactctgtgaaagcgaattgagacagaggatttcagatatttattatttacttctggtctcttctcttcatacacacacatatgcacatactttcatattcatgttcagagaataagaagccaccctgttggagtaagacagaatgtaaataaatacattatatgggataagagttcaaatatctatgaggtacattaaagaattcatggtcttagaatttcatctccctcttttcagaatactgatagaatgatttcaggaaacaaaaatcatgaaatattttggagaaacacaatggatatttacattctatcctgggggttctgtcctttcaccaaagttgcataatatttacctatctaccttttctgtctgcttatcactttcatagcactgtgctttcattcctgggactttctggcatagaagaaaactgctttgcaaacataacagaaatcagagagaatgttaagttgatgtaaaaaacctaagataactttcaaacagcattcttgctcattgttccaagtgttttctggtaacttatcatttttagtgttaactaagattatt

SEQ ID NO: 50851 - DNA, 579 bp, Bovine  19866881225931
acaggaatttcacactatgtgcacgtgaaattaagttcctgatacgtcgtgttattaatagaagcaaaggaagaccttgctggctaattctcatgaggatctctcttctggaatttaccagcatttgttacccaggatttctgaggtgttgctgactgctgcacagtagcttcgactgagcgacttcactttcacttttcactttcatgcattggagaaggaaatggcaacccactccagtattcttgcctggagaatcccagggatgggggagcctggtgggctgccgtctatggggtcgcacagagtcggacacgatggaagcgacttagcagcagcagcagcacagtagctttggtcaaatgattgggcaaaatcactaaagcgcagcatgaatcctggtgtttgcttgggctatggcagggtttctcgatctcagcgttattaatgttttaagccagacagttctttgttgtggagattgccttgttcgttgtaggatgtttagcaagatccctggcttctacggagctcccccgaggtgtgatgaccagcaatgcatctctagtccttgataca

SEQ ID NO: 50852 - DNA, 1298 bp, Bovine  19866881226044
tgttctgaccgtgtgagtaggtatctataatctctgaattagcaccacaatcaaagcagatacttgtgaattaggttaaaccccacaatactggaaaataaaatttaagaggaagccagttgaaataaacgtcagggcctttttaactcatactctgtcactgtcccagggaaaatcatcagctccggtaatgatgcttttcccagaggccgagcccgccccccatcccgtgatcattgcccttattcatttcttgtctcaagtcatctgcagcagacctattttttaagccctacgaaagacagtcaagtcataattaacatcttttcagtggacagtgacttagctccagaaatcccctcaaacctcatcagagtgaactgcctaccttaacgctttgcaaaatgaattaatatgcatctcacctccaccctttgaaggaggtgacagtaaccagtgaaaatgtccaaaaagatggaagagcaaaaactgtaatcaaacaggctgaaaaagaaatctgaatcatatttgcctctttcacacacaaaaatatactgctcaaaaaacttaaacatctactttttgacaaaagcttataaaggcttttaattacttaatttgtgtctttcaacgtgtaataaaacaatgagaaaacaaataactgtaggagtaaattttaagtaatggaaaaagcctagctcccttaattaaatgcattttttaaaaccgaataaccaaattcttcaactcttaaaacaatctgccttaacgagccccaaggtgattcttgagccactcataggtagaagaagaggaaaaagttcgatgaccttgtaaattagggactaaaacgctgtccgggtgtgagagtcagtacggtctcagtgggaattacaggaaaacatctgtccagaaattgttttttggggggaaattaccatgaggaaggggaaaagttggaggtaaaaacggggaagggaggtgacgaatggtaaaataccgaatgggaacccaaacgatgcaaaattacgaccttttttgccccagctgtcaagcaaacaacttctaagcatcttcagataaaaaggaaaacagtgatttggcacaggcgtcagctgaatgttgggagagttggatgaatggggcagacttgttatatacacctagtggtggggtgggatttcccaggctgcagcctccacagcttttctttgctgcactgcagaggcgccatcttctccgtcttaatcttcgctcaatttccagccttttatctgcaccctaaaaaaaaaaatgac

SEQ ID NO: 50853 - DNA, 741 bp, Bovine  19866881235035
taatggtgaaaccatcccttactatggtgtcatggttcttactacattatcaaatgtcaccaagtatgaaagaatcctgttaatgtctacttactgagtaatgttgtaaaatttcaactctcatgagcaagcaaattaggaaatccttacaatttctggacctacataattcttcctagtttcatctgtgcctgttttctctcatgatgcgatataaccaactcctgctagcctgtaaaagctgattattaaaatattgaggaattttgtgagccacagccattggtggcttgcaataccaatggtgggagtatttacaccccagaaattgacaaacactataaaacagagtgtttaatttttctgtttttctggacacacaatcagatttcccagcatacctgactctcagtcaaagaagaaaaataatttcctcttatttcctgcaaaggacatgggctcttgtcttatcagagtttagagcttctggtaatactgtgctgttcttcagaggaaccatgcagcttgatgacaaattagtttattcccgtaataaacgggaaacaaaggtattaggacaaatagcagtgtccttttgtgaatgctcaccagcaagagtatggttagtctaacactttacaagtatttttccaagtggcatttttataactaatctttcttcatgggagggatctgagaatcagattggatataattggaatgacacatgtactgggtagc

SEQ ID NO: 50854 - DNA, 1736 bp, Bovine  19866881343800
ggtttaagtctgtaagagcggcctatcaaagaagcaaatttacttcctatcctcagaggttttaccatttacaagaaagaaaaagtagcacttataaacatttatgccaagaggcagtcagtttaacaaaaagctactggaggtgaggggtcacttttgctaagctcaacaggcagattgcattttaaaaaggtggcatttgtgacaaaccatgcatttgggtcagactgtaatttgagacattctaagactcaaaagcaaggatgagaaggtgggaaagcattggctgtatgtgggaaatgctaagcagcctagatggaaaagctagcaggacccagatcacaggaggcccagaatgtatagtctgggagtctgtattttgtttgctaagcaataaaatgacaaaattaaagagctgtgctttgtaaagataaacacagcatcatggatcagctgggcttccctggcggctcagatggtagagtctgccggcaatgtgggagacctgggtttgatccctgggttgggaagatcccctggagaagggatacccactaaagtattcctgcctggagaatccccatggacagacaagcctggcaggctatatagtccatagggtagaagagttggacacaactgagcgattttcacttcacagaccagcaacgggccaattagacctaattaactatttgcacaaattcttgtttgtcataatgttactgccccgtttaacaatgaacaatataataaaaaaaattataagtgaaaattccatcaaggctagtattttcacctatgcctatgataaggcataggatcttatttgttatttccacaaaaaaatattaagccagctctaatttaagaacttgttaatgatgtttcttgtcacggactcagttttcttctataccagtatgtacaacagaaactttctatgataacagaatactctgtgtctgtgctgtctaacatggtaaccactagccatatctggtattgagcaccagaaatgtggctaaaaggcaaatgaggaattgaatttttatttatactcaattagaatttgaatagtcacatgtggataacagccacagaaatatatagcacagttctagacagagccttctaactggatacttgatgattgacgatcattgtccagttcttggatccacaagcttttggaaacattactcttccatgccacctttcaaatgtaccagctagaaaagaggattccttccaagaagttccccaaacactgaatgtgtcagtaccttatcacttaatctattttaccttctattatatttacttgcttacaaactttctaccctcttagacttaaagaatattatggaaatgccaagtggcttctttctttgtagcccaccattctcaatagtccagtgctctgcatatggtagacaactaaataaaacaaaactctgaactaatctgtatcactttcccaaagattttggggttaaatctgatgatggctaaggtcattaatcaccttcaaaacttttgcggttctgtaattaggttttccctggatttgctttatgccatttcagagtcttctgtcttttgacagtcccagaaatatattaactatggaaataatgttaaagaaaaaaatgctgtgcttatacatttctccccaaatcaatttagtggtcccaagatcactaaattgagagaatattctgagtatattttcc

SEQ ID NO: 50855 - DNA, 848 bp, Bovine  19866881457763
cttgtgtgtttgtagtgggaagggcagctgtgtgataatcaaaagcatatgctatttggcccgactgttcaacaaatagtttctctctcttccctgttgtattttcaggtgtattttttttttttacatgagccttcacttgaggtgttacattacactgaaatctctgaggatcagttctgtgccactgagggcttttagctgcagaattttttttttttttaatagttgattggatgctatctcgaaggagtctggctgtccacactgttcatgcaattcttggagtctagtgagataatctgatttttaaaatgctgcctgaattgcaaaatcatgctcttttcaggaatgtgttctcaaagagttagaaaattaacactgaaccttgtggaaccacctcgctttgtgtgccctatttttttttccccctaagaggagtctgaggatcctgaacaagctgagttgtcactggcacgtgggagttggtaaaggcaggagtgtgggttctgcagtttcatttctccacctgaggaattcactctcctggtgccacaagaaaaaaacaaaatctcacaagcatctaagtggaattactgttccacgccctcattgatgattacactttctacatttgagtttcttactgttgttgtgtttcatgtcagacattccttaatgttttccataaatatttattgaatgcctttatatgagggggagagagagagagaggtgaatagttaaagatcaaggtggatgtccagtagacagtgaagttcctcatctgtttgtatttacgttgaaaaaaaaaaaaggaatgcttatcccgcacacttgaatcattt

SEQ ID NO: 50856 - DNA, 1910 bp, Bovine  19866881497777
ttcatgtactgttgaagcctagcttgaatgattttgagcattaccctgctaacatgtgaattgtccagtagtttgaacattctttggtattgtccttctttgggactggaatgaaaagaccttttccaggttccattgtaggtaacctagagaaaatataaaaacatgcataattctaccacctgtaaatgcctgttgtatttcacgttttaaagcatttttcagatcatgctgtaggttccattttatatcctgcattttattccttaacattaaatcttctgacattataagttctttgtaaatgtagtgtctaatggatatatgaatctgtttagggcatcaggagctatgtaattgtggacatgtgcttttcttatttggcatttccaacccgaggttaggatgaaagtagtgatgtagggagggagcttgcgccaaatacttgttaatattttaagtatttattgaatgatttaaattgctgccctcgagtagtgttcaacacagtggtccttcagctgtaaatgacctaaaggaaaagagatgagcaaggactgtagagattaacaaggataaagaaataaaggaaacctgacctcgtcattcaaacaagcagtcctcttatttagtagttccatgatcacttttgtagaaagaagtttgtaagatgctgttaatcctgacaagcaaatgtagtcagggctcgaatgtagaagtcagtaaaattgtgatttcagtttctagagcccctcattaggagctctaattaggtaacgtgtttacacagatgtaaataaagtttcctcctttcatctccttggtgttcaatttgctcctcattttatgtggttgaaaaataagttgggcaaataagaaacatgttttctgtctatctgactccgcagacccaaaaatgaatataaaaatatctgtaaaggaataaaaatcatgctgattaaaaaaaaaaaagttgggaagatgtattccatgaagttcccaaaggtaagaatctttagctacaaaaaagaagaagatttgattttaaatttaaaaatgtgtgtggtgaggtgccacttccatagaaccctgcctagggctgtggaacacattcagccagacccgtattaatctttgattattatctgctattcacatcgacaattaaagaatactatatttcatttcataggtttttggagtaaggattatgttgttggctgaaattgaatactgtaaataggcaataaataaatgttacccctgcgagcccaaacttgtttttctttgttttgtcatatctccacaattaaccactctttattaaaatgatatatagtctctcagacctagttatttctttagggctgtctcttctatgaacctcttcttatactccgtctccctcaactcatgtaaaaatgttaaccaaaccaaatgtgtatgctttttctccattaatctgtcttttgtcagtttaatttgcacagacccaggaactaaacctaacagggtagagaaaaaagtgttttccactcctacaagtattcagctggaggaatagtattaataaatgcaaaggctatgaggtgtctgaataagtcggtgaattgttacaaatatctcatgaattatgtctataatttatcagtgatggctcacattcttgaatcatttgtgaaactaatggtcagtgtcttccatattgaatttactcagtgttggagaagaatgcatgttttaatcaagagggatttatgcaagacgttctgtattctaaacattttttaaaagagttcttcgagtatataataattcagctttgcttctctttaaaaatgtaagatggggagaactactgttctacagctatttcagggtttttgtttttgtttctagcaagcattaga

SEQ ID NO: 50857 - DNA, 1527 bp, Bovine  19866881658932
tatttctattaatattttacttattaaaaacacagcctcggatgtggtcattcgcccttggccacttacactataaatatcaggtttggctgtctccgcccccctttcccctctcgtgctgccaggctgcgtgataaaggaccaaatcaccttttgtatccaaatgtctttgtattctcagcaacatttttttctcctgttctgaagacttggcttgctgccattttcttctccctcactgttcctgccaatgtgtggcattcagaattgacttgggcatataatcccgtctttgaatgcctggtctgtatgcatccctaagctgtatggtcttgttgaaactgctgatccaaatgacatcccgtctaggacagcttctcttcctatgtacaccgctgctcactttttcttattttcttacctttctatttccagggccacacccaagaggctttatccctccttcatggctttaccgagcttcccaggtggctcagtggtaaagaatccacttgccaatgcaggagacgtgggttcgatccctgggtcaggaagaaggagaatgaaatggcagcccactctagtattcttgcctgggatatcccatggacagagagcctgggcggaggggttacggtccatggggtcacaaaagagtcagacatgacttagcaactaaagaacaacaagcgacctggctttgctgtccccttgtccattgttaatcctaaaagctttgtttctctcccttgcccatttcttgaaagaccagggtaagttcaagttaatattttctgagaaccagaagcactttggaaataccagctaatggtaaataatagtggacactattgtgcctccttcagtgttttctttgggtcaaacccaaaattgtgaaagtcgacaaacacaaaaggaaatactctcacttcatacatttcaacggtatgtcatctattaaatagaaaccagtctttaaaaatacagagaggaaaaaaaacacagagagggagataaactctggcttacctctgcctccctcaaactgggaacaaatttcattcgctaaatggcagattatgtggtgaagctttgttctcctgataaattcctatttgcatttcccctggggatttaacagagtccttttgtagttaattaactgtaaaataagataaggttggacagttgtaaaaggagttatctttaagattttccactggactgggcatcatgtattttatttctaatcaaaagccaagaaactatctctaaactcactgggaggaaaacccactctcaccagcccctctcctttgatgttgccgcgtgtcctggtgagtgcttttattggaaaacttaaggagcaggattggcacatcaatagcgataagccttttgaagtggtgcccctcccatccttgatgctcgagattaactgtggttcttttctagctgctcctttttttatatatgacttgtgtattgcacatgcttttttccctgcgctgtgttcaggagccacaa

SEQ ID NO: 50858 - DNA, 731 bp, Bovine  19866881743563
aaaaaaagcaggcaaaggacatggggggcggggatgggggcaggggcaaggaccatagggtcctgctccattttagaaggaaggaatggagaatcatacaggaagtttttctaggtcaaggctgggaatagcatgtattccattggctagaactcatgcatgtgaccccatctggctgcaaggggtctggcaagtgtggcctggctgtgtgctagtgaagaaaggaagtgggtctcttgaataatagccagtctctatcacagatgtccaataagtccatctttactgggctgttaatatacttcttcagcttgtaaataaccaatgccatttgatgtccaaccttcagtggctccggcagttccatcatgtgaagtgcccaattctgctctgcgtggaactgtggtagagctgcgatgtcaggacaaagaaggcaacccagctcctgaatatacatggtttaagaacggtgttcctttgtcagagaatccaaaacttggctcccatatcaccaacagctcatacacaatgaatccaaaatctggaactctggtaaggtcattttaaacattggcctaatgactgtcttgcatttgggaaaaagaaattattagaactaaaataatgtgagtagagggctgataccattgcttgttaagtagagagaggcaaggggagcaggaaggatggagccactcacacagagaagtgatgggaaacaccgccatagg

SEQ ID NO: 50859 - DNA, 2673 bp, Bovine  19866881746300
tctttcgtcgcattttcccaaaacccatttccaggttaaaacaactgagaccttcagtataattttactttgatttactttttaatcatctttacaattttgaatgaaagacagaagctgtagtgtttggaatgagagataccctgaaattactgctctatttgaaagccttaatcatatataatttcctcgtttataaatgttaaatctcaaatgagagatctgccttcttcaaacatgttttgtgtgccttttctgtgcaacaaggccttcctttgaaaagcttgttcagacttagttttgattcaaagcctgagcttttgcatgcctagaattcttgctcttcaaaatatttgctccctggagaggtcagctgaagatggagttgtcatgtgactatggaccattgacccggaagatgtttaggtaacggaatgagctttggcggagttccactgctttctttctagttgaggggagccaggaaaggagggcagagctggctgtgttcagatgggaagaacttgcttaaaaatgtttgagacctgaatgtacccttcatttgatgcctttgccttactgcttaggaacattttaaactgcagcattcctaagtgggccgtagcgtgtagtgatacatatttaagtgatcttgcatctaaacaaatgcattcaccctctgcctggtgagtagaatctgaatgatgcctgtactctgttagaaagggacagacgttttcattacaaaattcagtcaagcagaaaagtagcaaagtgagcagaaattttcatttacatccatgattgaagttgcagtgataaaagaaaatcgctaggttcacgaatagccgtgttctcattctgttatataacacggaggatttggtcaatacggaaatagttttttgatacttacattattgaggaaggtgctgatggatagctttaaattgtacataccttttaactgaccttagttccccccaacccagggttttcatagtatctttaaacagactccagtacccccttattatcaagtccattattgatttgttaaaatatggactttatgttccattaccatagagacccacagtaatttctttgcctttacttgtgaacaccaccaggggtggggcctcccaagtgacgcagtggtaaagaacccacctgccaacgcaggagacacgagtttgatccctgggtcaggaagatcccctggaggagggcatggcaacccactccattattcttgctggagaatcccatagacagaggagcctggcggctacagtccatggggtcacaaagagtcagacacgactgagcaactaaaaaacaacaagtcagcagatgaaatggaactcatatcactagggccaaacctagacaccaccatcataagagacgggattagagagtgagatcaggattttccaatttccctgctaaatagttcatgatataccttttggtatatatatatatatataagctttaatgcagtaatttgctgccccaagcgctcttccttagaagcccagaatttcacttctttcggttctctcaggagcagtgagccctggcaaactgatttacagtaatgaagctaagccttgtttacaaatctaagtggcagttgctaagtccacagttgaatggtaactgagggagagattcttatatggccagatccatccccaatgaaaagaacatgtgatttttgaaggatgattcagaactgggtaatttctaaaacatatttttattgaagaacttgatgaatcatgtatacttttttttttttttttttattctgtgagataattgtgtccctctcccctaggtcgtgattggagtacaatgacaggactccagtcctttctgctatccttgaacaaagccctgggaatttagagcagtgttctcatgccagtgaaaggttgtgctcattccaaataccgcatcctagatacttcctggctagctcttttgttaaatgctgtgatatcttttttctgcgtcattctctccttatctacttcctcttgccccaaatagttttgcatctttttaggatataatttttgtttctggaaagttttgaagtagaacatccctgaaatacagggcgacatgtattcctctgattcttaggagacacccccactgtctcctaaaactagacatttcaggtctaggctacacaccagagaatccagaaggtacttaatacgctcccaaggggcacagtgtggcagttgggtgtcaaggggtctcccaaatagaagaggtttgggctggaacagccaaagtctgggcatggagaacacatggagtggtagctggttgtaagcaccggtgatgaataaagtgtcaagggtgctgggacagactggcaggaaaatggaatgaagccagtgaaactcctctgctaaccttagtgagtgatgaagactccaggacatggggtcatgatgagcagatgcacagatggaaaggagaggggagagctagaatgatggtttttatactcaagaaatggtttactggaattcggaacatttttacatgtgacatgagctgagatccatcttcaggaatatggatagttggagggagtagagaggtacagcccttggggctagagacataatcagggtaaatatt

SEQ ID NO: 50860 - DNA, 883 bp, Bovine  19866881812197
tgtaagaggatttaacacctggcacacaaaacattaaaaacaaccctgagaaaaccctggtaaaacacaaagttaatcataatgacctcaattagattttcagtgcctgtcaagttagtagcatatagtgatattggcttaaaacccttgaagttgaaaagcacaattccttaagagagtagaaataatagaattttaatttttttcttaaagggccaattttgatcctagttcacactaatgtaaaaggcaagtattagcagtaaaatggcaaaaaaaaaaaaaaaaagaagcaaactgcaaaaagccaaattataatgaaattttcattttgatggtcgctcaatttcactccaatacacaatgtcttctcttcaaatttcactatcttgatcaaagaaaatcatttctaaacaccttcaactgaaaatgtcccagtcaatcagaggattgatgaaatatttcaacaacaggcattgttttccctgggtcaactgaatgtctgaaataaagagtagcaaatgaagttactgacagcatttcatatccttttcacaataaaatgttttagaaagattgaaagagtaaatcttatttaaaaggcttaatttttttttgtagacttgtagttaggtgtcattcacaacttttttaaacataagagaagctagctgtcaagagtcaaacataattatcactacagtataaaattccagagtcttcctttagaaaatttgtcaagtatttagtaaacactagatgtaaggcactgcagtgagttatgaaacaaattacagaaatagtttgtgatcaagtttaacattaacttctctgccccactattctatttttaatatctaaccaccaaagtacatccttgttc

SEQ ID NO: 50861 - DNA, 943 bp, Bovine  19866881939443
accccatggactgcagcacgtcaggcttccctgtccctcaacatcttccagagtttgcccaagtttatgtcctttgaatcagtaatgccatccaaccatctcatcctttgtcacctttttctccttttgacttcagtctttcccagtattaggatcttttccaatgagttggctcttctcatcaggtggccaaagtattggagcttcagcttcagcatcagtccttccagtaaatattcagggttgattagtttaaggttgactggtttgatctccttgttgtccaagggactctgaagaatcttctccagcactctaatctgaaagcatcaattcttctgtgctctgccttctttattgtccagctctcacatccatacatgactactggaaagaccatagccttgactacacagacctttgtcagcaaagtgatgtcttagctttttagcacactgtctagcttgtcatagctttcctgccaagaaacaatcatcttctaatttcagcccaagaactcgatgctgttaattaaataaagctagtgttagaagcagaagcagaggacagcctctgaatatcaggcatactgaaggaaccagtgatctccacaccctggtcacatcggagttacttatgtgaatcagtctaaaattggactgtcaccttcccacataaaacacagcaggatacaggcagtgtggacgcaagagagaaaccaggacttgtaccacaaccatggatgtcaggccacctgttatactgaaaaacaaaagcaggacatgaaaatggatgaaaataaaaccaaaaaaatcacactgaagcttgcttatataattgaaaaacagtaaacctcttttgggggtgcaaatttagtgtcaccctcagatttcaggctaggaacatgctcaaatataatagagcaagggaaatcacactttct

SEQ ID NO: 50862 - DNA, 1157 bp, Bovine  19866880452705
atgtgagagttggaccataaagaaagctgagtgctgaagaattgatgcttttgaactgtggtgctggagtcccttggattgcaaggagatcaaagcagtcaattgtaaaggaggtaactctcaatgttcattggaaagagttgaaggctcattcactgtaaatgtagatgaggccaagagaggctgaagtctgaagtactcttggtataatcattacactaaactaatttagaggtccccctgccttggaaattaaaaattctaaacaaatctcattttttccatcagccttctttttaagaaggtggattatgaacattctctccatccttgaaattgggctggtaatcttgatttgtccatagtacaagcttagttgtagtgaagagaaaaaaaatcttgggtttcctgttcttagagtagggcttttaataatcagaccagaatgaccatgtttctgttgttagcactttaaaatcattgtatcgagtcttgtgaaggagattttgtttagctgctacatgtggactgtaagattttaggtttctaatctccttttctaccactttttaaagttgtttttaatacttttgttgaaaaagctcaacacaaggtaatgatttgcttcttttaaaactctatgagtacttaagatagtaaccttttttatatttaacattccactgtcaccactatgtaataattttatatactgcaaataggcttacgactagttctcattagatagctgatttaaaaagaaaatatttgccctgataatttagttactgcctttcgtggtctactttctgacttatttatgtgttgaaaaggtctgtagtaggaggacagaaatttagaattagttttctcatgaaatgaaagaagttatcttttcaaaaagctacacaaacaaagaactacacagagacagccagctgccacaataactaaatatacatcttctgctttattttcagtcaaatacatggtaattgtgatatttacgctttttgtgcagagcttattctagaataggaagagattactacgactgacagtatttgaagaacctcgtgcatctttgactcacttgtgtgtgatttaggccctgctctgctgttggattcctttgaggtctaagggcattggttggg

SEQ ID NO: 50863 - DNA, 1787 bp, Bovine  19866880639212
gctgttttgagaaggatcttttagcttcttcccaaattctggcttataccccaaatcttaatttgggttgagcatatgaatatctgggttaaaaacagtcatatccttaaaaaaaaaaaaaaaaaagtcatatcctaaaacagtttgcaaatatatgatcacccatccctttatctaatatcctacttccttttcaaggtgagccttgagtaaatatgacagtcctcctgggaattaggggtaggactaggtaaaatttgggtttgtaaaaataaagttcaaggatattttgtaaaatttgtagtgatgaaagtggacaaagggcataaagataacttccctacccttatctggaatttagtaaatgagcagatacatatatgactgaaacaaaaaagaaaagaataagaaagccacacaatatgatataggctacttactaaaatttcattgaaaagtttaatcatttaaaatatccatattacttaagagaaagatatttagtgctaagtgatccacaatttgatattgaaacctgtcacagaaagactgaaagcaaaaggagaagggggcagcagaggataagatggttaggcagcatcactgactcagtggacacaagtttgagcaaactccaggacatagtgaaggacagggtagcctggggtgctgcagtccatggggttgcagagtcagacacagcttagcgaacaaaccatcaccacagaaagttgagtacatgacctatttttcctaatgtgatagtatactacagcaggttgtgcacagcagtatggtatgacctgaggagactgaaatacccaactggagtcagaacaccatggtcagattccaggtctaccacctaatcttggtcaagccatatactccatgtatgtggttttaatgtgaaaataggtaaaataatgtgtgccaatgtactttgcagggttcctgtaagaatgaaacaaaaataggaaaacacataaaactatacattaccatagaaatataaagaacctctcaaggtgttaactacagagtgatggaaggagaagagaactttaggaaaggcaaagaaatgaatcaaagaatggctgagtggcagtgacagtgtaggagttgtatgctgtaaacctttttaaaacagtttctagcacatttagctctttagtagtggaaactaaggtataaaaagagtgagacggccccagctcgtattgccaaggtaaaattaaaattgtaagtgaggaagaaataaacatctgctatcaaaaaacaagttccaggttgttttttttctttttaagatgagtgattcaagtgagaaataaaaatataaaagaaaacacagcctggttccatgcggctttacttctcctggaggtgataaccatggagagcggagaaagcctcaagggaacaagggcttgcagggctgaagccttggaccagcctcgtccaagagctccgcgtcctgaagtcctagtaaaaactacaactcccagaaatcccggatcccgaagggggtgggcccaacggtgtgtgggcggggccgtcagagcaagcggggcgcttcttccgtgaggagctgctggagaagtggcgggactggcggcgatggaagctctagaggagaaagaggcgcaggtgatggggcgggagctgggctttgcggcctccgggaaaccgcgtctttgacacacccgccccgccggcggatctcctgggctagccacttttactatgttcctctgctgatccatttttagtccggcttcaccatt

SEQ ID NO: 50864 - DNA, 1401 bp, Bovine  19866880859416
acgcgcacggacagcatcttcgcagctccccttgaggtgcttcctccgcagccgcagcctcgagactgactgggacaaaatggccgagctgcggggaaggtcaaagcagtcagcccacgtgacccggatgtaccgcccctcgctttcacccccggacgcgaatctgccagggtgcgggtggggggttaattactttcttcctttaagtatcatttttagattttgaacctccaactgactgattagacgtccgccagcgtcgatccaggcactggttacatattcactttgatctttctcatcgaccttgtggttgccctgggcgaccgcatggttatagcggaactggctgagaagcagtttccaggccgcatcctggtagaaaaacgatgctgccgtcaccttgtcctggggcgcagctggctagcttgaccatcgtgggggttgactgtggcgggtcccgaagatacagctattaaaccttggtgatgtgggtgcaatagttactcttcttgggcgtgtaggcagcagagcatttcctgctgtgcgaattaacgcggattaatcttcagatcgctagccacacccccagagactgagtcaaaaactgggggcaagctgaacgtttgaaaagcaccctcactgtgataagcactcaaattgaagaatcgtagttcttttagattcgatctgaaagaattatgtctgccaattagggcaatgtttaacattaaaatgtttaacaagcaaaaatttgaatagagtggttgctaatcctgggaagaattgtccagaatcactccagagtgagctagggctcaatttttcctttaaaagtagctattttcatgacagtatagacactactttttcatttgaagtaaaacggcaatgatgacaataactttctatacctacccaatgaaatcagggcaggacttttgctccccccaaggagattgtgtgtgtgtgtgtgtgtgtgtgtgtgtgtgtgtgtgtgtgtgagagagagagagagagagagagaaagagagagagagagagatactgagataattgtgaaatgtgaagaatttgggttgggaaggaaaatgttaggtattttgtgatgcttgttgagtcctatcagactgcaaccccatggcctgtatcccaccaggcttctctgtccatggaatttttccaagcaagaatactggaatgggttgtcatttcctccttcagggtatcttcccgacccagggatcaaactccatgtcttttgtgtctcctgcattggcaggtggattttttttttttttaccactgtgccattttatggcattttatgatagtggagagtatttacattaactgcacttgtagctgttttgagaaggatcttttagcttcattcaccaa

SEQ ID NO: 50865 - DNA, 1387 bp, Bovine  19866881138693
ccgacccctccatgcccccatgccattcagtcacctgtcaggcagcatgagctaagcaggcgggggccagaaaccgctgcctcttttgcttctcccactttccagggttctgatatacccctcttccttccctctgtccctcccttctttccttcagataccttgctaaccctatggtacaggcatatattcactattgtaaggtataccaaactacctttctcagacagatttagccccaccaccgtcttcccccatccatgggagcacacccctcacctgagtcttctactgcagtctttgaagttgccagtttcacaaaaagctgtgaggaccagaaaaaaaacaagaagaggaagtcaggaatgctgggccaggcttctaaaggcaaaacaggtttaaaagcaaagtctgtgaagagacaagttctaagtcatacttatgtttctcttgtaagttaatcactcaacttgctctttaatcttcctaaaacatatccctaccttctgattgctaacaatctttatccagatttcataaaattcaatttattaaagacccaagcaggagggagcctcgctctaaggaacacatgagatggagttttgaagaaagatgaaaacatcagaacccctcccccatgaccaggtttctctagctcttcctcaaaataggacatgggtttttccggctcagaggactctaatagcctgaaggagggtattgccaggagcttagagtgcaagtccattttttgtttgtttgttaagattattaattggctctagtttgacatacgtgaatcttggatttttcaggctattggctctcccaggtaccttttcttgttgcttcgggtttgccatgttggcactgcggtggacagcctgctctgcttcatctttgtctcggcatttctgctcatagttcttctttgcctttgtagttatgagacaaaagaggatcaaaacagataagcagactgtgactctgaggagcagccaccctaaccgctcccctcacccagcaaataagagggcacgctgattagggctgtgatcgcctctagactgtgtgtgctcagagcagctgctctttttaatctatctctggaaggtttctccatcccctttccaaatcatgtatgtagcggcaaccctgatcaaggaactaacaactcctatttggcaaaaacaaagtctatgaactttaaaaatttactgaaacaaaagactgaatataaattaggcaaaatcaaatacctgatgtaactagaggacgtgtaatccaacatttattcattacactcagaactgagatgcaatgatttggtcctgagaacttaactaacaatgccttcagtattctcatgtacctcgttacaaca

SEQ ID NO: 50866 - DNA, 1030 bp, Bovine  19866881147532
ttccaaggcccgaagacgagttggcttgaaagcccctgggatcattccctcgaatctctgtgagggaaccaatgcaaactggcattaaggctgtggatagcttggtgccgattggtcgtggtcagcgtgagctgattattggtgaccgacagactgggtaaagacttaacagcttgttaaaagttctaactaaaacatgctgtattgaaaggttacttttagacttggaatggtagatattaatacttggactatacggcgagagtagactgtaatatgagagtaacttgtagtggaatttaagttggggaattctttgaagtactcagtaaggtttatgtttgtttattttttcttatagcaaaacgtcaattgcaattgacacaatcattaaccagaaacgattcaatgatggaactgatgaaaagaagaagctgtactgtatctatgttgctattggtcaaaagagatccactgttgcccagttggtgaagagacttacagatgcaggtattaaggaatttcagtctcattgcagttatctgggatgctgcaaatcttagactagcttatgcttataatgaagtctgattttaattactccctaatgaactcaaatttctactaatacaagtcaatacaaaagtaagaagtaaaaaattatatcggtagtataaagcagcagtaaactgaaggttttgttagtttctttaaactagaagctattagactgggtaatcttaatagtaatgacagtagtaaagtgcttaatttttattctagtagcctctaatttaaaatcatagtattaataatcatgtaaaacttaatgtttattttcttctcagatgccatgaagtataccattgtggtttcagctactgcttcagatgctgccccacttcagtacttggctccttattctggatgttcaatgggagaatattttagggataatggcaaacacgctttgatcatttatgatgacttatccaaacaggtcaaaagaaatgtgtttttagacatgttt

SEQ ID NO: 50867 - DNA, 1977 bp, Bovine  19866881174917
ataaagtaaaaaaagctaagagacatatgttaccaattcctcaaagtaatctcagttcttttaaagaatcaatctatagaaaaccaccaagcaacatggaacctttattttaatgtgattactgtacatctgcagtattggagtaatccgaatggaactagaagaaacaatgacaaaaccaaactggcatttgatgtgaatccacaggagtttaagcttcaaatccagccaagaagtttgttacaatctctttcagctttgcatctgactcttctgagatctttccatcggtcctatttgaaaacaaaagcagatcagttgtgacctgggcaaaaattcaatgactaacctaattacagaattcaaaagaattttaacaagactttttattttaaagcttacaaaaaaggagacatcaggttatgttcatacctgattttgctcaacagggcctgatgttggctgataacgtgagacaagaaagcattctcaaattttgtgatcttgctgggctccagcttgtcaagatagcccctgacacccgcatagataacagccacttgctcttcaatagccatgggagctgaaaagaaagaagtaagttgctcaacaaatgcatgccattgtttccagagttagagaaacttatttttttcacaaattattaacatgtcttcatagatcatggaatttcacaagtagaaattccattattagtactccttcccacctccctggagaaacagtttttccccttattggtaagccttgaagtacaatctttgcacttattccatgagcaccatccatcagccaacaggactgtctggggtaaaaataacttgctgaaattttataataagataatatacattttttggctgcaccacatagcttgcgagatcttagttccccaatcagggatagaagccaggtccttggcagtgagtacagaggtcctaaccactggacccctggagaattcccaatactaacgttctttattagttactctttattaattattagtttattagttatctattagttatcccttgtggctcagctggtaaagaatcccctgcaatatgggagacgtgggttcaaatccctgggttgggaagatcccctgaaggagggaaaggctacccactccagcactgtggcctggcgaactccatggactgcatagtccatagggtcgaagagttggatatgactgagcgaccttcaccttcaacattcttttaaatctgccagattccacacgtatatagccaaggaaatggtagggagacatagaatctactatgtcttaatttccaaaagaaaggtattattatacccttcctagcaattccattgaaatgatgactgtaattaattaaaacaggtatcaatcacattcaaaaggcaacatctttaatcaaaggtaatggcacatactacagtttgtaaggagctatgtgatattcccaggtcctaacacagagtaggaacttgaccaaatgtacaactcacaatactgtccctgcttgagcagctcagtcaaacgcacaccacgactcaagagttgttgagtggcagcatcaaggtcagaaccgaactgggcaaaagcagcaacctcacgatactgagccaactccagtttcatagtacctgccacctgaaacagaaatggttaactcaaacaatacaaaaatacttcaatgacacagaccaccacacaaatacatttttatttttaacctaatgacaaagtgatacaaattacctgtttcatggccctggtttgggcagcagatccgacacgggacacagacaaaccaacattaatggcagggcggatacctttgtagaacaattctgtttccaagaagatctacaatgtaaggaaaatacagaggcatattagcaagcttaaagaaatcaattattttcacaattaagtcactatagcaaaaactgaagccccaa

SEQ ID NO: 50868 - DNA, 1927 bp, Bovine  19866880454883
tcttaaccaaaatgagactgggccttccagatctatggctaaggcaccatgcactcaggagtttggttggaataatgttctctgtatggtttagttggccatggcctacacaagggtagagggtaccattagttaaagttcttagtaaaccaaagattccctaaggcatggtaggatatagcttttacagatagagtcaaacactcctttcacagtactcaggctttaatagtgagaagactgtttaataaatctagggttggatagtagagaaaatactgaataaaatttcacaataagtttttgttagactaaagcctttcgtcatactcactaagtctaagacagcatatttccacagtttcaacacaacaaatgccagggaaaacagatgccttaaatttcattcttttgggaaacagctttgggtcccctttcagagtgtaaaatggccagagcagtccacacgaacacacatttccagcacgcttcactgtagagaatgaaacgccccaggcagcaacatgattcgtgccaagggcatatggcaggtattatgattagttagggatgaagattcaatttgacaggttttctttttgttgttagtcatttcagttttcaaagtgatcagaattaatagtccaggccaggtaggtgggtatctagaacgctgatttaataaaaagaaagccggccttgcatatcatttcaggcaagatttgaattattgcatccagcattatgactactcaggcaataagatgcctggagactgaattcccaaagaaccagtagctggacaaggccaatatcagaaagggatcttgtcacaattgtgtgtggtccatttagtaataggatattgtgactccccatctatgccaaagacagatctagctggagagatcataacagatttcctaaatgccagaagctggtctacctcatctagtcctccttggagggtagggagccagtcctcagaaccaacaagaatcagacgctaacaccatcccagccccaagtctccacgcaagcaaaacacgaagtacctttgttctatagcttttcttcacccaagcagagataaaaggcatgagaattctgaatttcagactctaatctctcatccaacaaatctactgcatgttaaccaagtgcaaagtacaatgaaaagttttctgagaattacaggaagaataagactttcattctgccctaaaaccacttctgatctccaagaggatctaaaatctctatataaatgatgaaaatgcaaggatgaaagcagtcatatgagtccatataaagatccacagaggtctatatagtgactcctaggagttcagagctagatgaaacaggaatgagtggataaggcttcacagagaactttttccttccaactttcagcttcccacagcatttaagctgaaatttgagctgggtcattgagagtggacagaaattgtataagcacaaacacagggtagaaggtttccaagcaataagatgataaactgaaagtgttagtcattcagtcatgtctgactctttgccaccccatggactgtagccctccatggaattcttcaggcaagagtactggagtgggttgccattcccttctccaggagatcttcccgacccagggattgaacttgtgtctccccattaggcagattctcccgcattgcaggcagattctttatctaacagagtctaacaagatgataaagcatgagcaaagccatggaggtaagaaattataagccaagagtatccagcagattcaatggtctgaagttccaatggcctctcaaagaggaaaactaagaaacaggactggatccctactaagggcagggctggaatgccagccagtgagtctacagactttaatctgctaaccaggggggaccag

SEQ ID NO: 50869 - DNA, 1455 bp, Bovine  19866880680408
tatctatgagttcaggttttttagagattccacataaaagtgagatttcatagtgtttgtccttttctctgacttttatcacttagcataacgccctcaaggtccatccatgtgtcataaatggcatgttcatgtggttttaggagtactgacagtgcatataaaattgctttggtatttagattatattgtctacattaaaaagagttgttaagtctcagtgcaggccatcccaaaatacgccatgatggcacattgattattttgaattatattgtttgagaaacagttggtgcaagaacactctgaccttccttctctctgtctccctggaagcaggaaataaatctctcctgtgaaatgtgccctccctgcctctggaggtagagacatagccttatggctagagatagggaattcagagctgagaagcctgtacaaataaaccttgttgcttttttgctaatttattaccccaaacccaaactctgtttagattcttcactgattaagaatccaagcctaaattcctttgttctgtccattccttacaaatttgttgtttctttgtctaaaaagtatcaaagctgtctgctttggtcactttttaggtcctgtttctgtaagattccatttgtatgagtgatatctgtttttttaaaaaattctcctgttaatctgtcttatgtcaatttagttacgagattagtcaaaaaaaaaaaaaaatcaagaagagtagcaaggaaattcccctctttacaacagagtagagcaataaataggtttttgttaaaagcctcagtattataataggactacagcctttgctactatataaatttatgaggaaaactttcagatgttaacataaaatgtttgagaagacacattgtttttgaaaactattttagggagtatataagccaaaaaattcaccactctaacgaaataaaatcaatggccccagtgttctcttcccagatctattataaaactaagcatttctttcaatttcttcatttgtctttatttctctaaatataaaatggaaataataactctccttatggtcagagatgtctgcagaattcttgccaaaaaaaaaatcccctgtgtaatagaaagtcacgttgattgttaatttacttgcaaactactgacagattagaaataaaatcatttactaccttgttcttttttaatatttgttagaagttattgcagaagaatctgaaaataaatgaccacccagtatccaagagttctaacaagaaagataattcagattctcagagcgggacttccctcatagcgcagtggataagcatctacctgccaatgcaggggacacggtttcgatccctggtccaggaagattccacatgcctcagggcaactcagcccgtgtgccacaactactgagccatgctccagagccggtagtgcaaccaccaa

SEQ ID NO: 50870 - DNA, 2227 bp, Bovine  19866880832592
gaaaatcctgtggacagaggagcctggtaggttacagtccgtggggtcgctaggagttggacatgactgaatgacttcactttcacggttcactttcacgcattggagaaggaaatggcaacccactccagagttcttgcctggagaatcccagggacgggggagcctggtgggctgccgtctatgggatcgcactaagtcggacacaactgaagcgacttagcagcagcagcagaaactaacaccacattgtaaagcaactatactccaataaaaattaattaaagaaataaagatgagaaaaactttttcttttagaatgtgagtgccttaagcggggatgttggtgggaaaaggggaaagaactccacagttctctgcagtcatctctacttcctactatggtaacatcactaggctgcttcacaaattgctatgaattttctactccctaagtatatttgttttcttttattttttgcaccatgactattctctcatatcccctttagcactaacctcctttgagtttatggacactgcaaataacgttagtcaaaacaccccagaatcctggggcggcagaggtaacgagctctgcaaccagataaaatcagcaggagtctgttaagaaatcaagcaactttcctctcctgctatatgtttgtggtttcttctttgatcaatgcccaagaacaagctgactcctctatatatttccatttcctgagtggacattattgtcagcaataatattaccacccactttcttttctcctttctcactctgtgtatgccatatttagattatgaattcccagagggtaggctggtcttgtttgagtttgttcatctttcttttttaaatgtttatttgtattccaattttgcattgtacacatagcacattaaatggaaacattcctcattcttatctggtctcttttcaagaggttagggaatcacagaacatactgtgtgctgaattagcgcttttctggagcttggccattaaaaggaaaattaatgacacatatgagatagtctttcttagcagtctcctctgaacatccttgacaatctgctagatcatacacttgatcttataatccaaaagacaacaacagtgacatatttcttggattaaagagaaaaagaacacattgcaaaccaacagagaacaaataaggataaaggagagataagataaattatttatacaataagcaggccaggcggtcactgcatcagccgaatataattattaggtaaatggggctcataggagcttaaagtttaaaccacatggagcagaagttatcatatccctaattattaaattgagaaaccatggttcattggttggaattctgggaatgacttgaatgcaaggaaagagtatgaaagagggattgcaatgaaagtgatttttaaagatctcttctgccatttgtgtagtagcttcttttacatgtttcctcactaatttttatttcagggtaagaacctgtgatgactgactggacaaagaagatggaaaaataatcaacctgagtgaaaaggaggtctgaagctctgagtgaagaagaccccaagggtgaagccctcaggaaggccctgtgatgagcttctataccaggtaatggtcactgctgaacagatgctaatacatggtagactgtaaaggaagccagtaaacattgaggaccccttcacccccagcaaaaactgtcacaggcaatgcagacacacagatgggaaaacagagaacctgcctcaaggaatgtgtcctattgaaacagggctgagcatcatgcaaatcggtatagccttggaggtcggcacaagcgtccccggaagatcatcaaagggaaatgaacacaggcctggatccatgacactcagaatgactgtgatgtattcaatgctcacaccacatgcaacatgttctcggaaccctacatatactattctagttcacaaagacaatcaataatggtcaacatgtacttggtacttactaaaatccaggctgataatcactttgtttaacgtgcaccggcctggtctgagacaggtattacattttctgcttcacagatgaaggaagtaccttaggaatttaaggaatttccaaatgactgaatgagcatgtagttacgaatactgcatgacatggatctatggctgtaagaaatgaaagtgtggatttaaaagaatgtgaaga

SEQ ID NO: 50871 - DNA, 980 bp, Bovine  19866880845332
ctgggaaggattaaggcaggaggagaaggggacaacggaaggatagatggttggatggcatcaccgactcgatggacatgagtttgagtaagctccgggagttggtgatggacagggaggcctggtgtgctgcagtccatggggtcataaagagtcagacatgactgagcaactgaacttgagctgaactgcacggaattgagcatcagagaagtggatactgccatccttgggctaatatgttccttctctaggcaagctgtatggaaatccaattgttattagaaggccatgttgtacatttacgatgagaggcaaagctgccaggagatcaggacacttacaacttctggccagctcatcctcttcctagagcaacagagcttgggaattgaattataatcagaagatagttctgggaattcttcagggcagtttggtcatcacctcttccagttagaggatcttctgagtgctcccataggactctttgttacactttgtccaacaatgtaatagcacgactcaggcttcatcacaattgcctatctactcctttctgtgcatctcttgatgttgtattgtattgctaggttgtattgtagtcatcattttaccttcagcttcagggcagctccctaattgtagaaagtacttttgggaccagggtgagatgtccagaggcatcctcttcctcagggatgaaatagcctctgcaacttttagggcaagtcttcacactgggcccctctgccatagaaagggcttgactgggcaccagcatctgcctctgattttcccttattttcttggctgatgtgaatactttaaaaaaatgatatgacatggcatagctctattctaatttttattttttgaagtttattatggaaaatttcaacatatgtaaaagaagagagaatagtataataactctgttgttccaccccctttgcctccaacagtcatcaactcacatt

SEQ ID NO: 50872 - DNA, 1258 bp, Bovine  19866880945938
tctccctcatctgatacaaaaaagtataacaggttcaggctagtttgctagtgtgactcacttcaccaaggtgtgatcagtactgggtcagcttattattaagaaaagcatgttcatcagcaaggccggcacttgtacccacactacacagagcttcctaccccccaggaagagagcccacctagctctatgctctctcattcctaactccattctcctggcattctggtttttaatattcttttgagtctaatggatcaaacttgactgtgcgaaagtcacctggagggcttgttaaaatgcagattactgggctccaccccagaatttggattcactggggtggaatgggcctgagaatttgcattcgtaactatttcctagatggtgctgatgctgctggcccagggaccacacttcgagagccactcgtagtgataggtgatagtgctcaaccctaattacaaattagaaccatctctggacatattaaacagatgcacatgaccaggctcctcccacaactgagtaaatcagaatctcactgggggtgtgtccatggtgctgggtttttagaagctcccagctgatgctaatgtggggccacatgagaagggctgcaaaaaagaggggctgataaatacataaaagttgaagtgagatttgactcaaaactcctctagagattctgtcttttctcttatgtgagaaacatattttaatattttagaactgtttaaaatatttaaaaagccattacacatcagtatatgtctcaagttctcagaatttgttggtattaaatactaaagaattatagtatgtagtcataataacataagcctttcctttctgtttgctgcaatgggcaggcatatattcaattaagcatgattttggcaagataaatgttccattttctatgagagaattaaaactagcaggatatgagcacagcaagaacttaataaatgccaaggaaaacttactcatcatcaagagagtaattgtcaggagactctactgagtaacactagaacttctcagtgaatctgagctataaataaatttgggcttggaaacacatcccttagttcttggatatcgtcaacggaatctttcacgttttttcctgagacactgactttgcatacataccttgcccgaattgttattctgactataagagttagaagcactacattggatttcattccacgaggccactaagaggccactgaaggattcaggtcactgc

SEQ ID NO: 50873 - DNA, 1045 bp, Bovine  19866881044379
ctgaaactccgtactttggcccctcatgcgaagagttgactcattggaaaagactctgatgctgggagggattgggggcaggaggagaaggggacgacagaggatgagatggctggatggcatcactgactcgatggacgtgagtctgggtgaactctgggagatggtgatgaacagggaggcctggcgtgctgcgattcatggggtcgcaaaaagtcggacacgactgagcaaccgaactgaactgaactctgacttaatgaggtaataataaacataagattagctacatgcctaatgtttactgtgagtttgtcaatatgctaagtaggcatcatatatattgttgtctcatttaatcctcctaataaccctggccagtagggattattaatccattttataagtaagaagtctgagacttgaagagattaaggaacttgcccaagctagtacagtgaagaggtaggagttaagctagtcttctctgacttcacacctcatgatttgggctgtactgtttctctcttactgtcctgtgatcaaacaatgtcagcaacaaaccaaccaaccagacagacaagccaataaacaaataaaccaaccccccaaaaaaacaccccaatttcaaccctgttgcatgcaatatatgtaagaaaaatacttatatttactcagcagcggcctaaatatggtgtagtgtttcattctcactgacatttatgaagaaactggaatctataacatcaagttaaattcaacaaatacgaagtggctactgtgctggtcatgcttcttaaaagaccctgaggtgaaaaatcaagagatacttcagaaaaacctagagatactttgtataagatatctggttttattttagcccttcctgttatttcctacatacatatcattggaaggtcttccttctgttttcctgagagatgagatatgttttatgtctctgtaaaaatcatcatgtgaaagaccatccacctcagaaatgtcttcctcatttcaacctcagcctactttgtagggatctcaa

SEQ ID NO: 50874 - DNA, 1027 bp, Bovine  19866881058694
tgtcccgatgtgtccactgtggctacttatattttgtgtgtaagctatgcatccttttcctttctctcttaatatctattgtagttattgtttctcctctatgttgtaagttcttggagccttggagactagggaaatagtcttcccagttctataaatcagcaggttgccttatacaatgtcctgcatcttatgagggttgcaatcgagaatgtaaatgggatatttaacattttctcaaacttttcctttgccaagtttgggtacactttgttctgtttgagggcttagaataaataagattttaagaggcttgtgatgaacagaatgagacttgtccctaatccaaaggtaaaataatattaagaaggttattttattaatttaataaactaaagagtattcctttgatattaactgggggtgggaagggcagctattactagaaaggacttctcaagattccttctggtggccagattcatggacccaaataagaacttatacatgaagaaattaagtcctggagtagttaagagacatgctttgggggcagtccttggcagagctgagataaaaaagactcctctgctcagacccctggcttcagcctttggtctgcccctagtgagctgatggtggacatgtgagtgtgttcctggtagacacagtgccctcataggtaagaaaatgacctttagggctgctgacccttgcacattttgtgacctttccaattccatacagccagcaagtaagtagaactccattttttaaaaaatgagacaatgcaaattcttgcagcttttcttactgggctgttttgtgcttggtgatagcaatattatatcactaagatttacagaaattatttgacctttcaatatgtgttccctaaacccacttaaaagagcaagatcctgaagggatgagctaataaggtctatgtaattgagaataaactggtgatgttgctaaaggctatttgtgtgtgtgtgtgtgtgtgtgtgtgtgtgtgtgtgtgtgt

SEQ ID NO: 50875 - DNA, 1039 bp, Bovine  19866881175576
gtgaaaagtagtttgcttttagacaaaatccttctactttaaactagattatggaaatattgataagaaaaattatgcataattaagtataatttacctctgtggaaccattgtttaaaaatccaatgattaggtctaaatgaaaaggaatgtattatataaattgtgatttttaaagaggtaggttttaaaaaaaaactttttgctttattttaatcaaatttttcttcatatacatggtcattttagcaccctttaagaaaagagatacagagatcctagcatgggttccaaaaataattaaaattattaaagtaagacttacaagagaagtagcaataaattggggatatttggcttagagaaaagtgagctaagagtgactttttattgttgtaaggaatatggaaggttttcagtcagttatgtcttgtactcatagaaacagaaatgaccttcagtcaaagcttttgtaatgaacacaagggaagagtctgttggccagttacagaagaaggccaaggactgtctagtcctagagatgttcaataagaaatttagaaaatacctggaagtcatggatggttgacaaatagagctcagtagcatctttgaatctgagctgccaacagaaacacacaatgcctatccatgagtaccatgggaagccatgagtcagataagaaggaagaaatataaagactatagaagaaaaacagaggaagaagaagaaataaatatgaatgtacatctgaggaagtggtcaagttagcattcacctatcagatacttctgaaggtcactcgtgacctctgttattttgtacaatatagagtgtaatagagttgtcatcatcaaatgccatgcttgtttagaagtgacccaagttgagcatgacaaacagaatagccaagagtttcaggcactcactctgaatgcagtatcgctcccctactctccacaagagctccttggggacagctcaaacaccacaagggaccggccaagactgattcaccaactcacttcaggaacccat

SEQ ID NO: 50876 - DNA, 1624 bp, Bovine  19866881217404
cactgcttgatccatcagtgtgtcagcatgaagtgctacagcatcagaaaccccagggcttgctgcgttatcacacatacatggacaagagccaagtcaagggacccagagcctcaacaagcaactctcagggatagtactgagtgctaaaaaggtgtttccaacatgcgtgaacagatagactcaggacacaaaattactttgagtctagtgggcacccattaggaaagagtatcacagagaaaaacttcctttcttttatgagcagccagagaccggtctcctacaaaaggctcggaatttgaagagagcacgatttaagaagaataaagaatgattcgtgctgcttctttccttaagagcatcaaaataagcaagaggtggagcactcaggtgtctacatgtgactgagataagcacagttcatgaatcccattttaaaagaaccttcaaaccatactttaagatgaaggtcctttgagaaagcatgctgaagttccaactagcaccagagcatacctccctctatcagctaaggccacataattatattgtaggaacaattttttaaaataacccaagaatgggctggagggtctgtttatccataaaagagtctggagacttattctgtcaagctggtgttggacagatttttctttgtcacatgaaaacacataccgcatgacaaatttttagatacaagtgttcacatttttcacttactgtcattgttagagcccgtttccataacaccataaggaggagccagaagtcctgccatgtactgtcgatatttctgaaagacaagattgtaaactcagtgcacagatatttactcacttggagcattcatgtgtttacatgttaaaaagaagaaaagctggatgtcagtaagcatctgagtcttgtatttatagagccatgaagcgtgctgtctgggctctgtggcctaaaataaaaatgctgtgttctaaagaggtcttcccggatgagactgtaagtgcccctgcctcgggaggggtttctactgcaacccactccttcacggtttgtgattgattaaccaaacagtgtgggcttttgccctcccctccacctcctgcctggcttctcattctctcaaacatgtgctcaggtttttgtggaggaaaaagacatttggtttttatagatgcagatacaaataaaagtgccaccttcctaacaggtgaatggcactcaatcggccgtctttcaaagcaaaaagaaatgcatctctggaaagtgtctgatgtgaaagaagctgattcattactatttgccagcttccttttacactgtacacctgcccgttatgtgacctccaaagaacctgtgggatgttgtcaaatagaatagtttggcttcatttagaactatttagatccttctgaattttctccctctgacttttggtccagacgtgctttaaaacctgaggctcagtgatacatattagcgccgggagtctgtgctgttttgaaggaataaggcttggtgagcatacagcaagcagatcaagctcccagtgagacagaagtgacatttatgaagaatggaatatgagtgtgagacattctctcttctcaggtaataaatacag

SEQ ID NO: 50877 - DNA, 1714 bp, Bovine  19866881225142
tggaacctttgccattaaagtcctgtcggatctatttacttatccaggggatgctcccaggacaattaaaggcatgcagcttaggcactgcctttgaaacccctttcctgctgcttgccagtgtcaacagccaccaccaccaccagcaccacttggcatcacctccaaagggggtggatgaagccaaaacagtatctgcttcatcaggttgttgtgagaattgaatttaattttagtagatagtgagctctcagtaaatttagtcctttttcccattgcaaccacttggtatagccttgtaaaggctaaagatgaaactgttggctataaacttgtgccgtgtttacattttaactcattttattaaactgaacctcctctcctgacttttgcagggctagtgacttgtgtgcaggcagatgtgaaagatacgggctgtgcccagcctgtacggtcagcatgtgcttgtgagtactacgcttgctgcaggaactctttcatctcagtagctgcctggaagggaaggcggctcatgacatatgaaaacagggaagaggcattctccgcccagaatcagcattctgaaaggatgaccctgttcatcccagtcctgttttggccagactctcctgtccatcaaaagtgctaatatccagctgctgtgaaatacaggagctgtgatttattctgcagtgcaccgtgccagtccagaccatgcttcaaaatcctggttttcccctttgcacaaaagagtttggacaaaacaaagctgggatgagcaaggtcatgagctcctataccctactggccaaagaatgggagacaaaggcaaaacaaagactggctatccaaagctttgcagattgtgggaagtggtgttgccaaggtgatgatttagcgctagacaggaggagctggtgttaacaaggacaggagacccaagccacatttcctgaaagggaagagagcaactcagagggaatttaccaccaattggtaggatttccatgttttgtctaaaatatgtatttcgagcctgccttatgttggaaaattttgttcagaactctgaactctgaacacagcagacttatcacatcctgactgtcagagataatttaaaatcagattcgagggaaggaagggacattaaaagtcatggttgttgtccaatccaagcctgataaaaaagcatttgataatggtctatttatagagacatatgggatggtcatcagcagcacagagcccaggcactgggccccagctccaatgccggattttgcaagagacactcactagttagggaaatcatttaacctcctggtactcagattagatcaccaatgaaaacgagtaagacccatacaatttcagattggagagaaaaaggcaggaaaagcctgactcctcacatttagtttggaatattaactattccttttcttttttaaaaccagaacacattgtcaggggacaacagatcaacatgtttgtttatttatgcttaactcatcgacttgcctaccaaggactattaggtgttctaatttctaagccaattctgtatttgaataaaaatgtgggtttttttctaagagaaagtcaactccaggcagatctatattcaactcaaaactcacctctgcacccttcaagtcatttactcagttctcttattttataaacagtgggaagttatttattagcaagt

SEQ ID NO: 50878 - DNA, 1483 bp, Bovine  19866881300565
ttggaatggtactgtgtgtcgaggtttagtaacagatctgctgagcggcttgactggtctccgcctcgtcagcgtccctggagtctccctgtctcctaggctgcattctctgctttcctccccacccccactctcaaacgaagaacctgaggggaatcatgggaggcaaagtctcaagccctgacctgctaaccaaaggcgtagctgaatttaagtttaatatttactcagccaggaaatgctctaattaagactagctctctaaatcttaaagccccaccctgaaagggcagaaaaagattactcatccctcagggcagagccctctgggaaagcacttttctgccctacacccagatgtctcagagacggacttaggccgatcttcctgtcaagctcaagcaagagcataacagggatggtggactgaattttcgtggaatgtccattggctttcagaataaaagctggctgtgtagatctctgataccagataacaaaaaagggaatggccaaatatctggagcagaaaggagattttccatctaggtgagcagtttagtaagagcaggagtctgatggcctgggtcaaatcctggtttcaccatcctttcttgggtaaactttcttgggtgactcaatcctctaagttttcatttcctcagggttaaattgtaatagtagcatctacttcatgggattggtgcttagagaatgtctgatttgatcattaatttgatcatttatgcaataattcattcaaataatatgccaaacatccaaaatgtaccaaataaagtgcaatgtaatgatgatacaggaaactgttcccttcctgaaggagcacacaacttagtagggaaatgtataaattattcctctttgttgtaataattgcaatcataaacatgtgaactcaagtattattaatgtgcagaaaggaagctctttccatggaaaattttaggaaagtttcatgatgacacctaaactgagtatttttttttcaagaagagaaaagaggaaaagttatcccggaaacttttgaacattatgaacaggagaacatcaatgagaaaaagcctggtgtgtttggaaaacaacagaaaatttggctagagtgtggggtcggcatgataggtaatgaggcaaggatgtcatgggccatatcaagacatttagatttatatgttgcatggttaaatttccatttaggatgatagttcctatagtaatacaaaagggaatgaataaagaagacatcagaacccagaagaacagagagaagactatgactacagtctgggcaggacataaagaggagtcaactcaaggtcatggcaaatgatgggaaggagatgaaggcagaattaagagatatttagatgggtactcttatctagtctctgcataaaatcactatgaacaagtcacttctgctcctgcttccttacatgcaaaacttgcgttaagaaaggattta

SEQ ID NO: 50879 - DNA, 1182 bp, Bovine  19866881351010
tcagacctggggcaggggtgcaggaagtagatgaagagggaaaggaaagggcggaggggaaggcaaggctgctctctgccaaggtgccttcccagagtcgtgaacagaaggctcgtccaagaaacggacaataacaggctgtaataggaccgtcatctcgtgggaacgtatggaatgcttaataactacttcctttatattttttctaaatttccagatgccttctgaagatcaaataaacgtatttcagaacattggggataaagctaaatgaatacatttgcattaaaatgactttgcagtttgttttgattctttgtgctttaacagtaacttagggttataaagagcttgtccccattcctactgaactgttgagtccgagataatacatggagctttatataaagggctacagaagctattcttattatgagtaccttcagattcattgtcatcattgccacaaagaccttttaaaagaatgaataaggtgcttaaaaacatatactgaaattctcctgtgtttttggaagggtttatagataggtgtacatggatatttttctctattataacaacagtaaaatctcaaacaaatgtacttgataacatcagcctttcactactgactccttaaagggctttgaaatattcatcatcacagccttgttagatgaagcaagtattatgaaatctatttttccagcaaaaacattataacagagactaggtaagtattagtatactaaaatcatgtgtttatagagccagtgatgacatggatatttcaaaagtctttgaaactcaagatgtttaccacttatcatgttagcattttaattatatgattattaaccacttagaaagtgaaatgttgactctttactaattacaagttttcccaacaacatcaacaaaattcagaaagaaggtgttgaaatgcattcatttgatctgcaaacatttactgagtgtctgtacaagagaagaaaggactcggtgacacaaagagcatggctcctgcacagaggaagttcaagctgagttagcggggagttgtacatgtccagcaattatcaaggtgatatgtggtaagaagggcaattaacataggaaagaaggaaatatgaattcagaagaacaggtatcactggtgaatgcgaattctacaaagacttc

SEQ ID NO: 50880 - DNA, 1090 bp, Bovine  19866881356374
ctcagtaaaccaatattttaattgaataaattttaacagtctcttcaaatgagttacttaatttatgccatttcaatttaatgtctctggtcaagaagccaacactttggttcataagatagatgcccgtggattttatcttagtgtctactggaacatgtgaaactattaaacttttttttatgaaacacatttgccactttcagaatggatttcctcaaaagcgggtactgggtcggggtggggagaatagtgtcacatttctactgttacattttggctgtctgtgcatctgtcatttcgaaaaaatcagcaggttttaggaggaaaatgatctgcatgaggtttggaagctggcaaagagggtggcttgccggatgcagcagtggcctcaacattgcgagcacggcagtagccggtgtgcctcttaccaagcataattgctttttcttcaatctcttccgtcccgtgcatgtgtacaggcctgctgtttttgaccagcgtttcctatacagatcccgatcagtttgtttataaaacacagcctcccagggagcagcccgacacatcccctgatgtgatgatgaatagctacctaggtttgtgacctctgagatgacaaataaatggtcttggtcatggtcatttaagaatttttttttttgatccatatagagcataaatctttttattttctatttcatttcaagtgaagcacacacaaaaagcatgctgcagttgaggctctgcagccagaatggcttccagagctggattcaattgtgtctcctttataaacttgtatcctgtttttcaacacgcttcacaatttgagaactgcaacagtagcggtgatgcttttcataaataaaacccaattaaaagggtgagcttatagtattctgcatctgcctcgtcttcacataggaagatttgctttatttggacaattttgatgcgtggacatttgtgtctgcttgccatttaacctcagttggtaatctgacatcctacctgatgctttataatgagggttctaatgtttttctgccctctgaacaagtgtgtaattgatacagatgacaacttg

SEQ ID NO: 50881 - DNA, 563 bp, Bovine  19866881356916
gaaaacgtctgttaatgggacacacacagcaagctgttgcttttaaagttagccaccacaaccatagcaggttccacagctagcaattaaaaaacattgatcaattaccaattacagaagtagatcaatactacgcatcagaagtaagcctctctttatcagatggctgagcatggatctcagccttgtgatatgtggcatcatagtgatctttcttatttctcttgaagaaaccacactacaaggaagcaaggtatttagtcagtgttacagttctgtgtataaaagctaaacaaaagaaaaatctcaaagtttaacctgtttcctacttacagcttgcttacaaagagaccactatggatcaaccaaaagggaacagaccccataccatatgacacagtgacatcaagtgtgctgtatactcagttgctaagtcctgtctgattctttataaagactgcatggactatagcccaccaggcttctcggtccatggaattttccagccgagaacattggactggattgccatttccttttccagggactcttcctgatccagg

SEQ ID NO: 50882 - DNA, 1935 bp, Bovine  19866881393054
caaatacacagttggtactcaaagctgagaaattgaagaatatcaagaaaatgactgttaaatagaagaggaccaattattaagtactactatcttcctacaagggttcaggggaaaaggtgtaaccagcaaaagaaactgtgtaagaacgactaaccaggtgggagaaaaacaagagaatatggactgtgtctcaaaaggcaagtggagatgtttccaaaatgttcatcatgtagatcatatcaatttgacagaacactggaaaaaagaaagaccacagtctgggtttgcatttgatgttttatattttacaaatgacatggctaataggcctacttttccagcctggttaacagttgggtgagttgcattcagtgctggttcttggaatgttgttgttaggaagacagcaggaccgaaaacaaaaataaaatatctcacacacaaggtgcagggcaaatgcttagcctgtggcttaaactcgagtgagatcatccacctaaaatgtaggcaaatggcagtgtccaaggaaggaaagatgaaaaatccaggcacagaggtgcagaggacaagtggtagggtaacacgagtacaattaggaaaacctagggcgttatttctctataacagatggagagaagagcagggagtcaatatcactacgataaatactaaacagcaaggaagcaaagtctcacagctgaggcatgcaggctgctgcgaaacccagaagtgatattatcaataaagccagagttggcaagtgattaacaaataaacaacatatggctcgttggttgccatgtccctggaaacatcttgtctctggagatagtgtgcctctgtaaatgagttcctggttggtgcacatttgcttctggtacaaaagacagttgtgaaattgtaactacctggttacaaatgctgctaagtagacagctataaagttctggttttggacaaatggactcaattctcctcttttctcccactaagtgcaactctaaaccctggacattatatgtgaaacaaacagagaaaagactctgtgtggtggagagaaggcagactgacacaggacctttttgtctgaaggtctgagctgaagtggtgagttccttgagttttcttttttgcctcatgtatcccagactgggtgctggaggagacagtattccagaaataccacttaatacagacaaaaataattcctcaagaaaagcctgctgtctccaggacaaggaaagggggagcccagtaaggcagaaaacgtttagataataacttctcactttaaacaaacactccagaaaaacctgcaggcttagtcccgttcctctcaagatcaagtgtgcaacctacactttcgctcttgtctgactgtgatgaagcagtccttcccacctagattttaaagtagcgatcataaaaatgcttcagtaagcaattatgaacatacaggagaaaagagaatgtctaagcaaagaaatagaaagccttagcaaagaaataaatacaggagacccaagtggaaatttgagaactgaaagatatactaactgaaattaaaaacgcaatggatggctcaataacagagtgacatggcaaccaatgagctcaaagacagaggggagcattagtgaacttggagacagaacaatagaaattacccaatttgaacaacagagagaaaatagactgaaaaaaaggaacagagactcagaggtctgtggcagaagatctaacatttatgacccttagactggaaggagagaaagaaagatggtgctgaaaaattgctagaagaaataatggcttgaatgtttactaaatttggcaaaaaaaaaataaccctactaatttcagaaactgagtgaacctcacccagggtaaacccaaagaaatccatgcccaagttaatcaaaattctgaaaa

SEQ ID NO: 50883 - DNA, 949 bp, Bovine  19866881426510
gtttatgactaacagataattactgttttgttgttctaggaagtagagaaaaaaaaagtggcacatctgggaagtaataaagatatgaccttgacgatttctctgggtctcttatgctttgttttattgccaaaaagtgacgagaccatcagctcagggtgttgtaattttcctaattgccttagcagcagctggcttgccgtgattactgatgctttggagacgaccaaatgttgagatttcagtcaggcttgccatgattcatctttgggaaggaaattcaataggactttgaaagtccagaaagcagaagtggggaaaactcttcctggaactttcctcaaattctccagagtcagttgttttgaacaggttcctgatttctgactagaagtgagatgctttacctgaagtttattatttagactttctcaggagcagctgcacaggcctttgcagtggtcaaagcatggtcttactggataacacaaagcattaggaaacatgatgcctatggtcaagtcccagtttcatgacgggttatctgtgctgccattggttgcctttaatattttattgaaaatctctataggattcattagaactttcttactgagggcttacaagcccaacaccaggagctgtattaggatctgttggtctgtagattttagcatacatactaagtgaagagcactacagaatatagaattactttatgaattagcttgtatttaccaagaatactttattagatattattcacggatgtccctggtggtccagcggtgaagaatctgcctgccaatgcaggaaacacaggttcaattcctagtatgccacagggcaaccaagcccattcaccacaactactgaacctgcgccctagagtctgtgctccacaggaggagaatctgccacaataagaagcctgtgcaacaaagagagc

SEQ ID NO: 50884 - DNA, 1054 bp, Bovine  19866881615753
tagaatatttctattctcatgtattatatattttgtgtatgtctgtcttattgtgaatgggatctgtttttttattacattttccattaattgcctgcatacagaacagtattgatctgcataattatttatagctgatccccctaaatgcttattagttctgataattgagtaatcctaaatcatttcacccaaatgccctgaatggcagataccattttaactgatgttattaactgaaatttttttaaaatttcttattctatcatcactttcatttgattccttgatattgtatttgttgtaatatacaatttggagacacaattttattataagatttatcttctaggatgacatgtccttcatatttcccagtatgttcattccaatttgacaaacataggttttcagttgcttcccttgctttttagacagtcttctgaattatttattttggccatgccatgcagcttacaggatcttagttccctgaccagggactgaacctgagccatagaagtgaagtgctgagtcctaaccacgggcccaccagggaacttataagataatcttctaatttttaattagaattatttcatctccttttaaatatgtaagtctcgtaagatattttattgtaaaccagcaatgtaacaggttctaaatatttatgctacactttctttagtcagatgccttatattaaatttaccgataacattgaataataacacattgtttcagatttccaaacagtgacaggtcagaagcaaaaatctggttgctattggctgcccctgtgcgatgtcaaactctggtttcaagcagcaaaatttggcattttcgttctgttcactcactgccttggcccaaggaaatgacttggatgagtgcccttcttttttattcagagatgccatagattaattgtaaagacttcctttcatctacataacagaatgggttcagatagccttttaagctattatctgcagtttggaactttgtgctgcaaagtcagcagttatacaaaaggggtctgttagaaaca

SEQ ID NO: 50885 - DNA, 996 bp, Bovine  19866881661667
caccatgcagtttttgctaaaataataactgtggtaacacaatataaatgaaagcaggtagttcgactcctgctgagtggacccagtaccttggaaatgggaagatctcttccttcatgtggtctcaagatgaggattacacatatttatcggaagagtaaggtcacactaattatttttaagtggatctccaatgttggagaggacctaatttagttgttggggttaattaacatctctaaccatcttagaagatttattagcagggacatttggagttgagtttagaatctagagcatcagtgcgcagcgtattctaaagatagggaagacagctgctcaatccatccatcatgattaatatggtgagtgctatactcattataatcaaaatctacagaggaaatattcttctggaaatgtcagaggctcattaaagctgtttatgagcaggagaaagtaagggtaggactctacctggatagtttgccagcaaattttaaactaaatgcaatatttaatcctgttgtgtccttctgggactgtacagatagggccggccaatcataggtctggggaactggccacagaattatttgttgctttaatgattttagcccagtaggttttcccagctggagctggcaagcgagagaactagatttccttaaggcaggaatgagtaacatttaacacaaggaagcctccctatttagggtaatatcattgtcatgataaattgggaaatatgctcttaaacatcttctgtaacaagtttatcaaatttacatagaccattatttacttatttaataaataagtgcttttttacttaatttttttattgaaggataattgctttacagaattttgttgttttctgtcaaacctcaacctgaatcggcaataggtatacatatatcccctccttgtagaacctccctccccatcccacccgcccaggtgatacagagcccctattgaatttattagcca

SEQ ID NO: 50886 - DNA, 1341 bp, Bovine  19866881668023
acattcttgttagcagtttggtttacatcctcccttttaaactgtaggaacatgtttataaatatttgtctttcaagctttgactaacttaagaagctccctattaaagaccataggtcaaatccctctaattaatgtattaagcctactgtggggatactaaagacaaacaaaataacataatatggaagagggtaaccttcttgccttgctgtgacaagcttcagaaggataccccaaacataaaaataagtcaaacctggtaattgaaaaataggactccagctcttactagaattaagaataagaactgtggaactgaaattattttctaatactattctgctgaattacagataggtttctacagaagaaagctctattttatactaaatggtatcttctttaacactcattgggaatctacttggcacagtctctctgatgttctatgttctctgctgatttcttttggttaaaagagtatctatggctagggtgacttcccaagtggcgagaatggtcaagaagaacccacctgccaatgcaggagatgtaagagacatgggctcaatccctgggtcgggaaaatcccctggaggagggcaaccccctccaggattcttgcctggagaatcccatggacagaggaacctggcaggctacagttcatggggttgcaaagagtcggacatgactgagtgatcaaggacacacaataaacattatgggaatcatcaccaacttaccctcaaatgattcagaaaaaaaatatatatatatatatacaaagatggagagagagatttcgagagagagaagcaatgctaaagcaaatgggcaaaattttagcacgaatggctagggtgatgttaccctgatatctggagaggtggttataacttggtctgatttgaagaaacattctctccagtctgactgtaaggcaagtccaagcccaaatacctgagggttgtgcccatacacgctgtgattgacgcaacataacctcaggtgctatttatctgaagggctcccaagccgctgagctcctggcagctgctcaagaaggaacgtctgtacttgggaaggactagtagctcctgttaaactcgggacctgtaactaggtctcagaaagcaattagctttcattcagtcccttgtaactgaataggacacaagggcacgagacccagggagtgtgtatttagcacaagcactagatgaggctctgtgcactgtggtttaagataccaatgagtcctttctaggcagaaggagatgggtacagcttaagtgactgtcagcgcctaccaaggttgagcaatttgtgtgatta

SEQ ID NO: 50887 - DNA, 537 bp, Bovine  19866881849201
atgtgcttttcttcctgacaaacagcaaagacaagttcttccctggaatcagcattagacacagcttaacaagatcaggcaagctggctgcaggaaggtttgatgagggacggcccagtattagcatctgataaccgaatcagggaggccagccttgtctcaggggcagccagtctgtcctgcaccagggctctctcttgcccctgcctacaccaagaattacacggcaacaaaactcagcccagtacgccaaggtcccaggctggatgctaaacaaactctaatcaggtctcaacaaagacagtgacctgagcatagacaaatattaagattacaagcaaccactgtggacaaggcacctttcaggttttactggcttgagacatgggttcagagaatgtttcctgatgatagcgatgtctgaaaataatggatcaaaagaatgtattaaggaatctggcaaaaacagaaagaaggggaaagataaagcaacaacacagagaaacatgcctgtccttcaaattttacaaatatgca

SEQ ID NO: 50888 - DNA, 1056 bp, Bovine  19866880542563
gcaactaatcctgggtaccacaactacgagcccacgtgcacaccctatagcctgtgctctgcaataagacaacccaccataacgagaagcccgcataccacaactggagcaaagcccgagcaaaaagcaaggaaaacccatcacagccaaaaataaataaatacaacttttaaaaaagagacatgttcacaaccaccagaatataggtggaaaatgagaagtggtataagaaagatggataaaagggccatgggcattcaaattagagatgattgccagctgggagactgaggaagcggtgatgtggaagcaggggaagagaaacaaagatcagcagcagcaatatatgagcaagtccttcaaacaggaaaaaagatgaagccagggaggctgaagtggataatgcacaaagtggaagaatgggaaataaggttggaaacataagagggtgccggattttgaaaatgctttaacatcaagaagatttgggaaccatgggagtttctatacagggaggtgacatgctcagagctgtttttcaggaaaaataatgtggcagctgtagttatggaaattaagaaaaaataagaaagactagttaggaggctgcctagttccagtgggagaactccttgcacatcctttctggcacacaagggaccccccagcacctaagcacagccatgaacggctcacatgtgactgccgaagcctcaaagctggaattttccttccatcaacatgtcagccaatattaaccaagtaagcaatattcattgtgaacaagaacaaaaacagacaacattgtggacaaaactgtagccaccccatcctgaccaagtaggtcaccgtaagggccggtgatagaaggggccaccgtgccgccagtcacagcaaaggagaagagctggaaggacagacacgttcacaagtcagacaagatggcagcctttgagtcctggcatcacagctcttcttacctctggtctggatcattttgatgacattgcccacatactcgtagaggatgaccagattgcactgagcaatgtcaat

SEQ ID NO: 50889 - DNA, 1408 bp, Bovine  19866880601703
aaacacctaggtgaatatctggggactgcagttcagcctagctcagtggacacattgaaaagccatcaccatgcccaaatgtcagaaacttgtagactttcctcctcctatatgtcctgcagacaaaaccaaagttttgttttgtttttaatattgtttgagtatattactctcttgctcaaattttcaaccagtagattaactggaaatagaaatgctgtctattttattgttattctttaaagtgtaaaaaacttacatgcattatgtattttataattttaaaaagtcctagagataatcctaaaatctgggtagggggttaaaggatgaaaggctacctttgatcctcagtggccagtcctcatgctgacattctcacagccttgctccccacgcctcagtgacaagcaatgacaagtcctcactgtatctcttatttagtgctctttataataaacagtcctgctctcagtcctcggtcatcacccttgaagtttccctttatgcaaaatttaagcctcactaatctaaaaagcaaagtcagattttgaatagttggcttaccaaatgaggttgtggttggaattcagaggcttctgccatatgactccagcatgagtccaacttgattttcaaactttgttattcatccatacataagcacctagaagatatttgtttgtccatccctccattcatcgatccattcattcattcatctatccatccaccatccacccacattcattgagaactcactctgtgccagtaactgtgcttctgccgggcagcctccccctcctcctaagtctagaccactagggcggagtctcctttgcccacatcccacagcacacagttctggctccattcattgtcatcatattgaattatactttcccatgtatagccttcttctacaaactaggagctccctttagataaaaatgaaccttttaaccattctatccttatctgacaaaccataattgcagaataaatgtttgatgaacaaatagttaagttcagaaattagtgaagtgtggtgtctgtcttgggcatgttcattgttcagtagatcatgttgaaaagaaattgttttggcctcagcaaaatatatctcaagattttgctgccaatatactgggacagagttgggacttttataaattctgttaactctgaggtggagaccacttaagttcctgctcttctcagtgtatcagtggctggaaactgcacggtggtagggtcctcaacttaaatcccaagcctggttttgctagttagctgtcagtttaccatccctccaaaacctccaggttttcacctgtaataaaggggaatcataacatttgccatatcaacctaaaaagggccttgtgaagttgcagtgagtaagtag

SEQ ID NO: 50890 - DNA, 1858 bp, Bovine  19866880944619
ttagctccaggtcttgtttttgtggactgtatacagctttctccatctttggctacaaagaatataatcaatctgattttggtgttgaccatctggtgatgtccatatgtagagttgtctcttgtgttgttggaaaaggatgtttgctctgaccagtatgttctcttggcgaaacttttgttagcctttgccctgcttcattttgtactccaagaccaaacatgcctgttactccaggtatctcttgacttcctacttttgcattccagtcccctataatgaaaaggacattttttgttgttgttgttagttcttgaaggtcttgtaggtcttcatagaattgttgaactttagcttctttggcattagtggttggggcataggcttgaattactgtgatgttcagtggtttgccttagaaacgaacagagatcattctcccatttttgagactgcacccaagtactgcatttcagactctcttgttgactgtgagggctactccattttcttctaagggattcatgtccacagtagtcaatataataatcatcgttattaacgtctcccattcccattttagttcagtgattcctaaaatgccaatgttcactcttgccactttctgtttgaccacatccagtgtaccttgattcatggacctaacattccaggttcctattcaacactgttctttacagcttcggactttacttttaccaccagacacagcacaattgggcgtcctttccactttggctcagcctcttcattctttctgaagctgtttctctactcttccccagtagcatactggacacctacagacctgggaggctcatctttcagtgtcatatctttttgccttttcctactgttcatggggttctcaaggcaagaatattgggagtggtttgccattcccgtctccagtggcccacgtcttgtcaggccctgactagcaggcacgtgcccttccgctgttccacgtagctggaggacatgcccagtgccctggctgtcccactgctggttctcgttgagtgtgtaaaccttcactggctgctgggcatgttggccaacattccacccgggggcctgagcaaaggccctgctggagctgttggctggagctgactgatgttggaggaaacccaggagcgcagggctccccagcctctctgctgccactgctcgtcctagggccaatccgccacccagcggcctgactgttgccgctggctgcctcctacctacatagctgttatttaaccatgtcattgactctctctgggcctcagcttcctcaggactttttaatgtttttgaatatagcctgacaggcttgttattcagattaaataatatacatgtacaaacactctctataccaagtgttacataaatgttatatgtatataatcattatctacttgaaaatgagcaatgtaagaagggtgtgtgtgtgtatttctgtggttaatccaagaccattcagccattctctgctactccctcttccaacactcctaaaggctgatttattaggtagtttagttattatgcaactgatatgccgattgctatcagagcatttatatcaaagagccatgtacctaccatatctggaatcttccaatttattcaaattgaagaacttctttcctggttgtgcaggatccaaaggctcaacaaggtgtgcaaatgggttgctcatgattcctgatgaccaggtgtccctgaaaaggacagagaacatttaatttctcctctcaaagctggatcttatttattccaatgagtatttgccctctttaacaattatgatacacactgacttcaagaaatcacttattat

SEQ ID NO: 50891 - DNA, 1090 bp, Bovine  19866881048691
ggagggagagaaacagagagtaaggtgacacgaggctcacgtaaagtcctgcaggatgactcgggcaggcttaaagggcacttctatgttcttatgctgcatgcccttccaattcaggatattttcaacatcatttttcttcaccaaaaattgatcacagttccgaatggctgcctccaggagaactctgatagaaaatggtaaggatcctaggaataaaaggagaaagcataacaaaacaaacaaaaatccatgagacatcttattatcagagctctttaaagccaatctccatccaaacttgatacaaggcaacatccccggtagtcttgcaacaaggaaagagagtaaatttaaactgatttcaacaatttgaaatataagaatattgaatgggcttgagacattcagttattagaaaatacctgcagcctaggcaaaagtaaaatattacagttaattctttcatagccagtggctgcctagccttggaatccagtaacagagcttcccttaagttatcatgaaggaaatcagtctagattatttaatttgctgtattactgttagtgagtaaaatacacatacacacatacagagtagtatttgttatgaaacctcagtgtgtaaaaaatgagaaaataacccctttacgatgattaaaataagaccaaagaatagtcatatatacctttcaaaggaaataaacacctaaactccatggagtatggtcattggtaaccatgttttttagaataagacaatggtaatttttaagaaaatttattttgcttataaaagaagtggttcaacttgatacctaagaattattcactagtattatccagagaaggaaagagcacaaaggcagaaaagcataggagttgggacaaaacaggtttgtgttttcatcctcttctgctctttttgttgctgttcagttgccaagttgtgtctcacgctgcacaccatgaactgtagcacgtcaggcttccctgtccgtcactatctccctgagtttgcgcaaactcatgtccactgagtcagtgatgccatccaaccaccttatcctgtgtcgttcccttctact

SEQ ID NO: 50892 - DNA, 834 bp, Bovine  19866881127255
acagcaacaaagacccagcacagtcaagtatactcaaataaataaatatttttaaaataaataaattctggaaaacacatacttaaagcatacttacagtcacgtgatacttgagataataatgaataatccagacaggaataagtacatgagtaaaagcaaagatactgtgtcgatatgtcttatagatctggaggagaaaaaaaatacatgagataaatagatttctcacttttttttttgccaaactacagtaatatatgcatagatgcatgcctttaaaaagacttctaaaaatatccttaatataaatttatgataaaatatggcattaaaaaatgagagtaagtttcactgatttaaccagagtaaccaaaactatagaattttcaggtaaactcatttccctgatttatcaacgtcagatacgcacgatcaacaccatttatcaacgtcagatacgcacgatcaacacaacacattccacatgtagggtggacaaccttgagtacactaatgctagaaaaagaatgttttacctactgggataagggtggcccaagctcactttgaggtgcctttacacatgctgtttttaaaaagaaaggcaaaggacagctaaaaatggagtttttccatggcagccaatttcagtgaaagagacctatcctttcagggaatgtataacctagattataagtgctataatagatatgattatggaagagaacgttaactcttaagtaaggcaagacagatttcaacaaatgattatttccttaaatcactggctgtcaattttcaatcagtggctgccagtgagtaatatcagag

SEQ ID NO: 50893 - DNA, 2660 bp, Bovine  19866881130489
taccttatctcgcattaatactgctctacaactgaaagaccggttgaggagtcaaccctgtccctcacagcggcaaaataaacccatttccaacgttattttctcgtttctctcacttcctcccctaaaggcgggataggcccccggacacgtgacaccgcccccgcccccaactccgggcggaagaggccggccaggctgatgggaaacgcccgtggaggcgagtgggcgggcgctggcgcccggctgaaagatggctgccgccgcccggcagccaccgccccggaggttactgtagggcctgcggcttccgcccgtgctcgcggaccaccgccaccgccttaccatgaagccagtgagtcgccgcaccctagaccggatttattccgcggtaggtcctgggctcggcgggcctccacgggctctacgctcgaggcccgcgggtggaagatcccctatatcttcagcgcccagaaactctaaaatccattcttgaattaagcctttcactccctaacctcgactccgcctcttcctggaggacacggtcttccgcttcttacgtaagggctactgggtgaactcgcttccggaactacatgtattcgagtttgtcactaaaatccccaccttagcaacgtgcacggcaacctgatgggggccgggaggacgtgccactcacaggttgtttttacgcctactcttgcatttcctagttgctcctcgcggtcgtattgctctcctggggatacgtcatctatgcatcaactgtagctgcacgacgacaactaagcaaggaatacccagacaaaatcttcgggatgaacgaaaatttgtaattcctctggatttgacttcatgcatatacagttctttacctctgtctggtacatgtctcgatttgaagtaaaatctttaatacaatgattccaaattcacttttgtataccgtccgttatagtaaccattaattctcgatttttcatataccaagaggtttgtcttttttaggttttcatataacaaagcacaaggatcttaggtgatgcagttgtaaagaatctgtctgctaatgcatgagacaccagttccatccttgatgatggagcaggaaacggcaactcggtccaatataacttgcctggagaattccagggacagaggagcctggcgagctacagttcaaaaagagttgaaggaaaagaacacggggaaggataacaaagcaaagtaaatctgacagtcttttgctctagagtttctaaaatacttctgaaatgtctccagaaagcctttaaagcaaagtgtgctgtaatttctgtacttatttttattgcagcatttcattccgttgtatactttcacatcaactaaagtacagtgtaagaaaaaactatcatgtgactaaacaattttctacgttctgttttccagattaaaaatggccagaaaaagtaggtgactgaccatattattatttagcctgtccagtttttacttattgttagataattcagtctcaaattgtacagagagaatggcacaggttgggaagaaacagacaacacatatgtgagtaaactttattacttttccagaaaatactttaaataagttggtaatgtagcaacaaacttaggcccatacacctttgaaattttaaagtaatcttcaatgatgttgatcgggaaattctttcatgggtgggattacttctccagtctccagaattgtatcaccctagaaaaacaaaggtgcattagtgataaatcttgtcagcagaggtaacagttccccttcgagctcatctggaaaacctagctcagttctggcattcaaactttaaaaatgacataggtaaaatagaagctgtctaaagataagaaaccagtatccaaaatcttaaggaataaggaacaaatagggggaagttttactcgaaccaaacaaccacaaagaacatgaaagttgtgtttacaaagtgacagaaggatgatctttatttgcttggccccccaaaataggagaagccctagaaagaagttgtgggaaacagcttcacttcaatacaaggtggtatatattcccagcaactaaatatggtaggcagctgccagttactgtttggctcggaacagatattagagacagacctgcagactttgcccaggcagctggtccagctgtctttccagctttccaaacctagatacagcgtgtgttgcagaacaggaggggactttaaagctagaaccaagtagtgtgaatcttggaaccctccactgacaagctgtataattttaggcaaagtacttagttttcacttcagcgctctctttaagaccgcagattccataagcctcacagtccatgaattgactgagtagggcagaattatcccatcaccacctgccattccctgtcctggttgctcaggactataaacttgtattagtgtaagccagtaaacattttggggaaaacctgtttccacagctagctttaccctgacacagaaattaataacctgaactggtatgaatgctgctgtaataaaaattgaactatatggcactggcttagcaaatctggcttcaagccactggcactggaggctaagagatggaaacaaaaggcactaatcacttagaagcaccaat

SEQ ID NO: 50894 - DNA, 1521 bp, Bovine  19866881157901
cttctgtgtaaccctttaaaccttctcccagccgagaagctggggctttatgttcagctaacacatacatgtgattagttgtacacatttctgtttgtttaatgaatgtgttactagtgtgtggggactgaatattatttatttttgtgtcccagtgactgggacatggtcactgctctgtaaacattgattggaagcctgactgcattttgtatgcctcaattaactacaaatacaagaaatagcaataccgtcagattgtgagacatttataagtattcagcttattaccagggtagattatgaatatgtatatcaaaagtggtctactgagacagaaatttctggggggaatacaagaatattaccccatttctttcactgaaaaatacaaaatttgattttccactattattagactccaatatatattcatcctttatctctccaggaggtgtcccaagcttcttgcaactgaaatgagtgctaaatgtgcctggtaaatcactctgatggttttcaccctctagccagaatggagatcttagttggtttgcttctttcaacagcctgaaaattcaagtaacattagatttttttaaattcccaagactagaggaggcagatacaattgttcttgcaccgccaaatgccctgtgaagaaagtgccagctcttgggaacaaaatcttccataacctctcctgcccaagttcaaagtcccagagctctccaacaatactcaactgcttgaaacacctgaatttcaaatccctgcaaggcagcagctgggcctggtttactcactctgagaggccctggttcccataatagcatctccagttcaaggaggcatcagtctcagtgatcaaagtggggactcccatggtggtccacctggcaatgtgggggacatgggttccatccctggcctgagaagatcccaagcgttagggcaactaaccctgtgctccacaaccccagagcccaggagccacaactattgagcccacactctagagcccgtgctccacaacaagaggagtccctgcagtgagaagcccgtgcacctcaacaacgagtagcccccatttgccacaaccagagaaagcttgcatatatccatgaagacccaacacagtcaaaaataaatacataaaagcttaaaaaaaaagatcaaagtgctccaccagtaaagcccagtgcaaatgggagcttccactcctccaattaaaatttgtttcgctacacttaacagcacccatgaccccactcaacatggtcctgggagagctcaggtaaggtaatgtcttaggcttgttacaaacccatcagggccaggcaaacaatacagacaacatttcactatggtgtgcggcgggaagagcaactgagaatgccagtggtgacacacgatgctgcagacgtgaggactggacctggtgtgtccttttccttgaggatagttggctgttctaaaaaaggtcttcacaacccagataatcacgatggtgttgtcact

SEQ ID NO: 50895 - DNA, 1469 bp, Bovine  19866881173363
cttacacacacacatgcacaactttatgtacaattttagaggtttcatgtatcccagtttaagactgtctgtctgtatctgggcactgattaggcatggatttgaatgtgactgaaacttttttataatcagacaaaagattcccattgagatgggcactgattaggcatggatttgaatgtgactgaaacttttttataatcagacaaaagattcccattgagaacctcctcagttatcacccagcttctcaaacctgttctctttccatttcttgaggattttgcagtggactttcctggggtgcttagttctcagctagacaagaagatggctccttcgttaaaccaatgggtcttggacaaaagccttggcaggacttgattctcctcctgttgctatgcccacggctgcggaatcagcctcaccaggaaggaccagccagatcccagctctctggaggaatcttcctctccatctggatcctgagggtattgttaaagtgagcccaggtttagaagctgggtgagaaatgggatggaggaggataggaaagttccagctgctccttttatgaagagacaagaaaaaaataggtctggcttagccactgggatggggccctagagaaggagataagtgatgctgttaagacaaagcttttaagggttttgaaggtgctggcaattgggctgagcaggacatgcagaactggagtttgcactagggggtcagcactctggttaatgcgcttttcacacttacatgttctctgctcagatcatccctctctgaaaacttgggagaatgtttggggtgcattactcctgctgccttattactaccgttgccatgtgggcttcaatctctttgttaataatatcccctccagttccctgaatccttcagtttctgggaacttcccactacaggatttcctagtggctgtgcatgtactacttgtatttccctaccattcaagggctttttcaagaattccaataagtaggcaaaagttcagattcccttctaattccaagccatgagaaaatattttgtatgtgataacaactagataaacagaagttgcagtttctccagctgatgagaaagttcgattttgtttcatgttatttctgcagaatcatagaaaacaaaatgttggctgaattccatggggaaaaataagaatttcagcagtttcacctaattccattacatcatcattttccaaattcaccagttgtcataccatattgcaaaatgtcaccaccaatttccttatttttaaatactatgaaaaaaagagacttttgttgggtccctggagagaaagcagaggatgaacttgtacaagagacgtgtcacgtacagtcattgtgggtgctcacctcctataaatgctgataggtacagagaaaagattttgacagtgcttttgttcatgttactttttttaaagagcaaaa

SEQ ID NO: 50896 - DNA, 869 bp, Bovine  19866881176033
catcattgtcatcattatcattatcgacatcatcactaacacttattttgccccagaaaataatactttatatggactaactcactgaatcctaacaaacactctatgacatcaagtattaggagccccattttacagatggggaagagacgaagagtggaagagctgagatttaaattcagggagtctaaatctagagccttctttcctagctacattgtgatacaggcaacactcaaataaaatagttttgaaaggacacattttggtctttccagaatacccatatgccttggtttgaacccatgtgtcttggactttccttgagtcggagaagatgggaagagaaacaaaaagtgcattgtgtcctagaagctaagggacaaaaaggaaagagcgatcatcttctcgaattgtttagagacatcaactagggtgaggactgtcagataacctctggtataagtcatggccttggtgagggcatttcttatggaacgatgacagcgggaaccaaatgcaatgggttgaggaacgcataccagctaaaaagaaatcactgagcatatatcactttttaacaagttctctagcttagaggacagaaaacaaattcacttctggatgaggaggctcgatttaaaccgctctaaacccctagcccctaccttctacctcccacccacacccacaccttgctcttttgtagggaactaacatttgcagcactcctattaagagacaggccctgagttcctcatattcattatctcactttattttcacactagccttgttaggattatttcaaggttcaaagagattgagtcacacaaccaagaaagtggaagaaaccaaatctgaactca

SEQ ID NO: 50897 - DNA, 1231 bp, Bovine  19866881194829
cttacagaccaaagaatcactgcagctagaatatgaaacctatgagaataactataaggggaaagaacattctacctcttcattgaatctccaagatatcattatattcatatatgaaaataggtattaatctatatgaacctcagatgtcagccgtatcaccttgcctataacattgagataagagtggctaaaacattactccagattttctgcaatatccaaccgtgtacccaagatgtctgatatcccagagggatatcttctcacagttaccaacagctccaagctttggctttccttgaactaagtggttcagattatgcattgttgtatctgaacaactccctgtccctgttctgaaccatgaaatttagcaccactttctaatttctacaagggagaaaacattcccacaaaggctttgtgttttaatagcttttccttaaagttttcggagatgaatggtgttattctacaggtaacttaaaatacagagttagatgtccataacattcaaatgaccttctgccattatactaaaattgccacttccacttcagcctacctccaggcctcactccttctcgccctcattttcctcctcccctcacattatgagcattctaaaagtatataacctgacagcctctggaaaatatttttagtactatttgcttttttattagtacagataatattatagctgttaaaatggattttctaagctttactagttatgttacaatcagtagataatagaaattctaagaaatagacaataactattttcttctgtctataacctctttaatctttaaaatttaacccagtggttaatgtactgtaaatagttcaatatcatcagattgttttggtattttggatttgcatgaaagaacaataatgattaaatccattccattcataatgtttatgtttaatgctgtgaggagttgcaattttatcagcccattgagcactgaacctcaatttgagtatataaatcatactgtaaaacaaaataatacccttctaaatgtgttgctatgtactattaatgacatgctattaaaataattttgggcatcatagtagatttactttgtaggtatgagtttaaattgtttgtaaaatgttttacaaaaatgactaataatgaaatgtaaataattacattttctttgtccttttttatacagaagatacacaggaggcatatgtagatcaa

SEQ ID NO: 50898 - DNA, 1466 bp, Bovine  19866881219430
cctcccagttcgctgaacttgctctcttctttctccatgcaagtttcaaagttttgggccagttctccttgtctgatctgagaaggcattcaaccattttctctgcacctgccatcagccccttgttggaacttatctaaggaagacaattgtagtggactgatcaagtgtttcaaaagttttcattttatgagtttttactgaagaaacgtcaattcaaatactatcaaatttaagatcactgtatactctggttcactaggtctctttcatgaccgttcttgccccagtgcaacttgatcttttaagatacacttccctttatccttgtcctcttacacatgatatcaccatgtcaagccctgtgttcttacctcctctgagatgttattatattaacatcagctatatcaggaaaacaaattacttcacacctattcaaaatatgggtatactggcataggcatatttggaagaatataataaaatattaacaaatagttttttctggatagtgagacttacatggttcttattattaatcatgataattaaaattcattgagcaattactattatgtgccagagatttataagcactttacatatattatctcattcaaagcctataaaaatacctgactaatacggtaccattagtattcccatttcatacaggaaacagagacttagagaaactaaatgtgcccaagatcacaccactagtaagtggctgagcttggattaacaaaattgatctgtgtccagagactgaatacttaaccactggagtccataaccttttttctttttatttgctaaactgtttgattttatttaaatttgtataaaacattattcacaaaagtagtaaagtaattttaactgaaaatagggcaaacctgaaaaaaatctgtgacacaaattgattactcagatcacaaataaaagtatccttctaggtaattatgccttagatttgaggactttaaatgatcttgttcagttctaaaataacatagaaaacagaagacattcctcatggtcaaatttttcccccaaattcaatatttaatattaagtaaaatacctgaataatttcttcacattcttgattaagtaaacatccagatatttcaggaaggatatcttctggattgattgtggttttaaattctggttgtaaacgctttaaaagtaatctatactcctccaatttttcaagtttttggaaatcccaactttcaatggcttcataaagtccagaataacctgaaaagtagggggaaaatggggctcttaggacaccaactaaaaaaatatgttgagattaaaatttaaaagtcatgtttgtatgtattgtgagagaactgaaaacaactgtaaatcacttccattatttatgatctttcaaaaagaaaattcaatattcattttaggcaccccacatttaaggtggagctagt

SEQ ID NO: 50899 - DNA, 1252 bp, Bovine  19866881280733
acatgcacatccttagtgataaaaaaagtaaggaaaaagaaagggagaagctggcaagtgccatggaagggagagaatggtatttctagttgtagggaaaatatctgttttaacatatattctctttttgttctgatttttccttaaaaacctttccattaggctatgacttttggcactgcaagacacgaccctactcaaaatacctcaagagcatcattacggagaagaatgaacaatgctgagtacctgaagaacaggaattctggctaagattctggctttctggttcttctttgtagacaatgtgtacatccaaagttttcatttcatcatcctcaagatctttcatttgaacattttctgcacctttatgaaaacaaaacacatctcataatctttatctgattatgatcttgatggtgaaagccctacaaagaggtcataaaattttaaacttccattacgacttcttataaccattccctctaccttttaaaacaattaaatgaaatcttttttaatttgaaatcttgatttgaagtttgaactccagtgtcatttaggactttattattcaaagtgtggaacacggaccagcaacttctttaggagcttgttggaaatgcaaactcttgagccccaactgaatcagaagcttcattttaacaagatccctaggtgatccacaaccacaccaaagacaagccctattagcagaaacacttttgtcttccattcctgacccgacccaagacaacagatgtgtattttgacagattatttctgaaacaatttatgatcttaaagaagactctgaaaggctaagaccagacactcagatggtttatcaaactcagctcttaaaataatgctctgagaagatgttattagcttcaggaagacaagggatagctcagccacttaatcgaaacagattcttcctttcaatcttgttctagtttggttccagatggattctaaacaagagaaccaccatatagtgtctaagatgattctattctgaaaaggcagtgagttgtggagtttgaacctttaactctagaattttcaacctatttctctcatcatctaaacccagagagtgagctcagactctgcctttcccccaaatactctgggcagataggctaattctggatgaaagggtttgtcctgatccattttcaggggatatatacaacccaactaattctgtagacaaaaaaaccacctacctcccagaactcaa

SEQ ID NO: 50900 - DNA, 681 bp, Bovine  19866881530012
tctgtgtgctgactccaacaagacttgatgcttccttccattgtgctcagccgcattttaagcagctccctgggaggtagtcagtgctgtgtacggggatttcactgcatggttcacattgagatcagcaaaagggtggataaatccctaggtgcggttttaattttgttgccaggaaaaaaaaaaacaaaaaaaccgcaaccagtgttcagagtccatcaggcttagcttctctgatgtacctctgcgaagtgcatcgggcaagaaacagcccatcttggagccaggccctccttgaatcacagctgccagccagacccaggaggctgtgtccttggagcccaaggaccgtgccgcccagtgctgccggtcatcggctcttgagagctgcttatcctcttttcagcgtttggcaaatgtgcttcaccattagctcaagttctcaatgtgttcctcaaatgattcacagtgactcctccacatgtcaccttaacccagtaggcacatttttaagagcggtttattcattttaaagtattcaaatgcctcccagtcacaatgactgaagaggccaagctcttcagtgaataccactgatttcctgaaatgcttcacaagtactagttaggtatagtgacggggcagggggcagggctgagctcctgcactcgatcccaggag

SEQ ID NO: 50901 - DNA, 1384 bp, Bovine  19866881774266
ttagtttcggtgttcaacataataatttgatcttgtatatacttgtgaaatgaccactacaacaaatctagttagcactccaccaccacaattaattacaatttttttccttgtgatgagaacctttaaggtctattttcttggcaactttcagattttcgatatagtgttaagtatagtcaccacgctatatattacatccacatgaccttgactcaataataagaaaatcattgcaacacaaaactatatagtgcttatgatttcaattatctgtttatatacattttgatatgccttcataagcctttttaaattaatttttattgcagtatagttgctttacaagggcgtgctagcttcttgctgtatggcaaagtgaatcagttctatacatatatatatatctccactattttatggatttccttcccatttcggtcaccacagagcactgagtagagttccttgtcctatgcagtaggctcttattagttatccattttacatatagttgtgtggaacaggattcttgaaacgtaccttagtcctactaactaacacaattaggttaatttgctctgcaaatggaagtctaattcattacccgaaattctgtttgctttttcaacctaatctgcatacttgctacgtacatattttagcaaaatgaggcataacaaaggaaatatttatgttcctattgaacttgtttaaattatgtacacacttaattctaaacatctcttccagaagcataaaggaagcaaccttaatggaacggaggcaacctgtaccttatcaacctgagatgcccaatctagcctgtgtatatccaactaggtttctggctcagctccagaataggtcacaatgatgtgcacagcctttctgacattttccgtcatcccatgggtccagtttgttaccatcagtcacttgtcatgtgggctctattgatgtgatctgtcctcttgagatctgtaagttaaaattttcttataatcaacttaaatttagggaaatgacaaagccagagatatcagatgtattgaagtcttgcttatccttataacagctgctgggtgaaatggaaaacactggcttctttcccaagattatacatttaaaatacaaatataataatgatataaaatggtcaaagcatcagagaaataagacttggtccacatttttctccatcaatgaaaagagaactgaattatcacgtggaagagagccaaaggcacatgatacaaaataacaatttaccagacatttatcttttcatttgtgacacacttttagatttcacagtacaatgtggaaatagaggtagagtgttttggaaaacatattttagtgtaggcattctctgatcaca

SEQ ID NO: 50902 - DNA, 1801 bp, Bovine  19866880237150
tgaatctatttgtcatttccactgtataatcataagggatttgatttaggtcatacttgaatggtctagtagttttccctactttcttcaatttgaatatgaatttggcaataaagagttcatgatctgagccacagtccactcctggtcttgtttttgctgactgtatagagcttctccatcttcggctgcaaagaatataatcaatctgatttctgtattgaccatctggtgacgtccatgtgtagagttgtcttttgtgttgtgggaagagggtgattgttatgaccagtgcgttctcttggcaaaattctgttaacctttgccctgcttcattttgtactccaaggccaaacttgcctgttactccaggtatctattgacttcctacttttgcattttagtactctatgatgaaaaggacatcattttggtgttaattctagaaggtcttgtaggtcatcatagaaccattcagcttcagcttcttcagcattagtggttggggcatagacttggattactgatattgagtgatttgccttggaaatgaacagaaatcattctgttgtttttgagattgcactcaagtactgcacttcagactgttttgttgactatgatgggtacttcatttcttctaagggattcttgtccacagtagtagatataatggtcatctgaattaaattctcctattcccatccattttagttagttgattcctaaaatgtctatgttcactcttgcagtctcctgtttgaccacttccaatttgtcttgattcatggacctaacattccaggttcctacgcagccctttgaaatccccttcaaagggcttctaaagaaagttcagggcttggtgacttatttgatacatgggatgaccaaatttctcggctggaaatacaaagaacggtggtagccccaagagaaatagcttttctctaattccagtttgacagtacactggatagatagattttagacagacgactctaatctctagatttgtcagttccacaaaacagtcaggagctgggtgtccacggtaacggcaagtcagattgaaaagtcattctggagggcagaatgataaaagcgagaaagaaagaaaggaaagaaggggggaaaaaagagagcgagggtgcacagataagtctttcctaggagcggtcgcatcccggagaccagcgggcactacaaagggaaaggtggggcttgtctaagaactacaactcccagtaggcatcgagaagagcaacgaagcttccggccagagcttatttccggtctttcgggtgctgacgctctcttccggttttgaaggcccctgaaagggtttgggggatgtgcacggtgagtcccgacaagtgggagcaggggaatcttgtgtccgcactacactcagcggctaaaagttagctccgggaggtcagggaggagagagggcatgctggcgggaggacgtgtaatcttggcaagaatgggggaggggactggggccacgaagggccccagaaagggatgtggagggcgaggacgaatgggatccctgggaaaggatggagggtgggatgcaagagcgtggggcaggaccccgcgagcgcgccgtgggatcccaggggagctggtggaggaggaccagagggaaggtagcagccgtggggtgcttctgcgtaaaggaaagctagaggctgctgtgggtccgagatcggccgaatccggcagcccaaggagcgtgggctcatagagtcctctcagaagatcctgccagttagggagcatccagggccca

SEQ ID NO: 50903 - DNA, 1756 bp, Bovine  19866880430495
ccaggcccgattctagaggggctggcacttgaaggccttgatctgggcctcacgttctgcccagccgctgagctcccttggcttggcaacggtttaacctacccccaggcttagtttgccagattttttacttaccaaagctaggtcggatgttggtgatctcagcaatgtaatcagaggctattgctataaatgcttttgcaatggtcagacaagtctggggcctccagtgggtaccgaggccgccgctgcagagcattaggttagggagggggaaggtacctggcggatgcctcctgcgacggtctggtccctggttgacagctgcggtcgcctcttaagatgttccagagttgcgctgagcaaaggatgcagccagactggtcctgatgccggaccaggaggcccctccttcctcccaacggcctttggctaaagactccgcctctgtccgaaaagttccggaaggcaagctccgcccctttccggaagatgcttggaagggggaccccttccaacgccaagatttcaagcgaatgagaccccacctatttagggcttgtgggtctataagatgaattcctcaaggcctaatgaagaagtgtatgtactttatcatgtgaaatcctctagatcttgtaattcggattccccaggcttaatatagcagcagaatgttctgggggagggggaagcaggagtttggaaaagtaaaattctgtatttcctgcatttgaatatcaattgcatcattgttatgcatttctgagaccactaaatgttattattgaaatgtttttaaactttaaaagctgtggttaaagaccaaacctggtgatggttgcacaacgctgaaaatttactgaaaataattgaattgtataagtaaaatggatggattctctgacgtgtaaacggaagctgctttaaaaaaaagactaatgaagagtaccaaagttaatcattgttggacggttcaggtgctgaaaactgcttagaaagtgcatgggagagagagcaaaccaacggatctacaggacagaaactaaactggaagcttttagagacttccttggaatttgaagagtttagggtgactctcggttagagtcactgttggtggttatttccatgattacatcaagttcgccattttaggctgtggatactttcatcccgcttcaattctgtctgcagacaggatcaggtcaagtaaattattcaaatgtgtaagtatttgttggtggttcatggcaacccactccagtactcttgcctggaaaatcccatggaccgaatagcctggtgagctgcagtccatggggtcgctaagagtcggacacgactgagcgacttcactttcactttcctgcatcggagaaggaaatggcaacccactccagtgttcttgcctggagaatcccggggaggggggagcctcgtgggctgccatctacggggtcgcacagagtcggacatgactgaagcgacttagcagcagcagctcctgtaccaagagcgggatgaatgtatttttccagctttgacattctgtacttctagaaaagagaaaagaacatggttttaggagttatttattcaaaacacatgtattgaatttattggccttcaactatgttccaggcaccttcctggaaaccagatgaatgcattagaacctagagtcaggatacctgattccatctgatagttgtgcatctttgtgaaatcacctacacagctgagcctaaatttt

SEQ ID NO: 50904 - DNA, 2092 bp, Bovine  19866880457925
atgagaactagagaataataaaagttaataaagacaactgtgcttaagcttatttatctactaaaaaatgttttatgatagggtaaaattccaaggacaactattctactaagacctgttactggatttttagggcagttaggagtgatgtgtatggcagagaaaaggaattgtgaatgcttttgagtggtcagtcagctcaagttcaccagagcattttattctggatacaatcaatttagaaaggaaatccacctaaagacagtttgcacacagcacttaggtcagttaggactcaccttatggaccctggagacaagccttgtcattcctttcagcattatccctgtgctttaaaaaaaaaaagtgaaaaggtaagccacaactgggaaaagatatctgcatgatgggttagtatctagaataaagactgcctggacactgattaaaagacgaacagaggacatgaacaggtatttcgcagaaaagggaatacaaatggctagtaaatctatgaagagtttcaccctgatgacaaatcagggaaatagaaattaaaaccacaacaaaaagacttccacaatcatcatattgagaaaaattaaaaagacaacagcaaatgctagagcacggggaacactgggaacttccctatactgtcaatggaactataaatacaaatatcttagaaaacaaatttgaaattacctgtaaagttgaaaaggtatataactatggcccaggtattctactctgtatttattttagaaaaacacatatacaggtacactgaaaaatatgtcttacaatgtttataggagtagaatatgaataatcaaaaactgtaaaaagcacaaatgtccactgatataaaagagtgtgtaaaccgagacagtcacacaatggaatgccatacaaaagtaaagtgcagttacatgtatggcatagatggacctcaaaactaatactgagggcgagctctaatacagaacatgatatagttcgtatgaaactcaaaacacaaatgctatttggggaatacacttgtatgtagtaaaactgaaagagaaggagcatgataaacacatatttagaatagtatttacccttagggaagagataaagggacaagactggggaagggcacggagatccaaccagtctatcctgaaggagatcagtcattggaaggactgatgctgaagcggaaactccaatactttggccacctgacgcaaagagctgactcactggaaaagaccctgatgctgggaaagattgagggcaggaggagaaggggacaacagaggatgagatggttggatggcaacaccgactcaatggacatgggtttgggtggactccggtagttggtgatggacaccgaggctggtgtgctgcggtttgtggaatcgcagagagtcagacacgactgagcgactgaagtgactgactgacacaaagaaaattataatgacctacttcaaatgatggataatgaatatatgatcatttgctttttttatttttatgccatatgtgttatgtttattcatttgtatgctgctgctgctactgctgctaggtcacttcagtcatgtccgactctgtgcgaccccacagacggcagcccaccaggctccgccgtccctgggattctccaggcaagaacactggagtgggttgccgtttccttcaccaatgcatgaaagtgaaaaatgaaagtgaagttgctcagtcgtgtctgactcctagcgaccccatggactgcagcccactaggctcctctgtccatgggagtttccaggcaagagtagtggagtggggtgccagggccttctccacatttgtatgctggaaatatttaacagaaaaaccttaatcatgtgaagtaaaaaactgtttaaaatacttaaatgcaactctcaatattcactagtagataataaagttgaactcatttattcaacggctacacagcacctgttatatgccagggcctgtgaataagatggtgaacaaagctgttatggtctctgactcaaaagagcttatagtacagttaagagatgatgtaaactcctatgaattt

SEQ ID NO: 50905 - DNA, 2565 bp, Bovine  19866880462519
tcttcttttccccatttgagggaggaagcactggctcagacagcccgggcaagcaagaaaggatacagagaacatatcgtacagctgggtgagcaaaattggtgtttttcaggtaatgcaggagctcgagggctggtttccttaccatcaggcaagcttcattgaatgtcttcacctaacaagacgggaaaagagggagaaaagggtggggctggaaagtctagccagctctggtaatatacaccgagcctaatacagcaaccataggatcaaactgcctactcttcatttactcagttaaaggatgttggtatttaattcgaaaatttaaccatgtaatttagctaaaaattaaaacacatcatcccacactgagcacataacagtcagcttttgattatttctgtaaatgaagcattagttaattgaaatttataaaaaattctgatgtctcataacataactatgcacactacttaaggttgatacaaatattacaagtgtgtaaaatgctgaacaaggtatctgatacatgctaatcatcaaatcagctgatggcataaagcctgttaattctttaaaatttatttttagctagatctcactgtaaccacctatacttttctctgaactatatatgtaccagctcaagagccaggtgtgaccagttgcctcagctatgaggccatacttgacaataccagcatatagatataccagagaactaacacacaaaattaattccttttttaaaaaaattaatccccttttagccaccaggaatagtttggtggaaaaattttggaagcagtgatatgtgtgaaaatggtttgcaaataaagtatttaatgatgtgtattgataaaaataaatatctaaaaaatactatttacaagtatgttagataaaggttaaaataatgttgatttttttttttaatcctaaccaaacaactggattggaagaggactttgacaggtaagttcaaacttaacaaaaagtgaaaacttcaaaaacatgatacagatattaaaacagaaatgctgttattaggcaatatgacagtactaaatacacagacaatagcgagcgggttggctttttacataaatggaagctgtggaaagaatgagtgattccctccaaagctctggtgggtaagccattctgaaagcaacctgggatacagttagaccctcagaaccacgttagagattgcactatgaatgtcttggaacagtttaaagtaatgatttcttctaattgtgtcctatttccaaacaacaaaaattttgatgagagtctatggtcgagaattagctcctttactggtgtctcatctgatttcttgaaatgaagcacactgaagaaatgacatcctctggcttctaagctaaatatcacctgcacagtcaagtttgatatttcagtaagaaggaataatttctgagactgaaaataattaagcaggaattagccaaagaaccagttttgccaataaaccctgctttccagttaactgaattcttttcactggctattaaggcaacccaagatcacactctttgggttgacgttatgactacaaaactattttctgaaaacccatgagactgaagaacaatgagtgatgcatctaagccatatgctgtttctgactcatgaatacgtttttgtttttctacacatattaactattttcaggatatcttgctaaagcaaatattaaattaatttttaacaatttttgaaggctgaagtttctagaaacctgttgggtaacacaagaaaaaagagtggggtattatttatttacttaagaatattttgcctggcttcaaaaaggatttaaactcgttaacttcagatctgcttaaaataataacaacagcactattcacaaaaaataatcaatagctgaatttatctttttaaagattcaaattaaatcttttagttttctactcatttaattctacacctctgctatcaacaccttgtgttacaagttccctccaaaaccctcccgttttgagcacctgcattacaaagcgaggaggcaggccatgggggaacacggtcttcagttcttggatggatatgttgtagtgctgacccacgtgctgctccccatgcttggcctaggaaataaaaatgcaaacaagtataatggagagcgacaaagactttgaaaaagcatcaagggctttctagacgctactgagggaaacagttctcagagctggaaaagatattctattctttaatttcttatcttagacaaaaatgttcactattgtccccaaatccacagtgcatgtattgaacacaaagcttatattggccctgaatgatgcagccagttgctcagcaacatgaaccctagatgtggaggcagcagagacaatttttgccatctggattcttctgtgctgtgtatagagatgctccaatcacgtgacaagatcctctgcatgccactgttgccatagaaaccccagaggaactggcagataaagggactacaattacaggggaaagctgaaagacacttcaagacttcat

SEQ ID NO: 50906 - DNA, 1993 bp, Bovine  19866880577308
tccttacctgtcctctgccttggtgaagaaattcttatcctggggattcatgggcttcagagaacacactggaagtagttctggatacatgaaaaccttgctcgtggctaggatccaagccacttgctttagcaaatagggcaatctataggctgtaagaagaaaattcattgtaagtgaaattccagaacaaaagagggattcacaaaagcttctgaatgtattttggcatttagagagagctgaccctaaataatgtgggtatccacccatatacccatctcccaaaagtttccacaatcattctcagccaaacatgtacataaaaggagtcccattcaacgttattaaaagttgattgtctttttctttcctgtgtggaacacttaacacactaacataaacacttatcaagtaccaaggaacacctggcagataccctatgctcaaaacatttttacctccttccccttttaaatccttgaaaggtaagtgaccttcaacaatgttttctttcttccaggataagactcccacttctttaatctccctcacgaatctagtattccaaatttcacttattcttacttaactttcattaagttctcccagattcttcctgaggttgggacaaaaaaatcagaaagagaatgagacaattcagtctcattcatttctgtcttgttgtctaagcctcccaattccaggcacttctgccttttcagagataagcacctctatagttatatttatccttccataagtgtaatttatatccccagaagaaaagcacaggtcactatatatgtaggttataaccgcatgtgtactctgttgtgtccaactctttgcaaccctatcagctgtagtccatcaggcttctctgtccatgtgattctccaggcaagaatacttgaagtgggttcccatttccttccataggggatcttcccaagtcagggatcgaacccgtgtctcctgcatctcttgcattggcagtggattcttttaccacagagccacctgggaagcccaagttataactgtagtctggtgttaagttttcattaccaacatataactaataaagcagtttgagatcagtgtccatgacataatgtacttacattccactgaattataagagtgggagttaaaatgaagaccaaagtccgaatccagagcaaaccataattaatttgttaaatcaggaagaaatcagaaggaaatatttgatttacaagaacagaaaatattttcacacaaaaaaaactaaaccaatgaaagtagaaaccaaacctgcagatgtctttaaaatattgaacatggcaaatgtacaacattgttactttgttcctaactcccaaatcaatgtttcactcaaaatggagataccactataatctttatgggaaataaaatgatgttaatgaagaagacagtaaaaacctaaatataacctgactttaccgcttgacttccatctttatctcataccagtggtcttgacctaatccctaatcagatcagatcagtcgctcagtcatgtccgactctttgcgaccccatgaatcaaagcatgccaggcctccctgtccatcaccaactcctggagttcactcagactcacgtccatcgagtcagtgatgccatccagccatctcatcctctgtcgtccccttctcctcttgcccccaatccctcccagcatcagagtcttttccaatgagtcaactcttcacatgaggtggccaaagtactggagtttcagctttagcatcattccttccaaggaaatcccagggctgatctccttcagaatggactggttggatctccttgcagtccaagggactctcaagagtcttctctaacaccacagttcaaaagggatcaagtcttcggcgctcagccttcttcacactccaactctcacatccatacatgaccacaggaaaaacctctatttaagtccaattattagcaatgagtc

SEQ ID NO: 50907 - DNA, 4168 bp, Bovine  19866880579232
cgtatgtaaatgaatgaacatggctgtgtccaagaaaacccctttatttatgagcactgaagtttaaatttcatataatttttatgtgtcacaaagtagtgttcttcttttgatttttttcccccaagcatataaaaaagaaaacagtacagatttgaccacaggccatagtttgccaacctctgctgcaaatcaccagaggctatcgcccctcccttctctttgaagagtgcaggttcatcaaggtccttcttgctctggttgtttgcgttcttttatatcagaaggactttatgataattagtccccatcacagttgttttagtgtcagcctgtgggttatttattcactctctttttaagagataacagtgaggtaaccatcatatagcgcttctctcttgggccttcctctctccagaaccccatttctcaatgctctgccttctctctgcctctaaataacagcaaccacaacaatagtagcatttactaagtacctaatatgtgccaagcacagtattagttgtatttaccgacattatcattaagtctttcaatatccttgcaaggtagtattatcattcccattttacagatgattccagagctcaaacacatgaaataagcaatgtcatgtggttatttattgagatgcccaaggtcacttggtttatgaaggtggcagagctagcaaatctgccgaacttcaaagccactgtagcatcctgaagaaattacggtctcggagttctgaataagagaactattaaataataattaaataatacatgcctccatctcagcacacactggaatgtgtaacgaatcaatggcgactagggaaatgatggagattacacacagaggagagatcaggagatgctgatggtctatgttggtggggaaagcatctgatccagaggcaggaagaagagtaaagtgactgagagccccttctggctttcctctcctgcccccatccccagcatctgatcccagacctatttcagaatctcctatctctgctcagcggaagcagtgatgtgacacgatgtgatctcattcaggagctaaataaagccattgtgtgagccccagccctggccgctcccttgtaccatttcctgagctcaggaacccagggaaagatgggagggggctgggagagaactggtgtgaagagcagcaaggaagggaacgtagagccacagaaagcggagggcggaatatctctgggagggggatgaggaagccttgctaaacctcatcactttgaaggagagaatgaaagttattgacattataccatgaaggagtggaatttagaaaacagaaaaactttccgaagaatggaatgaagatatgagggagaaggagtccagtgaattccattttcacagagggcggagaccatgaatgacaggacagaagaggttagaaagagggcagatctttgagcagaggtcagattcaaggtggtctctgttggaggaaggagggtgagatcccaggacatgaagatctcaggattaaaaatgtctgtccaccaggctaaggcagcaaggtaccacctccagcaggaagcatctccagggatggagggaaaagaaagggcttccattcactgcttttcattcatccagtcaaatccaccccacgagcaaaatccagccaggaagagcaggtagaagctgggtacaggtgtgtaggtctaacagctttttctcttttgtgaggtcattgaatgccagatccaaggtccgcatggtgcccctcagtgcccatttctgtcctattcccagcctctgttgctctttttctagtgagcaccccgagttcctactctttcctccctcccagcttccctcaatacttttttgtcagtacctcccgccccttgccccaaatctcagctttgagacccctggttggcagggatcatgctgtggccctcaggttctgtcctgctccctgcagaactgcccatcccgtttattttattttttaaagatatctgtatttggccgtgtcgagtcttagggtctttgttctaagatgggatgtgggatgtttcgttgcagcgcatggactctctagttgaggcacgtgggcttagttgccctgtagcacatgggatcccagttccctgaccagggatcgaacccaggtccccagctttgcaaggtggattcttaaccactggaccactagggaagtcaccgggccatcctgtttacagatggcacatcagatgacacgaggcccaagtctgtggacacagaggatgggtcccagtggctggacgagaggccccctctatgtggcttcccgatgtgctgagacagcaggcctgggctggtctcctaggcctctcctttcctattcttagacccacccggcagggcagcagaatccacctgcagaggcctgagtacttgtgtcctcccttccccatggtagacaggcgtgcagtggggcacaggcaccatctcagtggtcctgtctgcagcggcagcaggttgcagtgagagagggagcagtagctggaagggacgactttccaacaacctggactttaggggtgtgtgtgtgtttgtgtgtgtcgggggcagggaataaaataacctgtggaaggcttgacgccctcacaggaagcctgggaggagggcgagttctggctcattgcttcctggtcctcctgggtcctcccagcatctcagttgcttctctcctgggggaagaggagcctgggaaactcattctagcagaagttctgcagagacggggcctgggagggagtgcagaggtagatgccgctgatgtgagctgccctcccgcccctccgccaccttgaaactctggtatttggtacttgtttctggagcggggcttatcattttcaactttaagagctcctgagggttcttaactctgagacacactgaggcaagccctgacagcctccaggagtgttgggctatgagaacaatgcctacctggaagagagagtgaaggaatttcaacatggctaatttgggggccctttgctctgctccgtggggagaggtcagaatagctgtcttactacccaaaggacaggagtcttagaaggaagaagtcataatactgtcactcacgcaccttttctccctgctgttttatttgcctagactcctccctctccaacgtggccaaatcctaaccactcccacccttccaggcccatctcaaaggctatttacttccttctgtttcccttttccgagtcctccaactggttatatgtactcagcacaaagccttcttttttgaaacttttcttgtgacatttgacaaatcctggccagttgtttgtgatctgtgcttttgtctgcgtgcacacatgcacgcactcactcaccagaatgaattccttgagggtaggaacaatatctatttctctttgcttggcatggcttcctgtcagataggtgctcatcagatggaatgataatgagtgaacgagggtgtcattatgtactggacagaacactagactgggagtcagaaaacccacgttcctggtttgactcctcagctaattctttgtgtaatcttgagccaaccatcctccagttctgtgccttggggaagggaggagtgggtaacaggatactctaggcctggctgactatgacactttcctagttccaaggttccagagttctagaactctgctcagcattctctgtcttcttgattcagactggcctgtgtgcggcttccatgaacagagaagtcccagaggtgttcctcgcaggtggagatctggtgccccgaggccacactcgccgctgcctctctgcggtggagtccagagcgcagctggaggaagaggaagaggaggagaatcagagggaggggagaaaaaaggagggcgaagccttccatgctgtgcccctccgaaggtcgggcgcttttcgtgcccacagccacaactacgaccccttcaaaaggcatagctgggggccgggcagggagctccaggatccactgaacaggtaaaacaccggagacctcctgtctctcctctcaagtcctagaccctggagaaagtggttgggaaggaatgacaggagttgaagaggcctgggcccctagcctctgccggagagtctaacccagg

SEQ ID NO: 50908 - DNA, 2787 bp, Bovine  19866880587478
atgattacataagaactattatatcccaacacaattactcattcactccaaagtagggtgatcaaattaagtgacccctgggactccctggcagtccagtgattataaaactctgcactttcactgcagggggcacaggtttaaccactggttggggaactaagatcctgcatgccactcaactcagccaaaaaaattttttttaatttttaataaaaatttaaaaaattaaatggtcctttcagagctgttttattcaatattctgtttttaaattttaagacagacatatttttcattgactggtaagactactggggaaaacctaaatattaaaaagaactacctaggtcacctgaagctatcacaacattattacctggctatactccaatataaaatagttttataaataaaatttatgcttaaacttatcaaaaatagaactagctaatgatgggatttagaaggtcatcatttgacaataaccatagtaatgattgtttcaatcaagaataagcaatggatgctaaaataagtgggtgaaaagatgttttacctcaaaaaaaaagatacatattaattgattttaaaatggaaaaataacatttttacagcaaggagaaaaaaagcagacaccaccttaaccatatgatcaactttaacatgacagaagtcacgtgcctcccgaaatgctgcactgaaaaggacacatcgctttcgggatatctgtgccaaaagtaaatcacctgaataaaactatgagaaactattagaaaagtcaaaatagaggaatagtctgttaaataattgcttcataaggttcaaaaatgtcaaggttatgaaagacaaaaaaagattgagaaactgttcccaattaaaagtgtgtaagacacaggacaactaaatacaacatggaatcctaaactatatcctcgaccacaaagaaattgttcttccttgggtttatacaaaagactattggggcaattggtaaaatccaaataaggactttaatagagtttatatctaatattatacatccttattgtcataatcaaatgtcctcatttttaggaaatatacactaaggtatttaggggtaaaggagcatcatgattgcagcacactccaaagtgactcaggaaaaaaaaaatgtgtacaaagagaaagaaggagaagaggttaaagcaactgtggtaaagtttaattttgaggaatctggctgaaggctgtttctatgttccacatttaaaaattctctctgcgggacttctttggtcgtctagtggctaggactccacagtccaatgccagaggccaggttcaatccctggtcagggactagaccccacatgccacagctaagagttcgaacgcggcatctaaagattccacacagtgcaaacagataaatgattttttttttaaatgctgtcacatacctttattccttccttcggaaatgccattctcacaataaaatactacaaaccaaatagtaccaaagacctacaatttcatgacacaaacttattatatcagaatgtagtatcttccgttctcccttcccaatttgagcaacaacaaattactccattcgctttctcagcaatttagagttacattcacctggaaagaatccatgcagaccggactggaagccagctcctcatctactgcgtgcaacttctccatgaaggtactatccctggtctgtttgggctttggtgggggccgggggccccatgggcactacctcagcactgatgtgcctgatggcaggtgtggtcactttctcagcctaattaaaagaggcaactatgttagaaaatgaaagaggggaggggaggaaaagtgggaggaaaaaaagaagcaggaagagacaagcacatctttcacatgctagcaatttttctcttcccagccagatagaggttaaaagaaaaaaacaaagacattgccaagtacattaatctaataggtttcatcccatttccaatgaagccaacaggatgctactcaggttactgaagatgggaaataaaatggctttagaatattagaaaacacatacaaaaaagagaagggtagaagaatagaaaccctgccagtcactcatatttgaacccttaacaaaaactcaaaaatctttctccctgtcactgagttccagttttctcttaacccttcactgacttaaaggacgtggaaattcagttataactagtcacaaatacaaggaagataatggcatggttactgatcttgaatcatgtttggcaacaggtgacagctcagaatcaccatggggaaactatctatttatacagttaaataatctacttacacagtatttctgagttatcttattagcatggtatggatttacctctgataatatgccgctctcctcatctgtttcagtcatctcagaagactgcctcaatcgggatttctttgccccacgtggagatgaagcggtgctttccacatcactttccaataaactctacaaaacaaatccagttcactttcatatttatgcccccacctcattctactgagtctgaagtatctcaatagaataaatcataaaatatcaatcactgaattagtcagagtaaaagtaaaatttaaatagaagcttaattttctgaagtaggaacagggatctgatcaccatatactcatcagtgtcataacctctgcaaaactgtaaggcactgatttaaaatcctttaataaacaagtcaaagaacacattaaaaaacagacttgttacat

SEQ ID NO: 50909 - DNA, 1387 bp, Bovine  19866880603552
ccaatcagtccctttccacctcctgtcagttccttggcctgcatcctgggtgccatgctagaagggtggggcaagagaagggctgaggttcagagggacacacctgagaagactttgaccatagagtcccaaggaattaacccattagatcccagggaacacctaaaggtagtgggtgaagtaggaagcccctaatctgaatggatggagtaatatggaatctggaagcctctgagcctcagacatgagttggtggccctttaaatcttacaattaactcagacggatgaagggagtactgccaggccttagaggaaggggaccctgggtgaattaggacttgaaattttaaaactctagccatcctttttgtccatacctcttgagtaagaaaaagagactagaagacatcataatggactttgctgccaggtgaacttgagtttgaatccctcttaattgacaagggttagctgtttaactgggcttccctggtggctcagtggtaaagaagcctcctgccaatgcaagagacccagctttgatccctgcattgggaagatcccctggggaaggaaatggcaacccaccccagtattcttgcctggaaaatcccatggacagaaggataaacctcacgtttaatacagggattgtgatatgccaacctcatcaggattgtgaggattaagagtgcataaacaagctttggcatcactggttgcacaagtagtgctaattaactgttggccattttggtgattttctgtttgtacacctgtgcacactcacacagacacaaacagaatacaccttagttaaaaacgggaactaatacaggagactggtggagaattgttctgccacttcctgggtgtgctgaggggttcctgaagatctctacttctggggaatgcccactcatgaaggaaggactcagggaaagggaaaagggaaactcaccagactcaggagatatcccaaagatgggagacccgttcttgccctcggttggtgacttcaatatgggaggaagtcccgcttcaggtagcccctctaagaatccagtccagcaccttaatgggggtacctctctcttgatccttttaagggaattgctcatggtccagaagtttgcttaggagacaggggggactcattccagtccagaccagctgcctctccaacaactctagcccttcccttccccgccctacttcaaacacccttgacagtgctgggctccggtctttaacccctttggtgccaacgctggtccagaggattcctgggttctcctgtctttaacattccccaaagggcagccatcagattcagtcacaggtggaaacagatccaggaagccaagctggggtcactctgagcg

SEQ ID NO: 50910 - DNA, 811 bp, Bovine  19866880794103
catcattgctgcactctcctttccttcctcaaatagaactttctggcctagagggaaacagcaaaagctcaagtgcagaagccaagatgccaaaggccaggggttctagacagaaagactcctcccccactattcccaaaaagcaatgaatgaggggaggggttaaaagggtgccagtcatagctctgacggcttcagaaggggtacccacactatccttgggttacccagcacccagaggcccagagacctagctccctaggctgtatgtattcctgacctagactggcccctctgtatacttctgtctggtgggagaaaactctaaaccagaaatcaacaaagggtatccccccacccactcaactcacgtgcacatgtgtgtgtgcatggcacccccaccccccacccccccacacacagacacacactgctgagacagactccaatcctcttcatatcttttcagtggggattaaatcagtggtacgtggagatgcgggcaggtcctgggttcgtggaaatgtgtgtatgtactgaagcatgtatgtttgaggaaacagaaccaatataatcctctgtgagccatactgtttagctccactgaacccttttcttcgactcaaattccattaacatctctaagtctcctttgccaggccagagcctggactctctggcctaaaagaactattagtgtttccattccctgtcaattccaagttctcaactcaggctgattcccccttcttacagaaagtctcatcccctcctccccttgttgggctggtccaggatttgttaacttctg

SEQ ID NO: 50911 - DNA, 3733 bp, Bovine  19866880877925
cttgcatggggctcctcagttcttcccatagtcactttgatgggcaattggtctacacaagatccagagctaggtcccttaggactcttgtcttggcccagcaggccagcctctgctgcatctaccaacaggttcccgcgtccaccttccctcccggggccatctttgtctctccgcactttgatgattttcttcttgttgctgagggtttctggatatatgctgatgcctttgagcatgtgtatgaacttgtatggtgggttcttgtgcttcttctctgcctgctggtggcagcatgtccagacaaagacggtcactgagacacacaccaccagcacagaggccccgataaggccagcgaccactggtgagacatctgaaagtggagaccagagatgtgtcaaggcggctggacctcggcctctgccagagcacccctgcttagggcctccggctggggctgagctaatctgcaacccagccttcttcaaagcaaaacttgctcatctaggcttaggaacgtctcccctctcttagagatgccctcacccatccctccaaccaatctgtggctctttcttcccaccaacctggatgaaatacttaccttctctagaaagcctcccctgcagtgcgccacctgactgcctgttcttttctcggccttgcctctgcacttacggacttggtttgctcaatggatttgtatttcacataaagtggccccgtaagtgttataggtcacccttctacataggagccattcacctcaactgttccacaagggcatgagctgtgtctggtttcgggaggatattccacagcatgcagcacagggtttgccacagtgggtttgtgtgggctgactgataggtagggtggaaggatgtggaattgactttggatgggtttggtagggtgcccaagggtgataaaagtaggtgagtggtaagaagtagaactgtgggcctaagtccttttgaaatatgtttcaaatttcagctcccaggcatttgaaatacttgtattttaatgtaaaatacaaatatttaaaaataaaacacaagtattttaaataggaagaaatagggaccatggaacatgtcagaccttgtcaccttcttagtaaagtctttcctgaccaacctatttaaaaatgtaaccttttccacccttgagacctacacttctggccctgcttaattttctccatatgacatgacatgagttctctctttcataaacacacacacacgcatgcacacatatacaaacactcacatataattgtattagttattgtctatcttcactagaatgtaagtttcctaaggacagggatcttgtctgtttgtgtgctgtgctcagtcactcagccacgtccagcactttgtgaccccgctgactataacccgccaggcttctctgtccatggaattctccaggcaagaataccggagtgggttcccctgcccttctccaaggcatcttcccaatcttctgggattgaacccagtcttctgaattgcaggcagattctttaccttttgagccaccaggggagccttttgtttgtttagttcctgtctatatccccagcactaaaaacacccagcaggtacttaatatttgttaggtaaacaaataactaaagagaaacaggtttttttttttctcttcccttttctagtcttgtcttttcctgcacaaattgggcccctgacttagataatttggttttgggatttcttttcccttaaatgcactgaagctaaattgggtttaggccttaaagatctagataaggcctatagttatccatactacgcattagggtaagtctcaagtagggcagggggaactaaggaaataaatgtgattcttgcatattctagatttttcctagaagatccgtctatcaggcataggcctggcctgctgcctcactcactgcaggcttttgttcaaacctcatcagaaaacatttcctgtctgttccaaggaagatagtatccccactactctgattgatttctctttgtagcacttattacctctggtatatatttatttgtcagtcttctcttactaggtaatttaataagaccagtgactggctgttttgttcactgctacattcccaggtcctagaaccatgtggcacatagtaagtgttcagtgaacaaatgagttagtgaattcaaaacagcttccactttaggagcttgggattaacagataacaaactactatttaaaaaatagataaacagcaaggttctactgtatactacaggaaactatattcattatcctgtaataaaccataatgaaaaaatatatatacacacatatataattaaattattgctgtacataagaaactaatacaacattataaatcaatgatacatcagtaaaaaatttttaaaaacccagttgccacagattggagaaagaggatgaggtcaatatgactacatataacagggataaatgtaaaattctatttagccttcaaaacctattgataggaaataggagaccttacttgataaaatctgagtaaaactaacttagtagtttaagtgatcacaagcttggagtatacctaggctgacttatactatcagtgtgatgtctaaatcatagaggggcagtataatttcatctgctctggtcatgacacacatgaagtgctctatctatttctgacaagaataaaaattgctgttttttgtgtgccagtatgatacccgtgccagacactgtgttagagcttcctcaatttgactcaaataactcactgaataggtaccattaatagcccaattttacaagtgaggaagctggggactcaaatctgctctagaccacaaagaagcaaatgacagtgatgagatttaaaccctggtctatctgacaccagaatgtgtctatattatggataagcaggatagaagaggacctagaaaccatattaaatgaggagaaactgaagaagctgaagctgaagggtctgggaataacaattttctttaattactgaaggtactttgctggaagaaggtctcatctgattttacttcggagggcaggtctaataccagtgcatacaggctacaagaagacagataaattcaaagaactgaattattgttagaactgcctctcaatggcccagattgcttccggaggcagtgaatctctgaagactttcagagactggatcaccttcgtcagatatattattctaaaaggaatttccttaacaaggattggaatcaacatctctgaaattctttctgcctcagacattcaaagttctatgaatgttgggaccaggtaagaaaagaagtggtaacattttgaaataatacagatgaggagtaatgccatttaacaaaaagtatatcaaggtgactgtgtccatggccatgctgaataataatagcatttattttcagaatatcaggtgaaataaaaactgttagggagaggtttcacataatgggagcagccttggctgtaagctccttgagagcgggcagaaattataacctgtttacctttgaatccccgagtctcttgcatcaaacagaagctcagtaaatacttgcttgaacaattgattgggttcaattataaatcagaatgggcacaatctgaaaaatcggctctccgttcacctatgagagattttcctgaaaactgtttgctactgattcgtaaca

SEQ ID NO: 50912 - DNA, 2502 bp, Bovine  19866880904964
cagcagctgcccccctccaacttagccggcctgccctgtgccaggagggcagggagtcctggcacagctattgttcgcctgcacaaatgcccgtctgtttgcatcactgcccccctccatctctgcttgtctttctctcctgacccgacaggtgtggcctggttggggggcaagctgggtttcaggatgcctgagtcttatgctttccagcccaactttattccctatggccctcagcacccctcttctgctccactcgtgtgcccacccccaccgtctgctatctcatcttcattcatcaagcaagcgtttattaagtgcctttgtgtgttcagcgatgtctttttgtgttatgttgctggctttggtgttaacgtttcgatttggccgccgtctcctcagcctcctgccttcatcttatccatggaagctcataaaggaagcaaagcctggctgagatcaccccacaccctcttctcagtcccatggccaggaaccccctctcgcatttcccagccctagaacccatccctcaggactcatggccctttgcagcctatgactctgaacccctgctgtccagggtctaagccacagttgacttgaaacctggtagaaccttccagggaccttctgggcatcaagcacggcctggacagagactgtaccaccttggggaagaggctgctaccccttgcccagaggtcattctcagcatcatgtgacctccagaggtcttggtttggacatacctgatggaggaacaaggacactgagagtttaggctctgtttggagaggctctcactcctctgggtcagctccgccaccctctgctgcccgctagggaacacaggaagccaaagtcctggctctggcatctgtggcctttgcatatgtcactgccttactcatctctcgcctgggagcctaagccagaggaaggggagactgcctgtgtgtttgagccagcagcctcaatgccctctgccatttgcctagtctttctccaaaatgaccaaggtctgggatgacagtggaaaggaaagtcttcttctgactttcagaggataccatctgagcctaaattcaaaggaattaggagtgaagttctgggaggagggaggaaagagtaacaagagaggaggagaccagaattccctggtggtccagtggttaagactccacgcttccagggcacagggcacaggttcaatccctggtcagggaactaggatctcacaagtgcatggctcagccaaagagagaaagagaggaggcggaaggggagactgaaagctctgaagctgtggtaaagaatgaggggatccctagagcaggggcaagggtgctgctaggaccccttgtcttggtgtcttggccatccatccgtccttctttacttcctctcttcccaagcatacgttgagtgcctgttatgttccagcccttgtgcttggcgcttacccgtgctttattcactccatccttgatgcagcagtggcggagatgcaggctgtgtagcaagaccttctgtgagggtttgtaagaaagcaggactctggacgctggacgtagaggactgaaccaagcaggaagggcctctgagtgtgtgagtggttgttgtggattggggagtaatgggcccttttcttggtggacagatggggtcatgaggtgaagggctgtcctgctggctggtggcaggcaggtaacaggggtgatcttaagaatacttggaaagagggcagagaagcacacagggccattgacagggagcaggccgccctggggtgcaggccctgtgtccttcttgcctcaccagcctgagcccttggggagggtgcagactgcctccaggacaatagcactaggcagtgccagggccgctcgctgccgggcagtgtctgtgttgggatgtgctgctgctgtggctgctgcccgctgctggcccacctagacagggggtcccttggagagagggtgagtgttgggaggcggaggaggctgggcccttggagccagagagggaaggtccacaagagtccctgtcccctggctgccccggtcctctcgccctctttccccgcctctttcccaggtgagtgctcctggaggcctgagggcagaaggcagagggcagaggtcgggggagaaagggagttgtagcagctctgtagcggatctgcaggactgcatctgcaggactgcccattttggagctgaccctgcttcagatatgtcacttttttttttcttaatgtagttgatttaccttattatattagttttagtatttttacagattatgtatgctccattaaagttattacaagataatggctataacttcctgtgttatacaatacatccttgcttcttttctgtttcggttttttttttttggtcatgctgtatggattttagttccccaaccagggactgacccctcagcaagaaattgcagagtcccaactactggaccactagggaattccctgct

SEQ ID NO: 50913 - DNA, 1103 bp, Bovine  19866880911054
cctttgtataaagaattttggaaaaatattattttaatgagatgcactactctaagtgggtttactgagataaattatatgttcatttttttgactttggctgcattttgagaaatttaagccttgtttggagcgaggaaggaacttagcttagtggggagaatagatgagatgagtcagctgtgggagatgatctatacagaagcactgaggaaaagaagaataagtagtttagaaacttcggaatagggagttccctggcggtccactggttaggactctgccttcactgccaagggcctgggttcaattcctggtgagggaactaagatcctgcaagccacatggtgtggccaaaaaataaataaattaaaaacttcagaataaatgtgcttttatttatctaccacagagtagatttcctgtggtgctgaacatcttaaatattctttggagatatgagtttacagttgaataagtgtctgaaactttttttccctagatgaagcagatgatgatgatgatccggaatataatttcctggaagacctcgatgaaccagacacagaggatttccgcactgaccgggcagtaagaatcaccagtgagtctgtgtgtgttatgagtcctgctcttgacttttccacatctagctttgtttactttgcagagttttgagggtgaagcagcccactcaagacatttaagcttcctctgcctatttatttctataattctttacattgacatctatattcaggaatcctgtcaacatcccacagtcatgtattgagttcagtatttggcagcgattgtaccaaagtaagacatggcctctgtctgtaggatgtcagcttagtagggggatacagacaggaacagttacagtacaaagtgataggtgctgtaataatagcttatatattggtggcctaaaagagggtatagtgtcctatgtatactatggcttgggaaatgactcacaaaatgattcaccttagtttagaaggagtaataaggttttggtgaatgggggcagagaggggttttgtaaatagaagaatattttgcagaccagaaattatgaaacagcaatacatgta

SEQ ID NO: 50914 - DNA, 1147 bp, Bovine  19866880955297
cgccccccaccattccttgccttcctccttgggacttccttgaagaagaaggaatttaagtggaacctgccgctttctccttcccactctcctggagtctatgcagctcccgcatcaccacccataactcctttctcttttcactccatttctattcttccaggctgtcttcagtcctccacctcctcattctctgcgctctacttcttaccttcataggccccaaaccccagaggtcccttttctgtctttcctcctctgttcccaccttcctcctcccccaaaccttaactgtctcctctctcagaacaaagagtcctttcctccctagaaggaagcagggaccagaggatcagggatggctctggaggctagggggtccccctggaatctaaaggaccccagctttggagcgtggtggtgggggagaggagagagactatttctttgttctgactgttggagaggtggctggctttgtgtgcgggactgggagtggaaccggagaggagggctgggggagccctggagggaactggcggtgctggcagtctgggagggaagttgaagaactagggggtctccggagaggctgaggccttgcggggcataggaaaagattcttggggccttagaggttaggaaaagagctgagggggaggggagaagcaaggatgggggaagggagtgtaatgcttaaggtagtggctgagtgactccagggggtcggatggcgcctagagagggacgtgcctgggctgcccgagggatttcaagaggggttcagtctcagtccctctggctttcctggaacccctgaccttggagtcagggacggcagatctgaaagagtgagtcccgtgtgtgcacatgtcctgtcctgtgtgttggtgtgggtgtctgtgtctgtctgtctgtccccagatgctctgggtcactgtttgaatgatggtcaccaaagtagggggctcattgccctctggacgtgaggaagtagttccattcttagctcagtctctcctttgaagtatcatctaggaacgagagggagcagattggtcatggttcctggagctgatcggaaaaatggctgagaggtgctggctggacccttctgggtttgtttatgtctccttgggggaggggt

SEQ ID NO: 50915 - DNA, 971 bp, Bovine  19866880968398
agagaggaggcgcttggcctattggacagaggatcctggcgggtagagaactggagggagaggcagaacctagcaagactactgaagggtatgcaaggaaaagcgtggccctgatgggagaagcaggcgcattctaagcaacggagagacacagacacagcggagacagggagtgatctgacggcagcatagaaggtggactggaaaggcaagcatggtaccaaagcagagggcacctgacactgcacagaacgaaggtgaaggagaaggcaagcaaccaggcagtactccttcctgttcatttcactgcttgattttgagactttataacatactttgaaatatgctccttcctaccacaatacctcaagttttgggtccttcttaacttcctcagaatttagcacctgctctggagattctctgcaagagactgcaaaggaaggcagagctgagccccagccagctaagggtgtgggtgactcaccacaacaggcccatcctcctgggccaggtatgtcacagttgctgaggtgaagttgaaataaccagccttgagagggcgcaggaccacggtgtgggagacgttgctagcactgactcagagttaaggagggaaaaggatgaagctacagtcgtaacaaactttcaacttagggactaaatgcacgttcacaaaaagagttgctaacacatgtaatatttcatatctaaaatactctgcaaaaataataaacacaggctttgtacctaagcctgaagtgggtggtattatatgatatctttttaatcaagttttaagaggtctatgacatattcaatattgaaatgttataaaacaatacaggttatagatgaaaaattagtcacttacggtcacagaaaaccttttgctgcctgtaacagaaggaaattcttgaaaatacaaaacaaaaacaatacaaagagaacacttaaccttgtcagaaaat

SEQ ID NO: 50916 - DNA, 1309 bp, Bovine  19866881029262
tgacctgggccctgggcgcctgcctttccccatagccgagctggggatcaaagatcagactttccctgagggtgttgcatcaaggcagagaggccaacctctctttccctaggacgcgtggatcctgtacttggcagataaccagaaagaggagggggtttaacttgccgccttcacccagggttccctttgtccaggttggtgagcatggtagaaaggccaccctcctgaggggtgctctccgtccaccgcctgcccatttcctttagggccacctgttccacccagccccgaccctggggccacagccttgctcgcaggtccctgaaggtgtctgccagggcccgccggggctcctgcctgagaaggcagtacagcacggggttgaggcagctgttggtgtgcgccaggcaggtggtgacgggaaagacataggtgtggacggtgtagaaagtgctgtcccagggcaccaggtcaaacttcaccaggacaccccagagcgtgaccacatggttggggaaccagcagaggaagaaggaggccagaaggatgcggatggagtgggccacgcccctgctgtcccgccatcgccgccgccgccgccttaggaaggccagcagcagcaggtagctggtggtgatgatgctcagtggcaccataaaggccaggaccaccctctgcagctggtaggcccccagccaatacctgctggggaaacgcagcaggcacaggcgcacgccactcacctcgccctcggccccaaagacagctgtgggcaccgtcaccagagaagctgccacccacatggccagggtggctacacgggcccagaagagcgagaggtgggtgcctggccctgcagccatggccaccacccagtaccgggcgacactcaacgctgtgatgaggaagatgctggcgtagatgttgaggacggtggccgttaggaccatcttgcagagggcacctccgaagggccagtggaagtccagtgccgactcggctgcccagaaggggagggtgagtgccagccccaggtctgccagagccaggttgaagacgaaagtgtcagaaggtgggcaaggggctcgctgagcacagttacccagcacccacagcacggccgaatttcccagcaagccgacagcccccacaagcccataggccagggcaaccgagaccctcagggctaggaatccaacaggcatcgtggcatcagcagcactcagcacgctgcctccagaagcgttgacccagaaagcgggcagggggcaaaaggtgttggggcgtgggcatcgcagggcatccg

SEQ ID NO: 50917 - DNA, 981 bp, Bovine  19866881039179
gaggccagggtggctctccttgcagctgtcgtccgctgggtatcccccagctccctgaacagctgctgagggtcagagaactgattggagaaggagcaggaatgttgtgtgtctggggaggtggggtggataggggagctggatgggaggctgccagccttgcagctgctctgccgatcttcctgggctgaactgggtgttcaggacttcagggtccccttgccccctccctttctgttgactgggtggaggctgaaatctctaaatctctgaaggattagggataaggacacccatctcaaatttctagtctgactgatacatagtgagaaagaaaggatatggcagcaatgtgtatgttgagggaatagcggttagaactcctgaccttcagccacatctcaggatagccctgtattaagtacaagccaagatttcttccttccccaagatgcctatacagagggctcccaccctatccacccatccacccccagacttatggcaaagagctgcttctggtttgagcaggacggcccactgtggaacagaggagtgatagctttagcttctaaatctctatggaacctggcagggaaccccagacagaaccagtgaggcctccctccctcctcactgttcaacttgagtttatgagggtgaggagggaaccccaatctagatccctctagagacctgacaaaattcccaatctggaagctcgttgccaggggaactggggaggcgggcagcaagcgctattttgagagcaggtggaaagcggaggttcgatccagagacactgcgtgctggagtagaggagagctccagcggggtgggcgcagccccagcccccacttctgtctgcccctctgccccaccctgctggccttgtatttgtggaagtaagcctgatgctgggtattgtctgaaggagttagcagagtttccggtgttgttggatgggggaggggaagctgg

SEQ ID NO: 50918 - DNA, 653 bp, Bovine  19866881254083
tgcactgaggcagagtgacattcagggtccaaagaacttacttgggcagatgagggcttccttggctgtgatgctcttgttacaggcatagcacatggtcatgcccgaaacggagatggtggtgaagaggtgcccattggtgtagcgtgcgtccttggcttccttcatcttctccttttcccgggtctgcagaaggggcgagagagacaggaagtgaggttggaggatgccagggtgcctgagaagtccagagaggcaggcgagggcagaggtgagagagcaacgccttcctggggttgccagaaacacaccacttcctgaagcagagcctgccgcagcgtgtcagaggtagctgtccaggagtgactggccatgcccaagggccgagctggcccctgacctacctggcccctgcggctgggttgcctcctgttgccgctcatcgccacagctctagacctccgcgtcctcactccacctcccggctctagctctgctcgcccccaagctgctgtactctcttctctgtgccgggagaagatgcgcagagaggaggggagagcaggcaaagcagaaggtgccagctcaccagcgctttcaaatctatgggagttagctcctcttataaccatgacaacccggtggtggagccg

SEQ ID NO: 50919 - DNA, 1010 bp, Bovine  19866881292829
gggcagttgggcccgggcctcaaggacgcctccaggctgctgttgctgtatgatgaggacatcctcaagtgagatccactccaggaacaggaggatttggcctttgctcaggcttatctgaccagggtaggcaaatgctgcttcctgttcctgccagcccctctgaacaagactgcttttccttcaggggagatgttttttaaatgaagtctgcctattaggctgcacaacagccttctatgcatctgcctttgtttacctagaaatatcaaaagagctgtgtgagtgaaccacaaggacgccaaggttagtcatcaacaaatttattgttactgcccaggcataccacccctctgttgccccaaaactgaggaaagatgatagccaccatcatcagtgcgagggtaggctaataaagactttaactgagcccttggtttgagaaaatagacatttgatacattgaccaaaaagtggatctcagtgatcttcagagtcatgaaccaacctgtttgtggcagcagtccctatctcattcttttggtaaccacctggttcctttttactcctagctaagtagagtcctagcagtgattgtcatggtttttcttgtctcctgatattttactaacattcctaatttatgtattatttaccctcagatgataccatgctgaaatatatgtagcaagcactccttatctatttcaacatggaggtgaaaccaggaaggagaggtttggactgtgagctagagaaaatttacctgattttgcaggtagcactgtagtccctggaaaatggaaaaatttccattccacactgtcagaaaaagagctctgccttgctcatggccccatggcttccattaatcatcagatcttaggacctgtcagaggagtagcctctgatgggatgatctggagctctttaacagtaactcctccttcctcggtccctttgtttcttggtcagggtccaaagaaaggggattggatgattggaaaagt

SEQ ID NO: 50920 - DNA, 1514 bp, Bovine  19866881317292
cctgccttgtcctcctcatcctccttgtcttctcatcttcctccctcaccttatttctcctcatccggaaaatggcaatcttattccgcttctgtctcttgcctggaacaaggctgggatcttcttccttgaagaatccgagagcaaggaatgaagtgtgctctccactgacccatcccattacatatgggacttcgagtctaaggggggggaagtgaggcagagaaggattgagatcagagggaaagattaagccaagcacccacctgctggtgagtacagagcgggaagcacagctttagactgccctgcccagggaagacatgcgcttaaaatgacccaagagaagttaccaagcagtatcagccaaggacacacaggcatattctaagcgtatccaatgatagctcattattttaaaaaggattcaaatgctttggttaaagaatccctttagaagttaggtaataaccctctaatttatctgttctagaaatccaggcggttcctatttgaaggtgatggatctgtttattatcttgattgtggtgatggttttgcaagcacatacattgtcaaaacataaagttgtacactttaaatatgtatagttgtattgtgtgtcaattatagctcaataacaaaattacagctagcatttaaaccctcccccaaataaacaagcaagtaagttcatatatcaagtgtgttcaacagcgtataaatgttgagaaggtacaatggagcgcactcataaaaatggagtagctagccggaggcagttttgtgtgtgagattctgagtcacacaaactgagctcagactctagcatcttttaggcaatcttgggagagttacttaatttacctttgtctccatttcctcatctgaaaaatggggataataatagtattgaccgtacagggttcttatgaagtttaaatgagagataaattttcataaaatggcatgttgtaagtattcagtggatataagctgtgactactattactgttggtattttttcctggaaggagtcaatttgagccatgtttagtaaaaatgtgaattggaaggacatagacaagatatggaaggttgccacagaacatcaaaggggaggtcagtgacctaagatgcccatacggtggtagagcaaggggtgggagaccccagagggaggggtactcacgctgggtcaggtcctggctcccttgatagcctaggtcatcagtggaagctgtggatgggtgtcaaggatatatcaggtggtgttaaaggaggggttttctacccctggggatccccaagcttctttaacctcctaaagggaagaagaaggagaggttagttagaagtggaactgctcacacacaggcagaacttcaggagtcaccctgctttgcacctgctgtgtcccatcctgccctcctacttcgagattcgaagacagagacatattatctctcttcttcattatcataaagttctatgatcactaacgcattgagact

SEQ ID NO: 50921 - DNA, 585 bp, Bovine  19866881397023
agtaggaaagattcaggcagagggaaatccttccccccaccaaccaggcgtcagaattctgggcgttctctgagtcgcacagtaggcgcccagagttccccccaacctgcgccccgccgcccactctccgggctcagcacctggcccggcccccactctgcctctgcgcctcgaatcccgaccagtaaccggggcgaacactcccctcaaacctagggtcctcccccctgcccagtgcaaggtgtcctcttcccactctccaccacgcccccagcccaggccacaaggcaaaccccggcctcccttccccagcacgcgccacgctcccctaaatcgccctcgcaggatgccccctacccgcctgccctaccctcctgctcctccgagtgcctgctgggctcccgccctccactccccggccctcccgcacgcccgacagtctcagagccacccgcctcttcgcagacccctcctccgcgctcacccccacccccgccacccttactacctctttgaccgaggctcggtcgcagatcacaatttcctccttgtccttgggggtcttgacggtgacccgaatggggg

SEQ ID NO: 50922 - DNA, 1283 bp, Bovine  19866881801681
ccatcgagccagctttctcccgagggggttcctgggcctatggaggtgacccttgggtgacagctgttcttggtatctctcttgctctctgtctcacagcaacagaaagctgccctgctgaagaacaacactgccttgcagtctgtttcccttcgcagtaagagtgagtagtgagggtgcaggagctgccataggaccctggacccccaggcctctcggcccatgggctctgctgcccccctgaggttgttccctggcacagcaccttcctcccttcagttggaagctgatggcggccccacaagggagatctagaccaatgggcctgggggcaggacaggagaattcaaacgaggttgaaggcctgggattgactggtcatctgagcctgctctcactttatattattatgatcagttatttacatggcacttggggatgttggcagaagttgttaagggccaattcagaaagatctggtgtgacagcaagagtgggatgcttagtcaggaagactagagtctgagtctgtgctcagccaccagctgagtcaccccagacaagtcccttcaccatcctgagctgcagtttgcttataggcttgggcggggaagagataagaaaagctctttgtaaccattaaaagtattgcacaagtttatgggtagtgttataatcatctttctctgactagaactgggctaaaggtggggttggagaggaggcttcctttctagtcaaggagcctgggaggcttgagtcctgggaaggcaccaggtttgaggcttgcttgcttggtatcccctccgacagctaccactcgggagcggcccagctcagccatctacccctccgacatccggcagtccctgctcggctcccgccgtggccgctcctccttgtctttagccaaaagtgtctccaccaccaacattgctgggtgagcctctacttggggacgggagaaccagtcaggcagagtgaggcggtggagacaggtaggggggaggggctgagagatccttcccatccctgagttcagaatgataggtaaggagaacttagggtgactgcctctgggatcccgccttggttccccaacctgggaagggatctctcgcccgagtgagtcgggtgatgcagccaggctccactcccctcagacacttcaatgatgagtctcccctggggcttcgccggatcctctcacagtccacggactccctcaacatgcggaaccggacactgtcagggagtccctcatcgacgaagggaccgtgccc

SEQ ID NO: 50923 - DNA, 803 bp, Bovine  19866880818989
tagcaagcccagaggcaaaaataaacacaaaaggaaggcgatcacccttgtgtccagtcacacacacacacgcatgcacatcttcccgcatactaacccacacatactaacacactccacaccatcacactctcacacatcctcacacacatatacgctcacacatcttcaagcacattttcacatactcagaagccaaatacccagaaaaaagagagagacatcgcctccacactcgtatgctccttgagaaattgcagagagaggtgaggcacttgttctctcctctctctcccccctcacagaagggttttcatttaaaagttgcccgagcccaggctttcagattacagtctagactatataggtttcctaaagataaggctgagaaattgatttcaattaccaaagtggagaggcagcacttctccagccttctgagcggagcattaaccctggagatccgggagctgcaggagaagaatctggcacgccaggcacacggggagcccgtgcacgtgctcttggagctcacacatgcacactcccatgcaaaatctcactggcgccagcttgggcagagtccagacctttgcgttaggagcccgggttccagctttcattctgccaatattttgcagtgtttgaagacctgcctttctcctctctaggcttctcctcatagaccccatttctgctcccaagggctcatgaagcctgtgctcgctcctggctgagctcctgtctgttgagactggctccccaggagatctaagcaggtactcagagccctagaacccagt

SEQ ID NO: 50924 - DNA, 1830 bp, Bovine  19866880845739
ctgggaccccagacccaggggcatccacccctcccctgtagacttcggcttgccctttgacagtgacaggtggtattggtgcaggaactgccccccaggtagtgttttttgaccccatttcctgattggaatccttgctcttctgtaattagccctggagcattcgttcattcactccctcaattgttcactcaatgaacactcatccttcaaagcacaattctaggtgctgctctgggcttggaggggaacaagacagataaggtttcctttccgcttctgtggaatccccactttaactggggaggcaggcaataaacaaggagaaaatgaactgacgagatggaaaagacaaggggtggcgggtgggccggggggagggaggaaaagaacaaaaatggtgatggggaagaattctctgaggaggtgacgtttgaaaaaagattgtgagcaatgatctgggctcttagaacccatttcccaaaaaaattggggtaattttaatcatggctgtctctccagtttgataaagaattcaacaagttaatatacatcaagcacttggcccagggcctggcatataatagtgcccaatcaattgtagctctgtgtctagctaaggaaacgtggacttggggaggcacagcagaccagacaggacgcctggcccaaaggtttgctcgcctggtcgcatgcaggagggcttcctggaggaggctgtcagcactggccagctgtttgcctgaggccggcccacacatctaaatcaagaaagctcatgccttggctgagaggaccccagcatcttggactcctgagccaggggagagcctggacctccgtactgcctgagtcacagcctctactcacccctgcctgggtccctaagccaccaccttagtttcccattaaggctggaatctaccaccagcccccacattctgctctgagtcactcagagccctagcattgaatgaacccggaatattgatgacctacttcaggaaagccagcccacccaaaactcactgcccttgtgaccgatggcccccactgtactgccacctctccaggctcagctcctccaattagcctagccctgttctctgccccaggaggcagaatcccatttctcctccatcctaagggtgggagagcctcgctgcggccagagggaggaacagacagacccgagggacagaggtcagcctggggcaggcaggacagaacactcagcgccagagcaccacgtgtttcccttccccccacccccaggcctccacgctgccctacaaacgccactagtcctgactgatggcaggaaattggtccccgctaagcacatctcaggagaactgataaatcctcatcggagagggggagagaggcggagtgaggggagagctaggggggctgatgggaatggtggggaaggggagggctgctgttctgctgagacaaggcccatcgctcttagccctgggcccctcttctgcctctggggtacctgtgggcagggggacagtgatgagcagacagcaggcttctatgtctctctccatgtgaggccttcctttgccctttccactaactacagtccatctcgttcctccatcaaggcccagctggtatcctcccctccctgccagaagccttccaagatccttccagtaagatgccagctccactggtgggcatttctgtatgccaagcccaatgctaagcaagtcatatgcagtatctcatcaattttcataactccctaagaagtaggaactgttacagccattcggcaggtgaggaaagtggggctcagagaggttaaggact

SEQ ID NO: 50925 - DNA, 1609 bp, Bovine  19866880904655
cccttgatgcaggatggagtatcccttccatgcctgacgatgtattttcctttatttctaaataaaactgagctgtaacacggagctgtgacattgatctgtccgagagctgtaacatggtctctccgagagctgagacacagtctgtccgagggctttaatgtccatcgcttcaaatttttgttgtgacaagacagaaccgaggaaactacctattcctctgacaaatccatctcagggagtagggcctgagtctctagatgatcccgatgctgaagtttgggaatcgctgctccaaggcagtgtcccttctacagggtgcccctttccccaccctccccccatcccagctggaggccccttggaggggaggaggctgcaagaccacagttgaatctccctgctgaaacgagaaccctggagggggcatcttttccctctgattctaactcaagacatcccggaacctcaccagtagggctgacgccagggtatttgaatagctcattagctctgctctgggcttcaatccctcttaattagttttgcaaacgatattcataaaaaaagaaaaaaactccaaactcatcacatagcaaatgcaggtccctgtgaagtttgtggccgtgggtatataggcgcgtgtctgtgtgctgtgagtgagaatatgtttgtgagcttgtgggtgatggtgagtggtgggcgtgcttgtgcacagaggtttcagccaatgtgcacgtgtgagaaagctcacgagtgagtgtgtctgtggtgttgtggtgtctgtggccacatggccacctcatctccagggacccccaccaagcaggttatccttcccctccttatgagtccctaacacacccaagtattagggaaacataaaccttcaactcccctctgtcctgcttgtttttgcttccccagtgcccccagctctagctttcagaggcaaagattaacggtcagctagtcagctgagcaggagggggacagcagtgtccccactgtgggaaccatcctttgtgtccagtctgaggctgtgacatagcttctgggtgtcccttacacttgcactgtcccctgatgcccagggtttccattctcgcttgtcccccctggattcctctgcttctggggagctgttcctggctgcagattctcaggcctcccccccagggagagtcagccctcaacagggctgcctgtggggttcagagagaggactggctgtggggtgatgggcctagactttgggggcacttcctaccccttctcaccgccacccccctcccagcctcctcctgcattccctgctgtgagcatccccatttggagccaagtaaatttatggcataatcccacatggaaatgcatggaaatgctgccaattaccatgaagccaagagaaaggctgtctcgctggcgccctccgtggtctgctgtctgcggcttcctgccttccagaaaccacagggagccagaagccagccatttggcccagattggcggagtggggccgtttgtataaaactctttattagtctcacctggccttgaagggtttcagtaggaacaagtgtctcctttgcattaaaactgaacaaac

SEQ ID NO: 50926 - DNA, 740 bp, Bovine  19866881187307
gttctgttcctataacctgccgagctctttccctcccccagaacatctgttcctcactgttcctgcagatcctccagtggctggctccattgtgtcaccattcaatgttaccccctctgacctcagtatctaaccacacctccctctgcctcatcagcctttgccaccgtcttcagagcattaacactctgcaatgaaattattatggctttatgtcattattctttgtcatctgcttagaatgtaaaactccctgggaactgagctttcgtctgacttgttcccagagagagctccaaacacctaaaacagggcctggcacatagtaggcactcaataaatactacccaatgcatgaataagcccttcatcacggcctccaagactctggctctgttccgagcgggactctcccacctgcgaactccagcctggctgttgtctgcgtagttctttctgcaattaatcatgttctttcgctggataccctttgtgttgtcattggaggctgcatctcattcatctctgtctagccccaggacctggtgcatagtaggtgctcaatcagaagttccctgtcattagctctccccccgcccgggggtgagtgatgggctggctcagcagcaaacctttctgagggcagaagcagagggagtgagcagctttacccctcccttgcagggtccctttttggcagagagaaggagcgcaaagaggagcaaattgagagggggagg

SEQ ID NO: 50927 - DNA, 1527 bp, Bovine  19866881729801
taagtctccaggcctagccagattctcaaggaagggaatcagcctccatatgtctcagtaggaaaaaaataggactgtagtcaatggaattctccaggccagaatactagagtggttagcctttcccttctccaggggatcttctcaactcagggatcgaacccaggtctcccacattgcaggcagattctttaccagctgatccaccagggaagcccaagaatactgaagtgggtagcctatcccttctccagaggatcttcccaacccaggaattgaactggggtctcctgcattgcaggcagattctttaccagctgagctaccagggaagccccaggaaaagtcacagtgcatctttaatgcaccacagtgtctatcacactctgagaagccatcacagtagtgagaagaccctgcatttacaagcacattagtgggacttctctggtggtccagcagttaagacactatgcacccactgcaaggggcacaggtttgatccctggttggggaactaagatggcatgggttccatccctggtcagggaactaagatccctcgtggcacacagtgtggccaaaaaataggaaacaaatgaactaaatagcacattagaggtggtatgctgcagtccatgggttcacagagagtcagacacgactgaatgactcaacaacaagaggtgggtttgaatcccagtgcctctgctcacaagctgcatggccttgagcaacctaaataattcctcgagggctcagtctcctgatctgtcaaaggctgttgttgtgatgactcatatgcaagattcaggcaacagcatttagtgagcacctactgtatgctagatggccagtgcctgcgcctttcgccttgctttcctcccccactctcctgccccagcatgcgcctaaggggactctagagatgcgggggaagggtaggagagagtccaacagcctctgaggtcacattagaagccgaccagcagcagcctggctcctgccagcctcctgatggtcctgtctgctcccgtgccaaggcccaaggtgagcccaggagcctcggccatctggtccagctgggccagcgagaggcagctttgccagctcaggggcggccctggctaacaatggtgttaatttttcatttgtttgtttgattttctgcagtgaatgaggaatgttgcaacaacatctggagccgcccccagcggaagcctgcagagtggcagtggcagcggtgacagctcagaacgcaggcctctcaccgtgtggacatccacgcatccaccagcacacacagactatgtgcacgtggtcatgtctacatgtccacacgtacacatgcacatgcgtgtggtgtttgtacaccacacaagcatgccctgtacgtgtgtgcttgtgtgtgcatgtgtgttcaaaatgtgtgcattcacacctatgacccatacacacatggccatgcctgtgtgcacagatgcacatgcttacatgtgtgttcagacgtgtgcattcacacctatg

SEQ ID NO: 50928 - DNA, 1007 bp, Bovine  19866881213132
tgtgaaacaaaaaaatatttatactaacagtaaatcttccttgaaaacctgattttgagagaataggtaccttcttggagtacatcttttagagttatcctctccctggatattgcgatatccttcaccttagctttcgcctccaaaagagtgacacttctcaggtcattcttctctatccgcaaggtaggataacctgaggagccaacaaagccaaaccaagaaatataaataccttcttatggcatcaggatcaactagttcagttagaaccccaggagtcaagtcacaggaacaaatgaaggtaagaatcaaaaaggaaaaaggcacatacagggagaattatttatgaaggccatactaaattttaaagaaacactttcccacctaccccaaaacctttaaatgcagaattaaaacaagaaatactaaaaataatattttattaataccacttcaattgcttttctgccaaatgaaacaagctttgactcatggaattaatctaatcccttgaatgaactgcttttttctccaaagattttctaatatagtctcctaacaaaaaaacttcaaatgaagagatgtttgtaaaaatagcttttcttaaaaaaaaaaaaaaaaaatatatatatatatatatatataattggtttaatcattctagcatccatacagccagccatatctttgtgagattcatattcgtttttcagttcccttgattcatattcattcttaatatgatgatagcaaaacaaaatttctggccataaattaaaattctcattgcaacaaaaaaaaagttagaataaaagggaagatctagtgttattagcaagcagaaattggaatggtattttaggggagaaaaatcccgaaagaaagggtggactcagacaatgattattggtggctgctggaagaactacatgaaaagctttgaaaaactttattataagaggatgcattaggatgacaaaacctgatcccactgatcagcaatt

SEQ ID NO: 50929 - DNA, 1827 bp, Bovine  19866880348966
atgtaaagggagaccctcctaatgagattctctcagaggatgattattccagtctattctcagagatttaaatgaacaagtgttatcgtttttaatggtgtctcagacatattctgttggtgcattgcttttctgtattcaactttcctatgaattgagctgtgaaccgaaatagagtttaaacctttaactgtatgcatttgtataattatctgaatgaaggcatgaaggttaaataaagcattttgtatggaacgaaactccctaattattactaaggctgattcagacactttggaaatcatagttattaccatactaattaaacctttgttatgaaaagttttaccatttgtgtatagtaatttaaaacagaacaagatagactgtatactaaaaggtgaatagaggacgttttatttcgtaacaaccaggacctaaagtgggattcctgaaagtattttaatgagtgtaaaactaaaaagtggtctagaaatatgaagtgatatgaaaacaagatatttttcagagcctaaaatcaaatctctgtgaatgaatgaattacattattttttggactttgtgtgtcgtttaagtgtagaatgatctatctagcacgtgacaaagctggttcatttctataaaatcttaaaacaattataaggtttggaaaaataagaccattaatgaatggaaaagtgaaagtattagtcactcagttgtgtcccaactctttgtgacttcatggactgcagcccaccatgctcctctgtccatggaatactccaagcaagaatactagagtgtggtagccactcccttctccagggaatctttccgacccagggatcaaaccctggtctcctggattgcaggcagattctttaccttctgagccaccaggaagccctttaatttaaataatgcttaaaaagcacttgaaaaatctaagtatcctgcagttgtgttcagtcaccaggctgtgtctgactcttcatgaccccacggactgcagcatgccaggcttccctgtccctcaccatctgggagtttgcccaagttcatgtccatcgaatcagtgatgccatccagccatctcctattagtatccttcacttgaagacctactagaaaaatccattcaacaataagaatggtaggaaatcctactaacaattatattaaatggtgatagatgataataaaaataatatttgagtacttcctagatgcccagcagtgttctaagtattatatttgttctctttattcttaccaaaatcctgagttaggttctgttattatcctaattttacagaggtaaaagtaaggtactgtgttaggcaacttttccagtcagcctggttctaacactagagagtccttagctactaaagggttacaggttaggaagatggagaaaaaatagaaggtggggagagagaatgagctgtgatgaatatcatagaaatattcaagaaatatatttgattatgtacaaataaatattaacaaacccaatgaatacaattctttatttcatacttggcaaaccataatgtggtttaataactcataaaaatcagagactgaagtagattttggcttactttattactgcttcaaatccttttgtaaatgaactttaagttcagtgaaatcactgggttccactcagagacactgtgcgaggagagccagtgggttacaatttcctcctccagggtatcttcctgtcccagggattgaacctgtctcctacattggcagacggattctgtaccactgagccaccagggaagcccatggattacaatatataaatat

SEQ ID NO: 50930 - DNA, 2437 bp, Bovine  19866880386398
aatgcaggagacctggatttgatccctgagttgggaagatcccctggagaagggaaaggctaccctacccattctggcctagaaaattccatggactgtatagtccgtggggtcacaaagagttggacacgactgaatgacttttactttcatataggtatcatatgggcttccctggtggctctgtgataaagattccacctgccaacacaggagatttgggtttgtttcctgggatgagaagatcccctggagaaggaactggcaaccgactccagtattcttgcgtggagaatcccatggacagagggaggctggtagactacagtccatggggttgcaaagagttgggcgcacctcagcatggttgatttacactcttgtgttagtttcaggggtacagcatagtggttcagttataagcatcttcattccttctcggattcttttcccatatagattattatgcagtgttgagtagagttccttgtgctatgcagtagatccttgtgggtaatccatttatatatatactgtatgtacgttaatcccaagctctgtatttatcctttcttctacatttcccctttggtaaccataagtttatttattttattttttttgaagtctgtgagcctgtttctgttttgtaaataacttcatttatataattcttgaaaatgttattacttgttttaaggtatttaacgactcgagacttcactcactagcattcctgaaagtgtgtatctgacacttacactgctgtcctgcaacagaatagaatgtccctttactacctccatgtcagcatttctagtatcattttaaaaatctttgtttttttttaaagctctgtcccagccaggaggagtgctgagcttagatttccccagtcgctgtcaatcacactggttagcaggagtctcgtctgctggcaagttttctttttcagtcagatcggtctttctccattctgtcttcctgttctgcctttgtcttccctgaagcgctagtctgccccttctccccttttgctcagatgctcatttgatggatgaaatcaacaggggcttgatgtgtatagttaattctccacataaacctattaattatgtacgcttctgtgtgcctcgtggcagtcacagcttaatgagggaccacttcagaaaacctctggacagtctcaccccgttatagtcttagaaagacctgcgtgtatctatattccatttaccaggaagccaaaatacgaagctagaaaagttcgtccgcacaagggccttctgctgatttgtaggggagcatttaaacactattgcttctgccacttgcctggtgttgctgcctctgacctcagggttgggtgggaaaaaatggatttctctcagctttgccgttagtcttgtttggcttgtttgtgggtctctctttaaaggcattttctatgagcagggaagcatgtcaggcttctcttgactgcttgcttgctttaaatatccaaaaaataaagcctacatttttgcaaatataccaccctttacataaaaagtgtgttattgctgtatggatttgtaatgtgttgtggtttccagttgtagcattaggtgtatctgcctctctcaggtcattttctagtctgaaatttgatgttttccagtactatgaaatagccttacaaaaataactcttgtggcgaatgttttgtgaaatcaaaagcaaggtccatctggtagcagacaagattaatctgtttgagaatggtaaacattttgcatattttaaaatatgtaactagcacagaacatttgcctcaggcacttgaataagtctgtggtttagagtgaagattcaaatgaacgttttattcctaaaagtctataaggtatgctttcttgtcttgtatggtaaaacttcaatatattaaatcagtcactgaataataatgctcttttaaaaacaaaagaacaaaaaaagtaacccgtgatatagtaaagataagcctataacagttaacccttttttaaaacattgcaaatagtataataattttggtttattaattttacaaagaattataaataaaataatagataaaattgaatcttatattgaattcaaattaattttaaagaagtagtgggctttacttttttagtagagattagttactttcagaataatttggcagaatgtacttgagaattccatatactcaccccactctttaacagtttcccctacatagagtcttgcattagtgtaatatatttgttggatgtaatgatttaatgaacctatattgattcattattaagtatagtccatgctttacatcagagaaggcaatggcaagccactccagtactcttgcctagaaaatcccatggatggaggagcctggtaggctgcagtccatggggtcgctacaagtcgg

SEQ ID NO: 50931 - DNA, 2261 bp, Bovine  19866880434272
ctgaactgaattgactgatacctgcttaaaaaaatttagaggattctcactgcctttaggataaatcttcagttcctagagctggtccttaaactcctgttaaacctctacttatatcattgagtttggagtagtcacgggtacaactctagggggcgctgttcacaggttatcgttgtgcctgatgctccttctgcctgaaatgcctttccccgggctttcccgtcttttaatacacaacctttcttgagtttctctaaatacttcccttcgctgaaaacagagttcttcctgtgtcacctctacccctgtatggatttctttcatatgtacttagtcgatcagtcgtgtcctactctttgcgacgctatggactacagcctaccaggctcctctgtgcatggggattctccaggcaagaatattggagtgggttgccatgcccctcctccaaggatctttccaatccagggatcaaacccaggtctcccacattgcaggcaaattctttaccatctgggccaccagggaagcccttctttcatatagtctacaacaattcagtaattcctatttttctacataacttctctactgtctgagcctctgtcccctggtaaagagtaagccccttgaaaacagaggctgttttatttgttttcacattctgagcacttagaacattgcctgatgcatagaggtaattaatatttggtatgagtacaagtgaatgaatgcatgcaatacaattaactttgcattggcgtggaaattctaatttacctctttaaattttctccatgtgtatttggagtgtttctttctataatagctttggtcccattctaacatcctaacctgtcccttctgattgttttctagttccattgcctggtaactgctgtctctagcaggacgtggctttctcctggagcaaatattatctgccactgaacactgttttctctactggatcatgtgttctttccttgtggagacaaccaagagtttactatggctgtagtgcaattggcaactgtcagaatcaaaactcattaataaaaaaatgataatgcttcaaagtacattacattactccttcaaaggcctttgtgaacattatcttattaatcatcacaatagctcaggggaagataaacattgttggttatcttacctagatcatatttggaagaactttttttcttgttattgtttgattatgctatgaaatctggagagcaattatcatattggctatttggatataatttgatatgctgatgtaaaaatttctctggatcagtaaggtggtttttatttcttttagatatctcacccggactcttgtcaaattctttccagagagtgaagcaaagaataacaagcaaaagactctgaaatttctgttcaaggattgaaattgagcttgaggctcaataaaccattgattcatgatctggaaatcaaaaaatgaattactgcactcatgtaggtgttgaataattattgaaagactgaatgatgtactgatttataatctgagagtttaaaggagtgagcttatgtaggaaattagaatcttagtcaggaattctattagtaactgatatcaatgggtaaaagagaattcttttaggaaaggaattagaaaactggtttaaaaaattactcagcagttctgtccccacctcacctccaacatcttagttttacttttctcataacacttgacccttgtttaagtgtatttgttgacaactttactttcccttctggagcagggtaaagtgttgggtgctgtcacatcattggggctgttgaattgaaaaatattacctagagaaatctttcataaaaaaaattgaaaggaagatggcttcaatttcagaactataagaagagattgtctaattctagggccctatattcaaatgcaatggcagatgttctcagcgagccttgtatgaagaatttgacatcttttaatgtctcagcaacaaactgtacagcctctggaagaaatgtcacagatgacattggcactttctacattctaagatggtgtcttccgtcatgggagtgtccagggtggaatgatcattggtgcaactatacttctgttatctttggtcacgtgtgctggaggaggactttatgaagtttacctcaaatttctttccagtccaggcaaacatttctgactttttagactctgtcaactctctatgtccaattcataagcatagatagacttaaaa

SEQ ID NO: 50932 - DNA, 1960 bp, Bovine  19866880449186
ttcacaggcttgaaaccattgatctttttactcttttttttttttttttgaaagagaaggtaaaaaattttattactgattttagaaatcattcctggaaggttgaccttaagactgcagatgttagatgttataaacgagctctgtaagatcacttaaaaagcggtcgtgttggaaggtccctggcagtccagtgcttaggacttggcactttcactgccatgggcccaggttggggaactaagatcccacaagctgtgctgtgctgctgctgctgctaagtcgcttcagtcgtgtccggctctgtgagaccccatagacggcagcccaccaggctcccccgtccctgggattctccaggcaagaacactggagtgggttgccatttccttctccggtgcatgaaagtgaaaagtgaaagtgaagtcgctcagtcgtgtctgagcctcagcgaccccatggactgcagccttccaggctccactgtccataggattttccaggcaagagtactggagtggggtgccagtgccttctgcagatctttttactcgtattgcaaaattgtacatgaggaaaagttaaggcagctcagttgcccatggtgttcttattctattaataagactgttggctcttgtgggcgtggtcatcatctattcgcctatctcattaacaagtcaacatacttgcatatctggatgagtagggaaggtagcataagaagctaatgcttacagaggattcagggtattcacagagtatctgcgctacatattttattttatttgaagtttcctggcttacctctttcagtattttgcaacttgcctcccacttcttacacaactttataatttttcctaaacatttaaaatcattttttaacacaatagaatttgtcagttttgagtttactatggtttactcactttttttttttttttttacttcaaaaaatgctcaatcaaattttagcagatcacattgtgagtgagttctctgacaatcgatatttttaaaaaatagaaatgatttgatgaattcttatataatgacactgtagattgttggcttaaaatttttttaatgtggacatttgacttgtttaaaagtggaatacttatataatcatggcacactaattatattaggatatttcttcatattctaaagtctatgccatggaaatatatttgtcatttgaaggatgtttgagatacttattactgtagacacatttttaattggaaagcataaaactacttgttaaaactgaattcttacaaaattcaagttaatatttaacacatgaaacaaagtaagaaataaagaaactcttaatgctgaagtttcaccattaaaaagtgctttaaagttttctgaacttaatttgaacctttattttcatttaggtgccattaaagaatctgaaaggggagtgcaagaaagattgtttgaaatttgcctctaaaacaacttaaccactttaaccctttgaatggatgccccagacagagctaggaaacaataaactcaagagagagagttcaatttagttcagtcgctgagtcttttccgactctttgtaaccccatggactacagcacgccaggctttccctgtccatcaccaactccttgagctcactcaaactcatgtccatccagttggtgatgccatccaaccatttcatcctctgtcatccccttctcctcctgctttcaatctttcccaccatcagggtcttttccaatgagtcagttcttcacatcaggtggccaagagagagttaggaaagataattatttctggaacccctgcccctctggcatttcttcttttcctgcctcatgagagagggcccattttcgttggctcagtggtaaagaacacatttgcaatgcaggagacaggagtttgctctctgggcgtggaagattcccttgaaggaggaaat

SEQ ID NO: 50933 - DNA, 842 bp, Bovine  19866880499477
tgccttgagttttctgcttctgttcaaagcaagatgaactaggaagaatattcagactcacatttgcagcaatattagtgctttccaccctcaagagaagggacagaaagactttctagcaaaatgctgctttctctctctttctcattcttcttttaaaagtacactctgaatatccatgccgtttattaatattactactattattatgtgagaaatgaattacactcagtcactaaaaagacccaatgatgtgcttaggtggtaaggtaaatttcattacattttatggtacattatcaaagcccctaaactccaaagcataaagtttgacatcgttagtgatttcaaagggttagcaggtttaaacagattcggggatatgttttaatgacaaaccatgatttatgtacatccaaataaacattagagaaagaaatggcaatccactccagtattgttgcctggagaatcccatggacagaggagcctggtgggctacagtccatgggattgcaaaaactcagacatgactgagtgcacagccacaggtaaatatcctccactaacctgtgtcaaaacaagctgtcatactttacttgattctttaagcaaatcgcattaaacttaaagactgcctcccacggaataagctgaaacacctgttttcttaagcagcatgtcctcggtgagacattacaagtaaggaaataggacatgagaacattttataatttgtgccaaggtaaaaccagaaactacctcctaaattaagacaaatgaaaacaaatatgtgacatgtttgtctactaataaatgtatgttgttaatttaaatgattt

SEQ ID NO: 50934 - DNA, 2396 bp, Bovine  19866880540947
ccttctgaggtattcgaactattctatattttgatttacacaaagatcacatgaatgtgttcatcactaagctgtacatttagatctgtacccttaacaatgtacatgtcacatctcaataataaaacatgacctagaaacttaaaagacagtaatggaaatatttttttaaattagttaataaaaatgactaatgtaagtgtacactgcttatcattattactagagttaagaaataagaaccaaaatgatttataatatattatctttgccacacatgctataaagattcacttgatacgagtgaccgctaagccatggtgaggtcacatgttcaacacatgtgcctgactctgcctgacatttaatcgagtctggcacatgtgtgctttagtaatgtactcagctgtgcaattttatgtgagtggacatctgtagagatgaatttgaaaagaatttgtgcaaagtgacaacctttataaccaatgatatataataaaaagagtcataacaagaagcagcaacaactaacatttattaaggctttattacattataagcactgtgccaactttctgccttcaccacctcaagaactgcattttcaggagtttttaaacataggaacagagatggcagaagatctgttttgcaatcagcccttaaaataatagtcatacaaattaatgcaattataagcttcaaatttgtagaaaagaaagctggttagcaactctctcttatgtgatgatgttataattgcaatttcaaaaataactgaatttcattaaaatgaacctaagacatttaaaatctagcattctatagatacatcttgaaaggcatcatcaaaggaacttttctgacaccaaatgctgatcttctcattctaagagtttatagctcacaaactcctttccttatcccacagaagcaatgaataagtttgaagacatgatgtgaatgaatttcctggctcattcctttcctaaacaactactgtcttcatgattaatatttttcatatgtaaagcaggttcttgatactttttattgttctcgtataaatcatctattatcattacatcaaatcttatttaagtttcaattctaaaactctaaattccaaactcttcattaaattcaagttaattgattattaatgaaaaaatatataaatgggaatcaaactgtgctaaaccacacgctctacaacttagggtgaagttatgattcctgacacagttatcatacatcgtagcagttgagtacaaacgtaaacttggaaccccgtaattaagtggttaccaggggttatatttaccagggagggctcaaatttttcaacaatgttaataatcattgactcagtacttaagagacctgaataggaattgagagataatttagttcaaaccccttgttttctgattagaaaaaaaaagaaaaccccacagaggttaggttgggttaggttagggtctggattcactttttgacatttgcggagctgaaccagcttctcaaaccacctttaaagatgtgattgtctgcaacacactgcaatagcatttaaaaaaaatgcaagcacatagttatacacacacgtaggaatatattatagtaaggaaactgtgtatatggagtcctcgttctatatatatcccagttgaaacaccggcccaccctgtttgttgtctgataatgttcaatgtatttaaatgtaacttcaaaaataccttccaattcccctttgtcctgatgaagcaattccaaaagctttagctctcaaaagctgtcagagtatcactctgacctttgcactatcttcaattccccatagctttctttaaaggatgttgtaagcagagtgcaaggatcatgaaggaatccttagattaacctgtcccaggcaggctttactttctttttaaccagctcacaaaattaagaaaccactagaccagcaagtttattagattattaacttactctgtgccctcaactgcataatatgcatctttggactttctgccttccacccagagccaagttattactactctgcaatggcaccccactgcagtactgctgcctggaaaatcccatggacagaggagcctggtaggctgcagtccatggggtcgctgagggtcggacatgactgagcgacttcactttcacttttcactttcatgcattggagaaggaaatggcaacccattccagtgttcttgcctggagaatcccagggatggggtcgcacagagtcggacacgactgaagtgactcagcagcagcagcagctctatctctttaaactaatttcaaaaggaacaaccgggtttttaaaaacaatccggtttggtaaaaaggaaatactacacgttttccct

SEQ ID NO: 50935 - DNA, 1768 bp, Bovine  19866880595075
tgctgaagagactgccttttcttggagttatattttatgcaataaaaattaaaatgttataaatggccacaagtatatgtctatgtatggaatccaaatatgcattaacaacacaaagagctttccaaagaatcctttattttggtgactgcaaagaatatgaatttctccttttcattcttctcctctccttcctcttccaattctgcttctttgtatttgtcttcatcttcatctatcttcatcttcttctttaatctttccatgaaagagtggaggaatattgccctagttgcagaggttgatgtgatcacatggaaaggaatagacagtgaaaccagagatccttcaactgccctaagattcccacactttgctttatcatcattcatattcacaatgtatctttcttctaaagatctcaaaggctctgaaactcatattattatcataaggctgtgactcaaatacacacaaatttaaattttaaaagaggatgattaatttcagagaggcctggctcacttggtgctgacttgcttctttttcctgtggtgagcctgagttttctgaatcagctattgtgtccctctgcagtagatgggtaacccagtacctgtctttgctaagtcagagtatgctgcatgctcacgttccctttgcctgagtgactacatgaggctctgtcacgtatactttttattcatgcaatgtatcaggtaacaagcagaagcaaaggttaattttcagggaatgcaagccggactagtcactcaaaggaaatggtttgtgataaagagtcatctgtagccaaaggctttttattcccgtccccagcttgtttcatgtttaaatattgcttatatggaaaaatccagtgatattttgagtgtgtatgcattattttttaagtcgaggtgattctaatatgatcagcagaaatcatgaatgactaattttgggttctgcttgttacgaaaacatctgtgagatttctttttctgataagtacagttgattgtgggtattccataagattctgctttttacattttaatacccttggtagatatttattcagtcctgattgtgtgcaaagctctgtactagatactgaggaaggaggttattagaataaaagaggaaagagatatcaaaatgattataacagaggttcagccctcaaaggactggaggaggaaacatcacataaatttcaagggtggaaagtgattggtcccttatgtgggctaaatatgataggaaatctcattttcaaactgagaccctaaggttggaattgtggctgctagttcctctagtcctagcaatatcttttcagatttaattacaaacattcatgcaaacatcatacttaattaatccacccatgctggattgatattatccaaaataactggaatttatggaaaatatgaagaagagggggaagcaatttctataacaacttaaagctattttgttttttaggattagtactaacttaatgtactttctattctgaacaatatcttcctagctcctcttttctctgttagccccttccttagcacagagtcagccatgactgaagtgacttaagcagtagcagcagcagtcataaagctactaagtaactccttaaaaaaattatcttgaatcagaggaagaaataataaaagagtggtgttaaagtattttcaccatgaaggataagggggaaaggggaagaatttttctaagaggacattaaatatattttcttaga

SEQ ID NO: 50936 - DNA, 1982 bp, Bovine  19866880617591
ctacctcctgcattaggaggcagattctttaccactgcaccaacttgggtgggcatgtacacatcgctgcatttaaaatggataaccaaaaaggacctatagtgtagcacataaaattcttctcaacgttatgtggtagcctggatgggaggggagtttgggggagaatggatacatgtatatgcatatctgaataaaataaaatataaataaaaagttaaaaaaattttggatcctcatttacttttatcctgatcatggaaacttgctttttcaggatgagtccatctcacctcctcagtcctggtttattacacccatgtggggagagaactcggcttctctttgctatgtattcctggtcccgagccctggcctgggttcctctgatcctctctatccttcagggacccaaccctgggctcagacatccactgtcagcactgttcatatgagtcctctcacagctcattctcctccagccagagcttctgtctcattcaacctcttgtacctacagtgtctaggataacaagtacagcagtaaattagtaatatcaacaagtcaattttaaagaagcactgactttttaaagtggtggataaaacaaataggaggggctacagcctaaggcaggggggaggatatctagtcttatctgtcaactcctttaatcttcctgagaacgactgatgtatcataaatgtatattttaatttgtctttccatagcaaccgtctcttatttggcatcttcccaccatgacacattttgcctggagattttggtaaaattatccaacagaggaggactcaactcaatttcccctttcttaattctctttcttactacttctattagagcttctccctggccaaagtgttcgtatgctttgcctactcttctggcattcaaagtaggcctgggaaaccctgggagacaggagttgagattcttttggggagtccatgaggtcaaaattatttccatcatattaagatgatttttctcttacatgtgtgcttttataagtgcacacatttatatcagtagaaacctctgatagtaagaaccagttatccaggttcaattaatggaagttgccaggcaaagtgctacataatttcatacatacaaatgtttaattgttactgcaatcctaggagtgagatactgtgtcagctctgccaatgagtacattgagtttcagagaggtgaatttgcacatctacagcctgcacagccctatactccccacagccagaatttgaatctagatttatctccagtggatggacctctgcaactctaacattttgcctgaataattctattattctccttttaagaaacagctaggggcttccttggtggctcattggtaaaaaatctacctgccagtgcaggagacgtgggttcaattcctgatccaggaagatcccacaagccacggagaggcaactgagcccgtgcaccacaattactgactctgtgctctaaaacccgagagctgcaactgctgagcccatgtgccacaactgctgaagcctgcatgccctagagcccgtgctctgcaacaaggaagccccggcactataactagtgagcagctccaacttgccacaactagagaaaagcccacccagcacagccaaaaaataaattaattacaaaaagtaggcagggctgtgttccaataaaagttgaaaagtaaaaaaagaagagagaaagggctagcacttacacaaacaactttctctgtagattgtgtgataatgagatttgcatctttccggatagataattgaacatgatgctgtatatgactgtctgtagatgtgataattttccactaattctcatgtgaaccatcaattagaatactatcttcttttgatcagaaggatttttttttgaaagtcaggatcttcaagactgagtgttctcaaaaatatgagctctcttctgtgatgcagcttat

SEQ ID NO: 50937 - DNA, 781 bp, Bovine  19866880686328
aatccgtggggttgcaaagagtcagacacgactgagcaactgaactgaactgtgggagtaataatccactagagaaagaatctgtcatttagaactaacagtaatcctctgactagttcttagtcctctctccttttcattccatactctcttggagtgcatatgctctcaaaattttaattgatgccctcttgtggctatgagaattcccaagtgcataactgacctattatctttcttctggctttttattattgtttcatttcaggaaagcttaattataatgttctgacataattggaaactgtattcttcatgtaggcctcccacacaaattcccctgccttgttttcccctcaattgttaatgaccctgtagccggactggacccagataggctaagttgactgaatcactgatctcagatgcaaaaatttaaggggacatcccagaaataaattcacacacttacgatcaattaatctatgacaaaggaggtaagaatgtacaatagagaaaaagacggtctcttccataagccatgctgggaaactggacagctacttgcaaaagaaagaaattacaacattctttaacactgtatacaaaaataaactcaaaacgggttaaagacctaaatgtaagaccagaaaccatgacacttctagagggaaatataggtagaataatctttgacataaatcatagcaatatttttttggatcagtcttctaaagcaaaggagataaaagcaaaaataaacaaatggtacatacttaaa

SEQ ID NO: 50938 - DNA, 1429 bp, Bovine  19866880689015
atgggtaacgtttgcctcacaggaatacggaaggcttaaacgagatcaccccctttcagacacgtagcacaatacttggtacatagtaagttctcaacgagtgcaagctaagagcaaagcgggaatttccaaagtccatatagacttgtgggtagagtgtggtgccatcttggctgacaaaactatttttcaaatataagcctggtctcctccgaatctttgcattttatattgaactactgattatccaggagcaaaaacagaaactgtttccacatccaccctgccgtcctcacaaacctttgctctcatggatattagtttcacttctttctccagaacaatagctgcatcgcgaagtgatgaaaacttcccaaacacggcctgaaggaacagaaggatgggaaggcttacttgtgggtgactggcccacaagcaacagattatgattctaactcaaagtcccagagatgcagaccttcacagcagacaccagcctacgtaggagggtgggatcacaatgtccctggaaggtgagctgcagagcccacagctgtgaaatacagctctttgtgtgctgaacggtgaaccagggcacactgagacaagaaatgtttatgtacaggtgtcaataaagtgaaagcataagctctatggacagaattgggctggtcaagggcagctaattcctgcaaataccttgttactcattgaatgtaaatgatctacttctgcattttatcatgtttacacagtgatattttgtgggacctgcttccaggtttatgtgtatctttaatctgggaaagtccagggcttattcactctaatgttgaataaaaggtcactggcaaaaatcaggaaccaatctaaaacaagagcgggatggcgagttttgccaagtgtgtacatatcaacttatttcaatattttcttaaaaatccattgtcctgaaacaaggcatggcttctcatattgcaaatgaaaagtcaaacatttcagtgaaggcaagcaacaacacggacaaaaacaaaacctcaaacgatgccctctgtttccatcagagccacaaagatatatttttatgtggatgtggtgggtaaaagagaataagtacagtcacgtgaaaaatcagcagagctccacacttcagatgttgtattttatttacgtgatctagcatccctgagaagttgtgaccgtgtgttatacccattttacagataaagattctgaagatcagcaggcctgatgtatctgcctaagacactcatgactggtaagccacagggctggtccccaaggctgacttattcagcctagtcaaatcttgagctttcctctctaacatgattctttacattttgttttcttcagaaaaaaatgttatgggtacgtatgtgtgtgtgttttctttcttcactgtaca

SEQ ID NO: 50939 - DNA, 1444 bp, Bovine  19866880704837
acaaagcttattcagctgtaaaaatgaatttatgtcttgattcagttgacttttgtatctttctcagtaaaagggaaaagagaaagtgctgggaaataacagttattgacacaagggcatcagttaacgagtcctgaaaagaaagcgtagcctgacattttttttgtggagggaggtaagggggtctcctggcttcttcgattatttctggactgttccacaaagaccctccacatgtttgtttccacagaaatatcgacaaacactagagactcctcaagcagagtgaattccctcagtgaaatatatgtcctctgccaagaatcaaaggtcatcccagtggagtgccgtcttcgtgctcagccactacggagtgtctggaacagagtgagaacaaaaattaccctatttcggtgccccctgaactctttcgggaagtatcccaacaaaacagtcactgggaattcagatagcacatttggagactgggaaagggccaggccaaacagaggagaatgtgacttagagacaataaggtaaaggaaataaatgactcaaagaagagttttaagccaatatttacacccgtattgccatatttacagcttaaacactatgccctgaccaggcaggaagtacacttttatgagtcccttaatgaatgttaaatcaataatatcccaaacaatgggccccagtgaattttcttatgaaggccatagagggagttattcaaatggagtcagagtcatttgcactctgtaatgcacatttttttaggagacagattttcaaattagcaacttttaatacaatcgaaagccttttctacatgtttattgttaaagggaatcatgtcatagaagacaggtataatgcccaactaaaaacgtctatacagcagattttattgtcagcagaggcaatggtcaaagaacatttgccttcatcatgaccacaataagagaataattacacatgcagaaaaaactaattaaatggctaatgagcaaaccaatatgttcgactgtaacatccacggcagccaggcaactgagcatatggaatagattttatcagttggttggtgccatgtaatcagtaactgctttttttggaccttggtgacacccgacccatattggctgattggcaggtccagataaatgatcaataagacaaaagtactctgatttcataaaacacaagcccagcaaaaatgccactgacctcttttgatgttactgagatgctcaggaagcacttttgaaattttatttatttttttgggtggcccattgttcaatgttctctggttgcatttacaagtgtaataggaaatgacagtcctgccagtctttcttaaaatgtcaaagacagcatcatgtaaaacaaaactcaaagacatcccccatttgtgcatatcatgccaaataagctgcat

SEQ ID NO: 50940 - DNA, 1430 bp, Bovine  19866880745805
actaaccttttggtattctattattttaagtgtcttgtctatttcttaaaaaatatttaaggttattatttatcttacatcaaaagatctcatgaaaaaagtatgaaagccatatatgttgtcaaatataatagaactgaaaataagtaaaagtgaaaatatcagatcagcttttacaaaaattatttaacatgcattatttcaaaaagttttcctccactgttgcattaaattttattcctttttttcccttctagtgtttcaaagatggttgttctatttctattatttctatttttatggttgtgtgtgttagtcactcagttgtgcccagctctttgggaccccatggactgtagcccaccaggctcctctgtccatggagttccctaggcaacaatactggagtgggttgctattggttaggatcagcttaagggaatatatatatacttgtatataagttatgtatatataaacctatctatcaacagcagtctatcaataagaatgaagccatataaattcttggctaaatgagaaatttaatacattttccagttctcagaaattgatggaataattgctgaagttttagttccagattgttaatttttttattgtgtactttcaatttcaagacacccccctgcccgcacaaccccccacccacgtttaaacaagaattctccagtattcctgcctggagaattccatggagagaggaggctgacaggccagagtccatgggatctcagtcagacacgactgaatgactcacagaaattctgtgtgtcacagaaataacattcacatgtttaggacatgacagtaagtattcctggatttatacctggagcagggatttgcaccggatttgcctttctgtttccccccaccaccacctccagctcccctgtctgtttgattttgttctccacacagattaaaatgcacacatatgcacacatgtgtgtatgcccacacactcccctgctcaaccaaagggacatggtagggtcaataaaatgatgtaaagactagcctcctgaaatctacatcagactagggcaatcaaccacttaacaagaattagattgatttcctgagctaaatcagtcatggtctctgccctcaggagtacacagcattgtgggggtgatcagatgagcccagtggaaatatcacctggaagaaagacaaggagatgtagaaacgctgagttcaggtccctgttccaccactggttgccacatgaactgcaataagtcccttaatttctcagtcttatttctgatttcttctaataaaaacagctttaaattaaaaaaaaatttaattaagagccacatagtttgtcagcaagaaagaaaaggataaaaaacaatgaagagtctgctctcaaggtctatacccactagggaggccag

SEQ ID NO: 50941 - DNA, 1089 bp, Bovine  19866880764270
atatattcttttttggaggatatttgttttgcaatactgagttggtttctgcctatttgcagggcagcattggctgacttcttaattgatgtgataactaattgtactgcagaaatagtagattttttaagagagtggaacagaggttacattagttttgattgggaggtatggataatgttttgacaaatggaacataacaagatagacttttgagcatcagccgaaaccaaatggccaggtccctgtgatttaggttttatagaatgaagagacatagaaccttgtagagagaggcacattagagttaaatgacctcacaattgtgtctgggtgcatcctatttgctgactaatcattattaagctggatatatctattaataggcttttatggctccagtaaagactatctcattaggtagcccaacgccaagagataattgtgaaggaggccttctgtgaagacagcctacaaaaggtgactgaggggtcatcaccactgagatcagttactggaatttttcttaggaaatttctttggatatgagcaggttgtagccttcggaagcaccagtgatatccatctctgaccagtgagccatctacctgaggctcactgtcaggtccaaccccagaggaagataaaggagacagcatgagtcactctgtccaaatgagttcattcatcagctctcctatcataattggactcacattctcctagctagagatgctggtatgtgaacacctaaggggcttaatgtctcctttggaatgaacacatggggctaatcagagaagacgttcttctgaagatacctccaggagcttttccacagtatatcaatactatgaccaacactacaatgaatcacgttagttaatgcattttaaaaggactagggagctttgtcttaaagggatgagatgcaagactggcaggtttgaacatgttgatgacaggctagaccaaataaaatacatcacaactttaaaattctcttgaccaaatcttactcagacatcttcaagttagctccctctgttttatacattacttggaactctgtattttccttcatttagt

SEQ ID NO: 50942 - DNA, 3697 bp, Bovine  19866880788715
ttggagtgaatattaacacagttgtttctccccaaatgtccactgaagtaaaactgacatgtagtaagcctagccttgaccgaggtttacagttagtcctggaaatgaccagatttacattcagaacatcacaatgtgttcctaccattattttactgctaaatgtaaagtcgtgaataggactatacagcatattatatgaagagacaagagccctggaaattctccagtcccatcatttcagagcacaaatccatccaaacaagctatcaaggggtatcagtaaaattatactctttcagagccaaacatttggtaagagcaatttttaaagtataactgtgattaaacactcaggctttagacagtgaagactaccatgatggacagtgttctccggaaccagaccacaggattattaaaccatctcctgtttccccctctacgtttcagaacaaaaaacaaagaagtatgctagatgagggtataaagtaatgatcaaagtgtcagagtaacactgctgcgttccttaatcgtactgaaggcaagttttttgactgggctgttttctgcaagttgtctgaaagtactaaaagaacttgaaaggtcagaagttcagcaaaccatgaaaatactagctgttctttagtaaatccttactatatgccaagcagtatactgggtaatttttagacatagcacctctcctgtacaacagttctagatttcatggatgggaaaccaaggcacagagagggtggctgagttgtctgcaaacagaaatcagagtaggagtggaagtttacctctctcaggctccaaagcctgtattctccctgaggcactgctgcacctgtgttcccaagaaccagctttccatatctaacccttaagtagttttattagggatgtgtagtcatcagattttccaaataggatataaggacatgatttgacagtggtacataacatttaaaatcagtcttctgaaaattcacacatggagaatcattataaacaaacaccaactggctatctccctggacttctcacctgcctctgaaatgttcaacctggagatccagaatcatttaaacacttggtggctcagacggtaaggcgtctgcctacaatgcaggagacctgggttcgatccctgggtcgggaagattccctggagaaggaaacggcaacccactccagtactcttgcctagaaaatcccatggatggaggagcttggtgcaggctactgtccatggggtcgcaaagagtcgggtatgactgagcgacttcacttcacttcactacctgatggcattttagagcagattttcttgattctacgtgtttctttataggtggaataaagggttttccacttgtgtagaccttccagagtgtgtttaatttgcagttgaaagttacctccatgggactagttgttgataacaagagttgacttttggcggttgtaaatgggctggcatcttcattcagatgatgagcgagaagggaggacggaaaattccttttcatatttctcacctaacagtaccaccttgtaatgttttcagtagtcttacaaataatttgcctgtagtattattgttagtttaattgaattttatctaggaagctgtccaacatcagagaaatgaccccccaccctccttttctgtgtagagcacattctcttgacagtattgattcatggaagtactaatgggcttagaaaacatttggagaatgtcatttctcatgatgtttctttttctgaaaatgaatctcctgaattacaatctttctccctgttatttggctgagggaagagataaaacttgtgtaaacaaatttcctcccatgctgaaagcaagtgtttcgtgtacacacaacccattgcagaaaagggctctttcagttaattgggtttcaaaacaagcaataatttctccacagcaaaaccacaacattaagcgagttgaaaagagatgaatagtggaaatagtcacatcggtactttatctttctggattatatctctagaaattttaaatgtttgaggcaacaaagtctgccctttgtgcaaagcaagaaccaatgactcctgtgtgaattagtatatcttgctttttccaaatgcaggttgaagacgaaggtagaatttggatcaaattctagtcaaagtgctcaagtaatcaaaaagtaggatattgtagggacataccaacatcttccctttttgctaatgtcatgctcctaaaatatagcataaaacattttagaaaatgatgttgccctacttgtgtttctggttatcccgtagcagaattttgtatttacatccagactacaggatgtattttgtccctcagaacttgagtatattggacgggtatagttgaactggggcactggtgcctatattcaaggctctttcctatcaacttgtctgtctacactttgttgtgtttaaaaattcattaaaaaaacaaaaaaccaccatcccaaccccgccctatggaatggtggccgtattgttttgttcatgtctgtgtgggacacgttgcatcacatggcaaaccaactccccgtggatgtgagataactacttacaaaaccagcttgaaaacatcgtcttctgtattatgtcatcctgtatcataatgcaattatgtgtatcataacgtgctcattttaaaaaagagaaaccagcaaattcatgtttgtccatagaagaatgtattcagaactttctgtgttgtgaaatgatgagaacagaccacgtttaagatatacccacctgccacttaaaatgacttagttataattagtagtagtctagacgttgctctcagtgtgtgggggtcagttcaaacgtcatcctcttttgaataaatctctcggtggtatttgaaaaaatacatgggaataaagaaaaatatcatctttggccaaatcaagcaggcatctttttcctttccttgacacttagctcattctacttgctgattggattacaagagctgtgtaaaaaatacaaaaacatcctttcgtttacaaaacagttattctaggcttgaagcctctgaacagcaaatcaaatagatgtgctgcgtctgattcacttatgtaattttacaaaaggctcctgggtctctgaccccagagagttagaatacccagaggaggtcctctgcattaaaggattaaaacccccaaggatgctggcaagcaactgtattaatttcttaaatcttcatttggttttctgttcagagttttaattgcaaatgaatttatttctccagcttatctaaagatctaatttcccaatagtttcctctgcatttatatactctgtagtgtttaggcaacccctgttataagtttattaatattatgtaagtgttgttcttgtatttatgtatagtgtatgtattgtaaatatactcagagcttttttccttttactgtaaaatggtgatcttttttttttttcttgccctacaataatgtaaagggagaccctcctaatgagattctctcagaggatgattattccagtctattctcagagatttaaatgaacaagtgttatcgtttttaatggtgtctcagacatattctgttggtgcattgcttttctgtattcaactttcctatgaattgagctggaaccgaaatagagtttaaac

SEQ ID NO: 50943 - DNA, 1138 bp, Bovine  19866880884890
tcatgtagttagagttcttatcttcatataagtctaagttattattttaaataggaggaagcttctatgaaagaaataattcaaaatgcagtattagtatttccttctggggattagaagcagaaagatgttttgttacatgctgctgctaagttgcttcagttgtgtccaactctgtgtgaccccatagacagcagcctaccaggctcccccgtccctgggattctccaggcaagagcactggagtgggctgccatttccttctccagtgcatgaaagtgaaaagtgaaagtgaagtctctcagtcgtgtccagctcttcgctaccccatggactgcagcctaccaggctcctccgtccatgggattttccaggcaaaagtactggagtgggtgccattgccttctcctttgttacatgagtttatataataatatcaagttaattatatatgatagctgctcatgaagttatttttcttcttctaagttattttttttctatttttaagtcaaaggaattgtaataacataatgttgttgatttttccctttctgtagatctaaaaaaaaaaccccaccattctatagaaatgtaaaatgtctataatcatcaactcatatgcatgtgtttcatcttcagagtctagaaataatgatggattaagacttaggctgtagtacattttgctttgaataccatgttactgccaagctcataattaaaatatgatggatgaacacataaaacactgcctttgtgtaaaatgctagtaaacatagtggttttggttcttgtaacaggtaggattcagtgcataggaataatatttgatcatgaacttggagaatttttgcaaacatacaaaattgtgcatgcatcttttgcaagttactgttttatctccaatgagtttcttcatagcacatgacaaattgcaccttttcaattttaccaagtgaaaaatctcatggcttacaacagtcaaagatttagactgcaaacttgagatccaggtactatgcttacctaacaaccattttttatttttggtgctattatggacaatggccagtaactagtctcaccactctctttgtaaactagaaaaaaaaagaagggagtatctacaggattt

SEQ ID NO: 50944 - DNA, 886 bp, Bovine  19866880923848
cctccccttggcacatgcagggcagatttcccctagtaaaaaccctggggctaaggttacatcaagtccttggccagggaagtgggagtgggattcagctgtcacgctccctccaagcattcctaaaggcatattttccacaccaagggggattcttctggaggagcctggtgccagctgttaggataataagaatttctccaatttattatgtatgagaatcataattataaaagtcataaaaaatgttatgtgataaaaagaggaataataaagtgctatcggagtaaagggagagagggtctaattctgtctggaaagatcacagcaagcttaatgtaggacaccaacaagtgggtcttaaaagaacatgtgagaggcgaagagaaaataggagacgggaataggatgagctgggccagaaaccatggactttgagtgttcccttatagtgaattgttattttgtatgtcctggaaatgtcaggatttttgttcttttcttttagttttgggaagaaaatcatggcttataaaaataggattcattggtgaggaggtgatgaaagtcacagcttttatcagttagagagctatttatggtcatcatctaagcagtggattctaagctgaaccaaagtagtgtctttaaatctgattcagaggggcccaattccagggcatttcagatgtaggtccgtcagttcctggtaattgagtggaggatggcagataaggaagagggaggaataaccccagcagcttcgtctaagtgactcggataatattataataatgtcgttaaacatcctggagtttccagaagacactaatgattacattcatctatgtataaacaatagatttctgtctaaaacacagcagag

SEQ ID NO: 50945 - DNA, 1485 bp, Bovine  19866880948760
ggaaatatgtagctcaggcagtagaaatacattctctacagagaaccaggaataattgacacagtcctattaaaaattcccatagaacttataaattctcatcactttgactgtatactcaccaagcaaacttctgattattcattcgatttcctcggacccttgatactggggacggatgtaccctgtagtaggtagatgagaataatccagtcattaaaaaagcattttcctgattacaagtgaacaaaaagtgatctggcttataaatgatctctttcagattagcttaatgtagaatggcccacaactaagcacctcttagtaaatgaatgcagttcaattcctatgcctacagacctgcagtctctttccttttacaccacttttaacataacaagcatttgtcacaatgttccctgtgaagctcctgcaaagcaggaccagttttaataagttgattcattcattcagtccaacaaaaagttactgttgccaacctaatccctgccaggtttaggagtgcataaaaataacgtaaggtctaaggctgaccctcaacaagccctttctgctacctgttcccacaagaaggacacatagagacagtctaaaagtgcacattccctcagtcaacttctagatttaaagccctaaagtaacatagcaaaggagatcggcatacaccctccccaaatatgttactttggcataatgattattttgattgaaggcagccacaaacacaaacacgggaagagctctctacctttcctctataaggacattttaatttgaaaaggtcttccatttaacaatccccacatcaggacaaggagtacaacatacaactcatccctagaaatggtattgagatgagctggcataaacaacccttatttaccgtgagtttccaccgcccccccatacacttccttgctacctccctaaaatgcagccccctagacgcccttgtcttttgacaaagcaatactccacaatttttttgcctttgttaaagtggtacgtaagtcccaaattctaaccacccctttgaattactcatcactgagtattcctgcaaacatgaatgcatgttttatgtgtaaataagctgttcttgcctctagctaacctacctactgtcagtttaatctgcacaccttcagacactaaacttgagaggtcagaggaaaagattaacccccatcccttatactactgtgctgtactaagtcacttcaagtcaggtctgactcttcgcaacccaaaagactgcagcctgccagactgcactttgcactcagaaggtttatttcttccaacattcctcctctgtccatggaattttccaggtaaaaatactggagtggggtgctggccccttatagtaacttcatccaaatgcccaggcacagaatctgtgggaagaaggatgggtgagtagttatctttaggtgaaagggcttctatatgtgatgctct

SEQ ID NO: 50946 - DNA, 909 bp, Bovine  19866880953093
ccctgctcttattctgggggaacacttgggacttgggttcaccaaggctcacggtgcaaccatgagagaaggttatctcagatttcttcgttgcttgattttttgccaccaaaaaaaaccccacaaaaaactcatattgcttcttgtcctcagttgtaagtcaaaacttttcacaccatatgaagtattatcacgtatgtttaaatatcttgaacctcatagatgtcattttcacttgagtgcaatctcaccccagagtacaagtttgaaaagaaaggttttggatattaacaaagctagcaaatttctaggctaaagcatcaataatgctttttaatgtgcttaaaaggatgtacattctgtatttatgtatgtatgtatctgaaccacagcaggagaactaaataattcagtggaatgcatagagaaaactaatgatcccatattctaataactgttttatgaaaagcttttcatttggctctcaaaactgcctcataagtcaacacttggataatgcagtgaagttatatttaactctagaactctcctcacatgccaggtttcaaatatgtttctaagtaaatgtcctttttgggctcattatgactattcctgtcttccctcaaaacaacctcttatgtatgttcatttcccttctttccttgacttctggctgtcagatttacacctcttccaatccatgttatcttggcctggagcagcaatatcacacccaaggacagggagcccgagcttgacagatgttgccagagagtacctagcaaatgttttcttacaagatcgatccactcaagcaatggcccacaatagtatttcagagcaggtttataaggagctactggaagacttcttaataaatcactgatggaaatcctactttgctga

SEQ ID NO: 50947 - DNA, 1065 bp, Bovine  19866880960271
cccccattaaatctaattaaccctcacaatagcttgatcttgttgttaaatattatgctttggtttttcacagagggggagatggaatacagaggaagcagccatttgcttacacactgtgtaaaagctggggcatccctcacaatcactatttttcacaatcactaaagcgtattgttccctgtcaaacctggaaagctgagaggataataacgctgatggccattacataaaaggaacgggataaaccaggttctttgttgactgcatggaattgctcttactttttagtccaaagtacatcatactgaagaaacttcactacagatagagattgtgagacactcaaagtgagtgacgtaagctaatgggtagagtgccatgttgtcaggagagaggcccagtttctgcagcttacatttcagtggctaaatgtgcaccactgagtccataacacattttcttttctttgcttttcctggagtattagagtaacaataacttgttcttacataattcatagcacataatttggttagtaagtttaaaccagttttatctgcagagaagtaatccatgaaaaacaaaaaggatctttaatactagccttgagaaaattcaacttgtatttattcaacaacatttatttatactcccaagcactaggttagaaagataaataaaacatggtttctgtctttatggggcttactgtcttgaaggatgtgtgtgtgtgagtgtgtgtgagtgtgatgtcacatatatataatgtacaatattatataatacaaataacataataaaatgtggataatgctctaagatatacgttcatagtacaacatccagaggagaataattatcaactttatttaagactagtttgggaatggacagtatggaaggggaaaaaatataaagacagaaaaggattatcagaaaactgattgccaagaaggttttcgagtaaaggctcaaaattaatagaaaaaacagagtcctgacaaagtgctttatttattgattgaaacacaggtacaaagacctggagacatttctaactta

SEQ ID NO: 50948 - DNA, 1210 bp, Bovine  19866881008099
acttgggttttgatcatttaaaaagtatgccttagttatgtagagagtttgtcaatattgaaaaacccagtttcatattttttcaaatcaggtacattgaaaatttaaatcattttttttgtcaaggtcgtgatctgaaaatgttacataggaaatcatctatatttaaattcatatataagtgtgtgtgtatatatgaattgcatgaggtaattccatgtggctaagtattgatattatggtaccatattatgtatttccattttctccagcatcttgcaatatttttaaacaacagcttcaagctataggttaacatttcttaggtgtagggaaattttgtcaaagtgtggttgactgagtttcagagatcgacatctgtgtccttttcccacatatctggtccctgcctggagctctctcgagcagggaattggttagacaggcatacacagcacagacgtgcctgtttgtcttgcctcatcctggtagtggttattttctgaaaaacacaagggaaaaaccaccaaataaaaatatagccagcatttattagtaccgttataattgtatttatttttcttagattaatgagttcaataaaattctgagcactagccaatagctaataatcattacaacattacagctttaaaattatcctagcttatatcgcagatgttcagaaatgccttcttcagagttggaaaataaattccagaaaatgtgtgtctggttacagagaataggtttatagtaagatcagacgttttccagtttttatgtaagtttctcttgagtctcatccactacttttccatgtttttatagttttcttcctattttatcaagtttatcagagagtaaaatatgttgtatggtttccaaaatggattggtatcatgatatgtggtggtaggtgttttccaacctactctcaaagtgatggttgtcatgaaacatgacctgcctttccatctaacaaatgagcactaactggcaacccctgcctcctggcatccttgtacccattgattagtatgatctactataatcaaggtgccattaacctccaattattttcattataccttgcaagtagggcaacatattaataggcccttttatttccttccttggccaattgtgatcatttttttgtggtaatcaccacgataagcccctcacacttaacaagtaacccctttca

SEQ ID NO: 50949 - DNA, 820 bp, Bovine  19866881035353
cgtgggatggtgatgcccttttgtgttaacactgtgaaggggatccagccctgctgaatggggtgccgctaagagatccagctcttacgctcagctggacaagcagccttcctcacaccagcatatgcctccggcggtgcagtgccaagtggtctgaccgggagaagctgcggtcacagtctgcgcacttgaatggcttcactcccgtgtgtttgcggtaatgcctcgtcagttcatccgagcgcgcgaacttccaggtgcagccttcccaggtacacttgtagggtttctctcctggaagagacaaagggacataacgccgtgctccatcatttcccctgaacaatctagccaatgtgattatctggggacacgactgttctcagtggattttccgtttggtggtcctttgtcaagaaacctagccaccattgccagcaggtcttggggcgcacagatgggggtttcgatctaatctctctttgcggtgacagtggggaggttacttaacacttgcatcttcaattatgggtaagttactttgcagtcaaactatcaggaggcataaactggtaactctggtgtataatcaccatgggtagaccagaaaggcatgtgagagagctctacctaggctgatgtggccaaaggattgaaactcacaaagaattataaagggtaatgatttgtatgctttgttgcaatactgctctcaaacgtgcatcacttagatacttaaaggctattttagggtacactgtccttttatcagccacacaaaatttcatcaaaaggtaaagcactctaccacccccagaaa

SEQ ID NO: 50950 - DNA, 1859 bp, Bovine  19866881051533
cacaaaatatttcctcacagaaaagaaatcccacaggagttaacactttgagccatagagttttgtttcataccccttttcctttttccctttacatgttttcctctgtgggcccatgccatgcagacccctggttatcaataggctctatgtggttcacaatttagtaaataaacagctaaattttatatagtacccatgctgaaaaggactgttataacctcttatacataccaatccctttcatccccacaacaaagccataagtcatattatcatctccattttacagacaagtaaactgaggcactgagagatttattttgtatatttcacacagctggcaagcagagaatatgaactttgaactttggttatttgtagtgaaagagcctgatactgctctgccattcaagggaagtcctgataaaatatcagtatggtaaattaaacaatatagtccccagaagatgattaatgcatgtcataaaaacaggatggctgcaaatgaagagggtcaggataggaacagaacaaaggcttttctcttagtcatccttccttcagcacctatgcaccagttcctgtgtaaagaggcatgggatagggttaaacaagaacagcctgatacgtgattcataatttgttttaaaggtactaaatactgaggttaattgcttagtgtgccgtatagttgatcctgtgtgagagtttcactcaaactacccacttttgttctatttataaattcctgaaataaaggaacttcttccagtgttattaaagtggaagcctgaacaggtaagatgtgccacatctaacactaccagggctctagggaaggagggggacgactaggaaagcctctcacagaatcagattgaatcgggctcattcaggtatagaagggctccatcttataactgattttgaagggaggcattaaattaaaacaggaagccagaagtgggcctgaattatattattctcttagtagactaagaggaggctgaacctttggaaatgcctgccgggagtttttcctgggacattcattatttttcattccattctgaatctggaaagagacaggttacctgctcaggttaacgcgagatctcaaaaagtgctaaattagatgctgggaagtgttaaaccattgatcaaagagattccctgtttgttacccaaggattacctcattctcaacaccagaattgctgggtgtttcttttcgcagtatcgatcatatttttttttacttgcttgactggttaaagaacaggtttggtcttgtcactagatttcttcacggttaaaatgtgaaaattgtagaacagttgtgctttttgaatgggctcttatttagctctcattgtctttaaataaaatttattatagctatttgtgttcttttaaagctatttgattacctttttctccgactacaaattcatttgagtctagctaaaataagctccaatgtttacttatgactctcttggtcatttagttggtttttgttttttttcctttttggtcatgatttaggaattatcatactgcaagtctgattgtaaaacttctaatacattttcataattgagttggttagaaagcttaatttttatcagtatatttgaaagtcagagatatataaaaacataaatgcttcaaaattttcttttgccatgtatttatataaaagtgtctttttactattttttattatactttatgccagcaggttgaacaatatctatgctgaacactgaatttttaaagctttagtgcaacagctgaaactttctataagcgattataatgtacttatatgtacagtattaaaataattaaaa

SEQ ID NO: 50951 - DNA, 732 bp, Bovine  19866881113906
caggtgcaaaatgggacacattctcctcaaagtgctaagagcatttttacatacctcatttttaaaaagtttataataactccttccattcctatagcatcttttgtcagggaggttaaacttcctctaaaaatgttttactcatattttaaagttccaattcctcttgacagtgtttccatggaacagaagctttcctgcatcttagaggagagaaaaaccaaagcccaagtgggcgagcgcagaaggaaagggacaggtgtgctctgcatggcccagcgacgcctcctcccccacaaagggaagcctgcagggctggtccctgccccaggagcgggctgcaccaacaatgctcgcaagacccacaaaagctctgggttggtcaggtacagctggtgtttcaaagctgtaaattctggtttccttgtgggataagaatcttgccttcagctttacaaagaataacagcaaagacttccaatgcgatcccctggatcgcagttcttaaaatccttaggctaacaccatagtctgtcttagctccatgacatctgtctgatgtcactggaacctgcagagcttcagggtcactattttgaattattttaatttcaagtacgtgaggctaatctaagactgaaactctcacctttgaccctataatgatgaatttcaacagcttcattgttctcagcagttgactttaaaataataaattagacatttctccaa

SEQ ID NO: 50952 - DNA, 1505 bp, Bovine  19866881153088
tgatgagtaatttaatatttagagaaggcaataaataggaaatcaatgcagcaaaacagtaattcctacttgtgtttattatatttttcttaaatgagtatactctaaagacttgttatactggaacaaaattaatttcctttcaataggaacttaagcttctccatttcattctactgtgtagttactatagatacaacttaaatttggggatctgttccctctcacttgaattcaaagtagtaaatatgagatataattaggctaacagttaatgtaaactcatttcttgttgacactgctacatttctgtaaaatctttctcattattgaagttatttgtctagggtcttaaaaaaatatgaaacagctgatgactaagacagttcttactaaagcaagaaccaaaataaacctgccttgatcacattcatgaggtcattcaattgaatgaaactgcatgaagcctggaacacaatagcccaaatctctgaatgtagcgggataatcagggtagagaatttattgtgggggtgattaaaaagttgcatcagaaacataatgatccaccctttaattactttgctttgtagtaagcttagatcaatatcaactgtttgttttattcaagctgctttattttgcctccttaaagaaagcattacgtgactatgcaagtacaagaattaagagaaacttaaacatttggcaggaatggtagaaagtgtgatgaaagtgacatacatttggtctttgcaaagaaaagcttgtgccattgcaaaaatttaacaggtcatccagagtaagagtcataatgagatcatcatccttagctcagttttcattgaagtcctgtaaaatcatgatgaacatatgaaaatggaaacacttgagatcatgtatgaattggtgtttttaattgaattttggagtgtcagttgaatgcagttatccagtagagtagcttaattagttgccacttctcatctttctctggcttctcattgtgaaattgatactagctttttaaaaacaaaggatgctccagaagcaaacctgagttctcatcccatgccaaattggaaagaacatatggatgtgaaagaaaacatcctttgagggtggcctgtgttgagggcacattgtaatctgctagggacgttgcacctggttcccaatactgatgccacagacaaataaaaccacatagttcactcgggtgtggtaccagaccaagacaaggcctcctctcaatcagattcctctgaaagggaaaattgtacacaacttgaaaggcaatccagaaacagccttgatgttcagtcactaagtcatgtccaactctttgcgaccccatggattgcagcacaccaggctcccttgtcctttactacgtcctggactttgttcaaactcatgcccattgagtcaatgatcccatcgaaacatctcaccctctggtgcccctttggcttcctgccctcaatctttcccagcatcagggg

SEQ ID NO: 50953 - DNA, 2319 bp, Bovine  19866881153277
aactgccgcgcattttctgaatctgttatcaacactggaaagaacatgcttccaactaaatctaaaggcaacctgctgttacttatttgccaacacgtatggattaaaaaaaaaaaaatgaagaccaggcaggcattctgggaactggaatcttcacatattaaaattgagacacagtatcataatttttgccctgtaagtcaagaagcagtgaaatgctctggtaattaaagtaacatagtcaatattatctataaataatgagcatgcaaagatctgcaagatgatgagtaaacattttggcagggatcaactgccacagattggaagggaaagccatgtctttatcaggcctttcttctttctctcccccatcacatcaagctcatgggaatttcccagacaaaagccttctgcttagcttgtaatgaattaaacatccatctgacttaatctttagcatttctcttgctctgcccacaggtaactaactgccaccgagcagaaagatggctggacaggagtgtagagaactgggcttatgcctgcatctgacaaggaacacatttctgtccttggatctccatctctgtgtctgaaaaagtgagaagttgaattgaacttgatgacgtttacagttcaagcggcttccctggtggctccaaggtaaagaatctgtctgccaatgcaggagatgtgggttcaatccctgggtcaagaagatcccctggagaaggaaatggcaacccactccagtattctttaatgggaaatccaatggacagaggagcctgcagggctacagtccatggggtcccaaagagtcgaacatgactgagtgccaaaaacaacaacaaaaacgacagttccttttcagccccacaactgataactactgcattcagaaatgtcctgtccccccaacaccctttgaagagctagttctatctcagctttctcaaaggtttccagtagcaaccacttgagtgccttcctctattaaggcaaaaagtttaaacaagaagcaatgttcttatttttatgaccaaaatccatattagttacactgttcagaaagattcaatgaagtcatgtctaacatttgcaactatatgcatataaacatttaagttcactgtagcacagcatatccaaccataaaacatcaaagtgtgaaaaggctcttcctgcccttccctaaattggtaacacagaactttttcacttccaaatgtgaaatgtgatccacacccagaatgtgtcataattggcatggatatgctattaaaactagagcttcttttgcagacagctacataacatctcaggcatgttggtaagaaaggaatcataattgagactggtggtgacagtatccggatcgttagagaaaattaatcctattttactaatggcaattcctattaacaatgcctgattttgccatcataatataaatagtctagagtctctactatgtgacacataactctgcacaaaacagccccacgcaaatgttttgggtacagagcataaccatgactacgccgtcatcaaacaaccatatacacccaagtctttgaaaacttttggattggggccggatggaaggaaaaatacataaagagaagaaaaaataaaaagcaaaaaatgaggattttggaatcctcccactgagactggcaagtttggagccttaaatcaacttcaatgttcatttcagagatattccccaacaagccccgccctgtcctggtccaacctacacattcacaccaaacacgtttgtacatttcagactctagaatagctctggggataaaagcgctgaaagatgacttggaaacagccactctttgtgagtttggtatcagaatacgatagtttcaagcaaaaagacctgtgaagaagaaaagtctacctatagattcaaccctctaagaagatttaccccgtttcccctcatttgccccacaaggagcaaactatttttgcccctgtcattatcatatgcaagaaaaaaatagcattgcaagaaaaaaatagcaaatgctcttagttgtcggacaaaggaaggcatgaaacaagagctgtgacacatgacacagtgaatgaaattcatatgctgaacctcaaacacttcatcaatcctcagatcaacaaatattactacagtggaatggcagagaggggagagtcattctgatgggcagagtttatgtctggtctggattgctaccgctgattatttgaatattaaatgagttgtccgatgacctcatgttttttattagggtgctaatatatctgcaagaagtt

SEQ ID NO: 50954 - DNA, 1647 bp, Bovine  19866881175609
tgggttgcctgccctcctccggggatcttcttgacccaggggatcaaactggttttttaccactagagccacctgggaagccccaagtagagactaaaatccatataactccctgtcttttgagctcaggttggaccggagtaaagctagcaagtaattttagaggtttgattctgttcttaaaattttctgcttttccaagtgaaaaatcgtgcatgttccacagagtaccttaaatattcaggaatcctccccgagtctaacaactgtagcaagaatctgaaataataagcaccgcccttggcttctgtcacttttttttttcttgacttcatttatatctctaaatacccagcattttattaaattgaccctgttggctctgctcaaaagccacacaacgggagaccctgcagcaggttgggctcgaaactcaccacgtcagtaggcttcccagcctctcttcagaggtcagtgtgcgtggcggcaggaatgtgaaggctctcgtcctgcggcagcctggggtaggtgttcagcagatgacggcaggggactgtcaccaccacactcactgctgaacccccagagctcagatctgtgctcacacatggtagctctcaggaaatgtttgtgaaatactgaagaagtaaccagtctcacaagtaacaaatctcaaaaaaatcttgagatttttttccaaagcaactaaaccttatatttttacaacaaaatttcacatgaaatatttagaaagagcagagtggtgacttgctagtatatgcttattttctgtaaatttcaatttcttttttttttttttttagttgaagtatagttgatttacaatgttgtggtaatttctggtgtacagcaaagtgagtcagtttcatttgtatacatatatgttccttttcatattcttttccattacagtctattataggatatcgaatgtagtcccctgtgctatacagtagagccttattgttaatctgttttacagatagtagtttggatatgctaaccctaaacttctaatttatcccttcctcactttccccttgagtaaccgtgtgttctatgtctgtgagtatgtttctgtcttataaataagttcatttgtagcatattctagattccacatatgtgatatcatatgatatttgtctttgtaggacttactttgcttactatgacaatctctaggtccatccatattgctgaaaatggcagtctgcattcttttttatggctaagtgacattgcattgcatttatatactacatcttctctattcatctgtggatggacatttaggttgcttccatgtcttggccgcagtgctactatgaacattggtatgcatgtttcttttcagattagagttttttccagatgtatgcctaagaatggggttgctagatgatacagcagctttgtttttagtttcttaaaggaaatggcaacccactccagtactcttgcctggagaatctaatggatggaggagcccagtgggctgcagtccatggggtcgctaagatcagacacaactgagcgacttcacttttacttttcactttcgtgcattggagaaggaaatggcaacccactccagtcagcgttcttgactggagaatcccaggg

SEQ ID NO: 50955 - DNA, 1035 bp, Bovine  19866881341809
tttgaaatgctttgctacatgtgctaaatgtcgttgctaactctcctgtacagtctacctcgataaccacaggtgcagaataggtggatatggagggttgactttattaggccattttatataatacaagggtcttgagcatctgtggattttggtatccatggtggtcctaaaaccagtctctctctaggatacctaggggggactgtacttcaaaaagacaagcagcatgttaaaatttcaggattttcctagtagaacagagcattttacaaagcagaggatgctgattttacttggaaaacctaaactgtcttgaagtgatccctttaaattgttgtgtggtattaatagggaactgggggtaggggtgggaagtataagcctatccagcttgagttgacgttcctgcttattagggccagtctggggctctaaaggaaagaagaaatttgtttcttctccttatcttgttaatattcaactcatagtacaaattccactcacaatctttctaagactctagtaccacagagagataaacagagtaatggagagctctgtggttaatttcctatacaaataatagcagggagtcattttcatacatgaacttacatttgtcaaggaaacaagatgtaaatgcagcagagtaaatatcagtacatgcgtgctcaacggcttcagccatgtctgactctttgtcaccctatggaatgtagcccgccaggctcctctgttcatgggattctccagatgagaatactggagtgggttgctgttccttctccaggggatcttcccgacccagggatgaaacccacgtctcctgtggattctttaccactgagccactgaggaagctgataaatatcagttacagcaagtaaatctagaagtattttcggaatgagggtccaagcccagtacagcctccctaggtctgcaatatctaccattaaagtcgagtacacagcaggagccttttcatactgttcttcaagaaaattagagataccaagggaacatttcaca

SEQ ID NO: 50956 - DNA, 1402 bp, Bovine  19866881388355
tccttttactttgtctgggagataggcctcgggggtccatttgtgctgggaaaaaaggcatatataatgaattaaaattagtgtgcagaaagttaaccttgtcctggaccaacatcaagcatggaatgtctcttctgtgtatatcacacacatggcatcctctagaaatcccaggaattagtgaaagcaatgtatttttatggactgagcactcactgactcttttcccttgttcatttgttttataaaaccgccatcagctctcggtagtttcaggggatgattacaaaatagaacgtataaaatccacaatattaccaacttctgagtggtcagaagatgattaggtagcttgtgagttactgttctaccttctggcttcttcttgcttctgctgccagagttcttgccattttgttgcatactaacattgcctggaaggtggcgagcaggagggagaggatttgtttgcttatagctctcatcagaagcttagagaagaacaaggtttacaagagaaatatcaaggtgtaggtatttttcatatcacagtgaatccttgtctcatagttcactgttgctctaagtggagatctgagagcaggaaaataacagaactagcagcctgtcattttaactgtatttacatgtgttagccagtgcccctcatcattatcctgatctcattttccaaaacagcgtttctaggtaagattctccttcactgcatgcttgctgaggcaagaaatagcccaatgttctgacccttgttgacagggaccaccagatcctttcaaatgagaaggttaccatcaacctttaatatattaatgcatatttttcaaaactggtttcacttccacctcctctttacgaacagctttagcaaccaccaactaggaagtccatcagccctcacttcaagcaccaaagaagcacaccttctaaattgaaagcactgtgctagctacataattgcattgctaaaatgtatgatttcaatgctcagccagcttcaacaagaatcctgctcttcaaacatgcctacataagacttctaaacccactactgcttgcaagaaaaagcaaaatgaacttaaaatcatggttacaatgacatttgggtacatttacagtttcctttttttcttctttggtttttgttactgtgcatcatacatcaggtagagtcgcagggaaatgctgatttttcccattttattaacccacaaaagataatttcttacgattttacctaatactgactatatgactagaaaaactatagagagttttgatagatttctaactaaacttggttatgaaggtgctaatatctgttgaaatctaaggtggagtatacttgacatacattctgcaagtataaacatatcaaaatata

SEQ ID NO: 50957 - DNA, 1070 bp, Bovine  19866881400346
aaacagatcctttaaatgaactcgcatttgcgatatgcattctcctatgtccccaaaggctcagagcttgtgtccagcctttgggacatgaacatgaggtatcattgaccccattttgtcagtgatgaaattaagggcccaaaatagagattcagtgattcgttctctgtaaccagccactgtggaacggagcaggcactctgagatcttctcagtccaaatttagcaatggatctcctgcctgtgctgctgactcctaacgggagtcagctggaattcttatttgtggaaggagaatttcaaagcacacacaccagctctattttattttagtacaaagattccacagatcttggcatttggttttgtttgaggtatggaaaaatatttgttgaaagggaaagaagagtttccagataaatatgagaggtcattgaggttcttgaaactgcttttcaaaccattttaaagatatagattagttttccctctggaatgcttgaaatattgtaagcactctcaatgtaccctctagtcatatgatttttctcttttttctggacgccacactttctctaaaccaccatcatggtttttctcatttaacacagtgggactttaaggtgattattctgaaattgtcagtggttctgaagcagattgttaccaaaacgatttttaagatgctcttcttaaatcaacatttttctgaatatatatataaatacacataagcttgtgcatataacagtatatatatttactgtttatacatatttcttggtggtttttttagaagccacttcaaaagaagtttccatgtaactttagtggaatgagaaaacattccttttcttactcccctcttaatttataaatgcattcaacctgttaaatactcatatagtaagtcttcaggcaaagctaaatcctctggtgctttctggaacttaaagcagaggtctattttaaggaacttggcactgatcagataacagatttttaagaccgtctacataagaagagtcagtcctgaaggaaggcaggttacaactccttccgccaacatt

SEQ ID NO: 50958 - DNA, 701 bp, Bovine  19866881627522
ctccgtaattgaaagagcttggagagatagaaggactaactgattcagccggtaggttcttgatgaggaaggatccaagaacttctttgaagggtggagccaatacacaggtaaatgacttggtcttcagaaggcttagttcagcaacaggagagagtctcttctacttgacaaaagtaaaggtgtcaagaatgaatatctgcactcatccatccattcctctccaaacaaccatttatgaagcgcctgcaggtaagtgtgcagtgactccttggaaagtaaacttgaaggaattttctgttcaggatagtctagctcctcaatgaagtaatgtaaatcatctgcagagtggtggaaagttaggcagcaaggcagttagttactgtatttctaaaactcaaaagtgctttaaatactttttattgtttttctatttacttgtttaatacaatagaagtgttttcatttttagagttaaccttctgtttctaattttttctaagtccagagccaagttgttttttttaacttgagcatttaaagttggcattttgtaaactgtcaccaggacaatcatttacagaggaatccatttctgcatgtggctcatgacatcagagacagatctttgaatgatgctattcaactagacttcataattcctaatacaaggacttcacgattatttgggagaaaataaa

SEQ ID NO: 50959 - DNA, 893 bp, Bovine  19866881792462
cagggatcttctggacccagggatcgaaccctcatcttctgtgtctcctgcattggcagacagattctttaccaatgagctacctgggaagcccaaataattggtacatttttacaaatctaatggggaatggcaataatgattaatctgtgaaggaaaacgtggaagaatttttatttgttcttagtctaactgtctgatgttaggatttggcatttccttgtgggaaaccaattacagggatgttctgccaagataaaggaaggaggaaataaggaccgcaccccagtaagactatatggctttaaaaaacatttttaaaaatagcttgtctgatgatggaatcaattgaacttaaggaatatttcctaatcctactgccatgaggtgttagtttccaaatttctgtgactattattctgaaagtggtcccatttctcgcttctgggacttcccaaatcctgtgcctggctctgtcgtcggcagggagatggttacaatgagtcccaccaggctgctttgagtcagggtcacatctggggtaaaaaataccagttcttgcctttctacacccttcccttaaaaagtctctcttatttgggactcatgatttttttcttcagtattctattagcattatgacaggagagaattttttctttttgctgaaacatcacatatttttgagataatttccctgttaaagtcacaattattagtttctaaactggcagagaaatgatatcttgactctcaactgataataacccatcctctagcatacataaatcacagatataggtcaaggaaaaaatgatgccagaactttccattactggtttcctttaatttatatatatacacatatatatcaattatataaatatatataa

SEQ ID NO: 50960 - DNA, 1154 bp, Bovine  19866880360992
ctttctgtgttagtgcctgtgtttgtgctgggtgtaagaactgaaggggctgaaacaccacccttcttagaggaaataagtagcctgccaccgtttcttatgtgcagaatgcatacgcaaggctgccagcagagagagaaaggatgtcaccactcaggctgcagcaagaggtctgaggatcacctgtgcctgggatccccctgccctccgcttccaggaggcgggggtgatgacacggaacagacccagggacgctgtgtggtctgtcgtgccctctgaagagcaccgagcttaggacactccccgtgttgtaaggggctgctgaaaaacccatccatcctttgccccgaagcgaggctgtgttcttattatgtgcactgggagacaaatttgccctccatcccagagggaaatactctattttttcaaggctatttgctctacagacattcttgtaaagataccctggaataaaatactcgtatatggtatatatggtgttgtgtgggtgatatctatgtataccatttaattctctccgtaattctgtaaagatagctcagaattcttgttttagatgtaaagaaggaatatcagctaagcatcttgcctcatgtcatagaggttgtaagggacgaacttttggatattcaatcctttgttcttctactcaacagccagtaatctctctgaccagccgatgcactaattgccgtgaaaagcagagacactcgtatatattctgtgaccgtgagttctagaaagaaatccctttgactttttatactgcttctgctagatatatctattcctattaaagaaatatctgtggtgctgttgtcttcatgattggattgctacaaagcgtatcatgtacagtaccatccaaacaagtatggaagatggtgatcgatgaagcagtaaggtttcccccttcaatcaaaccaattgctttttgtaagtattattttggaagatacagttaaaaagatgttgaattaaattgagcttctgaaaattgctcacctcatgattccttctgattacgtcttggcataattccgccaagtttcaatatgtaatttagggataatgtataatgggtattagaactattgcagcttctccacatttaaaggagaggccaattttat

SEQ ID NO: 50961 - DNA, 810 bp, Bovine  19866880722210
atgaaaaatttctaagtataagtctgcataagcatcttttgctctagatctaaagaaaagctgcagttcctacccaaagtctgctgtggtaggtgtgttgctgaggaagatgttttcaagtctttaagtgctgagatcaataaaaccgtgtgattgtctcttttttgtttagacctgggcgctcacggctcacccaaagataatgggaagctaatgctgcaaaagagagatgatcctcatcaaaggccagtcagaacccttgctagtaatagagctgctaaaatcgcctgcaacagagactaaagaaaagtacatgcaggcaagaaccagagtttctgatgcttggctgggcctctgatgggaggctggtttccacagtgcagaattgtctctctcgaggtgttgtaactctttcatgtttataacaaagataactctttctctctaaaccgaatggatgcagtcaattagaggtctgtgattacatctcaaatgagagaaatcagaccctttggttggatactaggaagaatggaaatggctgatctcatctgcctcccaaaaaagcttgaagggtaagagttacatatttaatgtgaaagttattattattatttttccttgataatctgttctgatggacagatgtcctggaaaaagatccagacagaatttcaattggagccggggagccatttaaagactgttaagttctgcccatactttaaaatatatgtgttgctagcatccaaaatcatgtctgacaaataataaatgctcagtaagccctcagatagcaaattaaattta

SEQ ID NO: 50962 - DNA, 1555 bp, Bovine  19866880917282
atttccaggtgtactgcttttataaactattccaaatcttgcttgagggtagtcagttgaagaaaaagtgagacttggaaaaaatgcaaaagcaattctagatataaatctagaattaagttcattccatttacaatgattttttttaagctcatgatgtccctaatgtcactgaggtacttttcctaaaaatataatgaaccctcccagccacagtcatagatgccaccacactgcaaccaggactgacagtggcctccagaaagaagcagagcatcatgtattttgagagcactcacccagaagcagagctacagaagaaataaatgtttatatctgagacttaacagaatgaggcactttattcaccctctatcacaaatatagactggtacttttaaggtgctaaattataaaaattagaataaagttttaaatgataaaatatgtcatgtaacccaaattaatgaacagacaagcagcaagcaacaagatatgcactgcctaaaacaggcaagctattttgttaaaaatccttgacaaatggataattaagattgaatattgactacattcatgatttacttttttatatctcctttcccactgatttgaatgaacatatattagtaactagtttcataggatatctctacaaccagaaaattatctagtgtaaaatattcttagattttcaaatgtttttatgttacagaaagtatattaaaataagcaactaaaattgtttatgatcttcctctaaagaaaatcattaagaaccacagttctgagtttccaggaaatgttttgcaagaggaaattccatacctgcaaacatcagctctgagacatcgggtttgacatggagacaggtgaaaagcggcagaggacactgcccagtattgactttttccttcaaactactcagggtagtgttcattctctgtccacagaagaaaggaaaggttttacatatataaacggttacagataagaaaaaaaaaatctacatcaaatagtgcttccaaccaagacccttaaaacttttatgataaaaattagccttattattatctagaaatctctaatcctgaaaaaaataaaagctcactggaagtaattatcttcattctaaaaaacagccataactctggggactatgttgacatttgagctggaaaatgatttggcagtgatagagcccagaaggaagtcagtcctcagattctctggcacaggctccacccgcctactttatcttctgataaaatatcaccctatgatcatgtgtcaaatgtgtttcttccatgtgattcattccttttgttctggctttctccaggcaacctccatttcttcctctgccacttaaatattacttgtcttcacctctttatctaaaaatattgctacttgggcagatgagcagttgagggttaaaatatgtagctttctaaagaaaaagaatacaaaagtatttccctatacatcaaaactgccacatggggagttccctgggaagtccaggggttaggactcctcactcaaactgctg

SEQ ID NO: 50963 - DNA, 1352 bp, Bovine  19866880942922
aaaatagataactaataaagacctactctaggagaggggattcttctcaatactctgtaatgacatacatggggaaagaatctaaaaaagaatgaatatatgtatatgtataatagattcactttgttgtacacttgaaaccagcacaatattgtaagtcaaatatactccaataaaaaattaatttaaaaagaatgcctcatttgtataaatggtgagtgaggagacaaaattaaaaataatgcaaaagacaggcacaaattataaaagcagtattttaaacatcagttttcaatacatataactttgaggcttataacatttattttagaagttagggtgcaatagcaaatatatcaataggtcaatcaatctataattaaccactgttgttcagtttgattgacttcagtgcataaaccaaaaaaggagcaaaattactgaaaaaataaaaaataatcaaaaatgatgcacatgctaagaagacttttttccctaaagactctttcttgaaattacatcttttcaaaatgagaagtagaaaaggaatgaggaaattaaaattcgacttctgaaaagtgcagcaccacttgctgaaaataattattcagtgacagaaataaatgcatctaagagcatgtgagtgtaattagtgtaccacaggtagtaaatatcatgttatgtttcaatgattttatggatatcaaactcatctgtatgctatttctaatagcaattttatgactaaaactaataaatataggaaactgttctgatttttaataatacatggtttcttatggcgatagtttatttgggctgatgtaaaatgataaatctgaaggctaaggttaaagcacttcttggaaaataagtgaaaacattaaatgcattcgctgtcctagatctttctaaagtcattattgcattttttcaaagtatacttcaggggcttcttttccacttcaaagttaaagccattaaacttactgttccatgtaataaattaataaacaagaatagattaaccaaatgatatggagaattacctcttccagttcctctcattctcctctagttcactgttgtttctctcttgggaagtgggggaaagttctatttaaatttagattgaataaagtgctcgggtaagatatttcagactcccagaagtgtggtatgtgatagaagaaatggactttttttttttttttcctggagcttttaaatattttggcctgtgagcagctctgttgagttggctgccaaaataagactggcagttcttaagctcccaccagagctcagaaagcaacccaggaaggatttccccaaataccaactgtcctctg

SEQ ID NO: 50964 - DNA, 3151 bp, Bovine  19866881099684
aaaaaaaaaagcttgatagtatttctgtcttaaatggtttgagacttgttttgtagcctaacatgtgatctatcctgaaagaaattccctgtgtacttgaaaagaatgtgtattctgctgtgttttgatgaaatattttctagatgtttggtaagtccatctcatctaacatgtcatttaagacgactgtttctttattgcttttctatctggttattcatccactgatgtaagtggaatattagtgttctctacttttattgtattattgtcaacttgctttctttgtgcctgttaacatttgctttatatattttggtgcttctatattaggtacatgtataataatgatgtaatatgtcctcttcttgcattgatgcctttatcattatagaatgcctttttaaaatctttcattatatgctttgttttaaagtgtatacttcctctgatataagtattgctacctcagtattcttatttccatgtagattaaacatctttttccatcctcactttcagtctgtgtgtgtatgttttaccctgaagtgaatattttttaaacatatagatgcatcttgtatttaatccagtcagtccccttttgtctttgaaatttagcccactgacatttaaagtgattattataggtatatatttgttgccactttgttacttgtctttttggttatttctatagttccactctgctattttcttcttttttcagtttcttaacttttgatttgataattttttttttcatagcctgcttatgttcctttctctcttgttttgtatatatgttttaagtttttgatttttgattagtgtggggtttgtatatgttgactgataactatatttacttattttaaactggtagtaatttaagtttaaacacattataaaaggtctgcgttttttattccttctctcatgttttgtttttttgatgtcctattttatatcttcatgttacctctttaactatttattgtagtaactattgattttataattgttttgcctcttaatcttctatactagcttatttaaatggtaaatttaaatatagccttcaccatatatttacctgtactagtattttcgctttcctgttgattcttacctcttattgctcccctttcttttccagtagagaagcccctttaacatttcttttagggtaggtttggtattgatgatatcttttagtttttgtttgtatgaggacaaggtagattcttatgattttctgttaatggtctgctagctgagtaagcggcagagaaggcaatggcaccccactccagtactcttgcctggaaagtcccatggatggaggagcctggtaggctgcagtccatggggtcgctaagagtcggacacaactgagcgacttcacttgcactcttcactttcatactttggagaaggaaatggcaacctattccagtgttcttgccttgagaatcccagggacaggggagcctggtgggctgctgtctatggcgtcgcacagagtcggacacgactgaagcgacttagcagcagcagcagcagctgagtaagtagaatacttttcacctgccttccataaaaaagaatgtaagagcaaataatgatgtagattcctactattatatgcttgaatgaaattttttacaagagaaaaaaatagactggcttttccattggcctaaagaatgaaacttcaaagacagtgctagatatgaataccttaagaaagagtttgccatgctttctcttaagtttatggattacctttcctttaaactatgtctagggaacaaactgaaacattttttatgttcattttctattttatagcctttaagatggaaaataagctgtctctgaagtgggccaagttgcatgcttacaggcatttcttgtaacttgtaatatcaccctgcctgaaatgatagtgatatattctttacttaactttacaaacttgcaggttttatttttcaagagtacaaaagaactgaataacacagacctgaaatggaatgctattgtcctggataatgtgaaagcaatcattttgtaatgtgtaattcatttctttcttgtttcttgtccggattgttctgaattttcactccagctggaatcatcattgttctcatgcagacagtgtggctggtcacatgtggaagaacaaaaggcaactcgattaatctagtgattattttacatccatgatttcctcattgacttttatttcctttcttatcaaaatttatttgtgttaatttgcctttgggacaataaaggttatcaaatgtcctatgaagggagcaatttgtagaataagaatgaggcacaaagctggatttgtacaaagacttgaaagaagtgaggaatttgcctgataggggtgggggttaagtttatcacaggaaaggaaatagccagtttgaaggtgggaagtgtgcccactgaggtggaggtggagtaacctggagaaaattatataaaggggaagggtattaggaggtgagctcaaagggctgtcataaggctttcacccaaagtgaaatagaggtatatgcagggctttgaacagaggagtgacgtgaatttacattttttaaatgattattcttggatattgattgagactagctctagggaggcaaggtagaaagagaaagccgactatgctagggcagggatgatggtggtgataaatgtttgcatctaggtgtattttgaaagaagagctaacaggattactgaaaatttggttggggctataatggaaatagagtcaaaggggactctgaggttgacttgaacaaacagaaggatagagtcagcattatatgacttgggattcattacgttctggatgatcctgaattacctttcagatgccacacaccaattttctgttttcaatacttgtgactttttaaattcctcattctccctgtgcctcttactgtgtaaagtactttgtttttgacctcttttattttttttaatacttaaatttacaattacttctatccttatttccttccctttcctgttgtatcaactattttaacatcagtgtgcttaactccacacccatgaccttccactcagtcatcttgaatataaaactgtataa

SEQ ID NO: 50965 - DNA, 762 bp, Bovine  19866881153352
atacaactgagcttgcaatccaacctgacatgctttatttgggaatggacatctttaatctgctcctggcatcagtgcaaggcaaactatagagagaaacaagctcccagccggcttctcagatgaacagggaaattcgatcttgacaagaaaagaaaagttggaagaataaacaggcccaacaggattcctgactgttcaggagacagcctctgtactgagcacagtggagggaattacattttttggtgaacttgcccatttttttacatcacattcctcatccacagggagtatttaaaccctgccacattaagcttttataatctgggccatttgtgacttgcagatacatagtataaattaaatccccttgtttattttcttcaataaatcacagaaaggaagcctttgtatattttccattttaaattactttatccaagtctatctgaagattttattcaattatcatttgactgaatactattctgaaatacatataactgggatgatgtctcagaaagaatgatgcaaagaaaaagtgtgggagaaatcacggaactcttctctgatgtagctttacacccagaaaggcctggagaaaacaaacacacaaaaacaaaacaccaccacaacaaaaacccaggtctgtaaaaaagttctgtgggaaagaacgttaagagaaatgtactcctcagtctctctgttcataagcaaagcggtagggctttccctgatggcacagtggtaaagaatccg

SEQ ID NO: 50966 - DNA, 1291 bp, Bovine  19866881200061
attggaaaaggcaatggcaacccactccagtattcttgcctggagaatcccagggacaggggagcctggtgggctgccgtctatgtggttgcacagagtcggacacgactgacgcgacttagccgcagcagcattctctttatcctcaggagaaagggaaactatctcataatcttcattcttttaataagagtgccacacttttgaaacattgtaatttatagtgtctcttacacagtagcaaaaaaaaaaaaaaaaatcttactgtactcagcactggccagactcttactacttatgtattcattttttattggatttatacagttgtctttcccctgaagagctccaggttctacgagagaacttttaagcagcaaacattatttcaacataatgagcctgactctgtctcctacagaaagcagaatatcataagcttagccagaaaagaatcgctgacccgtaacaagccaagtccaatttataaaggcaaaatgcccaaagaagggcatggccggtgaaaacaagcataggactcgagcagagccagaggggaaagtgcactgaaagacagagaaagcaccagctttctgtaaaagagaagcaccagtcctccttccccaggaagctcatgtgttgccatgaacacaggaaagagtgtggatgaggtcctgtggtgggaagaaacaggaatggatgggggcgtgaagactaccaaaacagtggtgtggggagaacagccattcagtgggttgtgtgcctgcgcacgtgcacgcacgtgctcagctgctcaaagagtcctgactctccacgaccccacggactgtagcccacaaggctcctctgtccatgggatttttcaggcaagaacactggagcggacctttagtaaagacgacaaacagaagagaagcaagagtggaaggtgagtgacgccatacctttcacggggcaccagggagcaggggaccgtaagaaaccctgaccttgacattaatcctgccatcatctgtggcttaaatacagtcatcaatggccaagatgatgaactaccttcttttatttctacacaccagctttgttccagacacaggtattataaacaaattaactggatcatatagttaagactacagtctcctaaattaagaaaaattcaaaattcctacctgtggagaatttcattatttgtgttggggtgatgggtgcatggcgggggcgtctagctaggagcctggacaacccagatgcaaattctccagagtgctggagtctgtttgctgggatt

SEQ ID NO: 50967 - DNA, 1185 bp, Bovine  19866881200141
tatgggagagggttttcatcaatctgatcatttaatctaagttctttttcttaagatgtgttttcagaaattttggttcatttcaagagacatagatctcaggggttgaattggcttcaattcctggctttgattactgtctcaattagtggtaactgcagggtatcaactttaagtaaagcaaaagaaagccagtacctgtgatttttgccccttttttcccccctgtgctcattaaatggtattgcacaagggcgggacccctaaaccacctctgctggggacagacttcagcaatagatgctcaaagagcttggggatggaggctgtgagcaggagtttaagcagcacacttctgcaaagcttccttgtgatgcatttgagaggcagtgggggtggtaaagtcccctgcagtcattaaaaggttagtcaaagttttggaaacagatggcagaactgatgctaccactatgtgggagcccatatgatgagtaatgagacaaagtcgctaacgaagatgagaaaaggaaacatggttaaatttagggttattggcgaacttggaatgaggcaggaaaaagacaggggaagacaaatgcagagatacagaggaaagacacgtgatgtacagaaagccgtgcctacatgctatcgcagctgcctcacattctctttgcaatcagatgaggtataagttaattgacaaggaaacatgagttgtataactcagcaagacacagacctggaggaatggagacaaagagtaaattttcaattgtaacgttgtttttctagtaaaagaattaaaaatgttagcattccctttaacttaaaaaaacactgttaatacatattttgcttcattactgagcctcatgacaatctcaggctgagaattaattgatccctagtgtgcagatgatatgttgatcatatatcatgattgagagaaatgatctcatctattgtagacagaaaagattgcatgtcttgtcagaggaggcaaacttttttttttttaatgctattaaaacagaaaaataaaattcctcaacttagaattctcagattattggaaaaaaatgggcttttaaggtaaatgccaaaaatgtcaaatgagatcaatgcagattttgttaagtatcactaatcatgaaatgacgcattttattatttattattatt

SEQ ID NO: 50968 - DNA, 769 bp, Bovine  19866881305479
aaaaggaaaggtgtttttctttatactcttcccctcatgcgattctaataattttatttagttatttttggctgctctgggtcttctttgctgcatgtgggctttctctagtcgtggccagtaggactaccgtctaattgcagtgcatggaattcccattgcagatggttctcttgttgtggagcacaggctctaggatcaggggcttcaataatcgtggctctcggactcattagttatgacgcctggactctagaacacaggcccaggagttgtggttcatgggcttatttgccccacggcatgtggaatcttcacagaccagtgatcaaacctgtattcgctgcattggtaggtggattttcaaccactggaccactaaggaagtcctctacttgctattctaaatatgtagttttatttgtggtttgcagccctgagcactggtgacatggcagaagcgtggttaaggaaaaggaacagtcatctcttggttgaggagtgagttgaatccccttgtagcatgtccttctcttgtttggcccattttctcttgccatccttcctgcctagtcttctgttagtcttctaatttgtctgccattgacctgtcgagagagaaaagcgtcaagttagaaattgctatatataaatgttctaaaccaatacattgtgtaccttacacaatattacatatcaatcatatctcaatatgaagaaatacataaattcaatgaaaataactagctatttccttctgtctaaaaga

SEQ ID NO: 50969 - DNA, 818 bp, Bovine  19866881470669
aaaaggaacagagcggagtataatggctttattaaaagttgtttaattttcattctggtagggaaggtctatttttggcagattcattctttgaaatagccgtcagtgtgatataaatgaacgcatatatatatatgattgtaattacatatattattttctaactttgggtttagttttccatattcaactctttgcgaccccatggacagtagcctgcaccaagctccttcgtccatgggattttctaggcaagagtactggagtgggttgccgtttccttctccatgtaaaacaatataccaccttttatttttggaatcagtattttcaaataaaatagcagctgtttaaactttaggtcattcccttggtgtggtggtttagttgataaccatcaggaaattaatgcagatttctatggcaaagaaataaattactagaagtcccaggactccattcttaagaaatcttaccccagatctccaaatctttccttacagtgtagattctttgctgtggaattataggatgaacagagctgtaagaatcctgacttacggaactttaggggataaaatcaatgaagtaatataaagtaccaacaattctatctcaaaggatacatttctttaagattattggcctctgccagaggcggtattgaagataagactttctacctattgctctcgaaatgccaactgcttttcatcaattgcttccagaatgagcattcctttcacatcagtgtgccatctgaccgaagtttaaaaggccaaggtgacaactacattgtattcctattgacaatgctc

SEQ ID NO: 50970 - DNA, 1404 bp, Bovine  19866881514776
gactcttatgaaagctgagttaattggaaagtgcttaggacagcttctgggtcataaaaagtgtcatgttacatgtgaactatgatagaaatagtagcaatagtataattatttttaaaaacagtgccttaaaatgagaaaaccaagaataaaaacatagaaatgttttcctggttaaataaaaagctatgacaataaaacaaacaaaaattttttttaagctagagtaatgtaaaggacaactttttgaattttcttcatttagccattagttaaaatattaagcacaacttactctttttaaatggtacattggaatgacattattaacaaaggaaaaaaaaaaaaaaacattcactaaacgtgttttgcatttggaaacaaaagcaccacgtcaagaatctaaataaggaagcagtggattttggaagcaagttgactccttctatgcattacctaaagtgttgcagaatcagtacagtgataaatgctcaatcacaaggcattccatcaatgtagcatgccactaaaatgaaaagcaggcatcgctttccagataaaacacacacattctgggaaaagcaaaagcaaaaatcaaggtaatgttttagcaaaggttgaactttctgtgctcaacattcatctctgctcacaatagaaactgtcataaatgtctttagcacaatccactacctgatgtaacacctatctaatggcttaatatatactaattacagttgacagtcatttaacacactgaacagtcttgtcaacatgtttagtttgtagacaaatttgaaacagtttccttcaaaccttatgtgtatgtgtctgtgtgtgtgtgtgtgtgtgtgtacatgtgcacaagcttaagagctcatgatacttttaagttagctttgttttccatagtagagctcttactgctttggtaatgacatttacagcagacttaaaagaaatcagacataatttttgacatgcattgattttcacatttgcataattactagtagaccaaatatttgatctgtagttgaaatctaaaatggtgacattttaaatttatctccatagatagtcatttcagaactaggaaataaagggtattttctaaagagaacattgtttcataattatctagcaaaatcatataccagaagtctaacattcatttctaaaaaagggtatccctacataggtcctaggttacaggcttggatcctatgacaccagtcatataaaaatagatgtatttttctattcaatgaaactgattgcaaacaaaagttgtaaacccacatagcattattcaaaacagagtagtgcctgtcaaaggccactgtcaagtctctttcagaaacccaaagacgggaaattacgaagacaaaaagttacagaata

SEQ ID NO: 50971 - DNA, 663 bp, Bovine  19866882053192
cttgctggagctgcagtttccaaacacgaacttgggattgattatgcaaaagttgaacagcttgcttccttttgcttaggctttaggaagctgttccatttgatttttagaggacatagtcaggaaatttaaaatgtctctggattctggattttttttctgtgaaaatgtgtggtttgtatgagaagacatgccctgtctcatcagtcagcattattttagacagagtatttgtttctccctgggagacacatataccaattatccagaggaattcaattctcttccagctgcttccaggtcttatttataggcttgattatctgacagaccattcctaaatacatagctagtagtcttgaaatgtcattctcctctctccaagacaaacaattttgataaacactgcatctaaagcttcagaagtaatacaaagcaaaataaatggccttgttttttttaaaaaaaaattatattttttggtaaaaatacttttgaaacataaacactcatataagaatagtggtaaatgaaactcatttattgccctaaaactgtacactgtgttcatctgtgaaagtgctcacatcctatagtaataacttattggcgcttggaatagatctttcatcttagattgtcaaactgcagttgtcagtctga

SEQ ID NO: 50972 - DNA, 1045 bp, Bovine  19866880516172
gaaatctttattaaacttcccttgttatattaccacttggtttctctctcctgactgatagaagaatccttaaattagagattatttcaatcgtgtcatcaaactggagactttaatactgccacactaatgaataagtagcattcacagacatgcctaaataacaaataaatgacaccaaatataaaactacaagttaaatttaattagtaacacacagacctcaagtatgaaacctgacaggtgggaaagagaactctatttgtctgaatttgcctaatatcacttgccccgtagtttttgtttgatgccatagtatttctatgctctaaagactgtaatccacctgcacaaattcagaaaaggttctccttcaggattaggaagtagaaagaacaaagtcccggcaccatataaccactggccagtcactgaagtgatgtaacagaggcctggggtggttatcagtgagagaactagactgcagatcatttccagggtaaactgtattttaaaatgttacaattctgtggactgaaaggactgttaactgtggactcaattttgggagccactaaagtaacttgtgctcaaagttggattctaatttgggagagcaggcaagtgcacaagacctgggtggaaatagctttacgacaatctgcacgagggaaaagtcgaataaaaagagatgataccactgtcaccgtctactcagccccctgacccagaaacatctgtggagccagggtttgtatgtgaggagagcaggaaagaaggtctcaaaggtctgtgctagagtcatgagcctgcctaaacggtttctacaatgaagcctaaggcaggagataaattctgggaccaattgtatttgtgcagaaaaaacacaggtactaaaaggactgttaacatttcacattaaaaatgtgaaatgcaaaggctcatcccagaaatgattaggaagaaaacctacccgaaaaataccaattatttaaagaattaaattttctattttgttctttaaacatacactaggtccatatga

SEQ ID NO: 50973 - DNA, 868 bp, Bovine  19866880881067
tattaaaatatagagcttaaatgagcttccagatagattgttttgcctttgggtcaatattggcacaaaatagcgtgtagacaattattttttcctagtaataaattttttcccagtaataaactttaataaagtaattgggcaaaaacttgtttctaaagtttctaatattaaagtctgcttatacactttcagtgaatgtatacattctacacagtattcctaaagagtttgatttttttttttttccaggctgctgatcaaaaaaccaaaggtgagtttactttattttggggggtatattttatgtcaatcccaaagtttatgatgatgactttttaaaaaattggtggttaaacacaaagaatctaaccctgcctttgaatctgttttttacaattcactgtgaaattcctcacttatcactggttttacatctgcatttagttagcatatgcttaatctaaaatgcctaatgttatgttgggacacgtgtctttttcagttatggcttcctaagggtatatgcccggtagtggggttggatcatgtggtaattttattcctagtttttttaaggactctcctccgtactgttctccatagtggctgtatcattttgcattcccaccaacagtgcaagaggattcccttttctccataccttctccagcttttattgtttgtagattttttgatgataaccattctgaagggtgtgaggtgatgcctcattgtagttttgatttgcatttccctaataatgagatgttgagcattgaaatatacacattaccgtaagtaaaatttggaaatttgctgtttgatacctggtggtctgtgacaacctagaggtgtggggatggag

SEQ ID NO: 50974 - DNA, 1392 bp, Bovine  19866880339923
atgtcacttccggaacagtcggccgagctaaacgttagcgattatggcaacttcccttcccaatcttttaggagaccttggtgctgacgatcaccacaggaacttagctctgttgggctcaaggggtcatctctgacataagtggaaatgggaagttatcagaatagaagccctggatcttgctatttcagcccccagaacctgccctggctgagcttggggtgtcatcagccacacttgagaccgacatagctttcccgtccctctcaaggggctcaagagctgcaggaaggacgggccggcccgacttcaatcacagttcttggtgcagagagctcagctctgctgggagccaggaggacagtggctgagctcaggccattaactctgctgggcggctctgatgctgcgcagggctaattatgaaaggtgtaaatcacggggaggaggagagcaggcacgttattcaggtttattaccaacacaatttaggaaaagataaccaggctaggcctctcttctcctttggccagccagggggagcggtgctggcaggtaggaggggagaacccactagtcctctgggtgctgtttttcttctaatttttttttttttctgagtcaaatagcacgacatcatcagatttctaagtaaaactaagaaaaatttcactcagccaagccgactgctttcctgagtttctgagcgtccatgtatcacatgcatctatgatggttacacaggtagactcaggatgtacacgggattctggggcttttcccactgaacgttattatacagcatcattcgttatgggctggagactctgatggcaggaatcatttgtttttctttttcccttaaggcattttgcaaatatgcttggaggctaagggatgctgggtacctctaataaataaagcaaaataattaatagcccaagcagcctagagaccattcctagctgctcccgaaccaggcttctgagaaccaattgttctgtttcattcccaactgacttcatcctagagacagacttcactgagaagacaatagcagagacagctttcgaaacacaaaaaggacaaaacatagacacacatcccccctagattttataggaacttcacatgggtaagaaaagacgatatttctaaaccaagtgctcttattagccacatacactcagcccattgatggttgcacttgggaagttttgtaagacccagaaaactatgagcgacataagttccggtgagacctaggccctgatcaaggcaaggcccacagcggccatccagacaacaccctgagccacagagacaggcagagaacacatgttcacaggccggggcatcctcactgtcaggctcagcccagtcctcacggcc

SEQ ID NO: 50975 - DNA, 3915 bp, Bovine  19866880391448
ctataagtctgttctctctgtcggtgtctccgctgctttcctgcaaataaattcttcggtaccatctttctagattctgtatatacaaattagtatacgatatttacttttctgtttctctcttgggtttcttaagggcacaggcttctgctgcttctgtgttcttcccacagcctcgcacctagtaggtttccataaaagacttcccacagaatgtgttgatataaatgcccttgaaacactctcccttccccctgggaagcgttgactcactggtcaccccaggtgtaatgtaggagtaatctgctccatcgtagaccctgtcaaggggatgggagcacattactcactcaacagcatttacagagtaaggcgtgttgtcactaggaagaattttcagatcacgattatccgctctgcagtgtatttggttgagaagctgcaggtttgtgtatcttaatatctgttgtgctctttgcagctaaggaaacagatgcctgcacacccgagtgctaggtaacctggacaaccaggacaaatgtcacctgtgcctgacatgaccagaggtggcctgtgaatgttttctctcgtttgtgagccagaatgtcattggattggtcactgttctagaccattctgctgctcgaaaagttaccaaggcaagagcataatgattttttagttatttagtacttcacataaccccatacattctttgcaaaaatgctttgctctcggtccccagggcatacatggagcatttcactctgaccccactttccaggagctcagatacctggcaggccactccaatgggagactacttaccgtaccggcctccagaacaaggcatgcgtgggcccaacacccacctccattggcagctgggaaggctgaggcatttttgctgaggcaggtacaagccttattttatcttctatggagaaattaatttgagtgaatttttctccttttctgagtctaaaggaaagcctggttataatttctttaacatgagaggacatcccagaggtagagcatgcacctgcatgcagtaagctgtgctctggaaaagggagattaaatggtgtgtcttggatgatagagggcacacagcatttcactggaggtatgaatttttcctctgaagactccaaaaggccaggaatattaaacctgcacccctgaaagactggatgtctgttgccacaagaggtccaaggaaacctgacatctctttgatgtcttatttgttatcttaaaaattcatgcagatcttccatctcatccacaatatgctcttgctgcttgtaacgtaacagtaccatttctccaaactactttggctgaaacgcttgtgaaacgctgtgcatacttattcagctaccccatctcatcaccgtgattccttgagtggcttaagggggtggttaggggtgggtctctggtttgagaagcttggtgaggatgtcgggggagggtttctaacatgagatgcacatgtgtactggggagggggtggattggattagatgtattttaacgctgtcatctgtgaaattggatgagactcttcatacgatgctgctgctgctgctgctaagtcgcttcagtcatgtccgactctgtgcgaccccatagacgacatttcatataggcggcctagtggcctagaaatgagctgttgagtgaagatactccacccccaccagcctgccaatttctggtaataatctccactctttcttctctgtgtgggtggggtctcagagatacgcctgttggccattggaggtggagtgatgtctcaagctggtgacatccatgtgtgtgttagttgcttagtcatgtctgactctttgtgaccccatagactgtagcccgccagactcctctgtccgtggaattctccaggcaagaaaactggagtgggttgccattcccttccccaggggatcttcctggcccaggaatcggacctgggtctcctgcattgcaggtgacatccatagttaggatgaaatccaaatgtgtacgtattcattctccaacatttttggagcacattaagggcagagaaggacctggtgctgtgggtgccaagctaagcacaggatggtacaaggagtgacaaaagagagaacctgtggtcagcaggagaacctccatacgtgtgtgaaagtctcaccctgggctcttatttaatcctcagagcactctgtgagatgtgtctttctgtgggaggagcccagctctggaagtgcactcagtaagcagaggaccctgactctgtctttccctgcttcacatcttctcctgactctggctcagcaaactgcccttcccctgacatgcacccttccttgctttacattatgtctccctgctgcagtcccaccatgatggtctgggccctggaaaggaatctgcttcctggggtcgcagatccagctctgttcagctgtgggtgtgaggggatgtccaatgtggcaggttccatgcagcccctagtgtgcttgggagagaatcagccccaaaaccctacacttgaagcagagatctcgagagtgcaagcagcagcatcagtccttccaatgaatattcaaggttgatttcctttaggatcgactggtttgatctcctggcggtccaagggattctcaagagtcttctccagcctcacaatttgagagcatcaattcttcaatgctcaaccttttttatgaatcaacacacacatgtatacgttactactggaaaaaccatagctttgactataagggtctttatcggcaaagcgatacctctgctcttcaatatgctgtctaggcttgtcataattttccttccaaggagcagtatatctagttatcaatcatgtatgtatttatccatccatccgtgtatctattgtccaactatgtgtatatccattacctattactgtccacccgtatcttcccacctacctcctctctggaaatcattgcttattattattattgcaaagtttatttttaaggtttgtcttcttttgatcttataagagtgggagtgtttccttgccctgctgcctttcatgcttaagtggggcctctatcacctctcaggcctcagccaactagggaggctgtgaggcaggaaataagcatgggcgtggggtggggggttgaggaaggtcaggcagaaggtggaagggaaatgtggaaatgtgcccgaggaccctcctggaatgatgatcaggaccgacgtgtgacacgtggcacctggctgtgccatccacggccgtcaacatccagcccctgacctgtcctgtcccatctggcccctccctccctcctcactgtcccacccacatgctgcctctttgttcttatcctccctgccctgcccatcctcacagctggtaaacgtccaagctcctcctccggggccaagggctatggttgtcatcttgaggctttctggttagagccctgggctcagcagggggccgctgtgccacgtctggagacatttttgattgtcatgacagggagatgctgccagcatcttatgggtggaggccaggaaagctccagtgcacatggcatctcccaccaacagaggatgacccaggcctggatgtcccgagttgaggttaagaaactgggccagatgagggctcctgggtctggacttagtgcccaggtttggtgcggtcatggtccttgcatccccagtgtcccccagggcacctgtccaaggggcaccctgcgtctccacagggaggggacgccgcagactgagaggtgccatgggggaagctgcaggtgctgggcagggaggcggcacaatccctggtgcttgaaaaatgaccccctccagggcccaagtccgggatcccaagaggggagacaggccagctctcaggag

SEQ ID NO: 50976 - DNA, 2070 bp, Bovine  19866880485316
tgcccctctccatgcagtttacgctggggttgtgtccactttgtcttggcttccccagtgcccggagttgccacagagagagcctcttccctctaaggaggccatttccagtagcatgatgccacctatagaatgtacctggaattagtcccagctgtggctatgcctccagcagcctggtgctgtactggaactggagagaagataatgctccctccttgtccccgattgaggttcggactggagaggtagtcttgtcacccagcgcttcctccaggactcttcctcttgccttcttgaaccccccagctgtttagtagttctgtgcctggcatcatttgagaaactgagaccagaacctggaatggctggagcaggaattcccagctctccccaggagtccctgtgatttcccaacagtcacaagctccagggttgtgtgctggctgaggcatcagtggtcagccgtcaacggtgaacaagtattttctaaaggttttggaagcccaataaacctgatcacatgaccccaaatgtacagaaggggaaactagacaggctactctaaggctgcctgatccaaatgacccttttacaggacaaactgaagtcaagaagggaaaagaaaaatgacttatccaaggcatctcagccagtcaggggtggagcaagtacaggtctgaatccaatttttttttttaattccccatccactgctgtttggattatccaggcacgtctcggcacaagcttccatgtttgcatggcttggtggtcctggaaccctggagctggtgcatgaagtcccatgatggctgcccaactggctttacctgggccttggaactgaatgcctttggtggcagccagtagctcttcctgggtggctggggaggagggaggggggccagaggcaggaaacctctcttggaccctgacctcaggctgtttcgctgcttgtctgggcagagtctgggaagtccaagggtcagtgaccccaactgcaccccagatgactctgttacgccaaacaccatgacttggagcagcagtggggcgtgtctagcttcctgctgtgcttggttccagtaccatgacacctcctcttaggcaccgcaactcctgggtgacagacctaagtcagccctgtcctcagcttaacttggtcaccagtaagttacttagccccactgaacttgtttccccatatttaaatgtgattactgaagtctccctctaaggactgtgatgaagaatagaagagtttggaagcttctagctagagcttggcatggagcaagcagccattgctcagcagatggaagctacatctatccactcccaccactcctgcacaccctcttgtgccaggttaggcacaaggctctgctagacaaatgaccataaagcttcatgtacatttgggcccatgtagaaacatgggaaactccatgtagaaactcccaagcgctctccagcgggctcccttgggcagctaatttgtgggtgtcagctccaacttccaccctatccttggataaatttctccagtcagtactctccagttctagcctggctccatcctctgctgcaacccagaatccagcaatctagccttggctggcttccctgaacatccctaggagctctccggtgtagactgcaccaggatctttctctctggggaacagaagtgcctgaacccacagaggctggaagaagcactaccttactgtaggaaattgagtctgggacctctttactcatcttagaaaaacagcacgtgtgtgtgtgtgtgtgtgtgtgtgtgtgtgtgtgtgtggtcttgccttcctgggatccaaattactctccatgtgggtccactagaggtacctatcagagcaacaaaatgggaaagaccctgccaatttggcagttgggaatactgatttttcagagaggaggaagtctgctcatcttgtggggcaaaggctgaaggcactttcctggattcccctgagctggaaacttgggctggacagcgggtgaaagcatcagctggagggagcagcaggattagcctacagg

SEQ ID NO: 50977 - DNA, 1630 bp, Bovine  19866880544610
actcctgggactcgggacagccacagaactggagtgtccctccaacagcccagagggactggtaactccaggctctggtgtggagggccaggaaagaactctccatctccatctgtgcagaggctaagagcttccttcccccatttcgaaacagtggatttaagcacaaagggtgcacaggatcaatgatttccatgtccccagcatcccaggcctgcttcacaacctgctcggtcctcatcccacactctgggctgcaggaagggatgaaaccaccaagcctgacctgagggctgtgttcccacccacactcaagggggcctgggggaaatcccccccaccaggcagcttcctgaagaagacaatgccccacttccctccctgcagtcggggggctcccgcctcccagcagccctctcacagcagccctgtatacatgaatgccctcttccattgcaaacacagctaattccccttcgaccgtcctgcctcccctccgtgagtcaaatgtcacttggtgtgcttcccagatggggaaattagggcaaacagggaagtgatgcaggagcttgctaacttcagagagatcagccagctctccccgggcctggaccccaaaccttcttctcccagcccgtgaccccacgttccctgcaccggactcacctgggtggtgttcccccagcccctgcagcccctctgggggatgcacacagacattgttcttggagtagatgatctccccatccaggacggaggggggcccgctgccgccgccaccacctggggtaagggtcaaggaggtccgaggctttggaggaggcccggcgaaggaggcggcccagagacattgccgaggcagtgtttccatcctccgcacacttgggcccagatggggctcttccagacctgccttgggggaaggaagagagaggacaggcatggcccaaggtcatcaacatggacggggcattcctggggcagcatcgtgtcccacaccagtaagcgtaaacggaagctatgcaaccacggaaggggtcctgctagcacaaggccatacagaggaaatgggttctcaactgtggtgtgacggacactcggggctgggccattcttagtggtggtggctgtcctgtgccttgtagggtgttttacagcatccgtggcctcgactcaccagattccactagcacccgtttccactatgacaaccaaaaatgtctccagcattgcaaatatccttcgaaggcaaaatcaccccatgaagaaccagtctagggaattccctggcagtgaagtggttagaactgggcactttcactgctgtgggcccaagttcaatctctggttgggaactaagatcccacaagcccaaagtgtccacctcctacaaaaggactggtctagaggaacctgttggagaaggcaatggcaacccactccagtactcttgcctggaaaatcccatggacggaggaggctggtgggcctgcggtccatggggtcgctgagtcggacacgactgagcaactttactttcacttttcactttcatacactggagaaggaaatggcaacccactccagtgttcttgcctggagaatcgaagggacggggggagccttggtg

SEQ ID NO: 50978 - DNA, 665 bp, Bovine  19866880549588
cagaatgtgatggtaatggggggaggggtttggccaatccacgactccattcagctcacacgggcgatttttccctctgccttccacgtgcagacatttccacctccttcccgatcagacatctctaaggcgattagaagactccccgtcaggacaccccactggtcggtggggctgtgggggtccccaggccctccctccaagccccacggtcccagctcccgcccccagagcccatgtgtcctctgggctccagtcctgtggtacagggcagatggccctgccgcctgctgggaggcgggcttctgtccagagtgattccttcctctcctcctcccgacttcccccctctttcattctgccccactcccaccctctccctgcatttcggggtctcggggccaaggccgagtgcgtgtgcacacgtgcgtgctcgtcggcggtgaagccgtgtgcacttgtttatttatttcgagaagcagaggaagttgaggtgttgctggttcttaccatttcatcttgatttagtcatttttatatggctcgcaaggcacatgcagatttctgtttctttatttgttcattaaaacttcaataaaaatgttataaaaatgtcttattttggtagttaattgccatttccatcttaatatgcacgcagtgtc

SEQ ID NO: 50979 - DNA, 1403 bp, Bovine  19866880572241
gctgagccaccctatgggtaggacgtccagacctaccccaggagggccggcaggcttcttgggaggctgactcccaaccctgccagagaggggagccccggccctccaggatccagccctcgctctccacagtggccctccccctacccactgcctggactggcaagcaggcaatacgctgggaagggcgaggagcccggctgctgctggcagccagccaccctccccgcccccaccccccacgctgctcatttctatgcactgtgagccccaccagatcctatgaccttggcatttgggggtcacaggagaaggacaccgtgcgtgcacagcgcctccatccaacacatcaattaacattcctcgtgcaaaagttggggctgtaattacagcaagtgattaacaggccgaggtagcctgtctccgagggagcagattaacagcagaggttgggagcgccggcgctcacctcggaatcaccggtgcgtcttaaacaggggccccagtgccctgaaagctggtgattaatggaggggatgagaatggggacgtttccctggcacccatcgccgggctttttgctcttggcggtcaccgtgctggccaggtgcagggaaagggagggcgggctggccttgaggaaaacaccagagctccaggggagggggcaggccttgttctgcctgccccaggcctccgggccctcctggctgcagcttcccactgagctagaaggccaagtccacagggtccgtgaacaccgggagactcagccccttcaccaaaccgtgtggaatctgggaccacccctcacctgctgttccccagggaacatgcagggctctgctaagaggcggaggctgccgccaggacggtggccatcccagcaaagatgcccaggccaagcataacacctgcttagctggctgagggagtgaaggagccagagtgggggtacctcctgaggatgaagagggaaagagcggggaagacaccccagcaaactaggtgtttacaggtgcatgggtgtcagcacatccaggtgaatcagcacacacgtgtgtgtgtatgtatgtgtgtgtgtgcacagcgggctgacgtttcctattcttccagggttagaccacccctgttcccatgtgtggtgctgggcacaggcatttagggactaagtcctgcccaagaggctcttggtctcgcagggaagatggtcacagaaacctgataaatacccgagggctcggagggtgaggcttgccgagagcccagggctgtcccgggtctgtctgaggggatgggggcaggaagggagaaagagagaggcaacccgagatgaactgtgaagtcagctggggatttatccatcaagtggcagatgccaggcacacatcaccacgaatgtg

SEQ ID NO: 50980 - DNA, 1085 bp, Bovine  19866880606782
ccactaccaggtgagccaggcgggcacgcctggcatacgagcagggcaggatgcccgcataaccgggcacctcctctggggtccccttgctccaccatgcttggccccccacagaccacattcagcccctcacacggcaactgccttctagtcccacgtggccagcctccgaccctcaactcgcctcccaagtaactgaaatcgatgcaaattgcccactgactgcactcattaccacgttctggggttgagcacgctcctgtcacaaccaatcagcatgaaagacattgcgggacaagcaggacgctggtgcccacatgccggacccagcgcccacccgcctgccctcctcgggatggctcagggaaagggccctgagatcctgcttccctgccagcccctctgagagcccgggcaccgcccactgtcgcctcgcagggacgtgatttccccttgccatccttcattatcagcatctcctcaacaaattcccctgagagcctctcgctggccctgtcacacggctttaacgcccaaattagcaacaagcaggccatgttaaaggataggcaagtctctctgaatccatcagccttaaaaaaaaaaaaaaatagtattgacgcatccaagaggtggccgggaccatttctgcaagagcagcctccatccttcctacggcagctggcgcagcttggattagacaaaccttgctgatagatgtgcacgcccaccagccctcagaaatgtgcatcagcgtctgccctccttactagtgttgaagaaggattatgtctgatagaagtgagtctgaagaagcctgctgctggtgccacgggctgttttgtattcatccatcctcgcccacctcctcctgctccctcccggcccaggtctgggctgcatttcctgtatggattagcctgctccgtgtgtactgcagggtggaatctaggaagcactggcaaggatggtccaaaacactggatcacatttaaaagaaaaaaaaaattgtgtccgctttgcacaaagcctcattgcatcttttctagcagcaaatttgccaccttcgagacagcacatttagg

SEQ ID NO: 50981 - DNA, 1608 bp, Bovine  19866880622200
atgtcattgagcagcagctggccaccgaccgatgcttctgcactttggaaacctggccatgcacatgaatggggagcttgttctcaggaaggtgagtgtggctcccccacatgcagccctgccctcccttacacagagccccacctctacttccagagctccacccctacaggggcccctataagctccaccccccacatttatcaattcctgcccacatgcagagccccgcccccaccctccatcctgggagctccccaccaaggtcagaatgtctggcagctgctcagggcgcccatcaggctgacaaaagaggcccctctcctcatggaaggaacagattacccattttgacagacaggtcctccactgtgaggtacctcactcatagcccagagctgggaaaactaagcaggaggcttagggaggggaggtggccaaactttcatccaaggttagtgggataaatggggcttttgccacctcccctacttcccaggcttctgctggagacaccacttcttaaagctttctggtgttttccaggggcagcgaggagggcctggggtcaggggtggagtgggcaggaagaggcttgaagaagtccttcagggcagagaggtggagccatggggccaggctgagccagggagggccagggtgggccctgttccacttttggctgccctgttcaccttgcatatgactgttgggggagccgtccttgggtcaagccggatgggagcgcagcttgtgaaactttatagcccctgccttcagctggatcaggatgtcaaaagggatgaggcaggcggagccctggccctgacctggcacaaggagcaacctcgggtgctggctattgttgctcttggatcactagctgcccactgtccctcatcaccactgtcctctctgtttgcaggcgaggagtttgctgtaccagtttcgcctcttgccacggatcccctgtagcctgcacgacttgtgcaagctgtgtgggactggcatgtgggacagcggttacatgcctgccgtggagtgcacgggccagcacccagggtcggaaagctgcccgtatgggggcaccgtggagatgccttcccccaagccccccagagaaggcaggaagggcccaaagacgccccgagaaggcttcagtttccgcagataggttgggctccctgcgctggacaaggggtgaggggacctctgccaggtcccaggcatgggggagggggtggggatgggtgtggaggggacaggatggtagaaatggaaggaaaatgcccttgagcaacatgaagggaaacttatattaaggacaaaattggagtccggaagtgccagaagtaaaacccaccagctgcccagagaaaagttggctccccaaacagcgggaccaggatgtatgaccaccctacctggagacgcaggcttgctgggttctcatgttgcccacctttgatggatctcaacacaacccaggagttcttccagtttcatcagccaccaaagggtattattgccaggcactgggaaaggcagaaacagagacagaaggagagagacagcactgggaagcccagaacaagggggtcccatcca

SEQ ID NO: 50982 - DNA, 755 bp, Bovine  19866880646519
tgggttattttaaattttcttctttttgcataagtgtagtttctaaattttctgcagtgaatatgtattccttttataataaggacaagatcacagatcatgccaaaggctgttcagattctctgaccacaaggggcccaggttgctcctcctgtgctggacagctcccatgctcagcctggggttgcccaccacaagcttccctcccaacactcctgggactctgggctgggcaaagctgacgctggtttaccctagtgctgaagtgacttggcgacccctccctgacaggtgggtttatcaccaccctccttgatgggcctctagtcctctactgtacccacgccagccaatggttgtgctggtggcatagctggttaagtccagggtatggctggggcatggcctcaggaggatttctgaagcctgaacagtccccccagcaccttccaccgccagttctggaggcaggcttggcccccagcacccactgcagctggggaagatggacagttcagcctgtcccatccccagggtggtcctacaagaaaagcaaaggacagagcttgcatggtagagaaggccaaagcccagctaccccaccaactagctcttcatcgactctctgagcctcagcctccttaacctacaaaatgaggatgatgctgtgaaaatgagatgaaaaacgaggttcaaggaccttgggtggggcttaaacagggcgggtactagcatatatgcctcctctttctcac

SEQ ID NO: 50983 - DNA, 1623 bp, Bovine  19866880692603
tccccagcccctaggcattgacttctcttactgcagaggagggtccatttccccacccttagatgctgagtctggccaggtgactggctttggccaatgggatggtaagcaggggtagcatctgtcaaggcttgggaaggtgcctacacacttctgattctgcacctttgccttggccgggactggcttgtgggaaggatgcaagaggcatggagcagagccacatctgacctctacatacctctacatgtgtgagcaccctgttggaacttagtagtccaacccagaccagaaccacccagccagagctgctgccccacagacttgcgggctagctaagtgcatgctatttgaggccgccatgtttgggggctatttgttatgcagcattactgtggcaatgggtaattgatacgcctgttcatggagatgtggtctctagaggagggtcaacatagtgcctggtaactcaagtcacctccataacggatcaggagccatcctctggatggaaaggcaatcctcttttcccagaagctgagcagatgagaagtctatgcagcctggaccctgctgctggactataatggttggtactccaagatctgggcactgatggggctccaggacagtctccccaaaaggctcttggaccgaggtgtcaggaacctggaagttccagtgtcagtcttctgcccactggaggacatggactcatagagaagctgagaagggaagaggctgataacttcctctttcctgttgataaacaactttttaaagtggcgccatccagcagcgtccactctaagtgagaaaagctaggggcaggaagaagccttggttgggctgtgtctctgtgatgactctagcacttcaaggattttcctccccaggatgttcaggaggattctaggaacgattccaggctccttgttcctgtcagttcaagagggcagctttccgtgtccttgtctgtcctcctctaaaccccagaaggagcaactggggaggctctgggagcaggaagagtgtgctgggaagacctggttcccacacagaaagcagggttgccctgagtgacggctattgtactgtggtcgctcccgcatctgaccaccagagacgctgacttacagaagactggcggtcacggcagaacgcagaccccgcagggaagtgggagtgtttctggcactttcagctgcctttgtcttgttggtcagttcacatgtgccccttccctcaaacattacagattcccttcagagaattttgtgtgcacacacacacatacacacctcgacccatccaaccccaagttggtcacagtatttggtgaaaatggccttcaacattgccaaatgtagacgattcttcaactaagggagaagaatccgacacttcaacagcccgtgctcaggctcacgggcagcagattccttcacataccaagatggtcgggtgttgaaacagacagtatgaaagcccccagcctcctgctcttacacctctctaccctgaaatcagtggggcctttttttttttggcagatgtcttcacatcagctttgcagctgtggctggagaagctgtggaatctgttgatttattcaaagaatga

SEQ ID NO: 50984 - DNA, 2341 bp, Bovine  19866880732651
ggcccaaggacactgaaaagtctggagggaggaggctgtcatctggacacctgccttccgttggcaccaaatatctgagtgcccaaaaagtttgctctattgcatctgtcactggcagcccaacagcctcagagaaaccccgtctggtggtaggatgggtcccagcaacccagggaatatatttaaacccttgcaagggctcgtgttttgttgggtccccatgagatctttctggatccttggagatgcctcagggaggatgtgttggatgttgccattcgacagctcacctgtgaaagtgatgacagggtgctccagagagaattgatctgggcacagaggcttgtcattgaatatgtttagtggtgaagtcgggcagggttcagttcagttcaattgctcaattatgtccaactctttgtgaccccatggactgcagcacaccaggcttccctgtctattaccaattcttagagcctactaagactcatgtccatcgagccagtgatgccatccaaccatctcatcctctgtcatccccttctcttcctgccttcaatcttttccagcatcagggtcttttccagtgagtcagttcttggcatcaggtggccaaagtattggagttcagcttcagcatcagtcctttcaatgaatattcaggactgatttcctttaggatggactggttggatctccttgcagtccaagggactctcaagagtcttttccaactccacagttcaaaagcatcaattcttcagcactcagctttatagttgggttcatctcaagtgttaattgaggtagacagaaagtgtgatgggtgcaagggtgcctggagggtgcctgggccatactggggggtcctggttccatctaaagcttgctggacaactgtgatccatcgctggggtaatgtgtctataattcccaactcaaggagttccagcctccgtcccctgggtgtcagccccgcctggtttttgcccatttctcactcagagcatcatctcgccgccccgactgcttagagcggccggccccaggaccgcaggctgcaaggcgctgaaagacttggatgtggtcccagaggctccaggcagccctggcggtgtggggggtgggcacaggcaagcagctgcgtcccaggtggggagggggcagctcggggccgtggtcagcacgtccaggtgaggggtcctcattgtgaatgcacagcttgtcagcgccatctcgggagccttggataaagtgtgcccgtgaagaagataattgaaaatcaaaaaagactttgttaatttgattaggcagagccgtcgttgaattgttcttcatcaaaagagatttaattttgacatgcaattaaattcttctgctctaagatctgccccaagtgcgggagatgggcttggcagctggtggaggggcgcgaggagaggagggtgttgctaaggattgttaggtgggggggaagtgagccggggggtggttactgatgctgaggatttgggagaaagacagaaatgatggcaatggggtcctaggaggaagggcagagctgcggcagtggagggagccgagacgcagaggggcttagactgagggtgaggggcgaatttgagaagagaagcagaacgacagagcaggggactcgggacagtggggagctttaccaagaggaggaagggggaggccacacccaagtctcaaggaaccattctgtaattctcaggagggtaggaagcctggttatgactgggagccgggaggcttcttggtggcttgaaatcaggaaatatcctggggttgaccctggatctggaagtctatcttagagggaagcaagagttccatcagggattagagggtctgagccgtgtgaccgtagcctccaaggatgcccccagggttcaatggggcattggagggtctgagtcgtgtgaccccagcccccgagggcactcccagagcagcgatggagcccatgtccagctcctgatcccccaccccagacagtgaccccctgctcgcacaccccatgtttttattcatctatctaaaagcaaggatgtgggtctcttcaattaaaatgatagtggtgtttgctttaaaaaagtcactgatatttcttgaggaaaatctggaaaactgagaaaagtataaataaagatggagcaacatgaagctcccttaagtgacttgtgaggatttaggacgataagcacaaagtccagttagagctcaggcctgtctcgacttcatctcagtcccccctgctgcccatactcccatgtttgtcccgaggccacgagaggactcggtggtcctggctgtggct

SEQ ID NO: 50985 - DNA, 1347 bp, Bovine  19866880759633
gtaggttgaaatcaccccgggctcattggcagagcctttgagaactcacctgggtgcaggctctgagactctaatcaaagaccctgcatatcgggaagtgccccctcctgccaggaccctgccattcattctctgagagggtgagccagggacccttgcgatgatgtacagctcagcagtaggaccagctctcgagagtcctggagtcaggtcttaactgggacaagattgggctgtggctgaaaacagcagaattcagcttgttcttctgtggcttttatttatttctatttatcttaaacacacacacacacacacaaaacacagagctacaattctacctgctccagcctgggagctcacctatgaccttttcacctggaaaaagccttctgttcttgacaagccccctcatctcagtcactcatttttcccaccactcagttgaccatgcacacatggagggcaggaccctatctcgcactgggcagtcgggaaaagcattctgcaggaggttgaatgtgcactgagctggatcttttagagggcctggaaggtggtcaggtgaggaaagagggtgggagggctctgtattgtggaggcaaagtgggcagcaagtgcagcacgccctccacgtgtgtgtggagcaaagagaggacgaggtcggattggtgagcagggcaagcacccctttttaatataaaacctcataggcctgttgccctaggagatggctgttctctgcagagcatttggggcactgggctgcccccgtgcaggccaccctgtccatcacagcggatgtgatggagggcctgtctctggaccagtgtgtccaacagatggtgccatcacaaagatgttctgtggctgaaaggtggccaatgtgcctgaggacctgaattttaaactattttatttaaattcatttacttttaagtggccactgttttaactagcttggctctggaggtgaactgcccagacagcctcagggtctcacgctgcctgacctcactgaccgctggctgagagcagctgtggccgagaccctcatgttctaaaagctttgttgtgaagcctgagccatgggagggggcgtgtatcgctctccagcctgagacattttgcttcacctgtgaaaacagcatccacttgatgaatggccagtgactgcactttgtgaaattaaattcttggcttggacagagcagcatggggataaccatggctgcccccgcaacagggacaggacagcagggcactaggcagcaaagggctcagaatcctggccctggcagctgccacatgagggcaaggcaggcagatagctacatcagcaggtgt

SEQ ID NO: 50986 - DNA, 1020 bp, Bovine  19866880859261
gagcctgcaggtggggcatctggacacagctgggaacactttcaatgtgtttttgaagacataggaaaagactctgtgagttgggagagtatccttctcgaaactccggttctggcctcttctgccaaggtcgcacctgagcacattgaggctgctgtttgagggtcctcaagctgttccggcacagacacggatcccttcacacccagtctgggacagagtcttgtcacggagacccacggttggctaatgaggtcttcaggcccttcggggagctcccccaggcgtgtgtaaacccccctgagaacaggtgatgcagagcccccacgaggcccagcagctaaccaaagctctgggcgcctgtctgattctgaaccccaagttccagtcttttcctggcagggcacctggcaagtccccaggagcccccaggccatcctggctccgattccacaaggagcactctttacatgtcggggcaggaacccgccatccgggtgggattcctccagggaagtgtgttccttcagcaatgaaatttcatcagcagcaattaattctctgtcacgagagcccatgaatttgtgccagaagggggaggaaaagcaactgaatctttgatcaaacaagtctgtgtgctgaaggctgggtgcagttaactacatctcaccagtgtatggctgccggctgggacagggggcgggggtgctctcgctccttccaggccacttgggggaggggtggccaccacatggccagagacgctagcccttccaggccaccgctgtcctggggaggacgctgaggactgggctttagagaggggaggggcgagggacagcctgcaggccctgggcggctctgggacttggtgcctctactccgttcccggcctctcccgtgtaggggcctcacgatgaatggtaacgatcagatactggggtccagggctccagtgaagactggtattgattctgtactctgagtgtgagtgtgtatgtgtgtgagagagagagaggg

SEQ ID NO: 50987 - DNA, 1732 bp, Bovine  19866880926320
cgcctctgggcctcagttttccccactggaagaacccttaaggatcatgggaagaatggctcctttcatctcttccttttgttccgtcatagagggggcgatggcctggggggaatctggtcttcaggccgacagacggattagcctcctgcctggccaggtccctaggtagcttgtgacccctgggcagccctggcctgaggcaatggtcagggaagccagccagccagctgggccagcctgctctgggcagggctgagcaggactccagaagcccggatgctctgcagggttgggtgtccagcagcacagaggctcatagggagagcagctcagaagatgctgaggcaggccaggtgtggggcagacacacacacatggggtccctggcacccccacccgccgccagcccctgcacagcactcgacttctgacctggcagcagcaatgcctcatctcaacttggcctcaatccagggcccagagccagcagctccccctcccagacttggggctggggtctcgggggcaggtctcacctctgttgctaacatcttccatcttcccacctctgaagccaagagaaaccttttgagaaaacaaacagtggtccttttttccccactctctctgtttttctcaacctcagagaaggtctccccttccccacccagtatccgtgagatcgatcaggtggaaggttttgcctccccaccccggcaccatgggagcctcccttagaccccacgtgggagtgcgggcgtccagatggggaagctcagctctgagcacagagctgggcagcaggagtgactggactggacactgctgggcaggacccagcagatgggcaagcccagagcaggcgctgagctgaacaacctgggaaggaaacccgggagaccaggcaagggagaggacaggcagcgggagcagagagcagagcagcactgaagacagctgcgagtgcgagtgcctgctcaacccagagcccgcgtggggaccacagcccccatccccagcctgctgccctgcccgccgctgcggctgccccactggggtctcctccccgagcctgcgtggagcctcggttccaaaatgatgatgtgtttttgggtatgtaccaagcgcagactgccgagttgctttttcggctccgggcagatccagggttgaaatgagaaagcagcctgcccagcacggcccctgaaagtgccccctcgcgcctgtccccagctggcaccacagctctcccccagggcccagccagcacggcgctggggtcaggagtgtccctagacaggaagtgcagccggccggagagccagactcccctcggtggcctccatgggctaggcggaagttctgaaaggccctgcatggggtgcgctgtcctatcccttccctcttgccagtccttgcaggaacctgcttcagatcccccagtgaaaacgtcaggtggctcccaagaccacggacacacccgcccagccctgcctctcctccactcccttcctccctgccccccacctgagtcacaatatcagcaacagacactggaccctggagagactggtgggcacgctcaatgtgagctggagccgacagccccagagctctgggtccccaaaccccaaagctgggagggcccagagagaggacaagccccaacccgaagaccccttccctcctccctggctagccccgggcctctcggcaaaggaaatgacag

SEQ ID NO: 50988 - DNA, 731 bp, Bovine  19866880947263
ggaaggtttagtcctagggaaggggagagaaggaagagggaagtcccagccccccagcccaggctgtgtgtccttcacaaccccctggggtggcatgaagtgaaggcactctggcacccatgggatggcatgcaggtgtcctccacactcagtgagcagagcggggacacaggcccttgctctcagccccagagacgcagggggcagtggggaactcacccgctctcgctctccaggaacacggagctgctgctctccgcgagggcggtgctgataggtgagaggcagaagggcgaagagaaggcctctgagtccgagtcgaaggaactggccctgctcacaccctcagccgacagctccaaggaaccctcctcttcgcccacctcgggctggggctcccggccttcttccgtcccgtcttgcgaactgactgctgacaagattcctgagtcgctgtgggccggcggcaaggccgggagggggccgtctgtccccaagcccggggccagcttctccccgtcctcgggcgaagggctgacacactcggtgtctcgaatgctctgggccaccaccaggatgtcctcgtctctggggatcagggtggacctgggctccgtgggggatggctggtggggggcccctgagctctgggcacgccggccccgagggcggggtgccttgcgcacgggggaactctcgggggtgatatagcgcagcgcctcctcgtcctg

SEQ ID NO: 50989 - DNA, 703 bp, Bovine  19866880959041
cacgacagacaggtgtagtcctcacatgacttgctccaccagctccccctccagcatggatgcccacctgcagttcccggacggcagcggcctcctacagccccagcgctgggatgagccgcagagggctggcgccctggagcagatctgtggtgtgttccgagtggatttgggccagatgcgctccctccgcctcttcttcaggtgaggccctcttggccatgtccaggaagctgcctgtgcacctgccgtgtccccggggggccatgcttgggtctaggagcctgacattcccaactgtctgcttcccaacatcactagtgccctgtaggcagtgccccacaatggctgccccgcaggagcctggtctgggtagctcccaaactgtttcctctgccttcagcgtgatagtagcagctgttgcttgcgctctggtttgggggaagatgacaaactagggctacagagagagcagtgcttgcagggagctcccggtcacccaatcagaggcccaaccactcagtgcatactcaggataggctatggctttctagagggaggcactattttcttcatgatgggggaccatccctttcagttccccacctaatggctacctcatgtctctcttcctgaaagctgcaagacagcaccagccaaagaccagtgcttcaaagaagcaattgtgcctctgggggcattc

SEQ ID NO: 50990 - DNA, 1177 bp, Bovine  19866881008359
ggtgccctgagcacatgacactacctgtccactgctccacgcggatgcagccaggcagcctgggggtgaccttcagagccgcctaccctgccccacgccacatccacagagccgggcacacaggtgcactgccaggtaacatccgggcctccacctctcagctccaggccacagtccctgccatgcccacttctcaccaggtgggtctatgcctcttccctggtgtcctatcatggaactagcacctgcctctgaccctgcctgccactcctccaggctcccaccccaaggactcacaagaaggctgtttgtggagcccgcctcccctggaatggactctgctcgtggagactggtggctggacctgggggtgggggtatttttccaacacctcctcgattgacctttaattacactgtttgcccagctccccaaaccattaacttccacctcacagcaattgcacatcaattaatggagggcctgctctgagctccagctcctcaacacaattaagcgtgacagtccacaaataagaaagaactgaagaattaattaaggtctaaacaaattaattaccagtccccaatcaattccaatgccagcacacatgctcctgggctcaccggctttcctaacatctccacatataaatagaaagtgagatttcccacatgattgctgttctagaccagggcacggcgaggccccgaaaccaccttgagggagagaattggctgcagtgagtgtccttggggcttcccacgtactcagcacacactcacgcacacacatcagtcacacacatgtgtgcacagccctagctgaaaaatgaggggagaactggtggagtgctccaggtggcagagtgctccaggtggcagagtgctcctggtggcagagtgtctggggcttggcacacccagggaagacctgaggtgactgtcacggaggcccccacggggaagggccgaagctctggcctgatgccagagaggggtgggtgcggcatgaatcaggcgtcctgtgcccagtctcgaacctctctcctgggcagcagtggggcgcctccggacttcaaggtggatcaggacagggcaaagcagtggaaagaagcagctggccccaagagcttccttgctccccagagcctgagtccccagcccacccagggaga

SEQ ID NO: 50991 - DNA, 1203 bp, Bovine  19866881030155
ttaaaaatatctgttttatctaatacaaaggctgtggccagattaggcaagtgtcaaaatgctctgtgaattctgaaatggaaagaagtgaactctgaagtagaaattaaggggctgtttgtctgtgtgtaggggttttttcttgggagctggggcccagggtggtcagttcacttcctcactacagggccctctgagggggtgggagcccactggagacgagtcaggggctgtcctgatggaggggctctgggtggggggtcagccttagaggccagtgagaagttccctgtacatctctgccttgtcgtctgggccttcaggcagcaggctggggaggaccagatagacctgggccagaggccctgtcacacaccaccacggactgtagttctctcacctgtaaagcaggaataaggttcctgtgaatcaatgtacagaaggcatccagctcaggacctgaccatactcccttcctttccctgtgcacataaatatcaaaccacacagcctaccaggaagatccagatctttgctgcaccctctgcatgattcctggtggtcagaaaatctcaagtaggtccatgcaggggctgagaaagaagagacatactggattcttctatcttctcaacaccagttgcaagaaatcaggagccaaggtgagacagggaaccctgggaaacgtgaccagaaacctgccttgccaggcaaagggtccatccaccagtggctcccaccctgacatcctgatacccttgtccccagcacctttgacagccttgttctgggaagaaagcaccccagaaatatgtaatctcacctcttgccagttcttaacctgggcttttcagcaggaggagaagatgcctgattagaatatctctgaagagggcagtgagttatagtaatggacactcttctagctgtctctcccgctcataaatctatccccctctgaaagtgcagatggtccataatcgtccatcacgcccggagttcagcaccggacagctcccgggtggggtttttcctaggaggctcctttttctgcaagctaaacggaactgcagctccgcacagcctctccccatgatggagtgcaagcggtccagccatcaggaatgatttaggggagaatgaacaataaatatccaagaggttggagctcagagcagggaggcaaagaaggcgcctctgcag

SEQ ID NO: 50992 - DNA, 1517 bp, Bovine  19866881038289
tggtaaacatgacaacgaactctgagcatctgtctaactcttcagcgaaggctgtcacgcctgcacgcatgtatacacacactcacacttagagacatgaaccacttgggctcacaagcaccaagaaaaaacatgcaacacaggaagaaggcaaagtggctgggagtaagatgtttgcagattcaaactttgggattgaagtagctggtaaacagaaaagcacccagtcggggtttgaagacctggcggctggagctgtgtggttagtccagaacaggggtgccctgaaggcatgaaggggagagccgctgctggcctggctctgcagcctctaaggcagcacaacttgaaggttatgagctcctctgatggggaggcagcccgagagtccctttagtcacacccaggggcatccggggacaggaatgaggctggtgccaggggcccagtgtgctggcacccctttcttccagacagggcagtgcactggcatctctccatctcctgctggggtagtggagggagcattcttcccctttatggcccactttccagttttagcctggctgtctgggacccccagcccttgggtctgcccaagtgggcaccattccaattgcagatagcatggctatcacacacgagtcggaaactgcatctggacacccctcaaccaggtcttggatgtggatctgtccccaaaggcacactgttgaaattgatttggctacacaaaagccgtatcttcctatttggcgtggagggtgagggactgggggggctggagttctgggaggcctaccctcagacactagagcccactgtgtcccctgccctcagggttatgggaacaacagaagactctacacctgctggctgatgttaaccggtaattgaagcagaaataaagttccctgcattcccacttctctttttggcatcaaagaccagtgactccactcactgatgcacctctctgccccaagtcagtaacagcaattctgttgttggctggaattgccaagactgcttctggactcagccatctcgggggaggcagttggtctggcagctccagcctttctggagaccctctgccaggtggaccactcagatttgtcccacttcccaaatggtacggagaaacagctgctcagctgggaaagagaatatggaacccccagaggtgcaggggtgggggggattgtcaggggaggtaggtgggaagtgcaggaagccagccaaggggaagggaagcagactaccagcaactgcccacatggcccagtttgcggggccacgattaggactaaggcagtccttgcaccgggtggcagaaaggagggcagtggaagtatgcccttctccttctgtcccccgagcttgggaggtttgggcgaacagctctgggaccagccccctccctgcccgtgttggactctgggtcaacatgtgggggctgcagctgttaatctgaatcagggtgagacggcacccacacctacctctctagggtt

SEQ ID NO: 50993 - DNA, 820 bp, Bovine  19866881110676
ctctccctgtgcagctcacctggggtcctgtccccaccaggggctcctccgccctccatgccccccacgcccactctggcaggagcctgcacagccactccaggaatcgttcatacccttcagcggcaagcaaacaaactccccgctccatttatttcacaagtctcccgatttaattaggttttccagttttctgcctgtcctgggccagtcactccttggagcagaggagaattcatttgcacctgctgtcagaaagcggctctccccagttagaaaaataattaagccatcatcacacatcaggggtaatgaatcaccatttctcactcagttcgcaggtcgtttgtttcccctgcactggcgaaggaggtgcagactaaatttgagcagctgccaaatggatccccctccccttgcccccacccttccctctcctctctccccagagaccctgctttctccttgattggtgcccccggcccggcagcctctgaggacacagggctctcccagggcctctagcctgggcttcaggtggcaggccacgaaatcacctgcttctgctttttctcaggcacctgactcacaggtggccactacctgggtagcctgggaggtgtcacctgaatgagacctgtatgagtttcctagggctgtcttaactaatgtccccaaactgggcggcttaaaactacagaaatatatcatatcatggttctggaggccagaagtctgaaatcaggtgtcagtggggcttcagaggcaggtccttcctgccccttccggttcctggggttgcccggctgtccttggcttt

SEQ ID NO: 50994 - DNA, 974 bp, Bovine  19866881155445
ggacagttcccgtgcgctgtgcttcctacgcacgcgtgctcactcgctcagtcgtgactcttttgtgaccccacggactgtagcccaccaggctcttctgtccatagtatttcccaggcaagaatattcgagtgggttcccatttcctcctccaggggatcctcccgatccagagatcaaacccatgtctcctgcatcccctgcgttggcagatggattctttgctactgagtcacctgggagcccagccccctccacagccccaccctaactgtggctgtacagttgaggaaatgcaactacctgtcgcccaaaggtccttcagctatggaagccagcatcaccctcagcctcttccttggttcatgctttgctctgcacctgccatctgcctgctttgcattcctgatgaaccaggagttatttaaggataggacttgtgccatggtgctcccagagctgtatggttaccaagcttctgatttccctagactttgtggttgcccctggcatcctgaaaaccccccagtaggtgagggagataagaaggaagcatacaagtggcccttttggttgaaaaagtttcggccagcccccttacccctccaactgtccacctcctgcccattggccagccagctcttcgtcctggaaggcagaacatgctggggccaggtggaggggcagcaggatcctgagctgagcggatgcttatttttaggagcttgcgggcactgctgcccatgctgggcctccgcagcattctctgcagatccatcccttgtggcagtggtccagagccaccctttttccagagaacctgggctggccactggtcagagctttggcatgaagggttcttcaaccgggtgctgctttgatctagagagtattggatccccagtctccctggtgctggtctccccctgtccatccccagctcctgcctccccttgtctgggttttccagggag

SEQ ID NO: 50995 - DNA, 1343 bp, Bovine  19866881294886
tgctgtccttctgcgtcctcggtcgcatggggcaacactgtgatcccacccaacagccactttctaaaggattgacattcaattctagggctcaattcggtgtcccgacctgattgtaagcgcccccaagggcagccgagtccggaacagtgtgcccggggcaggtctggaggcggctcttcgcctggattgtccgggccagcgactgacccagcaagtgaacagcgatgaggcccaggagtggagtttccaaccacgtggagttttcacgatgggggaagacagggaggggagcaacctggaagcccccagagtgtgaccgagtgtgtctctttgacggtagccttctgggcaaatccattcgtcgctggagcagcggaggctgcgaacgagccgggttcaccccaccctgggagcgggccgcctgccgcccggggaggcttgggaaatgggcgaagtggtcagactggtttccggagccgggctcggaatccacgcgggctggcaggcattggtgggggaggattgagccccgccagcggcgttggcaaggccaccctgggatgctttgttttccatcctggaaggagaccctgcaggatgggggtgggagggacagcagacgtccggttgggaaacccagtttcaggtatgaaccagtagtctggcagctccccacccctctggtgcccagcccccttctgcccggtcccgactttagccaagagtatttgggagactgagttcccggtccacagtgaacccgggctttgatcttggtatttgaaagaaacaaggggaggggtggggtgtgtgaagaagagtccagctcggccactaacctgaaagaccattcacaggacactcccctctcccagcctgtttcctcatccatcaccatcttatccagtcagacactcctgggggtctgcatgcaccgggagatggggactcagaacccctagggagtcgcatggaaaggaaaggagggtgcagaagccgatggccacccgctccctcccaacctaggacgtgcagtcgggaggaatcaaccagcggttggagaccttgggtgcccccacctcatgcccaggggctggggacttgggaacgagaaaatggagtcttcagggagaaaattccctacctagaacagtgtggcacttgatggagtaggctgccaggagccagattctccctcggtctcaggggtgaggaaggggtgcctcaccttcccgccgccccacacacacatcataaaccccccaggtcaggaagtcctgtgcaggggcggtgaaggaagggggtgagcagcaagctgggggtttggggcgacagcactg

SEQ ID NO: 50996 - DNA, 1556 bp, Bovine  19866881386956
cactctgtcatttgcataataatggcttatctagaataacacagtaatcagaggcaaaattaatttgatttcttcagttagtccttaagatcctgaaaacagaggcttacggcaagaaaaactgattttgctgagtatggggttcttgaccaggaccagggagcggtgaaatttaaagtagtggaaatgtcaggttcacagctgagtttgttacttatctagttgaagtgtagctactttctggccaaacgggtgaaggactgagccaccgtgggaatcctggaaaacactctttttttggtgggaggttcagtggcccatgaaacagggacagcatgggggattgctgggggatataatcaggtcgacattgaaaatagcgctgggcagagagaagatagacgagcggctcgacaaggattaaggaggtatccgcagatcagcgctctgggcctctggcctggcccctctagggctcagttccccaccctttggacagatcaagaggaatcacttccttgctctgggacggtcgccgcgacgattggcgcagcaaaagtccttggattcaaagcaaaaaaaaaaaaaaaaaaaggtatgtgggtgggtgatgagggtattatgtggaggaaacatcttttatacattaaaacgtctttttgatcttttttaatatgaagaggagtgggagggagaaatccacaaataaatatggtaaatggatttggaccagaattgtaatcgtggggccactttcaaggttattctgggctccagaggattttttcagaaggacttgttacctccaaggtcagtcttgtcttccccagcaaaccacgcagagagagcacagtgcataagggtgggagatccacccccagcctccctgcatcgccctgtggacaggaattccctatctcttccaagaagacggaagttttacgttttttaaggaggtggcagaaaaagcccccattgcggtcacttcttttgaaataattcttatatttcttttaaaatcagagttgaagagggaaagcaggattaggaattgctgagagtgaagcgacctgcagagtgaagtggggaagcaagaggggaaatgggcggaggattagcccacagtcgagggactggctgtttccgcggaaaggaaggagggcgccaacagacctcccggcacgggggagagggtgtcgctgagagtcgcgactactgggttgggacagtaaaccagccgtccctccatccttctctttcctctgcttttattatgactgccttttggacgcagtctccatccagacttttttacacctccctgggtggcacagctcaccctggaggtattatctttttttttttttcctggcggtgggtgtgatagcacagcttcttccctaggaggatgggtaccctgaggaaagggcacccctggaatacgggagcaaagttctagcctccctcaagtcttttcctagctgggaaacaaacgcggggagaattggggctcctagtctcccaatcccagatccaggtttcagcctcaatttctc

SEQ ID NO: 50997 - DNA, 1664 bp, Bovine  19866881425868
tctgtttattacatttcacaccatagagctgaggtatgatgtcacaacgcttgattggaagtgctttctctgccgctcttcaacctcttgacgcacggtggagggctcccacactgtggcagtcatccggggacccagctgcttcccacttccagagggagatattgtgcatgccaggggagagtcaagagcctggcacgatgtgatggcaagagcacaagattcagaataaggaaggccctgaagttccaggccacagttagtctatacagtgacaggcttcggctgaagtgaatgctttggcagcccccagatggaacagggatcgtccaggcaccttctgttattcctcctagtagccatacagggtagggctattattatccgcatttcttcaattaggaaactgaggcacaaagaggttcatcgacctgcctgaggtcacacagctgctagtgaccagcgctggatcactgcaattcctcgtgccctcaccttctgccctcaaggttgctaatgccaatgggaggatgacaactcaaggacaggtgtcccagggaaagactggccaaaatcagctcccagaatgggggaggggtggctctcaccaggaagtaatgagcaggaaggcagcatggcccccctctaacctggcctgaaccccacggatacccttagacaaagtcccgagggagagactgcacgaattggatatgacctaggacacttgaggaggagttggtcctccccacaatctgaaggaacaggcttttgggataaacgagaggcagtggagtggggttcagatcccaatctgtgtgcctcggctgcctgcccatccaagtaggagagagctgccaccttccacacaacatgggtgtgagggatgagatgtgccaagtcctgtccgactctgtgtgaccccatggactgtggcctgccaggctcctctgtccttgggattcttcagtcaagaatactggaatgggttgccatttcctcctccaggagatcttcccgacccagggatcgaacccgtaattcttaggtttcctgcattggcaggtgggttcttcacaaccagtgccacctgagaagccctgagaaatgagataattgaggtaaatacaacaggtgcctggcaccaggcaggccctcaatggtccaaagctgctttagagaatttcgacaaaacccaagctttctgatgtcctggtccctcaggggacgggggtggggcggggtgcgggagacagaaggaggtgattgaactaggccccccttcctgttgtcaaggggctggtcagcctgaggcctgtctgaggcctgggggcttcctggaggggctactccctgttcccagctatctctcagccttgaactttctattctgttttgcaacccactcagaaagcggcatttctaaactcccttcttatcaccgggaaacttctgacacaacaatagctgattgtactgctctcctgggtgcggctaaattcctggaccccaccatcctcaccgcgcccccaaccccctacaacacgcacaccttttttttttggtagctttggaactctaatgatgccattgtgattggtgtgttcaggtgacagtgtgacccttgagtttagaggcatgaaaaagtggtgggggctgggaag

SEQ ID NO: 50998 - DNA, 1105 bp, Bovine  19866881529801
actgtgggctacacaccccaacatgcaatttcctcatttaacctttgaaataatgacttgaggttggtgttactgcccccaaattacagataaggaaaatgagtctcaataacccagactcagaaaactggccttggtctcagaagctggcttctcccagagcgtctgatctaaggagccagagagaaaaagccccaaggtgggggccacggtctttttataacctcacaaccagtaagggcttttggtacccaaacttcacttggaccccttcttagagaatggacggcctgcagaggacaatgcttgtgtctccacccagccacagggatgtggcagctgatgaactaggatgcccgcctctgaggggggctgtcgggggagactgtccagccgtgcgcactgccagaatctgagcccccatactcgtgactgcaacatctctgaaaccaggagacaactctattgggagaacaagcactaattaaatttactgggatcattgaagaggaaattatttaatattctgaacagatttaatatttgaaagcatggatggccttgattcgtcgtggacgggttctttgccatggggcttacatttgatgggatccacacaagctaggaggaggggatggaggtggctggaggctatgttgtccctggaagccagaggagagggagagaagctgggcatggtcggagggtgaggtccttgtaacaaccctccacagggaccctgggcactgctatagcaagctggaagtcttgctatattcacagtttctgtggccccatatctgtgggtccctaacatctgcctgcatttgccccacctttctgtaacccagagcccttgttggccaaggtacccacctgagtgagagggttcagagtcttgtaccccttggaacacatgatctaaacacccttatgtctcttggtggaagtgagaagagatacaaacacttctgctatgtcctcaagacacatgtctggacatttcaggagccactcagccttgtcaccacagtgccacccaggaccacccacaggttcctctgagagctgctcctggaggagccgcaccccacgccctcatcta

SEQ ID NO: 50999 - DNA, 2135 bp, Bovine  19866881766391
acgtgtcagggctgcctgtccccagccccaggcacctgccctcgtgcagcgtcacacagaggtgcacgcccagctcccgggcagacggcccaccgctcctctggggaaggcctgcaggggagggggcattgaatcagtccatttgcttcaagctccccagaagcaagaacattgccccttttctggacttgacatccacatgtcattttccctggatttcgcaagaggacactgtttccacaacacctgaccttcggatccactctggccagtggcagtataggggctgggaaaacaggaggggccccagatgctgacccaaggggaagatccaccacgtgggggtgaaggacacaaaggtgaagaggagggctgagctccaggctggtgttcttctctgagtaacagcagaatggggccccagggagcagactgcctcggctacagagggcaggcccttgaagctgaatggccattgggaaacatggtggaacttggttgctccaagtacacaagctgtggcatgggggtctgcagtcctccagaacgcattgcactgggtggccattcgctgccactgctcatcctaaaagggggacggggatcacaggactgtgggtctcaagggcagcctctggatcttagctctcagaacatgccaacactgtgccctcttctcctgagatcctccaggcctgcatatccagtcctctctccacatctttgcttattcgtcctggaatttgccaggtgctccctctacagctcattcccagccccagccccaccctctcctcctcttcctctaccttctcctccattccttgatgacccaaactctatccatcagccaagggctccctctgtccaccctgaaccacatcctgtttcatagatgtaaaagctcattccccaaccagtcaactcctatagaccaaagaccaaacctaacaccattctaatagcccaccccctctgggcacagataacgatggctcagtaggtgcccattgaattcaactgcaaggctgaggtgctagcacccccactggactgggagatttggggaggggcctcgtgtcagcccagggagggggaggttctcctgacataacaaaggccacagggtcaccatcacttttaacagcaaagaccattcttgatcatttctatcaccagtccagatatttgtgaacaaaaacgagtctgtctcaacagcactgacccaaggccagtgtaaactgttagtgcagtaggacatcttagatgctgctgggcttccagagtcaaggaggaagacttacacccaaccttggatttatctgaccattcttcccgtggtcaccctgtccctgcttcatccacagttttgctgaccccagtaaaggggagggaaggccagctgctaatgagacacactaatgagtctcaggacaaagaaaataagtggaattaagcaggagagactactagagagtcactaaggggcttacctgttcgatttctgtatgtgcaccaaggtaagaaaatgcctcctttacaggacacggatcttagagatgctctctggcctgccctagccccaggtcacagaagctttccccaccgcatgagctataggataggatttccatctggtttcccaacagggaggggagaagggctgttcctgtgcccacacagcctgggggagcaggtgccacctgctccggacctggcaagggagactgcttgctgttccaaggagctgggaagctggacccagaagggacttggcttggtttccacggatgctgccttggaactcgggccactttggagaaccttttaatgtattatgctaaccctgaggcaaggtaacctctctgctagtgccctgcacacacacatgtgcatgtgtgagtgcacgtgcatgcacgggtatgtgtgcgtgcactgtgtgtgcacacattgggattgtgtgtgcacacatgtgtgcgtgcattgtgagagtgtatgcacaggtgtgtgtgtgcgtatctggccttggaaaagtgggcattccccccacttccccatgggtgcttccctcccacctccccatgcctccctttgtccttcactaatgacttgggaataccaaacaagatcttttt

SEQ ID NO: 51000 - DNA, 799 bp, Bovine  19866882077355
ataagcttccaaaaattgcagtctatttgttgccaagtttaggacgattatttccttcccaacccccttggatattttttaatgccctgaaacacaaactgtcttccttggtggccctttggggctagaaacgtggtctaaagaagtccatctcaactggaccatgggaaaagagatggctcccccgccccggaaagaaagttgaaggtcagggatactaataaaggtcatcttggccatgtctccctgtcagtgaagcaggtaaagagatctgtcctcttgagattctgcctcaattcctgggagcagccctgggagaagctttctcaccgtcacccacgtcaagaaagaagactagagtggaccccgcccaaacctcagagaaatcttcaatgaaactcttatgcagagagaggctcgagactgaggctgacttgccagagatcccagcggtcccacttcccaaagcacagaacaagcctgtaatgacttctgagggcaaggctgggccctgaaaggagggagctgtcccctgtcctcaaacttctggtgtgtttttcagcacagacctggctgtacccccttccgcatcttgctgtcctgggacacggatcccggactgaggagtccctccaggagaggtgcatcaagagagacccctgagcacctgcccccgggatcccaggggctggcatccattgcaatgtgtccatcccgggccaggtagcctctggctaatgtttcatgagtcaaggctggactgagctcacctttcccaggggctgccttttatttgtaa

SEQ ID NO: 51001 - DNA, 1921 bp, Bovine  19866880366421
attaggatggagtcaatcatctcaaactcatcatttccatattggatttagctcctgtgatatctactcagggaaatcgcccatcataaactagttcttaagtgaaagttatggattattctagattttttcaatagttatttctacttccaatctttagccatgtattttaaatctatttcctgtgtgtttttaaagaaatctacttttattcactccattgccaataatttaatacagaataccataatcacttggctagattactgacacagtcttccaattattattcatcctttgtactgtactgttctccttatgcactaatatattatctcattttataatatgggagtgattggatttgcaaacatccatatttgattatgttattctcacatataaaactcttaaaacctccttgctttcaggataagctttcctcagcatgaattatgaaagtctatatgacttaactccactttcttctcaagcctcatctcacacaagtcctgatcttctactccaatctccagtggtactaaacatcttgtagtttgtaaataatatgccaagctggcattttctttctctggaaatttttaatttttcacttaaccaagctatctaactcgtgaaagtgaagtcgctcattcctgtccgactctttgcgaccccgtggactgtagcttacaaggctcctccatccatgggattctccaggcaagaatactggagtgggttgccatttccttctccaggggatcttccagacccagggatcgaatccaggtctccccaattgcaggcagatgctttaacctctgagccaccaaatttactatatttaaatctaactcctagacaccacctaaaaggagaagagaacatagctagggagaacatctgggaagttatgaaagtaatctgggcacatgtgaagaatttgtgatctagaatgttagctacagaaatggagatataaagatgaatcctagtaacagctcaatggattctattgaaaaataatgaatagactaacttccaaggaaacatcaaggctgtttgagagaatattggtgatattcaaagaaaaaataaaactgagataagaatcctcacatgtatctcttcatctataaaatgaatataatattgtttgctttaaccatatcctatagataacattattgtgaaaataatataataactgtgaaagtgctttgaaataacatgtatttctaaacaatttgagaagactttatttcgtgaattggccagaccatgtggtacctagcacttaggcatatttttccatatcccatgacaatctatacccagtaagggacaccacagtacattcctgtagaagcagaagaatgctgctgccagaaaatttacacacaggtcccaaaatattccaacagacacttttgtcagaaatgatggtattcaggtggattcattgacaaagtttttttgggcaaacagttttcctcctaggcaactgattagtattcggtgctaaggtacagttctgcatggaaccttaaagctggagttgaggagagagttaagtgagcagttcaactgctaatgccaggcttcagagaagggaccaaaaaactggcaccagattattcatctggctacttttcagccagttgggacaatacaaaagaaaacaaatattatgtcataactgggctctatgttaaaattcacacacacacacacacacacacccacacccacacccacccacccacccaactatgtggtaaaagaggatgagaagtctgtttttttctgaggtaaagatttttagattgcaaaatgtgcgatttagctttctgcatctgggacttcatccttaggccctaaaatatgcagtaaactcttcaaaacaaatcttgagatt

SEQ ID NO: 51002 - DNA, 1905 bp, Bovine  19866881124549
tagtacatcaaaactaatccataatctccaatcattttaaaattaatttttgttggagtatagctgctttacagtgttgtgctactttctactgaacagcaaattgaatcagccacatatatacacatatcccctctcttttgagcttccagctcattcaagttaccacgtgcattaagtagtctcctgtgctatacagtgggttctcgttagtcgtgtattttatatgtagtatcaataatgtatatgtgccaatctcccagttgctcccatccccctttcccccgtggtatccatatatttgttctctacatctgtatctttatttctgctttgcaaataagatcatctataccatttttatagattcaacatatatatgttaacatatgatatctattttgaatttagctggtgtctaaggcagtagggaagctctgtggttaggtttagaggccctgctgacctgcattcataggtgtctaatactggactagtaggatttggccttctttccattatgagtggtcttccagctcttctctacttagagatgcctgcaaagtcattataaggcagctttagcaccacaggccttaagaatatagcattattattagccaagtgcatagaattccagatattaataaatcaatcctcagggccaatctatagaacaatctgggaagtacaaaattttccattgagaagtttggtatacttcagtaaataaagtttccctgccaacagtttttctctctctccttttcagtgaggcctgaaatgaaacatctacacgttcttctggcaatttgtttccaccctatcccatgcccactggctccaaacacacatacacacacaaacacacatatacatacatgcacacacacacatatacacacacagttggaatttccaatagtaacgaagatgaattggccaaaatgacattgtttatgagtaaaccagatgtaaattgctccattagaaataaaagaattacaatccttgctccttgccaaaggtgtcataaccctgtataccatcttgatctctaagtcatgtccaggcacacacattgtttcccagatgcagatataacagtctattgcacagaagagagtggggtggagtttcaccacatcaagcaaattagtttgtgacatgaagaacatagtgtgggctgaaatgtcaaagatgcagggtcaacattcaccagcccagaccacaaaccagaggtgaacagagatgctcccagctgcccctggctcagtgttgccctggaagaaaggaatccactggatcctgacaaaggctgaagtcaggtggctgagtttgcattctctggctcagcagctggcttcctttgagaagacttgcatccctcccaaacaggtgaggcataaatttaatccttcattaaataaaggcaaaatctcaactttacctagttataatttccaaattatgtataaaattgtagatattcgtatttgtagttctatagcttgccaacacataggcatatctttctgtgcattctagaagcattgcctgggctacatctccattttactgataagagaaaccaagcacagagaagtagtataagtgccatacttgaacctcaagatctggctcagtcactcactaactgtgtgatactgaccagtcacttaaacattgtcactctaaaacaaaatactgcccccgcgtttgtaaggattctatggtaaaggttctgtagagactttaatgcaaacacaaatgtggtctatatgattactaaccatagttcaaaaaaattaagtagaggagtcaagaatggtctctgaactccttgctactctaagtgtggtctatggagcagcagtagcaacaacccccaggaagcttgttaaa

SEQ ID NO: 51003 - DNA, 1307 bp, Bovine  19866881155647
tgccaggcacatgatgggtgttgtaaatgaatgctgaatgcatgagttaatgtaaaggggagtctgtttcaaactgttttaaagttttcaggtaatcttggaaaagtatcaagatgagagtgggcataatttgaatgtcagtattctatttaatttgtacaagagaaatgaaatattgcagtcaaatgtctagtggctttatattcccaattcaacagtcatgaagagggaacacagaaaatgaactttttttttttcaaacttatcttggaaattagcccaagagccaaatgttttattttaatggtatgtttcttctctcagaccacaactagtaaacatttcagatcacacatacacacaatgtttgtttgtatttactgtaattccctatgcaactccagatgcttggaccatttaagcatctaatacatgtttgatgaattaaagaataaatgaagggacccttgaataaaatgagcttcgattctgacatccattagcaagctgttaccagttttcatctgtctagtttaaatgtaggccatccatttggagagagggaatggaaaaacatggtacaaaggcctgatctgttcaatgcttttgaatcaataattaaattgtaatcacttataaaacatttgcacaacatgatggagaatactggattctgactttggctttgtccccatattgttatgtgagattaacttttttacctaacaagattgagcttggtttcacctacattaatatattcaaactttatgggacaaagatcatattttctttaaatctgatacagtctagtatgattctgatatgattatatatgtgattgggccatgacaatatgtgtacatcccagggagccttttaatttggtatctttggtagacagtttaaagaaataaaatattgtctctttgattaatttctagggaaagttgttggaaaaaattcaccctctgtgcctcaggcaacatacctctggctccatatttctattgcactctatattcaaaaggtctgtcattaagtgtagaccttcttagaggaaagttttattgaatatgatttgaaagtagaatatagctcttggaatgggaatggtaaaagatcttacctcctatctcatcaaatttctcttccaattatgtatcatactgccctgagaattctggcaaattaagcattctttacctccttacacttcccactcactttttaaattatttccctgattgatgtcagggtgacatgccatggtctgatcatgtatttataaacaagcttaaagctca

SEQ ID NO: 51004 - DNA, 1299 bp, Bovine  19866881183947
tccctcagccactacagagaatatctgctattaatatcattgccccttggaggatctctactcaaatttcaatagccttgctttgtcatgtttttccctaaacataatcacacttaccaagaaaagcctttcagttttctctcactttttcaaacagtacttaaaactttgcctatttctggaacatatctattttgcttatataaatccatgtataaatatatatttgtattttactttctctattaatttcatcatatatatttcactctcctttataaccgcttatgaattcatattcccacaaccacttttacagctctatagtactatcacatgtcttcttcattctatcattatttcttcaccaatgattatgtcctatttatgtttatcccgctccctgtcctctagcatatttaatccagccctcttactacttgtgagtgctcagggtctcatcccagtctgtgttatatgttttagtttatgaagttacaaattaaaagatggaaactattcatgaatatatattcatagatctatagatgtagatatactggctattgattcctaggtggtaaagaatctgcctgccaattcaggagatgcaagagatccaggttcaacccctgggttgggaagataacaattcatacactatttttatgtgaacaagttttaatccttgccaggtagtgtagtggtaaagaatctgcctgctgatgcaagagacgtgggtttgatccctgggtgggcaagagctcctggaaaagaaaatgccaacctacttgcccggaaaattccaaggacagagaagcttggtggactaattgtgattgctcagtctcatcccagtctgtgttatatgttttactttatgtcagttacaaattaaaagaagggaactattcatgaatatgtattcatacatgtacagatgtagatatactgggtatagaattgtgctgggtatagaattccaggttgatagtatttttcttaacactttgaatgtcccatttgattttttcctttttttttttcccctggataattattttctcttgttttttcaaaattattcaactaaatttagctctagtaacttgaaaatgatgtgaaaaatgatacatatgtgtgtgtattctattttcacaaggtgaattatgaacaaaattctttaatattaaatattttctttgtttcactatgaagtttcatttcacaggctagagatttctttctttattaaaagtcatgattttttttttcctttatagatctatgaatatatat

SEQ ID NO: 51005 - DNA, 1703 bp, Bovine  19866881215044
tatgtaactttcttttattctttcatgtgttttgagtttaataacatatgctgtttatatttggtttctatagagagttcctttttgtcttgtaaacagttgcaaagttttacctagagctgagtgggttttctctttctttctttatcctcccacctcccggcccttggaaagtctgaatagttctaaggattagcagcagcttaacttcagtcatgatttgtaatagataatgcagttattgttccatttcggctctttgggatagtctgaaattaaccagttgtcttatccttttcttcacagtctacatcttaatagtcactcctattcgagtttcattgacttgtcagaaagtactcgtaagtgaatcttcaatatgaaatgaggcccaaagttcatgttattcttccaaatgagttagatgcttctggtaagggtaatcaactcctttctcttaagagcttaatatgtgacagatactgaacttgtccaacaatacatggtattttttgtgtgtatttattaatatccccatttttcaagttatggcactgacactcaaagagattgtaagatttatcaaaaatctatagatgttcaggatcagtataaaggttaatccaaggtggctgtatactactgtcatttgataaaggctagtcctcataagatactacaggcctgtatacttgctgtcttctaggtaatattctgtccttgactctgacacttagaagtctattgtgagacaacatgatagctcccttgaactcaacatggagtgaaagtgaaagtgttagtctgtcagtggcatccgactctttgcgaccccatgggctgtagcctgccaggctcttctgtccatggaattctccaggcaagaatactggaatgggttgccattcccttctccaggggatcttcctgacccaaggattgaaccagatctcctgcatttcgggcagattctttaccatctgagccgccagggaagccttgttagcaataataccatatagtcatctgaatgcatttacattttcaccttagatttctcttagaaataatatactttattatcccttcatgctataggtctgtgctgtttagatttttgttaaaatttctgaaaattaaattaaaatgtagctgttcagttatattagccactttttgaggattcaatagccacatgtggccagcaaataccatcctggataatgcagatttataggacatttccatcctggcaacaacttctgggcaacactcttctagagccacagtgacactagttaaattctgggtgaattgctgggtatgctctggaaatttactcatttatttgtttacatatttatcttttcctggagtataactgctttataatattgcatacaataaagcgaatcggttatatgggtgattccatctctcttgtcctccctcccaccccaccccattccacccttctaggtcatcacagagcaccgagccctctgggctatatagcaacttctcactagttatctattttacacatgctagtcatcccagggacagaggagcctggtgggctgccgtctatggggtcgcagagagtctgacacgactgaagcgacttagcagcagcagcagcagtctgtatatgtcaatactattctcccagttcagcccacgcacccttccccggctacgtc

SEQ ID NO: 51006 - DNA, 1533 bp, Bovine  19866881263096
ctggacagaattaagtttgttttcttcccagcagtaaatgaggtcagggtctggagtaagatactatgcctggttatatttagtcaacctggtgaaatgcctccaaccgtatccccaaataccaggagtttgaagggctttaacagctcctcctccactaataaaactgcttgcctaataagaaggacatatactgactgaccatttgaaaatgtgggggtcttccagaaacagagttaaaacaataaatacatattgaaacaataacaacaaaagactttaaaaatgttggttcagtactttcatttgatagaggaggagtctgaggcacagagagtgattctaacatgagaactaagggtaggagacagttgaccttcagtatccgtggctctcatgtccagatttaaccactccacgtagttatcagttttcatataagaaacttgaacatctgtgaattttgatatccagaggagccctggaactaatcctccatggatactgaaggtcaactgactatatcttctaaattgcaacccaaagttttctccagaatattgctccttcacttcattacaaggaaaaactatggcgaagattatctgtatcttttattaggattgcagacatttctgttcatctactgtttggtggaaaattttgtggttgggagcaagcctggactgagagccatattacgtggcttaacagaaacctgaaaatatctttaattgtaccatttttaaggtaaacaattcattcaagtgtgattaaaaatcagagcaaatgattgcatcttgatgtacatctggctacaaaaggaaatgtttctctatatgggattagaaagaaaaccttctttcactcttttttttaaaataataaaatatttctctgcagaccagatgaagaaatgcacagagcctgtgattgctatgatttcagaataaaggagaaccctgacctttcagggagtagaccggatgtgagggaaactttgtggaaagaagctgatatttaaacccatatgaagtaattcttaattcagcctctaggggtattagaaataattttcaattagttatggtaatatctcacagagaaggttcagacaagaaagtgggaaagagaaggtcagaaaaagttttgagaaggattaaactcaaaggaaaatttgaagactgagtttaagtaggcttcagtgattataaatattacctacacaacagaggaacatagttttacaaaccagacacaaccttccgaaagggctatttagagaaattataatggacataaaaatataaaacataaggggaaaacttgataaatttaaccacattaaaattaaaagtgcaaactcttaatcatcaaaagataccacaaagagagtgataaagccacatccagttgacaaaaagctcctgttcagaatacacaaagaattcctatttgtgagaaagaaaggaatgaaaataaaatgagaaaagacacaaatggacagtcctttagaagtagaaacacaaatga

SEQ ID NO: 51007 - DNA, 1100 bp, Bovine  19866881298330
atgtgaagagtcgactcattggaaaagactctgatgctgggaggggttgggagcaggaggagaaggggacaacagaggatgagatggctggatggcatcactgactcaatggacatgagtctcaatgaactccgggagttggtgatggacagggaagcctggtgtgctgcgattcatgggtttgcaaagagtcagacacaactgagcaaccgaagtgaactgaactgatgactatgtaacaagccaccaaagaactcaatgtatttaaggaacaatgactatctttcctggttctaaaggttaggaggctcagctgcacatttctcatttggtatttttcatgcagttccaaggaagttgcaagtggagttgtggtcatgcagaaacttctttcacacacatctgctgcctgagcagggatgctaccacagctcgggcatgcaacatctctctatacttatggattctccacatttctagcatggtggtctcagggctccaagaaagaatgttgcaaggcaatggaagttgccaacttttaaggagttggcctagaaactggccttatgccatgtttacagtattctattggtcataacagtcacagaccttccccagattcaaaatgcgaagactgtcattacagttggattcccattggttcccagggcaatctgcaaatgaatggttactcattgtgtggagcacacattcagggaagggcaaaagctgacaattagcacctgatgaggttaagtatttggtaataccacctaagaaatcaatgaaatcttggtagataaattcccagaacttggaggaattatatttgaaactgaattgcaaaaacaaaagcatgtaaaacagaaatctatctgttgaaccttaatctaaaacctgacatctagagtctattagcttttaataagtttaattttcagaaatctaatcttggctgatatatggtggaagaaataaaatatagtgcttgatttgaagaggtcacttatcaaatactccccaggaaaaaaaccagcattcctgagttatattcatccagcactcttttctcttctcaaggtaattgaaaagatttgcaa

SEQ ID NO: 51008 - DNA, 1117 bp, Bovine  19866880587701
tatggaaaacccaaattaactgtttagcctgcgcaatatccttgtatgaaatgcgaaagtagtgttgttggtggtttgctattagaaatttggcccttaagggttcccatagtaacttgttgctagcttttggggtggtgttagctgacggtgtttcttcctgtaataaaagattattgttgaggaatttcttattgctttagcatctaattctacccaacactctgtgttctctgtagcctttcctgataatcctacctttgaatctttttatggttgctacttctttcttttaaaagggttatttttttttttttttttaattgagaggtcagaattgtaccagttcatttaaggaatatgtagccctgtgcacagtctttacagagtaaccaccccttaaaaacatacttgtccttctttgaattcctgcagatagattatgtttgcatatttacgttttactccgtggcttcctctggaaaagaaatatggtcatgccactgcacagcttgcaaattcagcgttggatttctctgtggaatcctgcagatgcagagaaattaaatacggtagaattatataggcaatgaatgatctgtaaattcatttgaaatgctcataggcacccctttccaaactggggtactttgtgcgatatgctgcattgattttcttgtatgtcacatcacattgggtttgtatgtctcattatgcaatgttagcactttatggtgctttgcttttgtggtaacactgtgaacataatgtaatgtgatgtgccatggctgtgaaatgccattaaagtatgacactctggagactccgtgaatcatgcccatttcacttctgcagtgtcaggaagcagagagaactgcaggaggtctttgccttgcagggattatctgaatttatctatctcacttgagtcgtgggaagttaatgtattggtagatggctaatactgctaatactatgaccatttgaaacaccctctgtaataggaaactcacttatccctaaaatttgttgttgttacactttttcatttttagaattatggggcaataataaaagaaagtctctgtgtcatctgaccctctgctttcctcaagtt

SEQ ID NO: 51009 - DNA, 1664 bp, Bovine  19866880589410
tctcactggttgcgtatctcaaaaatttgacttctcttttcgtggtctaatgttcttagacttgcctggtagctcaaatgattaagaatccacctgcaatgcaggagacccgagttccgtccctgggtcaggaagatcccctagagaagggaatggtaatgcagtccagtattcttgccttgagaatcctaaggacagaggagcctgatgggctgcagtctgtagggtcacagagggtcggacatgactgaagcaactcagtatgcagtgttcttgtagtacagaagttatgagaccaattatccacttctctctccatggagggattaattctctccacttttgcttaaaaatacatgtatacctgtggcggattcatttcgatatttggcaaaactaatacaattttgtaaagtttaaaaataaaattaaaattaaaaaaaataaagaagtgaaaaaaaaatacacacagatatcagcaagtaaacaagaggttaaagttagaaagacaaagaatatgtgtataaatctggggtaaaattctttacattttttcactaacagtcaactatgcataatggattagactatctatgccatggtcctaattggctgttaaaatggcttagaccattgatttcagtttgtgctaagtttgattttttttttttttttttggacttcttgaaattgcccaaggtgaaaagggctcaggtatacataatttatgaattgattatcatattatccagataaacggatctggcctccaggctatttgggtgttaccatatcaagtacacctcatttaaattcatcaactttctctctctaggtgcatggtttgccatgctgcatgaaacactttaaagtaaataaaaatcatgaaataaaggaagtaaagtgaaaaaatcagaatatgctaaatttcatgttgaaataattttgcttcactttttgtattataaaaacaaacatttttgataagtgattaaaatatattgatgccctctctaaaataaaagtaattataagagtaatgattattttaatctgatcggtgttttcctatgtaaaaataagaaataacacaaaagagacaatgtatttatagtgagaaatagacataaaattaacctaaaattttttgctttggggaagattcagtatgaaatgaaatctaatcccaactgggggagagagaagaatcactttttattctcttcccaactttttcctgagacagtgcttatgcaaatattttgttggactctcctgaatgtcaaaagaaaactcttggaaataggaagtagttatattgttacatgcttctgtaggctgacatcagcaagtgctttttaaagtacagaaaagcagcattaatagtccaactcattcacatgttggtctctagaatgtctgttgggagagtctaagatcatctgaaaaatctgtaaagaagggaaaataaacaaacagacaaaaaacaaaacaaaaccaaaaaaagcaaggctctgtaaaaaaaaaacaaaacaggattttgtaatggcacatgaattcatcattgctacaatgaatgactgatgaaagaattttgatttacctaaagatttcacgttcccctcatttttaatcatttttttggttgatctcatcattctatt

SEQ ID NO: 51010 - DNA, 1712 bp, Bovine  19866880668683
attacatctccagttagagaaagtaatattttcaggaaaggcaaataaattcgagttatgtcttggagaaaggatggatttatggcatatttaagcagacaagagtgattatacaccccatggagcagctgtacttccaatgggcaagttctacgcagagatgcgagttagccagtattattataaatattttaaaggcgagggatttgagaaagagagaagctaggtaacctaagcacatgcctcagaagtttttcaaagctgagatttgaaaatgggcatccttgctctgaaattcattttctgaccattacatttttaacttaaccttgtggcagcatctcaataactgcttttaactcttcaggttggcaatgaaaaactcattggtgcagaggaaataatgccctaaagcctctgaaatttggaattttccttttgcttttccctccttatatatctgtcttgtccctaaataacagtaattctctgcagctggtcatgaaatttcaagcctagactttaaaatgcatatttgattccgacacacaggttttgcagccaaattttgtaaggagtcgttggaattcagattataaactgctgtttgtcacgtttaattattattttggttgtttccagactgtgtgggtgttgagggtgaagctgtggttttcttgggtgttctgagcatttcctaaaactatagaaagatgtggcaagcaagagctattttgggaggtgctgaagtgatttcgatgggaaggtgtcccaggcctcatatattaaagaaatgcctgaaatttcattcaatcacttgactgccattcctcacagttagtgtgcactgaagtggaaagccacatagcacacgtattttttggtttgtaagtgaacactcaaatgctcgaagttgataggtgggaatgcagatgtagacttttgctcattttagctctcctgatttctcaatgagaacaaagattgacttggcagaaagagcagggagtcacagtcttgcattttacttgtccacacacgttcctgtggtgagtggacccatgcataatggcctgagatccattctcttttctgatgattcctaatggtttatctccattcttcatttattcactgagttcacatatccagtgcctggtctgtgtctccacatggaagccttgtaaacatctctgactttgcttctgcaaagcagagcaattgatttatccccacactcccaaagacatctccttccccagtctctgcattcagcaaatgatgtcaccatcaaatgagtcctttaggccagaaacacaggacatatccttcatgtgtgcctttcttaaaggaacatctctccctttttaacaagtttctattttatattggagtacagtttattagcagtgttgtgtacgattcaggtgtacagcaaatacacgcatctattcttttcccaattcttttcccatttaggtatagtgagtagagtttcctgtgctctaagttaggtctttgttggtttgctgtttttctttagtcgctaagttgtgtctgactcttttgcaacgcagttgactgtagcccaccaggttcctctgtccttgggattctccaggcaagaatactggagtgggttgccatttcctttctttctccaggggatcttctagactcaggaactgatcccacacctcctgcattggtag

SEQ ID NO: 51011 - DNA, 1950 bp, Bovine  19866880825373
ttgcaggcagattcttaactgtctgagccgccagggaagccccattggatctgataatttcaccaaataccaggaaaactcaaatgacatattgtgagagtcaaacaattttttttctttgtttcttttttttttttttttttgcttttcaactctatttttaaaaatatgcagtatttgatatttaggttaatattttcccaagaaatgtaatgaaactattattttcatttgcataaagtatctagaatcccatatgaaaacattgtggtttccttttttacaatctaatatttcaaatgcattacaatttagctgtagatattaaataacatgaaaatctgcatagtaacatcaaaattctgtctgcattttcatttcacattcatgtgataccatgaaagacttttgtcaagagtgaggttgaaactgtttaaatatttcctgtttgggaaagagagctcttgaaattagacaatagtctatgcttactgacatcgatcaattagctgcagctgtaaggaaaagacagggtgtggatcatgagcaaggctaaacgtgtcactttccaaatttaaaatgatacaaaaccaggaggaataagcaatataacagttgatgacaagattgagattcaggttgtctcaaaagactggaatgctggatgaacaccaagaatatgaaatctgatcagatgaatctcaagccatgccttgggtttaaaataagagaaaaataaatgcaaagtagtggagagtgcagacagtagttcatggttatcagatctgacttggccatgactcaataatcaccagcagagccaagaggccagtgaaaacaaaagcatatgctgcgttagaagaagctgagcatacagaactgtgggtagcattgacttcactggaatgctacgtatacatatctgaaatactaggcttcatatgtgaaaaggaaattgatgagcaaaaatagaatttttatggtaaaacaactaaaagcattagattgttaacttggaaaaaaagactaattttgaagacaaaaagcacgatgactaatttcaagtggttaatggcttctctgcagaagcataaagagctacctttgttccaatacttcatagaacgggactaaaaattaattacaaagctagagaatacatttcagtactttgttgtcactgctgtttagtcctgagtcatgtcggactcttttgcaacccaatggactgacagtagcccaccaggctcctctgtccttgggatttcccaagcaagaatactggaatgggtttccatttccttctccaggggttcttcctgacccagggatcaaattcctgtctcttgcattgcaggcggattctttaccattgagccaccagagaagttcctggtgtgtggatcacaacaaactatgccaaattcttaaagagatggaaataccagaccaccttacctgcctcctgagaaacctgtatgtaggtcaagaagcaacagttagaactgaacatggaacaactgtctggtttaaaattgacaaaggagtatgacaaggctgtatgttgtcacctgcttatttaaactctatgcagagtacatcaggcaaaatgccaggctggatgaattacaagctggaataaagattgctaggagaaatattaacaacatctcagattttcagatgataccaccctaatagcagacagcgaagaggaactaaagagcctcttgatgaaggtcaaagaggagaatgaaaaaaactggcctaaagctcaacattcaaaaaactaagatcatagcatccattcccatcacttcttggcaaacagaaggggaaaagtggaagcagtgatggattttattttcttgggctcctaaatcattacggatggtgactgcaatcatgaaattaaaagatgcttgctccttggaagaaaagttatgacag

SEQ ID NO: 51012 - DNA, 1947 bp, Bovine  19866881060052
aagtgatgctttcaaattgtggtgttggagaagactcttgagagccccttgggctgcaaggaggtcaaaccagtcaatcctaaaggaaatcaagcctgaatattgtttggaagaactgatgctgaagctgaagctccaataccttggccacctgatgcgaagagtggatttattggaaaagaccctgatgctgggaaagactgaggtcagaaggagaagggggcaacagaggatgaggtggtcagatggcatcaccgattcaatggacgtgaatttgagaaaactccaagaaataccaaaagacaagggatcctggggtgctacagtccaagaggtcacagagttgcccacaactcagcggttgaacaacaacagaacagaagtagtctctgctggcaaatgtcaggaggggggtaatgactagaacaaaaggaacatgagcgcactggctgtatgcttgttcttggtgtactgggcatggctacacaggagaggcccctttgtgagcactcaagctaacatgtacttttttctgtatgtaattcaggaaaaaataagtacaagaatggagtgtggtaggaagaaatattactctggataatgtgcaaaacaataattacagccccatcatatttaatttttcaaaataattcttaaagctgtattttcctaccccctttcttagaaaattctatgaccaatatcaatatacttcccagagggaatctggcttgtggttgccctctctgacttgcagttttgtgctttgaaaaccttgttttcaaattgtcactaagttgagtgtgtttcaaggcatgcatttgaatgagaaagaggattcttatgtgaagtaacacttgtgttctcagaattcaccaagagctcttttgggaggcgagaagggaacattttgactttctttatctagggcacaggttgcatccatcactctcttcttaaactcacatttctgttctctatttttaaaagaaaaataaaagatttttaacagtagacaatgtgataaacaaattaacataggtaaatggataaaaaagaaacttctgcaagtgtgcatagagatggcttatctgatctataactcagagacgtctgttaatgtctgcatggaatatgatgtctttgactaggattaggatagaggcaaagactaaaacaaaatgagtgatgagaattctcaaagactgtggttccaaatcccatggaatctcagtgactctagcctatctcagaagctggatctttgtggtcaaacttatggatggatcagctgtgcatgctgcaactcagaacaacacacacactctctcaaggatacatttaatcaacctgtgatcagagctttctggataagcctaaccaggccaacttttccatttgattttggaaaacagccttcttaatttaaaggcatgctggcatttggaggttcacattcatttatgtattcgtgataaatgatttatttatccaaaacccattctggaaactaacatgtgctcaaattacaacttttgtattcttggcaaggcattaggttcatttgctttaacaaagaattacgatttagtgtttagaagtaaatgaatacctttttgacttactgtgtctgatgaaagattaggaaagaagaaaccaaataaaattaacatatatataaaaacaaatcaaactatatatatatatatatatatatatgcatatacaaacaagaacaaattaaattgctcataatgtccattatttatcactttccaaataagcctcatttgggaaagataagaaaagtaataagaactatttgtggaccatatggaactgcataatttatcgggaatgttgctagattcaaggaaagtgactacatttcacaagctggagagtccctttcacaagtaagattacagaatgaatatactcctcttc

SEQ ID NO: 51013 - DNA, 1401 bp, Bovine  19866881621477
atatattgagacttttaataaaatggcatgagcatacttgagaattccaaaagtctgagatgatggtagactgtttcccccagcaaaggaaaacacacaggcagacattttctgtaacccgcccactgagctggcagtgcccaagatgcccaataacctctgtttgacttgtcacttgcaagacaaatttgctcatatatcaaagcagtgagaatcccttttcagcaactgtatctgtaattggctatgccttgttagtgctcaaggtatgtgtatctgtcacatagataacaaaaagttcttttttttttttaatttcaaataacatgttggcctcctagcattataatgccaactaagagccacaatattgatcaaaccctcattgatgacctttaaaaatgcttacattattcaagaaaataagaaccagtgtgctctgccaccctgaagactatcaaaatctcagaagaaagtaaactctgtagttaatatttcaaatcactggagagcattttcttgaattctttggctaacttttctaatagaatcagccatgtgaattattttctgtacaattttctttgaaattttagctgattaagagtatccatatcttctttatcattgaaaattaagaggttattacaagagtttcagttctactctgggaggggagggggatcatttcagatgtttgtatgtagatcaaataaaaagcaggcatagatttacataaattagagattttcaattttagatcaccaacaaaaaatgcagtttttttcaatgaaaattcttgggcccaaacttactaaaacaaaatgtcttaagagaaaatataccataaaattctgaaaggcaagatatagtcttgagtaaacaattggaaaaaatatgtaaagtgatatttgatattattaacagttcagcagtgtttaagtaaaacagaaaagatgctgcaaattagtaagagactaatattaaaaatcaacatgttatatgaataagaaatgaacaataactacaaatggccaataaatatacaaaacaacactgaacatcatttatgatcaagataaatgaaaataaaataaaaatctcatttctccattgcccatcagatttgtaaaattaattaaaatttttacaattttacagatctccagtaactctgcccatggtgcaagtaaatagcagaagacgtgtctattgctacttgccacaatattgtaaagtaattatcctccaattaaaataaataaataaattaaaaaagaagtgtctaaaagaaagaataatctagacagattattttaagaaagagaccataaatttaaacctgtagcacatccaatttttctattcttttcagtttaaaagtatgtacaatttgtgttt

SEQ ID NO: 51014 - DNA, 1104 bp, Bovine  19866881892260
tctattggatgaatgagtctatgtgaatatcattttaatatcttcatatgtttattccatatgttatcacaaagtaacaggatgatatgaatgttgctgcaaacttcgaagggtgacatttttgtagtgctgtatagtaataggccaggtgttttgatacagtcaataaaatactcagacatgaaacctactcaagatattcttcaacatataataagccagaaacaatatcgcaagttttaaaatgagccactgtgagaatcagtgtctctatctttaatcatgaagtggttagcctgaagccattcttagttttttcctttgtttctctctttcgctcaaacaatccccttgttgcccacccctgagtgccctctctgcccaaacctaggctggcttccctcttgtgaggatgggtgagcgcgaacggcctcctctcatcctgtgcttggactcattgctcccagagggcccacactgaaggtcctgtacccacccccgaggaccagtcagctgccccgtgtcttttgaagtgggtagcagattttattgctttaattaaactcgttgtacggtttgtttttctactccactgacgccatggcctctggccttgacgcgtcttccattcatagtacggctcctagcatcacttttgctgccccccggaccaccgacactggaaggagaactccaatcgcgcaggtctaactgttggacattaatgctgcagcctcctgaaaatcgactgtttccaaaggatgtaaaacgaattctccattggtttgtcccagaggctcctgaggcttttcttaattaagcctaaatggtttccagaaagtggctgtgtcttagaccagttcttttcttatattgattttctgacttcctgggtgaccctccctgtctttaatacaggccaaaccttcttcctggatggccagcagaaactcagcccttgttatacagcacagtcagctactccaccctgtccatgcagaagcagtttaacagctctcgttgatattcctgtctgagtggtggaaagatagtaactggaatcttgagctcttgagttgttttccacatgttcaaactgctaca

SEQ ID NO: 51015 - DNA, 1737 bp, Bovine  19866880362576
ctgctactgctgctgctaagtcgcttcagtcgtgtccgactctctacaatcccatagacggcagcccaccaggctcccccgtccctgggattctccaggcaagaacactggagtgggttgccatttccttctccaatgcgtgaaagtgaagtcactcagtcgtgtccgactcttagcgaccccatggactgcagcctaccaggctcttccatccatgggattttccaggtgagagtactggagtggggtgccattgccttctccatgagccaccagggaagctgttaaatgagttaatgttgcataaatgatcaggcaccatggttaccacatggtaggggttggggggagtacctgggtccgttgcctgtcttccttctttattcattttctctcctctctctcccacagaaaaaagtgagaggtgttagaagttactataaccacttctgaaaaaaacttttgtatttggagcataattgattaacaacgttgttagcttcagatatatagcagagtgattcaataatacacatacatatatctattcttttaaaattcttttcccatttaggaatgtaaccacttatggtttagttgaggactggcttgcagtggaacaactcttcctaaaatgcacagggaagcatggaagatatctaattttttttacacactaggctttgcacatcacaaaaacagttttaagaattagccaaattattatacacaaaccctaatatactgtacaagaaaaaagcactttggagtcagagacatctgaattcatacattgctagagtcatggtaaaactctttatcctctctgttccgatttcctcttctttaaactagagtaagagataagtgtgagatggtatgtgtgaatttaggcagcagagaatttggcacgaagtaggctgtcaatagattttgcttcttggggccccatcatcacaaataaaatggagctggttgaactgtgtcaaatattaatccagtaactgtcagccgaaagaattaaaaagttggtctgcgtgcaggtcctgcttggcatagccctgagttacagctgtcactgataattgcttaacagctcagttagcatggcaacaagttgttgctttcagacagcttgtatatttgggaagagacttcaaatcattgcagagaatgtacctgaatttcaactaattctgaaaaggagtctcaagcactttggtgaccttgggtttaaacgtttattcaaattatttgacgtaacctgctctctttttaaaaaaagtttatatggaatgtaatgagttattttgacagtcaaaactcagtggcaattgtattacatgttccatcagtcaggagagcaataagagtttattgctgcacttaaaatatctaatgctagacataaccactaaattagcttcaaatgttttaaattcagagtgtatgaaatatgattggccacgcttaaaaaacttagcggctgccagcaactgatatataaatttaacagtgggaaccaagtttggggattataggtgaggtggttaaaatatgcatttagaaaggagagcagcaatggctgtgaaattagctttggccatgatgtggcccattgcaggacttaatacctccctctctttccagtagctaaattttcaggatctctcatgaataattatattttggaggataaacttgtggcaaagatcacagttcctttaaacttcacat

SEQ ID NO: 51016 - DNA, 1596 bp, Bovine  19866880362581
ttttttctgtgggagagagaggagagaaaatgaataaagaaggaagacaggcaacggacccaggtactcccccaacccctaccatgtggtaaccatggtgcctgatcatttatgcaacattaactcatttaacagcttccctggtggctcatggagaaggcaatggcaccccactccagtactctcacctggaaaatcccatggatggaagagcctggtaggctgcagtccatggggtcgctaagagtcggacacgactgagtgacttcactttcacgcattggagaaggaaatggcaacccactccagtgttcttgcctggagaatcccagggacgggggagcctggtgggctgccgtctatgggattgtagagagtcggacacgactgaagcgacttagcagcagcagtagcagctggtggctcaggggtgaagaatctgcctgcaatgtgggagatgcaggagatacagatttaatccctgggtcaggaagatccccaggaggaggaaatggcaacccacttcggtattcttgcctggaaaatcccatggacagaggagcctggcaggctatgatccatggggtctcaaagagttggacatgcctgagtgactgaacacaactcatttaacattattctcctcactactgagcttccctggtggctcagatggtaaagaatctgccaacaatgcaggagatctgggttcgatcactgggttgggaagactccctggagaagggaatggcaacccactccagtattcttgcctggagaattccatgggtagaggagcctggtgggctacagtagtccatggggtcacaaagagtcaaacacaactgggagactaactttcacttttccccactactcagtgaaataaatatttgttccagtggtgaagctggatctttaattagtgagataatttgcccagacattacaggactactcagaggcacaacagggattaaaattgagttctgcatgattaaaagtagttgtgtttcctattacacatttaaggtatatgcactctctcttctctctcttcctgggataaaactaataaaagattccagacaacagagcaagtcccttattcccactatagacaaatgtctccctttagccaccctggcttggtcccaattaataccaaaaaaaaaccatatgactgcatcattcaaaaacttcatttgtagccaagctctagaagtgttattcttcctcttcgctactgagctctgtggtagagtttcactatctttgatttcccctgggcatcttcctgatggattcactgtgaattaagagttgaaaagaggaaagaagccaactgaggaagttcacagtactgtgattagaaaataaaatgcaactcccttacaaaaaatacatgttatttaaaatccaagtattcattacagattgatttactttaaatagtgcaaaggcattttcactagaaaactactgatttatacttattttgctgtaacaggaagttttcaaaatctaaggtgcttgaagggcctactttatataacaaagtaagaaatttttcattgaaatgttttccctcatttt

SEQ ID NO: 51017 - DNA, 1662 bp, Bovine  19866880368048
tgaaaaaaaaaagtgaacggcctatgaaggttgatgaaagcagatagtttaaaatcatcagatacgattggcttctagtggtccctcttaatgtaataatcaaattggactatctttgaatacagcagtccccaaatttagtgagcctcagaatcagcttcttaaaaacagattgctggatcccactcctagatattctgattcgccgaccaaggtatggggctagataacttacatacctaacacatccccagttgatgccaatgctcttagtaagcagccacgttttaagacccctgttcttaagtgaattctttctattctctgacctatccccaataggagatctataaaataatttatgttgtttttttcatgcttaagaatgtggattgcatcttctctgaaaggcttacctgaaaatttattttcctttcctgagaggtagaaggtaggaaaaggtcagtttcttatgaagctaatcactgaggagagcaaataaaaccatgtcaaacacagaaggcatcacttccatgtacaggaaactttcaatcgtatttcaaatgcctctctattttgtatatctttctgcttctttgttgctgacaaatggatgatcaactttaatataaataaaagtgtttttaaaaataaatgtatcttaggaacagattcaacgatggctgctgaagtagtctatccattattttgaaagtcatatcacataaccaaacattctcacttttatttctatatttttgacaaaatgttcaggaggaattccacttttggctttccaagggtgcttcccaattttctcagaccactgtctcaggtactttcctgctataaaataacaccagtcaatttctgtagtgatcactgcttctgtcattgcaagtttctgttgcctagaggatagatatcaaactggagtgaaaatgacggagtgaagtgtgtatgtttagtctcaagtaataaatgtactcttcacttattgctgtaggctatagacatctcttttcatataaggataggcaaaaaatcattgcaatttaaaaggattttattaatctactctataatggtctaagagaaggcagtggcaacccactccagtactcttgcctggaaaatcccatggacggaggagcctggtaggctgcagtccatggggttgcaacgagtaggacacgactgagcagcttagcagcagcagcagcataatggtctaaactccaccaaccttatagattagagtttatattgtcagaggaattctggagtgatactatttcttttcatataaagaaatttgaaataatcataacattaaacttattttttaggagaaataaagtatgtttcatgtcatctcaaaatgttatgtttctaattggcttggggttagtgaaatctaaatgattagaaatttggattcattgcaggtatcttttacagagttccccatgacatattatacaaaggggaacagatttactccatctgtacgaataacactttatattttgattttgcccattggtcacatcaaagggtggagtctgtttctccactccttgactcagaacttggccacatgacttgttttggccaatggggcaatgtatcacaagcagatgctgaaaaatgttccacaat

SEQ ID NO: 51018 - DNA, 1818 bp, Bovine  19866880399526
atagatagtcatggcatagattcttcaactctgattcgctaaattcaaggactaaggggtttccttgctaccttgccatctatgcttctggaataacctctctcattcaggataggaagaaggaaggaatggcataggacatagttttggacacatcgttcatcagctagatgatcgtcaggcagataaccttggttgctagggaggctaagaaaacagagtgtttaaatttggcctctgtaataaaggaaggcaaggagaacaggtttataagttgagtgagcatccatttgctacagaaactcaacattagcatatttagaattaaattccaatcttctttcaaactctatttcttttcctatgttccctattttagtcattaatgcctgtttggtctcacatagaagccaaggagtcattcttcagtccttcttcccccttctcacctccacattaacttggtgcaaaacattattgagagtatgttcttatatttctctaattgtctccacttacttatcattattcatctgactctgattttgtgtgtcccacatttttttttcttggattttgaaaattccagtttcagtctattccactccactaatcactattatctgctatccaccggtttgtactttctaacatccaactatgaccaatctctactttatttaaatccctcagtaactctcattgccttcagaatggaattcagaatttttttttttttggtcatgacacaaggtcaccagtatcctgctcttacacaccagcccaaattctttcttcttaattcccccaagaatccccatattctgacccaaaagagctactcgtgagtccagtgttatctccttttttgcatatctttgcaaacattgctccctctgcttatttcataaaaattttctttgacctgtcctgctactagatatcctttcaaactgagtcagggtgtattttctgagaagtcttctcttacagaaaatgcccccacactccaagtccctgtacatacatacacacacagtattgatttgcctccacagctaaatgctgagaattgaataacagattgaacaaagagtatgtgaaattatttaaatatcaagtatttgggattttggatgaattcttctttctgccgagccacaagcatcattccataaaaagcagatttaaataaaatatcatgggaatatatttctttagcagtacttaaacttatgctaagaatattatattattttttaggttttgtttcagtatcaaaaataaagatatgtcttcaaaataatgagatttttatcaggatgaattaagcggaggcaaacatttgccatggtttagtagaaacattgtgttttctgtcattttacagcagatacatagcatctggaaatgagtccacttgaaagtgaatgctgtaataagtcttttggtggtcattttgatttatagaaatggttctgtttaagatatataggtttcctgacaagacttctctattttcttcttcagactagtgtgctttcaaaaatttgttcagattttttttttcttttgagacaagggaacaattctattaccgtgtttttattttctctgttttgatgctttgatacccggtgtcttgctgatcacagagggtccgtctcttccagagtgaaccaattcctagagacagtaaaccagctcgccttacagtgtatttttcaaaccgacagccacctctttaggctttcatactctgggtcactagatacctgccttaattaccccagggggagtgcatgttttctaaggcag

SEQ ID NO: 51019 - DNA, 1266 bp, Bovine  19866880509623
atatgaaagcagcaacggaattaagcagcactcaggtttagctcttcagtctcaggggcttgcctccaagggaaccagcataggaaaccgcagaaggcgtatctttcatgggcaggacataccacactgtactatttcgtaaatcaaatggaataacttctcagaaagaaactttgaagttgtgaaactgtacaaatatatttataattatttttgacattttctgggtagtttcataaagagaatctaagtaattacgcttcagatttagaagtgtgataaatgataacatatttttcaaagtattgtttactggctagagtagccttttagatgccttaagtatagctctcagttcaagttctgcttgaattatgcatagttgtatatacttcttatatagccactaacttcctgttttctaaccctttctactggttcatttaaaattaattacataaatgtatgtgaatattaggcttatggtttaaattgtgttgaaaaataaattcaaagaaaaacacttctacatgttagaaaaagacgataacatacaagaaagagaggaattatctttataatcaaaagatggagaaacggttatctcttaacatggaactgtaaattcaaccaccataaaatcatctctttcaattgatttttatgtacatacaaaacatgtaactgcagaacattttataaacatgaagcaaagataaatggctaggttttatgtgtgcttccaaacagcagagccttccagaaacttaccagtcatgcagttttcaaattcaatgtcatcaattgcagctcctcctcccagatcccgtgtacggagaccttgaaatatgacttcaaaattccttaactttcctagaaggatgactgccttttgccagcgatcaccagagttctgcttattttcttcccatactttcgatagtcctttctctgtctaaagataaagaagcttgcattaggcaaataatttaacacaaaagaaggaaaaaacaccaattatttagaacacaagcatttgaccagtgaaagctgattaaaaagctgataatagtcatggtatactttaccccattgaaacagaggtccattaatctactaaagtattcccaaaagaaatatgagcaagacttgtaaacttgtttgaatgttttcagagacatcattattagcaagtgaatactcacttaattccacttcttcttgcttgcatgcagagttctcaatggatagttgatggagtctgaa

SEQ ID NO: 51020 - DNA, 2038 bp, Bovine  19866880540350
tgcacattgtgaagagctttaaaatttttctcacatcgacccttattctgtaacactttatgaaaccggctaatcgttattagatctccttcagaaccacattaatcacagtgaactcagatgacatcggtgctgttatacgagctgcaattccactgcaactccagtaaaatatgaaatactgacaaaccacgatagtatatggcagattgtaattagggctgagctttactatagcagaattaatcatgatgaattattttaatactcatgcaaatatgttgcacacttactaggaattctgctatataatgaagaacagtaagcaaactcaaaaaagcacattccctttttctactagtataggaatatatgtttctgtttcatttttcctcacaaatgctatatatggaaattgaaattttatttcattcttcaaattctatcctccattaaaagttgtttcatacattattcatgccctaaagaagataattaaaaaggtcaaattactgactgtaagcctcttgacatcttccaccagctttctagattttctccagaattactagaattttctccctgatatgtcactaaggaaattaatcaatttggaaaaggtttatgcattcaactaatgggcaaatatagtccacctaacactgcctgaataacaggaagtcgcctgctgtttcaaaatggatcactgcaaatataaaatgcacccttcttttcaccaccagcacgattaaaagaaaacattacagggggagaaaagaggaacacaattgtattctaataaacaaacaaaaagccagcagtcagaatttgacagaacacactgtaataaaatctctcttattttatagaaaataaaaagagcagttgggtgaacagtaagaaaaaaggtgtaaggactgattaataactatacattaattaattactaatacattcattggatcaatattattgcaatacaacagaggacatggtaacaagaggctcagaagatgtaagtaaaaggaaaaattaggataaataaaaataagcattactaacttggctacactgctcatgcttatcttgctttattcgtgagaaggaatagaaaattgatataatagaatctcaagtctatgataagcacaactgtacatataaatatctataagctaactatatcacacatagctccattcaagtgggtgggtgggctcaagtgtcccaaagcattccttttgttgtctttatatagtcacaaattcaagaattggccatttgagaaagtcacaaactctctcatttacagtccacaccaggtaagcagcatttgtgaatggatgctgtctatacaaggagtatttgcattagggttacttcacattacacaataagcattttgatattgtttctactagcactgtcagtgggaagacacagatataatccatggcagaggacagttgggtcttgctctaagacaaaaattaaccataatttttaccgaaatatcttcaatttcctaacctctaaatggtagcatccttgagaaagaatgaacaaaaatttcaagctgagatactaaaaaagtcaatttgcatatataactgcagtctcagcctcttttgaatatttaattaaggcagacatttaaaaagcttacttgataatcatatcttgagaaaaagtcatgaatgttaaagttcaattctacttctgtcctgtatttatttcagtcttgcaaaaagctttgcaaattatccttagaaactagtcacaagaaagagcaaacccaagtgtctctattctggaaaattcactttctctcttggtgtttttcccagaataaatggaaggctgttaaaacactaatgttattgtatgcaaggcagtattgccactctggacattagggaagccaaattttcctcctaagtttcattagcaccttactgaatgacttaaaaagcaactgaaaaattccagttcgatctgaatgacctgcattatctgcagaggccaattctacttacat

SEQ ID NO: 51021 - DNA, 1026 bp, Bovine  19866880549540
gctggcgctgcaaagattatgaatcctgtctcatgctgaatggccaccccattagaaactcactcagcttttatccactgtgggttctacgttcatctcccccagatctctgcagtggggttgaacatagtaatagacaaaagccttaggaaggattcatcctctcaggtgtttctgctgctggggttcaaacagggctatttttctgtattcttttcttaaaactgcagcaaagcaggccgaaactatgatattattaagaacaaaaaagtattctcttttcccctcagattaaaccctgtggtgttgaattaaccccctggagatggctgaataaagatagtgtatctgttaaagaattagatgttttacagttaataagactgcacttgatgctatattattcccttgtcagaaccttataaatcatttcataattttgaaagaactgtaggaaattgtgataaaatttggcgatctcgttagcagccctttgttaccgacactcctctagctttagggacttaatctttttgatgatttatttaaggtgttcgagagtctctgagttgggcaaagagaagttagaatttaaaaaaaaaatcactaactgccctctttgtgaaatttatggttttcagccccactgctgtgaatttttaccaagcagatgaaaactattcagcaatatatgaggattttgctagattgccccagcagatatacaaaagaaccaggcaaaactgttctgattcattatcaaagatcaagtacagaattctatattcttttatcagttaactttccactagtggggaaattaaattcaattaaagttagactgaaatttgtgagcaaagaaatatatggcttgagtaagaggtagaagggtttcccaggtggcacagtggtaaagaatctgcctgtcaatgcaggttcgatccctgggtcaggaagatcccttggaggaggaaatggcaaaccactccagtattcttacctgagaaatcccatggacagaggagc

SEQ ID NO: 51022 - DNA, 2069 bp, Bovine  19866880585583
cttttgttctgaatgagtatggatgtcatagtcaaggcctcaggttagggtgacatgagtcttatgtaagtttgaaaaggatcattctggctgctgttatgagaagagattatatggttcaagggtagaagcagagagatcatttaaaaagcaatcacaaaaatctatacagagacactggtgatttggaccaagaggagagaagcaaggaaaatgagaagtggagtatggatacacgtgcagctagtggttgatctaatttgttgatgaagtataagcaactagagataaattgtcattcactgagacaagaagggaagcaaaaattataggattgaggagacaatgggtcatcaaaattttacttttacacattgagggataaaagtaaacttgttgaattctgattttatctttactggccttccagagaggggtttgactctgcagagttccatggaaactgctacactgaggatgataattaaccctgccagaatcatgagccggaaaattggagctggggcatgtagctacagcagaaagcactggaatccagccctctgattatgtctggggaggggtagatactctgatggaccattgcacgtaaagttttcagcatatgaaaaggctctccttggattactgcaattgatttttaaactaccaaacctctgatcactctgaggaggagacggtgcttcttcttgtcatgcaattaaaaagtctacagtctcaatcccaaaatcaccttccaagagcttgatatctaccccactagatcactatgcactgctggaatcagtttcccttggggcgtgtttgttttaggttatttccctagttatctttgagatgctcattacatctaagtttggatactgaataggttgttagtatccaagtctggagtccagccttcttgggcttccctggcagctcagttggtaaataatccgcctgcaatgtgggagacctgggttagatctctgggttgggaagatcccctggagaagggaagagttactcactccagtattctggcctggagaattccatggactgtatagtccatggcgtctctaagagtcagacatgactaagtggctttcactttctttctggagttcggggtggtgggggcgaagtttgaggatggagatataaatctggaataaatatattagttttttaatggaaagaagtctataacttggaaaggaaatggctggcagcaatcctcaggaatgtttaaagtgcagcctgagagtaagacatcactgaaggtaactgaatggttactaaagtctccaaaacaatgtaattacaaagcaatcagttcagttattataattgctccccccccacccaatatgatagaattactgtttaacctcggacacattttcctaatactttgaatgggatgggatgtatacacaactgattcaaacctctttactatgtttgcaaagagtttgaagaattacaaagatttgcaaccttttccagggttaatatattaagagaatagagagaagtgcaaatacttttggaatatttctggaaatgaaatattgatttccttggaagttctattcaagtaaacaggcttgaaagcactcatacattgaaatatccttccttaccagggtagagagtgcagtccatgaatgacaaatcatcaattgcaatgtctccagtaaagccatctcccactgaagcctccactgaaatctaaggacaatataagaaacttgttgatattgtgaaggaaattcatttatggatacacatggttgaaaaagaattcagaatttacctaaagacaatctcctcttctgaaccattaaaatcatactttgtaaaactctccataagcaggcatcttggtctctctaccaaatacttccagtcataggaagcgccacaccttactgggcccattatatccacgaagcccactttcaccctgcttctggtcaaagttttgattttttgagatttcagtgtatcagactgatatctacttctttataactttccatcattaattctagacttgt

SEQ ID NO: 51023 - DNA, 881 bp, Bovine  19866880589140
ctgcactatttaatatgattcgccttttgggttcatctatgtagaaatatggatattgttcattttttccagcccaagacagcctttatacctgttttccctggtgcttaccatgtaaatcagcagagtgtggataatatgaaacaaggcttcacttaaaggcttcaatgatgactgtgtttcgtgaaatccattatgctacatatcttgttaataagatgcaaaaaaacccctcattttttgatgaaatttttttctttctcttttcttaatcttggtttagtcttttatccatcaaaattgtttgttcccgctggagaaagcatgcgaagggaaacattactcctgccgggtggatggcagtgcatatgggaggtgataaatcattttgtcatgttgaggaaatcagaaattcatctgcttccacaagagacaatattatgctatgaagtctatggctgtctattcttaatgctgcgcatgtcaggaagccactcagtacatcagtgataaccccgctcactgttaacaaagagcttcattaaactgttaaatgcaatatcacagttccacttagaattgaggatcatgtgtcagtggcaaagaaatgctcaaatctctccccatcaaggtttcaaaaaatagaggaaggataatgataaatgatattgatattttaggttcctgtctataatctagaagaatctttatctatttctattatcctagtttcataaatttaattaatcatctaattaattcctggactatgagagttgtaatggtgaaaaaaaagtaacatttatcttcacggttagttggtacttcagtgaactgagacatacagggtttaaaggaataacattatatttgtagactac

SEQ ID NO: 51024 - DNA, 970 bp, Bovine  19866880669376
gggaggcctggcgtgctgcaattcatggggtcgcaaagattcagacacaactgagcgactgaactgaactgaactgatacactgtactgtctatacgttctaaatctttaatattatcaagacatttgagcaatattatggtaaattcacatataatcaatacttaataatgggcaaggaagggaaaaaattcacaagtgtttatttcttctgatcctgtgctttgcctattcagatgcagattaattttcctcctctcagtttgtatctctgactgagacattcactttcaagttaaataatttgcctagatccattttttaaaagtcatagattggtagatgccaagaaatggataccatctttcaacagtatatagctactgaagtgtccacatgtactaggattgattttcttattaaccctgcacatttgacatggtattcattgtatatgtgtattttgacaatggcaaaacttgaacagattcatcttatttgagggtattatgcttcttctctaaatatttccatttaatgatattgaagaataaagacaaaatgaagatgaatttaaaaagggctggtaaatgatagccctagaatcaaattaaggtcatgaaaacaagtattttgaatctaaaatattaaagacacttacctcttgttggacatgatagaagaatgtatgctgattcttctatcattttctatacaaaaaacttttatattaagaaactgctttaaaccaggttgaagacttctaactaggacattacaatactacttgagattacactagtgttttcttatctattttatggctatatttaatacaaaatttaggaattcacataccgcaggaggattcatctgattggtcagggcagtcatatctaaaatcacatttctggatattttcaacacactgaccatcagacctgcaaacaaattcactgtctgtacagttg

SEQ ID NO: 51025 - DNA, 1344 bp, Bovine  19866880754111
acatttcaccagccaacagataaagttcaatataaagtattaggtttaatttaaagatatgaattggctctgacacacagaatatgtttaacaaattatatcaattcttggcagaaatttttagctttacacacaaaaggtgcattgcagtttaagaaaacctaaaataagaacagtcgtatataatcagataaagaaactgctgtgaattgaatctcattcaagtcctataacatttgttcacaaagtgtgtttccctccctcatcttactgaaaaatattctgaattcaaaataaaacaagtctgtaacaatgaagactggttgaacatgaaattttttaaaaaacaggatttataatgttgaaaatatttcaagtgttactaaaacacaccactgttaggagtacaagtgatatgtctgagactgcctttcttccaagagcatttgaaattattgacaaactagatgtggcaggtgtttgcacgactgcttttactcccgagtattcatcatgatattagtagtactctctgctgttatggttcaatatggttgtttctgtgccattaagcatcagtaaagaaatcaagctggttggaattatttagtataacctctggatccctcaattttccagagttgcagtgatgattaaattaaacataatggtgaggatttcaatgataatcatgtctaacatttactgagtagttatcacaaagagttactgttcaaagcttctggcacatattaacttgctaaattctcacaaattgccctataaagtaggtctgattttcattgccataaaaaactgaggtaaagagttgataagtgcttattcaaggtcacacagcaactaagtggcagagacaggatttaaactaggaaggctgactccagagtctgctcgcttcccctccgggctgtgagatgatcctagcacaaagcagctggggacaaagctctgcatcctgagggtcactgccatctccccacacttccttctgcttcaggaacgcattccctcccagtgagtctgccttactgtgcctgaggcccggagtgcttttccccagggtgttggtgtgattgcctttgttttttaatatttggccatgttgtgaggcatgtcagaacatagtttcctgaccagggattgaacccatggcccctgcatttgaaacagagtcttaaccactgaaccaccagggaaatcccatgtggttgacttagtacattcaagcctttgcccatctgtaactttcagagattactttgactactctaatctgggtaataattctcaaatactttctccctataccattcatagtaccca

SEQ ID NO: 51026 - DNA, 1188 bp, Bovine  19866880814407
tcacctaactatctactaaattattttctttctcttctttagattcccatttgattttacaaaaggctgaaaattctgaacttcagtgattttatgacagatcaattaagaatatgtgccattcttatatcttatcattcaattttagtaatagaggtcttgttcattctctcatattccctcttagccactcaaaattcaatacaatttactctctttattaaggcaagtgctacatctatcacatatcagatgattttctatagaatgattctatagaataggatgattttctattctatatcaaaattataaaattattatattattctaataatagatgataaaggaaacctacctgggctaaattgagtcacaaaccaggtttaaaaagcctatttgttcagaataaaatgttttaagatcccttttttaacaggaaaattttgcttggctgcccaaaatgttaaagtatgcactatttttctaagaacttctataatacgtattagattataatttccatcatactctacgttttattaggctgcataaataaatgtcttttataggcttacattggctttaattctcaaaattattttggaagatgaaggctgtattgaataatttgagtttaaccatgaaatgaatgtgacaatgattccacttcagcagcatttggtattagtattgaaaacagtctatgttctcattacccaagacaatcctgttctctcaagaacttgagaaaattgtgaaacagaagcaattttttttaaattggaggataattgctttacaatgttgtgttggtttctgccacatagcactgtgaattggccagaagtatacatgtgtcccttccctcttgaacccctcctcccacccctctagattgtcacagagcaccaggttgagctccctgtgttacactgcaacttccccaaagctatctactttacaaatggttacgtatatttcaacgctactctctaaatgcattttgccctctcctaaccccacggtgcccacaggtctgttctctgtgtctgcatttccactgctccttacaaataggtttatcagtaccattgttctcgactccatatatacgcattaatatactatatttgtttttctctttctgacttacctcactctagattcagccacctcactagaagt

SEQ ID NO: 51027 - DNA, 1406 bp, Bovine  19866880817865
ccatgaaaagtatagagttatttgaaaatagattcgttgtaaatgcatttttatgagtctagagcaaacactaaaaaagtaaaaatggaagtataattgatatgatttttctttgctaccttcatcatcactgctttgatgttgttgaggtgcattttctaacacaggaatttctcttgcttttgtgcgcatccaggaagtttgcccagcagttgcttctgatacccagtcacacatgtcaaatgcaaatccacaggcttgacacactgaagagaggagagaaagatgctggcagactatcacagtctactggagtggctgcttaacaagggctagagctgcaatcaaggctaagcatatatacacacacaaatacacaaattcatacctataagccttagagtgaactcttctttttaaaagttcttaatttgatccagacaggcatcttcccaaatgagaaccattaccatacttccattgtggtttttttttcataagaaataccagactttacctactttatggaattcagttagcttaaaccacttactattcataatcacattaaaattttaaagaagatacattgtatttaatttcatgatttttagagcaactgtttttcaaaacattaccttaacttgatatatttactatcttccacttttttaataaaccacacacttccaattacaatccagctaaaaccccaatgatactcctggtaaaacgagaacattgatgacaacagagcttgtcaagtgagtacccctactagcggtttgatatttcttttggggtccgagtctcatggatggcaggcaggcatctcatttttacacttacacctcaatccttcatctgtagaatcaaatctgcagagacttctatctggatggcatagttccttctcggtatttgatgcctcttgacatggcaaaatgtcatctgttaaatgtaaagattggcaaaaagtgagctgtggtatcactagaaaggatcatggatttctcaaaaggttaacctttgttctacagagactgctgaacccaactcttctctatggcagcatcacaccattatatagacaaagaaacaaattcaggaagagaagagaagagagaataaaacaaccatgccagtacttctaaattttaatcagatctctgtggtgatttctaagaccccaagccaaatcatctaggtctccagtgaagtaggttacatgccttaatgtggaaacaaagagactgtcattaggctgataactgtacatgtatcaaatacaacatatggtaccctctttacctgggtccgtcctggatttactttccttgcagctctttcaaatggagcctatttcctcccactccccccacccccatagtcctcccaacacagga

SEQ ID NO: 51028 - DNA, 628 bp, Bovine  19866880902274
aaatgagtgggaaggtcatgtggacatttgggaaggaatcctggcagagagaggagcaagttcaaaggtccctagacatgagagtgctttataaaatgtgattttggattgcatgctttatcggctgatttcctttttctctccaccataaattggaaaatgttttccaggtgcctccagggggcgctgtgactttgagtttgatctttgttcctgggagcaggagcaggatgatgactttgactggaatctgaaggcgagcaatgtccctgctacaggcacagagccagcggctgaccacaccttgggaaattcatctggccattacatctttataaagagcttgttccctcagcagcccatgagggcagccagaatttcaagtccagtcataagctggagaagcaaaaactgtaaggtatggagaaaaaattaaaacagaaatgttataagcaacttctgatagagtcaaaaacagaaaacagaatggccagaaccagaccaaaaagtgactttgaatgcactcaacttggaattttgtgagcggcagaaagtgaagatgaaagggaaggtttgttagaactgttggaagaatttatcctatggataagttccatagacaaagaat

SEQ ID NO: 51029 - DNA, 1240 bp, Bovine  19866880967578
acacgggagatgcgggttcaacccctaggttgggaaattcccacggagaaggaaatggcaactcacttcagtattcttgccccaaaactgccatggacaggggaaactggcaggctacagttcatgtggtcgcaaaaagctggacgcaactgcgcaactaggcacacattgaagacattatggaggttctagagacatgctctaaggaactgggcatggaacaccatggagtcttaacaaaaatagcatcgtatcttcaaaaccaaagagagaggattggaatggaaaggagacttccgaattgtgtatggtgggcatgaagggtggctcaccattctgctgagtcaaagaactaaacttaaaggatgcccaccaggaaacgggcagggtgtggggaacttgggtggacattctaagagcctcagccaccacctgcatagcctgccaaccagctaagcatgtgtaccaatgccacacagccataaaagactttttgtatttgggcattgaccattccttcaaatcagtgtaagatttgtattcatttaaatgaaggttggttatgtaaacttttcaaaaaaagaaaatgatattgggattccctttctgagttattagacaaaatcattaattcaaagatataatagcctctagttcttgagaatctgttaagatttgtattttcataaataatgtattattatactatattagtctaatcaactatcatatttaaacatgataaatggcaatcaaaatgtcatttctacatgtagatcagacaagaaagcaggattttttttttcagtaggacttactaaaattatcagatcatggtatttctattttttaaaaattcataaatgtgctcttttaagaaatagatcctagagaatggatgatttctgcagactttcatcgaagtgttttttttaaaggtcctagtttagttttcatgttttatgggaagagtataagaattttaaagaagtgaacaaccctggctaagtaacattgccagtaggaaaagggtgtgttcatggtctttgtaatctctgaacaataaaccttattttgcagtagggacttttgtctgttttgttcacagatggattccaagcactaagaactggtcttgataaaagaaaggcactcaaatattgagttgctaaatgaaatggagcttttaaggaaaaataatctaagtaagggatgttttatgctgtttccagctgtaagc

SEQ ID NO: 51030 - DNA, 811 bp, Bovine  19866880999597
atgtgctgttttagtcttggcatttaaagaattacagctaccgcttcagaaatatagatccattttgaaatcacatgtcacagtttgcttaacattttcagatagctaaatcatatggtactctgcaagtaaggtgtgggtgtgggtgtgtttgtgtgcacatgggctcagttgtgcgagtaacgtgaagaactttaaaagagaataaataaatgggggatgaggaagcaaagggggaataaagagacaatattttcatatccaccagttcaccaaattctcttaactgaatgaagtagattaaactttacagatgagggaactaaggttgagagagcttttaatttgccccggatcacacatcaattttggagaaggaaatggcaacccactctggtattcttgcctgaagaattccatggacggaggagcctggcatgctacagtccatagggtcacggggagtcggatatgactgagtgactaacacatacatcaatttaattgaatacttattaagcagctactttgtacctgatactgcaccgccacacaccaggaatacagtggtgacaggtttcacagagctcacaaagtcagagagaacagataagaaatcactgatggataagcaaggtaccatggcagctaagccagccttcctgggaaactagcagttaaactgaaacctggaaaactggtaggaattagctgggtaaaattagttagttttcatgcatgtaatactactttcatattttttgatgagaattttagggaatatccaatatgtacaattcatgtttcccat

SEQ ID NO: 51031 - DNA, 1446 bp, Bovine  19866881155854
tgggagtgggttgccatttcctactccacattgtcctatgatgtagtatcatagaattttactgcttctctttttcttctcagacttgagcaaaggtaaactgaagtacagatctcccttgacttaagatgaagttatgtctcataagcccatcataagttaaaaatatcaaagtcatagcacagggaactctactcaatactctgtaatggcctatatggggaaagaaactaaaaaagagtggatatagacatatccactctgctatgtttaaagtggataaccaacagggacctactgtatacagcacagggaactctgctcagtgtcacgtggcagcctggatgggagggggtgtttgggggaagaatggatacatgtagatgtatggctgagtccttttgctgtccacctgaaactatcgcagcaatattaattggccatactccaatgtaaaatgaagtttttttttaatatgtgtattttaaaatacatacatcagatatgtgtataactgattcattttgctgtacacctgtaactaacacaacattgtaaatcaaccctatgtaaataaaaagtttttataaaaaaagaaaatattgaagttcaaaaggcatttgacctactgaacatcacagttggccttgcctcccttaaccacgcttagaccacttacattagcccacagttacacaaaatcatctaacacaaagcctatttcatactacagtgttgaatatttcatgtaatttattgaatgctctactggaagtaaaaaacagaacagctgtaactatatcgattgtgcatcatggtgatcatgtggctgcctgggagccgcatctctgcctcttcccagcatcagaagagagcatcacaggtgtatcattatcccagaaatggtcaaaattctaaatgtgatgtatagtttctattgaatgtgatctctttcacaccatcattaaactgacgaatcattaggtcaaaccattgttagctggggaaagtggggtaggttcgaagaacctctacaggcgtcttaccttgagatgtgttgtgagtgtgatcccaaggtggagcctgatcctcaaattcagcagagaggttacttctagagctccaggtccactcaaaatcatcaccacgggctgcttcaaaccaaccacagctatctgtttcaaagtcacattcggtaactgaaaaagaaaaatgcagcttttcggtagactcttgaaggtgatcacgtgtttaaaagggtagacagagctcaatgggaatcaccttgccacatttgcctaagtaaagttttatttgaggaagaaaaggatgatatctgatcccctcaaaaaaaaaaaaaaatcccctccaaaaaaactgaaaattgataggtagaatcaacaatttaagaatattttccaaatatttttctaagaaacagcattg

SEQ ID NO: 51032 - DNA, 2195 bp, Bovine  19866881234935
taggtttaaagctctgttttgaatatttacaaagttggaacatgctgaaactatagcagggatctaaaaatttaattgtggtaggggacccctgtagcctccctttccacagaatttaattaaacagttcccatttgactttatgtttcttggtttgcctcaagacctgagtgtaggtgagcttggtggtaaaatctgatatgaaatggatgatcagaaaggatgctttgaccaagtgatggcaattcggtagacactgaaaaaaaatgtgtaacacattgcaacagagaatgctagatgtttcaaacagttttttagaagacattacacattttttttcaactttcatctccacggaaattggtacccacaatgacataaatgggataataaataaataaataatgcatgtaataatgcctgtccatgcagcaaggtaaaagtccagtgatgaagggaaagaaaaaaaaagcaggaatttaaaatgtagtgaaactgaaaaggagtcactttgagtcgaaagagaatgatttcatttctcaggagcctcatctctgaacaatgctctgtctttgaaacatgaagcattagaactctatggcataatgagaggaagaaaaaattactgttgtgtctgaacctggttttgtggggtttttttcttgatatattttgtattatatcatccaaccactgaggcaattaattttcaacttgccttgtgtccagtccttagtaaatgatcagtaaatattggttgagttatgatagtgctgaattccatgttatagctgcagctgtcagcacctaaaataatcctctctgttttctccactacctcgttaacctgtcagtcctttagattgtgccaccattgatggtgagtaggaaacaaaatgatcaaatctgggctccctaacctcaaaaagaacattctctagttagattaaactattgataaacagtactatgtgatctcccaaggtttttgctaatgtcacaacaaagaaggaattaatgaaaaagtattccttgcagtcttcttttacttgaggaaattttgaagacatcaaagagaataaatagcagtatgtgattttgtaatttgagtcagatatagaatgtgtgtcttcctatattcataagaagcaggaaagcagagaaaagggtcctaaaattgttccctaatgatgtagacaaatatttgtcctcatgcttgtctgagcaggatgctggtgtcccatgtctttagacagctctatagcatgtgtttaaaataccagttaatgtaactgccttgagccttttcttaaggaggggccacaaaggctggcagaagatgtacttagcattttctgggtctacatatttggaggagaattaagatgatattgaacaccaaagtaattttgggtatttttaattatagatctactgggcataagtaaatggaatatttatatcactcaaacacacttttcaccaggtgcagttttggtatcatttgtctcagcattcacgtctctcgctttttacaagaacatctctgaatggggatttgcagaagcacagtgatctaatcggaatctctgaatctcaatggcgacaagcaaaaatcaatctcattgcaaaggctggagaatctactctcccttttcaggtaagcatgtaagagatgaatacaactcagaagaagatgcttatttaatgctgatcttcccggacaataggagaacacatatgtcccataagtttgtctgatgttgataaagcaagcatattcacagtcagagataagtagagaagttatcttgactaagtactcacaacttgtggaagcagagcgaaagtggaagtaaggattgaacagatggcagagacaagagaaatgtaatgggaaaatatttttcttaaataaggatggtggagtacatgaggtagtgaaaaaaatctgagctgcattcctatttgctgtccattaatactgagaatttttatcacacttttacgtcattttcttggttaaataatgaaagaaggaaactgtagcttatcagatgagtgccccagcttccacccttctggacatgactcccttctggatgatgtttggaaagagctagtttagtaactagattgggtggtggaattagaggaacacacactgccatcagtcagatggtctgagttcccat

SEQ ID NO: 51033 - DNA, 1970 bp, Bovine  19866881302459
ctgtattaaatggctgcagtactttgctttcacttactccccagttgcaaacaaataactttcagttgaatctggaattcaatgtttttaaagtaaaaagaggttagggaacaaagctccccaaagaaactacctttgtcgttgaatacagtaaaagagaaaatgacggagcatgaaagttgaagctgaaaatatccacatacaaaggggaatcaggaagtgactatccagagaattagaggcaagaaagaaatgtaaaagatagatgcagagtgtgtgctgggccccaggccttgaatatttatggctgtttcagcttgctgccccacctgctacataaaagttatatgaagacttgaggtgtttgccttttgtagagagtaaagaactgcaatttttttcctgtttatttaacaggaaggaatcagtccttctcctctgataataactttaaaataatcacagaattgatgtgaatctaaagattcatttttaaagagcaaaaaacatgatgtagttggtcgatattttgcactgtggtatgggataaaaacagcaagtgggaatttgtagacagaatgatgatgcaaaagctatagaagcttcatttgagatcaaaaagaaatctatgcctcagttggagggttgagtatggttctcctacagtcttctggtcaaattaattttaaaaatgaaattcaaattgaagaatttttaaatttctgcagtaagatgttgaagagtctgtttctaggagtttgccctttgtataagagaagagggaagtgatttcatagaccatttctggtcttgagttctccaatatttacttctctaggtatgactttcttcaatgtaactattgataatttgaagatacatttgatatcacagaacctagagatcccaagaagtcatatatgtttctggagacaggacaagtatatcatccacaattattcccattttacctgtgataaaactgattgcttggtgagatgtaatagctagacatatgacatatccattgttgaaaataacaccagtaggataaagacgattttttttaaagtaggtcgtgactctgatatgtgtgtgtgtgtgtgtgtgtgcgcacgcgcgcgctaagtcattcccattgtgtctgactctttgagaccccatgaaccatagcctgctagactctgtccacagaattctccaggcaagaatactggagtgggttgccatggcctcctccaggggatcttcccgactcaggaatcaaactggggtctcttgcattgcaggcatgtatacattttggtgtgctggcacagctgttcaaccacacttgatcatctaatccgatcatttttctctttaatctgtattcaaattttacattgttgactgatttatcttctatgctaactggatttttatttggcattgaacccatccccttcttccacatcctaataatgtgcattctcccacaaaatctttgggcctttgcttttgtctttcttgagaaggcagagttcagggtggctgctccagaaaaacccaaagaaagcatctcctagtatccatatgcaggacctctgtactggtagtttagataccaggtctcgaagaagccccacctagtcaccaagaaatgaccacaaggactaaaggagaattgtttttgcttcctttataaataaatgaattaagagagaagcatcaatactacagaatatatacacatttattcaataattggttaaatataccactactttgaaaatgtgcaagtcatgaatcattaaagccatcatgattcccatctaagagtttaggtgacacttgtcttcagctatttattgcttgtgagacttctataaacactgatttctccatctttaaagtgggatgacggtgtctgtcttcgctgtctcatagggcttttctgagaactggataaaacagtatggatagaagtt

SEQ ID NO: 51034 - DNA, 646 bp, Bovine  19866881389862
tggttgaaatttgcacacatttttctgtagaaacaatattgtaaatcatggtttgtttcacaaactagtctatacaaccctgttgaaagcataatatattctacacctgaaatgaaaataataggtgtagaaaacatcttttttgttcttttaaacaacaaaattataattaagcacatggcacagacggaataatcattggtagatatgatgatttttaaatgtgttgagtcagagataacgcaaccaaagggaattcatgtcctaaataagataagattttagacttacttttgaatgttaacatgtgagaggaattaaactaatgtggggaatgatgaagtagatggagagtggatgaataataaagggacttcatgagcattctcagagtccttgaatgtttattgtgctcttctgtttatttaattgaatttcaacactttgtttttttccccttggtttttgtatatttcttgcacaattaggttcattttatttatttggattgtaattgaaggaaacatttttatttgaaaacacaaaactttcctaactaactgcctcctctaatccttcatatttaaaagtttcttcttcattctcccttagatttatttttctctgtcttttctaaagttaattt

SEQ ID NO: 51035 - DNA, 1731 bp, Bovine  19866880458322
atgctctcctgcccctgcaaagcccctctgggtggatgaaatcttcagagacagggcttcaggctgagcttgcaactggttcctgggaacttagggccttccagcctgggcaagagctcgaggcagggcccaccgatctctagttcatctgcctccaatttgttcacttgtctttcctgcttgtcacgcagcaaggtttccttcatcctaagaaaacctctgttcgtaacctgtatcccgtgcctctggcccttaccatggccagacctgcctctactgctccatctcgcacgtgatccacacccctgctccccacctctgcctccccactgggtgggaattgaagactgtcaccacccatgggttactgccacccccggcccaactcagtgccccccatctggcttcactgctctccatcttaggccattcccttcctaggctcccccacccctccccgccttcatcccagtgcctctgatggctcttcctgcctttctgagtcctccccacccttatccctgtcctgtcccctctgtctaccccagggtcagtccgtgccccacccgcctcccttgctgtgccgtctgcctgggccttcgcacccacctccaggacttctctttggttcctggtcaatgccaccagctgacctctgctgagctgcagacccacgagcagcctgcctgcggcaccccatgccccccagcacctcgtgcccagctgactcattgccctacctgttctctaggactgcccacctttgccaacaaccaaggtttcttctaccttgggaagcaatgtaaatggatcccaggggtttgagttgggaggggaggagtggggggcataatgagatttgtgtggatgtcagggatgaggcccacttcaaaggagctgtgctgtgcctagggctctcttcctcaagcccaaataggaacacactgccccgtgctcagccccccactctgctcccttctttcccgcccttggcctctcctccttcactcctggtttcctctgcttccgtctcacccacgtcatccctgtcgcccagtgagcgaggggttttgcctgtgctgtgcctttccttagcctattcttggtaccttgaatgtcctggggggttgatcaatgttgaagttgttgaaaagatgtcaaaggccaagctttgttgcttgaggcacacgaagcgatctaagcacagaaggtcctattgctggggcctgtcagtgtctctcgggggtccagtcaatgccagaaacctaagggccgtgttccatcccaatgcctccctcctaaacatcaaccaggaaaatgcttccctcacagcctgaaagtcctaacctgggtaagtccagttgaatctcacagtgaactctcgctcccggacaggcaggataacctctggggagcatgtattcgcagacagggtgaaggtaagaagaggaggctttttttttggccctaccaggggtggaggaatgggtaaactcttcctctctcacttggtgggggaggggatgcaggacgatcacagcagagcacccctgtcatccccataaagggctggaaaggactcgaggaaacctgcccatcttcccgggccaggcctgcagggggcggggccgggagtccccgcggcactcccatccatgccccatgttgtgcctctccccacagacggtaaatattggtgttgtgacttcattaataaaggcttctgtgagc

SEQ ID NO: 51036 - DNA, 931 bp, Bovine  19866880500455
ttctcccatctaaacctttggcccacgtctctctccgatgctccacacctggacagctctgcttggctggctcccgttcaccttagaccaaacatctccagaattgctgtcgtagctcctcagctctcgcttaattttgtgtgtcacaatttgggatccactttcccatagaaatatggagcaacagcctcctactggcctgaaagacctgcgtggttgacgaggcctgtgagagccagtcaggctgtggccacctcaacattgccatttccactgagaacgtactctgggtgccaaacagcccattcgcagcatttagctttcctaactggatctgcttgccccagccataagtgacctattttggcccttgctgttttctacttccagtcaaatgtctgccaaggacttttctagaataaggcagaagagcagtgggccctttggcgtctccctggacatagctgccccgtgtttccatgtgcggagctgtgctgagggaggcatggatccctttggctcccagaggccttccttttctcctgcccctcaggctactgggcgggaatgtccctcgtggctgaggctgtttgcaagggtgggagttttgggcaccctggggtcctgaaattctgtatctttcagccttcacctgcatccaagttcatccagggctacctgggagccgtcatcagtgccgtctccattgctgtgagtagcccccaccccgcgccatccacgccaccctgctgctctgtggctgtcccctcagcatttcggcccagaccttgtactgagggtcagggctgggcaagcagcgcgggaggcagaggtttctgcgtgggggctgtcaggcagaggaaagtagaccataggtagagaaggcgacgcttttgtagagggagagcacaggctggtgctccaggttccg

SEQ ID NO: 51037 - DNA, 1581 bp, Bovine  19866880507433
aacatactgataaatgttacggcttcttcaaacaaaagcaaactcaaccaatcattaatgatgctttgacctctaacacagagttatttgtttatgatatttatcagagaaactagtatagtaattgatgtgacatcttataagctacaaagaaaaaaggttaataaatattataaattatgtgattattggttattatacaaaactgtgtacaagttttgtacaggtaaaggatatgacaaggaaagatatcaggttatactaaacaagctattaatcctaggaatatcttcttttttttccctcttccatgaatttaagctatatgacttctaactagggctttggcaattctaaacctgactctaatacatttcattgtttcagaacatgctcatggctttctaggactcaaattacagttctgatttcatggggtgacagggggtgggcaggagggggaggagaaagacccagaaaggatgagtaaattgctgaaagtcacaaagaagacaagtagtagacatggcttgatgacttctactccctaagacaccatagctgtctatttttaaaaatcatcattgattctggataaagcacttgcctaaggctaggtcaaagttctgaccagactttcatttttttgcaatggtagctaggaaagactagcaaaattcaaatgagtcaaggtgcaagctagttcaaagccagacagtgagctaactggcagagtgtcgatagcatcataatagtagaacaaacgcaaacttctaggaaagaccgtagaaatgagatattaagataagcatgtcaacatacatacttgttcatgcatatcaacatacatacttctcccacagaacatgcagaagtgattcaaatggatgaattgttcatgggtaaaggagaattacaggttaatattcaagtaaatggtcctgagggtgctcctgtgttctcagaggcagaaaggattaccacctcgccccccaccaactcagaaagtaaaaatgaaaagatcagtgaaggacgccctgcatgttcccactgctgttgtttagggccaagtcgagtccagctctttgcgaccccatggactgcagcgcgccaggcttccctgtcctatctcccaaagtttgctagactagtattttttactaaaccagttcacatcatgcttactttggtgaggagaattattctatatattctcaccttcactgctaattcttgagatatgaatctcatctcccatgttgacggggagcttcacaaggatggagatcatgtttcctcctcctgactactccagaacatggaccagatagggctaggttaccagcaggtaatcagtaaaagcacattaaatagaattaagctaggtaaaaatgacattttataggaacaatattggggatggtgggacggacttataatttgtttttcagaacaaactttacaaagagaccaaacttagggtccctctgaccagcactagaaacaaggttgtctggggaagaaggacacatcaaacgggagcaataagagttggacagagaggggcacgaaggggaagat

SEQ ID NO: 51038 - DNA, 1480 bp, Bovine  19866880548308
tggcagaatgtgcggtctgtgagttccctccaacctggcgccccaacccctggacaaacagcggccgtgtcggcctgtccacagcgggcctgtgttctccttccaggccaggagatcccaggggcaggcagccgtgcgggagacgtcactggcccactgggcccacgggggagaggccaggacagacttggtgatgacaggccagccacccgcccagccgcgccctcccaccccgtggcagggcggtcagaccgagggcagcccgaggaccaggctccttcacctctgctgccacacaggacattccaccgggagagatggaatttacactctgaaaaactactgccttccactggcacacttcctgagggaagctgggggtgtctgttgctgcttcttgctggccctggaggcctcagtctgagagagcccttgggtggggcctgtgctgttagggccaggtggtccccgttctggcacatgacatcctctgcttctgcatggttctgggaacatccctgctatgctgagactctgcttcagcttaaggaaacgggggatcaccttgctctcccctccccagggtggaggttagggcttggggagtacagatcggggtggggaagcaaagcaagggtgaagcagcctaccggtggcactgcccaggagatgctggtgatgcccctctgggtggcccggttctgtgacccaggttgtgagaggccctgtctgggctgaggttgggtctgactgattgtatcaaaaagaaacactgaagccacaaaacggcctttttcaggccagctcagtggggactttcactccccaggctctgaggaagggcctgggcacagacagggtctgggactggcctgagcactgtgaggcttggtgcttgccagggctgggccccccggtgcctggtgtagctccagggaccacggctttgctactcactgccctctctccctccccacccccagccccttgttctagggactgccctggacgttccttgtctggcactggacgatgtgtcttttgcagggtcatctctgggctctatgacagtcacagagtttgagaatgggcaaagaggacatggttttagtcatcaagtgggcttagggacccctgtagcctgtgagctcttcactgtccagccctcagcgtgcctgactctgtttaagcccttttgcaaactgatttggtcccagaatcaatgcgttcctgtgacacccatgaaatagccctgcagaagtgcctcatggagtgtgagacttggaagtcaggagaactgagttctgctctcctatttgtcgtgtggctgtgaacatccatgtcctcacttgtgtaaacaagctggactctgcagcactctggttgccaagacacctggcccagccacgcggccaggactcagctcccagtcattccatcccacatcaggcttctggggccaacgaccatccaagtacac

SEQ ID NO: 51039 - DNA, 695 bp, Bovine  19866880560076
tccatttcaccccttgtgacactgaataaaaaacaactgcattattcttttgcttccgtcttcacatctcctccctctcattatctaatatcattgcatggtaaagtcacagttcataaaagcaaaagttgggggatcctgcttgttttggctgagagcacctattgttcgactaaacagagtgtttggttcattttgtgcttttgacacactagctggaatgaatgctcttgttggtttaataaacaaagaataataatccaaaatggggtttgattactatgtggaatttctcgttcatagaatgatctaattgttcacatctctgcgtagtgttaagcagtaaagtataagtaatatggaggtttttctatttgaaaagaagtttcagttaggacacacgtaaaaacactcttggccttcccaactccttttttagtaggagatgtcatcatatactcttctgtttcttacagaacacttaagtgaagtagaaagttcacaaagtactaaccagtaatccaggttcatatcaacttaatgggatttcacttggttgatgactaaggttcaatattggtaacagaccagaggaatctatctttttggaagtaagtgctttgtatttgcccagcatgtttcatctccatctaatgcacaaacttagaaatggactaaactccccacaatagtta

SEQ ID NO: 51040 - DNA, 1033 bp, Bovine  19866880592181
atttcttgggaaattgtcccctaaggtgggatgttcattctttaaggatgggtctgacatgtgaaagggctaagactttgactgagcaatggctagaagcagtttccttttgaatgaaaggctttgagttcaaagcaaaacaaaataaactgtatgaagaacatagaaacaaagttgtgattaaatttgttgtttaaaattaagtagaatgttcttaatatttttaaaggtatatacttctaaaaataactttataatcattaattctaaataaaaggaaaaagtttaattttccacacagatcaaagtaattttttaatgcgtttctgttcttgtctttttcatgtacacatgtaatttttaggtaatttaaatactattgtaaatataattttatgggaattttctgtatttcttcttttgaaattgtttttcacttagctacagttttcactagtaggctctgattttccggaaaaataaaataaatttccttgaaatctccacttcagaatcaaagaggagcgactgtaaaggtgcttaatgttgtagtcattttaaagaagagggcctgtaatgatcacctattgcccattgttgtgttaagatgaaaatgaaggtccatttgtatccttaaagttagaatttttacatgctttttaatcatacttttctttacctacatggtgcctgtccatgaaatgttttacttagtaatttggcagtgctcactaactcttctagatttttttttttttaagtaaaactgtgctttggccatggtataggatcttgagcaccttatcagtctttggagtcacaaaaacgtttgtttggagtgcttatagatacataatatattgagtgagattcccaaacatagaggtttaatttctgatctcatggatgcaaagcaaataaacagaatggccaataaatttgaaccaatacatagagacatgtgatggtttgaagggaaaagaaagtggatattgtactattaattaggataataggtttcattagaaacagc

SEQ ID NO: 51041 - DNA, 3161 bp, Bovine  19866880594836
tccttccatgaacacccaggactgatctcctttatgatggactggtcttagggatagcttatacttgtgaatgagaaataagactgttatttagtttttaatcttttctatcaggagttgagaggcattggtgggtggaaagagtcattttcttggcttggattagtccatttggagcttcagtatactaaattatctgttttgggggacaaggtaatgtaatatatcagaagtaacttataatcaggaacggaagcctctccttggaatttaaggcttagttttgaactgttaacgattatgaagacgttttctttcctggagtttgtcaggaatatgaacacctatctgtgatcatagttcagcttctgctgtggtgtttggagcaaagttgaagaagtgatgcctacaatctactctgtgccttctttattagattctctctaattttaggaaggaaagagccccccccccaaaaaaaaaaaaaattcctgtttcttaatggtttttcgtctaagtaacttctgtcatttggttgtggaagtgtttatttgctttttggtgttttttttgtgtgtgtgtgtacagttttcatggaaatccccctttatgtgagatataaccagtatcttaatacattgttagttccatgttcttgaaacaataggacagtttagactgctgccagtgatatatttttaaaagagagtgggtagtatgggttaaaaatatcaaaggagctcaaactctgatggaagttgatataagaaattgcttcatttcacccttaagttcaaaataactcccaaagcatctggcttcacatttgtaaatgcccttttaaggattttggttagctgtcattcaggagtagagatcacttagacctcattaacagacaaatattccctttgaaaatgacatgatatctactgtaatcctagagtgttttaatagtctcttctgtgctcagcaatgaaacatttcaaaagtgactgacagccaattgatgtaattcatggtgatcttttgtgttgacagatctttaaaaaatcatgggaaattactactgtacccagtgaagccgcctccttttttttaaaactgccaatatcctgcaaaacatgacaattttctctttgactgccactgttttttatttctataacatgacacgattcctccttattattaggatttcttttgatagatagaatgtgttccctattggtaatgctcattttaaaatagaaaatttttggttccccaaattaactctgttacttttctagcttccacatcaagacaacctttccagtagccacattcccactcatgaagaagaatgatttaatgtataaaatttaaatttttaaagtgattttagtccttctctgaagaagaaacacattgaaaggaagagggtaagaaatcacttatttttgtgggtgtttttccctaaagcactctcaagttaaaaagctgatattttgggtaattttataggtgacagaattttttttccaaaattcgaagtgtccaaattcaaactatcgaataaatggaaaggacctgggtatgtgctaagttgcttcactcgtgtctaattctttgagaccccatggactgtagcccaccaggcttctctgtccttggggattctccagacaagaatactggagtgggttgtcattccataccccagggtatcttcctgacacaaggattgaacccatgtctcttatgtctcctgcatcggcagttgtgttctttaccactacccctacctgggaagcccaaccctgggatcgaacccaggtctcccacactgcaggcagattctttactatttgagccaccaggaaagcccagaaagagcctaatgattaatatgaacttgtctgatgagttttgggaaatagtaaaagacttagtcccattgttgccctaacttatctttcttggaactcagtcttttatctttgccattatatttcaaaagtagctgtttttggctgatccttagtgggtagaagttaccttttcccttacttgaatctattactaaagcattattatgagttgacatgtatttttggagaatgaattgtgtatttggccctgtgctgtgtgctgtttgaggaggttgttgttgttcagtcgtgaagtcatgtccgactctttgagactgcttggactgcaacacaccaggcttcctgtccttcgctatctcctggagtttgctcacattcgggtctgttgaatcagtgatgctagtatctaaccatttcactctctgccacccccttctcttttgccttcaagctttaccagcagcagggtcttttccaatgagaaggtttttcaatcaggtagctatagtattggagcttcatcttcagcatcagtccttccaatgaatattcagcattgatttcctttaggactgattggtttgatctccttgctgtccaaaggactctcaagaatcctctccagcaccacaatttgaaagcatcaattcttcagccttctttatggtccaactttcacatccatatatgactactggaaaaaccatagttttgactatatggacctttgtcagcaaagtgatgtctctgcttttgaatacactgtctaggtttgtcatagctttccttccaaggagcaagcgtcttttaatttcatggctgcactcaccatccacagtgattttggagcccaagaaaataaaatatctcactgtttccacttttccttcttctatttgccatgaagtaatgggatcagatgccatgatcttagttctttgaatgttgagttttaagtcagctttttcactctcttctttcaccttcaagaggctttctgctattagggtggtgtcatctgcatatctgaggttattgatatttctctgagcaatcttgattccagcttgtgcttcatccagcccggcatttcacatgatgcactctgcatataagttaaataagcagggtgacaatatacagccttgtactcctttcccaattttgaactagtcagtaatttgtgtagtaattcattacccaaagtctcagcctaagttgtcaaactccttttaacagtttcgcacattccagaacatcttcaagtttttccccagggaattcaca

SEQ ID NO: 51042 - DNA, 1396 bp, Bovine  19866880647647
accacaaggttgcttgagggtttatacctggaacaatgccccacctcccacagagaaaacattataaagtgacaaagggcccaaagcaatgccccaaaatgtttgaatatttagaccttctccaaagacaagcactagagctaataataaacattcttgcttaaaaggaaattcaagttctagcagtgcaaataatttatacttcagctaaaatgcttaacagaaaaaggaggagttagaggaagaaaagaaggaacttaggaggttcaagaaaatctactatagaagagaagtgtctgggaataatgtatttccctgctgctgctgctgctaagtcgcttcagtcgtgtccaactctgtgcgaccccatagatggcagcccaccaggctcccccatccctgggattctccaggcaagaacactggagtgggttgccatttccttctccaatgcatgaaagtgaaaagtcaaagtgaagtcgctcagtcgtgtccgactcttcacgaccccatggactgcagcccaccaggctcctccgtccatgggattttctaggcaagagtactggagtggggtgccatcgccttctctgaatttatttccctagctttcctcaaactttctccggaagctaggagaaggaagacgattaaattgcaacaaaaccctggctctgaagggaacccgtgtttctagaccttgttgccagtagaggcggagggtgacagcagtccctaagggcttttagaaaaaaattgcttccaagtggaaattttttatggtaatctgcagcctggagccacttttttttttttttgctttctttcttaactactgatgattaaaccacggacaaccagatttcaacagtggaaatagttagatagctcccaaacatcatggttatatgctctaaattacaaagctaactctcaaaggagagaaaaatctgctgggaaagtctttcttttttgaaggaggaggggaggatagagtctgttaaagatttgtatctggtagaacataaaagtagtcaagaattctgtatcataatgctaaacatcagtctcatacccagaataggcactataatgtacaatcacagaaagctgaacagagcaatgctaaacatcctgctatttagcaatttttcattactctatttcgacctggataaagtgtctgattaaatggttatcatagtaatatgaagagaaatcctaccatacatcttaaggaacagctaaattgatttatgcctaattgtggttgtgaaaaaagtctaaggtatatgtcttagtttgtaatgatggctcaagaatgtgagtgaaaaaagtcacttacagtaccaactcataaagaaaattagaagccagtcattcaaccacccagcaa

SEQ ID NO: 51043 - DNA, 1845 bp, Bovine  19866880660789
taagaagaaggacaagctgactctggaacatgtttaaattctctttgtcctgtagcttgttttatattgtctgctagaggctttacttcatttatattcaagtttcaagtttactatgtattttgttcataatctacatgttgatttcttttcatatttttattatgcatatctgttgagtcttgtgcgcctgtcatattggccctctttttctagcaaacatgtatggttgaaatttgtatgtgtacattttcagcatcatgattgtattctcagagagaggcctgtatttggccgatgataaaactattgatcagaaataaaggaggacagcatctcagttataagctgcctgccatatagcacacgtgctttcctagtttggtctttgcatttactcatcctagtgatagagttaactttggaaaataactttccaaaagttattccaactgttaaaggaatgtaacagtttgcatctccactacttaacataatgcctggtcactcttaatgcactccataaatatttatgaatgaatgaattcatgaatgaactacctcgtagcctctacttagtactgatgcttccactcacttctttctctggtgcctttttctttttcaagcctacctttctaccttgaagtctcaggaaatactgactctctttagagtctatagctgtgtcatctgtctgtcctgcaagtagaaaatcattctggaagaaaagaaaaacttgattactacttctctgtgtctaaatatgagactagtcatctgctgttgacagtgatcagagacagcattgactttgccaaagagtagtggaatcacctgaaattgtctgggagaaattgagaccctttgtggtctccttaattttgatgtcactctttgcttacaattctataatacatctttttgcaccagatctggctaaatgacagttaaggcaaaaattaccagggaagtaactgcatctttcaagattcttctgctgagtcacagaaatctcaccactttgcctgtggaatagcatcactgattgattgagtcatcatgggccaaacatgtcaaacagttcaaaagacagggacaatgctggaatgcagtttccagggcctactgcagaacctaagaatatttgaatttattggtagctgtcttacaggaaagtgtgaggaaagttatattgtatttgaaaaccaaatatttagtgatttgagaagtctaaattcaagacagtactgacaagtcagtgccaggatctgatttacttccctttgccctcaaaatggtgtatccagaaagttactttccaagctcagaaaaaactaggattctgaatatttcaaatcacttcatctcctcttctggatggagtaccctagtattacagccctattttccaactgccatgtgcctgcaaacataaaacaataccagctatgctggtaagcaagcagtggtactgaaggaattagttactttgatttgccaagaggttgcttgatctggtcaggagagaagcattcttagttccctttaggttcagttcaagaatatgaggaaagtaagttggctattgtagatgttaattcatatatccatagaatgtgagtaggaatcccttcttcacgagaattatcagaatggttagatgttagcgtttgttaggtgtgttaagctctgtcatcagctggtatctgtatatatgatatctgtatgtatgtgtgcatctgtatggttgtgtttacaatcttcttgatatgggtggcaaaatatacctgtacaaagataagccaaaataaaaggtagtgtagatagttcagttcagtcgct

SEQ ID NO: 51044 - DNA, 3626 bp, Bovine  19866880712826
agtggcttgaggacacctgaggcttgtagctgacatctgtagaggggcagtcttgtgggactgaacccttaatttgtagaatctctactaactccaggtagttactgttagaactggattgaattgtagaacacccagctgttgctgggattccctggtggctcagttggtaaagaatctgcctgcaatgtgggagacctgggtttgatacctgggttaggaacatcccctggagaagggaacggctacccactccagtattctggcctggagaattccatgggctgtatagtcagtggggttgcagagtcagacacaactgagcaactttactcctcactcagttggtgttgaagaattgctgttggaacacaagtttcaactcagatcatgtacaatacaacttgatatttggtacattttagtatctaggttatagccagatatgtcccagcataacaaatatgaaattaactggaaacggatataataaaataatgatatgctttttttttgcctacatggccacttcttcaataaatcaaaaaacttattaaagatattgcattaaactgagtgttcgttagaagagattatttttgacatagcaaaataaaaggtttcacatatctttttcagagaacaataacattttctacactttctagctttacttcatataattgttcaagtatttgttgggaatttcacctcctcaaatggaattataatgttaagtattaaaacaatgatccacttccacactaaatgtttgcattagatcagtatgaacataaatactggtctgccattatagttatacagactaatgaatttgttttcagaggtcaagatctacactcaggatctatcttactaaagaatataaacattgccactaagagctcagtttgaggtgtattttcccttttctttttttcccctaaaacaaacaatgaagcaaacaaaaacaaaagaaggtgaagaagagaatctctgtcagtgaaacctgagaccttaagctggtggttgtaagaccaaagacttgaaggcagacacaacggggaactccagaggcaatgttaggcgtttaacttggaggcgctggtaagaaagggggagattagtgttttaagagaatttaagtcagttggaaaaaaaggaaatggaagtaagtgtttctttaggtacataagcaacttctttccatgataaactggtgctttgaaaggaatatcctaacaaataggaagtataggagacaaatgagcatctcaagtattaaaagcacttctgtctttaaaatgtttaaaagctctcgaaatgcttttctacaggagagtacagaaacattctttcccctggttaattgtctggacaggagctgatgctacaccttgtttccatctattgacaggcagacagctgacaaagagattctgtgagccagacggaatggcaggcccttaagcctgactgctgggatttggtgaaaaactgaggaggcttgaatttcagaaaggcacatcattcaggaaaaaagagcagagaaagaagacaaagattactagggaaattttactgatactgacaaaataatttaagagttatttttcttttattcttggctacattatacaaaatatttgctgttatttacaattaaacagtcccaattatcaggcttaatggaggcaatgaaataaacaaccttttctctcctctctttcaatgtcaatttctgagagtcttttataagcactgattcaatttctttgtctttcattcatttctcaactcctagcaatctggtccatcatctacttccactgaaagtgtgctctctaaaatctgctttggctccaatagtaacaattatatttccatgtttctttctggataccccagttcatttcactatattttctagtcaaatgaactagctttatttccctaataggccatattctttatttcctcccagaattgatacaaatacttgcctttgtcagaacacccttcccagtctacctcatcctacttgaatggctaattcctagccacgttgtccaatggaatatcctagtccaaatcattcacatataacaaatgagtaaaaagattttgcaagagattaagtgtgctgtccaaattcacagctacttagtgatcaaacaaagacaaaaacacaggcctcaattcacccatccaaagtactggtaggtgtacattatcccaccagtgaccctaatatatactactttctcctcccaggaaaggagtagaaaatagaagcaaaatatagatcaactactattacagaacattataggtaagactttaaaaatgctattcattgtctcactagtttctgaaaacttcagcttttctaagtggaagtgttggcagtgacattttactcatattttctaaattccaatcttagaaaaaagaaactgggaatgctaagggaattgtggggtgccactctctcatacatatacacacacatagaacagaggaagagagaaaggataaatttctaaaatttgtaataaattttagaaaaactagatcagatagatggtttaattaaaatcatctcagaactcaaattagaactcaaatcagaatctgttaactcttaaaatgttacagcaggtgataatggaaaagaaagtttttttcttttaaaatgtttcataaaaattaggactttgatcaactttttgagatgtatatagtactattccacctaaaggcagtaggtggatgagaatgttacaggcattttttgtgggcccaagtctgtcaattttcaacaattaaaatgatttttaaatatacattgtatttaatatgatttcctggtttacaccctataaaatggcctaattaaaatatttggcaaaactaatacaattatgtaaagtttaaaaaaaaaaaacaaaaaactcaatattaaaaaaaaggaaaaaaaaaaataaataaatagtttactggcctcaacccccaaagacaggaagtaagggccaaagaaaatagaaaacgtacacaacgcctcagcataatcactcggagacaagtacagtaaatgcatcagatgttcttgggagagtctggtttagtacaaatattaggattttagcctatgtgaataaaagggaggtgcaaatgccttgatggaatgaggcagcgatgctgaagaagtaactcttcacctgaggtgatgtttgtagttgatatagttgatataggagaaagagatggccagccgtacatacaccgtcaagctcagtggctcattcgtgtccgattcttggcaacctcatggtctgtagcccaccaggctcctctgtccatgggattatcctagcaagaatactggagtgggttgctattttctcctccaagagatcttcccgaccgagggactgaacctactgatccccatctcctacattggcaggcaggttcctaccactgagtcacctgggaagcctcagccagacactgctctggtgctaatggtgaggtgaggtctctggtttgcaagattaagaaacactgttgtttcagtgggctcatttctccaggaaaatgtttctggggttttcaagcaaatt

SEQ ID NO: 51045 - DNA, 2178 bp, Bovine  19866880719124
attcatcatactaatttatgctccaccagcactatttcttagtatttagaacacagcctgagtttgaattcttgtcaattcactttctaaccaagtagtcttaacctcctaattctgttttatcatctgtagatggggatgaatataaagtctttgagatggagattcccttataaattaaatgacataagtaaaatgtatatattatgcttggcacataagcagctgttactgtattttaaagattttctccttgtctttggttgtctgaggtttgaatacgatatggctagatataaactctttggtatttatcctagctgtgtttcatgaactgcttggattcatggtttagtttctggcattagttgtggaaaattctcagtcattgttatgtcaattattttttttctgcccctttctctccttctcttctgatattcccatcatgtgtatgttatatcttttacaattgtctcacagtctttggatactacgttcctttttttctctttgcatttcagttttgggagatttctattggcatatctttcagttcacttgttccttgcttgtccatggacagtttacttatgagctcatcaaaggcattcttcatttctgttatagtacttttgatttccatcatttccttttgattctttcttagagtttccatttctctgcttatgatactcatatgatcttgcatgttgtccattttttttccaatagagcctttagcatatcaatcacagttattctaaattcctgatctgatcattctgaagtctctaccatacttgagtttgattttgatgcttacttttgtctcttcacattgtggtttttcttgccttttaggttgtaattttttgttgaaagttggacatgatgtgttgaataataggaactgagataggctttacgttgatctgcctaggaattaggctctactcttttgtacctgtaggtgtcagaggctttaatttcctcaagtattctggttttgtttcatgttgtttcccttcctgtggtctttgtgtttccctaaaaactcctttttacagcctgaacatcagttacttcacttgtaatctactgtcattagccaggagctttattaatacagtgtgtgtggtggtggtggtggtggggggaaacagtctttaatcctatgatcagttcttaatttttcagtgtacctgtatccatgggatgtgaccctaacaagtgcttcttagcttttgttttaccctcaagcaagatacgcaggctaaagagggctgaaattgggtaatttcccatctttcaagtcagttaaagctctggtaaattttttttcccttgctggtgaggcttttgttgtaaagaatgttctgactttgttttaaaatacttacctttctcctgggttcatttcaaaattgttacttttgtattgcaaaatggtttctttccccctcttctgttcaagcactataggatttttctctgattttcaccatgagatatagtggaaatcctagagttgaaacacacgaaagtgtggggctcccagttacattgagtctccagtagtttttaactctcaagatagtcaatactctcaactattcactgaagttctagttcaatgaagttatactttatgtgttactaccagctactgggtccaatggcttacattttaggtaaactgatctttattttctatatctgtctctctctccagttttgaggatgggactttgtcctgtgatttcattttctgatggagcgacgtcattgatttttcagtttgttcagccttttacttgttaagagggcagaagtgatggcagctctttacatgcatgagtggaaaccagatgtttcttctgccaaaatattttaaatttatgaacaagttacactcttctcaactagagagatctacaaatctaaagatttagaaatccaattgtccaaatgtgtttctatcacggcactcaagtttctcacattatcaaccatatcttcttatatgaaacaaataagaaataggcaaatggctgctccttttttgtaagtacaaatgttactgcagttcattcagacaatattcttttaagtaatttaactggtaattaatgatctgaaaaaggaaagaaaaaagttctcttaactcacaggggg

SEQ ID NO: 51046 - DNA, 1523 bp, Bovine  19866880776668
ctttgaacttgaacccctgccctgtaaattacctaaagtcttgagtggggaggactaaattttcccagtgtctctctatattgtaaaatgtgtgaacttggagcaaatatctctttcttctgggaagaccacttccaaatggctgcctcacttttgcaaggacaaacaaaagactcaattcttaaatggagcagttagaggtcccatgactcagtgctctgcataacgatacaaacatctaataggatggtatctttgtagattactattattacagggaaatatttcttttcaacgtatggatctaggctgctctctccctgaaaattagaactccttcttaggagtatagatgtgctcttattcaaatacttcttctatggaattgaagggcaggggaggccatgcccttcgcctcccactgatagtgtggtcttgaccaaaagtgccagagcctaccccaagttattgactctgctgaatatcactcagaatgtcagtccagaaggaatatttttactttttattttaaaaacttgcaaacataccccaaagtagacaaaagtgtgcctatccatattccctgttgcttagattttatagccactcacatttttccattttgcttcatccttttttctctagagtattttagagtagattacaatcatcatgatatttcacctctaaatatctcactgtgaatctccttggggaattctttttgaaaaaccaaaactttttaccatatgaaatttcaaacataccttgtagagagaatgatatgatgaatctccacatgtttatcattcaacttcagttatcagtcttttgccaggcttaaaaacatctttttgaatgattgctgagttggcacaaaagtaaagaaaaataattgcccataaattctggaaacttgaattgagacaaggaagtacattttgaagttagagtttgtgttggaacaaatcctagctcactggtgatccagagtttgggctttaaagggccacaagttcgaaggacaggggacaaagaaggggacaggaagtcagatcaaagacttttttttttgaaaggtgacatcttagctgagtgaatgagaaaataattcacctgccacagaaggaggtggtggacatatgattctggcttagctttggctctgtgtggaagggaaaaaagaaaacatgttttcttgagagttcctaatcatagccccgctatacttggattaggggccagaaattttagcaagcctaaaagattccaagctgaaatttagtatccactggaagaagcaagcaagcttctttagaggaatacacttgaaagccaaacttaaaacaaactttttttaaattttatatttggagtatagttgataaacagtgttatgtcagtttcaggtgcacagcaaagtgatttagttatatacatacatatacatatagaaagcttattttgggttactacagagtattggagcagtttcctatgctatacagtaagtccttgttggt

SEQ ID NO: 51047 - DNA, 2012 bp, Bovine  19866880914299
aaggttgtatagccagcagtagattgtgtatagtgctcccatagttaactatttatttatttctgagcatctgaggaagaacattcccatcgattatttctttttggattattcataaaatgattttgagtaataaaaacatagcccaaaaaatgaaagttggggaaaaaactaaagatcttatgattttagtggcatgagatatatattctctatttgtgtagggtatttgtgctgggtatcattgtttgggatgtaagtactatatgtatgtattgtacaggtcctcttcttttatagtaggatgaaataagactatagcaagagtacttacttcctattgcttctggaaggtaaagaatctgcctgcaatgtaggagacctgggttcgatccctgggtcgggaagatccccagaagaagggaatggctacctacttcagtattcttgcctggagaattccatggatggacgagcctggtgagctacagtccttggagttgcaaagaattagacatgactgagagactttgggcttccctggtggctcagatggtgaagaatctacctacaaagcaggagacctgggtttgatcccttccattgggaaaatcccctagagaaaggaatggttacctactacagtatgcttgcctggagaattccatgggtagaggagcctggtgggctgcagtccatggggttgaaaagagctggacatgactgagtgactaacactttcactttccctatgagaagttcagtctttaaatataaataacttagaaaatttggttaattttaataaagaattaagaatcttgctatggttacacagaagtctccaaacagaacactaatccttcacttctgaaacctgtacttcttcagatactattccttggcaaaaaatctgtgccatagtcaatagttttacaatagatctatcagatcataattgtacattctaagattcctattgactagtgatttttccctaagagaatgtctttctcccatcacccatggtagagtctatcttattatatcttgaactgcattaattcagttaattttgtatgtagcatatttgttaagttaaagaattctgtgggtggtttttctatcatgactgttttgcctcttagacttaaaagcctgagcctacctaaggaaattcacttttcaaaactccagacttaacatatgatgaaacttaaaagaaaaactcttggctgagtttgaatgctgagagccagctaagtggttttctctgtctggagaaaattggaaaaagggaattattaagcccagcaaatgtagttgctgatggaaatgctgacatactggtcttgcttggtgccactgttgtaagaagtcgatcagtattagatgcattgtaagagctgctgcttatgtgcaagttgtgtcttgtagactgtcacacataaataaaccccttcaaaaaatgttaagtgattttcataaaaaacatttattttgttctctgtcgtaagccaaattcttgttgtttatggcttcctgtacccaacagttcctgattgtctcaaaaagcaaaacatatcctgcatggattaagctgctgaaatgcctctcaggcattgtttatgagtctgctctctttattttcagagagaaagcgaatactttaatgtcttccatattccataaatctgtcccatgctgcaattcaaagctgtgtgtgtttttgttagaaggtacttctggttgtacttagggaagaaaagctgcttaagaatgttagtgaatatttgggtgggtggtggcagactcccctaaaaaggatttgtactggttaaaagggctcttgattttttcgctcaggaaagaagtcaccaaaggtgctgttagagttagtagtagtgtagcagctctttgattgctttgcaccagtcagtttcctgtttggctcatcctttgagaccagttttccctccaggcaggcttgctgatttaccactttgactgta

SEQ ID NO: 51048 - DNA, 661 bp, Bovine  19866880962790
atagatgtttatctcttgcccgtgtatagttaagttccaggtgggcaggtggctctgctccacagggtcaatcaggaacccaggctccttccatcatgtttctccaccatctccttgggttcttccctctgcctggcccacgctgggctgcagccacattgttgttctggctcacaggcaggtaatagaaaatataggttgggaggagctagctagggaaaggcacatctcacctcctctcagatgccactaagggactcagtcacaaggataagcctaattgcaaaggaggctgggaaatgtagtacagcaggccaaccacctgccctgcaaaggaggctgggaaatgtagtgcagcaggtcagccacctgccctctacctttctattactatggcagaaaaggacataggttttgttggaccattaacagtctatgccatagaggaccataagagctgaaaagttgtgcatgttatttctatttttctaatgcttactctcaaatttttaagaattatttttgggtgggtaacacatgaacaagggcttccctcgtagctcaatcagtaaagaatctgcctgcaatgcaggagacctaaatttgatccctgggttggggaagatcccctggaggaggaaatggcaacccacaccagtat

SEQ ID NO: 51049 - DNA, 4018 bp, Bovine  19866881035953
aatgaatgtaaatccacaccaacatacacaatgatgaagtttcaaaatatttgggatagcgaagagatcacaaaaactttcagagagaaaaattaagtttcatacaaaggctcaagaattagaagggtttccaacttctccatagcaatgctggaaatcagaaggagtacatgttttcacaattttcagggaaaattatatccagtatggaatcctaagtccagctaatattcaaatgtgaataaacatagttttagacgtgcaagttgttaaaaatgtttacttcatatgcagcctatctcaggaagctattacaggtcgtacttgatcaaaccaagggagtaaaccaagaaagagaaaaaccttggatccaagaaaagggactcaggtaaaggagaggtgaaagaaatgtccagggtggttgtgaaggagaccccatgatcctgaggcgtgtgcctcagaagtatgagatgtgagtttagatatggcatcggcagctctgggagaaagctcctcctgaggatgacattgactgaactcccagatgaatcattttacaagaatgttgacatacctgggagagagctgggtgggggtagggtgaggcgtggttatgttgtgataagtacagagaaaacaaagcagatagggaacaagataattacagtctagcacttagagtacacttcaggtctcaactgagaggaacattttctttttttttataaaaacattttcttttatattggagtatagctgattaacactgttgtgttagcttcaggtgtatcacagagtgattcagttatacctatacatgtatttattctttttcaaattcttttcccatttagattgttacataatattgagcagaatttcctgtactatacaccaggtccttgctggttatccactttaaatacatcagagtatacatgccaatcccaaactccctaactagaatagcctctgctcaccacaactagaggggaaaaaaagcctgcacaaagccacggagacccagcgcagccaaaaataagtaataaataaataaatgatttttaaaaaaagaagaaatagagcacgagggacttccctggtggtccagtagttaagactccacactcccaaagcagggggaccaggttccatctctgatcagggaactagatctcaaacactgcaactaagagtttgcatgatgcaagtaaagatcccacatgatgcaacaaagatcttgtgggcttcaactaagacccagcacagccaaataaataaataacatttttagaaaagaaatagagaatgagtcacagaaagcagagggatctaggtcttcactgctctttgtgataagaaatacctgacaactgacttctgcccgtgatgcagaactcctgccctagcctgagacagaaatcactacgaggaatctcaaagacacaaagaatccacttccgagagacctgatcctcagtcttccgaggtgggctggctattccagccattggctgaaatgctcactgtggcttgtcccatgcgcccacccaccaggcttttcttcccacaggagaaaagataggcctagaagtagctctgggctgcctttatttaggtaagtggagaagttaacaaataaaaaatactgttgtcaagatatttttttctagattcttttatttttcattttatttttaaaaatttttactgaaatacatttgatttacaatggtgtactaatttcaggtgtgtagcaaagtgattcagttatatatatattcatgtagttatatatatattcatgtagttatatatatatatattcatgtagttatatatatatatatattcatgtagttatatatatatatatatatatatatatgtatatgtatatgtatattcatgtacggatgtgagaactggaccataaagaagatagagtgccaaagaactgatgctttcaaactgtggtgctgaagactcttgagagtcccttggacagcaaggagatccaaccagtccatcctaaaggaagtcaaccctgaatattcattggaaggactgatagtgaagctgaagctcctgattcaaagagccgcctcactggaaaagaccctgatactcggaaaggttgagggcaggaggagaaggaggcaacagaggatgagatggttgaatggcatcactgaatcaatggacatgagtttgagcaaactctgggagatagtgaaggacagggaagcctagcatgctgcagtccatggggtcataaagagtcagatacaacttaacgactgaataacaacaaaagaaaaggcaattctataaagaatagagagagactcccacaaagtggactgcaagtgagagtatgagggggaacggaggtctagctgttttggtaagtttttgagccaatgggtgtaaagacattgttagaataggctactagaatacttagatcgctgggtttagaggacattcaggttgcatttaccttttggaaatttaatattatggccaagtatgtgttttaattatggttacctaattgtgaattaaagtaatgtacctttctggccagctgctctgggctaaaattcttagagctgggaattggcataataaatgtgaatatgaaagttagcaggtgatacatttgaaagtttaaaatgggcaccatgagtttagcttttaattttaccttaatttacttttggaactacgacattactttgttgattttgacttgttttctcattggtgaaatagggatggttaatgttaatctatgatacagagtaataaggataatagcattaacccaaataatgtacagctttgactagataattttgtaaaactgcttggtaattttgggacccttatcacttattaccaagttattagctttataaaagacagtagaaaaggatcaagacagaacctccaagagacagtgttttacactgaataaaatagtgacacaaagtagctcaattatcataatgaatgtagcgaatgccgttgtgttttgttttatatccctttagacttaccctttcagtgtgtgcctactgaatctccaattccagcacctgcatttctttgcctaaaagttttctttggatgtcagaaatagggaattaattccactccgcacacactcaatcattgattaataactgatggaaattgatgtaaatacttcacctcccctgcccatcagggggtagggatggtataaaatacttctgaggcaggtattctatactatttctgtgtactctgtggaattgtctcagttgacctaatttgcttgataatagaccctttattataaggcttctttcttttcattgtctcacttacttcttcatgtccctaccagcccttcctggggtcttctccaaaatgaattctttggactgaaaagcttgtctctgggggaactgaagacaataattaatagcaatgaaaagtctggatcctgtttctatacctccttagcagtaaatgtgagtttcttgtggtccaagacaaagaatatgtacatagccacttaactccaactcccattgaagttataaccctccttctcttctcctacctgtgcagtgatctggatggacaattcctttggggagaaacttcctttgtcagtatcttttggtgattttttttttttttttgctgttcaaattattccagttaggagattctagaatccttcttgcttgccagcattttaagaagtctaagtagaaggaaaagactgggaattccagcatttagtaagtagactctaatgcttaatcccccattttcaaaatgatactcatattccccagttcagagacgttctatctttttgctgtggtgagggaaggataggtggtgcccagatgaagttagaaaggggaatctgagagcctaattgtttcttagacatactttcaacttagcttattcaagcttccttttctactctcccttccagaaatacctagta

SEQ ID NO: 51050 - DNA, 2621 bp, Bovine  19866881156419
aaatgtttaaaatatttttttattattgtgtaatacacatgcagaaaagtacataaatcaaaggtatacatttgtcaacattttttaatctggtagttttttaaattgttaatgagcagatgatatagatcactgacaaccaacataccacacgaagattataaatcaggcccacaaactaggggttatggttatatttacagatttgctcccctagtatcttaatgatacccaagatccttgttatggggcatatatacaccctttagtgagagaaaggtgagtgagcaacgaatctgaagaagagtcagaaagatggaatagtacatagaaaagcttgaagtatgtacaaatctttgtccaagttgattggaattcaaggcttgaagcccataaacatggcagacatccctggattgatgagatgttttttaaaaatctgcaagacagatttgtttctgtcttcattagacaactatccatcttttaaactaaaactacacaatgtacaagaatctcagattattcttcatcatttcccttccagttaaatttttagtttatgctattttctcccttcctaaaaaattatccttaatgactgtgagatgtcttatatcctatcccttacctgcccatttctcaactgtacaggaagatttaaacacttgaagctctttaaaacaattctataaaatatacctacctctgctttgtacacttccatttgccttacgtacaccagggaccaagtctcaattaaccactatctgacccttgttcactttcttccctcccctcctcctgccaaagtttgcccttcctgccaaagttcagcacttcctagaaaagtctcacagcctgtttgatattgtacttcactttagtcaccaaaggaagaatttacaggtgcttggccccatctataagaccatgaccgaaatctgacctcctgttacaatacgtgaactcctgccctactgataaggctggcagatataagtaggatttttcaaataatcctttgggaatttataagcagcacagccataaaaggggggtgaatggaaggtcggtttcactaaaaataataaatattgccatgtttattcaaagtgtgccttgttatcctccaggccaaaagttcagataaacactattgtaaatgacaaatattagaactttttgttacttctgttatgatccttccgttggacaccaatagaactgttttcccttgtataagccccagctctgatattgtataacactgaccgagactaggatactggattcatttgcaggtcaaaaggagggtagttatatttcaaaataaaaaaacttgtatttagcattatattctactaatactaagaattaagtgctatagtattataagtattaagactaagtgttatagtctactgcagaaaaagaatgcctattgagaatacaatgagataatatagtaagcactaatgtaaatatgcaccaggttctatagtagtgcaaagagaaacagcatccactgtgcttaacctgaaacatcaggaaaatttgctagaggacttgagtagcaaataaatatgaatctgtaaaatagaatgggaatagtaattcaagcagaagcactagcatgaagacaggatgagctgcgtgaaacagcatggtatattcaatgaaccggaagcatttcagtatcagtaaaggaaggtgggaaccacaggaaaaacagcagactggacatggaaaacctactatgctttcatatgctgggtcttcttctatacctctacattttactccacagatgaccaattagagcattttacacagacatcattgatcagatttatatgatagattattaacacactacagtgagaagtgagtgaggggttaagatacaaggtagggagaacagttaggagacagttttcagtaatcttgatgagaatctaaactagagcaatcattttaggaaaggagaaggtgaagtaaaacgacacctaagaggtaacacttggaagatctgagatctgaatacgttattgaaataggaagggattaagcagttaacttagttttagattgtaaactatcaaagtcataaactgctaaaaagtccagtaacatacagattcagggtagtggtataaacagaagataaatacactaggttgatgaaagaatgaaaagtgaagaagtcgagacaagtatagaaatggaaaagaatgagaaagagaaggtttactttctcctcactcctcatttctctattcctaaatcttttcttcaagcctaactcttgaaagtcccttggactgcaaggagatcaaagcagtcaatcctaaaagaaattaacccaaaatattcattagaaggactgatgctgaagccgaaactccaaaattttgtccacctcatgtgaagaaccaactcactggaaaagaccttgatgctgggcaagattgaaggcaggaagagaaaggggcaacagaggatgagatggttgaatagtatcaccaactcaacggacatgattttgagcaaactctgggagatagtgaaagacagggaagcctggcatgctgcagttcatggggttacaaagagccaga

SEQ ID NO: 51051 - DNA, 1415 bp, Bovine  19866881159390
gcccaaaaccatcccaggaggcatccgtaattgccaacactcaaaatgccagtggcaggagctattcctcctccatcccctgaccgctcattttccaccaaatcacttgacaagtcgcacgtaccctcctcctcggctctcgctgcagcgctccccacagccacctcaagccaccacggccgagggagggctgccttctgctctcacctcccctggcttccatctggtccccacacccctgagctgggctaagcagacagtggcatagaggcgggaagggacttcagggacacctttccaagggcaaagggaagggtcaagggagggatgacggaggccctggctccccgtcagaagaacccgtatccttctccatactcaccagccagagtggggggcaccgcggtggacagtgaccacgtgggagccggcagcagcccccagggcccctgtgctagaggtttccgccagagcaggcggggaggcagtgcgccatctccccatctcccctggggacaaaagcagacccactggatctcacctcgggggtgaggctccgaggttgagcccacagaaggtctggtgcctggggggctgctcgacccttggccagtgggggtaggggctgggggttggccacttgcagaagtcctgcctgggacagctgggatggaagccaggggatggcagaatgcttgttccagtcccagtaacaccaagagtcggttatatcagtgaataaatatggggggtggggtacgggggtcagcccatgggcagagggccttgggcgtgggtgtacagggagcagggtgggctctgagccgcctggtggaaaggtgggggtgtcagtgcgcgtgcccagggccaccagggaggatgctgggaggacagggcctggggctcctctgccccaaggtcagaagagagaaaaagtagcagcaacaggtaatttcaaacgtcccagatggcaaggggtgggcctccaggctggtgacaacccatccccgctctgccaagggtgactggcattctattacccacaatgctgttccccgcgggcacgggtggccacgccgggaggggcactcgcctgtctgagccggggcagcgggggcgggtgctgaagagagggccacagggggaacctctttttctccctccccatggcaatcacctgacctcaaactaagagtccaaaagaaaagggaggggagagaccaggtcagaacatcacaagcaaaggctgcagcacagccgacggttaacactgtgacgggcatgcggggccccggggggccgggccctttcccgggggactaagctgttgggaaccagagagactggagagaggcagggtccgggggagggccccaccccagaggctggcccccttttgacttggggcaggtttg

SEQ ID NO: 51052 - DNA, 2693 bp, Bovine  19866881170979
ttctatatgccaatctctgggtattttcctatgtaaaacacagccttttataggggttctacttttctgtgctgtgtctggatagtgcccttagacagaaaacaagagcaaatgtcaaggttaccttgtgcacttcctcctttgaaggatcatagtcgtgtgctgtctgctgtctaatgcatgaaaaaggttgcttcatacagttaatccagttttagagctgtttatggcaaaagggtgactttgatagctgttacaccatgatgctggaactggaagtcttatttaattaactaaaaatagcatagccttaatttctagccatcaaaagtcaaccaagaggtggaattcccaggcagtccagtggtcaggactccacgcttccactgcagggaacccaggtgcaatacctggttggagaactaagatcctgtggttgcgtggtacattaaaaaaaaaaatgtccacaaaaggaaaccaattagcagtagaaaaataaaaaggtgaggcagaagtattagtacacttatgtaatttttcactattttaatttttctagaaacagaagtttccagaagtcatatcattttagttcattttcatttctcaccgatggcacagtgagatgtgcactgatggcacacacttttcatcccttccttctttgctaaccaaagcctgatttcatgtttaattccaagtagatgattcatgataaatgaactatgtcaggaatgatgctcctctttcactctgccagatactcaatcccccagcctccctgagagctggaggtgatcatacacctatacacctatatatatatacatattttgcatgtaatgaataatttatttatttatgaaactagattagaatctggactgtgataaatctactaattacacacgaaaataagactcattcacttcttcaatattatacaactatattttgatcaacgagacatacaggaaagtttgttaggggtttactgaaaagattttaattttttaaataaaaaagactaggtgatcttggcaccttttttgtccattgaatgtgagtcctttctgactataatatagatgagaaggaaaattctatattcctaagtgtgacagaggagagggaacaaaagagcctgggtccttgatgacatcactgaacaactaaattagtacagcaacccacggtctctgagaaaatcaaaacctatttaactactctgcctaaggttttctgttttgacctgtcatagaaagcatttctgactgataaatgcatactccatttattctttagactaagaagagtttgcacataagatgaaaaaataattttaaattacaagataaaaagcaaatggttgagaactgcattcttttgaagtctatgaactaatcaggtttcctttgctgtgtatgaaatgcatgtctgccttgtattccccctagacttccatgcagccaggggtctttttcctatatgtgggcctatgcacttttgggtgttcaaattagcttgctgacagagtcttacttttagacctacaaattatttctgtcacttaggtattttttgactccattaggaccaaaaccccacagacctaaagcttttttcctgcagtagtgagcaggcaggtaaaacaaacaaacaaagagatggtttcctgtcttacgttcacattctctgacatccaggttgaactgctgtaatgctcccaaggtgagctgccttacttcagcttccagcaaaagttgcatcaaagatgtggctaaatgcttgcaagctgacatacatgctgtctgggccacctttccctgaaatacaagaaagcaaatcataaggttgatggattaaaatgaaattccaacaaaaattaaaatcatttatttttcaattaggaatttctttaaaggttttctccatcatgataacccttcctttcaaataattttgaaattaatagcacctgatggcaaacatcttaaatattagctccatcaccatttagttatgtcactataatactcagctaaaattcataaatcccagctcttcattcacaaaatgttttttcccctaaatcaacaatagataaacaatactcaaaatcttaattaaactgagaaggaatgtttccagagagaataaatttcagcaatcccttcaaaactactgtagttcttaaagagcaaatgaaaacaatttcctaacttatctagaaaccaaagtgtttactactttatgatttaacacatataaaatgcttgaggctggtgcactgggacgacccagagggagggtatgaggagggaggagggaggagggctcaggatggggaacacagatatacctgtggcggattcatttcgatatttggcaaaactaatacaatattgtaaagtttaaaaataaaataaaattaaaaaaataaaaaataaaaaaataaatgaaaagaatggtttaaaacaaaagagttttctgaaaaaattaataaaagggtaaattttctcagaaaataagcactgaagtttataagcacatactctaagctaatttttaaaacactgatatcaaaattagtaatttgctatttctttgaaagattcatttttacactagtgaattatattttagtcccaggtctgagttatacagtatggaggacatatccatttcttccc

SEQ ID NO: 51053 - DNA, 1671 bp, Bovine  19866881178520
ggcggggctgaggttactggagccttgcaagcatggccaggtggtcaggtagggccgtgtggggcttaaatgcagtgaaaccactgagagacttacgtgtgttgattccactctggctgctgtggattagaagggtcaagagtgcaaattgggagcccagttaggaggtgggcagttgtccagggagaagtgatgggtgtttgagctaaatggtgggagcgaggagagagaaatagctgtacttaagacacccagcagacagagctgggtgtcgggtagcagaggctcctgtctaggtagacccctaagattctggcttgaagagctgagctgggaatgggagaagcagacaggatgtgggtgaggaagatcaagatgaccctcatttgctgtgtgtgcaggtggagtgcctgaagctcatggagatagaggcatcctgcagggggtcagctatgtgggctggagtggaggacacaggcattgttccaatccctccggtgtctcatctctggccttgcagaagctaggctggtgttggcctggaagccccctcctactcaaggagacagttatcagctgtgttccccgaagacactgaaggtcttgggacgcgggtctcccacccctccccagttcttggtgccggtcagcatttatctccactgtgggggtttgccagacttccctccttcccctcctgcgctctcagctgcccatggcaaatccagcctcctgggagcagagcttggagagaggtaggtcccctgctctctcagcccaacctgctgtccacgggtcctgggctctggcttctcccaggccccctgcggctggccccatggggaattcttatacaaaatcccccatcctatttgtgctcccctccaccaaaatggagcccctgtttggttaatttctattttgtggtttatctggaggctgttaaaacaaaccctgggggaccctcagcagtgactgttccatatctcattatctttcccaaacccgattattagctcagatttttctgatcgctagctgctgttcgtgatgagttgtgtgccattaatgccagctggttcccttaaacaggacccaccatgccagggaaagtgagctggcattcagagccatcagccacttggctttttaattttaatgggctctaccaaatgttccaggccaaagggtccccgaggaaccagaacagacgggctcccaacccctagtctgcagcccaccctggttccttcccagactgtggccatcctgattgctgggacaataaggtctgggtcgaggcctcacctgtattcatgccttcttgccaccaggcccatcctcgatgagtggtcagagtgacttcatgggttcctagcgagcttgcaactacatataccaaagctctctggtcccagccccctccctgggggagacaggctgggtcaccattctgagctgtgctaatcctagcctctgggaagcaccgtcagctggtcagccaagtgtggggaagggtttgagggagcaggcaagtctgagtgtttgctccagccagtggcccctattccttcctgccctcccccaccgccagcccggcctgtccccagaaggctgcctcgggaagggctccagctccctgctggcttctcctgctccccattcctccag

SEQ ID NO: 51054 - DNA, 1635 bp, Bovine  19866881180849
cttctctctctcccgatccgtcggctggtgaccacaccatctgcgtctcccacctcagagcctttgcccgtgctggtccctgtgccccgaactccctccttcctctgctcagtccccgcctgtcctgtaaggcccacctctgcactccacctcccgtgtcactgacactgggagtcatttaacctttgtctgcctcggcttccttgtctgtaaaaagggatgataacatctgacagcacccagggctgctgtgagaacgtacgcatagtgcctggcatgagcctggcacataagaggcctcagtgaaagaatctaggtaggagtgacgtcacctctcccagcagaaagtcgctccctcgcacatcactcctctcgtccccagcactcactaccctgtgagtctgtgagcctggcgccccggccagactgagggggagggactgcaccttccttaccttcggatgtctgggcacataatacaggctcagcaaagcagtggctgaggaataaatgcaagaaaccaacaaacaagtggatggatggagagaccagcaacagctggaggaggagcatcctggagaaggggggattgggctggggaggactccggtgggaagacaagcatgagcacagacaccgggagacaaaagaggagcctgtggcctagatgaagggtgtgtagaagcctctgctcccccaaactgaggccacagccaggcctcccctgggggcctcctggcctgacaggaccacggacagcctgctctctggtacacccggtggctcagcaggccaccctgcacccgcagccctggctctggcctccaccttctgggttgttggggagaggcagagccttgggaaggcctccagggcatcagggtggatgccacagcaatcaaatcaagccatggcctggtgcaaatggcccagaccaggctgcaactgtaagacctgggaagagagcaagtgccagcccaccagccgtgggcagcccgagaccccacaccaggagccagagtgctgccaggcaaacccagcttgggctctcgggggcctggcttccatttgaagcctccagctggtggtcagagtccaattcttgtcctctctgtctgctcaaggagaggcagggagacgcacggcagcttggacgcacttagcgggcagggcagtgcaggtgggtaggctgaggggatgccagcccaccctgggccccgcaaccctgctacacagagggaactcaccaaggccaggtctccccactctcaaacagcaagtgactattttggtgactcagaaatggtcacccccaagccctccaaaataccaggggatatgttcttacagaatgccagtctagaaggaggacacaggcagacataagcgatgagtaagaaggaggaaaggggcaagtggagataccaggccaagtgctgagcgcatcacatgaaacatcttactccaatccccactgccagccttagagacagggcatgttgctcttgaaaggattcagggaagttcaggcagattcagagaggtgaagtaactttgctcaaagatgtcctaggtaaccgctaggcctcaaatccacagtctgctaattccaaagctttgctcttggccacggtg

SEQ ID NO: 51055 - DNA, 1697 bp, Bovine  19866881192399
gagaaatcatgaaaatctgcaaagtgaatatcggggcttcagccttgctcctctagttggcttccagaatgcagaggtgagaagatactgtatttacaaaataggaagaggatcctgctgaaaggaataaagaaaagaaacaaccaaatagctctcagaaattaaaatttgtactagctgaagttaaaaatctgatagacacgttgaaaataaactgaaggaaatttcctgtaaatccagacagaaggaaaaagtgaaagaataaaagagaagaaaaggataagaaaatctgagtatcaatctaagatgttgaatatttgactaataggaattccagaatgagaagaaattatcaaagaaatagtataagaaaaattgccagaactgagagacaggagtcttcagattgaaagaggtcaccagaaacccaaaataatgaattttaaaagacatagcattgtggaatttcagaaataaaccatatacatagagaggagatcctaaacattcccaaagagagaaaacaggtcacttgcaaagaatcaggaataaaacagcactggatttttcaaaagctagactagaagccagaagagcaatgtcttcaaaattctaaaggaaaatgttgtcaacctaaaaattggaattttctcctcagccaaactgtcagttaaagctgagtacagaattacaattacaaattacatttttttcagatataaaaggactccaaattttctttccacttaccctttttcagggagctaccagaagaggtcttccactgaaatgaaggtgtacaccaagaggagctgagggaactgtgccccagaattgaaaatttcaggggaaaatatggaagtgaaaagggcttcccttgtagctcagctggtacataatctgcctgccgtgcaggagacctgggttcaattcctgggttgggagatcccctggagaaggaaatggcaagcactccaatattcaggttcctctggcctgggaaatcccatgagactggctggctacagtccatggggtcacagagttacatacaactgagcgagtaaaccaccaccaccattaaaaatatcaaaaagctgctagaagatacagtaagaattagagatggtacaaagaaaactctgtcagggagaaaaatgaggtaattattaaatccagataaaacataaagtcaaaaaggagaggaaacataatcatatacaacaaagttgtagtattgctcatataattgtcataacgtgaatattgaatatccatagaccccaaaactatgataactattttgggagggtgatgagggtaggggagagaaatgtgtttttggaggtaaataataagagagatggatcctcaactaccacacaaaagaactagttgagaaatagcagtacagatacgcttagtttgaaatacagatttctatctgaagaaacagctaacagcatttgcttctggggaagagaaatgggaactggggagagatggggcaatacactatttttcctcacaagtgttttcgtgctatttgactttttgaactttgaaaaaaaaaaactgtgagattaatttttaatagcttttaaaataaagcttatgaacaaaaagaaaaacttcagcacattaaccatctgtctctacaatcactagagctgccctatactacatctccctacctt

SEQ ID NO: 51056 - DNA, 662 bp, Bovine  19866881201417
aactttctttgcccctgttagagtacatctcctagtgctcacgtcactctgcatctgttatttactagactgagtttctcaaagtagaagtgtctgcttcatcctttcatgtgcctagaagagtagctgagactttgttggtactcggtttgtgtttgttaaagtgactgctgctttccctttcctgtgtttgcccagatttctgtgtcaggaagcatgggaggcagacaggtggtctgtgaatgagagtggcccagcaccaaggacaaggagttggggggaccttgggcaataaacacaatgagtccttagtcaagtccgtgctttttggtggactttctacagttgttctcttcatctgccctcagctattgataggagctcttgtgtttccatatccaaatgagaaaaacagatttggtgacttacctggagtcacactgtcagttgggggacctacagcctgagggtcttttattgtgttaaactgccttttaaaaggcacctgggcattggatgtttatgaaaaatactttatagtgatatgattggtttcatcctgttagaggctagaagtcgaccaaaaaaaaaaaccctggcttagtgttctatatgtttgaaaaatgaaagtgaaagtgttagttgctcagttgtgtctgact

SEQ ID NO: 51057 - DNA, 1278 bp, Bovine  19866881204882
ctcggccagatccgagcgcggtggcccaaatttcacctcgcccctcccaggcaaggcccagcaacctctgtcacaaggtgcccccagccgcctgcgcctgcttgcggtgcccttaaagcaacctgcagcaggggaggctacgtgtgattttagaatgagccgtttctagtcctcgggattccaaggggcgataaggaggagcgctggccaccgtccgccctctctttttgtccaggtttgtggagcacggcgaggacaggctttggacgcccctatcgccgcatgttcaagttgtccaaaccaactcccaatgaccctccctttgggcctggtagcgcgcacggtgcggtgggtcagcaaaagggcagacccggaggaggcctgtgcaggccctggatctggggtcgcagctgtataggcagggagcttcgggattctcccgcatggtgtgcgaatacgggtgcggattctggtggggacgtcaccggggccccaagaactccttactccgagggggtgcacgcgagaagaggatcagagcacggttgcggagctcttaccttgcgcttgttccggtggatatcgccgatggagttggacaccgtgttcgggcccagcagcatgcgtgtgctacgtggccactcggtgctcacgaggtggtgctcgcccatgaggatcttgcgtacattctctgcgcccgtcacacggattagcggccgcccgagcaagtgcgtcttgaacacgttgccatacttctccctccgcgacgactggaagccagaaccctacaggggccacgcaagaactttctcagggcccacagcgctagatgggacgtccaggaggcccagcctcgagggccgcgggggaggggcggaggacccccacctcgggcaccagttccctgccctcccctatcccactcatacacatacgcacgcacgcacgtaggttttatttttcatagcatgcacgagaactgggaagtggggcctagaggataataaataatgcaagggggcgagaggcccagggcaccccgcgggaggctttttagtaatgacttgcgggagggaaaaggtatcacggaccggaccgcgagaccctaaactagagcctccgcctcccccctccctcgcctcgcgctcgggagactctcggaataaatatttccaggctcgcggccacgggctggcgagaccccgcggggtggccgcaggccaaagattatttatagcggcgagcggtcggtgccccgaggcaatcactacagatggg

SEQ ID NO: 51058 - DNA, 890 bp, Bovine  19866881210079
cagtgtgtaaatcagttgaaccctctccagttcgtcccgggatgtcgtttcagttctcagataacttgaattcgagtgcaatgtgggtgtttggggtccaacgaatagatttctcctgagaacttgctcccctggccgctaggaccctcgggatcttccatcgtccgtctcctgggacgcagtctgaagccgcggccttgttcctgaggtttctcgttttctgggtggtaagggggacagcttcggaaagcagacgcgcagttattttcagaagaggccaggccagggagagcgctggaggagctggcggagtggtcacccagacgtctcaagctgcagttctccgggattggaagcaggaccttggcccagctacgggcatcgcgaccggcccgcagggccatctgctttcttcgtcttctctgattgtggagctcaggtgcaggcggtccaggacaggccggggccttgaagacactgtcttacgttggaggtggccgaacagtccacaaccaacgcctaagaccctccaagaagacacacagaccatccggggaacgtagcggccacctagcctcctccgaccctcaccttccactcgcgaacgcggagcagcggactactctactccagccagtttccacttcgtgcactaattcgtcggggatgagagggcagttgggaaggagaacaaatactcagcaaacttttccaccggggccttccaatatccaggcctaagaggacactaggcggtgatggggaggctgggacccgcaccctgccagtgcactgcgagaagccgacctgcttcctcgctgctgcccggcttagtcagagcggcctggccgcggcccgggtgcgcggattcaggcagtgcgtcccggcgc

SEQ ID NO: 51059 - DNA, 1167 bp, Bovine  19866881233256
agcctcactggccacggccgccatcaggacggaaatccttgactctctggacagacgcaaatccctcctgggagctgtttgttgtttttagctagttcgggggctcatcttctgcccagcccagagatcattgacactccaggaatgtggcttcccctggccccatccccacccactggcccctagggcctccctcctcccactcaggccacggttaggaggagagtcagagtgccagcggaggaaagcagtgatgagtgacagtttcccaaggcgctggggagcccaacctcattttcaggatggagcttccctcccgccatctcacccatcccactgcccttgattagctccccaaacaggaaagactcagagttccctgaaaggcctcatgctccaggaccttgcttccctcagcatcaggtgtgtctcttaggcaatagcccaagtgtttgcgtttcactccgaggaagctgccggcagcctgtccaaggtcagagcctggcttcttctcgacaaggacagctcctcaaccggagctagaatctggagaccccaccttgctccagttccctgggccttgcagaggggagaagagaaggaaggagaggcaccagacaccccttgaagacccccacacaaatccagcggggaaatgaggaaagggcgctgccatcagcccccggccgcccgggctggctctcagcctcttcacgtgtgtgcacgcagagggacggacagtacagcagggccctcactctcttccagaggctagttgcaggaagacactggagctgtcagtgagccggcagctgtaatgctgaagacagctggagccactagaggctttaagtagggaaatggatattcagccgtcaacagagcagagggtagtgtgaacaggcaagactgctggggagactggggaagagacctctgtggcagtcaaggtgagggaagatggaccctggaccaagtgatgggatggggatggagagaagtgaggaggttcaggactgcttagctcctgctgattcacgtggaaaggatggcagaggacagtccaagatggccctggattcctggctttgtcagttgaggacatagatggtggtgccatttctcagagctaagggcagagaaggatgaacatacttgcagagacaa

SEQ ID NO: 51060 - DNA, 814 bp, Bovine  19866881243316
cctctgaccccactgggaaagtaagtgtccgtgcacggcttgtgaggggcaaggagctcgagggtgctggcatccacaccacatcctctgctttctgcacaggctctgggtgcctgaccccccccccccccacatccttacacctgttcaggagactgaagggaccctctcccaggccttcctgcagctgatgatgaagaacccaggttcctgggagaaatattcagcccccggcccctcatcagaggggagttagcctcaacttcccacctgaccctaacctcctatccagccctattctctttcctgacttcctgagagggtggccaatagtgacagctccttcacgtggtccaaacagcagggacccccaactcttctgcagccctgggctgcccttgtcttgaggctgccggccccttgccattctggagaaagactccagggacccacgtgttacaagcattccttgagccttctctgagagccaggagcctgcatcacagcgaccatcaggatgcagagatgccactgagctatacctcgacagccgccactgcccggggatcctgagggaaccccccgggccaggccccaggcagaccccttatggggaccacagacactcagcagaagcctttcccactacaaagttgacctcttgtcgctaagaaagactctcctccagagccaggagatgctttaagggcccaaaaaagaaagtcagtcccggaacctctgttctcactgggcacgaggaacctcaggcagctcagcaggtcccagcagtttgttctggtccttccagcgcctg

SEQ ID NO: 51061 - DNA, 1698 bp, Bovine  19866881263626
acgctagaaagagtcaaaggaaacttagaaataagaacactgtaacagaaacgaagattgccgttgatggccttatcaatagaccagacatgcccaaagaaagaatcagtaatcttgaagatatgtgaatagagatctccacaacagaaatgcaaaagaataaaggaatgagaaatacggaagagaatagccaagaagtatgggccagttacacaagatgtaaggcagacacagtaagaataccggaagaagaaagcgagaaaggaaaagagggaatgtttgaaataataatggctaagaattttggaaaattaatgacagatatcaagctacagatctaggaagctcatagaacacctaacaagattaattccaaaaatctatacctaggcatatgatattcaaacttcagaaaattaagacaaggagaaaatttttgaaagaaggcagagggaagaaaaaaaaaaattctatactctatacactggactcctcttcagaaaccatggaagcaagaaaaaacttgggtgtaacattttaaacattcagagaaaaaaaaacaaaacaactttcagcatatccaggaaaatcataaattaaaagtgaaggaaaaataaagattttcacagaaaaattaaaactgagggaacttatttccaacaaacttgctttataagtaaaatgaaaagtttttgaaagagaaaaaattttgtaggtttgtacaaccactatggagaacagtgtggagattccttaaaaaactggaaatagaactgccgtacattttaaaagaaacagcattaaataaagaataaataagataaaatgttttatttcttatttttaattcattaaacagataacgggttttttttccaattataatatcaacaatgtgtccgtgattgtagcgtataaagtgaagtgaaagtcacttagtcatgttcgactctttggaccccatgaactatacaatccatggaattctccaggccagaatactggaatgggtagctgtacacttctccagggcatctttctgacccagggattgaacccaggtctcccacattgcaggcaaattgtttaccagctgagctactagggaagccccttgtagcatatgggcaagtgaaatgagtaacagcagtgttgcaaggatgggggaagggattagaattctatgttacaaggtcttgcactaaacatgaagcagcatagtgttatttgaaagtgacttggattatctgtaattgtatattgcaaacacaaagacaatcactcaaaaagttaaaaaggaggtatagctgacttgctaatagaataaagaaaaccagatcatataaaacactcagtaaaaatcagagaaggcagaaaaagaggaaaagtcaaaaaacaaagaaaaaatacaatgaacagaaagcatctacaaatatagtagatattcatgtaaatatataaatgatcagttttcaacgttaatgatataaatatatcaatcaaaacacaaaaactttcagaatagtacaaaaacaagaaccaactattgtttataagaaatccactttaaatataaagacacagattgattcaaaggaaagagatggaaaagggtacatcatgttaatactaatcaaaagaaaaaatagaaattttatattaacttcagacaaagcaaacttcagagcaaggaaaatt

SEQ ID NO: 51062 - DNA, 963 bp, Bovine  19866881327298
tcggcagattggctataacaaggcaggggccgacgccccctgtgaattattttatttcctaaattctcggccaaaagcgtagaccaccgctgcagttaaccctttaagtgtgttggcacaggagaggctctggggatttcttcacagcggtgggggcggggtatgtaggtctcactggttgatatgaaccccaccttgctgcacgaaccccaaagagatgagtttgattcgggacttgggaagaccactggggagaggaagctcgcgtacccctcccgccccagctctgctgtcaattggctccgggcggggcggggctgcgctgggtgtctgtgtgtgcacgcgcggattgcacgcgtctgttaatttcaagccaagctttcgcacttctaaacccacaggtctctgccttcacctcccgcctcagctttcctgggcctggactgtctgtttcagtacagccatccttctaattctcatcagcatctgccagacaaacccgcgtgcacacgcgcacgcaacacacctcccgcggttaacccagaggacccccatcccaaagaaaaacctgctgtttaacacattgcaaaagcggttgtctagcgcttgaggaggttaattccagattaatttccccattacctacctgggtctggtccccgacaggcccacccccattatcgccgtcagtgtggtcgtgcggcgtctaacaacaaacacaaacgctctcaatggatctcacacacctctcccaagttcctctcccctgctaaactgtccccacctagtaagtaaatagacccttttctccgaaagtcgagaaacctcgggtctcaggcttctcattttccttgggttacctccttcttcccccaccacaaaacacacacactttctcgaaccgggaccagggcagtagtaccggctggccagtacgggacgcggcgggaacagagcccgggt

SEQ ID NO: 51063 - DNA, 839 bp, Bovine  19866881331062
tttgagaaactctttaacgtcataattaatggaacttactcatatttattctgccctggttattgtgagcacttatcccagccatccagtagtaagtttgttactgtttccatttattttcctgatttatactagactgaatttttattggtcctttttgtttcttaagtagtttggaaggggagcatcttgatcctctctagttaccattcacctgtaatgtgttatagagagatttcattgtatttgccttatcaatatcaataactgaataggaaataggacctccccaatcctactcatagaggaagagatttttagcacaccatcttaccctgttttataccatttcattcatatacacttgcccagattttgtatatagtctggaatctcaccagctttttgaacccttccttaacacctatattaaacttcacaagtatttaggctgcatgtgtgtgtgtgtgcgtgagttctctatgcttggctagagtacttttttgaataatattaagagtgtgtgggcaatactttctgagtccttgcatatctgaaatgattttttttccgtcttatacatgaacaatagttggcctgattctctttttctttataggtaaacctcccccattccctttgggatcttttggtattttttctctttatctttggagtgcagaaatatacttaggattaaaaaaatcttctccatatattttataaaattatacaagtaatacatgaatatgttctttggaattcaaaatatcactaagaattttttaaagaatatttttaaaggtatacaagtaatacatgaaatatggttctctcaa

SEQ ID NO: 51064 - DNA, 1042 bp, Bovine  19866881372582
cctcttttctttcccacagagtttgccagatccggcccggtgcctgggttccaggaggacacgctgcagttggccttcatcgacttgagacaagtaagtctttgtgtttttgttttttgtttttcttttaagatgtgtgactgaagaccatcaggtcttaaggaaaaggagaggggaggggcattggcattggcgattcacactggagacctaagggcttttccctgtgtttgaggccacctcttttatttagctatctgggatccttagctatggtggagttaaaggttttgtggatggaaggaaagggaggaggtggaaggagggccccagaatgtagtgggactcaagtgaccctcaagtgatgtgacccattgtgctatagttggcttttgcagacacagcagaaaagataactcagcaaactgatgctaagcaggtgcactgatgcagactgcctgcttagagaacttctgtttgcagataatgagggcagtaacagttaataaaaatgaaatattttacattctggattgttgatttggtttgttgacttttttttctgttcccttaagtcttctcatccccacctttgtagaatgtggtcagccatgagtgactgagtggtcattgtagatgactagtaaaggccctgaacagtcatgataacctgacaggtaaccctactgaagtagtgtgatgaaagcgggtacttaggtatacctgaggtttgcaagcccatcagacagagtcattctgtagagctgttgcttgcagattgaaaagggtgggtcggtgggtcttggtggatttggtacagaggagcagtatgggtgggggccgacagagggagagggttaactgggctctgtcatctcttcactctgaagatggatggggttggatagaaagtgtgaatgaagtaagaatcaatgactgatgcttctctcctattaaaacaatctttttttttttgtctgtttttaaaagggtgctggctttgtttctcctgccataatgatgcagtgcctctgttttcaga

SEQ ID NO: 51065 - DNA, 1200 bp, Bovine  19866881375656
ggcagccgcttccattcctcccagtctgagtcactggcccggggagtgggttccctctccggctcttccagcttctgaggctgcccatctttctctgcatccatccagttgtgaaggggcagttatctggctgagtgggtcagcagagggctctgggggcctggggatctactcccctaccagggtgagatgtggggaggggggcctcggggtgtgagggagacatttgcagaaacaatcacagggaatttgagccttgacaagccccctggtggttaccccagcccccactgtggaatccacttttattccagggagaggaagaaccagggatgaggggtcttgagccaactgcattgctgggaaagccagtagaggtagggggagggtttccaagcatgtcatccttcaaggccggagcccatcctgctctggcgtctgtgcctgaagttcccaggtctcccgcgccctgccctcccagcaccaaccccatggggcgttccctacctgctgctctctctgctgtgctctttggagccgggctggttcccagtgacctttgtccagcattcttggctcacttgtgggaattcccagggaagccccagagggaaacaaagcagtcctggctcccgctgcgactgcggtcaggccatgggctctggggccacggggacaccccttcccctcctcacccagagctgctccgccggcgccttccccagtgcccgagtgctgaccctggcccgcccccatagccccggccttcctctgccctggccagcacctcccggcctcctcctgggctttgtggtgggcggtggtttctgggctgccccagctttgggaagcgcccgcgttgttaaccctgggcacggtcccagggatgaggccctggagtttcccggcgcctgggaggccccgatgcctgtggaacggctgagcaggaggcaagagcgtggtcttcatgaccacggaagcaaagccccttgagcttggagtgcccgcaacctgcctttgctttgcttctcgtttgggtggtttttccccctcaggggccctctaaggagaatcatgggactgccaggaggaaagggatcccagagcatccagttagactcctggatgggtcaagataagggcccggttggggctgccgttctttcagaagccccacctcaacgagcctgcagattcagg

SEQ ID NO: 51066 - DNA, 1387 bp, Bovine  19866881438368
tggtagacgtcattatggtattacctttgtgaaggtgggtgggggtgttgacttggagagggcatgaggaaccctctggaataatggaaatgctcaaagttttgatctgactggtagttacacagtataaacgtgtgtcaaaatccattaggtcatacactttggatttatgtattttgctgtatgtatggtatatcctttttttaaaaaaaatcaataataaatagacaacagtgagagaaggcagcctatgtccaggtcagatgaggaacggtcatcagggatgctcatgatgagggaagaaacccagggaagccaccctgttccactttgaccaagggacaaagttggctaaggatgggagtgcagagagacctccacagaagtccctggtccagaggcaggatgcagctccagggcgggttgccccatggggcgtcttctgagcaggccgacagtggtcgcataggatgggaaaggaacagccacctcccgcactaaaacagcaggactaaccccagcccagacaagccaattgggctgtcaggaggccaggagaacttcttacttgggacagcccgactgctgtaaagtactgcctcttccctttcaaatatatgtctatcaatttctgaattccagagtccttccccagaatctctttgctttcaaagtagagacaactttgagttggtgttttttccaggtgtaatccactctgtttagaaaaaatgtcagaaaaatcgaaagcactcacaaaaatgttgtaatcacctgtaaacataccacagagataaccactgcaaaagttattattttccttctagacttaatacatttgcttttcatgttggttgattgctctaacttgcttaagttcaacagaaagtgagcaggtcagtatttgaggccagagtttagtcagacccttgctaactagtctctgcaactgccccccaaatcctcctggtgatacgacaagctgcccgctccaagcctgcttcctgccagcctcagccttggccccacaataagtgctctactttccaccctgaatggtgaatgaccctgtgttctcattatgttcccactccagggattcagttcctctaacaacctggccagattccatctcattccacacagtcatcaaagggaggcctcttgccacaggattaagttccaaagagccctgatcttggcgctcattgagaaagaaccaaatccaaagcttccggagataggcctgctaatgcaggactgggacaagctagcatgtgcttgtctgcctctgggccttgctaagcctcagcttggcctcctagctcagagactgagggatagcgctcccagcgcctctgtgggacaggaaaggcctcgggccttg

SEQ ID NO: 51067 - DNA, 1276 bp, Bovine  19866881453379
tgttgaagtaataagaataatttaccgacgaggagctactgtctttctaggtcggcttccctcatgactctcactgtaggaagtgaagctcttcctattttgggtcacagggactaccggtgacgctccctttccctatatttggtcctaccttcctcagggctgtgacctctgcacttcatttaacaggactaaagtaaagtgaaaatgaagagcatggtgtgggaggaaaataatgaatactatttatttaagggagtttgagtacaaatattatcagaaattcaatctaattccatttacttctaaaatggcacaaaacaatattaagtcaatgcattcagaaagcagttatgaaagcataatacctcataggaactacgttacccactggagcaggggaaatttgaggataaataaaaacagagatcctgcccttggtgaactcagaatctaatggagaaggcagatgattaaacaagtaattacaaaggaattagtaatgaagggatatacaaaatgtcagggacccaaagggggaacaattaaatctgtctgaggaggttgggaagaatttataaaggagatgacatttgagccaaactgtgaaggaagggaaggagtttgtcactttatcaagagagcagtctgtgacaggcagagggggcctaaagcttgtccagtttttggatcagggaggtgtaaagagtggtcccattagaggttacatggggaaaagacagggaaaggagactagagagacaagctgggaccagacttgctttgctgggagtttttcatttgttctctgggcaacagagctcttaggctttataagcaagcaaatgacctaacaataactgtagtttttaaaaatagtaggtagcagaatgaaaaaaaagaaataagaaatttttaatggtagcagcataagacaggtcaagagaagaagtgacaataaaatagtttcatacttaacagaaagtatcatgaacataaccactatccacttatgttccaagtcaatcattacctcctccaatgaaactgtcttctttcactaccatttaatcaatcagacagtgaaggaaaagaggttcacacagatagacataggaagttggaaagaacttcctacgttcttccaagaaaacacaagaaaaaccactttctctcttttaatgatttctatcagaggttataatggaaggaaaaattaaattaacagcatcatatggaactctatgttcaaaaaagatccagatgaactggatga

SEQ ID NO: 51068 - DNA, 792 bp, Bovine  19866881507632
catttctgaagaaattaattggatcagtcaatctcaactgctaactgtcaaaacatttcatgcagtgctctgcattcttggtgggttagggtactagtatgtgtcactgcatgggaatccatggatggtgtcagggcctgtttccagtcttgttggcatgtgcaaccaaggcagaggttgtgtgagggcctagtggggggattccttgagactggggctgtggatggaagcttgttccagcttttgtagttcctgaccctactacctcagccctattcagcccaatgtcagccctcgtcctgcatgtagcagctgagtccccatgatggccaacatttgccaagggactgttacattctaggagaaaaagacagtagggaggctggagcatatatttacatacgcccatgcagaaaccaatatatctatatctattaggaagaaagatgacatctagttatttatacacatctcttcagcacaagattattcagggatgaagcacggtctttttccaccagagagcagtaagtctgcaggaagaggattttatctgatgacctggggggagagaggtgggatattgggaagaagtaacctaactggagacctccagatgctgtctggattttgacctggcccctggcctatttttaccacttgcaaggcagagtctccgcttgttggcaggaattttctatgggctagtagcctgagcatttagctgcaaggctgatttaagcaggtgtgaagggagagttcctaagaataccctcagttcttgaatctgcg

SEQ ID NO: 51069 - DNA, 631 bp, Bovine  19866881861316
atattcaaagtgctaaatgaaaaaaaaaagtcaaccgagtcccatatctggcaaaactgtccttcaaaggtcagggtggaattaagagatgtcaagctaaacaaaaattgagggcgctccttaccactagttgttccttgcaagtaacactcaagggaggtgtgcaaggtgaaaggaaaggacactagacagtaacttgaaagcttatggagaaatgaagatctcaatcaaggtaaatacatgggcagttataaaagctggtgttatcataacagtggttggtaactgtaccttttgtttcctgatgatttgagagactggtacatttaaaggaaaaaaaaaacaattattaatctataagctagtattttctaacttttgcaattccatatcttattttctacataatttaatacatttaaaagaattactagtttatattttgggacacatgtatataaagatgtaattttgtgacatcaatgatggaaagagatggggaaagttgtaaaggagcagtttttgtatactattgaagttaagctaaattgaaattaagagtgttggtactttaggatgttaaatgtaattgccatgtttggtggttggatagtcactaagtcatgtctga

SEQ ID NO: 51070 - DNA, 1142 bp, Bovine  19866880489632
aaatatgatttaatgtggttagtccagtaatattgggaaacagataattcttttttttaatttctttgctttataaagtttattgttttttcttcatagatacttcatagctgtggaagatgacaaaattttcccattaaattcagctgaaaggtaaagtttatctctgggtaactctttgttcatcagtagatttagcaaaactttgccactggtaaagttaaactatgcaaaagtaactgtgtgttaacctgagcttctgggttttttctgtcatccaggaaacctggtgtgaagcatgcaccatatataaggtaacttgatcattctcttctgatctgctgtatcttaggcaacgttagcagggtgtattagttctgactattaggacaaagtagcctagactgggtggcttacaaacatcagaaatctatttctcacatctctgcaggcggaagtccaagatcagggtgcaagcgtggtcagggtctgatgagaacctcttccggtttcagcctgctgcgttctcattgtgtccacacatggcggaaagaggactagagagctccctggggcccttttataagggcactaaccccattcactggggctctactttcatcacttaatcacctcccaaaggccccgcctcctaataccatcacgtgggatgttaggatgtcagcatatgaattttgaggggacatagacattcagtcctttgcaaacagtcatagattttactatcgaaataataaaacatttcatatttttcaagtattgcaggtgatgaacctcctgcaagctgtgtgtttagtcaagttatgaacatggcagcattcctaggtaagaagaacatgaagaatgctttatgtgctttgggatatttcttttttattttaaattctccaaaaactcatatcaaaagtatggtgggcttagtggataatttagtgtcatatcatgtcagtatgctaaagagggctttttttgttttgagggtcattttttttttcataaatccctttcacctgcttaccttccgttttcttttccctttaccatcttcaatcattatagcaaattcttgactttatttcttttgctgcatgaaataatgtatttcatgtgccataaaaatc

SEQ ID NO: 51071 - DNA, 992 bp, Bovine  19866880541449
atccaaagggatttttcatacacacaaaagcatgcacagcggatagcccctgtgggcagagtctttaggcttctctgggcctcggccaggtgggacacggctgtccctctgagctggccgtgctagtccttatttcctggtctcctggacagacgtacagccctcccagcggtgtccctctcctggtctttccttccctgatgctggcttctcacctgtttcccagggttcccatgcatccctctgacttatcccagccaccttcatcagacccacctcaagccccctctgctctgaatttgggctgtcagatttagcaaataaggttacagggtacccagttaaatctgaatttcagataaacaatgagttttgttttttagtgtaagcgtgcaatgattgtgcatgcctgcttgctcggttgcttcagtcgtgtctgagtctacaacccccatggactgtagcccaccaggctcctctgaccatgggattctccaggcaagagtactggagtgggcagccatgccctcccccagggagacttcccaacccagggattgaacccgcttctgttacggctcctgctttaagcaggcgggttctttaccactagcaccaccaggcggattcttttacccactgagccacctgggaagcccattgcagcgattgggacatacttacagtagaaaattgttgattgcttatccaagatttacctgtttgtcctgtactttctctggcaaccctcctgaggtctgcgtggtgttggtttgaggtttatcctgcagcctatttagtcgtgggccaccaatcgcttcttgacctttctgctaagatccagggtcagggggagccctcgtgaaccttcaggaaggtggagcgaggtggttctgctggggactttgaaacctgccttcagtctggcctccactcactcttgtccccagtgagaaccctcccttctacctggcagctctcctcacccctca

SEQ ID NO: 51072 - DNA, 854 bp, Bovine  19866880618920
ttttttttcttttgctgcttatgttctataattatgaagttaaaaataaatatgaatgccacgctttgcctggagaagataccactattttaagtacacacgtatcaatactagtctgctaaagcatggagaccaaatggaaaaccatactttgtctagaaatcttagaattggccaactaaatgtctaagaaagcatccgagtagcatgcactttgggaacccattgattcaagtgtaagagacttccaaattgttagtaatatgagtaggtctggtattgacatctgccaatgaataagatatcatccagttgtccgtggagtgcaaattgcaggtatcaaatagagatgataaatgcaggcgttattcctttaagtggttcttagcttttgactgcatttgaccatttgtcaaagctaactggcctctgtttagtgatattgagagtgaaacacacgtacacagacacatgtgtgcaactgatacttgaaataaaatttcataacattaccatctatcttagagattcggtttctgaattccttagtttttataatccaatacttcagcaatgatctctgcttgccccccactttgttccaatttaatcgagtaagtgtcatctgtgtgctgttttaaaaatataaatcttggttatggacgttacacggcagaagttggctcagtagaggcagagtatatctatttctaaacctaatttagtgggaataaaacaacattgtaataattctcagaggcaaactctcccttaaaaaggagaatagaacatatggagtctcttttcagtactcaatcactttgcaaaacacacccagcagtagaatagggtag

SEQ ID NO: 51073 - DNA, 911 bp, Bovine  19866880650223
tgttatgtaaaaagattacaataaaaatgttaagttgtttgacatgataaataaggttgatctgttatgacagggactttggttgtccttggggaggactgactgtcttaagtgcaaactcgtgattcagatttacagatgtttaatctcacaaacgttaagtctagatgtaaaaaattattgtatttcccaggatttttaatgtaatttgaagcaggaagagctgctttttgaaatggattcatctctgatatgttaatatttttcatggtgcattcttaggcaactgctatgagtcgctagcattgagtttctctgacagctttcacgtggtaatcagagtaatgtattttgttagctgactcattggaaaagaccttgatgctgggaaagactgacggcaggaaaagaagagggtgatagaggatgagatggttgaatggcatcacctactcaatggatatgagtttaagcaaattcgggagatggtgaaggttggggaagcctggcatgctgcagtccatggggccacaaagagtcggacacgactgagtgactgaacaacaacattttcttggcaaatcctgatccagtggacctttagatgctagggtatttccaagatagggagggctgtgataaagtcacagagaagtgataggggagcctgttcgcatctcttcttggccacattttattattattattgttattagttttacacattttggccttgccatgcagcatgtgggatcttagtccctgaccagggatcaaacctgtgcccgctgcactggaattgtggactgttaaccactggaccaccggggaagttgtcagtcacattttacagctgaaccattggttggctcaaccccctcccatcattcacttcctctgcttcacctttt

SEQ ID NO: 51074 - DNA, 2376 bp, Bovine  19866880673857
ctgtgcaaatgggttcatctgtaccgttttttctggattccagatatatgtgttaataggcgatacttgtttttcgctttctgacctgacttcactctatggcaggctaggtccatccacatttctgcatgtggcccagtgagcactgtcacttgaccactgcgagactgatttctagctttcctgcaccttgctcttcttccccttccagtttgcttctaacccgttttgtggattagttccccacaggaccctgagttgctcatgtgcaggattctgcaaacattttcaaggctgcgttttcaaggcaaatcttagcagtcccctgctgcattctgctgaatctgtttctgagcttgttcttgttccaaaatacagtgctgactttgcaaatggcccgtaaagcacgtgtgcgttgaaatcacagccatctgtgtgcagcagagctggaaatgtggcatcaagcagccagctgtttacaagaccacctcccttgccttgtccattcaaaggagagacaacatcaggatacgtgtgtagctgttttgttgttgctgttttatcggtcagttgtgtctgaccctgcaaacccatggactgtagcccacaaggcttctctgtccatgagatttcccaggcaagaatacttgagtgggttgctatttccttctctaggagatctttctgacccagggattgaacctgtgtctcctgcaagtctcctgcattgcaggtggattctttgccgctgagccaccagggaagcagtaagctgaattcaaaacctgaaaaattaggggcgaaaaattgaagagggatttcttaaagtcccacctgatgcactggaaagcaacggggactacgggaaatatgtggccatagagcagtctggctgttaccgactgtgggacggaagtgtcctttaccagcgaagatacagacggttggtccaagagaagatgccctggactgcagggcctctgccttgccctgcttcgtgtctgcctgaggaccatgcatgcagcccagactcacagattggaagaaaataattgtcaaaatcagcagaatgttctttgtgatcacagaataacactgactctctaattaaggaaaaatgatccacctctttgtttcagtatgttttagcaccttcgctggtggtatcttttattcttggaaggaaaaaaaatattgcacttcttttttgctctggcttatcagaatctgtcttcactaccatataaattcacagaatttgtgaatatatctttaaatttagttcacaatttccctaattatagattttctttcttgtgtatttattttccaggcttttgcctagacattttagttgcttcgttctttctggctgagtggcacagggacaatgctggcataaaacaaacattagcagactagaatccaagatcaatctcttatcttcctaattaccacccattcccgctgacaaagtcttcaggtcttaaagagaaaacaaacagtctacctgaaaggcagaggcagtctgtgtgtgcagtttcacctggctgggtgcgttctgctggaggaattttcagtgctgactttcgggttgtgcgtgcatgctaagtcgcttcagacacgtctggccctgtgggaccctatgggctgtagcctgccaggctcctctgcccatgagattttccaggcaagaatactggagtgggttgccatgtccttctccaggcaatcttcccaacccagggatcgaacccatgtctcttatgtctcctgcattggcaggggggctctttacccctagtgccaccttcgggctggtactacttaaacagcgactgcagtaacaaggtcacctctggccttgcatctctcagctagtaaattaaatctcaatttccccatctgtgaaactggaataatcatagctgcttcatagtgtttgaagatcaaatgagttaatgccttgtgaactttaaagtattgtaagagttttagcgtttagctcagtcggtaaagaatctgtctgcaatgcaggagacccaggttcagttcttgggatgggaagatcccctggagaaggaaatggctacccactccagtattcttacctgggaaatcccatgaacagaggagcctggtgggccatagactgtggggtcacaaagattcagacacaaccgagcaactaaaccaaaccacaggagctttagctgtggccaggtgatgatgattgctatgaattttgggagttaaagagttttctacagtcaattttaagttactctttacctttttttgtcctgttaatgaatgaacttgttcatcggtagtgcactcagaacacacacccacgcatacacacacacacaccat

SEQ ID NO: 51075 - DNA, 1767 bp, Bovine  19866880741907
cagcagaagcagcagcagcagggcatatatatgtaaaagactttggatataaaatagaaaatgaaagaaagccgaaaagattacagaatgatcttacatgcattgaatcagtagttttcttctttcagatgtttatttctataaaaccttactttatttttcatagcctccacaaagttctctatgaagtagacctacagggaatatttcttgagtggatgaagtgactatgattgttgagtatttcaaagaaaagggatgagaaccagaggggctgggttgcacatgtgctcataggcatccttctttcccctcctgtgtgttcaggcttgtggatggtcactttgataccaagattggacacaaagtggagagtgagagttaccaaaagatcgccagcagcattggctgttcaaccaacaacatcttatttctgacggatgtttcccgaggtgagtaacctgacttcttggatagtacactccaggctgggagctgagcctggcactggaaacactttgccttcataaagaaggtttccatggggagccgtgagaaatgagacaggtatctaaaggaaacagtgcaaatagatgtttatagacaaaacttgcctggtgctgatcttggtaagagatctaatgctaaacggttattagccagtgtcaagtcccacgtggacagtgatgactcagcttggttgagaatctgggttgctggtcaagaggactgtgcttgaggcaggggtgcttgggaactgtgcttgaaaactcggggtgcatggaaggcagcgcctctgctgctgagtgagtgaatctgagcagggggggtgtggagcactctttttctgggaggtgacagtcctttcacagaaggtgggaacatagaagagacagttctgccccatttacttttagtactcagagtgaaagtttgctagtcgcttagtcgtgtccagctctttacgaccccatggactgtagcctgccaggctcctctctgtccatggggattcttcaggcaagaatattggagtgggttgccattcccttctccagaggattttcccgacccacggatcaaacccagatctcttgcattgcaggcagatttttcaccatctgagccatgagggaagcctgtcacccttaaattaatgcattctgttgctctgtttcccacaggttgagaaactactggggattcttattacagcagatctgaatccacagagtgtgttttcagactcttgccctgtctgccccgtctctggccgcagacctgagtcccgtctccggtcctccgctgtttgcgcgtggattttatgtcgcttgcagtgcctcctctcttgccagttttccttccttgaaatttcctcccactctgtgcacaggagtcatttgttacattgcgggtcctaatgcagtagttgcgcactgaggacctgagtcactgcatttttaacaagcttctaggtgattgccacactgctggtccagggaccactcagagcagtggtgctccagagcaggagttgatagtagtgttctgtaaagggccagacagtaagtattttaggctctgcaggccatgcagctactcaactctgtcttcgaagtgcagaagcagccatagacagtacagaagtgagtgggcctggctgtttccagtaaaactctgtttacgataacaagcggtaggccatcatttgctgaccttcgttctagagcatatagagtctgacacacgatttcaactgagctctac

SEQ ID NO: 51076 - DNA, 799 bp, Bovine  19866880742748
tgatgtagtagtgtcttactggttttttaataaatccttttgtataaaaatgtattggctcttttatcctcagaatagggaaaaaaaatgaggaattataaactgtcatgaagttaagcagaagtttggaaaatagtaaaacttgtcaaaattgaggccatggttaagattgcagtgaaattttacatgtttttagttaagatctagtttttggcacagtgtgacctccctgtcctaattggaaatgacttaatgtagttaatttgtttgttggatgttttaaaagtacttccatatgtagccattaagctttataatactttcccagtttttgcttaatatgtattgtgctttttagaacaaatctggataaacgtgcaagaacccttttgcacagataatgttttgtgcttccattaaataaaaaatctggttatcataatacaaatgcagctagtttagagatttttagggttgtgggtttgtattcagtagatatccaagtgttgagggaggattaaagaaatgtgtactgtgttgatgtgtgcgctcatttgtttggatgatttttattgccatttcttaaagtcttagtttttttggcgggggaacgggggtgttcagggctttaaaacatcccagactgggattttaagacacctagcagttctgagtcattctaagaaagtaactgggagtttagttgatggctttaggattaagttggaaggtttctttttttctgtcatttgtaaaatgtagaaataggtaaactttcagttggaaggcttttggtata

SEQ ID NO: 51077 - DNA, 1902 bp, Bovine  19866880779605
acgaggagccgtaaagaaattgttagaaagcagataccatcaaactggttctgggaagtgtgaaatcaaagttgcacaacccaaagaggtatatagccagcaacagcagcaacaaaagggaggaagaggtgctgcagctggtgggcgaggtggtactagggctcgaggccgaggtcagggccaaaactggaaccaaggatttaataactatcatgatcaaggatatggaaattacaatggtgcctatggtggtgatcaaaactgtagtggctatggcggctatgattatactgggtataactatgggaactatggatatggacggggatatgcagactacagtggccaacagagcacttacggcaaggcatcccgagggggtggcaatcaccaaaacaattaccagccgtattaaaggggacactgccaaaaacaggaaggaatcccttcctaaagtaaccatcttgcaggaagacactgaaggttggtcttctgttgatctaagatgattattttgtaaaagactttctagtgtacaagacacaatttgtgtccaattgtatatagccgccaattagttttcttggtttttactttgtcttttgctatctgtgttatgactctgtggatttgtgtttatacagactttgtttgtatgattacatgttaaaccccaaataaatgcttccttatgtgattgtttttctatatcaggtactaaataactctgtaaaagtgtaattttaaataagcaatgataaatgcacagtttattttgtagggagtcttgctccataggaagagaaaactgtggtcctttatgaataggcagctacagtgtctgctctgttgcccttgtttgttagatgtattctgtgctcttaagggagaaggaaatggcaacccactccagtgttcttgcctggagaatcccagggacgggggagcctggtgggctgccgtctatggggtcacatagagtcggacacgactgaagcaacttagcagtagcatgctcttaagacttcattttcctctctaaccgaggcttccatcataacctataatgttgtttcccctctgcctatctggagacattgtcatgaaagcttctgtggcattgttatactgttgtgattagtgggagctttctagtagaccatgagtctctggttatattttgaaaagtacatttttaatggcacaaagcatgctggtagctccttttatgaagaaaatgttttgctttgttcttgtcttcggaaaggcatttttcaatggattgttgtattcagtggtctgctagaaagagctttgactaatcataatatcataactttgttttcttgatttaaatgtccagatatacccattgcggagtcgggggcctaaagctgtgttataagagctacaggttaagaatagcagatatggttagattttacacaacaattttggcaaataggtatgaagttattaaagtttgaacaaaacttagattaaaagatttgaagtagtagctaagtcaattaattgtattctattctgttggtttaatgtcacagcaagcaccaaactgaacaaaatgttttctcttggggccttgttaggaagctgtactgggtgttaactgttagatggtgtgagttcttagaaggcatgggtagtgggtttcagtcatttttttatgtggttagtgcatgagctgagtagctgagcataatcacactcagacataaaagaataatggagaaggctaacccttgattctcatgtaaatgcaagtttagtgtgaccaagtcatgtcattacaacacatcttcctggtgcattaaaaagaaagccttttagctctagatttgggaggatatcctagataagttcaagtctgaattttacatt

SEQ ID NO: 51078 - DNA, 937 bp, Bovine  19866880947242
atcaaccctgaatattcattggaaggactgatgctgaagctgaagctccaatactttggccacctgatgcaaagagctgactcattggaaaagaccctgatgctgggaaagattgaaggcgggaggagaaggggatgatagaggatgagatggttggatggcatcaccgactccatggacttgagtttgaacaaactccaggagatggtgatggacaggcaagcctggtgtgctgcagtccatgggctttgcaaagagtcagacatcactgagcgactgaacaacaatggctgcacaaccttatgaggtttttttttttttctgagaaatagtgaattgctcaccttaaatgggtgaagtgaatggcatgtgaattgtatcaatagaactgtttatggggagggaggtgggagcggggttcaggattgggaacacatgtacacccgtggcagattcatgttgatgtatggcaaaacaatattgtaaagtaattagcctctaattaaaataaataaatttaaatttaaaaaataaaaacttcaaaaaaattacagtgaaaaaatggaaataaaatatgtatcaggatagtaaatgacattatactgcatcctgttgatggaacatgatgtaatcactaaatattataagccctagaactacataacaacacagaacatacataatgtgatgttcagagtaaagcaaagtgatgctgtagctaaatatacattcatctggataaaggctggcaggaatcagagagaggagactgtggtgagggggatgtgccactttctttcaaaagtctcattaatgttgttgagcattttgaaggcacttgttttaatgtgttttgtaatggcagccttgtggtaagtacaggtggtactgaagatgcataaatcataggaaaggaaggcaaaagcacaagggacat

SEQ ID NO: 51079 - DNA, 1699 bp, Bovine  19866880969018
cacgacgtgtgaaagaaaggacgcagagatgagactgctgaattaggtacagaactagttgatgtccccagagcaagaaaaaagggcagaaaccatctattagttgtctgtcagtgggtatataatgtcccagtgtgatgacagaatgccagaagtataccaaaccgggttacatttcttacagccgcaggtgacccttaggcctgtcagacaatgatcctgttaggggaaacacactgactgaaatcaacccccggccccacccagccaagcaccatagtaactatttgcctgagttattttacaacaggaggtcctggtaaggaacacagaactaataagccaccaccaaccagaagagtttggaaaaggtcaaaaggagataccacgtgtctggccacctcccagaatccttcttgtaggcatccatcttggctgagtgatgtatgtgccaccaggaaggactctagagtcagaatgattggctaaagacaacccgaaactgactccaactgccataaaacctgaggctgcatgccacatggcagagcagttctcctgggttcccttaccctactgttctccgggcgcccctgcccaagaaagtctcttgctttgtcaacacgtgtgtctgctcggaaaattcatttccaagggttagacaagagtccacttttgggccctggaaggggtccctcttcctgcaacaatcccataggagtttgaaggggcatgcagtcatcttttgcccgtattttaaaatagttcatgcttttagagatggtccctgaagggtagcagaatacgctattcccaaataggctcctttggcataaggattattgggagctgattattttggagaaaaggcagatacagaagcagctctaaaagcagagtagaggacttccctggtggcccagaggttgagactctgcacttccagtgcaggggacctgtgttccatccctggtcagggcactaagatcccacatgagccctgcacacccagaagtgttttaaaaaaattttttttaatgaaaatcagagtagaatgtgctgtttgtactgttttgtccattgatgggggaaatctccatttgtaagaatgtccccctctctgtatcaggaagagaaagactaaatcacaagaagctcttaccagtgtgacttaaatctgcaaacaaccttacccatgtttgctgtgtttttcctaggaacctcccataactggtcttctacccaccaacatgtttcttttgtcggtagctgaagatggtattaaggtggtggtttgggccatttcagggagttttcccagttttcttgggtatacccattatacagtcaatatccatgttattaaacttcagtttgtttttctcttgttactctgtccttcattacagggagggatgtctcagaacctagaaaggaagacgaaaaattgcttttctcccctacatccccacccccagggcagccccaggacctgcgtgaagctgtcttcataacccatccttgcaactggtgttgcctccagccctgcaggccacacgctcctcctcctgggccttcctgttcccaagccctagtaaagcagtccttctgacaatgatggtcccctttatcaaatgttactaaggttcctgtaagccctcttctcaactaggcctcgaccccggccttcgagtccttc

SEQ ID NO: 51080 - DNA, 702 bp, Bovine  19866881067685
gaaaaactttggaaggactttttgtgattagaagtggggccattaccaattaaaacagaaagtctatgagaagagaatttgtgaaaagcttacagtaaaaatagagtgtctgcctatatctctcataaacattttgtatcttaactgtgaaaaatgtggaccaccctcactggtcctctcattatttcctgagccaaaatgatgttccatgctgcaaaagtcatttccaaatattctgaaacatgacttcaccattgttcacatgtatccccagggaccactgacagttctaggcctggaagaagagaagttctaataacacactgaggaaatgtcctagtttaaacctcaattgcctgggcttccctggtggctcagacagtaaagaatccacctgcaatgcgggagacctatgttctatccctgggtttgggaagatcccatggaggcaggcatggcaacccactccaaaattcttgcctggagaatccccaaggacagaggagcctggcgggctacagtccatgaggtcacaaagagtcagacatgactgaatgacttagtacagaagaaacctcagtcctctatctccttcactgatctttgttttttcatttttcttagctcaaaataataagtccatttttttaagggacaaagacctataaagagccctgttaagtaatattacaactgtaattg

SEQ ID NO: 51081 - DNA, 1305 bp, Bovine  19866881157137
ttatcctgtgcggaacattggttcccttgggtgcacaggaatatagaaaagagaagaaacacatcgtgatgttagtattgggagctttcagaccatccaaggctgatcaatagagacactatattggatacaaagttgttccctccctgccaagcttttgcttgtggtgtttttagtccgtgtatcgtgttcacctattattaattctcaaagattcttttttaattatggaggatcaagcctttcaaaaaataattaattacaaaacctacttaatattcagaggtgtcatgcaagcctataactggcattctctgttggtggtttaattagacaaggaaatgcaaaaagctgtcacttgagggtgggtggctgcaggggaggggagccccagcactaccagttggccatctgtaccagacacaaaagcacgactcttcagctggcctccctcacaggaagctccccatttttaccagctcatccactgacaattcctttctgcagcgtgtagctggaaggcagaagatactcgggtgctatcatttcaaatgcaataattcatggatgtggaaaaacaattaaaaacacagggtgcctcagtttctccatctgaaaaatacaattcagaatgtcatccatccatatgcctcccagaacaacagctgctcaacatttttttttttttttttacaaatggccagaaacatgccaagtaacaaaactggccccatgttacacattttcatctaaatatgctggcaagaaataggaaagcttcttaattttactcagtaatcaaatgtggcttgtttttgagtgagtttttccagtttgtggcttttccatgccatttctcctcccccaatttttaaaatcatctttgaccatctgctctctagataattctcttttctttaatattgtcattagatggtaagtaagagtaacaccaagaatcatcatagttcactgtatactcacatttagtccttataactcagtgaggtaggcattatttttttatcattattaataccatattactgatgaaactgaagtttagagagtttagatgacctgactggtaccccaaaaaattaagtagaaaattaagaattaaaactcaggccagtgtgactctggatcccataggattatttttgctattctcccaaagaagaggggggcgaaatccataaacatacacacaagcatggtcaggatttctactagtcagcaattattataaaatatgggaataacaaaaattactttataaaagaaaatgcattcgaaagaaaa

SEQ ID NO: 51082 - DNA, 742 bp, Bovine  19866881191685
tgagcagaaaggagacaaggggagggagggtgaaaatcccaggtactccccccatctgcccacccccccacccccatctgagatctggctaccttcccactctcggttctaggatctattcctgcattctaacaaataatcattttttgtttggcctgcttgaattgctttctgttacttgcaatcaagagggcaagttcataccgtagagatctattctgaaagacagaaggaaagataacctggtgcctttgcagacagataaattcactataagcattacttcttttcaggggagccttctgagccaacttcagcacttggtgtttcagttacccacacactccaccactgtcctcacctccgggcttcttaaagttgaaatccagtagccctgaagtgtgaaagcattctgggcagcacattctttcccctccagtctagcagatgcacagctgccctctgagactgtgctcctgttccacaggccataaaaggatcttcattactcttggtgggatcacacgtactctcagtgggaagagccaaacatcatgaatgtgtaaaaggaaacttagcattaacacatgttaccctcctgtgcctgttaactttttacttcctctattttcattgctgttttctttattcatcctcagtcatctacaccaagaattctcactggcctatcacctatttctacaattcagtacacattcatttccatttttctaccatcctc

SEQ ID NO: 51083 - DNA, 1475 bp, Bovine  19866881220654
acccatctgttaccaatgacccctaaatccacagcttgaacctggatctcttccctgaactcgagtgatttttttttcaactaccttcctcaaatctcacttggatatctgaaattcaaactcctgtttctagcccttaatcctgctcctcccacactgtcccatttcagccaactggcagctccatcattccaagatgctcaagccaaaagccttgaagtcctctttgactcctcttgctctcatactccacatcccaccaattcatcagcaaatgctgtcagccctatcttcaaaatacatccagaatcgaatcacttctcaccatctgccactgctcccaagcactccaaatctactcaatacattgattaatgaataacctgaatcacatcatttcaatcctcaaaataaccctatgaaacaagtgctcttatttcctccatttcacaaaggcacataaaggttaaatataaactaagaaactatagtttatcaatcaggtctttttccttttttggttcaaagagtcagatccccagagcctgatcttcttggtcaaagggatctgactagcttacagacttacaacgagttggtcccagccaaggcccagggcaggagtcagtcagcctcctggagcacggcagcaccaacactagtctgcccacgagctcctctctgaaatcccacccaggttccactgccaggactgccactagttttcaaactacatgtgttagtctctttttattcagtatcagctctccacacttttttaagacttaagaaaaggaacttgttggaaggtcacataatgaatcactgaaaatcaagttaagaaatgaagccctcacatgcatacccagaagacaaagaacccttttctgtattaaagaattctgtctttgaaaagcaatccgtgtttttgaaagtggagtcccctgggaagggtccagtgaggttccagaagggcctctgaggacaatattactgactttccacgtgacggaggaccggatacagcaagataagggtgggctggccaccacccttcttctgacctctacctccaccaaaaccaataatgaaaattaaatgagttaataaatgtgaaaatcaaaagctgtatacaaaaataagcctttattgtaaaaagaatagcttttttgtgcatatgaaggagttacatggggtgagctttaaggatagaaaatttaagaaccatcaaagaagggaggtcttttcagagctaaacacaggatagccttaaaaagtttatctgagcaaaagaaaggcttacctatctatgtattttcaaaacaggggttatatattagaattgggacttttggggaattgatctgactacatatacttcaaggatctaagtgactttaagcataggaaaaaaaaaaatcagaaagaatattcaccaaactcttaatgattactgcttggtggggggagcaaaa

SEQ ID NO: 51084 - DNA, 762 bp, Bovine  19866881292207
ctcaccaattgagaatcactgtgcataaaaatagaaattaatagggaaaaaattcagaatccttaccaagaaaataagagcactaaataaaatgatctctcgcctgggaaatgactttccatttcaagcaaagcagaaagctctcagatatacaaaagataacagagccagaaagcaaacacttctgaaaacaatttaactcagttgctttcttctcaagatatgatttatgacacaggatgccctgaacagtcttacggatgccactcacctggcgtcagtagcactctttttgctggtatacgggaagtaattctgtttgtgtttatttggatacaaacagagatgctcttctcctaaacatgttagcagaagcgctgtaaagactgatgacggttactaatgggagtgcactgatgtgcacctgcctgttaaaaccttacaaaaatcctgcttatctctttccagatgcaattctcccaacaaaaaggattctttaatgatgtaggatgaacagattctttctcagctcttaagcattcaggagagcctggacagaattaatccttccacagaagaaatacataatagatcttaggaaaattctatttaatccccaacctgtgttctaaggaggatgcattctattaaagaagagaatgggtggcccctttgctcagtcaagcagcttgggttggtgttggatatgcaaaggtgggcctggggatgagtctggggagttggtgggggcggggcaatgag

SEQ ID NO: 51085 - DNA, 1010 bp, Bovine  19866881294236
ccaaccagtttgtttgcatatttttgtctggctgaaaaatatcccttgtattttcactggcctagttcttggcaacagtgtctcttgtggctggagcagaggctcatgaggcagagagagagcccttgaacacggaccatttgagtctctatcctcatggaccactgaggactttgggttggggtgcctgggagggggccaggcaagtgcagtgaccaggacagacttcagcgaggaatggcctgggaccctgtgctggctggctgactcagctcagattcgcataagtgaaaaacagatactcatagaaggctgggtcgcaatctgaatatacccgtaaggacagcctgccgtgccgaggaacgggggcctggtgaattgtccgccaaggaccccacaaaagatgtgagggctttccagcttgaaagccaaagccctgagggcttgcaggccaagacagatgaccatcccagtccaacccagtcaacatcagggctctgctttctcctgcaccccaccaaacccgcccccgcgtctgcggtctcttccgcttctcttccacttccttttattctcggtgctttttcaagtttgggctcattagtctgactggaggaaacagaccaaatatgttttattttcaagatttagagattatcctctagctgtaaagttcctttaataagtaaacactggtctaatgttacagtctttagacctatttcttactttccttatttttttaaatttattttaattggaggatgattgctttacaatgctgtgtttgtttctgccatacaagaatgtgaatcagcggtgccttttcagtcgtttcagttatgtctgaccttttgcgaccctatggactgtagcccaccaggctcttctgcccatgtgattctccaggcaagaataccagagtgggttgccatgctctcctccaggggatcttcctgattcagggattgaaccccagtctcctgtggctcctgcactgcagggggatt

SEQ ID NO: 51086 - DNA, 1663 bp, Bovine  19866881376332
ccttataaaagttgttcctctagtctcatttcttgtccatttctcccttctgtcagctctcagtcactataactagcagcttgttttaataatggtgggactacattttcttactctattgggtgctaggtgctcttttttctttaatcaattccctctcctttgatcaattcagtttcctaatctgtaaaaagggataagaaaagtgtcaccttagctatgaggatagacatcttactatgaggatagacaatttatgtaaaacacttagaatggggtcaaacaatgttaattgttgttgtatataatatgttgttggcttggaaaaagaaaaagggttaaagaatggagggggtgaagaaaagggagaccacagcaaaacttcaaatttctcctttataagtacagagatcccttagtatctgaggggacagatgttcaagccccttatatgaaatggcatcatcttttcataaaacctgcaagaatactagagtgggttaccctttccttctccaggggatcttcccaacccagggattgaacccggatctcccgcactgtaggcagacactttaacctctgagccaccagggaagcccctttcatacacattgtcttatattctttaaattatctctagattacttataatacctaatgcaatgtaaatactatgcaaatatctgcaactattgatacaatgtaaatgctatataaatagttgccagtgtgtggcaaattcaagttagtttttttggaattttctggaagtttcaaaaaaaatattttctatcccgtggttggttgaatctgcagatgaaaaccacatccagctgtctaatccataattttgctggatgagaagttcaaattccaagacatgtattttggattagttcctcataagggtattaatcacatggttatttgtccacattttagtagttttcaatttcctgcatttaagctggagagtcatgccttgtaatttagacccctgagcttagtgattcctttggggatgctcaacactgcaccagcattgaaggaggtttctccacctcttgaatgctgtgcgtgtctactgacccaccaacgtcagaagggtccactgacactctgggtggatgtctgactctacttattaaagagaccttgtattagtcctagaaccttctgaaatgtgctcctttaatccttttccatcctcatgattacggtctgtccacagccaccctggcactgagtgctttcctgtcccttctcttgggctaaggcttcatttttcagaagatttttttccgtctactctgatgaccagctgccctctgccagctggccccagagggctgttatgcgaacacctggctgttttgatctgcacacattttttctagggcttgtaataaagcatttcaaaaaatagtggtcagatgttccttttcattttctcttctcaattgctaagccaattgccccctttttttgtgtcccttgggaaaatcaaacccacaaagaaccatcctcaacctcaaagaagactagactactgatcacactggaggtatccaacgttctggatttttttccccatcttaatttaagtgaacttattctccagcctacaatcttctattaagtgaatatcacattttctcag

SEQ ID NO: 51087 - DNA, 769 bp, Bovine  19866881412967
aatctgctataaatatacatgtatcccctccctcttgagagctccagcccccaacccctcatcccacccatctaggtcaccacagagcaacgagctgagttccctgtgctacacaggtgcttcccactagctaggtattttacacagtcacctccttttcaagagctattttagtaagtgcagattatgctgctgcacaagtaaatcataatttaactttgcatattcccttactgatggatagtcaggtttaaaaaatttttttttgccaagtttttattgttatcgactctgtggcagacaggcttatttgttctcctagtattttacagatttagattttagttttaaatctttaatccacatggaatttgttttgtgcaggaagtgaggtgggaattagagccatttcttgacttgcctcatccaaatgattacccacctgaagagattctgtctccaggcaccccagtaatcacgctgcatctattaggggaatacttgggaaattgtaataaggagaatctctgtggtggaaaatatttgatagtgtgtgttggggagaggaagcagaaacagcaggctctgccaatgtggacgagaggccggagctccgctttcaggttggaatgctgcattttaattagcaatattactcccaaatgtttagctgcaacagtaggggattagagacccctgcttgctcatcataattcagaacctgagcatcagagtgtctaattagatctgcttacttttaaaaggtcag

SEQ ID NO: 51088 - DNA, 629 bp, Bovine  19866881587742
tgcagggatattttatatttattcaaaagctgggagagcctagtctacaaatgatttttaaaaagctcttgcaattaatatgttatagctaatataaggaaaggcagttactacttcctaaggcaatttattttgacattaaggtttagcagggaagatgattaggaattcaggaattatcctatttatagagcaattcagtaggtaattatttgctaaaagtctaccttgattactggccaatatagtagccattaataagaaaccatccacaaatttgcatttctcaagtctgccgaatttaacagtttcaagctacgaagttagttcatcgaattgactttcagttccaagtacctctggtgaaagagtggtatacaacttggataacacttggatttgggaagcaaaatagaaataaaccataatttatgaaatcgtaaattgtttggctctgatttagcttttagtatatttatacttagcccatgatttatcatcagattaatagattatacttcagttgataatagtgttttaacctaatggtttgagggatccagttaggagctacagtggaatattttcagaagtctattaacagtgacaacagttctccttgttgttta

SEQ ID NO: 51089 - DNA, 852 bp, Bovine  19866881628904
cccagttagtgacagaatctgagtgatttgtaggcatttgtgtgctgattgtcttgccctctaggcatgaactgtgttgtatcaggagggcaagagggttccaaatagatttaatatgccttgtatgagcttcaaccatctgcccgccagctctcagtgtgagcataatatatgtttccagaatcaaacacaaagagtctgttttttttccctctttctttttcctttttttcagaggcttttagttcagatcatctgtcttttccttgtcttttgggggtaggctaccagggtcaccctttctacaattatattggctttcagtttgttttctgattcctctggcatatttaattaaatgggtttccctttcctgcttgccatgtacccccaacagaaacatatccttgaaattggtacatatccatgaaatcttgtgatgcatctatgaagtggttggaattgaactgcaggcattcccagtgagtacagattagaccctggacatctgaaaattcttcccaggctaaatccgaatgctgttcttctgaataatgcaacttgaacctcttctcttctttcagtggaaatcgtgtgactgttgatgggcctgttctagtagctataactggttgtaggactcaagttattcccggtgttgagtgtccttgccctggaacccttgtatcattatagggatcttaagctctgaaagagatgaaagtaagttaagccaatcatagagttcttaacttcaattctcacctaagttacaggaatttagcagaagattcaggaagctctttacatgaaagttggggggggaacacgattagaactctcctagcatca

SEQ ID NO: 51090 - DNA, 1332 bp, Bovine  19866881707136
cagacttgaaaaattccttgaggggacaaaaacccgtttagtcataaaagcaaagattaatttacctcattttgcaagatgactgacgctaacttgatctgggtcacttcttgcttatgcctctggaaacaataagtaaaactaaaactgtttccctaaactgatatgagatcatcatgagccaatttctttcatttaaggaaattctaatattgtcatgaaacactgtgaagaataagcaatcactgcctccacattgtataagctactttatattaataacaatatacctcggagcctcattccaagtcttggtttgtgtgctcgtgtcttgcaaactatatttttgtggtgtgtacacaataaacatgctaatgactgcttcagtgattcattggttttacttctgtttttttcccgcctgaactttggacagttccctttaccatacgtagaccaagtctcttcccaaccgtggtttgactgctcagtttctggacaagtactgttctgtcttttaggatgcgccacttgcctgtgttacttttccttttgctatggtatctacaaaattctccttggaaggttctgcagcacttggccctcttagaaaaaacagattgaaaaaaatagttttcttttagaaagagctcatcagcgaatagacaatctattctctctttatataactaatttatagcatattattcacattttcaagtcagttatatgtcccttaataccttgaattgttccttgcctggtgtaaattaaggacagattctttaactgagcaacttgaaccattagaattctcagtatgtctcagtacgtcaaagtttctttgattctaaaagtgattagttttctggggagaaacagcttgacagaaaaaaatagcaatttgccaaagtagtctttttggatagaaatatcctcacatctcttgttctaaatctatatttaccaagtcacattgcggcttagaatatggtattctgaatggagttacactttcaccgcactgtccatacatttagaaacgtttccaggtttgagcactttctggtgaatgatgaaggaaacctgcaaagctgagagcttagaccttggtctgacggccctaccttatctgtctttgctgttcgccttctcacatgcactgatggaggggccacgtcatgcattttgtgctcctcatatcgctggatttgtggattatatgcacatgaaaaatagaaggtgaattccccaataatgccacatcctaatcagttaattggtggctcttaaacatatgttttcccaggctccccacctccatacgtctaa

SEQ ID NO: 51091 - DNA, 1006 bp, Bovine  19866881819890
cgatccctgatccaggaagatcccacaggcctctgagcaactaagccctcaagccacaactactgagcctgtgctctaaagcccaggaactgcaaggtactgagcccacgtgccaccactgctgaagctcacagccccggagcctgtgctctgcaacaagacaagctacacaatgagaagctagcatactgcaactggagagtagctcctattcgccacaactagagaaaagtgtgagcacaaagaagacccatcccaggccaaaataaaaatacataaaagtaaatttttttaaaaaagattccctcgttcaaaattctcaggtaagacagtaaagaaacatggccagtcttgggcagtgaaacggaagtgctcagcccttggagagattcttactggtagaatggaatctttcatcatgaggttttcacagtgtcttcctcttttttttttttttttttccatagtaattctatgtactaatatgtacctacatagatctgtcttctgaaaaaacaatatgttaatttgtaatgcaagctgatgagatactaacttgtaaatttagtgggtggggaggagaggagggggaaggtcaagaaagaaagacattctcataattactagctgttacatataatttaaatggacacacaacaagaatggaggttgcagggctcagtgggctgggttcctgtttaaaagcccggcactgtcattaatcaatgaatggtgatgtggcattatctcaagcactctaagggatggtttgacaggaaatcaatggctacacaatttttactgcacactagaaataaaaataaaagatctagcttgccataagcacctttcataattacagtactgacagatgtagtccttaccctagttccaaattgctgcatcttcatttctccagtttattttgagatccacctgcacaagctctccatgtgaaaggctaataagagatgattaaagtgtcccccagggcttggggaaatcc

SEQ ID NO: 51092 - DNA, 3466 bp, Bovine  19866880511595
gccctgtgcacggagttgagttacaccctgagacagagttgggcccagagcttcaggctctgcatccataattggagcagggcatcaaaaacgaagctacagcctgatgcagaggaacaggccagttggctgatcttttctaaaacatcatctatataataagggagcagctgctcctgaaccatttcccaggctgaagggttgagtaagaatgatttaattctgcaaatatttatcgatgaccactacatcttgggtcctgccctacatgctattgaaaaacacacagtatgattcctacccttggcaagctcaaagtctgccggggggacagatgtgtaaacagggaggtagtgcacaaaaggctgggccttctccctgcataatgagcagaatgtgatgggaacggaagtggaggagagacgaccagcagagatgaggtctgagaagtggttgaaggcatgaatcggattagggagagagatagagagggtcactaagagagagggagaggaaatgagagcaaggtgcgcagcaaggaccagcctggaggagaagagtggggtgggagccacgtcccttagggcgggatgtccacagggtaggggaagtgatgatataaaaaggaacttgggagacaagaacttgtacatttgaaattaagagagtttcctctaggtcaagccccactgttccaaaaagaaagtatgttcccagctgcctatgaccttgccctaaatccttaggataagagcatacaatgcttaacttctggaatcaattaacagatagcagtggctgctttgcttttgtttcaggctaatgatacctggtaacagcattgtttgttttaacatgttctgtggtgttttaaccaggggattgatggtgaaaaccacggaaaccgagagacaggaccagccctggacgtgcttttctaggcccctggggggaagggtctcttgaccccttcccttgcttgactccttcagcctggctccagtctgtccctcagtttagtaagctttatccaggggtctgctttcatttcccactgtccaaaagggcaaatactcggcagatttctgtcgacacctgattcatcctgtacttatagaacagaaagagctgtcaccaggggctgtgggaatgtagacacagtggagacccagagacacagggcatggggtgaggcaggcctgcatcaagacagtgggcctcctttctctgcaaaatgctgtgtaattgccactgccctctatcagctgaagggaactcctttcagaagctgctgggactgagaatggcctagagctcccagaatctaaactgctcatgtgataagtaggaaaactgaggcctgaagaagtacaaagtcgattatgtttatctaatctagacatctggggaaaaaagtgtggtgaagtcacgggagggactagatgagccaaaggggcttggagaggaattctgcctcttacagcagatttttattaacatggttgtgagagactaatggatatattaggaaagtgaggaattgggatgccagaggccagagtgctagcatcctcagattgtatattttaatctgtgtagtcaagagacacagaaggaagccatcagggctttgaaagtggtatttcactcaggcaggattccgtccactactcaccggcctctctctagttacttccaacgcacccaccgcagtgccatccaaatggtattctgtaggaagccttctggaatgctcctacctaggtcagcttgctttattattggtgttacatagccaagtccctcttcttcagagaatgtatctgaattataatttccccctaattatttgagtcatgtttgtatcctcccttaaactgtaggctccatgagagcttgaaccgtgccttcttttgctcactgttgagctcccaatacaagagtttctggcaactgatttgttgaattaatgaataaaatcatgaataacagtgcttgagaatgagtggttggtaagagacttaatttgaaactaaaagtttgaagtaactactgagaataacaagagaagaagcatgtcaaaagcaaacaaaacaagttataatcaaatgcaaggcactgagtaaaatggagaacatgttatggtgagtctatagttgtgagattgtgctagtcattcaatagacacttactgagagttgataacgtgttcagcttcatgtgcattactgggggaattggatggctatgcctctcatggaatttccagtctaatcatgatctgtagccctggggtaagctgagaggagagagagagaaaaaaaagaagaggagagagaaaaagaaagagatagagagaacgtctaattgggagaacatggagagaaaaacaacccttgggttctctgtgaatttaaacaatagttgtaataaggtgtgggagaaggagagtaagaaggatacaaacgtgagcctgcatttaaggtttcagccgtgaggcatttctcgttgtttgtcagggttggcccttggtacagatgtctggagttggatacagctgagcggcaagacgattgtgagttccatgagttggatcaccccctccaaacagtccctggggtcacccaggatacaaaagccaaaacgtctcaaacaactttaagtccaatactcagtgacaagacatcctgatacacatcaaaatataagtgagtggagacaaaccatcagttgtaacaagattctcacggtcttaaatgtcataggagacagtggagggaggccaaaggggtatttggctacactgataagttgtgttgtttagtctctaagtcgtgtctgactctttgtgaccccatggactgtaaccctccagcctcgtctgtccatgggatttcccaggcaaaatactggagtgggttgccatttccttctccaggggatcttcccgacccagaaatcaagcccacatctcctgcatcagcaggtggattctttaccactgacccaccagggaaggccacgtttataagtagagaatctctaaagtatcaacagttacaactgatcatctaataggttattatgaagccaccaggcatcactgaaagggtcttttgcaggctttaacctgaggatgagtatgctgctgctgctgctaagtcgcttcagtcgtgtccgactctgtgcgaccccatagacggcagcccactaggctcccccgtccctgggattctccaggcaagagtactggagtgggttgccattgtataggggccatgatagtgtcagatggtttgtggagggttctgggccctgttgattctcaagacaaccccaaaagactcatttctgggatgaaacttttctgaaagaaagtgaaatttgcttagtcgtgtctgactctttgtgaccccatggactgtagcctactaggcttctccgaccatgggattttccaggaaag

SEQ ID NO: 51093 - DNA, 1703 bp, Bovine  19866880601012
actgtgagaaaagaaatttctggtgtgttaagctgcctgatttgtgataatttgtgatgatagccccaggacactaatacacctactcaggagtgagaagggacatccccctgttgaaacagctgaggtgacatttgcagagacctctcatttcctattcgtttgatgaccagacgtgagaaactgtctctgcgtcttggcatgtgaaatgcaaatgaagcaaatcctaggtctgaggtcgcttctcagcacgtttggttctggctgggataaggttctcaggtgtctggcatgcggtagactctacgtattcatatttgcgaatggatggattgacttatgagtgatggctgtgggaggtagaagagatcgttctacttctttgtggaagtcaggcttcttcatattttcctttgattcagtcatctgtaaaggatggtctggtttgctgaagtggtagagaatgggcttgaaatcaaacttggagtcactttctgtgtgactttgagccaataacttagcctcagtgagcctttctttccttatctgtgagtaaagatgacaatgcttgcctcagagggttgctgagaggattggtcatatgagtgcctagcctaccatagggcttccctggtggagctggtggtaaagaatccacctgccaatgccagagacgaaagggacgtaggtttgatccctgggctggaaagatcccctggagtaagaagcggcaaccgctccagaattcttgcctggaaaattccatggatggaggaacctgatgggccacaaggagtgggacatgtctgagcgtgcatgctaaagcctatcctgcatgtagtcacagggctatgctgttgatccacctgcccttctcaagtgggaggtgcctgaaggtcatacttgcaatggccctttgaatttggaaggtgcgtgtacacattttatggtgtctctgtgttatatgtattcttaggtgtgagatgtgtacgaagtagcgtgtgtccatcgaatggctattcttaaataaacctggaaatctgtgaccacccgaaattgttgcttctcagctctagaaaaatccaagttttccaagaagccctcctctgagagtggagcatctaagaattgagtcacttggtcacacattttaaatctctgttaacgttttcctcatttatcccaggactgtcaacacagctgttacgcagcgtaggtgtagacagctttctaaacggaatggtaagtccattggttttgctttaatagacacagtagtagatgttttccacttttggctactgtactcaataaatcatcttctctggaggaaatacaaaggaataaaaaagaagaaagaaaagagaaaaggcatcaatcttgactgatgatgatccccagagcttgtctcctagggaggagtttaggaagagtgtgtgaatgcgagcaccatcactggacacgattaacctgtcctggatcggaatgtcagcactgctaacacggtgctgtgcagtggggaacacactcccaggataagagggaggcgagggagcaggggaaaacctgaccactgaagacagggcctccaggtacctttgaagcagatgctggcaaacaattactctgcacgacctggtccccagccaatttcttaagcttcaccagatcctataaccagagcaaagtggcttcaatcccca

SEQ ID NO: 51094 - DNA, 1076 bp, Bovine  19866880658375
taactgctctgacactgactcaaggaattcagtacctagtggaggaatcctactgtaccttggcttttctgaaactgcccagagctaaagactctagataattaaaagtccccaagaatgagaaaaaaaaaaaaaaaagaaagtgacaatgtatgcccagagaaaggctcaggaaaaacctgaggagatttaagcttatgcttcaactgattctcagcacagagattctacaacaaccaaaaaacaacaacagcaaaaaataagagaaaactgaaaaacttggggaaggttaagaatcttatttccagatttaacatattattagactcagatatctagtgattaaccacaaattacaacacacacaaagttacagaaaagaattgcccatttaaagaaaaaataaatcaacaataaatcaactttgtccctgaaaaagacctaatggcagctatactagacaaagactataaaacatctggcttaaaaatactcaaagaaatataggaaagatgtggagaaagtcaagaaaacaatgcataaacaaaacggaaatatgaaaaaagagaaaacctaaagataaaagaaattctggaactgaaaattacaataactgaaatgaaaaattcactagagggattcaagtacagatttaagcaggcaaagagagtcgtgaacttgaagatagggcaatggaaaatttcaaatttgaagaacaagagagaaaaagggttgaagaaaagcaaacagagcctaaaggacttgtaggaaattagtaagagggttcagtatatacatcatgagaggccctgaaggccaagagttggagaaggggcagagaggatatctgaagtaataatgactgaaagctttccaaatgtggtgtcaagacatgaatatacacattcaagaatctcaatgaattccaagtaagataaactcaaagagatccagactgagacacattataattaagttttcaaaaggcagaggcaaagagagagtctttaaaaatagcaggagaaaaacaaagaattccctgccagtccagtggttgggactctgcactttcactg

SEQ ID NO: 51095 - DNA, 1556 bp, Bovine  19866880692120
tgagagtatgcaacatatataaaagatgcccccaaatccacaggcaattagaaaattctggagccactggagcgaaaacttgacatcaaccacaggcccagttggtcaagtaaagagtgtcaggaggtgcagcccagagcccatttactcatttttcttttccctgaagcttttaccaaacacctcatttattacaaactgaactcttcaggccagaaatcacagaacagtcaccatgtcctccttcaagggggttatgacccaacagctgccaaactcagttcgtaagaaagccctgaggcagtggggggcgggaagggacaagtacaagcagttctggggagtcctgagctgttagcatttgtgtgattcctgaggaactggacgtggaacaacagactggctccaaatgggaaaaggagtacgtcaaggctgtatactgtcaccctgcttatttaacttctatgctaagtacatcatgagaaacgctgggctggaagaagcacaagctggaatcaagattgccaggagaaatatcaataacctcagatatgcagatgccactacccttatggcagaaagtgaagaggaactcgttcgaagaaaagttatgacctacctagatagtatattcaaaagcagagacattactttgccaacaaaggtccatctagtcaaggctatggtttttccagtggtcatgtatggatgtgagagttggactgtgaagaaagctgagcaccaaagaattgatacttttgaactgtggtgttggataagactcttgagagtcccttggactgcaaggagatccaaccagtccatcctaaaggagatcagtcctgggtgttcattggaaggactgatgctaaagctgaaactccaatactttggccacctcatgcgaagagctgactcattggaaaagacgctgatgctaggaggtgttgggggcaggagaaggggacgacagaggatgagatggctggatggcatcaccaactcaatggacatgctgctgctgctgctgctgctaagtcacttcagtcatgtccgactctgtgcgaccccatagatgacagcccaccaggctcccccgtccctgggattctccaggcaagaacactggagtgggttgccatttccttctccaatgcatgaaagtgaaaagtggaagtaaagtcgctcagtcatgtccgactcttagcgaccccatggactgcagcccaccaggctcctccatccatgggactttccaggcaagagtactggagtggggtgccattgccttgtccgaccaaagatctagctttggtaaattaggcagagctgtatttgacagcagacaggtaaactgtgatatcaaggagcaccattttaatctagggcccagctaggttctaaaataatggggcccaggactatggagaaatggccaccaagttcaacaccgtgcacgtggcactggtttctgtgtagactgtttcaaactcagttctttatgacatggaccagattagtcaagtgcccaaggcacagttaatctttaagctagg

SEQ ID NO: 51096 - DNA, 2864 bp, Bovine  19866880916229
ggagtgtttatgtgaagggacccaggcaaaggtgaagactggaggccaaattgcaaccaggtacacggagacgtacttgtgaggcctcgggcaggagaccacggagacgtacttgtgaggcctcgggcaggagaccacggaagacgtacttgtgaggcctcgggcaggagacgggctatagtctggggcagaggcacgcgtcttaggaacactgcctccaggtggggccaagcaaaagccattcaaggctagtcaagtaagatcacccatcagaaggaggctagagaaagaaagtcaggcctcagatgcaggctgagaagaaagggagttcagagtgaaggatgagaagcaggacctgaacagtgctagaggccagaaggacacagcagcttttctcgaatgtttagccatgggcgcagccagaggagtgtgacccgcagctggcaagcaggcatcaacatacatcacagtagtagcaccaacagcctgccctggggagagtgtcaccatttacaacaggctttgcgcagctcactcattagtggtattaattacccagcagcagtgtgctatgctgcttgaggcaccggcttgttctgaacttagctggtgagttctggctttgctagttacaaaaaaagatggtcttaagctagctactgatttctcagattttgtttttctgccaagacattaaatgtaatgttagcctatgttgtaatatcattgtgaggattacataagatcatggcttatcagattgccaggtgcagaacaaataataattacttacagttattactacaattaccactacactattattattattccttgactcaataatccctgaaatgtcttcaactgcatctacagtgcaaggtgagctttcccagatcaggccattaatcctgtgaatccctccagataaatcagggagctgaaaagccaggctttgatgccggacacattgcagagaacattccaaactctgcagtgcaggatctggggctggcaagatctatctgtttctggtggaagctgttctttccctcagcctttttatgggcttgggtacaagtcaagtccttcatccttgtttcctcctgtagccccttcctcactctttggaagtgagatgccataaagagacatccccccaggctcactgaattacaaaaagaaaggcatttcacaaattggagaacatcctttgattttttccaggaccacattttttccctagttggctttgtctcctggttgaaggattaaaaaaaaaccacacaaaaggctccacgtatcttttgaaaggtgaaataaagccagctgagcctaatcaatgcacaaaggtgccataaatacctgccaggtcataaaagcacgatctctctgatatggcaaaggagaagtgagagttacagtgggaatatggcccccgattggaggataaacacttcccaaacttgctttgtgttcttgcctgtcagagcctagtggctgggctgaggattagaaagagagccttgcattagaggcttagaaagagccttgctcctagagagcccacgccttggtcaggtgctgtctgaggactggagctgccattgcatacgatggaggggaatgacagcctatcaaaccaggcagccaagtgtaggcgtgttgagggtgatgccatggaaggttatttccttttctgcttggacaataaaggtcttagttacctgtctggtctcatcttcattaatttaagccaactgtggtgactcactgggtcctgcttgtcttcattatagttcaagaacattctttggcctccaagcaaacacacttctgtttagtgtgctgggcatcactttagtctgctgggcatcaacagatatgttgagaattaaagtcaggctgcaacccccaaacgtggaaataataacttgaaaaacagtggaaagtttggtcttgatgtgaatgtgctgaggtgtggaccttcctggacggcgggtggtgtgatgggcgtgcagttggcatcccttgcaatctctgaatagctagcatcttgggagaggaactagatgctgatggtaatcatgtaagtacttagaattctcatttttattttcaagaggtaattttcacactcaaacaaagtgacttgccccaaatcaaacagcttataaacgctgacgtttgaatcttatttcaagccctttcccaacctccttaacgaatatagaaagtaacaatctcttgctgtaagcctgacggcgtgggtcccagcatggcccactgatttgccctgtgagttggggcttcctctctcttcctaaacctttcatcagaaacagcatgccaagtgctgctcacttgttcatagcatgtccatggccaggaacacggtgagtggttagagtcagctctagtggggttaaatcttagctcatcacttattagctgtgtatttttgagcaagtttttcaaactctctaagatgtcatatcttcagctgtaaaatgatctctgagaagaccaatcttaagaatctgtggtaaagattataagcaatgattacacagcagaggggacacacagagccggtacaccactagagaaaggacttgtttcacagcttgaagccaggagcaagactaatcttctgatttcctttctccactgtgagttggaagattgcagaactcagccattaagtctaggagccatttggaagagaagcccatggatgcgtgtggagtcctgggtctctgtcagctcacagaaggggattctaagcgaacctgcagactgtgaacattgacacatgctaagagatgtcctccgtggtgagcacactctttaggattatggga

SEQ ID NO: 51097 - DNA, 1816 bp, Bovine  19866880935075
cttctaagaaacccagtgtctaacacttactagatctgtagcatgggatgtttttccaaagcctaacttaaaggacaaataatatgttaagtgtgtgtgcccatttaaggagaaagaaggctctcacatggcaaaatcaatgaaattcacgtccatctgtagaatatattctcattctcagcctgcctctggaatgggttgcagagtttcatatattaacctgaagttattactcatatgctaacaaatggagttaatgaaaactatttcatataggaaagaaatgtagatggtatacaaattatctgagacattgtctgaaaactggcaaatcctgttgcacattaatgggatgacgttgctactcaaggattcgaccaacggaatagtacaagaagtatccagtaagtggaatcatcctgctaatgggttcaatgaaacagaacccactaaagtaaagaaaatctacctgaaactagatattactgatctcaatcaagtacaatcatccagttgttttccaaagatatgcattcaaaatctgcagaatttttgaaaacttgctttaaaaactcacttgtccagaatcttctgtcagagaacgtaaaagggaaaaatcatacaaagtcacccacaaaaagccttaggaaattacccagtaattttaattcaaactccactttactgttttaaaagaatggccttgacaatcatcttcattgttaatattttatgttaaaatatatgtatattttctttcaagactcaaagaaatctaaactgaatcttaacagcatgtgattatacccaggcattttcatgacttgcctctcaaaacaccagagggaagaaggtaatttctccgccttcttggaatggtgccaagaagcttcaaggaaagccaagcagagtgcagtgccccaggagcagctttatctgatgcaagaaatcacatgtgtttgatcagacttgggctcctttatgtttccacacttacaagtcaaacgtaagtttattctctgtggctccttcttggctaaaaatgttgggttgtgagtgcttccctccaacactttatggatcttacaagtcagtctggactgttcacaaaataaaggtttttttccctaacgattttctgaagcaggaatgctataaaaaatgagactgcccaagataacaggataatgccctatttccttattgactcccaaaggccccctttattgggacaactccctgggggaagaagtcttccagaaaattctgtggcccctgcttccctgagcccaatcttccaatagaggtacatgcttattcgctcagtttcttcacccactgagtcatcagggaagccccctacagaggcagatattgttctactctcgttctctgggggcacaaatacgaccatcagggcaattaggaggcagactcagattctacgactttactcactctgtccccttggatggggtaatgagcctccttatgtgtgttttcttacctgaatttgacagtcaggaaaaaaaaaatcaatcctataccaaatgttgattaaacaccttcacattacaggcagagttagcatctaaggaaacagataagatctccctctcaaggatctcctgataaagacatgaaatgcacagcatgccagagagtagtgtgtgcaggccagggactggccttctggacagtgggcaagggaaggctgcagagaggagcagctgtgtgtacaacctgaaggaggcgaaggagcgagtcctgcagatacgtgggagaagagcctgccaggctgcgggaacagcaaggg

SEQ ID NO: 51098 - DNA, 685 bp, Bovine  19866881034013
tgccctgccccaggcatacccttcctcccccgcacctctgcccttttatctcattcaggtttagctttcctcgggtgggtctagtggaaagtccgttttggttgttgtgcttacttgtttaaagctttgtccaggtattcctgaatccacttcaatttcgggtcaatgcacacttgcctattgttgttcttcagccttgccctgtcaaaacagaagaggcgacagtatgcagctgagcagaagggggcacggctgtgacccgggccactgctcacctgatacccaggtgtggaccccactggagcctcccagccggctcaggcacagaaggaactctaggtgtgctagggagacaatgctagccacgctgcaggtttcaccccagagacactgggaagagaaggaaggtctttaaggagtccagagagaactcacacatggaacacttgagctggcttttgaaggataagtaggagtgggcaagtaaagggggagagaaaagtaagcgcaaatactccaggggggtgacagtgcagagagaatgtggagggattggagagacgggaccctgaagaagcctgcggccaggtgtaaggagcaaagaagaggggctttatctgcaattttgtttgtgatgggaactcgtggggactttgaaccagagggtggcagaagcagatttgta

SEQ ID NO: 51099 - DNA, 1647 bp, Bovine  19866881061493
cttggatagtctgtgtattaagaaaggaggctggtggagtgctttaggacaacacaatctcatctatatttcactagtggaataaatacctggcagccttttttgtagctttaatgtttccaggagtgaaatggagagaaggcacccattttgatgtgttcctttattagccttggacagaataattgttccctccttttttttccccctacaagcagccccagtgagaatctcatctaacttgggtggtggaaaaacatttacaaatgttttccttttgcccctgaggagatactctgggctatttccatattccttcacaggagtttggctggaggaggagagggaaggcttttcacacgtagcgttgacttgtgtgttaaattgtctgcaggaatggagagtgcttgggtcacctgtaaagcacttcaagaactccaagccaagcagcccagtagttctgctgttcctaaatattctctttccaaaaaccttgcactgaagtttgccaatgcatagaatttattatgtattctggagctcactaaagttgcaaattgctttctggataatttcatttcatactacttagaggcacactgatgtctaatttgaagttcatctcttttgaaagtgtcttttgccctgtacattttcattgctctcggtagtccctgaaggacattggagggaaagtgacttgtggtgccaggcatgtgtgttctccgcatgggagcgattgttggagtcaaggcagatacagcaaagtgcagtgcaactatattccgtattttgctgaatcaccacctcatggtttgggatatttatgtttcgtgttcatattttatgaggcagtggcagaacaagaggtgaccaggagaaagaacacattttcctcacagagacagctagaaagcagtcatgtacagcgattgcctgatgtatgcaactctttagactgttcctgttaaagaaagattatcatgacacttgctaaagatagcaagaaagactttatttaaggggtgttacaatggtagagttttgtgttaggggaaagagatcagactcaactgtgaatacagtacggaaaagtggggatttatagctaaggatcaaggtggaggcagtgtccatggatggagtcgaaggaggaaacggacagaacaggctccatcttgaaagcacgacgccatgttgggccagactgtggactttgagctatgtgccgagtatctatggaaacgacgtaccaactggaaagccaggccccctgaaggaagagccccaaggcttgtacctagactttcctttgcctaaaagaaacccctaattatgtgtgtaactgaatagaatcatacattctattatgcttattggggtatgaccacaggcatatgaatcacgggttaactttgattgtatctttcttttcctttgttcagactagtttcagggaatttggggaggtgggtttgggcatgtacacttagggtatataatgttttcacaaaacttggccggggtccttggttaagaggagactctgcctcgggcccgctggtgtagtaaactgattaagcaagattcttgctaaagttggaataaactggccaagaacagagcccaaggtaaaacaggcaggca

SEQ ID NO: 51100 - DNA, 726 bp, Bovine  19866881157681
actttaatgcctctgactcattcctcaaagacatgcgttttttattgttttggttttttttttcattattgaaaaattgcaggccacgcaaagctagagacttcttggtccagggaatgtgtcagcttgctttcatttagcacaaaaggaaggcttttaagagagatttagagaagccagaggccttcttgggaatggtcccaaagatgatgaagaggctggaaagatggagctcagataaaaaaaaaaacaggagagtttttggtgacttcactggggacaatgggaaaagttactttccctccagaaaactgagaattaaaacacaaattgtgttcctctgcccagagatttcattaaggctgcctggtttgtttggggatacagggacctggggcatgcaggcaggatgtaaagctgaatcttgcaggtctttatttttaaacttttatttgtttatttattttttggccatgccatgccacatgcaggaacttagttgcctggccagggattgaacccgtgtcttctgcagtctgagctcagaatcttaactaccagatggtcagggaagtccctttcaggttgttaaagctaagaacaatatgcatcctttgacctggtttaagtattaactacttcacagacaatatgggttgctggtgcctgacttctggggatgggagtctgaggattatagagacataagaatgagaggcaaaagct

SEQ ID NO: 51101 - DNA, 734 bp, Bovine  19866881181313
tttcttcttcaaagctttctatgaaagaaaagtaaataaattctgtggaaatatttattaccccaataagttctttagattataggcagtttgtttgtgtgtgaagatttgaagactacctgagaacttcatcatctagacatttaacagatgattagaataattttaaacagttttttgattcagcacttcatgattgatttgaaaaaatacttgtattaatatctatagatgtatgacagaggctgattcatgcaataaaggagattttggatgaattaatttgaagacaaccttgttcactcataactgctgagctagtgccctgctaggaaacatatatttattgtataatatgaatctgtgttttctgtctttggattctatgcatatgtgatcatatttgacattgaagtgggtagagcaactgtcctgagagcaagagaggctgaagggattttatgtcggatcgcttgaatcgtgtggagagaggtgactatcagtctgcatgtcttggcttcctcatctatctcatggagagacaacatacacaacagtgccgtctgcttctgagaaatatggagggcattaaatcactcatgagagcgaggtgtgtggagccttaatgaaaatcaagtgtataataggaaaataaggcgcagcacattttattccgctctcccgtgtggccgtatggatggattcttcccaggagagagcatatcgtagagcat

SEQ ID NO: 51102 - DNA, 1038 bp, Bovine  19866881449990
ttagatttcaggagacaaataaaccattttttccttgaattaccctggcatatttggtatttacaattgcaaaggtctgagccttgctatttgtgcaatttggcctggaaatagagacctcaagcactttctagggtcagctgtgtgtaagcgtcgtggctctgcatacctcatttcttcctggtcttcataaatttcactgctgtcagctcagttttattcatgggagctaacacagccagcggccaggaagagcggagtgagccaaagtgtccatttgaatctatttagcatctaatactgagaagtaaagaaactgagggaaggggggaaggaagatgagatgctctggtggaaacctgctaaacactgagagtgtttggcaggagaacctcaaataaatcatcagtggtctgcacctcacaaggagatactttggtccctggaaacttggtgggggggtgagatatagggtagaaaagcaagtcagttctcagggaatgtggtgaaagcacaggcatccccagagtccttacacaaaccaccattccatgcagcactcaagtcagcaatccacaaatctctcatctgcagactggctgcagcactgcagagttagcgggggtcatataggacgccattgctggatccaggcagatgctccacagccctacggctggccatgctgcctccaggaccagccagctctaccaccattctccctcatgcagtgcacaccactgaatccagagacacatcagctacgtgagtaggttagacgattgccgattttcctgaagcacaggtaaccatacttccttgcaattaatattagttattagtataataacactactgctatattaattattatactaataacactactgctatattatactaataacactactactatattaatgaattctatattctcctcttcatataaccaaatataaattactttattaaatactcattaaaaacccttattttctagaacctgtccttgaggttctaaactgattgggaagg

SEQ ID NO: 51103 - DNA, 1135 bp, Bovine  19866881457302
cctaattttgcttcttacttgtttaaaaaaagtcttttcttggcgagcccttgttttctgtacctggtggctttttcaggtagctgtcttctctggcacctagtctagaatacatgaattcaaaagaaaatccaaggaactcaccaccacatcctggcttgggttctgaggtccctggtcagtctgccttttcctctctacttttcagcaggaggaataagaaatatatttcctccatcattgtggaggttgtggtcctccataattttgcttttgatgtcagtttttgttttctagatggtttgatgcacaattttaatcttatgctatctggatatctttacatttggataaggaaattcagcccatatacactgacttcaaatgtagatactgagcaattaatttcttccattttgtttaccacctttgtaataaaaatcacttggtctagattttttccttccttagtttgttgatctagtcaggtacaatttcatttcccttcccagtgctctggtttgtccaatgtggatattctattctgcattaccattgcattcaagtggcttctcattttaaggttcccgcagctaataagtgcagagttctttctattgttcctctgagtattttgaggtcctggggcagatttcatctaggaacacagaagctgtgttttctcaatcggctccttggagcaggccccatcattatgcctctctgaaaggacattggaaaactaggttgtggaggccagacgccgaggaggtggccatgttgactctagggatatctgaatatagctctctcctctgggtaggatgataatccctatcatttaagggaatggcagcactaaaacctcacaccatcatcatttgcttttgcttcatattaagtgaatagcccaacaggagcctgcagagtccacttgggacagggaacagaatttcaaagaaggtcctcctgcttcaagctgcttctttttaaaaggtgacatgagggcatgacctagaatctcagagaatctcaaatgtctgtctttgggggcctggccttctttatccatcataatggtttggggaatggagatggagtgtctaggccagagccaccgggcggatagaattgg

SEQ ID NO: 51104 - DNA, 1624 bp, Bovine  19866880371266
gtcaggaagatcccctggagaagggaatggctacctactccagtattcttgcctggagaatcccatggacagaggagcctggcagactatggtccatagggttgcaaaacattggacaaaactgaagtaacttagcgcacacacgtaaagttgcatgtacaccttatgcttatatttttgttagatgatgctgctccagagcaaggcacagtgaaaagtctagatctaatcaagctagaaatgctgaaatttaccagagtcttccaaactccagaagttgaattccctcacaatagtttcataagaaaatatatcttagggcactagagtagaagtgagcaaactgcaaccaaggggccaaatccagccttccactggcttttgtaaataaagttttattggaatcacgattattcattcacgtattgtctaaggttgttttcatgctacagtggtagagttgagtagttgcaacagagaccatctggcctgcatggcttgaaatatttaccatttaaccctttattttaaaaaaagttggccaaatcctggtctaaggcaaaaaaggtaggtattgcggctctggaaggcagagaggccagtgattgggcgccaactccactgctcattagttggagtctctgggcacattactgcagacccctgagctttggtgttgtcatctgtaagatggaatagttgtaatagttatttcatgggttgctatgagaaagaattaagggagaggatgcagctgaagaggctggtagctaaacaataactattataactgatatgtctctatgtctttattatttgtttgttttgatgagttagcagccctgctctgtgcctccatggatccctgcagggttctctctctgtaagatatttgtctgctcccctgagtgtctccttaccccagactatgtattctctaggggcagatgagtctgaattttcttgctttttgtagtcagagaaccagagtagggaagtgctggctggctccctctgctcaatgcccctcgctcctcttgttctacagacagttgagaggacccttctttgagggaactgggtgggaaggtggtcttcccacaccgacttctcctcagtggtctgggggcaacggaaccctgagggctgggtccctgcagtgtttagtcagacctgtcgggtcgagcagtctccaccccagttccttgtagggtgcctctgagtcattgagggacccagagcaggcatccagatgggatggaagcctatttttatccactattgatctctcttgctcagaaaccatcattatcctggtgtaaaatggcagctcccaatgcaggaggctcacggtgtctctggccaatggatacccagcaaattgctccaagccacaccagctggagaaaccaaaataacttcatgagacagccgtccggcctggccccactgggctgtcagaaaagggctaactttgaccctttctaacattatccacagcttttcttgtcttgtctttgggaaaacaaagatgaagctagtctctaattgacctggtgtctgcagttcttggccgtgcctggcggctaacagaggtagaggcctgcgccagcatcaagcccag

SEQ ID NO: 51105 - DNA, 1716 bp, Bovine  19866880532933
tctaagttgattcctctggaaaccagccccagcctctctttaccttagggctttcctaaagtaatatcattaacattacaaaagacatcttttattgctctcctctcttagagaattttgatggttttaaggattctgccagaaactggaagatcacgtatgtatttctttttataaatcagtatcacagcattgtgtaatttaatttgatctttataacatcctttgaaataaatagtacagtctccatttcatagatatataaaatgagattcagcaagtttaagtcatttgcttgatatcacctaacttgtaagtagtagaaaatagaacaagatttgcctgattccaaaccctaacagagtgattgctctattctactctgaagcatttataattgcgtgtgacacctccaacgatagactcttacagtggaagaatgaaatatttatgctgagaggttgggattatttgatttattcagtaaaatttaaaataattcaatattagaagtcctttatattctggtcttttctatctatcaacctgtctgacaactgttttctccaaaatctcccaggtcaccccaggtggaggggaactcatgaccttttgtgcaagccatatgaattttctttcttttgcttttacttcatggcaccaccctgcccttctaatccctcagagtacacttacctgtcttttccacttatttgatgcttgatctgctcagatatcttcacaccatgaattcttcttgcttctattgacttgcaatgaaatctacattctgtataatcctggtggaagaatcattttggtgcttttttacacagcacctgataacgatatttaaatgtctatatgcgtcttttctttctccttactgaaatgtttaagcaccaagttgtcatatcttctgtttctccatcataacaaatagtacatttaaaaataaatggctatttaactgagttgaagataccaataataaataatgctgtaaaatacatgattaaattttttaaaaactgtgcttggtaaattgatgtattcctgtaatctcctggaggcatacatttaaagagatggaagaggctatggaagtacaatggaacaggaatgcttaacacaagagtcaactaagtataaaaaagaatctcaggaccaggattcattttctgctttttgtatattaaatgaaaaagttcagtagtaaaataagtaattgagttatatcactgctttagagatccaaacaccaagatacaaagcatgaattcattgttcactcataaaactgttatttagcagtcgtcccagccagaactgaatcaattaatattaagatctccttgtgcatatggcactgtgctaggcatttataagggggctggaagtgcttgtttgtatttaatttctgttcttaggaagcttacagttaagataaatgcattgaaagaggcatacatttccatgtattaatgagaggtctaaatgataggatacagaatgtgggggaagagaagtacaaagcacttgaaagtgttttcttagtattctgtattttgatgccactttgaattgatttgtagaaaggagagaagatgagtgggactggaaaagctgaaaagaggagaatagaatgtaaatgtccttggtaggagggctcagatctgaacttcttttgtattcttttgcatcaccagcacatac

SEQ ID NO: 51106 - DNA, 601 bp, Bovine  19866880652922
ggatggggtataatcctctaaattattttcgataatatcaggagactcataaaagtcaataaatgtgattaatttttctttttttttttttactaaatgggatttccaaaattctcatgtattctactcaagcacaaagatttatagggcttcaaaaagatttccacagaattgggcagatgctcgcatttatttatgtgcatctttaaataaatatactttattgtactctatctgttttgtactttaaactctttctggaaatgacatctcaaagactttaggagccttacatgcaagcatacacaataatacttcagatttctctcacggtgaaataaaagcatagttgcctaggcagtacagcttaaaatgtgtcttttattaagattaaaacgttttgtagaataacaccataatgtatttaggagcatttttcttgtttacttgtgttgttctgtctttctcgatgtctttggttataaaaatgtcctattatgttttaaatattacaggcatcagaggggaaaacaacaatgatttgtgcttattgctaaacaaagtccagtaaaggttaatgaacttctgctactacatgaat

SEQ ID NO: 51107 - DNA, 2382 bp, Bovine  19866880792181
ttacgttccttcttgtgtcattctcaacttattttcccctacaccagataattccttcctcctattactgaacaatcactgtttgtctctgtcttctctctcttacactcacagacatacaaacacacacacacacacatacacacacacacttagtttctcaaatacacacgtacatgaacacacaggtttattgagagtttgactttttatcctatcaacaaattaagtgctgttttcttacagggttcaccacacaggagagcaaaaagcagttattatttatacctttagacacgtaatactcaggggaactccagcatagtaaaaaaaaatggtgtcatagttggaatattgaatggtatttatggtaactcacctgtctagactacaaagtatgaaaccttggcatctgaaggtactattaatatcatcaaacccaaacttctcatttaaagatagtaaagctgaagcccacaaaggtcacagaacacaactagggtgatgatatttcattacatattgtggagagattcgaattctgccatattcctttagcaaaggattaactgcatgcccttgagccatctcttatggatggctcagtccaagaaagactatctttttggattttcagtgctattagagttattctttggattgggttaatacatcttccaaatggtggttcctggagcaagaaatccccaaatcactataatgacatcaccataagtaacacactaagttctgctcagctaaatttggatctggatttgtggaaattttcaagaataataattagttgggatattattagcacatctcagagaggttgtgtatgaaacaaatcattgggagtacactgttgtaaagcttgtacagcctttacagttaccagaacaggctggacctttctttacatttaaaaaatttttcaatcatgatactagaagagtatgtaaccttttccacttcctcactttgggtaagagaaaggatatgcaaacgtttcaagaatagaataatgttgtaaagaaacattttaaattagattggaaaatataaactccaggcctgttcatttggataattgttttaaattaatacatatcttaccaatataaaaataaaaataatatagagcctaagaaaagctggacaggtatggtcagggtctcaagtttgagagaaaaaacagtgcctcaaagcagacagcggagaaggcaatggcaccccactccagtactcttgcctggaaactcccatggacagaggagcctggtaggctgcagtccatggggtcactaagagtcagacatgactgagcgacttcactttctcttttcactttcatgcattggagaaggaaatggcaacccactccagcattctcgcctggagaatcccagggacggcggagcctggtagggctgcggtctatggggtcgcatagagtcggtcacgactgaagagacttagcagacagatggttcagaaccctggacagttgcccagctgctgctcctgctgctgctgctgctgctgctgctgtagctgtaccttttctctcagaccccgcccccacccctcacccttaccaacgtggttcccttggctgaacgaatacttagcagtctgcagcacattaggactgctataaacgtcaccttagtggtcccaagagagacaagacatactgtcaaatgtgtgttatctttacaaacattccaaaaaccaagatttggacatttgtatactatcttgtttctatttccataatattttatatgacagcctaaagagagagagattggctatattttcagagtacataacagcaacaccagaaaaatatagttgttaaaaaaactgaaaattctcctctccacagaaaaacagtattcttaattgaaataatcagtttctcatcttcatacttttactctgcaaagtctttgcaagaagcatttcgtaatagccagcattgaactcttaattgaaaggcgaaaaatattcaaatatatttgtttaaattgcatattatagactattttaggaaaacctacatcatctttttgggaatatatgagaaaccacttcaatttgccaactggttttggtggtagcggtacagattacattcatgacagagcttgaactttgaaagaaataaaagatttcagtaatctcaggtaacatttataaatcttttgcaaaattcagcaactaaacacatgtcaggagctatattttctttttctattttaaaatcgggatgccttgtatacttaactaacaaatacagtatatgaatgaccttctgaacatacagcttcaatcataatagagttgccatttcagtcaatatgtcccttatct

SEQ ID NO: 51108 - DNA, 1180 bp, Bovine  19866880815316
ttagctaaaatttccaaaatcatgtcaaataattgattgtctttaattgtctttcctttttattttcatccaggataaattttctggtttgtaacattttctggtctttaaaaattgctaatggaaaaggagtacaaaatatttatgtaattaggacagttcaacactttaaaaaaaaggcaaaaataaacagcagttatgggacacctgcttaacagatactggaaataactgctttgtgcttcattaaccagtaaaaacacatttactgaattcagaatttctaattatcactagaatcgtattaacttggcaaggaaagaaattcctgggtaaagaatttcagaatttctataaagcctgcaaacaaatatttattaaaactaaatgtgatttaatttaataaacaattttagactaattgttttgcatattttatttacctttgagtggcattactacagtgcctcacatatggttgtttcaagggccaaagtggaaagaaagaaagagaaagagagagaactctactcaaataaacccaaaccatgaccctgatgcagatttgctaagaatgataaggcagtgattatctgagtcaaatcaaaatagaaaattgtaaagttaatgcaaaattattagaaaataaaacaaaataaacacaaacatgtcaagcttttacattcgatagtcagggagttggctcaaaatgacctctttagctgccttcataaatgctataagactccttcaatgcgatggcgacaaccattacaatttgcattttccttaactttgaagtatctattttctaataatcttattcgtgttttctaaggaggtaatgcactggaaaaggcacacaagattcagatgaccagaattccaaatatggttacaaaactaagtaattttaacgagtttaagtaaataatttaatattttcagcatagtcagtaaaatgaagaaacaaatctgggttgttcatttagatcatgattaaaatcaaacacaatatgcagcagtagtctggaaaccatataccaaaaatatatgtgatccttacatccagcatgtgaagactatgtaacatctttagtgagcaccaagggttcatgatgctggggacacagcttatgaaacaaaatatataagaacaaaacatagcaatccatgccca

SEQ ID NO: 51109 - DNA, 1131 bp, Bovine  19866880844238
aaaaatgtttattgtttgagaaactaatcagtccattctctgcataaaaggaaaagcccattcagaaacctgttagctatgaggagctagcctgaatgtactcacaccaagcttggtattacaactttatgttggaatttggaattgcttttgtttagtattaaattaattattggaaaaataaattcaaattgatagattaaagatagtcagctaacagactttaccacactatatcaaaacaatgtcactgagcattagtgcagtttttttttttaagggtttttttctgtctcttgaaatcttttgactacctcaaaaagttctttgtaatatgtgataaatgtgtttaaatatatgctttcagatactctttaaaagctgaattaagtatgtttcttttaatggggacaacagaaccatattactgatgaaaagtataatccccagggagtcaacaatcagtttagttgcaaacctggccccatgggctagatgtaaaccacagctctgtccattgtagaacttgaagggctgaaatgaaatcaacacatgccatcaatgcatttctgttttgataaatactgtttaaatttccgctggcatttaaaaaaaatatgtattaaaaagaagaatgtgcacaacgccggctgagcttcctcaaatatgaatgtgttcgatttcatatttttagttctgtgtctgttgagaaaaagccatttttgctcaaccccagtctataaatttctgtgtgcttattgacataatatgtaaatgtccttgaccagataaaaagacaaaaagaaaactgcctgcctgcttgcacaagccatgaagcactgcaaaccctctcaaagacctctctcttatcaaaacaattctccaaggctgagcgatgatctgaaaaaaaactaagagaaaataataaagagaaaaaatcaagcttgcatattttgacttacattttttgaaatataagcaaaaatatgaagttttgctaaaataatttcaatgatgcttatttctaaaaaaaagaaaaaaaaccaattatgagataaatattgctaggggaacaaaagctatatatttaccacaaacttgttctttatttcattttaaaagacagatggg

SEQ ID NO: 51110 - DNA, 948 bp, Bovine  19866880902079
tgagacagattaacaagagaaaatcaaacaaaaattttgtaacatgtatacatgggagagacccagagaaactgaataactcgcccaaatggctaaagcgctcaacttaagcagcatcttcagctaaagacaaaggaagatgttgagggtaagagagtcagttttaggaggttattaggaaaagcttagtaaacaaagtgattgtgatgcagatttaaggcactactttctccactgataaaatacttggttatcctcttccaggcacagaaataaagacacccttattaaaatggacattcctcttataaatatgtttcttacaaaagggcacctacctggttttcgagcccttttcatgtctgctgtttctcagaaaataaccaatttaaaataatatgccaaagagacatattttggggtggcaaattctgctctccaacactaccaaataattgttctcttgcattctgcaaattggatgcaatttttttttaaagtataatctgataacattttcaatagatggagaagaaactactcaggatacccgccccccccccaaaaaaaaaaaaaaaaaaaactaatgaaattctttgaatgtttaagacatgaaataagaaaatgaacaatattttcaaatgtactgaaaagactactctaggtactttacacattgactatatttatcaaatgttgccaagtaagttgctaaggcaagaatgagaacaggaaacatgtttcagagtaagctactagcttggagtttctgtgattgccatacatgataaatttcaacttttaaatgtttaacgatgtaattgggcaagtgctactggaaaaataaacatgctgattttcaacccatttattccttcgatcaacacatatctgggtacacctacttatttctacacactatataagctaaggattcaatggttaaca

SEQ ID NO: 51111 - DNA, 1239 bp, Bovine  19866881082148
cttctgcacaaaaccaactattgaaacattcttattgactccatacatatcaatgcacctgagagggtggtaccagcccagaggatcatttagacacaatcttactttatgttctgtcagaacactatgcttaaatggagagtgttcttcaacaaaaaggagcactagaaaagatggcaaaagggaaatcagtctacctgttattcctttttttctgtccagtcaggaagcaacaacttccttccaaaaatatttaagggattgtgatgcttgtgtctgctctgaagataacggtcacagctggaaccattacccagacatctcttatgactgaatcactgtttagtgcaggtctgtttccctactcctaatgaatcctggctttagaattgcagaaattcatccaacagaagagaggagtgcactaatgtgttattttcccatgagtgaatcaccttcgatagagtctaaattccataattttgtacgatggatgcctgagtgttttgtgagtgggccctgaaaatcaggatccaatttgaaaacattggtaaggaccctgcaaatgactattgtgttactaagcacacatttgtatacttaaagcatctcaattacaaaggatggcacatgtaggataaagtgataactggcaaaatgacaaacaccaagccttaattcattcaggattacattaaataattgaaatagtatgttttctagaataaggttgcagagatttctatgaaaagcaccttagtaagtagggtaattttctcaccatcaaagcatctgtggcatggatgcccttgttttctgaatagaggatcaaaaatcatgtatcttggaatgctttgagactagttttcttcaaggcagagtcctttgttctccgatcactattgaaatcaaggatagccaagtcaaatggcaaccagacagaggtcataaaccagtggaaacaataagaagaagacactctagtaacttaaatggagtcccaaatacacctaacatctcagggtgcatttaagaaaaaaaggatgaaaagattatgaaagtccagataaacacaactgcaggccccatctcaggggtgctgccagcctacggggagccttcctacaccacaatccgaggccttgtgctactccgttgctacacctgtttgcaacttctaaattaaattcattcctatttcctttttccaaaccagagatactctctaaaaggcagggt

SEQ ID NO: 51112 - DNA, 2229 bp, Bovine  19866881157744
ccatcatgtgcatcaaaatctttatatttatataagctgtagagttcaaactatttatctctatattgccaatacctggccacctcacagtagatactcaacaagtagttgtcaagaatgaagatttcagggccagtaaggtcccagagaggtcccttaaaccaggccttcttgagtctttttttttgattcatggtccacatgcttctacttaattttgtaaaaatagacaaaccaaaatctacacacaactcgtcagcattgactgagattaatggcacttttttgccaaaacagggaaaactctaagtaaaatacaaatgtatgtgaagtgtcatcaccaacagattacaaacaatatttctgtagcagatgagcccataggccacctgcaagctcattaacgtctcagtttgagaaccactaatggaaaacactttcttttagacactcatttctttatttaaagactctctttccctatccaggtgtaataatcttcctcattgtcatggtttctaacagtaagtgttaaagaaacagccatgattcaactccagcatgagccaagttagcttcaagagtttaaaaacaaaacaaaacaaaccccctcaagctgtcccgtaactgcagatacttctcctgaccttctgctaaataaccattataacaggtgagaggacaggaatggagtcgcatcagtctgtcttaattcctagaaagatgactaaagtagagccctcaccatcagctaaatacacttacttattatttttgcagtttaaactttttattttatattggggaatagccaattaacagtgttgtgatagcttcaggtgaacagtgaagggacccagccatacatatacctgtatccattctcccccgaactcccctcccacccaggctgccacgtaacattgagcagagtcccctgggctatacagtagtcctttgttgcttttctattttacatatagcagtgtgtacatgaccattccaaattccctaaccatcccttctcccatccttcctccttgcaaccataagtttgtgctctaaacagtgaagctctttctgttttgtaaataagttcatttgtataatttcttttccgattccacacataagggatgccataggatatcacttatcctctatctgacttacttcactcagtatgacactctctaggtcagagaaggaaatggcaacccactccagtgttcttgcctggagaatcccagggacgggggagcctggtgggctgccgtctatggggtcacacagagtcagacgcgactgaagtgacttagcagcagcagcagcagttttagctataatttctgcctcttttgttttaattacacctgagttttcaaagcatttcttatggagtattttttttattaaattaatttagggacttccctggtagtctagtggttaatacttcaccttccaatcctgggggtgcgggttcagtccctggtcaggagctaaaatcccacaggcctcatggttaaaaacccaaaacataaaacagaagcaatagactgacaaattcgataaacactttacaaatggtccacatcaaaaaaaacttttacaaaattaacttagaaagtttgacctacttttaagttctccttttatttttctctggaaattaaaattagatgtttggatctctgtttaataaacacaaacattcaggagtgtggtttgtacatgagcaacaacttctgtttggtaattggcatttatcctctttctggtgaatcacatttgtacagctcaatttagaaacacttcactagaaacactgccaatcctaatattataattttaatatttttaaaagccactgattttaaatagcagaaagaaaaaagtcatgacagctaaaaatgacatggaggtgaaatagctagaatacctcacctttctcttaaaaagatagtaaaacgacagtgggatcagagacgtttcttcattcacatttgataagctctagaccttacaggatgttccaaatgcattgccatttatttctgatagaatgactataaagtagaagttcaataaatatttttagaataaaagaaggggagaagagagtctctctatatatatacataatatttttacagtggaagtgtacagattgagttttccttttaaagacatgaaattcagaaaactaaaatgaaagctttgtcaggt

SEQ ID NO: 51113 - DNA, 1539 bp, Bovine  19866881275860
cacataaaaatattcctatgcaagagattgtgctgggcatttggaatctagaagtgaacagaccagatatagcctcctttggcttatatacacattagcgtgtcttttcatttctctgagcttcactttcttcacatgtgaaattgagataacattagccacctctcagagttgctttgaaaattatgtgaaaaaatgtttgtgaaaactaaacattattcaacatgtttaacttccttctttagcattctttcttttttcagcctgaattttcaaatcatgaacatttattgagcatctgttgaattcaaaacactgttctaggtgctggaggtgagggaattaacaaagaaagaaaaaggaaaaatgaatagaaaagtgcttacaaaattctaagaaaggaaaataaccattttcatgaagataataaaatgcagcaagtagccaggacaaaatgaatttcccagatattaaatactataggagcttagagtgggagaaataactgcagtggtggtgagttcaaacaaggcattagggggtctctgcattgttgaaaggagcaaagaggtggaagaacagattaggagaatggaatggcataagcacattcatggagatgagaactgttgggtgttttcaagggagagagaatagatgaatataattatagtggataaatgtgggcaaggtagattataaacctgggtgtgtcaactgagacctgagagtgaaatgctttgaatgccagactgaagcttgtgcactttatctcattaagtaaacagaagccattagagatttttaaggcagggaagtgacataacaaagtaatatttccagtcaaataatatggcagttgtgtgcaaggacttagggtcaaaagggaaattttaacaatgaaaactttcccgctgatatacttctaaaaacattttggagagtgcatacctacctgaaaatctgattatccttagacattcagcattgtccatagaaagtgcccaaaaggggattgtctgcacatatctttccaagttattcctcccttcacttggcaggtgggtgatcactcactggtttccctttctgtcttctgcaccaaagctcagtgtctttgcatgagtgcactgacattccccagacccctctctttcttctcctaatagcatgagctgccctttcttcagtaaaagggacataccacttggcatcgttagagaaaattcttctatttccgtaatgaaaccatctatcctttgagaccctgctcattttgaaacacagaccaccaaatgctactcctgggacataattcttaaaattggagaagatagggtcatatcctcctttcccctcatgttacccctcctggtggaagggttcttattgcattgccaagatttggaagtggtgtaacaactccccagcccagacattatcagaggctgagacttcctccaagctgatgaggttgcaatgaggaaaatgattagatttaaaataaaaaaggcatctactagccatccttttcaaatt

SEQ ID NO: 51114 - DNA, 713 bp, Bovine  19866881285400
ttctcctggcaatcttgattccagcttgtgcttcctccaccccagcatttctcatgatgtactctgcatataagttaaataatcagagtgacaatctacagccttgacgtactcctttttctatttggaaccagtctgttgttccatgttcagttctaactgttgtttcctgacctgcatacaggtttttcaagaggcaggtcaggtggtctggtattcccatctctttcagaattttccacagtttattataaatggcagatcataccaacagtgccccacaggtccattgtgattgcacagcagaccccacacatcaacaacttgagtgattttgacactctggctctgaaaaaggtaaatacaattaagactgggctgtgaaataaatctaagtattcatttggggatgctaatcagattcagagactgaccccaaagtattcacggtattgtgtttttcttttaaaaatctataaaattttattaaaagtgagaaatattgaaactaccaaataaacatgacgaatatattaagtggcctgtctcctgatattaactgtagaatttactgcagaaaaaagagctagtgcaaaatcagcattctgtctggtatccttactctttgaagagcaccaaatgtttgacattattagaactggcttggaatcaagtcaaaatttaaacagagctactaatcttattggtatgaa

SEQ ID NO: 51115 - DNA, 1674 bp, Bovine  19866881330549
aagtgatggtgatagatatattaaagtgattaatgatattgtcagcttgatgactcatctgtatcatatgaaaaatagattgtttatttatccaagactatgctctttcttatcattctaatattaaatgtaatcatgggatgaaagcactaacattgccaaaaatgaaaagtgattgatttaagggctcatcttataccagatgctccatggaaaaatgagtcaccattaaaggccaagcggactagccctcacctctatctcatggacccaccagtttaacactgtgattaacacacagcctttttgtcacactagtgtgtacaaatcccagctctcccgcttgctagctgtgtgaccttgaacaagtaattaaacttcattgcctcagtttccgcatttataaaacttattattattcctcatttataaaaatgagaagaaaagcatcacctacttcatagagttgtcatgaagtttcaagtgactcagtgtgtgctccataaactattattttgatcatccatctgatgtgtcagttattttgtatttagaaagcttctgatggtatataccatgatgggaaaacatgatctgcctgatcccatttctctgataattcaatcaattcatcacccaggatataggctgataccagggtagagaaaaagtgagtcaagctgtgttgaagcaggagtatgagtcactgactacaaggactttgctgtatagaaagcagtgtggtgtgggaaagaagcatgggtgtcagaccaacaggcatttgagaatcagctctgcctcttgagaggagatcttcaacaacgtatccaatctctctaattctcaattcaccctaaagtaaaaggtaggaaagatttaagtgtgatcacaagtgtgaaatacttagctacctgttatgctaactcattattaacactattactgtttttaatcttgggagagaaggtggaggagagacaccgggttcctagagtgggggagagatcaggagccatgggatgagggtagggggagagtagtttggggacagtttacaaaaagggaagtagtcagggcctttaacacatgctgtgtccttccagctcgttctccctcctggtaaatgtccaactgccatattcattcatttagtcaacacatattaatgagtccctgctatgggctgggcacttttctaggtgtcaaaggcaatggtctgattcttagggagcttatattcctggtggggggtgggctataataagaaggtaaataaataaatgggacagataatctcatattgtaaaaagataacagattaggcaaagaatgctgtgggagaggctatcttagctaaaaaaggccagttgaagaggtaaaatttaagtggactagaagaaagaggaaccaagctacattaagctctgggaaaagagcaatctgctcagagggtcctgcacacaaaagaccttgaagcggaaatgatcttggcatattcccaggctagtgtgactgtggcccatattggatcccactggaggaagcagcagagcccccactgtagagagccatgcaagggaggccttgcaaggaggctgtgtacccagtgctatgtgaagctgtgagaggcttccatgtttccactggaagcagaagaataaggtgatggattta

SEQ ID NO: 51116 - DNA, 832 bp, Bovine  19866881423692
aatgcttggtcttgccaagttttgacaggttgcaaattgtgtaattcaagttcttgaatttcctattagttagcttgactgaagagtgggagccacatcctcttctctttgctgacatggtcacatgggtgatggggattaatatgttctctatctgttcagctccagtagtaacatattcgcttgcagttttacaaggtggccagctcagtgtttcctttgcttatcactacacttacaacacaaaagactataccaagtaaaagtatttgcaatgtgagaagcaaagagtatatcaaaaatagttattggaagatatacaaattccatggaaaagagaagagtttatgaccacctgctaaatttacccatgccatcataattttacttggtatgtctaattttcaccctgaatcattaagaaagtgcaaaggttagggaatggcattcatgccagtttcctttggccaatttttagtgaagaggcatgtaaatattgtttccttaaggaacaacagaaaatttccaatttgcataatctcaatttctttgttatctactgcagtgaaatatctctatattttttgcatgatttgctacatagattaaagtgaaatcactaggagaggcacagtatatattgtaatagaatgaacaaatatagccgtgaacactgggcaaggactcttggcagctctttcctgaaagctgtggaggacctgctgtgcggagccctaaggcattctgacagtgaaaaagcacactgataaataatgttttaaaacatttaattaataactaaggccacagtatgtatcccttcaagcacaga

SEQ ID NO: 51117 - DNA, 1554 bp, Bovine  19866881849224
taagaccggttagtgtgaaacaatagatatgagaatgctctgtaaaatataaaaccatgtacagattttacttttagttattttactatgcaaacaatgtgcagtataatccttttacaactatactacatcatgctaaatggattaatcatttctcaagaatataatacaattaaaccaatttacaaatcaacggcttccctggtggctccgtggtataagaatctgctgcaatgcaggagacaaaggagatgagggttcgatccctgggtcaggaagattccctggaggcggaaatggcaacccaccccagtattcttgcctggagaatctcatgtacagaggaacctggcgggctacagtctatgggtcgtaaagagtcagacatgatggagcaactgaacacacacacattagggtgtgtggacaaggcccatattttcataccttcttttgtctcctaaacaactttgtgcaaattaaaagggggcaacagtgtataaggtgtatactccatccaatttatttattttattatcactgccatatgtaacctttcacttcatatcccttaagcctgcatgtctatcggagaagaacatatgttcttaagaacacaagcattggaagatagctacgtgcacagctagctcactcactcattaacaaccaccacatgaaaattactgagcagccactgcgtgctaggcactgtgctaggcactaggcaagcaacactgcctgttctttcagagctcacagactggaaggaaaaacaagacaagaaaaaatgcaattgtcacagggtgcggttccatgatatgagaaatacagggtgatttgggagcacacaggagggacaccaagccaagactttggtggtcagaaaggctttcttgaggaaactgactggatttaaaagtccacacttaactatcctataaacaaaaggttataaaccaatgttacctactttatatattaagaaacaaaagagaataaatgaataagtgaaaagaaatcaccatctgaaagaacaaggaagagggtacccactgtggaatttataagcaaatgggcatgttagcaggatgagcaggacttaagaatgtctagttttctactgtctctgtttctctctctctctccctcccactctctgtctcttaacaatcccaagggatcagtgaggaaactgtgaagagctttagtgaccatgaatctcctgtaagttcctctttggataccagcgctacagaattttctgccccagagaatatttaatagttcagaactgaaaacattccttgtatttgtacatagcacacttgatcactctttcattcaggatgaactatataaaataccaacacttgtagttatgcttaagatatactgagtatttaatatacgttaggcactaagtattttacatatattatctattttaaccctaacagcagggtgtgtttggtccaataaatatccctattttacagagaggcacaggacggttacctacttttcttaaggtcactcattggcagagttata

SEQ ID NO: 51118 - DNA, 1520 bp, Bovine  19866882007975
tagtgtgcactagtgtaacagtaaaaatataatgtgtggagacctcctagacctgctagcatgtgaattacatagcagtaaatacaaagtttaatttggaatagttggcatatggtgttactgagaacaaatatgtaggtttgatttctcagttgggccagttgatgcaattcaaggaaagggggtgttccagagcttcatgacaatcccagtcagtcagttttaaagatacgtgaccacaaaggaatttaggttacagaatactactaggtcaatggagaagaggacagaagtcagccattctgcagatcaacttctaagtgtcagtattctcttttgttttttctaactgtttacagattactttggcctgtaggtattagaataattttataatgcaaatttaagcacttgaagatttctacttcttgaattccaagttccatgattaatggtgacatcaccaaattcacactagatcttttcctcaatgaatgagcatcagaatcctgaagataaaatgaatcatggttcatagcttgtttctaacatcacattttgcatgtttcttgaaatttcatagttaactgtgacaacattacagattaaaatgtctttaatcatgcaaaattaatgccagaaaatttggaaagaagaaactgccactaattcttgacctaatgttaatcttagtttctcagatgaattgtgataatccatttatcacttcacagccttcaattatctaactcagcttttgctctgaaccatgctaattcatatagctcttgcaaactattctgccctgggcttgaaagaggtcacatttctgcacttgatatatcaaccagaaaagtcaggaaaatacaattctggacacggggatagtaggccttctataactttaaaggtttattacttatatcttgtctttctgtagggaacctcttcttaaatctagtaattcttatactcttacttatgtaattcttcctgctgttggatatcaaggaatctcaaaccttttcatctcctaccttgtatgaacatataggcttcctgctatctagaattagaaaccaatttctaagactctgagcaccttctgaatatgtcactgtgctttgtggaaatctgtgcccagcttaactgtacctgcaggaaaaacttcctttgtaactgatatccttggtaccacaatcaaatgtttaaatcctttatgctttggggatgactgagctatccacaaaaaaacccttgatgctgtctttccaagaattaccttggactaatcaactagtagtatcaagtgaaaccaaagaaaagagaagcaaagttgtttttttttttttaatgccttctatattattcagtattctcagagaactctgtgccatcctttattatctaaacttggctaatattaatttaagactttatcacttagctctatttctgaaatacagaattcacataaagacgttttctgtgtaaagaacacttgtctttccaaaacaaaa

SEQ ID NO: 51119 - DNA, 1788 bp, Bovine  19866880513405
cttctggccataagaaaagttctaggaagagtagaagatgcccaccaaccaaacagagctgattcagtgccacatcaaggatggaagctaacacactgaggcagatgcatgattgaggctgctggctattaaaggagttggtacaagtgtaagaaaagcggctgctggctattaaaggagttggtacaagtgtaagaaaagctagtttcttagggacgaagaaagggaacctaccattaaccaacaagaagaggactggagaaaagtctgattctggtcatccattgttgggtgacttatgtccttcaacttctctggaagtcagtttcttcatgtatagtaatgagtagggttggattatttattttatctgtagatgtctcttccaactctgataatttatgatccacagaacagcaaatcctaacttgtctgatcctttcaatgactccttgaatcctccctcacccattccagaaaagcacagaaaatgagatgacctctggttaccagacagatgttggcaagccacttgggattccatggcctctgtagctactgtggtgatcatgcccagttgcagctaaaatctgttgctggcaagatttgtaccctgtttgctgagcctggactctagctgctgcctcttacttcctctcattaaggcaaagcaccatcttattttgttttgttttccctgcatgttttgagtttgctgcttcccagctcttgttattagaacagacataattaataactcctggcacatggagcagccagattggacaatctgccttttgctttctcgaactgtcttcttatgaacaatctgcaagctcgaatttatagcctggaccccaaagaatcaggaactcaccacattgccagcttgaaaaaataaaattttctttgtagttcatagtgggagttttattcagttaagaactgaaagtgacatgtggtctcatcctttcttaaacctctgctgaaaatatgattctgtggactttggtcagcattctagaattttccttctgggatcatcaggagttggttcctaaggtctaatccactcaatttctgtggcagcccagacccatttacctttaaagaaagtgttagtcgctcagctgtgtctctgagatcccatggactgtagcctgccaaactcctctgtttacggaattctccaggtaagaatactagagtgggtagccattcccttctccagaggatcttcctgacccagggatcgaacccaggtctcctgcattgcaggcagattctctatcatctgagccaccagggaatcccatttctttagtagagattaaaaacagagtagcctgtggcggattcattttgatatttagcaaaactaatacaattatgtaaagtttaaaaataaaataaaatttaaaaaaaaaaaaaaaacagagtagccattcttattttattttttattgtgattggaaaaaaattattaaataccttgtcagagtcctctatttgccatcacagttcgttggccttttccacttcaggaaacattccaaaacatcaggcatatccaatcctgccatttggtctttggttaatttgtccatgtttgtttaaattaatagaacctgaattggacagatgcaatcatttaataatatttattgagctactacttttatcttggtggtgtggaagacacaaatttgaataaaataagatttctgctctccagtagcttacagtttataatcatagtaattataatgcagggctgagctatactga

SEQ ID NO: 51120 - DNA, 1241 bp, Bovine  19866880556490
tcaggtttggtccaacaccccagtgattcccaaacctcatgctataagtgcaagaggtgggaggggacggatgagtctgtgactctgtagaattcctgccatgtttttctatagccagacagagcaagaaattccatttagccatgaccccaaagccatgatcccactctgtggttgaacaaacttgtgcttcattgacaggttcaatgctgacaggctgagaataactgaaacaattaattctaaaattatccccaagacaaatctctttttgtccaaaaattctaggctgctttaatgtctggagtgtgtggtatttgggtttttctttcaacattaaatgacaaattccagtcccagggctctagagtctccagaaatggagggtcctaacttgtgtgtgcccccctttccaggtgtgagtgccccaatgtgatgaggcagcagacttgcagacttcagtcccctcacacgctctgacaagggtggcttggttcgcaggtcacatcaggataatgcaaactgagctatgcatttactgtaattctaatcagatgactctataattggaagaaccccagtggcattctgtctttggaatcttctccattaagtgactgaacgagggccaggggacctttgcttgccccaaatgtaggtcctgatggagatgttggaatctgggtactgtgttccattctccttttgttggtaagatgctaaatcagtctggaattggcacatcatgtgtatcgcaatcatttcccctcttctcttagtaatgtctggccagttgcatttctaacagtaaagaacaagtgggatgcccatagtgtgtatatggcaggacagtgggggcaatacctgtgtataagcttcatgacagtgactgaatatttttggtgaacatttccaagtttagactgtgctcaggtttggtcatggttgtctaagatcataagaataataatctgaatttcttaatctttctggatacatctgtcagaaacaataaagacaaatgtattgaggaagcagattgtagtaggaacttcacaaagtattggatcatttggggaaatacagaaatgagtcagatctaaaccctgaccttgaagagctcatatttggagagagctataagtcaagctcataacaattataatccaagatagaaagtacgagttctgtggcattgcgatttagaggaaggaaagatcattcttaatgggaatatctgg

SEQ ID NO: 51121 - DNA, 2912 bp, Bovine  19866880620013
ttgtcagggaagactccacctgtgtgtgtacgctgtgctcagttgtgttcaactctttgagaccccatggactgtggcccaccaggctcctctgtccatgggatttcccaggcaagaatattggagtggcttgccgtttccttctccaggggatcttcccaacccagggattgaacccaggtctcctgcattgcagacagattctttactgctgagccataagggaagcccaagactctgcctaggagttggcatttgaaggtactaagcacacagagtggaaaagcattccaggcaaaaggaacagagagagctaaggcaaggggatgaagagagaacacagcatgcgctgagagtttcatacacactgttgcaaagagcaggagggtttgtaccagctgcttcaggataatctcggacaatgttaacagtctcagctgctatcctccacctcattcggcacgctccctggggcagaggcctgtgtccacctaatgggccagtatgacacctggcccagtgctgatggcattgtggggcttaataaattccctttgaagatgagaggactgtacaggagaaaagaatttgccactctagtgagtcagccggaacggcaggcgtgtcctggctcctcgggccaagcactagggccgatgggccagacatgctgggtcacttccccctggggccactggattccacctgggaacatcgagtcttttttcagcaagtcgttcctaagccacgacactcctggctcatccctagcctttgtagcttcaccagcgtaattgatcccagagctcagcttcctccatgcccattggtttcctagggagtgatggggtatcaggtgcccttagagcacctgcgcagcctggcctcctggggcagagatggagcgacatgtgagaggcagacataaatagtcctgagttctgtagtcatccttttgggtgctctgagcttcctgtcctgagctaaggttttctcctggggttagctgaggcatggagagataaacaaagcttgaaaatgactctccccactggaaagctaaaggcactttcaagacactgctttctcctaccttctgatgaatgcgtcccagacttcccaccatcacaccctggtgaaggctctccaaggtgtgtaggtggagaggagagacccctgaggacgaaacttctttcaggcgtcctcccacatatgctggggctgcataatgtccggagagccagacgaatcttgccaggattcaccatggcaggagaacctgtcaccccagtgttcatcactgagcagcccaaacaagccttagtgactaaggttttttttccacttacacctggttcttttgctttcaccacagaattatattagcaaatgagatccttgagtaagcaaaacaggtccttcacagattcttttgtaagaacacattcctgagcctacgacagatatttagagtcaaggaacatttactcacacaggcctttcaaaattcacctccaagctgttttcaccatgtcattgccatgatctgaaaaattaagtgtgtccagaagaaggcagccagtggcttgcaacaactgagaactgggcagcaaaaaaaaaattaaaagcaagtcacagatgcacattcaacatatgtgactgacaaagaattaataccctgaatatagcagagaaatcctatacatccataagaagaattaaaagcaatcgagatacattggcagactgtatgaacatgcaaagtgtggaaagagaaatgattctcggcatatggtaaaatgcttaacttcactaataaagaaatgcagatttaaaaattaagagatgccatctcatatccatcagattagctaaaattcttaaagtctgacaatatgaagtgaaggaatagaaattttaaagcccattattaagaaaatgggcttaataaattgtaacacatttaagaaaaagaaaagcaatgtagaagttaaattgaataaactatgtaccaatatcaatatatttaaaataataatattgaatgaaaaaagcaatttgcagaataagtcagtattattacatcatttatgtaaagaaaacatgaatcaatactatatattgtcttggacacatgtttatggaataaacgtacccaacatgaataggacaaaggcatcccatctttgggtggtggttgtttgggggggtcaaggaaaagggctgggaaaaggtaagttagaaagagactcagttgttttgggtaatgtttgtttcttttaaaagctgaagcatgccttcaaagtcagggaggtgggaagatgaacataaaggtcaggataggttaggttttgctacagtaacaaaagtctgaatcagacacttcagacaacagagatttggctttttttgctcattcatggtaggttggcaaaggggctctgactattgttgtcattcatggaccaaggcagacagagcagccaccaccctcttgctggcagccatgtcaaggaaaagaaagaacaattacatgctccggactagaagtgacatggtcacctcttctcacaactagttagccagaactaattgtacaatcctccctggctcaaggggaccactgctaagtcacttcagtcgtgtccgactctgtgcaaccccatagacggcagcccaccaggctcccccgtccctgggattctccaggcaagaacactggagtgggttgccattgccttctccaatgcatgaaagtgaaaagtgaaaatgaagtcgctcagtcatgtctgaccctcagcgaccccatggactgcagcccctcaggctcctccgtccatgggattttccaggcaagagtactggagtgggtgccattgtcttaaagtacacaattccactataagctcaga

SEQ ID NO: 51122 - DNA, 1947 bp, Bovine  19866880663295
taaaatgaatccctttaactctaaaaaaggaagtagatactgttctgtcaggagcattcaagccttccccaggtgtgagcccacagccacaggtctaccttttgggcctggggtcgcgtcactgaaagtgaagctgggggagaagcaatctggtgacttgtgaggagcccgactgacacccagagaccagggttcaaggacagacgggccatccaacagcaggactggaaccttgaacaagttactcccttgcatggggcctcagtttttccatcagtaaaaagcaggagctagacaggactggcatatttcaatttttttaacagcaaaagtcctctttaaagatgaaatctcctgcagggctccaatgctatctaaaagcagataaaagtggaacctctgtctttagagaccctcccccatcctcacctggaaagaaggttcagtcttagctcactggagtgagccttttctaattatttgtatagttcaatatcatgagagtaactagtcagatccaggaaaaaaaaaaacaacaacaaacacctaacccaaatagggtggtaggtctagagagacagtaaggggaggtggggccagagtgcagaaggtttgggccctgatggagttctgagactcccgcctgctttttcacctcaaattccccaagaggaaactgaggccagatggctgaggtataaactttgtaactttttgacccaggaagttttgagaatcataataaggaaatgattatagcatgctttgagctctttggagacaagcagtatttaaatacaaggtattattacctccacagagctctcttttgattaccactgtgcttgaaaatgtgggcagaccacttttattttttaaaactcaggtgtttaaaaaaatattcacatgtacaatacctaccctagccccctcacaagttaattctcagcttccttgtcacaagataatttaaatgttcaaagatatattatactagctttatcagctaaattggcagtccctgattcaagacgtctttcccttccagctcattcccctcccattatttgaaggactgttaaattaagagtgaaacaatattatgttgggagttttaaatgtcagtaccaaatatctttcaacagaggcacaaagtaggaacttatttaccatagactctgaatatatcaggtgaacctcgggatatttcattccttggtacagggcctgctgtggaacttcagaagtcaacttcccaaaattcagaatgtttttctttcagaattgagaagcttgaactctcagcttatactgtgctcacaggacttaaaaatcaagtcctggttttactgtgcctgggtgggttgacctctgcaaatcgtttcacttctctggtcctcagttttctcctctgtaaactgggatcatctccctgccctgcctaattcacaaggctgctctgaggagcaaaatgatatgacaccgtgtgaccagcctgagtggaggctcagacgcataggcaccgagtggggccagatcagaccttgatgcaaatcctgctccttctccttactagctgtgtgatcttaaataagttgcttgtctgctctgaacctcattaaagaggctatttatagcattttcttcatctgttcttttccagacttaaagcctccatcggagtgcaacctcaatcagtgtgggcatttattaaaaagctgtaactctccctgtgcccaaggggttactgttgtttctctctagagctgctttcagtgcactgcagacctaaagataaccatacacctattgtctctgaaccgcctcagtgctcttgctcgaaggaaaggaaaaaggaaatacactgtggcccagaatggggctccagagaaatccaaaatgagctgggtctaaaagtgactgctctccaagcctatttttaaccag

SEQ ID NO: 51123 - DNA, 1851 bp, Bovine  19866880712219
aacaaaagagtgtgttctgtgagtcctcagccagtttcaagagatcaaagtagaggtggatcagagagtaacagggtcgggggaggggggaggtaggaagaaggggaggttccttgcatcttctaacagaagccagagcgcagactccatttcactccaaggagcctcctgcaatggcttgacccaggtcaatatgagaatgaaagctgcagagtgttttgcctcagccaggccaatgtggccactggtggtcatgctcttccttccaaacagctgctgtggaatctcaaacagcagctcggagtgggatttccaggcctcatcatcccagcaaggaaagcagttgacatgacaatgagagacaggggaactagacataaatggggcttcccaggtggcgctaatggtaaagaacctactcgccagtgcaagagatgtaagagattcgagtttgatccctgggtcgggaggagggcgtggcaaccctctccaatattcttgcctggagaatcccttggacagaggagccgagtggactatagttcatgctgtcacagagagtcagacacgactgaagcaacttagcatacaggcaagcagacgtaagttaatccaacctatgtgtgcccagagtggcctgtgactcactgtcactcagtcacctgtcttcccagtttgttttacagacctgcgttgctgatgtggcaggcactgttctaagcacttcatgagttattaacttactcagttctcataacattccataagttacgaacctctaccctgtctgactgatgaagaaagtgaggtgcagagacacgaagcaacttgaccagggcctcacagtaattcacaaagtcaggattgagcccgagcagttccaacaactacagggtctgaactctgaagccctgaactctgttgctctttattctgatttccactcagcctctagcactcctacaaaagagggagatcagagcaaatcatttctaaagttgcaccgagctctaacactttgtgattcagtggaatcagtaagtggttagggctcaggctgtgagttttcagtgagctgttaaatatgctttggtgtgacacaaatacccatgtgtgcatttcaccgagttctggccattggctggccaccaccccggctgtgctcagtggatctgctggcctattgcagggccccaaatcttcacgtcagggactcagagattctgcacctcttcgcaaagctctagccaatggaattgtgaaaacagcactcaatctaggcaaataagtgcgatgaggaagtaactagagattagggctgcaggggtacagtgattcagtgagataaggccggaaggaaacacttggccctgagtgctcgccagggaggtagaccagaggcttcggtttaataaggcaggtgattagttgctggccacggggttacttgagtggaagaaatatgacctttctagtggcccaaatgagaaaggttctgtatggtaatacaatctcaatttcccagtttgtttaaacattcaaatgggattatcacgaaattcacattgtggatattcccgtgggggaggtactaggtagaatggaaagagcactggcctggtgttgagacatctgagttccagccctgcatctgcccctagctaggtgagaggccatagatgagtcacatcccatcttagcctcagtttacctataaaaactctcagcgagtagggacttccctggaggtccaagggttaagaatctgccttccaaagcaggggatgcgggtttgatccctggttaaagaaataagcccatgtgcggaggggcaactaagccccccatggg

SEQ ID NO: 51124 - DNA, 1222 bp, Bovine  19866880776451
cccaagtttcctctttcctttctctctcctctcccccacaaaacccttcatcacaaaaggtcaactgcctgaaagcctgttgttttgatgactggcgtgagattctattggttaaaaatgtgagaaagctggctacctaccctcccccaacttcaaaccaactgtatgtgtgtgtgacagtgtgtgtgtaaatttgggccaaaaaaaaagaactgtggttaattcttcttgttgtgtgcttcctgccgctgacatttgccgctgctgctgtgtaatgaggttgaggctgggtaggaaaatcagatgcaaatgacctatttatttattccccaattatgactgctcttctcaacccttgttcttggaaaacctggaaagtagaaagaagaggtcatgaaagccagctgaacaaggcattaccctgaagcaacccctaggacttcgggtcattttagttgataagaaatttgaggatttttgattctgtttaataaaatggcatatatttttaaaaattataaatcatgaatgatggctttttcatagagactttatggttgaagtcaaggactaggatttatgtttcactgggttcagttcatcagctttatttcccccatcctcatccatccactccattttccacaatttagtggtgtaattgaaaaatatattcaccagatcatgtctctttcatgtctaaaatccttcagtgggttcccattccactgcttagaataaaattcaaagttctcactatggcttagaaagccctctgacataagtgccccctgccttgccctctgaccttttctttctctctaccctccttgtgacactggctgcttaccttccagccccagggactttgcacaggtggtttctgctgcctgcttgccccttggttcctgtcctggctcacagaagagtgccacctctttagacagggcttccctcatgtttccctatgtgttttccttgcgtttgtgaattctaagttgcttcagtcatgcctgactttttgcaaccatatgaactgtagcccgccaggctcttctgtccatgggattctccacacaagaatacttgagtgggttaccatgccctcctccaggggatcttcttgacccaaggactgaactagcgtctcctgcattgcaggcgattctttaccactgagccaccagggaagacttcccctcgcattactctatactagttt

SEQ ID NO: 51125 - DNA, 1330 bp, Bovine  19866880830329
aaactcaagtaggttggagccttgacgtgatcaataaaaaaaaactcggccacaaagtgtcctcaagctactggagcataaacctgaacgggtattgtgtcagttgcaatttgctctcatttatccatcagcatcctctccaactaaatataagtgagtatgaagaacagttgtagatatagacaggcatcagtgtctctaaaattattaagaatcactgacttgtgaaatatcagtattcaaaagttctgatttctcccgtgaggtacttttcatatcttattttgatagctgaatgcaaatgagcgtgagtaaacccttcttcacctgggttctttgcatgatggtgcaactgtgtctgtttattacagacaattaacaaatacatatcccagattagatttatacaaatcaactattaggtgagttaccaaaaaatatatttgaaggtgaaaacaagcctatctttaattacagctctgttgattcttggctttctataattattatgatttgcaacagtgcatgggtctgttcactgctaacaactccaaaccaagaatggagagtctgagaccaggcccgatcttggtaaaataggaataagcatccttttggcgcctatcttacgggcttgctcagcggcttagataacgggatcgttgtgatagctcgcgatgagattatccaaacatggaaggaggagcatgactctgcttagaagagccctagcaaaccaggggcacatctgcttgtgtcctaggagatgcacagacacagagagctcttcggaaaaatgacttttcgctgttgttgctttcgtcattttcatcgtttagcagccatgaccagatgtgatagtaatcccacctccccctcttaggtgcctcatacatcttgcatagattgaatttgatgagcactgatgaagagcctactgtgtaccagggactgttgcaggggatgcagagttgggtaggaagccattctcatcgcacccagtaattctaatggaaggcagaagtgcggacaggcttctgtggcagcacaaactctttgttgaagggagtttcattcccacgggtgtgggttgggagggagtgctcatcagaaaagtgggatttcagcaggtccctcaagggcctgatacaagtgtctgctagatagcttcctgaagaatgggcccaaaaaaaaaaaaaaaatcacttttagcagtcaggctagttgattccatccctgtgtgacagacttgctgtggtcttctttcctcttcttcatggctgaatggccagggttagcagaggaccagtgcagagtgctgctgctgcta

SEQ ID NO: 51126 - DNA, 2151 bp, Bovine  19866880859659
ttttcactaatgcaaaaggcctctctttctcttaattttccttaagggaagaaatgatgccttatgttcctttttcattgcttcacagcacccagcatagccctgagcacaagagaagctctcagtaaatatgtattcttctaagtgtgagtcacagatttgaaattatgaaggaagatattggattatggagtgaggaagggaccacacaaatggcctggggatgtaaagaaaagcctggcatatgtgtggtaaagtcttaggaatgagcctttgaggtcccccagcagatgctaacagtaaagccccaatctccttttctcttcattgcatagatcagatggtagaggccctgaaggaaaatggtcttgataaaggtgacaaagccactaagttctagaactgggtttagctttctagggcttttctgggttggcccatctttgttttcaagatttttttttttttcctccaaattcatgtcaccataaacataacaaaaagaatcctatgcatttttggacattcaaattcacactgtgtttcttcctcagaaaatgaatgcatgagtacatataaagtagtgggaacaaagccatatattgaaatttcaaggcttgaaaatgtgactccttttggcaaaggaacaaaaacagtaaaattggggcgttctcccaacccatcaggacatccaggtgttatctgctcagcctctccctctcagtggagtgagagtgtacaagtcaggcaggcagattccttaaagaaaaccgagtggaaaatacctatctccatggggctatgtgaggatggagagtgaggcaaggagggagatgaaggaaccatgctggtgtggtcaaggacgacgtggatggagccagtccttgtcaggtgtctaagaaatggagacaactgccagttcctgatacgagcagctgtaaatgatacactccaacccttcttacatattagcaacaggatacatttatacggaaaactttttatggaggaggcatcatgctagagtgagaaccaagttctggtccaaacttggtaacttttctgtaacttggacagtttctctctgccctgagtctcattttcttcatggacaaactgggatctcttctacatctagtgacttgtttctctttcacatgttaaggtactaatacttacatttctgagagaacttcaacttttatggttgcaatatactctaccatgaacttctgtagagctctgagaattattttctttttcatcatcacttaactggctaagatattcagctcacaacctatttagtgattcaagttatagaaaaaccaagagaagtgatatggaatgttactttattttccaaagttggaaggggaaattgcctatatacttaccaaagataatgcttatttgcattaccctagagaaatagaaaaaggcaatggcaccccactctagtactcctgtctggaaaatcccacagacagaggagcctggtaggctccagtccatggggacgcgaagagtcggacacgactgagcgacttcactttcacttttcactttaatgcattggagaaggaaatgaaaacccattccagtattcttacctggagaatcccacggacggaggagcctggtgggctgccgtctatggggtcgcacagagttggacacaactgaagcgacttagcagtagcagagaagtagaattagtcacataactttaagtggagtttaaagtttcctgtactctctcccatggctcaagtctttaaagataaattatccttaagtttggcccagagatttctctttatttggggccagcaggaaagcctactgtggtccaaggcacaatcattttaggcttaatctcttgacatagcctacatatctatctcccttctccccaccatacccacctctcaagtccttttccacatagcagccagggtgatctatttgaaagccaagtcaaatggtgtaacacctctgcttaaagtgctcccgtgacttccagccttactcagagtaagagccatacttccattcaggccctgccggacacaactgcccatcagatttccactcctacccattccccctcacaaactctgctgtagctacagtggcctccttgctgtt

SEQ ID NO: 51127 - DNA, 671 bp, Bovine  19866880934252
atcctactaaacacccatcccaggggagatgcccgaacactggtgactctgcccttagggaatctgggactaatgaggatcttagaacaagtacataaataactaattaaaggtagagagtgatgtgtcatgaatcattatcttcatcattattggaagtcatttttatggaattgcatatatttactatatcatcctttttttccaaaaagaattttgaatgacttataacattacagaagttagacactgaggtataaaaagatagaactagatatttatattgaagccataagaaatgccaaaagctaatacagttgttagatctagcattagatttaactctgagcttactggaagtcaggacaaaatgggaaacacattgttataatttactacttctcaaatactaacactctcttaagcaatatacagaaaagtaggcaaggtctaatccactaaccttgcattttctattcatttgacaaatgcaaaacgcatgcctggctgtggaattttgagacattcaggttggcgtggaccattatcagcctttaggactattctttttttaaaaaaaaaatctatatgcgttattaaactattttgtttatcatttctgttaaagctgtttctcagctagaacacaagctgtctcacttcttgtattt

SEQ ID NO: 51128 - DNA, 787 bp, Bovine  19866880936944
tactgaactatcctgccctcccttcatgcacataagcacatcctattttcattttcagcccaagggtaacatggaacagcccctgggacttggattccctctggggcagactcaacccttggtgtgtggtttggtctagggccccaacaaaactagctcatggaatgcaagctgcacaccctacaaaaatgagaataccagggatggggaggtaaggggcagccatggcccatgcaggtaggctgctctagtctcacccttgcttctttcaacctctgcacacgtaacttgtagtacaaagaaaggagccctaaagagaaaatggccaacgccccttctctatccatttaccacatggggaaactgaggctcaagcagtgacttgcccaaggtcacagctcaacacaggtctacagcttgggtctttgacttaccagactttgctcctggagcccaacaggatacaataaatgtatagacattctcatgccaacaccaccaattcaggccatgatttgagtcaagatgtgtttcctctatgccttgattttctcactacaaaaaaggctggtaataactatccttcctctcccccagcagaactaagtgtgtgtgtgtgtgtgtgtgtgtgtgtgtttatatatgcttcaagttcactgggaggcaaggagctatttaaatatgtgtgtgtgtttgtacttacacttttttcttcctgacctagttgaagtggtgaaccattttgggactaggtgaaaatggcacgtgctaattctccccgcttttt

SEQ ID NO: 51129 - DNA, 1597 bp, Bovine  19866880999514
ttgcctgaagtttggcaagagctggtggaacaagttggtggcagagcccaaggtgtcttgcagagacttaattgataagaagcagaaaagccgatggccaagagcccagtccttacctggcttatcagcatgcccctttcacaatcattgaaactatgtctcatggacacttttgtagatggggaattccttgaagccagacgatagatttgtgaagtgatgaagcttcagggagaaaaattaccactgcaacttatttgtgtaaaaatatgggaaccagaggttcattttcagaaagagcaaatatgagggactctgtgaatcagtaagatgtaaaaaggtacagactgggaaactgattcggtgacttggtgaactagtaaggtagttttcctaaatgagagaagaagaccatgattaaaaataaatgctttggaggaagaaaccatcaaaaatttcaacaagttcccatcgctttaggctcaactgttgcactgttggagatttattctaagaaaataatccaagtctaggaaaagggatggtaggaaagtgcctatagaggtattattgaggtgaaatggagataacataaatatcccagttatttgaagaatcatttcaaaatgctgatataaatgacaatatattcactaaagttctattttgaaggtgaagctccaatcctttggccacctgatgtgaagagcagactcattggaaaagaccctgacactgggaaatgttgaaggcaaaaggagaagggggtggcagaggatgagatggttagatagcatccctgaatcaatgaacatgaatttgagcaatctctgggagatggtgaaggacagggaagcctggtatgctgcagtctgtggggtcacaaagagtcagacacaacttagtgactgaacatattttgaagcattcaaataggttgttctaaagaccacattggaattgctcattgtgtggtgcttatgaaaaagattagaatgcaaaagtatatttgtgctacatgtccaacgctgtgagaaaatatgcttttttggaaaagacaggaaagaatggaaatagatgatttataaagatagtaagcttgtgggtggctttttatttccataatcatggtatattatgtatttgtataatataaaaaaattatgttaatcagatgctgggaagaaaagcaccttaacacaaggtatgttgcacccagcagtatttcagtgatgctaaacattagatatgatcctttccattccctcatcttcaaacacaggtccagattagatttatttcactggtgacaagtttgaaattgtgcacttgaaaaattcagaaagactttgaacccacagctattaatacagatatagatatacatataggtatggatagatagacatcatgagtcctctcatgagtatcagatgcctcatgcaaagtaatacctgtatatgaagagtggaagagattacaaatgtgtggatttcagtgccctgcaaaaagcaagagaaagtaaaaattaagggagaccattcttcaagagatgggaataccagaccacctgatctgcctcttgagaaatttgtat

SEQ ID NO: 51130 - DNA, 1132 bp, Bovine  19866881158224
cgccttatgaaagagggctctctttctccttcctccatctgaggacagtgggttgtcagcagaaggccaccatgctgactgcacccagaccttcctaaactgtgagaaatgagtttctgttcttcagaagccactcagcctgtggtgttaagttatagtagcctgaatagactcaaacacgtgaatccctctagatttgcaaaaggctttttttctttcatgcattagtctaccggccactctccacgtcaggcaatgcacccatgaacatgtgagagaagtcaggctcatcaagtccaggtgacatcatgcccaaggtcacactgctggaaagagcaggggcagagctgagaggagagctgaggttttctagctccgtggtgagcactagctcttctgcccagtgctgcccattgaaaacctgattccccctcctctgctcttaccatggttgcagccgaggccaagagtgaccctctgatgatgtgaggctggcagctgccttgcccaggccaggatgctctgggaacagctgtgagcagctctgcacatgctgtgagtcactgcgttctcgccttttccgtacacgtgctctcttcactcagcgcctctgccctttgaccgcagcagcgatgtggagacaggctgccagcctgggactgaccaaccgcaaggtcctcaggcgccctcggccctgtggctgagatgccatctggcactcgccacagctgcagggcctccagcctggccccaggaagggggaggaggggaacaagatgaaggtgtacggagagactgcctgactttggtccagatgggacaagatactgatcccctacagactcagcgtcttcacctgtaaaatgaggagaataaacagttccgacatcgatcataatttcttgattctgaggttgtctcagtccatgatttttcttcaaggaataagtctcaagccctgatcccctaatagtaaaactttgccaggcacggggacctgtcagtagaaataaaagggcaagaaacatcagaaggacagagatcagatgtagaagctgctatcaggattaaatgagttagtgtagtattttctaggtcagaaagcctttgtattaatagggtagaacatcag

SEQ ID NO: 51131 - DNA, 1084 bp, Bovine  19866881442215
cttcaaatttgttttcatctgcacttctcggtttaagagcaaagtttaatgtttttcatgtgtttttgtttttgtctagatcatattattaaaattaaaagtaagctgccataaattttgagagttttttaaaaaactctccccaagcatcccccaaaatatttattaaggaattcaactttccaaattaatccgatataattaatcaaagagcagtgtcaaactaatttgtcttttctttagctggttaagtgtctttcatgtgcaattcaagttctattaggaatgttttaaaggatcttaaaaataagacatggctattaactccccaaagtttacattccagtaccgttattaccatatgactgatcgggattcaaaaattgttcagtattataagaagagaacagaacaagggttatgaggaaagaatggggaaattatttctgactttagaggtggagtatgaggagtcagagaaggcttcttggaggaaattgcatctgagttgaatgaaaagggtctctgaaatagggacctgtttcagggcagtgggggaagtgtgttggtgagaatattttactcattttacatagggagcttctgagattgttttcttaatattttaattgtattgattacagttgatttacaatgttgtgttaatttcaggtgtagagcaaagtgactcagttatacatatacatatattcattctgtgtgtgtgtgtgtgtgtgtgtgtgtgtgtatacactttgagtcttctaaggcatagctactctccttcttgtgggaaaatggagccaggcagggatgaccaattcatggccagcaggtcacatgaaagggacaggtttccctgtaagtttcattttaaaaacaaacatgaagacaaaaatcgaccggtttcgattgtctccacaacagtaaaattatattatgtattttgaaaggcctgaaatttacagtgaagctcagggcttcccagtcccttccgagacatggtacacaaagaaactgatagtatttctttgttcttctggagtaacagacccacatgttattcgggacaactagctcagag

SEQ ID NO: 51132 - DNA, 2458 bp, Bovine  19866880172380
atggtaactgcagccatgaaattaaaagatgcttactctttggaaggaaagttatgaccaacctagatagcatattcaaaaccagagacattactttgccaacaaaggttcgtctagtcaaggctatggtttttcctgtggtcatgtatggatgtgagagttggactgtgaagaaggctgagtgccgaagaattgatggttttgaactgtggtgttggagaagactcttgagagtcccttggactgcaaggagatccaaccagtccattctgaaggagatcagccctgggatttctttggaaggaatgatgctaaagctgaaactccagtactttggccacctcatgcgaagagttgactcattggaaaagactctgatgctgggagggattgggggcaagaggagaaggggacgacagaggatgagatggctggatggcatcactgactcgatggacgtgagtctcagtgaactccgggaattggtgatggacagagaggcctggcgtgctgctattcatggggtcgaaaagagtcggacaccactgagcgactgatctgatctgaagctacatctgcagtctcatcttccagagtatcctgaacatgctccagccacagtgactttgtgccattccctgtctgcatccctgagcttcctcccacacccagtgtcattgcctgtagagaccagtgtccacatgcctccttctccacaaagcctttcccaatatccaggcaaatgttatctttttaccatctgaccactcatgtagcattaggcactgacctttgacagattattttatatcacacttatttgtatatggaacatattcactattaaattataagcttttttgaaataggaattcattatatttcacctttgttcctcatcattaccatatcttacaaaatgaatgaatgatgaatgcgagtagcttcttttgattttctgattatttgtaagcccaaagaaagactcaacctataaagcaatcacatacaaccactcctaaattgtttttgaagaattttgattagagcatttggcctgaatcttccaagatcaatcctggcacattgacagggccctgagtttcctgagacttaataacaatgtaatcactggtgtagtcagtgatatgtataaaaatggtactacaagaatgacaagaggtaaacttctgccaagaaaacctccataggtgaacagctggatgaatctatacacatcataacctaatagaactaagatcagatttgagtctaacattgtattaatctttcttcttaaagtattgtcagactgaatctcagtctctgaaaaccacactatcatgcagacacacaccatcacaactaattagtccagttgcagctcacagcatgctgtatgtggacattctctaaatcatcccccttgcactgaggtttaccgtggtgactaatgaaagccacttaaagaagcaccttgcaaacctctcctggatgatagaaggttgaaatgataacattttctttgaggagagaagcagttgccttacagcgctccttcaaaatacaatggattcaataagaggccctatcttttgattttatagtgcgaggtcacaggcctttaggcctttgacgctataaacatgtacctccaaaaccaactctttcagaagttatacaggagacaatcacaagaagcatccatttatctctcaaggagaaagaaaaggtttgtgcagactttgtagtcagttttatgctatcttacatgcatgtaactcagataatgcttcctttaaaatgaattgtcttctctctctctcatctataatgctatagaggggtttttttgtttgcaagagtgctattttcacaatagtatctgcacaaggaagacagatggattatagaagcacttagctaagagtgtagtagttttgtcatatgcatttctttatcaacaaaagcacaatttctaagatatacaatgttcccactgatctagacaatttaaaccaagcatcacaaatttaggggggaaaagcagaattaggtgagaaggaagaaggagaagtggaggacagaaaaggaaagagaagtggaggacagaaggaggagaagagaaagtaggtgagagaggaagcagaagaggaacagatagagaaggaaagaaagaagagaaagaaaaagtaaggcactagaaagagatcagttactagcagcaagattgacttaaacagcatcaaagaaagcaactccagttccaagttatgcagctcacccttattggatcataacaactgaaatagcaaaaatacatgcaaagatgttaaaattacaatttaatcaggtaacgtggttgattatcctgcatctatgtatcagaggggaaatgttaatcgccagaggaagtaatttgtcttatgtgtaacaggttagcaaacttatttaaaaa

SEQ ID NO: 51133 - DNA, 1298 bp, Bovine  19866880375964
aaggctgagtgctgaaaaattgatgcttttgaactgtggtgttggagaagactcttgagagtcccttggacagcaaggagatcaaaccagtcaatcctaaaggaaatcaaccctgaatattcattagaaggactgaggctgaacctccaatcctttggccacctgatgtgaagagctgactcactggaaaagaccctgatgctgggaaagattgaaggcaggaggagaaggggaaacagaggatgacatggttggaatacatcaccaactcaatgggcatgagtttgagcaaacacagagagaagaactttcttgtttataattccatgactagtgaagtcagcaccaagacctaaaaatcgttatagctctagatccaaaattccctgctgtcattctgcctattatgctgtctccctctgcttagtggtctggatgcctttttgtggccctccatcgcacagctggttaacactgcctcctcataaatatccagcccacatagtttaaagataagggtgcatttcttcaaaggcataagcttgttttcttcattgataccatacaaaataaaatataaacaaaatattttctgtgctattttccttggctagaaataagaagcagctcatcaggtcacaactgagcattctgctttctagagtgtctggttggggggactagtgaacttctgtggagcatcaggacaaaactgttgtcagtaaattaaacctttgaactagctctactggatcagaattccagtctcagcaacataattttgaagaactctgtgatcctgctcaagaaaattaaccaaatgtctcattagtaaaaattagtcctaatatacttactgcttttaggattgttgagaggaataaataaggtaacacatgtgagtgtgttatcagtaaatagtttaatataagtttggacaattcaaattatgatcttcacacagcccctgttgtatatggctaaccatgttttgcaagagttaaattcactgaggtttgatcaagattctctccagaggcagcaagcactgatggaccaaaataattaccttaatcattctcctgctaaaagtctttcaaagatctcatcacctgcaggataaaatctgaactgaaatatggcatgaaaccaatttgttgtctaccttctgggaatttttccaacatacctaagtctctcttccatacacacactatagcccatccacactcaggatatttgcacatgctattccttcttctagaatgccctctgctctttgttcttaagactgctga

SEQ ID NO: 51134 - DNA, 768 bp, Bovine  19866880432485
aatgacatattcctgtgttctttgtctccaacacatgctgcaggagagcacggacagttattatgctttaaaaggttgaaaagaaaatgctgagacctgtaggccaaataccagagagcacagagaacacaaatcagctttctgtgtcacctgggtcttgcagaaagtagagggaagaaaggactggcttcgtgtcctgttgctattaacaagctctccactgttatttcttatccctgggtcagagggatattgaaacaagatcggtgcactcctgggcggatttgcctttccttcttccatctcactcagctctgccctgacttcaccccccacttctccacccctgtcccctgccctcgtttctgccctggttctatgctctggtacttagatccctttctcagtcccctgagctgttcttggcacaggtacagctgccgagaggtgctagtgaaagggctcccaaatgaccagcagtggccgggaccaggaaggctttggaggcatgtgactacttaggaagagcagtctcatggcctaaaacggcactgctttctctcaagacacaaactgacaagtggttctgctccacggcagtctctgcttttaactacagttgttgcttctccatcaggcctcacccacaatggccagaggcacagagaattttcttcatcagcaagagtggtattcacagctggtgtttttcccatccagcaccacaccgggacaataccattatcaaacaaacactcatgtaacaca

SEQ ID NO: 51135 - DNA, 2572 bp, Bovine  19866880481187
tatctctgtgtttttattaacaaaaaaaacatgggttttacaggaaggaggctgatagcaaattcgaatatttctatgagggatttactaaagccaggctggctatctggctgggaaaggaacatatttgcagaaacatttacattttctgagaaagtatctcatgccatgtttcctgagctgctgatccactacccaggaattctgttagaactgcttttctttggtaaaagaaagatctttcttcacatcgcatctcacccctccctcatctattgaatctcctccatgaaacatcagaagtcagtccacttattcacagactttccatgtggcaggcagcatgctaaccaccaataatgatgtatgaattgcagcactgatgtcttttgggagaatagcaaaaagagccttatgtttccaccatgagaatttcatcttcctgcacaaggaactctcgtctttaagtaacagtgtgtgagtcagcaccaccccgccccaggatagagctcctgcattacttgaaggctgatccctggagaaacaagcctagttcctttttcatcctgcttcatagcaggaaggaacagggatgcctctactaaggctttcttagccctcaccccttgctggaaacagcgtttgtggcatggttcactgcttaacaaatacaaacactgacattcagctccattttcccatgactctgtgtaaatcaaaattgggtcataaacgctgcctcctataaaaagcaataggtcaagaaaaccatttcataacttaatgtgaagaagtagtcagacccacgttaccatggcatttatgagaaagggagacagaaagaaaacagcataaaaagtgtaaggcaagattctttttcaaactgaagagattcttgtgccaatatgtttttataggaaaatatctggtattcagatatatttttgcccgacagaaggaagcattgtcacttctctatgtgaatactccccagagagaggatgtatctacttaagggtaatcgtaatttgtaggggcaaagttcttaccctccaaaagtttatctgggtaaaatcaggttgaaacaaatatctgagcgagccttgaagagtaaagtatataggaaaatacctttatttgtagcttgctgaagcaaaggcgtaccatgtgatttgactaggtcaagctttgcaaattgattaaatgcttccaggggccataaatgaataatgcaaagtgggaagggacttgtagagacactggcctaaaaggcagaatgtgtgcccaaattcaacttcatatacctacatggatggtagatgcttcacctgaggcactagtttagaattatttgagtacatgattttctgcagaggaggataaatgggtttaaatttgcagtcttttctgaacaagctgaaaagtaacctactttttttacagcataccttcctgagtggatctccataagctctggtacctctaaaatcctgggctcccgtgaactttttgcaccaatttgctttccaccacagagagaaggctttctcctggcattgcccctgccatcctacaagtgttacaaatacccagatcttaagtaccactgggtaccaatattcctcagctcagtctataaaggctgagctcactgtgctcactgcagtctcatctcagggggctgtttagatgcattctctgctgtaggtaagactcctggggccccagctggcacatgaacatgtgactagtctcaggaggcacagacaagaaggtatctatggatctgagtgaagagttttctttcagtcctcattctagactttaggctacattttggtcctcattacagcctccttaaaactctgctctgttgggtttcttttgttttctagatatcttcgtacttcttggtccttctgtgaatccctcatgagatgtttctccgttaactacctcttgcaccttatggttccttagggttctgtcctcaggccatcgctattataaagactctccccacatgaaaggagggaaggaaatgatgtgtctgtataaggggaaaacattagtttccaggaagacagagagagggctaacgagaatcaaagcttgtaataggaaatcttccaaatggtatgagaaggaaaggcatgagcttcctagacgtagcacagcaactaggaacatgaaggctgtgcattccaacatcattataaagttacaattataacatcatggattgagttccactttacatgcatttacatgcattattacatcatgtaattgccagttcaactctaccagatattattcctgcttcaactcaacagaaaaacctgagactcttaagaggttaagaaattttactaagccccttggatgcagaggttgagagggattcatatcatggcctgactacatccaaagttggttctccacattatactatgacaatatacctctgatggtaagaattaatctttctgccttagcaggtgaaatctctggtgagtgacatctctgagactctagggaacttcatcactcagattgggggaaaagcatt

SEQ ID NO: 51136 - DNA, 2030 bp, Bovine  19866880569605
cattgcaggtggattctttaccagctaagccacaagggaagcccaagaatactggagtgggtagcctatcccttctcccagtgaatcttcccaatccaggaatcgaactggggtctcctatattgcaggaggatttaccaaccgagctatcagagaagccccaaaagtttcttggttgattctaatcagcagtcagatcttgactacttccaaaattttctctattccccaagttttatgattccaagaatctcccatattctcttgtttcaaagcccaaactatacatatattcccaggaggaccaaacatctgagtcttaaaacttcccaaaactaaaataaaactttacctgagtgttttggaggttttgaggtgttttcgtttttttttttttttaattgggcaaagtgaaaaattataccatctgcttctgagtctctggtggatttatccaaggtaattcaatcatatcagaaaaaaatgagtaactgactggctgattcttctgacaagtgacacaactctgtcctgttctcaagcctgtagcaagacactggctctgacaccggagacagtggtgaatgcttcagcagctgtcttgccctcagggaaattgagacatgcacgtgatttataccagggcacacagcaagccagggggcagtgccagaaataggagctcccactccctcctggcagaccatgctccatgtcgtacaccctgaggatatgaaagcgatgtctctcatctgagcaaagaagcggatagagagatttccatttagaggttcataaatgctactctgaaaggaggaagaaaattcccctttcaggctcaatcaagcctaaaccaaggtgagagaatggggaaatgttatttatttttgtaagatgaaagagtgttgtatttattcacttcttgtcagaatcacagaggggcttcttttccctatcattcttcatgcctggtctcacgcagtgctgcttgggaggcacaatggggccaaacagataggggtgatgcctatagctggcctagaaaaaaagagattttttttgttttctttataaggccatatcatagttgagttgattatatttctaagtgcctggctcaatgcagaaacttcaaaaatataacaagggaagtgctaaatgtcactggagaagctgaaaaaaaagataaatttcttttcccaacaattttaacctattcctaagaaatgaatcaatctctttaggctgaaactatgtgtagttatacatttctatttaaaatatttccatctttttcacatgtctttctgacatgcagttaattgatccctcaaggataagaatgaagcttacttttacatacatgcatgcaggtgtacacacacacacacacacacacaacttcatagaacccactacagtgtttcacactcagggtatttaattcatatcttataattattcaattatagaaataaatgaatatactaaataacatatatttaactatattaaaagaaatatgggttggatggcagtaaataagtgttgagggcatggcagaggagggaaatgtttaaaacttactctttacatttcaaacttggataaaaataatggtagaattattggtggggttttctatgtttttctgtattcttaacatgtatataaaggacatttgtttgcttcatcatgcaaaaaagaaacaaatgtttataaaactggcaagtactaatcacagcacacaagtatacaagaaatatgtagtactatattttctataactaagcttaccttctgatgccatagtccctttttactggacagatggaaactttatcctcaaccatttccctgctaccagggaaatgggggaagtgaggggacatcagtccacaccagttggacattgattcttgcagtacagtagtgatctctctctaccaagtcagggctgagacttaaagatagggttgagattctaggggtgagatgggcatgaaataaacaaggcagggacatgggtg

SEQ ID NO: 51137 - DNA, 1553 bp, Bovine  19866880581964
caagcatgggacttgatgtacagaagataataaaggtccaaattaatgaatgaataggtgaatgaccaacacctgtaaaataatttatcaatatttctactcatatttaagactatataccctgggtaagtgaggtactggaggatgcagtgagtagctatagaagggaagagaaaatggaaggagaaatggaagcccagcctcaaacagaatgcagggctggaaaacgatgtcagcaaccaagatactttatatacagcaatccaaaatgacatttcaacaaagacagaagtaattcctattgtcttggaaccagacaaaatcactggcctctgcaaatatcaatggcatgcccacagtcaagaacacattttgcttatgtgtgtgcggttggtgttttgggtttatgactgttagccaaccagctgggcttttctcaggcagacttcagcacagcatccggcattttattctttccatagattagacaaattcaaatactagaaccaaatctctagtgaacaaatcctctattgccactacttgtatgttcaatttaggaaaagctgtaacatcaacccagatctagagaagtatacatcctaagtgaacattttatgtttgaataattttcagtcttttccaattaatgatttcttaatattaaaatcttgctattttgtgctctcttgaatagcaaccatttaatctattctctcttaagatgcttccacattttcatctggaaatcttttcctcattttacatatgagaaaactgagtatttgaaagccaaagaaacttgtccaagaacttcacccactattcgtgatggggcagagattcaaggccaggtctttttggctcagtgtcttggcttcatggtcttggtctcctcatgaccaatgtatagcaaatttccactccttagacaaatttctccgtaggaggccttcacattttctatttttagttgttcaccataaaacatatttgaacatgaaagttttagaattattcataaatttcttcatgctatatgaccttctgctagactgtgaacaatgtgaaagaaaaatggtatttttcttaagaatcaattttattcctttcatgaatgtattggacaaatacaaatacacctcatttgataatcagcctagagctttccttaagaaatgttattttaaatttcaagtaaaatgtggatatagtcttatgaaagattcaaacaacaaagaaaaagcaaagccctcctcaaacttcagtcccacgtccagggtgtagccacctgaactagttattatctagattcctcagcaacaaattcaccttaccttcttatgtttgtgacactgctgctggggctgttcattgccaactggtatttcccagactactctaccagatggctttctgggaggttttatcaatagggggtagaaggagacagaaaagacttctcagtttttttccaataccattcagtattagtcccagcagtgggaatttgccccttccgtctctgtgtcttttgacaattctgagaccag

SEQ ID NO: 51138 - DNA, 1900 bp, Bovine  19866880585282
tcaaagctatggtttttccagtagtcatgtatggatatgagaaattggactataaagaaagctgagcactgaagaattgatgcttttgaactgtggtgttggagaagactcttgagagtcccttggactgcagggagatccaaccagtgaatcctaaaggaaatcagtcctgaatattcattggaaggactgatgttgaagctgaaactccaatactttggccacctgatgtgaagaactgactcactagaaaagaccctgatgttgggaaagactgaaggttggaggagaaggggatgacagaggatgagatggtcggatggcatcactgactcaatagacatgagtttgagtaagctctgggagttggtgatagataaggaaacctggtgtactgcattccatgcagttgcaaagagaggggcatgacggagtgactgaactgagataatgactataatttccatcaaattttttatgttttatttatctgcctttagtaatattgtttttgtggttttacttttccccctgcattggatattaaaaagtaattatgatttaaaagtaccttttcaactgttctgttactgatgattcttcagcttctgctggccactcttggcaatgtattcgtgtattttcttacatgctttataattttgtcagctcacttttttctaaagcaatcccatttattaatagatatattaaaaccataataaaatattaggaaaacaaatgtaccaatgtatttttaagaatgtactttaataaagtagggtttattctgtgaatgtgcgaatggcttgacatgaagaaatttatggtcataatttacattaatttaataaagggaaaaactatatcatttacctcacatgtaactaattattgagataacctcaaatcacaaaattcaaattgatgcattaaattaaatatctatctaacaaaattcttcaaaatgttagctcacttttgatgaagttacttattgttggtatttcatctttgatttatgtaagtgactccattgatagtttagtggttatctctgatatagtctaatatattcactcattctggacatgtttttatgttagacttttagcacagtgtctccatggaagcagtagaagaatttgaatctcacacattgatagatataggctagggaatcttatttcttgagataaaatttttccctttcaagcctcagaatagatagctcatattcatgtcatgtccttagtaggtggagctttgcgaatggaattttcctgacttcccacattattcagagattgtaatttcagtttcctataggagtactaatcctcaaacttcaaggattccattacactcatctgatttcaatatcctgttaccactgtgtattcccttttcatttgtggtacctgcagaattacactccttgctttgaatctttactatttatttacattaaaaactattttcttctgaatagttttctgtatttcggaagtagtaggaggtattcgttttttatgtcggttcagcctgccgttttgactagaagttccactttaacctttctaaacttcagtttatctgcaacattggaataaagataacagctacattgtaggggttgttgtggggagtaaatgagataatgaacataaaacttttatttactggacacatagtaattgctcagtgtacactattagcatgtgaatcagctactgcacttcctgccaaatttcagatactcaataatttatcactttaatctataattatgggtatttgtatatatcctcatctcagatccattcatgattgggaaccatatcaagaattgaaatagtcctagcaaatagtgtcagaactattcaaatatttctacact

SEQ ID NO: 51139 - DNA, 878 bp, Bovine  19866880662854
ggagaaggaaatggcaacccactccgtgttcttgcctggagaatcccagagacagaggagcctggtgggctgccgtctatggggtcgcacagagtcggatacgactgaagcgacttagcagcagcagcagcaagaggcttccctggtggctcagaggttaaagcatctgcctgcaatgcaggagacccaggttcaatccctgggtcgggaaggtcccctggagaaggaaatggtaacccactccagtattcttgcctggagaatcccatggatggagaagccttgtaggctacagtccaccaggtcgcaaagagtcagacacgactaagcgacttcactcttcactcactcaagaggcttatggtccacattagaacttagaggctctgagaagtcctgcactaaagaaatctatgaacctctgctgaacccagtagcttcaaaactttttaactacataatcttttttcctgagaacacttattaatgtctgctaggactctcatttctacctgggaaattctgtgaatttacttcaaggttaattttcatttcacaggaggttaaaaatgaagtttgacctataaagtgagttagaggtagtttgtttaaattataaagaacttaggaggcaattgcaaatgtccccaagagcacacattttcttcgggctcccaatccattaattttagttgcccattatctgttcattcttctcaaggtaccttgaggttgatgatttttgatgaatctgagaatataaaataacatttacagataatcaacccatttccagaacacaacttctgggtataaccatttattctaccagttgcttcaagtaatcccacattgccacaaaggaagacaaaaaggta

SEQ ID NO: 51140 - DNA, 958 bp, Bovine  19866880667053
taaagaaagagggaaaagtcatctctccctaaaaaatttttatagttccagaggttaggaaaactgccataggtcaaaaagtgacttaggatggaaacccggatgcaaaccagttgctttctcttcctggactccctttagtcctgtgatctgagtctttaatgtgcttttcatttatatgtagatttcttttagcatgtagatttctacttccagtgggttttacaacaaccccatattttgagatatttggaatcccagacagacttttgctgctttctggatatttttgaatccaggcttttcaataaccaagattgaaaagtgtttgagaacctcaaagtttctatacaacagtaacatattgttattattctatataaacaccaagagtgaaatttaacaaactaaataattcatccacaattttaacagggaagaacaaaatctgactccatgttggatctatttcttttactttaacctttgctttccattgcttttgttactataattactaaaagggtgatgtttatagctattgctgttcagtctctaagtcatctccaactctttatgacaccatgaactgcagcaaaccagacttccctgtccttcactatctcccagagtttgatcaaactcatgtccactgagtcagtgatgccatccaaccatctcatcctctgtcgccccattctcttcctgccctcaatcttccccagcatcaggggcttttccagtaagtcacatcagtggccacttcacatcagtggccaaactattggagcttcagcattagttcttccaatgaatattcagggctgatttcctttaggactaactgatttgatctccttgctgtctaggggactctgaagagtcttcttcagcactacacttgaaagcatcttcagtactcagccatctttaggtccaactctcacatccatacaga

SEQ ID NO: 51141 - DNA, 1287 bp, Bovine  19866880778343
cttcattttctggggtttttaatatatttctaactgcaaaaaattgtaaaaaaaaaaaaatatccagcctcaaattttaaaggttaaaaatacatacagtctccagtagaagagctgagtagaaaaatgatgtctgtggaagattctggctttttgattttatggtttcagataataagttccctgaagtttcttgaagtatgtacccatttgactgtagtgattaaaatcagtttacattcatcacttgggaattgatgtgtcattgggaaggaggcaaaggtgagcaaaaataccttgctgccccatcaattgcattttgaaacaatgtgacagctactctcccagggaatttcaggtacttgtggtgtagagtacacctcaagtctgtgatagattgatattggaaaggactttgtaaatttagaggtaaaaattatagccaaattaatttgtaaatgtaattttgcataagtagggagttttatgaaatttacacatatatctgctttagaggttaatgttataaggctgtgctgtagtatttttctgcttaccatcatctgtaggacagattttcttcctttatcacaatgcttggaaaagtagtccttgatgtttttgttaaagttaaaacagatatatttataaatataatatgtgatatcaaggactcacatttctaaacaacttattttattctgtgactgtcactcatcaggttcatgattcttgatggacaaaaataggctaaatcacacactttattactgttaaacttaagactcaatcttaggcaagacaactggaagggctcaatttaaccaacagagggttagatttactctattcctcccacccccagtataatggctaagcctatgatctaacattctaatggtgatgaaaaattaagttttgatgtgacagccagcaaacagaggagttcaagaacgttaatattagatgaagatggacactgtgaacactcgtcactgacgaccaggccctaaactcagtcttctttctgtagccctgtggaaggaagaacatccagggagaatgcctgtcacatagaatctgactttcacttggtgccatcaaaatccccccaccctgccccttgcagttgtgatctaataaaatatcagcaaataagacacatgtctcaaatctctccccttctgtgtgagcaaatttgaggtgggagttagcaaagagaactggaagcattgcttatctcatctcctttgctctgtaatcagaatgagcaaatttaacagacag

SEQ ID NO: 51142 - DNA, 2638 bp, Bovine  19866880870774
agagaggaaacttgttaattttatagtgggtgttggggggatggtgtcttaggaatttgatgaagcagaaccttgatgagaaaagccagtagatactttggacaggtcctgtcattctgtcctgaataatggagggggtggtggttgtattagctttctattgttgcctaacaaattaacacaagtttagcagcttgcatgattgattgggttctctgcctaggctgaaatgagtatgggttggtttgggttcttatctggagaattcggggcaagaatccaaaatcattcaggttgcggcagaatctagttcctgtggttgtaggactaaagtccccactttcttgctggttgttgggtggtcagctttctggtccttgcctgtggctttttccatcttcaaagccagtacttgtcaaatccctctagtgcttcaaatctctctgacttgctcttctgccatcaatcacagaatactctctgcctttaaagggctcatgtggttgcactaggctcatccgaacagtctccttttgattaactcaaagccaactgtttggaaataattaaattatatctgtaaaatctcttgccagataatataatcagggacatgatatcttattatatttatagtcctggagatttaggtgggaaatcttcgatggtcagtttagaattctgcctataacagtaatcaagtgttgttttctcaaattaactcttcattgaagccaagcttctgtggtttccctttattacttttatgtacttgtgaactttgcagtttgttgcttgtgctttgtcttatcaatggaatttttccattggttcaaagagggtgccagtctcccagggcactgattcccgggactcatctgttggttttggactttgaggtttgatgttccaagtgcccatcttggtttggaccacacaggaagagccatgagaagcagacagcagtcaacagaaccagggctaaccttcaaacccgtgtgtttttagtgttagagggaaaaaagaaattgctgctgtattcacagactgataattatctcattaaataacttctcagaccttgatttagccattatgaaagatgttttgatcaagaacatctggtgttgttttcaattaaatattgtaccactaaactttgattaaaaactgatttaaaattttaatagccccttctttagaagatggttaaatgcaaaaaagaaaaatgtcgcttatttaaattgttttccccccttcttcgttgctctattttagccagattcccattaatgactgtttaaaacccacacagttttggatgcagtaaatccagatgcataaataagattaccataccaatactgctgttcttactcttttactattgatacctcattttatttttatgctttaattaaattgagtatattttatgttttcagtttgctttaaaacaactgcagtgcatataattgacactatttcatccttgttagaaagtgctgagttgaattaaacataccagttccatttccttacgtttaatctgtggaaaaactaagacagaaataatacgaactatatttcttttccaagttgccttgataggtgaaaataattaaccacttagtaattactaataaagactgaagtgaaatctttactcttatcataactcctacctatataaaaatacttagtggtataaggtagttttacttagtaatttttctcagctaatatgtaacaaataaatacattattgctattttgatgtactccatataaagcataaatcttcaagcacatattttaatatatttttacttaagatatcatgtctaacctaagaattttgggtggggaaatgacattatgccatgcttgtgaagagcaggcttggtaaactttttggttaagggctgcataggaagtagggcttcccaggtggcactagtggtaaagaatccaccagctagaacaggagaggtaagagatgcaggtttgaccctggaggcaggaagattccttggaggaggacatggtaacccacttcagtattcttgcctagagcatcccgatggacagaggatcgtggcaggctacagcccatagggtagcaaggagtcagacatgactgaagcaacttagcatgcacgccctaggaaatattttcagctttgtgggcagtatgatcttgaaactatacagatctgttgttgtagcatgaacacagccagagatgataggtaaacaaatgaatgtggctgtgttccaacaaacccttattcacagaaacaggcagtgagtccgggctttgacccatgcgctgtagtttgctgagcctactattgatgattataaccaagcgctggctaagtccacagttgagaaaaacaattggtcaattgatcggttaggggctgattggggtcctaatttttgttatcatagatttttttttgcttgccttttgcaatagttcgttgtaacttaattgattgagtctcacattggaatttcctcccacatcttgcattttaaaatgggcgtctatgatacttttagaccatcacatttttgcacctggtcttatatccctggatataagtgtctcctagtttatagtctagaa

SEQ ID NO: 51143 - DNA, 1435 bp, Bovine  19866880885979
aaaccctttattcatgtgaattttatagagctggattagggagcaggtcagctgagctacttcctagggaggcaactataatggattctggaataaatcagaaatagggtacttttaaactcaggtttccacttgctgttatcttcagaagcttcaaaatgttcattgttcctaatcctagtgaagtagaggccttcatgtggaaacaaaaacaaaagcacaaaaaatacttttggatggtgatggccaattttgtttttgtgacctcagcgcacatgaagttcactcggcccccaccgagcctggctggccagccagcaactggccaaaattctgaaacccaacgacatgtcactgagtcctgcttactgaggacaaatgctttattttatcacatgaattttaagcccttgaatgtctcctaaaatgtgactgacttggctacatccagatttgcatcctaaataagaaacaaacatttcagaaaaatagaacgttttgttaacagaatgacaaaacaaaacaggataaaagctcactgaaaaagccacataagctgcttttatcccagtgagtctgagggctgggtctgagggcataatactttagcaattaggaataatggaaaatcagtgcaaagaaagacaactgcaaataagttgaagtattatgttaatgataagtatatggggtcatctgttgttccgaacataaaaaatatatataatttttatcaacagaagtcagttcatttctttttactctgactatatactttcactcaatatttaaagaattggcatgaaccattcaccagaccagagagcccatctgtcctcgagtagcctgaccaggtggaatcctcatatgtgtagaatgagagtaaggtctctctggttgaagtgggagccagaagacccacaaccaactttctcctcctgtcctgaagctgctctgtttggtcattgtctgatggttcctaatcttcatctctttctctatactctctgctactgctgctgctgttagattgcttctaatctgcaccaacttcattcttgtactttccaccacttctcagctggtggtccccaaatcccagtgctcagagcagccctggaccccaaaaaagtccatactacatggcaagtggtaagagaaaacatgaatcaccctgcagtgagtttttgcaaagccaaattaattaataatacaaaccattttttttcatcatgggatatctaccctacttgtatagttgttaaaaaattcttccttttatgaaatagtgaggatagcagattaaataaatcttttgggaggctaaatataaaattattaaccctgtgttagttctcaggattttcagtaaaattgtacgtgtctgtaaaattctaaaatctgggcaccactgtcttaaggtacattttaaaga

SEQ ID NO: 51144 - DNA, 1272 bp, Bovine  19866880921873
atgggcttcacaagagatcgtcactaattctctaaattagaaaatgtgaacatgttggcagattaataatcagagtggacagagtaactgagccactcagaggaaagactgaaagagcaatgacaacatctaggtaatcacacaaggactcgggggaaacggaatggatcagtcaaaagcaaaaagaaactgtctgtgattttgaagattttctattgaaaaagaataggtgccacaagtcagcaaactaaagcagtaaggccgctgcaaagcaaatccctaacttctttgctttacaattcataaaccaaatgttaggcggataagaaatagaatatgtttgaggcatatgttaaaggtgttaaacacatggattttgacatatttaatttggaactaaaacaattactgctcataatacacccaatttctgaaactactaaattcagtgtgacaatttctgtgtttgtattcattttccttaatgtcttgagttttttttttttcagctatccaaacatttttactaatccacaaagcataaccaaaacttcccagacccactgttatgaatgaaatgacaaagcaacaatacaagcaactgttaataatttaaggcatatagtaacattttttaaagtcatcttcgggcagtatttactaaaactcaattaattttctgctgaatctcttcgaacttgttggccagtgctaatttacttggatgagtacatgtttctctgcccaaacatctttccagaaaccaactcctcctcttgactgcccaatacatcctttcagtcacccttgaattctctttgattctttcctgttttgctacattcagtctgaagcaaaagagtacaagacttttctagcacctttcccttttcatcacattcctgcaatactttacaaactggctttccctttcatgtcactaaatggagaaattattttacaaacttctagacagtttcccacatataatagaagtccaataatgttagttcccttactctgcttttctttcatctttctggtctaaactctaaaccgcctgaagcacaattctgaacagattattccatagctcagaagcctctaaagcacttctttcttgaaggataacccgctcagctcagcattcagagatctctgcttcctattcacatttttcagttttctctcactgctgtcttataaacaacgcttatgctttagacactaaaccattacccaatggcacacacatatacctccgagcttcca

SEQ ID NO: 51145 - DNA, 1183 bp, Bovine  19866880950653
tctctggtgctcctatgtcatttattatacacatcccaagtactctctggccttcagggggttccactaatattacaccccctaggatcccatcccaccttcatttctcattacctgtcactgcaatctctctgctcccacaagcaaaatatgcatgccatctcctacatgtgatttgctcattttcatctgatatcttttctcattcaaactacccacccactgacctacaaattcattcctgctctctccatcaatatcctgttaaccttcaaaattctgctcatccctcatctctttggaaagtccttcttccttaattgcaaacaaatatgagatttcttttgtcctttattccctcaaaaaagggcgatcctctggttgttattgaaggtggggacatggtaagataaagagattcaaggcaatgcattagtttgggtatcaaactgcaaacagtttcgtctaaattaacaacaaataaaatatctcacaaataaagaaaatggttaaaggttcacataaagctttcttactcattttataagggaaataaccatgtataataaaaattgttgttgttgtctagtcattaagttgtgtctgactcttttacgaccccatggactgtaatcctcctggttactctgtttgtggaatttcctaggcaagaatactgtagtggggttgtcatttccttcttcagggaatttcctgaccccaggtgtctcctgcatcggcaggtggattctttaccactgggccatcagagaagcctcaatagctgtcatttataagggatttattttacttcctcaaaggactttatacatactaacatttcatttttaagtaagttatgtgtcatagtcatggtacaggcaagaaagctgagggtcagagaagtaaaagtaacttgcctgaagtcacagagctagaaataaaggcagaatttgaactcagatttgtccttactccaaaatctgtgtcctaaccacctaagctactgtcacaaattcttaacagcattcataacattcagttttggcagtttctgaaaaagaaattcacaacttacttgacagatttcattttatcaattggcacttgatagtatcaaatttttgtcccctttgtatacaattcctcctctttctgccaccctgtctcctggtgagattgc

SEQ ID NO: 51146 - DNA, 746 bp, Bovine  19866880966656
ccttgggaagggaatggaatggaatgaagtgggcaggagaaatcacaatgcattgcacacagtaaaagcacacattagtttctgaaacttacattttgatcatgtaggcacgtgtgcctggaaaatggtttttgctgctaaagttgctgctgttgttactttggctctgctccctcgctgatcagtctctttcatttatacaagtactttgatgttagacaccaacagacatagatcacggaaatgcccaaatttctgttcaggactttggcccagtgtttatttcagccttacaactgctgctgccacttcacttcactcactactattgagactgtgattccttcagggaagcttcgagagacttctttatgaatacttgaggcactactgggctcactccaggacagaagtttacatgattcatgagagttgtgcctgcagttgacaaagacaaggcaaactgcacaagagcaactcatctcttccctaactttacgtgaccatttgacaatgcaggcagctatcatggaattcagcatcatgaaaaaataaataaatagaattttttaaatgtaggtgcaccagagaagtcaagacaaatatttaaagaacagttatacccaaaagtaatgtcaatgtgatagcgaccaggtgataaaaataaaataggtacaacattttttagccaagtttagaaatagtcccttcaagcaccagaccattttcatgttcaagaggataca

SEQ ID NO: 51147 - DNA, 2176 bp, Bovine  19866881055129
agatccctagtctttcccattctgttgttttcctctatttctttgctttgattgctgaagaaggcttcttatctcttcttgctattctttggaactctgcattcagatgtttatagctttccttttctcccttgctttttgcttctcttcttttcacagctatttgtaaggcctccccagacagccattttgcttttttgcatttcttttctatgggaatggtcttgatccctgtctcctgtacaatgtcacgaacctcgttccatagttcatcaggcactctatctatcagatctaggcccttaaatctatttctcacttccactgtataatcataagggatttgatttaggtcatacctgaatggtctagtggttttccctactttcttcaatttaagtctgaatttggcaataaggagttcatggtctgagccacagtcagctcctggtcttgtttttgctgactgtatgatccagcaattgtgattcttggtatttatccataggagttgaaaacttatgtccacataaaaactatacacaggcatttatagcaactttattcataattccccaaacttagatgggcaagatggtaggtgagtggataaagaaactgtggtctatccagataatggaatattattcagcattattattatgttattcaccataacatattattaaaaataaatgttatcaaaccatgaaaagacagaggaaacttaaatgcatattactaagtgaaagaagccaatctgaaaagactacatactgcttaatttcaatgatatgacattctggaaaaggtaacgctttggtgacaaagattagtggttcctaaggatgggacggtgagagagggatgcatacgtccaccaaaaagaattttcaacgcaatgaaattattctgtatgatatgttaaaataatatgtatctgttattacacagctcaaaactatgaatggcctcatggaggagatccctattgcccagcatgaacacccaccttgaacagttcaatgaatgagaaacatacaaacctctattgtgtttgaactcattgtgtattttgtgtctacttgtcacaggagcttgtgttacctgaatacagatagcatattcaggcaaagatgaatagagatgtattcagggaaatatactgggagttaactggaatcctaaacagtggcttggagaaggaaatggcaacccactccagtactcttgcctggagaattccgtggacagaggaacccggtgggctgcacagacagtggggtcgcacagagtcaaacatgactgaggcgatttagcaaatggtggctaggttgaggtaggtcacattaaagagctgagtttccttctgttagcagcaaatcaaagcaaatccatactctgacaaaattaaacagtatgcaggtacaatatattttgaagactacccataagagcatgtgacattcaaaactgaactttggacattcacatgagtatcttcttataccatcagtcttttattttgcaaagaagtaagcctcttgaaatgatgtccatgcttcaagttttgcacttgccattccattagtgagcactcactggttcattaatgtgtgttagtttcagttccactgacaaatgctgtaattagcccctgacaatggaaaaggacacccaagtcaggaatacagaagtgttcctactctaagaaaaactgaagaacaaacaaaaacaaagattgcagctggcattatgctatcagagaaaacggaatgttatcaaagatattactaggctctttcaggcatacttttccccaggccagaaatgtggaacacagcccaagaaagattggagataacaagtatataaaagcaatactgaaggaaggaacaaaacagaaattaacttgaagcagaaagcaagcacttagtgcaacctcgcttttctgaatcaacagtttctctctaaagggcaacctgcaagataaatgttggacatggtcagaaattgtaatagggttagaagaagcaaaggaaaaaaactgtctttcaattgagaagaagcatgagatagattttgagaacccagattttactagactccaagggaagtttggagtctaggacttccctgtagctcaaacggtaaagaatctgcctgcaatgcagga

SEQ ID NO: 51148 - DNA, 1111 bp, Bovine  19866881080707
tcatgtaaaaaattatagaaaatgtgctctgtgctccctgtgaatatttgcttgggaaactggagctatgtaaggcaccatcatcccttgtcaactctaatattaaagtccttatttaattagctgtgtctggcctttatgatttccaggtttgaaaggaaaatgaaggaaaggataagagcattgaactgcttaccatggatgatgggaataaatgattgtgaaaaatgctaatctttaatttgaactattttgagtattttaaaaagaattagttatataagatgatttgtgtcctcccctccttttctttctcttttccttctttaaatttttaaagtgttcctttttgtttggtttgcacactcctaagcatcaaatccatcaaccccagcctgacaaattggatagcctctgcaggcaggactgatatgcgccagttcccactgatagacataacagctggcatccattctgagttgtcagtccctgtaccatactggttgttaaagatttgactatcacccatcccttgccatgcatgatatggactggctgcatatttgggttctcaactattacagtgttcttgctgtatctttctcttcagttctatctggggttttcaaagttgaagatgaacaatatgtaatgggcttttattatttttaccttcccagcatgtgttggccctgttttaacagcccccagatatttttgggggctcatccctctccatatcaatcaaagaggttccagtagaactgcctccattccaaacatacgttccagatctggccacattgattgggaaggatgatgtcatctcatcatacttcttaaatgtcctgaattatttcctaggaccactagcctagaagcatatcttcatttctactggtagggatggagagtctgggacagccatcatggtacaagtggagtctgagaatggagttagcacagaggcagtagaatgaggacatggagagtaagggaaatctggtcttaggacttcggttgaaactttgaggttttaacattttcttaattaaaacgttaatagttttttagagtagtgtgagtttcacaacagattgagcagaaagta

SEQ ID NO: 51149 - DNA, 1026 bp, Bovine  19866881082961
tagtagaacagaatgaagcccactgatagagacaagtgccatagacagaatcttgaccatgtcccagggtaagtcctgtggtaaaaacggcaaattcttcctgctatcctttctcccattcttccttttggtaatagagccctccaatttgagtggggaacatggtttaccagctgggtaatatacttctcagcctctcttgcagcaacatgactaagttcagacacagacatgtgagcagaagtgacataagcaacttccgtgtcaccttctgataaggaaacagcttgttcccccattttccccaatcccatcagctggagcttagacctaacaggaagtgatccagaataaatcacgcagaaaatataacatgcttaggtatgatggaacaatcaggtagaacaaaccttggactgtggatcacatagatcagatgaccacctgcttctagaccgtctgctcactcatgtttttacacaaaacataaataaagctgtcttgtttaagctatactattaaaaatagctaaactgatttcctaactaataaaacccttgaggagctttccaaaattcctgccttccaaaccttgatcgttttttaattccaatgattctcaaaattttatcaggatctttccaataagtcatctttttgcttaagtgagttccacttaggtttctgtcattcacaaccaaaatattcctgaataatacaaaaggtaatgctagtaatattcagttgttcctcccatgaagatatttttttaatgcttcattgtcagtcttataagtttaggtttgtattaaatcaataaatgtggcaatatcttcataaatatatttagcaaactaagaataactgtcccaattccaatggaagatcatgtcaaagccaataaactcttgaaaatagaggagtaagataattctagaagacttttaaacaagtacatttccgaaaacaacaattttcagattattcacagaaattcttactaagcattttcaaggacttccttca

SEQ ID NO: 51150 - DNA, 1831 bp, Bovine  19866881116523
aatgtattctgataacacaattgccttctcacttcccatttccgcactgcagaatgattttttcaggcctggctgtgaaactagtcagactggaatagggagccgatagaaagggtctgtctcaggcctcagcaaaggacattaaattacaagaaatgcagcatattataatgttataaggctacattacagattacattgcagcttcatagacagctttctgtagatcttctctttcctggtttctcaacagattttctgaataactctaattcaaaatctcttctcaattaactagagtcctttttttcctggatggttgagtcacttcttccattctatcctgagattacacagaaataagtgtttgactcatttttaagtagtgtgtttagaatgccatatttaaaaaacaagctagaaattagagataacaagggtctttgtcccctaaagctgatccccaaaagctcaaaatagttcagacattatctaattccctgtcacaacaaagctgccattatcttttccattttgtacatggagaaactgaaataagaaaattatagcctgactttgacactgttaagaggtgcttctattaaccctcttgcaggaggtagctaggggaagcctggaaaggagcctgcctcgcagtgctatagactggttttcacgccaactttatcaaacacgactcaaaacagggaaggtaaaaggatggctaggtgagccagaccctcttcaagcagaggagctcagctttacatagatttttatcagctttatagatcagggttttaagaaggattttcttaagggatcaactttttaaaatctgataaacattgccattaatctggcaatatttaggttgtgccaccttaaaaaaaaagtttaattatattcagtggttattcaaaagcccaattgattatatgtgcgtgctcagtcctgtccaactctttgcaactccatggactgtagtccaccaggctcctctgtccacatgatttcctaagaacactagagcgggttgccattttcttctccaggggagcttcccaaccaggtatcaaaccctcatatcctgcttgacagacagattctttaccactgagcttccagagaggccctcaaaatcccaaaagtaatcattaatggcaaacctgagcttttcctatgtgcccacccctacggtaagcacatgacaagcattaacttattgcatggtggtaaattaccattttacagataaggaaattgaagcttagaaaagataagcaacttgcccaagatcatcaagctggtgaatggtggaaccaagataaaaccaatcagcctacactcccttttttccttagaggctataggcaggctgctggggtgccaatcccacatctgccaaggtccaaagccacagcgactcaaaacacgccatttctttgttgcagggtcacctgtcccagcagggcctggcagcagccagagcccacaagtcatcccaggagaccatcactaccaatacctggcccctctccactgctgaacagccacagagcattgctctctctttctgatccagcccaagtgccagcacactatgatggggcagggttcttcgccaagcccctcagttaggaatgctttcttctgggggcctggtgtaagtaggtgaaatgtgggatttcccacaaagagaagcagagcatgatggagcctccagggtacactttgtggctacaggagatgatatggaaagcatggctgagtccagacatggaagcacgaagaagatggtagtggataaagtaaaggtgggaaaacaagg

SEQ ID NO: 51151 - DNA, 1853 bp, Bovine  19866881135630
aggcttctttagagacctcttgtttattcttaattcttagtttagcctttcttgctcttgggtttcatcatactcatttaaatacttcagttaatttttgagtcattctttcatccagccatttatttcaacaagatttaattgaacacctatcatattagtcaggataagtcatgctaactattgaaacaaacatctccatagcttagcacagtggtttactgtggactttcatgctcacctaaagtccagtgtgaatgttcctcctgagaccgctcatctcataactatcatccagacatttgatcgcttctatgctgtggtcctgccatattaagggatataagaattctttgcctccaaccacacaaataaaaaatctttgaaaaattgcttaggatgtattatggctaagtttggtagtgctgtatattacatgcactcatgctccattggatagaactcagtcacatggttatctgtggcaggctggcagtgggtagattcaagatgcatttgggaaatgtattttaattgtgtatacaggaaggagaggataatcaacacaatgccagacattttgcttagtattgggaagtttaaaaaaatgaataaggaatagtgctaattgttgggagctcacagtccagggaaccagacacacacaaatggaaaattaatataatatgttattagcagttactgagtgatatcttcctccatgcactactttaagcccttaatatagtggcctttaattaatatattcctttcaacagtccccaaaagtaagtacttttgttatcctcatttcatagataaggaaactgagtcatagtacttaagaaatttgcccagggtcactttgcaaatgagtggctgagctaggattcagacctacgtagtctgttggcaaaggttgcacacttaattatattgttctacaatgatgaagagatgctcagggtgttggtggactgtgcagggacccagctggttgtaggattctgcagcaggccatctctgaatttaggtataatgactgagctgaaattagtccagtttggtggcagggaaaattccaacaatggaaatgaggatggataagggtaaagaagtgacagttatcttggcatattccaggatctgtgtgcaatctgatgccatgagtcaggttccaggctagaaataggagagactagctatagaggtagataaggccaggtcatggaaggcattttatgcgttgctgtggaactcagaacttatcctaagtaatggaagcctttgaaaagcttcaattaggggatttaaaaagtcaactttacgttttacctaaattctgctggtggttatctgaaggatggattggagtggaccaagaacactgactgaaagattagttaagaggctttcaaagtagtccaggatggccaaatgttaaaatatcttgttttatttcttattacacagagaatataaaatggtagcaaatgattattacttatcatagcactcatttgtcttcacaaccatgtgtaagaggtactgttaaccccattttacagatgaggaaactgagtccctgggtgtgtcaatggctagtaatcattgtcactaagacccagcctctgcagtctgtttccagagggtgtacagttaacccctagtgtatacggtctttccatgtgaggagtgttacattttatcgaagatgcaaaaagtggatgggttatgtgggtgagggggatgaggagggattgggcagcaggatcagtaagaggtgaaccaatcagggggtacagggccctcctcctcaaggtcaaggaagtggggagtctggaggcaggtaa

SEQ ID NO: 51152 - DNA, 782 bp, Bovine  19866881149196
caagaatactcaagtgggtcgccattctcatttccaggggatcttcccccgacctagagatcaaaccccacatcttctgcatcgcctgcactgagggcagattctttaccactgaacccactggtatgagtgtctatatctataactgaagctggaaagctgctacagagcccaaaagacctagacttcgccagcaatgacagtaagggttggagtaggagaaatggacctgaataggaagatttggaaactgaagaacataggtgggaaataaggcagggggcaggaagggaggggtactgtggcaggtggggatgagtttgactaaataggaagcatgattctaaggaaagtcactaagtttaaacattgttgattgtaagaccaatatgggttaaagaaagtttatggtcttttgtgagcacggcttacccctaaaatatttgtattggcataaactaaattaataatgttagactgcttttaatagcaataatctctgctgctgctgctaagtcacatcagtcatgtccaactctgttgtagagcttaaaacaaagaaagaaaaaacatagcaatgtgtgcaagaggaaatatgtgtaaaggcaagcagattcccagaaaatgtcagcaccttgtatgatgagctctggcagccatttgagtgttgacaatatgctagagaggctcggaacataaatcaatctacatttgttctcacagggactaggagctggaattactgtttctgaaacttgagccaatatgtcacggcaatataa

SEQ ID NO: 51153 - DNA, 1835 bp, Bovine  19866881154763
aactatttccacttggtggtgttgaatattctctaaagtgtgttttatatgtctagtctaaaacatgcccttctctctatagccagtgaaaagacgaagactgaatttttcttctcatatccaatttttgcttctggttacttaattttctgtacagaggttctcttgatgttaattcaaatctcattttatttctataaaagtatatagtttctttcctagtggccccaaaagacctaccctctccaaattttcaggaatgaatactccaaaacagaaaaagtctattgcagttttcactctcaaagagtacttgctatcatcattatccacaaacttctatcaacaacccattctgcatagtaataatagttacaataatagaggttctgacactgggagtattcatgcaactttcatagttaccatgaaggagaggcaagaacagcatcggttgtacaaattcagtgttgaactatatcaaaatgattgcttgacaatcatctatatttagcacttctctcagaaagacaggttttgatgacatcaattcctctgatcagaggaagggaaagttttcccccacaagtgagagtcggaggtatgactgggtgtggatgcaggtacatgtgtcgaggttgcatgcatggctatgtgggagagggtgagtagaaaataactttagctgaatgacattgacattattgtctctaaagtagaagttaaagttttctactgagagtgggcaaaaaaggagcttaaagagtgtggttattattcagactaggctataggttatcagatgtgtcttcaaatcacaattgtaaatttcagtaagttaaagaatttaattttattctccatcattattatcatgatcaatcctctaggtctgtgacttcatcagacagcatatatgcttatagaactatgatgtactctccgaattgagatgttatttcgaaggcaacaataatgtagcaccaggacacacgggttctaatattgcctgtagttgtaaagttgtggacaaagatctcctgagttgtggtaaattctcattaactcagaagccagatggaagacaggagaggctgacaccgcctactgcacctctgagggtttacacatcattcttctttgtccagttgctccataagaattggtgcatgcatgctaagttgcttcagttgtgtccgactctgtgtgacactatgaactgcagcccaccaggctcctctgtctatggaattctccaggtaagaatactggagtgggtgccatgctcaccttctgggggatcttcttgactcagggattgaacccgtgtctcttatgtctacctacattggcaggttggctccttatgctggcaccccctgggaagccctctaaggaattgagcagggcactgtttctaagtacttcaaggactttgtggatgattgcatcagtatgaaactttttttttttttaactttttaattttgtcgtattttcttccttggaaagatttgcattgaaagaactctgtagatagcttatctgttcacaattttagcaatttgtctgcatttctactctgaattcaactattacctttttgaagcttttcatgtcatgttaaggaaaaaaaaaacacttctttttgaagccataagaagaacagaagtagatattgctattcagtaaggagtgggtatcattagcttagtacatcagaaatcctctgagtatagggaggatttcttctgaaatgatataaaaattatttagcaaagaataccattgtcataagcaattcatcttcccaaagaattctaaccctttaattt

SEQ ID NO: 51154 - DNA, 4065 bp, Bovine  19866881158704
ttgtcttgggctgtttaaagagtgaaggctcaggattagttttagtgataattcatctcaataaataccaagattttgtcatgtaacaagaattatgctaaatgctagaaacacacaggtaaatgtggcaggtccctggccttcaaagagtttataatacagcagaaaaaaataagaaatatcctgttagttaaaagaaaatttaatatgggcataatagcaatatggctggcagtttcaaccctgaatattcattgaaaggactgatgctaaagctgaaactccaacactttggccacatgatgcgaagagcctactcactggaaaagcccttgatgctgggaaagattgaagcaaaaggagaaggaggaggcagaggatgagatggttagatagcatcaccaattaaatggacattaatttgagcaaactccagaagatagtggagaacagagaagcctgccatgctactatacatggggtcccaaagagtcagacacaacttagcaactgaacaacaacaatagcagaaatgagtatagaaaaggtgaaaaagttaagctacgccagtttttagagagccttgaattcttgtcaaaaatttatattttattctgaaggtgctggagattaagaacatttttttcaggtaggaagatcactcatgcatcaactagacatgaaagtgtaaaaaaagtgttcgttgctcagccgtgtccaactttttgtgaccccgtagactgtagccctctagtatcctctgtccatggaattttgcaggtaagaaaactggagtgggttgccattcccttctccaggagaatcttcctgacccagggatagaacctgggtctcctgcactgcaggcagattctttaatatctgggccaccacattcaaaaggtaccagatgagaggcagggagctgggttaatggatgattgcctaaattaggaaggtggtaaagaaaatgaggaggatcaaagaaatataaaaactatttcttcaacagaatttgatgtttttgtatcagataggaggggggtgattcctaagcttgggcaactgggtggattctagtattgtacagttttatcactttgctaccatattacatgcaaccttcagacaccagttatgggatccatatgccagtttttccttctctcactgatggaaagataaccacacctgtgttcttttctataagaaaggtgaatggatactgcatttatacaaagtctggttgtaagtattttctcacaggttttttaaaccaaggggttaaaaaaaaaaaaaaagcaaagaaattcaacaacaaaatcttcaaaatcttggtttttaaagccctgggattcatttgaatttactgttgccatggtttcaagagtctgaaatcaacatttcaaggtaatccaaagatctagatatggtcacagtgttcaggtatcaaggaacaatcaaagcgttataccccattagtgaccgaacccagttaatgctgtgcaaatgcctcaaattggtattcagcttaatcactgatgctgtattactaattatagcatgacactatgcaaaagtgggacttttcaaaggctgcaaaatggcattattttaataagtcattaggaaattgctctttgaggatgcaatgaaagtataagtatctttattagtggaattttgtgaaattgatgagagatttgagcatgcatgatgtgcagcgaacaatccatttgaaacagaccaagccattgggagggctggctaatgacaaagaggatgatctgattcactgtatgagaaaaatgataatggaggctataaacgaagggcgttgaaagactaagcagtgtctcccaacgacacccacccaagtcctactggcccttcatcttgtatttagagctgaaataaagatatcaagatggactctaatctttgagagaattaacaagcctcctctaacttgtctaccaatacttgtgggcaagaaatatatatgattattagttaattggacaacacaaaaatattgatgttctgtttgaggcttatttgtaaattgggaaagaatcatttgagacaggaagccagatgagagaagatgacaagtacaagaatattaataaaatatctttgagttctttcaatgccagataaaatatttttattctgaaactctcatccagggaaattcatacctaaactttaaagagcattatgcggactctacatgtgtgtgggtaggtggggaaggagggaggaggagggagagaaagtggtgagagagaaactatattttcttctttattttcagttcaacaaagtattcatgttacagctcaaattacaggtttcagcatttggaaaggctcaggaatgttttccttagccattcttgaaacatcctctgagaaactgcctgctttctaaggctcagttattgaccattctcagaaatgggtttctatatttaataacctaacacattcctataatattaaatttttcacatggaaattggtagccctacttgaattcgtctaggctcaatgagcccattgtttgcaatgattatcactctcagcagattcggaaatgcttgcacaattcatgtccaaagaattcttcaaaatatttttttatgatctttacttttggctttgtaaaagaacttgggtttgacaaatgtgttccaaattcccccaatttgtcatctgtaggaaagattatttgaagctaagtaggaacaagactgattaacaaactgggatctgataacaacttttagagtggagggagtttcatataaatgtatatatgcacaaaatagcataattatgaaaatttcttagaaggaaaatatctggtgacattaacaggaaaacataaatggctcagggcctgtataccaaacttttactctctaaaatttgtttttaggacaaattttgattaccaaagacccagagttcaactctgctttattaggaattaagctatgaaataagattcttaaaaataaaaaagaccttaaagctgctagccattctgttagatttttgacataatttgtagtctgaagatactgcacctttggtcctgtatcagagcaaaattcatagaatgacttggctgttctcagcatgaagcagaacagacacatttttcaaaagaagcaattgacttgttaaaggtttgacatatcacaaacattttgattttgtgatcagactggatggtgatttacttatcctctgactttactgttgggtaatttataattttagttctcagccaaaaactgtggaaaatcttaggaggaattggtagggcaaacaggagaaaaacataaagctataataaagctatagtggtggctaaacatgactagaaaaacaaatgaaaatatttgatttgtgctgcacctgtgagagaaaaaaattatggcctctttttgcatctgaatctcacggtctattttgagagttgagatgtgtatgaggtaccttactcactcttctcaaacagcctttactttaagagaactcagctgtgaaatttatcgaaattctttctgaagctaaaataaagttcaaattctttagcttttgacaatttttgcattacttctctagaatttagagatacaatgtggtgtggcatgaataagatttctcaatacataggctgccataataattagaaccttggttatacagcacttccatccaaggaaaaggatctctctatcagtctcgtttcatttaccttcctttgtttgctagaagattctaagatttgaggcggtaaaaggcaaagtgagccagttagaacaatggcagagggaccagtactaatggctcttggtaatacctgttgagttcttaccaaaagccatgtgcttcagttagggtagggcattactagttcacacttgcaatggcaccccactccagtactcttgcctggagaatcccatggatggaggagcctggtgggctgccgtccatggggtcgctaagagtcagacacgactaacaacatcactttcacttttca

SEQ ID NO: 51155 - DNA, 851 bp, Bovine  19866881220447
ctttgccccctagaactcttgataactaatattcttagggcctctagtttagaatcaaatataccatatttttttaagaaaaaacttttattttgtattggtgatatagccagttaacaatgttgtgatagtttcagtggacagcaaagggactcagctatacaaaaacatgtatccatcttcccccaactcctcttgcatccaggctgccacataacagagttccatatgctcttcactaggtccttactgtttatccattttaaatatagcaaaacaccgtattttgtttggttgcaataatcattgaccctgtctttttttttttttttgaagtttaccacttcaaatatttatttaataaatttgaaggtaaatatggaaaagctacaaaatacagaaatttagtttattaaattcctttcaattataagaaaaatatgaagcgtgcttcacatctgtattttttattttgaaaatattgtgctaataaatcctaaaacgagatgccagtccaggttcaatgccagaccctgtcttatagagttgaattgttatatcgtcatttgtaaggttatcatttggaatgtgttaattgttatcacactggtataaactataaagctttggttttgtaatgttttagtatttggctgtttaggaagttttcactgtccagtcacgaaaattagtacagatgccttccagtttcccaattaaaactgctttggtctccttttccaggtaattacctacctaccaagctgggcacaggaaatagattaatgaccgtatcttacaaatatacaactccaaaaaactatttaaaggaagctgtaggctttattgat

SEQ ID NO: 51156 - DNA, 1284 bp, Bovine  19866881279432
cactgtggtgttggagaagactcttgaagtcccttagactgcaagggagatccaacaagtccattctgaaggagatctgccctgggatttctttggaaggaatgatgctaaagctgaaactccagtgctttggccacttcatgcgaagtgttgactcattggaaaagactgatgctgggagggattgggggcaggagaagaaggggacgacagaggataaggtggctggatggcgtcactgacttgatggacgtgagtctgggtgaactctgggagttggtgatggacagggaggcctggcggtggtgcgattcacggggtcacaaagagtcggacaggactgagcgactgaactgaactgagctgaactgggccacactgtttttgtttaattttgcctatggatctaaacaaaggaaaacaaaagaaagatagtgagttaagttatgtattccttggatccatgtttctaattctcagtcttctctctactgtgtcacccttgaacacaggcatttcaggactggggatatgaaaagggagtttgccatgagatttgatagtgcaatacctcggaacttctaccagcctctctgcagcttgggagtgcaagatgtttgagagttggaatttgttgaggagatgtcttagaggccactgatgctatgggactaaagtctctaatgactgacatgggatgagcacttagcatgccaagcactgtgcttggtcctttgaggatgtatttcatagtcatcagttacacatggctctctttgcaatctatgcaaataatgcagtctgtgttagaagtaaaatctttttcctatgctcctgtgaatatcttagtttgaaatgtctttctcaacttttcctgtgcataaggataggaaagactgtgcccttttaagattgatcaaatcacagaattactgttatctttaacacatttaaggtaactttaactgtgaagtaaagtgtaaattagcaggaaaacatgtttggtttcttggctaagatggggaagttttagcagttgacatccagctggtttttgtgtttgggttgtaagcattctgtgtttttaatagtgctgacaaaatttaaaaaaataggaatatgtagtgaatgtaaaacccaagtcctctcttaaagaatctcacctgactgattttgtattagatgtgcatatcttattttcctatataatttattatgtattatgaatcttatataccttttgcccacaatagaggtacatgtatgtcttcataatgtctgcat

SEQ ID NO: 51157 - DNA, 904 bp, Bovine  19866881618989
aactattgaaatgaacattggaagctcctataatttgtagaaaccctagcatgatgctcagtggaagctaacaagaaaaactatgttaggcaactgaattatttttacaggttaataaggttgccagaaagcaacagagaaagtactttcaagaggggaattatttaacataatgacatttcttttcatccaaaccaaattaatttctgaaagtacattagaatactctcaccccacccccttttacaagttttcaagctaatttgtgttagatctacaaaaacactgaagagcccccctgcctatcttcaggggcctttaaaatgaaaatgtgtgggaatgagagtagaaagagcgatgacacaaaccaagagagctagaaagtcgatccgtatcaaggagcaagcataaggtctgcactgtcagtaattagcattcatactgggaaagaaattacatattaatatactgtgtgttcttttattaggtggctcattttttagcagtgacacgcctgtggacagaaatgtaattcttcagagagatttaaaaggttgggactacatgcaactcaccacattaatcatgtgttagatcaaataaacacccattgtgggctttttgtattcatcaagagttcagaagcagtaacatgttctgtttcaaaattgtgaaaaaataaaatctgagctgaaaaataaggggagaaatgaaagacctggagaatcaaggaatgtttcttatttccaaaatccatcttctctttctataatcaaggtgaaacttcagactaatcttagagtcatctagtcatctatctggctgatatgagcactttgtattaattcgtgtatgagataggataaatcaaaatgtgtaacaatcgtgggaaataattgtaggg

SEQ ID NO: 51158 - DNA, 1042 bp, Bovine  19866881635009
gcagacacgactgaagtgacttagtagtagtagtagtaatctctacttgaacctctcttggagaaactagggagaacaccctgggagaatatggagaaagttacatggtgcttggtaagtcagccttcctgatatttccacaattgatttatccttggaccaacagcatttttagcctattcctattgtaagcagaattaacctacccaggtttgagagcattcccattttccttacacaagaaattatcctgtaataaccaaaataatttttatcaaggaaactaagactttagaaaggataaaaagaacattatttaaaactaagaaaagattttaaaggctgttgattaaaggtttgtaaatcactgctaaccatttcttattaagcaaagtgttagaaaaaaaaattttggagagtagcagcaaaaatcttcaaaacaggaaagacttcactcaccacaaaaattgttgaacacagaaatatcctcccaaatgtagccagttgagtacatttccattttatctatgaatgtgcctcaaacgggtaaacaaaatcatgaacgtaaagaatttctgatttcctctctcctcttggtaatttgtttttataggaaacacctttatgattgtctaaatacaaaataataattgcaacaatagaagaaaatggtcatctcaacgtgccatttctctgatatagtacaggcacgacaaactgtccggccagctctggagagcagccgccagctgccaacaaccctaaaataggacagacactgccctcattacagaacacagcgataattcagaaagcattcaagtgatggaaaataaaatctttgaaatgcagaaagcggtagatttaatcatgagtgatcctgcacaattgggcagttctgacatctcataaaatagtccaccataaaaggcttgcctgatcctaaagtagaggtaagaattggccacgaattataaaatcaaaatggctgctgcctttgctgcctcacagtcagaaccttgtataatcaaatcatcacaaa

SEQ ID NO: 51159 - DNA, 1945 bp, Bovine  19866881877199
atttgctggcatattgagtgcagccctttgacaacatcatctttcaggatttggaatagctcaactagaattccatcacctctactagttttgctcatagtgatgctttctaaggcccacttgacttcacattccaggatgtctggctctaggtgagtgatcacaccttcgtgagtatctgggtcatgaagatcttttttgtacagttcttctgtgtattcttgccacctcttcttaatatcttctgcttctgttaggtccataccatttctgtcctttattgtgcccatctttgcatgaaatgtccccttggtatctctaattttcttgaagagatctctagtctttcccattctgttgttttcctctatttctttggattgatcactgaggaaggctttcttatctcttcttccccatactaagtcagtatctatacccaactgaatcctgacctcaggctacccttagatttttcatgctaagaagtgtgtagtaatggttaggagtctgactccacctatcaaaggtgagatagatcaaagtctgaaatctacctgcctcttacaaactgggtgatatcaccaagcatctttctagacctctcccaagcctcagtttcctcatctgtctactggggataatagtagtatttacctcagctcatgcatgtaaaaggctttgcccaaatgctagggaaatatcaagtatggaatacatttaaattattgttttttcttctctctcttttcctcttatctctatttttccttgttattatcttgctctgataattaattcttgcctagatgttaaagatttaatatcagatatccaaagccattttcaagtaaagaaatgctttatggttgatgatgccttaacccattaattgttctgagccttaagtgcagaggtttggtttaactataatattcaatttattatacatgcaagttctctctaatttacttatttgtttggttgctttctgttttcattcctcacactccaatagtaaccactctaatgtatttaatgcatatctttctgtttatatttttgtcaaatatgtatttttattttatttgcaagtattttattaataattcatgtaaacagtatactatctactagttctcatttgttttcatgtcttttcacttatgggatgttctttactgctgctgctactgctaagtcacttcagttgtgtccgactctctgcgaccccatagatggcagcccaccaggctcccccgtccctgggattctccgggcaagaacactggagtggggtgccattgccttctcctgggatgttctttaagattcagccaaatctggtgcctcatctttaagtgctgtatagtactcagaggtggacattaattcaaatcttttccaaaaaaaaattttttttttaaccaagaactgcttaagatttaggaaagtgaacttatacccctatagcctcttaaagtggagcccaaagttctaggctcaagctccatatttctttgaaacaatttgatttatcatatagaaagaaatcatggattttgcagtctatttcatagtatgtccattgtttactacaaaaataatattttttatggttaagttgtttaattttaatcttcactaaatcaatgaacttggccctctgtaagatgcactattttccccccatgagtttccatgctgtctgcatactgctgggcagaacaagtttgagaaatgtggtcttaatctaaatataaacacgcttctaaaaagtgggatttcaggcaaaaatttgcttaagtgacagagagtaatacttaaatcccttcttattatgaaaggcagccctgataaatatacttagcactgaaaactcaaagtatgtcatttcccacagtaaacagctaaagccataacttcaaaggataactaactgtgt

SEQ ID NO: 51160 - DNA, 936 bp, Bovine  19866881911998
cctcagatggccctctcctgggatctccctgcctgaagagtcccaatatagaattcctcccaagaggacttcagcatgtcagctgtcaccagcacctgccaagagagagaaaggacatagtgcaggagtgaggatccaatcaccatgggcccatagagcacaatctccacctcgactccttgaatcgcatccccaagcagatgggaagccagcagcgaacccggagcacagatgtcgcaagttcacaccgagcatgagtgaactgtgcggttcttcactttaatttcttatctgataacaagtttccagtccccagatcaatactgccagcacgctgctgtgcaccccactggccacacgttgttgtctctattactctttttaggggaatcattatctgtacacactcccatgtaaaaattatagtttgttctttctctccccaaatgaaacaattaaaaagcatatttttaagaggtttgcctctgcctttcacagtagaagcttactgaaaaaagctgcagttttgtaaaagtaaggtctgatcccctaggatctgtaaacaaaggctgtgaaagtagaaaagatgtggcagagagggtgtaagtcagtcattttcacccacaacataatgacctaaggacaaaatacatcatcacacgtccaaacaaccttcagaatggccggctttagcaaaagcacagcttgatctgcctcttggctaccagaagaggcagaatcaacaggaatgccagagcacttgacagtcctctaggagtgtcaactgtaaagtggctccttgacacgctttcccacgcggatggggggctgactattccagtgctggccaccagtaaggactgtctcccctgctatgcattacttgtagtgtctctcaggggtgcgtgtgagtgattcttgcagtatccttgcctg

SEQ ID NO: 51161 - DNA, 3413 bp, Bovine  19866880168104
tgatgccatccagcctctcatcctctgtcatccccttttcctcctgccccaatccctcccagcatcagagtcttttccaatgagtcaattctttgcatcaggtggccaaagttctggagtttcagctttagcatcagtccttccaaagaaatcccagggctgatctccttcagaatggactggttggatctccttgcagtccaagggactctcaagagtcttctccaacaccacagttcaaaagcatcaattcttcggcactcagctttcttcacagtccagctctcacatccatacatgaccactggaaaaaccatagccttgactagatggacctttattggcaaagcaatgcctctgcttttgaatatgctatctaggttggtcataactttccttccaaggagtaagcatcttttaatttcatggctgcagtcactatctgcagtgattttggagcccaaaaagataaagtctgacactgtttccactgtttcccaatctattgcccatgaagctgatctcaactagcaggatgtgaaatctttccttctagtccctgtctccattttaaatgaggtttctatttattaattttcatatccttactgtgaaattgacattttaggatcaaaacttttaatttctattctacaacctcatatggactttctaatttcatagtatataataaaattattattttggaggataaaaaatagacttacttaaaaaaatactttttttgaacatatatacagtacacaatataaaagctgctatgaaatataaacttaaaagtcaaggctgcttcttaactctctgtcttcacctagttttcttctgagaggcagagtcctcctgtgtaactttctaaaaatactacattcatttacaaacacatgcatagagaaatgtatatatacattatcaaattctaggaaaatatgtacactgtcctacaattgactttttaaaattttttttacttagcaatatattctggaaaattttctatcaacgcatagaaagctaatgcattcttttcaagagctgcatattatattctatggttgtacattttcccaaacttttcactattatcaattacatggcaagaatatttttgtatatatgtcattttataaatgggtaagtgtagctaaaggataaatacctagaaatagaactgttgcataaagacagtgacaaattgcgctctgccaactttctctccagccaagttacaatgtatgcagtgactgttttccttgacatgccctgtgatacccaagaaagtcacattattaatggcaaacacttacatagcatttagcctgtgccaggagctggtttatgtgctttacatatattagctcaagtgagactcaccacaaccttgtgagggaggtactttcatcatcttcaatatacagatgagataagacactttgcctcaggtcacgcagctagtaaatagtagatgacatctatgcccaggctgtctggctccaggaattagctcttgtaagcataaccctaaactgtgctaatcatgacaattcttaaaaaaatattctgtatgagatataaaaggaatttctcaagaaataaaagttcaactgttgaatgatttctgcatcaggccctgtacgctccttgttgctagtcttccacagcaccctgagttcctcctcaccatttcttgaaggcattagttcctggtttactagcacattctggtcataatttgccagaatatcaatgcacacatagatgaacctttttattattctcatctattaatttcttggtctcttcttcctgaataaccttaccctccaccttacctctgctctctttcctgctattataaccaagaatctaatcatcaccaataactgcatctcatttatttatttattttggtcattaactatttttttctaatttttaaaaatttatttttaattggaggataatttctttacaattttgtattggtttctgctgtacaataatatgaatcagttatgtgtatacatacatctcctctctctaaagcctccttcccacccatgctgccccatctcaactgtctaggtcatcacagagaactgagctgagttccttgtgctagacagccgcttatagagactgtgtgtatcagtctctcagtcatgtctgactctgtgacccatggactgtagcccagcatgctcctctgtccatggaattctctaggcaagaataccggagggggttgccattcccttctccgggggatcttcccgatgcagggattgaacctgggtttcctgcattgcaggcagattctttaccacctgagccaccagggcttaccactagctgtctgtttcacacatggtggtgtatatgtcaatactgccctcttaattcatcccgctctctccttccccagctgtgtccacagttccattctctaaatctgcatctttattcctgccctgcaaataggttcatcagtaccatttttctggattccatgtatatttgttaatatatgatatctgtttttccctttctgacttcactctgtgtaacaggctctaggtttatcctcaatcaactgactcaaatttgtttctttttatggctgagtaatattccattgtatgtatgtaccacaacttctttatccattcatctgtcaatggccatctagggctgcatcttgattataatgccactttcaagcatcctgcattcagaccagtggttccaatgtttctaaaccattcttctaatacttcactggggtctacattctgttgatactgtgaataaagaacaaagaacactgctcatcactcaattatatcagagttaaatcataatttatggcagttgttcaccaacaaagtatccagaaaggaactcaggataaaaaagaggatgaggcactctttgctttggataaatagcccttagataattaaatgtgtatctcaggaagaatttcaatgactccagattcttgcactttcccatatatagaaaaacattgaaatcattaacttgagatattggttggttgttattagcagtaatcttctaccaagatatatgcttgacttcatgtatttcctagcctatatacatatatatatgtatgtatgtatgtatatatatatactgctcctcccctacctctttggaccaactcctcagagctgtctcctgggctatagtcctcaataagaccctaaaaaaaaagaacaacaacaacaaaaaaacttatgactcttatgttgtgtgtttttctttaagtcaatagtactgtcatttatctttcatgtcatctgcacattggtgctctctttttcccttacacaatagcttatatttcacagttcattgctacaatcaat

SEQ ID NO: 51162 - DNA, 2016 bp, Bovine  19866880401040
aacgaacctcttagagtctggccctgcagggctctggacatgctgtttacagacttttccagaaaaacagaattgtgttaataatgactgaatggcatttttccatagttggctgttggtaatgactgaaaggtatttaaaacgcagtttactagtctgatgtgcatcttgtcattaccacttaacttaggtgctggtactctacattgatttttaaagttttacatatgctttgcatttatattgttcataaaaagctttttgtccaaaaacattaccagttggcaatttaattctttccaaaaatgtctcttgtttaaatatgaaattacagcttgcacttttatcaaagaactgcttatcttgaacataattattttgaatttttaaattgtagataaacctagtcacataaaattgtaaatactatatacttcaaaatattaccaccttctattagcaaaatctaatattagcaatgctagtgacctgtatttttttaataaaaagaagtattttgtttataaaagcttttctcctaaagataaagattccattaatgctagctcaaagggatcagcttagcagctggtgagtggcatgcggtatgtaaacacttttcatataaaaatgtcacaaatctaatacaattattcaggtgtttgtaattttaagtgcaattaaatcaatgcatctatgtacatatgatatttaaaaatttttctcttcatttgtagcctaatcttgagttacttagcttgtttattttgagtctctgactactaaccttaatcccatttttccagcattttgttcagcactagtccttatatgttgggcttccctggtgtctcacaggttaaagcatctgcctccaatgtgggagacctgggtttgatacctgggtcaggaagatcccctggagaaggaaatggtaacccactccagcactcttgcctggagaatcccatggacagaggagcctggcgggctacagtccatggggtcgcaaagagtcggacacaactgagcgacttcacttcacttcagtccttaaattatcaggaggttgttggcatactgaaagtttagaattcactttgaaatttcaggaatttttcctgctcctaatgctatagaaaaatgtgcatatgtgaaaaaaagattttaaatttctattcagggcttacacggcaattgtttacctgagcacttaggagagagaggaagccctcagggtgtggatgaacaaattcagtgtttaggaagaaataatgtctgtattgtctattacatgtgagggggcacagtttgagagctgctgatatagatgacagtgtctggctagaccaatttggaaacatttcagtcaaacctggaagttggtctgctttcgcaattggtacattctcacaagttccactgggacaagttccatgcatttccattcctctatccagatgcagaggagcacctgggggcttggaaatttgtctcatgaccctaatttcttcacgtatttactcagaccaactcatattaaatcgcccaacaaaacttgaacaagcctcaattgtgttttcctgaacacaagttgcctttcattaaaggctacaggggctttcctaatagctcagtcggtaaagaatctgcctgcaatgcaggagaccagggtttgatccctgggtagggaggctcccctggagaagggagtggcccctcattccagtgctcttgcctttagaattccatggacagtacagtccatggggtcacaaagagtctgtcacgactgtgcgactaactttccttgcctttcaaaggcacatgaagaggagaaactcaattgttttaagatgaaaagttagattaggtggaactctacagatttgccagccgtctgggttctgtcacaaactcctcagggatcctgaacatatttgcaactgaaaagaatttgaacttgaagacttttaaattgggatgtaaaatgtggcaacccagactaggcacaga

SEQ ID NO: 51163 - DNA, 1347 bp, Bovine  19866880430595
aatacctgaggtcattacagtgtcaaagacttcagaagacaccacccgcggtcaactagaggatgtggagtcagtctccgcatcaacgattgtctcacctgacagtgatgggtcgcccatggaccacaggcaagagaaacagactcatggcaggataactgaaggttttcttggccagtatgtgtccaccacacctttcccatcacagcatcatacagaagtagaattgtttccttattctggtgataaaagattagtcgaggggacatccacagttatttctcccactccacgaacaggaagagaaagaacagaaacctctaagaccagcgatgagaacagttacttacaccaatgatgaaatacaggaaaagatcaccaaagattcatctatagaaaaaatcgaggaagaaggcttctctggaatgaagttccctacagcttccccagagcaaattcatcataccaagtattcagtgggaatgaccaaatcttttgaatccccagcactgatgacaacgacaaagccaggcgtgacaccaacagaggcaacagatgtggaggaagactttacaactccaagtggattagaaacagatggctatcaagataccacagagtatgaggagggtattacaaccgtgcatttgatccagagcactttaaatgtggaggtggttactgtatcaaaatggtcattggatgaagataatacaacatcaaaacctttagggtccacagaacatgtaggctctccaaaattgccccctgccttaatcaccaccacgggagtgagtggtaaggataaagaaatgccaagtcttactgaagatggaagagatgaattcactcgtatcccaggtagtactcaaaggccactagaggagtttactgaggaagacacaacagaccatgaaaaattcacagttagatttcagccaactacatcaattgctaccacagaaaagtctactttgagagattctataactgaagaaagagttccaccttttacaagcacagaagtccgagttactcatgcaaccatagagggaagtgctttggatgaaggagaagatgtggatgtctctaagcctttgtctactgtccctcaatttgcacacccttcagatgtggaagggtcaacctttgttaattatagtagcacccaggagcctactacttatgtagacacttcccataccattcctcttcctgtaatccccaagacagaatggggagtgttggtaccttccattccatcagaaggtgaagttctaggcgaaccttctcaagacatacgtgtcattaatcagactcactttgaagcttctatgtatcctgaga

SEQ ID NO: 51164 - DNA, 1053 bp, Bovine  19866880442252
tgatgagagaatggaggaggaagtcatttccttagctgacgtgtccactccaactctagattcaaagggcttggtattgtacactagtcttccctgaagttactgaaaaatcccattttttcttagctactgcctcagtgactgaatcagtaccagctgaaagtgtaattgcaggttcaaccgtcaaagaggaagagagtataaaaccctttcccaaagttacgagcccgataattaaagagtcagatacagatcttatattctctggactgggatctggggaagaagttttgcctactctaggatcagtgaattttactgaaatagaacaagtccttagcacattatatcccctgacttctcaagtacaaagtttagaagccagcatcttaaatgatacaagtggagactatgagggaatggaaaatgtagcaaatgaaatgagaccactcatttccaaaacagacagcatttttgaagatggtgagacagcatccagcacaacgctaccagaaattttaagtgacgccagaacagaagggcccttcacggcacctctcactttttccacaggccccggacagcctcaaaatcagacgcaccgtagggcagaagaaatccagaccagtagaccacagcctctgactgatcaagtctctagcgagaattctatgacagcagaaactaaagaaacagcaacccctgccactgattttctggctagaacatatgatcttgaaatggccaaaggatttgttacatcaacaccgaaaccatctgacctgttttatgaacattctggagaaggttctggggaattggatgccgttggtgcagaagtccacgcttctggaatgactcaggcaactaggcaaggaagcaccacatttgtttctgatagatccctggaaaaacatcccaaggttccaagtgtcgaaagctggtactgttaatggattcccgacagtttcaatggtgctgccgcttcatcctgagcagagagaaggctctcctgaagcaaccggcacaccggcaagcacagcatcatatgag

SEQ ID NO: 51165 - DNA, 2179 bp, Bovine  19866880446396
tccttctccattattttcattttttaactagttttatttatttatgactgtgcttagtcctcactgctgcgcaggcttttctctttttgtggccgtgggggctactctctagctgcaaggagcaggcttctcattgcggttccttctcttgtcgtggagcacaggctctagggcctatgagtacatatgtagttgcggctccagagattgtgagcacaggatcaatagctgtggcacacgagcttagttggcttcacggcctgtgggatcttcccgaatcagggattgaaccagtgtctcctgcattgtcaggtggattctttaccactgagcttccagagaagcaccctccaattattttcaagcttagaaaaattttgctcaatctcaagtatttctttgatattaacaacttcatcattttcatgaagatttttaggactagggtgatgagaatccccagatcattttgtttaaatacataacccaaattaattcttcaataactttccttgttttattttataaattaccgttgtcaatgggaataaagagagggaaagtgagaaataaaattgttactctggctaaagagaaagagaagagaaagagggagagagggatggagtgagtgagtgtgtgtgtgtgtgaatgtgtgtgtataagagagtagaggtggaaggtgcttccaagtttaccatgttcagctctatccacagagacatcttgatttagataaaaatatacagaatttggaatcttaagacctgattctagattccttccagttctgcttttggcactaactttgagagcctgggaaaaccacaaagcccacgtgtcttagtttccatgtctgaattctcatctgcatttgcattctcaacttgcataatgttacaatgctctaacatcattatatacatcaaagccatagcactatgaagttctataaatgtccaacaattaataaactacaccactactgttctcattagcaagtatttgtgcccaattctgatctccttccaccaactataatcccgttattacctctccctactttttgtttgtttgtttttggaaaggtggggtgctctgtgcttcatggtaaacacttcaggcaaattattgtcctataatttgatccatcacttcaagaccttacagacttaggcttccaagaaggcaaaaaaatggcctatcttactaatagataggccaccttaacatgaatcctcattaatctctaccttttatttgtgaccaaggttctctgtttagaatgctctgaatttattgtttgaaccagaataaccagcctgggaggaaattaggtcctatatatactcaaaagccaaaatgaggctcataaaagtgatgcacttgtgtctttacagaactgttgagctcctttgaggtcacaaggtatccactatccctaccactcgcatccctatcaggctccgagacccatccaggagtatatatgtacactaacaacatttgattgttatcatatttgataacaacaaatatcaattgttatcatatttgataacaacaaatatgaaatgcacatttcaatatattataaaccccagaagcaattactgattttgacccaaattccataataagtgaaagtgatgcaaacagaggatatatatacatatatagatattcatatatatgtgaatacttactgtactgacaatttcttcccatgaattctcctgggcactcacaggaatagttagcaacaaggtctgtacatatcccaccatttttgcagggctcagcttcgcattcatttatatctgaggaaaataggaagaagagagaaagagaattactggtgaaaaaagatagatttttagaaggttttaggcatttcaagtaagaaaagctctaaataatgtcatgtgcatatgtcttgtcaataatataaatggtgcttacaatagacaatttgttaacaatcaaactaagtcaagttcaaatggaattgagaatccaaacccaacagaactaaaacactctctaatcctgaaaataaacatgactagttggggaaatattcagtgtgtccttaaaattaaatcaaacaaattaatcctgatcgagaaatgaaattggtatcacttacaagatctagacaccttcccagcagcaacca

SEQ ID NO: 51166 - DNA, 1310 bp, Bovine  19866880496240
tcaatactctgagagtgtattctcttctctgctattcactgtcccgcaggaggagcttttacatggagaaagttctgggtggtagaggccaaattaccatctaactgaaagccagctgactagacattagagccacctgtgttcccaacaagtgcatccccaagcaggctcatgagtatcgcataaattacaaaaaatgacacctcttacgaaaaatgacacctctaggggaatagcccaacagtaagagaaaaaaacctctcaaaaaacattcttctagcttgacttctcatagctaggttaaggaaaaacgagcatttattcctctaatccacacactaaaactaaaatacagcaacttaactaaaatcgatgatcttaacttctaaattaaaaaaagacaaacctgaatagatctattgaactccatataacacgtattcgcgattcagcttaccaaatttggaagatagagtgtactgacctttaagaaggaataagttaaatttaatgataaaaattgcaagtattagtcaatgtaaagaaacagcttttaagatttttgccagagagatatataaaatacttgagcagaataaaaagcaccatgaatattcttataactaaatcacaaaataaataacattacagcctgggtttttagggaacagaggtaatccactttctgaaactgtatttgataaaatatattacagcatttcctagaattgagctagaccttatttgttctaaatatttacagcttaatgaaaatatccaaggacaacagcttgaaaatatgttgaactttctttaaaataaatttaaactgcatacctattacccaccccacaaagttgcataataaacctgcaaatcatggaagagaaaaaccaaaacaaacctctagatgtctttctatcagcccgagggatatgcaatacggttttagctgtccacggtgtaagtactgaaggttaatagttaaagaccaatgaaatgttaacacagtctagtactacacttgagtagtaacacatggaaagacactgaaattaaaacatcttgttctgcatgttctgaagtgatgtaacagtgatgatttggttatattagatgacaaagcagggcttcttatgacttttaaaataaaaccatatctaacattcttccaaactgtttaacatattcttccaattcatgtacaaatacacaatatatgaagctaaaacagaattttttcacactccagttatcttctaatggcagcatttggcatgttgatacttttttttcccaaaagtaatttt

SEQ ID NO: 51167 - DNA, 2250 bp, Bovine  19866880579005
cattaactgtgaattcgttttttcattgttttcttatttatactggttgaaatgcattaggcaaagaaagtagcactcttgatagcaagggtaaaacaatcttatagttatcaaataaaagcaagagttgtcagagctttcatgatcaatactgaacttataaaaagaatactgcaatgttagcaataagttttgtccttctgtaatgagtctatattatcctaagtatttcccggtgcctaccaaacactgtcagtgtttgtaatcgaattttgaagatgaatctgtaacatgcagtactaattgatattataattttcatttgacttttatttctaatcagagattatatgatcttactttctgtgctattctatattctatatattatatactgcctgaataagttcatatttttcccagttgatttttgtcctattttttgcctaaaaaagtatgcttgtgtatatatatatatatatgtgcccatatacacacacacacgtatacatgtgaaacaggattgagtatcagtagattgagcatatttaatatcagtagattaaatctgcaattcttttgtttttgaaggaagctataactatgtaatcttcaaatacttccttaattaaagaccccagtactatcatcttgcaaaataaacagcaaaatcccattatgtttctttaaagcaaaatttaaatctttgttttgatggtatttacgaatagtcttatcttcactttaaaataatagaataattatttgtctatttttaaaaaattttagcaaatattgacatagtactgcataacttggccaagcatactcgtcatttctttgttcatttctgcatttcctgtgaaactagaattttattgaggtttgaaactggtgatggtttctcaggaaagcacaatgtgtagatatttgtgaggagaaaagtacttactaatggcaaagtagtcaaccattttcaaggtaaaaattgatttctatttattttgcttcaaaggtcctgaaaaaataagcaattatcataacgatttgttattgataatggaggtttcattgacattctcacaaattaaagttctcactgcctccatgaaagtcctcaacatctaatttataagctttaccagtgtttgttttattaaggcttagacatggaattattggagttttaaattaagggttctggaaaagaaagtatggtatgtgtacaaagctttgaggtcctgtgcaacactaagttgtttttttttttttcgttattatttgtgctgcattacaaaacccactagactgttactgtcttgtctgtctatgtgttaacagcaatttcttgatgatgtatatatagagtggtcttcaatcatagtgatgatttataaagagaaagtcaatcataatggcatttttaataaaagcaaaattaggactggctggccacatatttgtcctatgcctacatgctttctacttcagactcttattgtaaaattgttaatttgaagcatctgaaatggtgatcagtttttagcatattaaagaaaaagcgctgccatgtcatcaataacatcttcttaggatagctttaaattaggaatgtaactatatttagtttactaaattgtaagatcatatcacaaataaatactttgggtcaaaggtatatacacatttactctgtagccaatggcccttatgtctttaaagatttactgtcccgccgaactctcccttgtaggttatgcacaattcttgattctctacagagtgtatttttaaagttatgagtaattttttgcaatgatttactttctcagaattattcattgcttcttatgatgttttattttattggtagttttttcaaaaaaaaatattttcaaagagtttgctaaaatgttgctaccttttattagaaatacatagaaatggcttttgtgcattttctctcttctgtatatgcttttcaccaacatggaatatctctttaacccacaatgccccagattaatgacaataaagagattccctgtagatatgtattgtgaggtagtatatagcttttgtgtaatttctatcaatgacattaaagtgaagcagatttattctgtttaaattcacagtaaaacaagtaaaacctcataagcacaaggcacagaagatcacctagccttcaccatgagtaactctaacatgctattttatagtctattaaattatattttaacatttcca

SEQ ID NO: 51168 - DNA, 2151 bp, Bovine  19866880591883
acagttagtggcctaccataatttgagcacttttccatgaaaaatcctgttcagtttcctatagattttgcagagttcattccatggagatacttcaggaaaatagagaggaggcctgtgacgtgtcttcactcttcctctgtgcagcccaacagctccgatctcaggtgtgatcctcccgtaccaggaccaaggaaggatccttatgtgccgtgcgtagatgggaggatcaatgacgttttttctgtgagtatcattgtcaaaattgccctggaaaacctagtaaagaagaacagactattaatcatttggccttccttttcttgggagttatttttattattttcttgtttggatttccccccgccacatgtgaggtctgataaccatgttttttaaaacacactgctgctgctttcttaatgatcattttaaaactgaatgggcgatgcatgagcttcccaggtgatgctagtggtaaagaacccgcctgccagtgcagaagtcagagacgcaggtttggtccctgggtggggaagatcccctggaggagggctcagcaacccactccagtattcttgcctgcagaattccatggacagaggaacctaggttacagtccgtacagttgcaaaggaacctagagggctacagtccatagggttgaaaagagtcagacatgactgaagcaacctgcatgcaacacaggcaaggaatatttaaagagttaaataagttgaaaattagttttctgaagcaggaatacatagatttatcatttttatgtgttttaaaaagatctttttttttttttaatgcaacaggtatttattttttgcttctggcacaggctgttggtcaggcagcttgctgaaggtggtctcttctaaagagtgattcagagatctaggctgttgcaaattttagctagcatctgaaaaatgcagcattcacattcacaatgggcaacaggaaagagccgtgagattatacagggtgtttttaaaaaaacccaaggtatggaagcagcttaaatcatttctggatacattgcattgaccttaactaattatatgacctcagccaaattgcaaaggatgttgggaaatggagaggagcacgtggatatctggtgcacataattgtctctatcacagtgtcatttgttcatttctcccctagagaacaaaatcaacccagtatcaagagataactccaatcaatgctatttttaaaatacttttttttttttgccttctgtattaattcctagatccatacaatactcttgagatcactgtgacctatagtgtcctgatacagggcattgcatgactttgttcttctttcttttgtttcaaagatttttgaactttgtatgtctatttttctcccagaaggcttttataatagtaaactttgagatgtgcttgcttcagaaagaaagaaaacaaaattagcagctggttggtagagcatggagtagtggtacgtggcgtgaataactgaggttttcccatgtgcttacttgtgctgtgagcacttggaaattgaaaaggaaaagttacaatggacaccaccgtaatacaaaatgtcaactgcaaattggcactggccaagagcatcgccaatgactgaacagcaagggcatttgccatcggcctctgcagagactgaaccctgtgctgctgagctgttgaccttcaacacccgctgagggagttcaaggtggagagaggcactctgtgctccagggaatctggtggcacaggtctttggattgttggatattttcaggaacagattttatgaccccaatcctggtacctcctcatatctagaaaagcacgaagtcccttcatgatgacatcagatcctcccgactagcagaaaaccttttgtaaaatgagtgcttaatggtactgaaatcccccttcaccaaaaccttaacgatgaccttccctcactgtgtctttggagcagtctctcagaaatctctgaggtgctgcttcccaggctgcagtcctcattttgccccccaaaaaacttaactcgtaactctcaagttgtcatatttttagtcgacagtatgacaaccgctaaagtgacccagagtggaattccttcctttcgtctgaaccccgtgaagaa

SEQ ID NO: 51169 - DNA, 1340 bp, Bovine  19866880614589
atcaattaaataaattaagatgttggagaacagcatattgctcttccaaatgagacaatagtgtgggatattttaaagtaatggatggcgtcaacacatcccaattctaagacctaactacttaagctgctttggtaatattttattattaacctgcctgtatcagttgtctgccttaagtggaatccccatttttccatgaactggaaatagtaatgcttaattgttttcaaaggatttttgcccatgacaggagaccttcaataattaagtcataattaaatagtaaaaggatcataaaaaatccacatccctggaagaccaggctttaaatgttttatttttaaatcctcagctgggtattagaagtctttaaggaagaaatacttattttctatgcaaccagagtataataaaaacatcaaaaagccatttacattttaattattgaaggtgaatttaccatactcaccatttttgaggataacattaaagaggttatttcagatggatgaaatagaataaatatagtcacaagagagatggagggaactcagggtactatagggactggtttactatactgaaaagataggtatatattggggacggagctggcggcaggggagaaggagggagggaggtgtggaatgaaaggataaaagtctgcaatgataaagagataccagaatgtgaactacatcaatgttagatgaaggagacatttaagatggttactgaagggttttcagcacgttacaaaaactgtcagaactagttcaggaaggtggatgtccgtggtgtatattatgagtatgcaacacaaagtctgagctgatgaggtgtttagtaaaattttatggaataaatgttatatttaacacagaggcaaatctaagagcaggcacaccagttaagaggcttttacggctaactgcccagagaagaacttgaatgagactagcagctattgaaataaaaataataatcagattgtaagagggtttgagagtgcatcattgacaattgattgtctgttatgggaggaggggaaggaaaaaagtaagaaaaattaaattccagggttttgagcttgagcatgattttggtaccatgaacagaaatatagaagttatgcatagaaaatgctggatgtattctgggtgatttgccttgagaaagtaagtgtccagcatgaagttggaaaagtgtttgttctttatagagaatagaagtgggtcaaggggacaccacccccgtgtgaccgtcttcctttttaccactgactactttgagtcgcaagcctgggcctgctggaatgggaggttaggtggtgtcca

SEQ ID NO: 51170 - DNA, 1305 bp, Bovine  19866880615575
tgtttcctccctcccgtagcatctcccgggaacttgcaggacttcttagggcgcagctggatcccagagcacatagtttaagcgatgacactagttttctacctcgctctccgctgcctgacacagggatcgctccacgcccagtgacacagggagcctagacaaccctgatgccccccagcccgcaagcaccagggatactgcccggcggcgcccacgcctccgcagggcggtggggcgctccagcccagggcgtcccccggagctgccgacactcgctctctgccgccgcaagactcgccagtaaagttgctcaactagggccgcgagcggggagaggggtggggaaatggaaggaaaaggagggctgcagtagtccgggcgaagagggctgatcctggaggccccagattcgggtccccacgccacctttgtctgaaaagcgccctgagcgctggcttgctggttgagacgggagcaaaagcctctacctcgcttctcagaatgagctaaaattcttgcacatctctactggttcggaacaagcttttcccgccctggcgccgagcagacgtccgcggcgctccaaacaccccacccccatcccctgctccctcctggccggctccggagcacggcgcgctggacaaaagaacccaggggcaccggagagagccgtgacagccctcaagtcgccaaagagacgcgcggaccgggaaccctgcacctcccccagaccggaccgcctcccagacagcccgcgggatgagggggtcacgtccgctcagaacccggatcgccttgtcaggagctgcccgagagcggctttccaggaacgcgggcattgaccacacaccaggggccgggaaccaggtggcctgcaccaaggcggcttcggggatttgcttgtgggcaagtctcgggagtccccattcaaacttttgcctcgagcaggttaacgacaacaaaaagatcaaggtgccagggtccctccgtcctctccagctccagacccctcgacgtttctagggggggtctccgcatttccttccctcccttcccccaattccattagtcggtctacccccaccccaccctgggcttcttttgtctggatctttttcagcaccagggtccctccgtagtcctctctccaaacatccttttgaaagttacctgcattttttacagtgcctatattttcttaacttctcaaagatagttctttttgccttaattaaagccttctaccaatcacaatgtactttttttctaaactcgatttttttttttctataagttttt

SEQ ID NO: 51171 - DNA, 1935 bp, Bovine  19866880630860
atgcagggaggagcttgcttttatttatttatgactgttgagtcttcattactgcatacgggctttctctagttgcatcagtgggggctgctttcccctgcagtgcgtgggcttcccccctgtggtggctacaggagggcacgggatcagtagttgtggcacgtgggcttcgttgccctgtggcatgtggactcctcctggagcagggatcaaacccacgtcccctgaattggcaggcagactctcaacaattggaccaccagggaagtccgagataatagctttaaatgaacctcatcagtgtaaagggccatacagttattaaccataccacagttactaataatgagaggcgtatttgtgtgctgcatgtttgttatcatatgatagttatattcaaagagcaccagaaaggagagtagccagaagtcagatagtcataaatcaaacttataagaattcttgtagtgaattctacaagactgtatataattcagtgctaaattatgtggtagagactaaaagtgatgtaaaatttcaaagaagattgatgacaactatagtaataagagaaagagtcttggagggagacttacactagacttcaaaggctgcaaaaagtactcataatattactgggttgtttcagatgtcaaaacaaatttcactttagaattacatttttatgaatatatcctgtgtagaacaccaaacatttagttgttgttttcccagacctcattcattcatccatccatccatctattcatttattcagctgatacttaatgacatttgtatgtgccagtactttgataggtgctaggaagacaggaaacggcaacttactccagtcctcttgcctggaaaactcatggacagaagagcctggtgagcgacgcccatgggggtcgtgccgagtaggacatactgaacgactgagtacacacacacaaggcacacatggtctgtgccctcagagagcttaccatccagaaattaagtctgggggcttccctattgatccagtggttgagaaacctcatgccagtgcaggcgacacagatttgatccttgctgcaggaagatcccacatgccgcggggcaactaagcccttgtacctcaactactgcacgccaccccccaggccgtggagcccatgctctgcaacaaaagaagccaccacaatgagaagtctacgctccacgagaaagcatagcccccacgcccagcaactggagacagcccctttgcagcagcaaagacccagtgcagccaaaaataaatgaatacatgtctttaaagagaaagtttaagtttggaaaatactaggctaatcaagataaaacctttttcagtgaggttactgtttgtatgtggagaaggcaatggcaacccactccagtattcttgcctggaaaatcccatggatggaggagcctggtaggctacaacccatggggtcgcaaagagtcggacacgactgagcgacttcactttcactttttactttcactgtttgtatgtgtatatacatatgtttataactgaaggattttaagatttttagtatccttaagtctgaaaatatataaaaaatggtatattgagagttattttacagatcagttattggacccaatgtttagacgcctgaaaaattgtctagaggttgaagaaaaatatggtgcatattatttgaaaacataatattagactcttcgaacataaactgatcttctgtttcctatgtatataataatagccaacttgtagattacagaaatacttgaaggtatctgggaactcacctaggttcactgattaatagggcttgtacagatgttatgaacactgtcaaggctatggtttttcctgtggtcatgtatggatgtgagagttggactgtgaagaaggctgagcgcctaagaatt

SEQ ID NO: 51172 - DNA, 1264 bp, Bovine  19866880637716
ctatacatgtatatggtgtgtgtcctgacataaaagtctatctcgagaaaacgtactttgggagaagtctgctcagttcttgagaacttccagggcttgggagagagggagacagagagacagaggatgcacagacagagaccatatggaaattgagcagttcaggatctagaaatgtaggttcaggtcagaggtggagacacagggacagtcctctgaaatatgaagggacccgaatccgccagaggagaaagaggtcaacgctgctatatacatggttcaattctatgagcagtttacaatgcaacagtgaatgtagacccttaaacacttcagtttgattgtttaaacagggagctttcagcttattttattaagaagtatcttgggctttatgaagagcattgtacagagagcagtggtttaggtaggcagttgtgttctaaatgaaaccctattattcactggaaaaggtcaaatgtaaaatggctatttttgaaaaggtgactctcacataattcctttgcattttaataaatagcatattcatggatactttattcttttacaaggcacatttttggtgccttggcaaatacggccatgtagtattttcactgatcaacaccttactgatggcagggcctatagaccacaaaaagcaagactaaacattgtaaagttgtttgtatgttatggctctttgcgagagaaccagacatttgtatcctttgcctgaggctgcttagagacagtttagctgccaaataaagttgctaaatgggcttttaatttactgtatatatctgaacctgaggataatgttgtatctgagaactggcttgtggaagaagctaaatttgactgttatcaccatataagtggtcatatttgtttgactcttttagtttggagaaaaatatttttacagcagtgctgagataatatgtttgaattaaatgtaatgggtagagtcactctggaaagattttgctctgaaaatgacttttttctaagcccttttccataataaaatagaaaattttataggctgtttccccccatcaaataatatttactagttatatattttgatgacacaggcctttgtttcttttcttcaattgttacctttgatgattttgcctaagtatgttgtcagtatatacccttaaatcaagaaaccctagggtctggcaggcaggaggaagtgataatgttttacaggatatagtcaccatatataggatttgttagaagtgag

SEQ ID NO: 51173 - DNA, 1105 bp, Bovine  19866880640872
aattaaacgcttttccttctcagcttatccctgtccactgaagttgtccagttccacatgcctccattattaaaagatgcttctttctttcagttggtgtctgactgcagcgtgagctgtgtttattcaagggattattctcaaggtggagagaaagctcagattcttcattttctagggatgaacctattggtttgatcaacaaatatgagattctcagatggtggtaaattctaagaataccacattcccatatttttctttctaagtaaggggctcaattggcagctcttcattctgcttgaaatatctgggatttttgttgtttttaaatttttttccactatttctccctttgattttagtcaatgaaaattttccctgccaaaactcatacatatgagtagaaaacaaaaagcaggaaattttgaagttttaagtctttgaaaagcccttctttgaaaatgctgagaatcttacatatgaatctgaaacaaaactgcagaaccattcatttattattctgataaataaacatattcatgtgtaatgattgctgtgagcccagggaaaagataaataaagtactttgtggctctgcttgtactcgaggtcagccaaactgaacatcctccctccatgggaaagcacttaattcctgtgctgagagcctaacttcaagtggctgagaagcaaagtctactgttctaatagaaaaaaaaaaaaatgttttttaaaggccaacctttcagttcaatatacatgaaaatgtagtaatatattaaagcagttggcagcatattagaatcacctagggagctttagaaaaactttgaggcctgggtctctttgccacagatcatggtcaaaggtgcaacctggacatcaggattgttcgaatcttctgtcacagacctctggtaaattttaatatgtagtcagggttgagaaacactggtcttaacagacttagcaggaaaaaaatcaaaaccattccactgataaatggttggactgatatttatagttcgcaatttaaaataatttttaaaatagtataatcggttgaatttgatcaaactcagaaattcttcaaatgtgaaca

SEQ ID NO: 51174 - DNA, 1494 bp, Bovine  19866880658049
cagcagcttccagactactgcaaggcacggcagtctcagacacttttctctcgtgtacaccaggttggggttttctggacatttctgcagtgggtgcttctttgttatgatggctttgcaggaagaaaggcttttaggcttcactttccaagacccacctgtgtcttttcttccatcttcaccccagctgtgcagtcatggaaaaataatcacatccacttccctccgcttcatttctcagcactcttgctatactctttatctctgccttgattctctaacttccttacttagacttttgggatacaaaagcccaaatatttgctggctgtttcagctttctgtttggatacatccttgtcctgaggcaatgaacccagaatatttgctacaggggacaaggaggaggagggcaaggaaagcggaaaatagcagtggaaaaacaaagaacattagttggtttatcaaagctgttatctggatgaatgtgatatggaagaaaaatgtacttctgaagccaaaaagacaagaaatcagatgccaacaatgctactttctagctgtaaatagggcaagttttatttagcctctctgagcccttgtactctcacttaccaaaatagggaattaaaagacctaccttctggagttgttgtgaggattaaatttagtaagataatatacgcgaagtcgtaataccttcatttactaaaaacacaagattccaactaccaacccaccgttgtcacagaaatgatgtaagagtggatcgatgtctgagttctttcctgagaaaccagcatccatgaagaaccagctattgagcctgaacattcattctgagagtgacctctcactatgaaacaagacgctgctctagaggctggccagctccttgtctttctgatgctaaggaatagcctgaggatgggaattagcttttcagttcttccctatcattatcatttttagcctttggagcagtttattttttgtgctttcctgaatccagatgaatactctgcagatagacagatgccttatattttaatccacttggctcttaaactggaacactgctgaactcttgtggggagagaagagtgctctggtgttttttcaggagttggagaaacccagcagaggcctgttgccagattttccttctctgactaagaagctgtcatgcagatgcaaagccactagatgtcacaaatggggaagtgttctgtcttgctccccgtggtttctctgcaaggagaaatggtgatgtactgtaatccttaaaaaaaaaaaaatcttctaaaagactaatttttagggcaattttaggtttataacaaaattgagtagaaagttggggagtttcccatatatccactcatgcaaacatacttggcctcccttattgtcagcatcacttgctagaatggtacattttttaaaaatcaaagaagaacccacactgacacatcattatcaccaaaaatccat

SEQ ID NO: 51175 - DNA, 1127 bp, Bovine  19866880707176
taccactagtgccacctgggaagctgttcttggctaatttaattttgcttatcctggtattttcataagtattctccttaagtagatgagtataaaaggacatgtttgatatgcctacttgtcttctattccttttcttctgttaatagccccctgatgttctttgggaaagtcctctctctactaatctccattgttttaagcggttgtttgggtaactcagggatgatacagtgaaacaagaacaccaaagccagtgatatttattgcgggacttttgtgaaatttttcagagacagagctcatcccttttctaccagggttgaaactaataagctgtgtgtttagagccactggtaaccattctgcttctgtataggaagagcctatctgaggatgaaaccaacacagaagcaaaggatgcctgagggcattatttaaatccctgaatccagctgtttgtgaagccagaatgtttcaattatgagacattgctctctctcttgtgtgtgtgtgttgggggagggggaggggcgggggaggatggctggagctggtttaaattcatatctggcttttgaatacaagaactactaacaaaatacattgagaaattgtagtatctgaagggttctaagctaagctctggaacttatgctgcataggtaacccctgacttctttgataacttcaaaatgtcatagagggtaacaaaatgtccctttgtccacagttctgtcctaggcaacattaaatatatatgaatggaaggaaaacagtaaaaaatgtaaatgtattcagatcctatcaatacaaagttctatttttatctgttctcttatcagaaaacacctcatattgctttgaaagtacagatcttgtatcatgaggcagaggacagaaactgaatatgtataagaagaaagaaatgctaccctccatttggaagtagctaattgacatttccaggaatacttgcctttaatttgattataatgcattgtgctcacatcaataattacagtaactcaaactaaatgcccatgacttttcatggatcttctttacctaaatatacataaccatatttgggctttccccctatcatatcagatacaatctattag

SEQ ID NO: 51176 - DNA, 2048 bp, Bovine  19866880712211
aatttttataacactgaactacctctagaattaatgtttgcctcatattttttaagcacctcattaaaaatcacctatcacattttgttaaaatgtaccctggatatatagacctctgtatgaaaagaaaaatgctctcaaatttcagcagatggccaatttatctcaggcaatattaaacataactttattttagtactgtgaagttatatagaaaacttctaatttttaacaaagatgcagaagtattagaaagtataatttctcctcaaaattaagaaaaagggacacactcttgggataaaattgtatccccattcatcactacgattaagttttctaaatgaattcatagacatatttttaaacacactgttctctaaattagtttctaatccagacaattcattctatgaatgttttaaaagtcttaatgaattacataaaaatcatttgaaaatatattgttctcaggattcaggatgtcttcacaagaatggtgataaagaagaaacgaccaagattatataaatgggagagaggctcttgcatcagtgtattaatttcctattgcggttgtgacaaattaccacaaagttaatgatttaagacaaaataaatttatcctacctacagtctgaaagataaaaatataaatgggcttcattggactgaaatcaaggtattagcaggactgtgctccttttttgaggttttcggggagaatctggtatcttgccttatccagctgctagaagctaccccatattccttgactggtgtggcccccttccatcctcaaagttagaaggccaatttttttttataatcatcacttcaactctgaatcaatcatcacagctcattctctgaatttcttgcctccctctttcccttgagggacccctcataactacctaagatccaacagataatccagggtaatgtccccatatcaagatccttaatttattcatatttgcaaagttcctttcacacagattcaaggaagcaggacctgaacacctttgggagaccattattctgctaccacatcagacacattgctattacttcctctcccatataatcttatacctaactggtcacaaaaggcaaaggagaaaagggaagatgtacccatctgaatgcagagttccaaagaatagcaaggagtgataagaaagccttcctaactgaacaatgcaaagaaacagaggaaacaatagaatgggaaagactagagatctcttcaagaaaattagaaataccaaggggaaatttcatgcaaagatgggtacaataaaggatagaaatggtatggaccaaacagaagcagaagatattaagaagaggtggcaagaacacagaactatacaaaaactacacatcatgaatggatgtgagagttgaaccataaagaaagctgagcaccgaagaactgatggtttttaactgtggtgttggagaagactcttgagagtcccatggactgcaaggagatcaaaacaatccatcctaaaggagatcagtcctaaatattcattgtcaggactgatactgaagctccaatattttggcgacctgatgcaaagaattgactcattagaaaagactctgatgctgggaaagattgaaggcaggaggagaaggggacagaggacaagatggatggatggcattgctgactcaatggacaatagtttaagcaagctccaggagatggtgaaggacagagaagcctagcctgctgcagtccatggggtctcaaagagtaagacacgactgattgactgactgactgaacaaccacaacaacaaactggtcacacttattttcttctaagtattcatcatatcaatgattctggaattgactctccagatatcatttatttggtttttctgactttgaaaaaaacaatctttctgatgtcagttcccacttttagttgcagcccccgtccatcctaaaggagatcagtcctgaatattcattggaaggactgatgctgaagctgaagctccaatactttggtcacctgatg

SEQ ID NO: 51177 - DNA, 1096 bp, Bovine  19866880804633
tgatatttaggtatgtattccctgataggagctgtaaaacaaaaaaattttaacccaaagaaatatgaaaaagaatgtgttacattactctttccagattctttgttaaatatgtaattgtttcctcctcagagactataacaaaaatgtggaagtttggatacaagtgatgagtctgcttataccggacatctatgtggttaatgaggcatagttgcagtgaccattgaaaagattaagctgtaagaagcgaatactttgaaatataagccacatatacacaaaggatctgcacttttcagaaatggaaaattgatttttagcagctttcttttctagcatacctaaaaggtgttataggaaatttctccctagatgaaaaattggctgtgtattttgacaaataataaacatgaaaaagtcagcatacaaatgtcaccagaaattaaagatagaatactatttggtaacctggctaagtcaaaagatttcaatttgcatcatactatataaatatatggtattttttccccaaaggtatacaatgctactgaattgctcactggcctcacaagctatgtattggcaatagattttatgctcttgaacactaaacaagaagaaaaaaatgccatttgaaaatggagtgatttatatgaaaattgatagctggaaactgcccaaatttagagatagacctaagaaaattgaaaagcagaaatgtagtgttgaatggtggggttaagcattttaccaagaacctaaaatccagagatgttaaaggttttgttcaagtagagtatatgataaaatcttaagtgtctttcctttttaaaagagcacattaaagttaaaatctaaattctgtataggctatacatttcttcatttactaaccatggcaggtgactaagaaaagcccttcacaaattgttcaaaccttccattccagcctcctttcctaaggttcttctgccatatattctagccacaagaaaatcctcctccttctgtaaacacagaaaattctttgaagataccacacatttgcaagtatacctttccttgtctggaatgtccctccctccttttctca

SEQ ID NO: 51178 - DNA, 1187 bp, Bovine  19866880851983
actttttaaaaatgctttcacataatgtgaatgctttcaggtaataaaaatgttttgcagggtggtttttttttttttttttttttttggtaataagaattccttgaattagtatagtactctgagcatgctcacacacatgagatatatacatgtatgtttgtacacatatgccaaaagattaaaccctgatgataaattagcatcaaaacattttatttattatgaatatttgcatagtgtatatggctagttgaaatttctcacagtatttttttctgatgatgggtcagttttatgggcattatggtacactgcagttcttgaaaggaatctattaccttacagtatgtaattttgacttatattttacatgctgcgatacttcatgtgtttcatataaacactttcagatgggatatacaacattcttctgtttccaacaaatgcaaaagatatatttgtatgtctctttattataaaggttttattataaaaaaaatatagaagcagaaaagtgaataaaaacaaatatactttgggatgaataaactgtttaaaagagaaaattcatgtgaaagtgttactcagtcatgtctgactgtttgcaagaccatggactgtagcccaccaggctcctctgtccattaaattcttcaggcaagaatactggagtggattgccattcccttctccaggggatcttcctgacccaggtatcgaacctggatctcccacattgctggtagattctttaccatttgaaccatcaattcagttcagttcggtggttcagtcatgtccagctcttggtgactgcagcacaccaggcctctctgtccatcaccaactcccagagcttattcaaactcatgtccatcgagtcggtgatgccatccaaccatcttcatcctctgttgtccccttcttctcctgccttcaatctttcccagcatcagggccttttcaaatgagtcagttctttgcatcaggtggccaaagtattggagtttcagcttcagcatcagtccttccaatgaatagtcaggactgatttcctttaggatggactggttgggtctccttgcagtccaagggactctcaagagttttctccaacaccacagttcaaaagcatcaattcttcagtgctcaactttatttatggcccaattctcacatctata

SEQ ID NO: 51179 - DNA, 1683 bp, Bovine  19866880852949
catatattttcactcaacttgggtggggtctgacatgaactttcccattccattaaaatctgcaaatacgtagagaaaggatttcaaagcaaacagctacatacctaccatctaggttctgttagtgttttatgccatgcctagtcactggtctctatttacaaatgcatcaaaaaccacttaagttctctaacaagcagctaggcttacagagtactgagccagaggcctacatggctgggtggcattgagaggcaagcaatgggaactttgtagatgagcacacagatgctacttcaccttgcctgagaacaggagtcctttgctacagctggtgatgaaaggtgcaaccgaagctcctggatgttctcctgaagctttgtaatggcaggctgtgtgtttgaatgggtctggggagaaagactagacgagggaagggtcctagtccccatatcgatgaccttgtgggtcttaaggtagaagatcctgttggggtggggggtagtgacctcacaggtggtccagtggaaggagacgaggcttcacacaggtgctagccatcacggccgacacctgagccagcatctgcattctgaagatgggggtggtacctaaagaccagaggaggatcctgatcaagggaaggcagcctgaactctgggagggctctccctcaaaggtgggcaggtggctgggccagctgtggctagagtacagaggagatggactcttactcaacagctaatgaggaaccgctccggggatctgaggccccagttagcatcatctgggaagaagctgaggctcaaggcagttcccttcctggaatagggatgctaaaggaccaggaagtgcttctccgggtttcgagaaggggtggagtcagacaatcgggagtgcagcctggctgattcaagtttccgaaacggtttccctgctggtgcattcagccactaggtggtggccacagcttgtggttctgtacgccgaaggcttcaggacaggtagctggtggtccagtgccttggcaggcgggcgtgtgtggggtgggggacccctagagtatgagggggacctctggttgggatccctctaccaagaggccctgggctgacctgagctctggtcttgtcaaaattcctcccattccagcagccaagttggattttgttcccgctgggcttgagtccccgttcctaaggttttgatttaatgaggccctgggggtgagacacggctgagtgattggagaagtgtgagagagtctaggaataaagctgatgggttgggttctaattcagaattcaatttgcaacttgctctggacttgtaggcaagctgatctctgaatatgcatcctcttgtctctaaagtgggcttcccctcctcaaaggctaaggttattgacgaactggcttaccagtcactgaactgcctagaactttgcctggtaatagctgctcttatttccagatatatatcacctgccacctgaaggtcactccggttgaccgagtcccggaccaactaaacaaagcctgttccttcagcaagtcctccaacaggtaaggagagcagactagggtggaaaaccagccatccttgctcatgctgattttttccccaatgtgcccactattagcaaactgcttcctgcaggctgcaaagctgtctaacttcctg

SEQ ID NO: 51180 - DNA, 982 bp, Bovine  19866880860201
agtgaaccccccgtgcttgcgcttcctgcactggcagggggattctttaccactgtgccacctcagaactagagcataaaaatgtattgcattgacaggtgctaaaagcaaagagtgactgtagtttcctccttcaagtatgcttggccggaacctagtgcttggttctgatcaacccctcagagccatgcctccacgtcagcactacattctctgcccaaaattctccaagggcccacccctcccagattagacagtagtcacctcttctcagtttcctgctcttgtgaccaaatcctccttgcaggcgcccccaaaccaccatcaggactgcagaaccgaaaaggtggacacattggcctcagggtatcaataacgccagccctggcgatgggagagcaggctgctcgcaatggactatgcataacacctagacagtgtgtgagcctcttattcctggaactacaaagctcccacttgtttgacttccttgagactcatttcgaactgatgaaatccatttttttaaaaatggatgattatgtaacaaacttgtgtgagacaggggttcagaaatcttggcatcacagtatgtacctttgacaaccacaccctgggacacagtggccgtaatagtaaagccccaggccggcttcctgtggccaatggagatgactctccagggtgaaggatgcagtacatttacacttgtctcagttttacactttctgtaagctttacagaaggtccacttctgttttcttcccatattggaagaaattggaaaattggactagtcctttcagtgaaatattttagtactaaaaggtactaactggcagtccaaagatgttaaattagtagcagagtttaacaacttttacatagtagttgattattggcagaagaaaatttgatctatgtatcctatttccagcctgagcttcttttatgtaaattaaaaatttatatcctagagttt

SEQ ID NO: 51181 - DNA, 1518 bp, Bovine  19866880860402
aacatccgctggatcatggaaaaagcaagagagttccggaaaaacatctatttctgctttattgactatgcacatattaactgtattcaaataaatgccatcctccaaatctagcacaagatcaaacttcatgtagaagactgatagaatagaggtgactttgtaattttctgaaccttttctatgcagtgtctactgcatagaaaggagcacctcactgtggcctagttattctgcagttctcagggtggggaattgagcacgcagtatgctgtctgaagtctttggccaggagagattaacacttctcttcatactttcacaaagaaggagttggtaataacaactttaagtcctgaggcacttcctcattggttggccaaaaacaagcaaatcaacaaacaataaaacaaagattttataaaccaaaaccttcctctaaatacttctctgcatacttccagaggcagctccacaacttacttaaatgactgaattcacaaattttaaattgtagttgactctacttttccttagtaatcacacccacacacacgtacacacacacatttatagcatttaacatctgggcaggcatgaataatcatgcatacataacatcattgttatttttgcatcactgcagttgagtaaaagcattctaagatgttgtgaaaatacagaaatacgtatttcttgttgctttgctcatggaaataatggattgcataggtaattctatatttgcaaagcatgttcagtgcataattaactagttatatagtatagcagacaaaatgatccataaatcaatatgaactgagtaacatcttgtaaaataaattatcatatgcgaagaagtgtattttatatatttcatagtgagcttttccaatttgatggtgagccatgctgtgtatatgattgctttaaatgggtagaatttctatgttttgaaagtgtacttaagacacccaagaataagacaaacacaaaacaacagcaaccaaaaaaaaaaaacaaaacaggagatataagaattgttgagaccacatagaaattacagctggtccagtgaagaagtatgtgtgttttaatagcacgtgtatatcagagcaatacacggctcagtggatagttattgtacttgacagttgatcctatgagcaaaggagaaagggaaggagaagggaaagaaggaagggaagaaaaaactgtagaatgcactcttctttgatcaagcaccagctcagttcatgaacatgatcactgccagactgctctgaaaatttgtgagcaactttgaaattagagaaatagattcattgtatcaaaatatggtggtaagctccatggacaaattaaaatttgtggaaagcccacctgtcctctgaggtacagtcctgaacgtccccttctctgacttcaatctttcccagcatcaggatcttttcaaatgagtcagttctttgcatcaggggccaaagtatggagtttcagcttcaacatcagtccttc

SEQ ID NO: 51182 - DNA, 775 bp, Bovine  19866880870833
aatttaaagaacagtctagtacaaagtaagtgtatttaaaggtaataaaattgcaagagaagataagtagattttaaaaatgagctaaagaaacatctaacatattcattctttatatcctaagacttcataaattgtagaaactatttatgctgtttatatcatgcagtaatgcatagagtggaacattaagcaccttttgcaaatatatgtttattttagtcatttatgaatttaagaacaaatagatattggatagcacaaattgagtccaaatattaatgtatcataaaatcttgtcctttggaataagatatgagtagctattaagtaatattttgatgtaaatattcctactgatttaacaatttcaagattgcacaaaatgtttaagctacatgcctgcattttgtctcacaaagcttgtaataacatgtttaatgtaaatgcaaattatgtagttgactatttagattatattcaaatttgaagctgaagagatgtgttctttagaagaaacagttgggtgtcaaggttcctattaacctgtctcatgaagactttcttctttatggtatactgtggaaccaattactagctaacatagggcaaaatgacaaatcatcccattatcaaccaaatgagaaaaacttgaaaacttatttcaatatttaaatcacttgcaagattacagttcaaatgacacaacagcattgctcaatttaaacttacatctttctgtaaagctgaaaagcagattaaacttgaataatta

SEQ ID NO: 51183 - DNA, 994 bp, Bovine  19866880883134
tatgagtatactccaatttgacatggggaagtctggagagataagctcctttggcctagacagcaggggaaaatatggcagtaaggaaaccccaccttctgcctgtaataagcatgtaagatagtcaaagtatatgtcagcatcctgccaaaacatgagacatgttatctgtaactgtgagtgcaactataaataaccctgtttcccctcaccccgcaccacccccagtgccatcatcaccaagttgtccagatactgtgttccttgtgctgcttaactcatgtttaactcaagattaattggcaatgagtggccaagagactgattatatgtgcagtgctgagagcatgaacgtgttaactttcataaggttcatgtgaatttaaataaaagtgagaaaataagaggtgtgatcaaagaagaaaaacatgttgttggatgaaatttggaagcagatggtgaatcgatgaggcaaatacagtaagacagagtgattggttaccagaaagtacatctagcttttcctaattaaaaagagatttaactacttcattgtactcttacccttaataaaagagacttttacaatgtcaaatctcactatttatgttattaggaaaagtagttttagcagttcaactaggtaaggaaaggaagtgggagtagaccagttgctatagagattctaaacaaagccatgaaatgaaatatgcaatacagagatagcactaaagaagcaagcaatataaatgtttaataggaagaaaagattcagaatctgaaaaatacaggatacgttgaaatggctttgccttccaaaggtaggctgtacagcagtgcttcacattacattcacaaatgcaggtctttactcttcgtaaataatacagaacagtcatgctatccattccccgtgctgccctgtgaccttcagttaaactattgctttcatctttttcttcattactgacatcatatcatttcaccaagtcat

SEQ ID NO: 51184 - DNA, 1192 bp, Bovine  19866880889332
ctgcctgaaatgcagatgtggttgtcagccttcttggatcacgtgtataaggacaacagcctagggatggcagagaagcaagggagagggagcttgggacttgtgactctgctgtgccagtggtgatctgcttacattcagttaatcagattgacccatgagacagaaatcaactcatagcttgttaactccaagcctttgttaaaaagattaaacctgtatcctaacacagagagttgagctgtgatatccaggtgtgcaagggtctttcacactgcacagtgtacagcctctgtgttgtacaaggcatccctgaatacagtcccatttcttcaatcaggacggcaaagctcaaggaggttaggtcacacttttagcgaatcctagatccaaagccctacaagcattatagactatacaggggacaatacgccagtttctttataaaataaaataacagtaacatatcaactttcttaggcaaaagataaaaatatgttaagggctagaattcaatatttatgtactcagaaattaaagtaagacatttgaacaaaattagaattggagacaattctgctgaatgttgttcagcatgttccaaggaacaggattctctccttaaatgtgatagctcacgtgacaggctgtgcacggggcagttaggatgcctggacgtgtgggtctatcatttgcatgcattaagatggaaattgagcatccatattttacttccatgtgccagtgaagtgattgcacttcccaagatccctttgtactcataattatgtgatttgtgaaccaaatgagtggtttgaggatggaaataggtacataggaactccatttgggaggtccaattttgacataaatgactagaggctttttatgaaagaaagattagatattggattcaaattcagtttatttaaacatgtgatacttggggtttcatttattggaagggcccagtttgattttttggtacttaaaattgtgctttaattgggagatgtagttaggtgatgattgaaataatctgtaataagaaaacaagtataaaatatcagttttatctgtgggatatatcaaatcaactctgcagctgtaagaaaaagtgtcaatttttttgtgtgtgtgaattgtaataatgctttgcaattatctgcctgttgttccaaaatacatgtgt

SEQ ID NO: 51185 - DNA, 1593 bp, Bovine  19866880909050
attactttactgctgggagttatttaagaattagtgataattgggttgattcagttaaaatgccccatgtcaactagaatagcttcctgcacactgtggttcagcagatggcttcaaatattgattccggattatagaatctttccacatggattgatgtcggtgcctgaagatgccggaactttttattctctacagaactcacagaattgtagatcacagttaaggctgtgggttcccaaataggctttagacatgaatgcaccttgctaagggtttgaaattgaacttggagttctttttgtttaagtgtttgaatgtctcgctaagagtcactgaggaaggtgtccaggcgtggaccctggcagaacctctggaaaatgatgtcctctgtcagtatgacttgaatagattgactgtgaagtagctccatgggtagaataagaaaaaaaactatttgttgtatgattgtactgtcctttaacttaattctcagaaaaaccttgatagggatttttgtaaaaccttcctttttatacatgaagatactaaggaacagaagttaagtgactgggtataccctttttttactgtccttcttgagtagcttttcaggaccaccaaagattccccagtagagcaacaggcagtcttacaaaccaggagggtgcaaagtactcttaatgctccccgaaatctctgatttttcacatgaaaatatcctaattcttatctgagtaatgattgcatccctgtttggattacagtgattgggattgctgggttaaatgacaactctatttttaacattttgaggaactgttttgaaatttttaccagaagtaccttagggtcccgattctttcattcctgccaacacttgttttaatctgattttttgattataaccatcctaatgtgtgcaatactacctgtgtgtggttttgatttgtatttccctgatagctagagatgttgagcaacttttcctatgactgttgactatgtacataattttcttggagaatcatctgttcagaagctttgctcatttttaattgggtatttgcctttttattactgagttataggaattctttgtatactctcgattcaagagtgtctattcagatatatgatttgtaaatattttctcccattctctgatttgcatttttactttttcaataggaccttttgatgaacaaagtttttaatttttatgaaatccaatatctagtttttctttgataatttgtgcttttggtgtcacatctaagaaaacagtgctaaatccctagtcatgaagacttatttctgtgtttgtttctaagaactgtagaagttttaacttttatttttatctattttgagttatattttgtatatggcaactctttgcagaagaagtaaaacaattttgaaaaagaagaacacagttgggagtctcatattttccaatttcaaaatttacaacaaagcaatagtaatccaaacactgttgcagtgacgtaagcatagtcatacaggtcagtggggcagagtccagaagcaaacccatatatttagatcaatagattttcaccagggtgc

SEQ ID NO: 51186 - DNA, 1286 bp, Bovine  19866881014770
taaaataacactgatattcattcactctgactctcaggctaagatagacataaattgcatctgtatttttctaaacattctcatgattttctagaaatcccaacaacttctcatctgccaaatcactcagtccactaacttaggtgacagacaacagtggatggcatatttctggagcaaagagtggtaggagacagagacagaaagggcttcacatttttcttattctgtcctcagcatctgctgctgctggttaataaaactgctcaaagaatataacataagaggctcttgatggtacttggggcaaggagacaaggtgtctcggtcttagtttcattattctgttattaacttcatcctgccttagcttcaacaagctccccctctatctgaggagcaacatccaaatatattcctgagctccagagttaggctttcagggggcacatctgaggttttgtactgagacctggggctgtcagcataatctccccgagcctttatatctctatcagtaaacaggaatgatagtaaaatcatcatgaatattaagagaggtgatttagtcattcatttagcaaatatttattgagtgcctgctgcatgccgggtactgttgcaggtgttaggaacatggtgatgatcaagacagaggagtccctgtacttagggaacttacattttcatgaaagaaaacagatggcaattcgcttatgagagtgaccagcacccaataaatagtaccttcaacacatagtaattgagcactctttggggtattatgggtaaaaaatagtgacctcaagcaaatattctcttgaacatttactttcctacttgtgcctttttgaattttccaacatatttacaatgagcagggattgctaaggtaataaattaagaaaaataaaagagcgatgacataatttaacatatctaaaagagttttcatggtgtctaaaagagaattatgattcaagttatgattatgttgaattatgattcaacaaacagtaattgcccacacagttttcagcttggatgtgtgttttccaacttcagcacagtggtccattcatgcttggtaacttcagcatctctcctcctctggtctagtctccatcccaagcctctttcttcatggatgtacaggatcattatttttgtgtgtttaagccctccgtttattaaaaatcattttacatgttttccattcttatacaatcagaaatgcccaagcgattgatatctgcccactgttagtgagcttcgaatattctttg

SEQ ID NO: 51187 - DNA, 2509 bp, Bovine  19866881027540
atgggaagggtgcctacccagacttctagctgaggacattgaaacacagctggacaggcaagttactgtttgaatggcctccttaggtctcgtatgtgacttctttgtggcagacaagaaaccatgaaacaaagcaggcatggataccagccagctggccatctgtttcttcatccactgtgataatttagtcttgtagaattttgttaagtgaacattaagtaatgaccatgtcaaacagagtgcataatgaatgcttcttaatcactggataaaagcttaggggaagcttgcccaaacactgaaaaggtcaccgatacaaaccaagaattaaaaacaagagagcaatgaaactgatgcagaacagcaataattaacttcttttccagtttcacttctgatcatatggaatctatgtcacatggaagatgggggtctcataaggaagctgggtaatagtgtcatagttcctaattcccagtatacatgtgtcaaactcaggaataaatttttaaatgaataaaacatgtgaggagatttatcattctgactcaagctgaaggcaccagggttatagctattaacaccaaacttttccaaataattccctggattaaaatcaagaattctggaaaatattttctgtgttgttttctataaagatcaactgaaatatctcattctgagaaagttttttttttttttttttgtctcataaacaatacctacaaagtcatcaagttttttaatccccccagtggaacgatgtactcgattaactgtattattgggatggtcggtctcctactgcctggaattctgaagttcataagtttacactaatcttagatagtcagtgttaccgccactattcatgaaaaggaatcagaatgttttacttggttaagttactatcctattacctaaagaagacaatatctgttcctaagaatctgcttatatggttccccagctcagaatgcctttcttcaccccactgtctcctccaaatctccccttccttccaagaccttccaaagtttcgtattctccactcagcagtggacacaggatgggaataggtcagttttcatttttaaaatcggaggagggcaatgccaaataatgttcaaactatcgtacaattgcgctcatttcacatgctagcaaagtgatgctcaaaatccttcaaactaggcttcaacagtaggtgaagcctcagctgagaacttcaagatatacaaactggatttagaaaggcagaggaaccagagatcaaactgccaacattcattggattatggagaaggcaaaggcagtccagaaaaacatctacttctgcttcactaactacgctgaagcttttgactgtgtggatcacaacaaactggaaaatgtttagagagatgggagtactagaacaccttacatatctcttaagaaatctgtatacgggtcaagaagcaacagaactggacatggaaaaactgactggttccaaatttggcaaggagtacgacaaggctgcatattgccattctgcttatttaacttaaatgcagagcacatcatgcaaaatgccagagtggatgaaccacaagctggaatgaagattggctgggagaaacatcaataacctcagatatgcagatgataatataatggcagaaagtgaagaggaaataaagagtctcttgacaagggtgaaagaggatagtgaaaaagctggcttaaaattcaacattaaaaacaaagctaagatgatggcatctggtcccatcacttcattgcaaatagaaaaagtgggaagcagtgacagattttatttttcttaggctccaaaatcactgtggacaattacttcaaccattaaatataaaaagacacttgctccttggaaggaaaattataacaaacctagacagtgtatttggcttccctgatagctcagttggttaagaatccacctgcaatgcaggagactccagttcggttcctggtttgggaagatcccctggagaagggataggctacccactccagtattcttggtcttccccttgtggctcagttggtaaagaattggcctgcaatgtgggagacctgggttcgatccctgggttgggacgatctcctggagaagggaaaggctacccactccagtattctggtctggagaattccatgtactacagtccatggggtcacaaagagtcagacatgactgagtgactttcattttacagacagtgtattaaaaagcaaagatatcactttgccaacaaaggtctatacattcaaagatatggtttttccagtagtcatgtatgaatgtgagaattggaccataaagaaggttgatcactgaaaaattgatgctttaaaattgtggtgctggagaagacacaagagtcttttggacagcaaggatatcaaaccagtcagtactaaaggaaatcaaacagactattcattgaaaggacggcttgaagctccaatacttaggcca

SEQ ID NO: 51188 - DNA, 1789 bp, Bovine  19866881060665
tttggtatattatgctactgtttattgccaagtgttatagctagcctctcttgccaatttacctcataccatgaatttcccttctcatccataatattttatacatataaattaactttttcaccagaatggacaatgtgtatccatgttatggataatagttgaacagaataaagtattaacaatgcaactgattatttttacagttaaagtgccctagcttttataaacattcctcaagagatattattccctgcatatacttttaatatcaatttgtggggtcaggagatggggtatgacttctttctgaaaatgtaaaaatgtaaagggtcaggtataatctcttgtcaaacttgaaagtaaaacatattcatatcttaagggtataaactgcgccatgtgtgagactggccttcatgaatcaaaagactgaaaaattggggaaggcgatgttcaccaactaaaagcatagaacttgcagcagacttcatcgcacgagggcttcctcctgattgctttatgatgaatgagctcaggatgatgctggcccgtggtgatgcagtgacacgcaaaataaacactgtgcagcaataattctgcagagatttacaggtagtcagcaagcctgctcgaattaccaaaatggggaaaacgtccctatcgcgataattaatggtactaaatctgtaccacggattgcttcataaaggaaacccatatatagcatgaaagtgtgattcttaaaatagattcactcatctgcccaaatgcccctaattcctttgaatgtaaagggttcatttaaagtttggttgttttgaacaatcacttgcatttccttctaaaccattccctttcttaaaatcacatataaacccaagaaggtaaataaagcatgcattttaaccattatatgcaaccttttgaaatgaataaaattctctcagttgtctctttgcagggatgtgttctatttttaactaaatggtctataaatatgcaagtctctcatacttggaggttgtactaaaaagtgggacacaaatggatatttagtgttctcaaaaacacagtaatttcaacaaaatttcaggccaaagtgacaaagagagttgtaagtgttgatgacagaaatataagaaccatcaccaaaaatacagcacagtgaaatgcctgggcaagattttctgtttagttcagaatctacctagattgaaagtgaacaactaagagacccagtcataaagtcttcatttttatatccagtcttgaagctccaggaggactagaattatttaaatttgagtcctttggtagttatctttgtgtttaaaaaccactttttgagtaataggtaagttgctagataataacgatctaggaattcatagtagcaatcttggtttttaaagtattgtctcctaggaaacaatgataaatttacatgttttggaaaacctaaagaaaaaaaaaaaagacgaaactaaacgcttatggtagatgtacaaacaaaaagcttacttttctatgctgtatagtctaaatgtaactgcaatttatgaggtcaggcagattccaattttcactgaaattttgtcataaaacataaatcatagttgctattaaaattaaaaagacacatttaaacttgacaagagtttccagtaaaaatttgttgtattttctttgaccactaaaagaaacacattgccccttctacattaatcccattctgtagtgtgttttagaacttctttctcttttaccctctctctctgctccttct

SEQ ID NO: 51189 - DNA, 1133 bp, Bovine  19866881102839
tgctcacatgatataattccccacctctgaatctctgcttatattgtctttcccacagaaatctcaggagattgcagtacatgagcaacccagtcttgagtcatttaaaacataactaaccacaccctttcttatagcaggcaaatatggctgctatatttgaatatttcaaattcaaccttaaattatttcaaagttgtctagcacatactcaattccagctcctggatgaatatcatcttatatctagcaaagagaggacctgtaaacagttaaaatagtgggtatataaaccacgctggcagtttgaaatggtgaccttagaaaaatatcacggtctctaatttttggatcttaagatatttgctgaaagagcaagagcatagaatttttaacatctagatttcattttcaggactccatacagcatttttataacacaccaagtctgcagtcatttcaatggctgtttatggcctctgtctcagccagttcaagtggaggtgaaagttgactgcttcagtggtgctccctattttgaagtggaccaattttctgttctttggtagtctgtgactttttagcacttcagtgtagtgcttgcaatctgtattttgattgctaaggcttgaagactttgttttggtagtaaggacttttgattattctttgaaagttctaacttaagctgatcatgtttagcataggcttagaaattaaagaagcagcatctgactatatgcttgagagattgctgagcgtacggcaaaaatctaactttcaagtcaggaggtaaaatgcctgtattgaattgacctatctatgttagggagcttcctaaaatataattgctgagaattatcgtgtcaggtcatttgctgaagttattgtatgtatttgtcatggtgactctgtacagtagggatgagtaggccatgttgtggacatctgctttttgaattgctttaatctttaatctttcggaaactatccctctatgcaattcaagtggtgcaagaaagtaattattccttcacctccatgtgctgtagatcaaatctgccaacctgtactaatcttagtagccttaagtacctaaagtcctgagagaaagaacagaactcaagaaaagc

SEQ ID NO: 51190 - DNA, 903 bp, Bovine  19866881140078
ttctatctgtgagggcttatacccaaggctgatgctatcatatcatgttactctgaagcatggcagagaaaaaaaagaggtaaaaagaagcatgtaatggactaaaagcaaaggaacaaaacaccaattgatttttctgtgttcttgcctaaaactgaaggaggtagaagacaaattatcaaaatcaaaataataaatccccagaacagagtctatcattatgtctgggatggtaaggatttacagagcacttaactaactctggggacttaaatgtgataagtagtttgctacacacttccctcctttttttcttttcttttctcttcagagggagggaatacggcagtcactgttctcattcagcttcagtttagaaaagaaggggaaaaaagtggcccccatctatacagtaaaaatttcctaggaaagttaaaaaatacttattctttggcaatttaatagcagcctcttcctagattgttttgctttgaaccagatgacacatatctcaggtctaagaataaaaacaaaatgtgtcaaaataaattcacattgtcgtgctctcataagacatacttgagcttgcttgccttctgtaagctccctcagaccccctctgccctcagtttctttctctatttcctccaaaaactgtacagagacttatatggtatgttgtacatggatgtagccaggggaccagccatatcttgactgcttgaggtagtatttttctctctgaacttcagttttcccttctgtgaagttagaaaaaccattcacttttcaaggttattttgaagatacacttggcttgtattaaatactcaacagttggtggccactgtaactattacttttatcattatgattatttttattactgtcataatcatgttt

SEQ ID NO: 51191 - DNA, 785 bp, Bovine  19866881159235
cctgctctcctagtcagtaaaacctccacaagtcctattctttcactttcctcatatttattctataatcatattttattatcatcactaagattatttctagttgaaacagcagatttatccaattcacattttagaaagtatcaattctatatgtagcaatatatttaggcagtttttgagtcaaataataacatattgagaaaatataacaagattaatgttaaaaacaaaatagaaacaagtgcctttctaatgcaccagcataacatttcttcttctctggttgttttgtgatttgtactaaaattttgagtaaaattgtatgttgttatccttaaaataatggaatattttattatttaataataataatgcttaaagaaaaatatttcaaggaaacatgaaaaggtcaaaataaagattcaattaactacaaaattaatcagtatctgtcctgtaattatagtattataaagatatttacccaacaataccaagaataactttttatgagtaaaaagttttttttaagtaactgctatatttcaaggaaaaaatgcccttttaaaccaataatataggatgaataaataaatacttagaagacaaaggctggtctttaaaattaggataataatgctgatctaattctacatgtggatagttactaattaaaactaaattaccaaatgcctcaaaaattattttgaaatgatttatttgccagcttagtaggtcaattctgctattctagagataaaagtcatgccattcattcccca

SEQ ID NO: 51192 - DNA, 1460 bp, Bovine  19866881164072
ctactttcttttgatatacttaaaaagtggcaatctagaaaatatagctgaagtttactgccagtgtaaaatttaaacatatttgacaaatgttttcatctcaccaggatactggttatagtatgcttgtttcaaaagagaaaaagtatatgtatatattaatacacatacacatatctacatatgtgcatatggcttgatgaaatgaggggtactaagttaaagtcactcttgataaacttcaaatcctgatgcttttgcactgggagttacctatactccttctccttttgggaaaaaggctcacagttgttagtgatatcccagaagctgccaattgatgaagaatttttttctcttagtaaatctacgtgacaagaacctgtgaccatgcagctctctgggaagtggggaaggactatttccagagcctttgaagtcattatgcaaatagagcattcataatccttttagcaagaattcttatcttatcatttgactgatttctctttagaaaagtttggtaagaaattattagccccagttgtttcacaagtgagtcagtagactctgcagcctacagaagttttgattggccccttttccagtttttctcctgctgatactggctttcatcaaggaaagtgcagttcgatagtgcctttccagtcctaagatgtattgtcactcatttggcaggaatcacctgggctctctttatcatgatttctttgtcactgtaaccaaaattggtgaatcccttgcttcagggacattgcattgatgtggcttgggatgtctatgaacttttggatgagtgaaccaagtttgaatgatataggtgagtttaataagcccatccttgtttcttcccagacacggagacatgtgactatggctggcacaaatttcaagggcagtgctacaagtactttgcccatcgacggacgtgggatgcagctgaacgggaatgccgtctgcagggcgcccatctcaccagtatcctgtctcacgaggaacaaatgtttgtgaatcgtatgtaccaaatatacatgggttttcattcaatcttaccaccttcttagtttttcctgtatctaactgaaacaagtagcattctcagttgtgacccaacttattaaatccctcatctgtaaaatgctttaaatcatgtctcctatgtgagtcccctattttgagaaacattcaattgtaacatgggcagacatttcttgatttgccaccagaaatggttgaaatagcatgctataggtggaatcatatgaaattgctattcaatcattttttaacttacagaaatgaccacctcttaagtttccaatctaattcttcccatactttttggtctttgaatatgtacatatgttgtctaaagttaaagagaaaattgctttcaattatttttatcccactaattaaaattaaattataaagcaccc

SEQ ID NO: 51193 - DNA, 1810 bp, Bovine  19866881172531
caatacagttgaatgaggtcaggattggagcattatttgcctgttaatgatgctgtttcttggaaaccatatttcttctctcctacattgctcttctgcctcttggaactggagatggagagagaagacaggctgccaaatagtggtaatgaggattgctgttagtggggctggaaagtgacaagaagatattactatgaaaaagaaagaaatgaagagaagcttagggattcctacgaatgcttaatttgagaattaaaaaaaaaattcttgaatggctaactacacaaaagttttttcccaacttagattactctcttgttagtgtagatactatgttgaatcaaatgatagataaagcagtaaaacatgttctgcatttaaaaactcttctaaatgggaaactgtacattgaggtgagggtaatcaaattaccaaacgggataagtgaaactcaatctccctggaagaattggcagccatcagaaaaaaaaaaaatctaagtttataaatggctacttgaaatggagagtctgagtaactttaactcataaaccatttatacaaagtgtgtatttttatctgaattgtaaacttaagtcagctgggtctgggaaacacaactaggtatttcctcctcttttttctacctttattttacttttcttttctttttttggagtttagttgctttacaatgctatgttagtttctgctgtagagcaaagtaaatcagctatacatattcatatatcccctctttgtcaccacagagagttgagtggagttccctttgctatacagtagattctcattagttatctattttatatatagtagtgtatatgtgtcaatctcacttttcaaacatgtggccttgacttgccttcaaactaatttccattcagcattgataacaatgggtcagaaaggaaagggaataattgtttatcttctttggcagagggttccagtgagtgcagtggggtgcagggggctagggatgagaatagaacatgtatctattaactccctcgctccatctctctctttttctcccctgtccctgcatctatctgtcttttctgtatgctttatatatgcccttcttaagactaaaaacaccgtttattgtcttgataagacaatgagggtggtgactgaggtccaactgctttatattcattttatttgttttctatgagaaatttaatttttcaagcatttttcactctgaaaagggaaaacctgagagcagatgttaaattaatgagttttaaggcaggtgttcattaataaggaaaaatacatatgtgcctggaaaaccaacctttttatgtatcaaggcacatttttccaaactggaaaatccttggtacatgtacaaatttgtataaatctattcaaaaacgtaaaattgacctgtacatatactgtatattcaagtaggcaaaaaataccacccatgttactctaaaccaaggcattcataatttttttgctgctctcagcaagtcacataaatcttgatttttaaaaaatttttactactattaaacaaaacacactatgcaggacatgtttatgttctatttgctcaaatggatcttaatagcaactcagggtgctgttgccggagggcaactgtagttagcagttaaaaaaaatctgaaggaacttttcagctcataaaatttttatgagctgaaaaatgctataggggtgtgtttaaccagtggttcagggggatactgaaaacatggctcctgtctatttcaggagtaatttgcacacctgcactttgaaaagt

SEQ ID NO: 51194 - DNA, 1443 bp, Bovine  19866881198487
aaaagaatatacagtatggtcaaaattgctaacaacaaccaaccaataaaatccaaataattatgacaaagggctgtccagaattaacagttgagatgaagtatcaatactgttcttcatgcacatgttgcaaaagctcttaccttgctcacaaagcgcaccaacgtagctcgggaggcagagacacctgaaggtattaaaaccgtcaatacatgtggctccattgcgacaaggattagaatgacattcatcaaaatctataataaaagccacaaaagtactttcagtaaaaggtcaaaagatcctatttcataagattgccaggtaaaatacaggatagccagttaaatttgaattccagattaaaaaaaagaaattttagtacgtcacatcctttatttagggcaaacttgtactaaaaacttttcttttttaaatctgaaatttaagtgtcactgatctaatatttttatgtgttaaatctggcaaccctaagaaaatttcaagtatattcagagtaaggtcattatctccattgctgttagatgagtcccatgagcattaaaaccaataaagaatccccctagccttcccacccccaattctgactcatgctctgaccacttcagttgtgaaacactgaaaatacttcactggcttcatagcctccagacccttccctttccaatatatccttcattcagctgactgtcatcttctttaggcaccatcaagataattttattcactggcttttttttaatctttttaaatgtttaaatgtatttttcaatttttacaaaacttttaattttatattggagtatagccaattaacaatgctgtgatagtttcaggcgcacagcaaagggactcagccatatatacacatatccattctccctcattggcatctaagcattccgcagacaccgattatccagggtggcagtcgtcagaatgtggtccctggaccagcagtatcgatatcacctgagaatatcagaaatgcatgttcccaggcccatccaagacttactgactggtatttggaggatgggaacaacaaattgtgttttaccaagccctccaggtgattctcatgtacactaaagtcttagactttagactagatcccactagctttccactgttctttcccagcgtttctctctcacaacccactaagtaggcatccagaatactcgaggtcccccagacgcatcctgcgtttgcggtctctgctttcgtttgctgtgttgagtctttctctcccacttatgaaaatcctccctaatttcagtgtctatattgaatacaaactttctaacagacatctatgatctcttgtgatgaaactaatacctttatttcattgcattttgcagttacactaaaaatttagttaatgtttatataagtattaaaaatgaatatgtgtgt

SEQ ID NO: 51195 - DNA, 1532 bp, Bovine  19866881205520
tttctccctctctccctgccttctttctcctttctcagttgttgaaatcaaagtgttggtgctactatggataaggagaatataaaatacctctttgaataaatgttcccccctggagactgacatagatgaacgtcagggcagtgaacctgtcacgtgtgaccccaggtcatgtgtctgcagaggatagctctgtgcttctggaaacgctgtgcacctttagtttctgtcctgccccctgtcctgttgtgctctgccctctctccagctcttggatgaagcttctttcttccctgttgcctctttttcctttactatgttatcctggggctcgaatggtcttaaggttccatcttcttccacacacccacttcttttgggacctctttttatgcttgtgggtttcacctattatgaagacagacaccaagtatatttctccggttccagcttctgggctccttactggacatcagtgctaaaccttgtatttaaagcccaactccttttctttccctttacaaaccagtcctctgatgtcacatttttactagtctatcagcacttttccagtcacccagacactgaaattctgatatcctttcctctaatcaggcattcctttgccgtatctcctgcatccatcctttcctttccattgcctctgataccaggctggctccatttgcctgagatcaattgcagggaatctgaaaggactacacaaagattagttaatgctatcagtgttttcagcctctccctcatcatctcctttgtctttgggattaaatccctttatattgcattggagggttcacacagtttactttctaaatacctgtggagttaatctacttctctcacacaaaccttccattccaatccaacttaactaatcactattcctttaatattatttctctttgttcacgctgttctttctacccaaacatcctgagtatgtttctccagcaaaagcccaccctttctttaagggccagtttaaactttaaccccctttcatgagcttctgttaacatgaagttatatatgctgccttttgagctcaatgatgagctttaataacatttcttcttctttatcaattttttataacactgttgcttggtatattttaatacattttatctctagttttagattataaactacttgagggcaaggagtttatttgtattttccacagttaatagggaggttcagcatatcagatgactgattgctgcctggaggttgtgtcatctattataaaaaactatttacctcctatctttccatgaatgatgaatgattctgaaattattcataatagctacctacataataggaactgcatttgtcttgaagacatatgtacttagttttattaccaattgtataccaatggtggggttttagtctattattaattttattctgcctttgggggattctcagggtctttacagctctagggctttatttatccctggtaaataataccatcatgcacaaaaggaaatcagcaa

SEQ ID NO: 51196 - DNA, 1336 bp, Bovine  19866881224623
ttgtaaaggcctgacagattttaatattgccataataacacccattcattagagttttgttttgtttttttttttaataagatacttttcctgttcctaaagctaagatgtataactatgggacctaagacaaagtcatacgtaagttgtggataaagtcaaattgaatttttataccattaacaacttcaggttttccatgttgcaattaaaaaaaaaaaaaagaaacaacatgtttcttaaacccagaaaaatacaaagtttatcttggaagcccccagtctatacttactttctttgcatctcattagggaatcaatactatggcctgttctgctgtatgtgaacaatacaaagaaccttcacccctttcacagtacaacacaattatataaataaatatgttaggaccaagggactgtttccacgtttggaaacagatttatcaacattgtgtccttacctggtaaatagactgctgtgccttccactgactcttcattaatgccaatcaggaaactggtttcattagaagtttccagaaggggaaatgatggtgttgcaagctcagtatttaactctgtggtgcttagtgttgcctgcttattagaatcaagcatcctcgtcggtacttgctgtttgggggccgctactgtggaatcctcccctctgatcaaagctgcctgtgtttcagggcttatttccagaggagaaaggatggtgggccgctcagaagtctgtgggctgggctgaggcaccacacctgcctcgaccccgtgaatcacagaagcagaagtagaatgtggccgcagtgtagcaccttctaacttcgtttcacttgcagctgtgacaatagcctcagcctcaggggtttcaatactgggaaacaccttgactgcttccccagaaacctggacactggttgtgttgtcagaattttggaaaatctcaatttcttcttgagcaattagttctgtggcagaagcctctgttggttctaatagtttaggcttactttcatcttctgaaggctctgtgtcaggaggtaaggatggaggctcagttatgtaaaagtcttcttcacttgagggtttgaaagtcgcttcaatgtttgcaagttctcctgaggatactgggggtgtgctggcatctgtacttggcagagcacttggctgcaagtcctctgagtgctcagagtctccactgcctaagtggatgctgagtggaggaaatgatggtgtctgagagagcagctctgaaaaagctgaaactgtggatgtgtcgatggaatccggcagacgggctccttccatcacatcaggtgcctctgtaaact

SEQ ID NO: 51197 - DNA, 938 bp, Bovine  19866881257776
cagttcaggaacatagccaagaatagacgttatgccaagcacatttttttttcaatattttatatgtactgagaactcaaagttaaaagaaaaataagtaatttcaagtgatgaattttatcaaatgaaagtttccaacttttattagtaggcaaagacagtacacatctcaaattttaattgggtaaaatttaaatgacttctgaatagctctttatgtttctctctaaagaaaataaagaccaggcaaatatttggttgttccttcattgtagccattaacatatttaccatgaatctgagttttgaaaatgtagaaaattatgatttggaatcatgaaaatttgatgtaattcatgagaaagtggaaatgaatttggacagagaataagtgaagaattacagccctaacttgactacacctaactttcaacaccttgcttcaggacagtaaggttctttgaatagggaggatgtataaatagaactcatggataagtagttctcatataagtagaacttaacatctaaggagttcagtgaaaataccctttcaatagaaaaattgctttcaaaatttgaaaggaaacttgactataaatgtttggatagatgatttctaagtttgctctcagctctagaagttggaaagtttctgaaatgaggaaacaatgaaaaatgaggcgtaatgttgtgccagacaccttgattctaagtcagtatttaaacttaagactgagatgtaatactgagcaatcataaaggatagataattcatcatacaaagattgacttgttctgtgttcaaagaatagatgaaagaaaggcgtatttatttctaggaagctgagtaatggtgtttcataaattttattgataaaatttctttcaaaggaaagaaatcaattcacccttcagggccaaaagagagcacaggg

SEQ ID NO: 51198 - DNA, 1620 bp, Bovine  19866881313760
ttctcttttaccctctctctcctgctccttctcactgaacaaagccctagaacattttgtagcaaaaatgaatatctatgaatattgaaaaactgcaagctagcaacacactacatacaattgtgctttgttttcctttaaagagagtacaaaaatagataatacgagactcacctgacagttcacatccaagaagttccattctcaaagtgcaatgccttcgacaaacttgggggtagagtctcacatactgagcttttatggggggtgtgaaagagttagcatagggtgtgttgttatcaacgtttccatggaatacctatataaagaaataacagaatttaaaattattcattgcagcttttttaaaaaaaaacaaccctattttcaaatattgactctatatcctacccaaccaagtccctcaaagattggactaaataatttagaggtctggagcttttagagagcaccttgccatcagggcttcccttatggctcagctggtaaagaatccgcctgcagtgcgggagacctgggttcgatccctgggttgggaagatcccctggagaagggaaaggctacccactccagtattctggcctggagaattccatggactatccagtctatggtgtcgcaaagagttggacatgactaagcaactttcacttactttgccatcagaagcaaatctaaaatctatagatagaatcctcattaaagctataaaccactgtaacctatggcttaatctataccctattatgttggcttattaatttaagtccagtcctttagaatggaatgcttctaaagggaaatgcctcctcaacttagtcccggatctgggtctatctattcattttgctacttagtaattatgtatgttgttttaggaaccagccttcaatgttatttcctgatcacttagtttctctaaagagaagtcgctcagtcgtgtccgacttttcgcgaccccatggactgcagcctaccaggctcctccgtccatgggattttccaggcaagagtactgaagtgggttgtcatttccttctccaagctgtgatcaaattcatgatgctttagggtgtgagtcctcaagtcccagatcattggataagagactcatatttctttatatacatatctccagtgaaaaaccaatttatctttaaaatttaaatgctaaaatgtgttatttttaattcctttaaatctcattttactttatcttttatatagcctagtaatcaaaaaaccttttaagaagttaattaaaaaaatctttcataaaatttatcagtctattttaatgattcagttttaaatggaatgagctacattgctgctttttaaaattagaaatttgtgttaaaattaattaaaaatttggaaatatatgaaagggcaaatgagatactgaatatcattatggaagatgcacactgatatatattcctctaaaatactttattctgcagaataacaaaaatttcttccaatattaagatattaagtatagaaagatatttatcttttctataactcggtgtttctctttaaaaattttattttttctttaacagttttgatctgtatttatttaaggagaa

SEQ ID NO: 51199 - DNA, 1367 bp, Bovine  19866881328678
acttttatgaataagaagtttttctttcttcataaaatagaaactttgccaaaggtggttgggcatttatttaaaccttagtcttcagtcacttggggctatctgttcttgataatttcatttttaagtgaagagaatagctatatattttggtaatctcttcacaaaattggaaacagattaaaaatgggaaaactagataagaactaattctgtttaaacataacttaatgagcaagagaaaaccaacaagctccagaccactggtctccaaagagaaagtacccagaggccagtattccaaaggggagtgttcagtgggcctgggctttctatcagaaacaagcaagaagagaacatggtgttcttataaagtgagccatttattgtctgctaggccctgaatctcagaggaatgactgacactgtaatttagaagaactgaagatactttcacagagaagaatcaattcattatatccctagtggtttcactgccttttccttcctttgggagccggtaacacatccaggataaatacattcggcgaacgaagatgctttatgaatagatggtctactaaacagtcctgccttttagcatcttgggtgtggaatgttggtattttctgagtagttgaagaagtctttgactcttaaggtagcacagcccttggtctttgtaaagatgaacaagaggcatattcaggaaataactcccttttttggaacaccctaatactggttttcttttcgtttccttctgaaccatgcatgtcttattttccagattacagtttaaaaataatggtattcacagccagttaaaattccagcgaaatgcagagaaaatttgaaaacacttttgcattgtcatcttctgttgcctctagttaattttccaacctcctgtattcattatcagtagccatagtacttagcctatgatatttaaatgtatttagtctgttaagtaaaagtaacaatatgttgttggggtaaaatggaaagggatggaaacttaaatgttcttaggattgtaatcaatagtgtttaaggaggattacaggaaacagctggttaaacaaatattaagtgtagagtggatgctatggtataaattaataatgcagctctttatttacactatgaatgggagggtctgtgatggttccatgtgggaagcgtagtccctgtctgccacctagtggacaaattgaagaacgctttctcaccagcctcttggtaaaaaattctgagttccattcagttgacattgaacaccaactgcagaccatacgttggggtaggtgctcagagtaaaaaatacagcaagtgacttttgcataatttaaaaattaaggcat

SEQ ID NO: 51200 - DNA, 1262 bp, Bovine  19866881345587
tgttcttgtctggagaatcccagggataggggagcctggtgggctgccgtctatggggttgaacagagtcggacacgactgaagtgacttagcagcattgcattttaaacatgcagaggagattttataatctggaaccttagtaacaatgttttacttagtgttaatactttttgaatgtttgatatgtatgtgttcagggtattttatatgtatgaattcttttcgtctctgtcattgccttttgaggtagattgtattattatagtattgacatttcacagaagatgatactgaggtaaagagaggttaaataaatcatccaaggccacatggctagaaagtggtgaaaccagtattcaagccctggccgttggtctccagagccctcacagcttctgcatttcctgtagcactaatatccagaacactttctctgtaaaattgttaattgcaaaatgttcacccagtgtctactttaaagcatatgtatcatgcagcaatattgctttctgtcttgcaggtccctgcactcctaatccatgccataatggaggaacctgcgaaataagtgaagcgtaccgaggagatacattcataggctatgtttgtaaatgtccccgaggatttaatgggattcactgtcagcacagtaagtcatccacggtctttgtgcttttattatcattgattgcaaagtatgcaagtcattatcattcttgtttgcagtagaatgatagaatctttgagcctgcttctctcccactggatacaccatatccccagctgaggacttatccctagactgtttctattctcccaagggtgtgggaggctagcaatcttctatcagcccttttcactgtcgctcagccatacttgcaaaatgctgcttttatattgatctgatatctatgtctttctttcacatgtgtcctaaaactacagtcttcaagcttcccagacatttttctgtttgggttcagagaagatacctaaaagagaaaactgcccactctgtcctttctataagccagtttcttccatctcacatgttagcatttttatactctcaccctctttgtcttagaagcctattgcataggaaaaaaaaaatagttcagatgttatgcccttaggtgcaaaccctgcctctagacactgggcaatatcccattatgaaaactttgttctcatttcaagggggcattctgctgtggtgtgtgtgctccgtgcaggcagcccttaattgaggggctcag

SEQ ID NO: 51201 - DNA, 872 bp, Bovine  19866881413504
ccgtggactgatacactccggacttaatccccagggtctccttcctgctatttaatgtaccactgctcaagatttgatgctgtccagtttccaagaagactgaaagctgcacattctcattgttttatggcacttgacactttggccacattgctttttgttcttcccacatgactggtatcttcgaagtacaatggttaagtaagggaaaggcaaaaatgtgctgtttttgttgcttctctctctacagatgcctggcagagaactgtttgcctgcggcatccaggattcatgtccttgttattttgctcttccctttccttcatctttactgagtagtaaggagtgtcatctaccaatgtcacgagggataacagtaacatctcccgagaatcccaccagacataataagaatgtaaagtccaaataggaggtaccgtgctgcagagaaacggatctctggttcacaacgcatgcacgcgtgctaagttgtttcagctgtgtccgactctgcgaccccatgaactgtagcctgccaggctcctctgtctatgggattctccaggcaagaattctagagtgggttgccatgcccttctccagggcatcttcctgacccagggaccaaacctgtgtctcttatgtctcctgcaatggcaggcactgtcccacgagtgccattttccattctttaccactagtgccaacttggaagtccctggttcacagacgggtgttcaaatgctgactccaccaaatatgagacgtataaccctgcacccattcattactttctctagggttcaggttcacctccttgaaactgatattgctaaataagataatgaccatccagtaggcatccattcgat

SEQ ID NO: 51202 - DNA, 731 bp, Bovine  19866881793877
atgcagacagagccctcccaatcatgttttccttaagcatacaaaatgccatcactaaaatgggtgggattacactgccaattgtgggaacaataatctgcacgttaaagttcagatttagaattttgaatacaatagtcaataaatgaaatatttggaaaggtcattattatgtattttttcaaaaagatatgtgttaggaattcttaatgatagcatactttgaaacctcatgatctgctagagtctataaagccagggatgtgtagaaaccaggactgttctgacattttcatagcattttcagtttttgtaagtagtcatttatgtcaaaaggtaataaagcataaaaacagtgttgtgggggcagtgatttcataaaactgcttcaacaataaaattagtaatatactgcactgtttgatagcatatctttttcagatgttatctaaatggaactttcaaagccttggggaaaagacatcatattttaatgttacaggtgaacgacagtattagtactacacttaattgaaattcccatgtgcttggtcaatatgatagccaatgactacctagacttaaaatttttaaatttgtctttgttttatctcgatgaacttaggaaagaaaggataaaaagttaagtatttgagcaataatttggctgtaaaactgatcagaatattgcttatgtaagaaaaatggaaaatatcatgcatgtcttataa

SEQ ID NO: 51203 - DNA, 818 bp, Bovine  19866881936109
aatgcctgctgttgtgcatttttagcttatatttatcaaaataaaacaagcactcgaagaatagatgttaaatatattgtcttgatccagtgtggttgtctcctaaattcctttaatacaagcttgataagatcttaagcacagcctatcagcctgtactgcaagatttattgctgaattgtcttttttttatactttaaagagcattttatttattctattttccattaataaatcttctgttccttcatctggatatcttttctctttctcttttaaatcagggatagactgttataccttacaatcccctctaaaagtatagaatgggaagtgtagcaagctaaacacatatcagtttttctgtgtgtgtgtatgtgtgtgaaaatacatgatatcacagaattaaaaacagttttaacatcctaaactgcagtctactgcctgtgctattctctggagagcttggcttcttaaagcacagctcaagaatatttatgcagtctgactataaagcctaaagctaaaacaagaatttaaggatacaggacaaaagtttcatcttaggaaaatccatgaaaaaaattcccatggaatcatataggttgagattctgggctgccagcaattatgttcagacaggtaaaaaggactccatgtataatatagttacaatgttgtgctctttgtgtcttcccatttccatataaagtgccggcactgaaattaatcagtgccactggatcctgcatgccactgacagaacagtcaccctgacacttcctcctgtaaagcctttctatctaaggccttccaca

SEQ ID NO: 51204 - DNA, 2370 bp, Bovine  19866880244004
tttgtagttgacagcagttttactggaatatcagttcagttcagttgctcagttgtgtccaactctttgcgaccccatgaatcgcagcacgccacgcctccctgtccatcaccaactcctggagttcactcaaactcacatccatcgagtcagtgatgccatccagccatttcatcctctgtcgtccccttctcctcctgcccccaatccctcccagcatcagagtcttttccaatgagtcaactcttcgcatgaggtggccaaagtactggagcttcagctttagcatcattcttttcaaagaacatccaggattgatctcctttaggatggactggttggatctccttgcagtccaagggactctcaagagtcttctccaacaccacagttcaaaagcatcaattcttcagcgctcagccttcttcacagtccaactctcacatccatatatgaccacaggaaaaaccatagccttgactagatggacctttgttggcaaagtaatgtctctgcttgtgaatgtgctgtctaggttggtcatgactttccttccatcatatctactttagtaggtatttagtagtttcatgctacactggcaaattactttttgtgacagaaatagaattagtaagttgtgggagaaactgtgtggactgaaaaatcctagaatatttcattcctgaccccttaataaaaagtcttctatccttgatctagaataatgggagagaaaagagaatgagtctgtattcatggtaaatgtggaacttctatatagccctggactacttacttccagggttctttccgatgaatagggaacacacttacaacttgctcacaccactcgtaaactttatttttattaatattatattcatgtttttactgataaattcagccaaatgtaatccttagtgataaacctggtattaacgtaggtttgatatctaatatgtttaaagttcttcatattaataactaatacatttaagtgcttaccacatcaacattttgccatatgtcatttattttacttttaaaggttttgagaacttttttgctaatttatgtcaaagtctcatttggttagcactcattagaaaagtgctaattagtagaaaacatagagcaagaattttaagactactattaatatctttcctcttcccctaacatgattttcttgattttttatgagccaatatttgctgtgatccaaaagtattctaagaacacagtcattactgtaaatatcccatagcaagatataaattctgctaattaccttatgtcaagatttcgatctcccctctcagaaacaagttatcaatttatttttctgtgcttaatgccagatataatatttttcataaaaatactatgacttcatttaatagaatgttcaaaatattgactagaattttacctaaaatgttattaacatctggagaaatcttcattgatatggaacaaatgctacattaatttttagtgttattaaatctatacaatagatcaaatgacatcacagtctacatcaggcaaatgccatggttataagaatttacagtagtatctcagtacagttaccaaaatcacacatttatttaaccaattaagcatgaaagtggcattattgtcaaagatttgatatatgacctgaacataatttggttaatgaggaacaagaaatgcctgctaagtacaccaggtattctgttagcagaagactgctaagactgctaattacccctgacatatgtcagattgaatggtcttaggttaaaaaaaaaaaagtgctgagtggagacactatttcaaaaatagtctcctctttttatttataaagtgcttttaaacatttagctttaagaagttgaaaaaacaagttttcagcagacagtagttgcagatattgtgcaaattctcctgtgtactcagtcaatgataaataactgctgccatttcaggtttttgtctgttacgaacttgtagagaaaaaaaaaaatctttatacccaatttctaattatctagactcccaaaagtatcaaactggagaatcccctggcttacgttgcatccaagtcttaacacctaaaatctctttaactccctccactctttctccttttttataaataagaaagacaaacaacattttacatgaggataagaaaaactcttgaagttaacagatttttgaacttctgttgtgggatttcagtgaagttccttattgctgattgacaaataattcatggaaaaaggtaatgcagggcaagggtttcaagggaagtactgctaaaaatagaaaataccagatgaacatagcaattaagaaacatggggtcagaaccag

SEQ ID NO: 51205 - DNA, 1069 bp, Bovine  19866880587264
agcacaaggttggagataaaggagtcaggtttgttctctgttacaaaagttaaagtgctggcaaaaaggaaaaaccaaaggagagtgatgactacttcctcaacaagatctctgatcctactctttcatctcattgcttgaaagaagagccttttcttggtaaaagctcattgtttttagtaagctttgcctcacttctaactgacaccaaattaaatgacataatctggagggtaaacgcagtaaaatggatataaaatttggaaaatcctaaattagaaataaattccaactgttttattaaaaaaagatgtgttatcttaaggatgatatttaacttctttgacatagttttcatttttgttaaaagtggataaataatattttattaatgggattgcagtgataataaaacacatgtgatatgaaacacatgattgacactgagaaagtgataaatttgtatggatatggaaaaattgaattcaactttgaaatctacttcatattcaaataattaataaggggaagcattttaaaggttgggagaatgaattcagatggctgaaggtaaaaataatcatcaaatatgtaaattcttaaatgttttgcgtgcttctctgatggtgactaacatttgtccctatgtttcttcattccacagagtcaaaggcatttttgtaaagttctttatgggtcacaaatcttttcccatgctgaaaagtgtgttcttcaccatctgagaaaccagcaaagccctaagtttctacactactcctgaaaaccacttggacaaattgaaaataattctgttttcatcaacattgaattacagatataaaatattgtatgggaattataatttgataaatgggaacattctgggtcccatattgagtccagatggttacagtgtctttaatacatgcatccatttggcactggcacatttgtgtatcacagtctctttctcatttatgtttaatgatggataaattccaaatactacaagaaggctttcttatcttttcttgctattctttggaactctgcattcagatgtttatat

SEQ ID NO: 51206 - DNA, 1091 bp, Bovine  19866880641940
aaatcttaaaagtgttaggtagagtaccctaggagttaaaagatgacagataaggaagagggaagtagattgtttgtaacatgagattaaaaggtctgggaacataagaagaatggaaggaaagtttttcttgttgttgtggaagtctccaaagcctatagcacccagtatttccaggcagtctccattccaagtactaaccaggcccgatcttgcttagtctctgagatcagatgagattgagtgcattcagggtgcatggccacagacccaaagggcacaggtagtttgtaaaagaagtgacacttgcactaaaatgtcctcttattccagtgctgtaaaaggagtttgttcctttatcataaattaatctgaatagctcatttatttgttctataagtaatccttaaaatgaacaaatgcctttcagcagaaattatcatataatagtagtcatataattgtaaaactacagccttggcttaatctgcccctgtaattataaaataaaattacataggactagcaaatctatttaaagaattaaaactatggaatcatgcatggcaaggaaagaaagaataaaatatgaagattcatgttaaatgatgtgaaactttctgctccatgcttacctaaagctctagcagagtgaaaatatgctttctcctttaaggagagaccctgggactgaagccatcatttttcctgtaactgacagatcctgccttacttacagtaattgaggtatcgggatgaactcaccctatgagcacagtagaactgcttgagaacctgcacatcacggaatcttgaagagagtcaattggtctttctatctcaggaagcatcacagatacccagtttcccaagatagaaacttcagtgctaaccttgactcctgaagtctctcccatctcacacatccacttattcacttactaatccttctccataaatatctcttgaatctggcttttcctctccatttccactgccagtgccctagttcagtccttcattatctcttcccaggaacttctcaccagtctgctttataagaaggtatgtctcttccacagatttttttt

SEQ ID NO: 51207 - DNA, 803 bp, Bovine  19866880665584
aaacttaacttgtttctctgatagctcagctgataaaaaatcccctgcaatgcaggacactccagttggcttcctggttcaggaagatccactgcagaaaggataagctgcccactccagtattcttgggcttccctgatggttcagctggtaaagaatctgcctgcaatgtgggagatctggattctatccctgggtttgggaatatcccctggagaaaggaaaggctacccactccagtattctggcctggagaattccatgggtatagtccacggggtcgcaaagagtcagagaggactgagctactttcactaaattgtttacagagttgaataaatggcttatgtgtaatactgactatattgtcttttaaatcagcaatgttagcccttagatgaaaaaaagaataaactgtgaagattttttttttttaaacccttatgtcactccccaccccacaaccttattgttttaaattcattaaattcaatttggaagctcaggtatccattttataaccaaaagttttgtaagcaattctgataaatgtcatatctaacaatcattgggctacatttttaaagggtctgatcaaaatcatcctaaagcaattttcaccttaggggaaattaacttagacaagattagttggaattctcgctcaaatctttttcttttaaggacaatgcattggccaatacataaataagctaaattatcttcgtaaactctttatcaactctgacctaggtagtaggcaatttcctttgcagagtgtttgcagatagttcatactgatt

SEQ ID NO: 51208 - DNA, 1324 bp, Bovine  19866880782372
tctgcttggttaaaaaaaaaatcaggaaaattgtgacaaatctatttgagatacagtttgatccaccaatctgtgaaaagcaatagcacatccatgggaagaagagttacatgaaaataatattattgaatgaaaaacgtacttatgagatagtccggattggaatccaagctctttcattgtcttgctgtaaccactgtgtaatttaaaatatgttcagtcataaaataagattatttttaataagctcaatacttagtaagggctccacaattataaactcttttgtttttcccaaagtaaataatctgaatgcatataataaaatatatcatatacaataaaaattataaacaattacattgtttttccaaaagtaatataaatatatagtattacatatgtacacataggcttctctggtgactcagtcagtaaataatctgccagcaatgcagaagacctgggtttgatcttgagtcaggaagatcccctggtgaagggaatggaaacactctaatattcttgcctggagaattccatggacagaggtacctgatggcctatagtccatgaagctgcaaagagttggacacgactcactgactaacacagacacacatgtacacacaaagatttttcaagaatagcgttttcttgattttatactctttttaaagcttcttctaacctttctaatttataaacatttatgaggagaaaaacaagttagataaaaagtgttattctaatagctgggtatattctattagaatatgttagtagctttaaacaatctctgaggttattctaattcacactaaataagtggcatcttccaatgtgtgagttggtctaaaatcataagtttcagtaattttttttgtcagaaaagtgtaaattgaacattcacatcctctctcttttaaaatcatttccaaaaggtgaatttgtataacataaacactacatctctgatgatatcatttccattttacaaatatgcagaaaggaacacggcatctttttttaattcaggcaccctgcctcagctcttggaacctgttgagtgtagccatgcaccaattctaaaatcattgcctttggtaggaaagtaagccattgccttcatatctgtgcaaataccagaaactgaatcttcaagccattgacttctgaattgaaaagcaatgtggatcacagacttggaatgatctgcctggatttaagctccaattgcagcataggaaccaaatatttcctttgctgtgttgaaaattgtgagctatgctctatgacaaatatcattttgattaaacaccca

SEQ ID NO: 51209 - DNA, 865 bp, Bovine  19866881036126
aaaatttcttgggattctgtaacaatagagtttgcttagaattgaacaggatatatttgattctgcttttctgtaaaactttaaatgtgtaacatgctttatttttctcatctttataatatatgtatttcaacttgaaaatccactttccttggctgtacaaactccctctaagtcagttactatttttaaaattaaatatatgctataaatcagaaatatgtcagttgtggagaaaatacatttaaaagaggcaaaactaatatttcagtttaagattgtgagaaattaattatttttggaaaacttaaataaaaacgtttatcattaaaagaaaatgaaatattaattgtcactattctgtctcttcttcaagtctttccacacaggcagtcaaattcaaaaagtgtttgctctcatgtttgaagaaagttacatcacagagaacagaaactattttcagttctaaaaatatattttctgtttttttaaaataagaaatgaagaaataaaaagtatacatataataatattttatggaaatatataattattagtaatgattgataatttctgcttaattatattttagtatgtgataattagttgaaaataccaggcaatttttatgactgtaagcattattataatttatagcaaaatcaaatatttttagcatcaacctgggacacaggagaaagcaggtaattataagtgagattctatacaaattggaataattgggctcaaaatggagccatctcataattacagaagagttttaacattgattaggatagaatgtatggagatttaagtatttttttcctattcaatatgtgtaaaaagtaaatatatatgttta

SEQ ID NO: 51210 - DNA, 2174 bp, Bovine  19866881147203
ttgctagtagtccagatatctattaatggctattagtaatttctgaaataagttgttcagatgaattcattagttgaaataattccccttgatataagagaatggctaaatatctgtcttcaagaatttaaagctagggctgcctaaatgtagacgacttggctctctcactatattagtcctgtatccctttggtcttcaataagagaatgatacatttcagggactgtcctgagtaaggaagttactgagtagaaatgttctagtgctaaatctggaaacttctgttacataaagagtttggtagttatcactctgtccataaagcaggaagcctaataaactgaacgttagcaacttttcttggattgagcagagacctgaggtcacatggcaaaccactatcttgaaatctggagagacagtgaatacaaagactcacaggcaggtacacagaatcacagccaagaccaactttcttggagcagaagcagtaggaggcaaaaacttgcaggaacacttaattggtaatgtttctaaggtgctaggctcagatggtaaagaatccgtatagaattcaggtattgcaatgagggagacctgggtttgatccctgggttaggaagatcccctggaatgggcaactgactccagtattctagcctggaaaaccctatggacaggaggagccttggagggctacatacagtccatggggttgcaaagagtcagacacaactgagagactaagcacagcacggaggaggagtgtggaatgatgtgagagtgagacactcctggggaccctaatctttgggagccccgacactccaggtgcagcatagaaccccgctaggatctcatgactcaaggctgagagcgagcctcacatggctctgcggagaggcagagagtaatcctttcagaagatgtgcggagccttctctgtagctgctgctgctaagtcagtcgtgtccgactctgtgcgaccccatagatggcagcccaccaggcttccccgtccctgggattctccaggcaagaacactggagtgggttgccatttccttctccaatgcatgaaagtgaaaagtgaaagtgaagtcactcagtcgtgtccaactctagcaaccccatggattgcagcctaccaggctcctccgtccatgggattttctaggcaaaagtactggagtggggtgccattgccttctctgtctctgtagcaaaggtccagaatccatgggaagaaaagatacctctgctacagccccctctggacttcatgtcctgccactgagaaagggagggaaagctaagaaacacatgtgatggccaggaatagacgccagcgaaatcactgagatttaaccatgagattctagaatgcgtcacaccctccacacctgcacacaggactccactaaagtaacagtggattacagattaaggggctgaaagacagagtctatctgaggagtccttaaggaaacacaaaggcagctacagcacacgcaaaaggcattagagtgatttgaagcctctggcatccctggctatcgtaaaggctaaaaacatagctcaactcctagccatactacagtaaatcctcacactagagcccaatccctgttaattaaaaaatcatctcttctaattaaaaaaattacaaggcatgccaaataaaaacaatctgaagagacaaagtaaacataagaatcagatttagaatgacacattttggaatcagtagaaagggaatgtaaaataattatgattagcacattaagggctctaattaaaaaaaatagacaatgtgtaaaaacaggtggataatgtcagcagagaagtgcaaactaagaaataatcaaaaagaaattctagaaataaaaaatacggcaacagaaataaagaatgtgtttggtggactgatgagtagttaaggttcaggtgaggaaagaattagtgaccctgaatgtatgtcagtagaaatgttctaaaaacagagaggaaaacaattaaaaaagtgagcatatccaaagactgtgggacaattacagaaggtataatacacatctataggattgccagaaggggaaaaaagaacagagcagaagaaatactgaagtcatgatggctgagaacttttcaaaattaatatagacaacaaatca

SEQ ID NO: 51211 - DNA, 922 bp, Bovine  19866881159639
ctgaataatacaaaggaaaaaaagaaagaaaatttaaatttcagatttaattttctcaagcaagaaaggacacactagaagaagaggggaaaagagacactaggaaaagaaaagggatattatattgtgtgcaagttctaccccataaatcttaagatacctgagagacttgaaatattctcactctttaataaacacatatagaaacatattttgctgttctcaaactgtactttctcactattactgcctttgggaataaggggctcaaagtagaaagaatttcaggtttagttttcagggttaagtttccataagtacttacatacataaaacaggtcaaagaagaagggcatggcatggtagcacattctgaaaataaacgacccccataatgaataaatattttcaataataaatttggtcatatatttaattggtgaacactttcctttaaagtagtggaggctactctaaccataggtaatttctaagaggtctaataaacaacaataaacatgagtatttatattcaatgcttgagaattttcaaagcaatctcacagatgctaatagtaaccttattattacaggttctcacattgtttccacatagctgatagaaacagataagtggtatttcacataaatactgtgacatttttggcaaactttctcaagtgaaatttatgagaaattaagtcacagaggaaccagagatcaaattgctaacataggctggattattgaaaaagcaagagagttacagaaaaacatttgcttctgctttaccgactatgccaaagcctttgactgtgtggatcacaataaactgtggaaaattctgaaagagatgggaataccacatcacctgacctgcctacttgagaaacttgtatgcaagtcaggaagcaacagttag

SEQ ID NO: 51212 - DNA, 1711 bp, Bovine  19866881306076
tgatgagacacaacacagtccatgtttattttggcagaaaaacacagctgcaaacggtaacaaaaattgctatcacttttttattttttttaagtaacagtacttgctacctattccttttcctctagagcaatagatttttctgtccatttttttcccctcactgctagctgacaaaggctgtgggcagaactgaattcacatctcacaattctcatcacccctccctgacaaagatgcacactccgtatgtttgatgtattatttcctccacagaaaacaaccctgcctcaagaaacaaaatatgatacaaaaggctcagctttgcctggcagacaagaaacaaaactttatgaaaatgaggccagtgaggggaaataatagcagctctatacacattgggataaaacttttttaaaaagatgtataatatctagctgaggtaattagtaaaaacaaaaagtaaaaacttttgtttctactaatgacactggaggtaattgataaaaacaaaagctctttagatatatgtgtctgtttatatatatatatatataaaaacatatatatttttatataaatatataaatatatatatatatatatatatatatttctttatgactcaatagtaaagaatctggctacaatgcaggagacacaggagatgctggtttgatcactgggtttggaagatcttctggaagaggaaatggcaacccactctagtaatctcacttagaaaattccacggacagagaagccttgagggctacagtccaaagggttgcaaagagttcacatggctgagcgtacagcatatatatgtatatgtgtgtgtgtgtatatatatatatgtatatatatatatatatatatatatatatatatatatttgttttgaaaactcactccttccgacaaagggcaaggagagattaaagaaagaggctggctactccagattggtaggtgacagggttaatatcaaggcaacttacaaagatgcacagatctcttctcctggcctccagaatattaaaagttcatgtagagaccttaactgggttcaatcacatatactgttcagatagtatcaacactttgctctctcatggcttcttgcttaaaaatggctcctatgtgggaacagtgggtagaacatacattccaatggcacagagtaaggagcctccaattgctcaggtccaactcagagaggtcatgtcctctggataatttcctccaacaccctatgcctcctaacttgctcttgcaatcttacacatctcccatcttctgcagtgtgccctgagtgcttggcagtggggttcattaacttggaggtggcttttttggcatctatctagcttcatagcaacaatataggcacctgaaagaggaacacagatctagatgattccccaaataagtaacagtcctgagggcaaactagagtatcttagctctcattcctgctgtgaatatggtcccatcagaaccttccaagacagacgcattggtgggtctgtttcacccccaaatccctaaaagagtgtttactttctctatagatttcaagggcatcacatcctcagggagactgtcctcattgggtcaagctttcctgtagtctagaataatccagtgtataagggagtgagtaccttgaacccacagaataccatgtagatattgtaggagggcacag

SEQ ID NO: 51213 - DNA, 1032 bp, Bovine  19866881489413
gataatagatttctgttatatgcttggcaacattgttttaagttctgcagcttaatttctattgatgatttatttttaaagttacctgcataaagttgttggaaacttggacaggtatagttaagataactaactgttctaagctcctggagtttattgtttcaaagaaaatgattaatataattagcttatggtacataataaatcattgccaatttgtttctttcaattatattctgtatactcaaaagtttaaattgaattaactaattactttaaattacagttattgttgttcaatccctcagtcatgtttgactctttgtgaccccatgaactgctgcattccaagcttccctgtccttcactacctgcctgagtttgctcaaactaatgtccgttgagttgatgatgccacaataatttcacaattatagtagtaaaaatttcattctagtactgaaactctagaaacctatatgcaggtcaggaagcaacagttagaactggacatggaacaaaagactggttccaaatgggaaaaggagtacatcaaggctgtatattgtcaccctgcttatttaacttatatgcagagtacatcatgaaaaacgctggactggaagaaacacaagcttgaatcaagattaccaggagaaatatcaataacctcagatatgcagatgacaccacccttatgtcagaaagtgaagaggaactcaaaagcctcttgacgaaggtgaaagagagtgaaaaagttggcttaaagctcaacattcagaaaatgaagatcatggcatctggtcccatcacttcatgggaaatagatggggaaacagtggaaacagtgtcagactttacattttgaagctccacaatcactgcagatgatgattgcagccatgaaattagaagacgcttactctttgaaaggaaagttatgaccaacctaagtagcatatttgaaagcagagacattactttgccaataaaggtctgtctagtcaaggctatggtttttccagggtcatg

SEQ ID NO: 51214 - DNA, 1077 bp, Bovine  19866881604030
tccttaaaaacttatgtagaaatttcttattattttttcatacactgtaagtattagcttgttataactgaacaatttcatgagaaaaattgcaaattatgcatcaatttttgcccaaaggtaagactttaatagatttaagtaagaaggagttaatcacggaaaagtgaaaaaagagaaagtgagaaaatgagtcttcattctggatatgtcatcctcagcacccttaattgaaacaaagttacacttgaagaatactagaattcagagcatttgaattttcaggtagaggattttaactttcttaatataactctgtatatagcaggagccaagagtttgcaatgagcctgaacttgagaagactttggtacaggaatgtaagagtgaacaagtagatatttttcaaaatgtgccttgtgtaaacacttattcctgccttccatggtataagctctttaggaaagctgccttataaaaagactgggctgccaatttcttagcaagctcaaatcctggaaatatcaccattgatgaatcacttcttgctgaggagccaatttgaaacagaaatgggcatgcaagctgctaactttagggcagaggcttctgaggtgtataaggatagaagagaagaacagcatgttttcacgttaatttggtccataaccttgacactaaagtaataatggaaatcccataaagtgtgaatgaaggtctccaaccaagctagtgaggatgttagataatacctcagttataaaacctcttttgactatatatatatatactgagtgtcttatacctcatagcacttaacctactgttattgtggagtagtaggacgagcacggattttgaagttagatgagtggaagtcagcacgtgagtacaataggtaagtcacttaacctttctcgcctttggtattttcatctgtaaaatgagggtgactagattacttgaaaggtctcatcaagcttcataaaatctatggctctacatatgtttaagatcagactcaaagtacagtagatatagtataaggaaaaagaagtaaattttttcaacagaaaa

SEQ ID NO: 51215 - DNA, 1606 bp, Bovine  19866880372852
cattgctcatctgaagagctcatcgaaattggatatacagatgtggagtcagggttctttgattttataggtcattgacaaagcattcgagagcagaaagcttctactgtgaccagaggcacagggtggagagtagggaggtgagggtaactcacagggacaagtgtgccctgactttggtttcgcagcacagggagcaaaggccgtgacccagacccacattaccatgccttttcaatgtggttccagtgataaatgaaagccgtggctttccagtaagctgacatcactacagatatacacagcttcatgtctcctcaccaggtttaaacacttttgcttgacaaattcattgttccatgatctatctgctataacactatacccagttgttaactaagacagcaattagccaagtggaagaaaaacaacacaatgatttcagcttctttggatgcagattgggaaatcccttctcttttttcttgccatggagatctccttaagagtgggatggcaatagaagttaatgatcatgtatgtctcctagaaaaatgctcttattgcattacaaaaatctcaaatctttatgcccttgaacaacacagaggttaggggtgcagaccctttgttcagttgaaaaatctgtgtatagtcagccctctgtatatgaggttcctctatatcagtagttctgtatccatggattcaaccaaccccatgttgtatagtactgcattatttttaaaaaactaaatgtaagtggacccacatatttcaaccctctattgttcaagagtcaactgtatatgtattttaaccttgaaaagcacagattgagacaaaagcagagagttgtgttttcttaggcaacaaatatttttaaactgtcataatatgaaaacaataacaataacctttttatgtatgtgattatttccttttgaagaccccattatacacaggcatatggagagaggaaaaatagttgtgacaaattattttggaaatcggatgtgtgtttaaagggaaaaaaatgtatgagtaatcctgaaacgagcagctgggggaagtgtgactaccgttcatccctaaaagaagcagggattttaaagcagttcatgaactgaggtagttgaagaatcccaaagaatatttaaccactgtgcaaaaacttgaacttttatggaaaaatcaataaaagtttccattaaaatataggctgcttgttaagaaatagttgatatcttactaaatcacaatccaagtgttctacttgcatcaaggatacttttttcagaaaatggatataagatcggataaaaccagcagactcagatatgtatgtgtcactgataccacctgaaattttttaaatgacaaaagagatctacaaaaagaaaacaaaaactatgatgaggagtgataaaaaagaaagtgtatcatgagtaagtcagaaatattggacaattaaaacaaaatagaaaccagataagactgctgaagaaacatttagagagattagaatccaaacatacccacatgagaatgtctgcaagaggtctggtctaccaagggagcagcataggctgcagagagaggagct

SEQ ID NO: 51216 - DNA, 3054 bp, Bovine  19866880413398
aaacagaactgtaaagtatcaaaatggaaggtagaattgaagaacccaaataaaattcacaacccctggggaggctgttcacaccccagtgatttgttgacttatcatacattctaacacatgataacaaaatatcttgtgtcagcaaagctcccatactgtgataactttctgagaggaaaaataaagttttcttgagaaatggatgtacttttcaaatttgcatgaaggtaggtgggaggtgtctaaccagggatcttgaaatcatctgtatacccatgagtgctatgggctgcatttctaggcaaagagcagacttaactaattataaaaatactaaatgcttccagtttttaataatgaacccaaattatagaacttaatgtgaagatctattagaaaaaaatagagaagtgtaagatgtggagatggctttcctggtggctcagttggtaaagaatcttcctgctattcgggagacgtgggttttacttctaggctgggaagatcccctggagaaggaaatggcaacccactccagtatgcttgcctgggaaatcctatggacagaggagcctggtgggctacagtctatggggccacaaagagtcggaaaagacttagccactaaataataacagcaaagacatgaatgaggaagttatgtttaataatgagcagagagaagaaataagattaaggaaaataaatagaaaaacaagaatattaaaaaaatgtagaggctgtggccaagaattttctttcagtcaaataacattattttgaaagtgagatttataaacacaatttaacattcatggccttctgttttcagagaaagctttaaattagtggaaatatttttcacctcacttcgcattgtttttctattttcataaaacctgacttaatgtttttatttttaaatgtaactgtttcactgtcaaagagaaaaaaaaaaacaaatgtgctccagctaaaataaacagaaaacaggaagaaagagccttagttttcagggaaattgcagtatgccagatggctcatgtgttaataggaatattaagacgatgcgtgttgactccaaaagtcatcatttcaatcagcttcctcaaatatgactagtacatgaaaagctttaagggcagtatttatcggaaggacaaatgtaaagaccacagcattaatatatagtgtatatatcttatactattaacataaacataatatgtttatgttgttgtggtttagacgctaagttgtatccaactctttgggaccccatggactgtaacctgccaggtgcctctttccatgggatttcccagcaagaagactggagggggttgccatttccacctccgggggatcttcctgacctgggaattgaatgcctgtgtcctgcattggcagacagactgtttactgctgagccatcaggaaagcaatatgtttatagttccaattctaatgagttttatgcaattaaaaaaaaaaacgttatccccagttacaaagcctttctcctgcgcccagatgcagtgtgccacatatcagcaaaatatcaatcaaaagactaaaattaagttgtatttatcaaacctatttgacttcgctctgaagaataatttctctttatttcatatttctttgccattaatgaggatgttactatattgggttgcttagtggtgccatttgcataatatggtgcaatactgtttatccaatgtgaggagtatcattgattaataaaagaaatgaatcatatcatctgtgtatattgagaaaatgatcggaaatcttgcacgtgacatcagtagatggtagtgttgaaactaatacctaagaaggcacatttgatacaatttgattagatacattttgtacttccccatgattttctcataaagttaggcaccttcctgtgcagctgacaagactgctactaccctagggagagtgttttcaaaatgtcactaatgtcatagacctgctcttaatgctctaagtgagaaatcaggataaatagaaattgacatatgtattccccaggtacttattgcctgacagatacttttcagctcattgctgatgctggagagagaaaaacacagtgtcctatcctcaagggatctgtgtggacctgaaaaccaaaatgtctttttttgttttttgctttttatttccttaagaggtaaatcctttaagttaggcagcacttaatacacactaacagtcaaacttgcttttaacagtgttttctgccacagtgagaatctagagagagaacttcccgaggctgaattttatttgaaggtaagatatcaaaaggcctgttctggagtgcgagggccagagtttcacattgcagttgcttcaataatatcactttatttttgtctttcaaaatgttttcttggaaacacaacccattaatcctctcagttaaaaaatgcataggctgaatcgagcattgcttactaccccatcttgccctctcaaacatatcaccaagaggggcacatactgatatgcttgaatgaaatgccatcatgtgtgtttcaatcacgtatacgagattgaatgggttctttctctaatttcctaaggtgaaagctgctgctgctgctaagtcgcttcagtcgtgtccgactctgtgcaacaccatagacagcagcctatcaggctcctccgtccatgggattttccaggcaagagtactggaatggggtgccattgccttctccaaggtgaaagctaagggtgattaattgtagttctttcttgattcgtgcatttagtattataaaatttccctgtaagaactgagttaactgcattctacaagttttgaaacgttatatttttattttcatttacttcaaagaatttttctatagtttctctgagactacttttttgactcatgcattatttagaagtgtgttgtttactttctgaattttgggagactgttagatttatttctattggtgatgtgttctgtgcctgggctaagtgcttcagttgtgtgagcccatggactgcagc

SEQ ID NO: 51217 - DNA, 1427 bp, Bovine  19866880513113
cacagaaaaacccactatattatacccagtaaaggcaattgctaatcaagagatttaagacactttcatctttcacctcaaaaactgacctgttaaaaactgagttctgatactaaaattgggcagcatgatatatcaatttttattgtaaattaaacagtttcatttaagaagttaggaagcaattacgatttggcgagtttttgtcaaagaacattttctccacaaataagtgacatggcacattatcggtgttaggtcaaaatgccctccttaaagtgtttcaatattaaagttaaatatttttttaagcggatttctttccagaatcttatgcatcaaatttctgtagcagcagcccaacatgagggatttactgaaggtttatttcaacaccaatctcatattatcagcaaccatcatgagtcactctttccactaagtgagtgtcacagacagacatgtctttagcttcctatgagaagatcctctgtgcaatgttgtgaattaaatacatcagaaatcatgcttacaagttaaaatgcttaaatagtatttcatttcaaatacagtgtctaacaggtgttcttcaaagtgacacttgagtactgctttttagaagacttcttagtttgtagcatctggtgatgtactattcctaatttcaatttctcagtggcatgcttgaaaagtacctgagtgactgtctttggatgaacacggcccttgtgccaaaacaaaagttcaggcaatagaaaattgcaaaattatgaagctctttatacaaaactgcagtctgcctggtttttgcaatgcaaataaagaaagcaatcttgatgcaattcatctgtgtttgaaatccccttgcattgcgctaaagtgttccttaattgactggtaaatcattctatgatcagtttagcaaaattgtttttctctcttttcccctgccgactctggggagctttgagcagttttatggtaactgttgcttttttccttcttttcaactgaaccgctataacctctgcatgtgataaacaagttcaaaaagagaaacaataaatctgtgtgtgagaattcaaatgctcctggaattaagtaaatataacttccctgtcaaacagtattgaatctgagacttgttattagcaactgaaaaatgtgagctttctgaatgcctgattccctccagaggaatgtgaaaatagaatgtttgcaaatataataactaggtctgggtttacagtatttcctcagagcaggccaggggctacactgttaccggccagttgaagccaggtcattgtataaaataatcagtgtcagtacactgataaaacaatatgagatactgtagttgaagcttttcaaaatgctagcgcctcagttggcagctattcctccagctatgttcttctaaagat

SEQ ID NO: 51218 - DNA, 758 bp, Bovine  19866880600589
taacctttttgtttttagagagaactgtgtgaagcattcctatatattagaaaccacgggaacaaatacaaattggatccctcggatacttaggtttccagcttttgtcatattgacaataaagagcaccataggatttctgatacccacctccctccacttgacgcagaaggcattttgatccataattaaatttgctttttcttggtaagagaattgaaatatcctacagtgtgttataagaagttttgacattatctttccatttagagccatgttttgacagctcacaattttccctctaaaagggcatgaaaaacacatcacatactaacggaggccctgctggatcagggaaaaatcagatctttcagccagactggagcttttgataattctagatgcatgatgaacgaagtcaaatcacctccaaatattactaatatagtgctgtgttagtcactcagtcgtgtctgactctttgcgaccccatggactgtaacccactgggctcctctgtccatgggattctccagcaacaatactggagtgggttgccatttcctcctcctactaatacagtaaggaaatataatttattctactgtaaatatttctcattatgaaagcttcctcctcctcccccctccctctccccctcctgagaatagacttgtagacaaggaaagaggagaagagagggtgggacaaattgggaggctgggatgacatagatacactaccatgtgtaagacaga

SEQ ID NO: 51219 - DNA, 1675 bp, Bovine  19866880688674
aagtagaagtagatatttttctggaatgctcttgctttttctatgatccaacgaatgttggcaatttaatctctggctcctctgccttttctaaattcagcttgaatgtctggaagttcactgtttgtgtgctgttgaagcctagcttggagaactttgagcattgctttgctgacatgtgaaatgaatgcaattgtgtagtaatttgaacattctttggcattgcctttctttgggattggaatgaaaactgaccttttccagttctgtggccactattaagttctaaaaatttgctggcatattgattgcagcactttcaaagcatcatcttttaggatttgaaatagctcagctggaattccatcacgtccactagctttgttcatggtgatgcttcctaaggcccagttgacttcacactcgaggatgtttggctcttggtgagtggttataccatcatgcttatctgggtccttaagatcttttattgtatagttcttctggagcatgttgaatgtctctataattttattcatataacttcaaaacttggaaaaactgttgtggctattggtgcatagcatactgctattgatctgtttatataaataaataaatctataggtcttccctaatggctcccaatgagtcagacgagactgagtgattgaactgtactgaactgaactgattgctcagtcagtaaagagtctgccctgaatgacctgggttcaatccctgagtcaggaagatcccctggattaggaagtggcagtccactccagtattctagcctggagaattccatggacagaggagtcttgtgggttacagttcatgagtccatctctctctctctctatatatatatatatatatgtgtgtgtgtgtgtgtgtgtgtgtgtataaatatataatatgcatttttgtaaactttagctgtgctgtcaactttggaaaatgtgtccccattgtaccttgtcagcttggcattgtacagaaattaatagtcatgttggtctagaaaggctaaacataattttctctatttgtacagaggtaactcactgaataaggcttctctggtggctcagatggtagagtctgcctgcaatgtgggagactcagcttagatccccgggtgcggaaaatctcctggagaagaaaatggcaatccaatccagtattcttgtttggagaattcatggacagaagagtctagtgagtgtctatggggttgcaaaaaatcagacatgactgagctgctaacacacacagctcactgtaaatgtaaggttttatctacatgggtttgattacaaaaactagagcattctctaaaaaaaagaaaataataataagatatatcactttgccatcaaaggtccatacagccaaagctatggtttttccagtagtcacatacagatgtgagagttggaccataaaagaatactgaatgccaaagaattgatgcggtcaaacagtggtgctggagaagactcctgagagtcccttggaccgcaaggagatcaaaccaatcaatcctaaaggaaatcaattctgaatattcattgaaaagatggatgctgaagctgaagctctaatattttggttgataaaaagccgactcattggaaaagactctgatgctgggaaagattgaaggcag

SEQ ID NO: 51220 - DNA, 1113 bp, Bovine  19866880840956
atgtaccatagtttgtttattgacctattgaagaacatcctggttgataccaatttgaaagttatgagtaaagcagctatcaacattcatgtacaggttttggtatgaacaaaacttaactcacttgggtaaacacttggggacgtgattgctggattggatgataagcctccatttggctttataagaacctgatgaactgtcttccaacatggctgcaccattttattccccccaggaatgaatgagagttcctgttgctccacttcttctccagaattcagtgctgtttgtgttttggattttagcagtaatagcagatccttgtgtttacattaaaagaaactccttcccataaaactccctcttgatcctttgttggtcgcatgcttgtgtggtgggagattgatgttggcagatggttcgtccagggctgaccctttcctttgtttccagcctgaagctaaacttgagagaaacttgccaatcgaattgcataaagtgagctgtgtagcatcactgacgtgggctgtacggagaactccctaattcatcttgggaatagaggggcgcaggcatggagctgatctttgacctcatctcccttagacggtacagggtttcataacatcagtcctcctgacacagcagaggaggagagtgagggctggggaccaggagccgagggtaatgtgcctgatgttccactagttaatccggtgaccttcaagcacatcatttaacctgtagatccacagagatgtgtactatggaatttgtaaggccctcgtaagcgccaaaattctgattctaaagttagtctcagcgcaagtcatcagcgcagaacaaaggaaagaggccctcagccctcactcggaggcagacatgagttcatcaagcagaaaactctctagtgagttgtcagtctttgaagtggctgagacttgtgacagggaggcctaaggtaaatttcttcaggggagatgctggaaggttcacaaaggggatcctgcgtgttgtcgacctgagcgtggggatcacagggagtcggagttggtgtctccggctggttggggtttggttgctggtttgcatcagccatggcgaagggaa

SEQ ID NO: 51221 - DNA, 1420 bp, Bovine  19866881128556
aattgattgctcttcctggagaatgtgtttgtaccttcttcctacagggcatgcattagaatccaaaaatagctccccactcctcccctcaagatggttttaattaataaaaatgtagaaaaaagaagttaggtcatgtttaatatataattcccatcagaagccagacacttaatagaggtatatcactgatattattcagactctgtaaatgctgtgcagtggggttcatggctcactcttacaagaattcaaatgtactgaagattttcttgtctctttctccaccttcccctaaataaactagtgtaggcaataaaacccttggtggcataattacctgtaatgggatgtcattcatgaaaagaaattaaaagtgaatgaaatcatttttttctacatggagagccttacagaaatcagtttcattgccttagagttgcatacttaaatttaacaatctgttttagtgtttcctggaattgtaagcaggatttttcatgcctggtgaattgacatatctgaaggagaaaatgtgattaatggagatagtagtctaacaaagtgaaaagaaaatgacttttgggaactttataattgtggagcaaatcaggtacatcttgttggttgtatgttgacagccataataatgtgatatcatggtaacagaagaaactttgtacataacctcggtgctcactctagtattactggtgaggaatcttacgctcagatggtgaggcagtttccaagttaaaatcatgctgtagtctatgcaaaaggcgagacatcgtctccactaattatgatgactgtgggatagaattgagggtgaaccattgtattcatcttcctctctttagagttcagtattcagtgtgccttgaaccaactcctgagacagaaggcagaatggcattgtaggatcatccttactggcttttataatatactttgacattttcatatggcaggtaagagattaaacataaagtcctttttatgatgacactctgataatttaaataacagacccatctgaattattatctcaaagactctggcatttcaaatctgttgtcattttaaattccctgaagaatggggagcgatgggtgtctgtttatttgtaaatattacagtgaaaggttgtgctgtgcttcatttaaattaaaggtgtagaacctctttgaaatgttgctggagttataaattaactctgaatgacctattaaataatacctcattcattaactcaaattagatgaatctttctataacatgctttgtctatttgtttatatttaactctcaagtgtattctgtcagcaaacaaaggatttgcaagaagactttcatcactttccaagaccactttgcaattgattcaagttgtatcttttggaatgtaagtcaaaga

SEQ ID NO: 51222 - DNA, 1039 bp, Bovine  19866881131740
ggcgtgcagggaaatattggtatttgaattagagtctaatcggagaagcagacaaggtgacgtgtttcagccttgtcttttttgtagccaattaccccagactcctagtgttcatgtcttctatgcactttctttaattagcgctttaatagctcagcttcagagagctggtgcgggagagaactttccccaaaactgccaaatggtgacaagcaggaggtgattaaatctcggctcgagcagtaggcatctacatgcgtcctttgtatcactctgtgcttttcgagatgtgttcccaataactcctgaccagagggatgcgatgctgtcagtaaatgcatttgagaaagctgcctggcatcattggctcctgtctgtatactatggatttacatcagttttcttaataagggtattgcctctccattaagcaagcactagtttatgttgggtggggaagaaaaaaaaatatttatgtagagattgttttattagctctgaactaggaggagaaaaattttttttaaatgctgcttcatccttttattagcccttcatgttttaattatggatggggctcaatggaatactcttggcttagagcattaacccctttgattagatacactgggttcagtttaatgtaaactgtgttgatagccaataattaaaataagaggaaaacctcatcttaatgtttcttgtaggatttgaggcagtagcttccataatatgatattaaagagagaaagtctctatggaaatttgctgaaacttggggtggtttctttctttcaaatttatcatctctgaattcaggatgcatattacaattaacgtgagaaaaaactacttcaatggtacatcatatcattaatggcaccttatgtatagtatgtagttttcagctcagtgtttgtcttaatgtaaaacaactggcattaaaaaccacagtacttaaaaaaaaaaagtattatgtgttttattactaacaagataaggaaacgtcatcaatcttttctttatttaatgatttatc

SEQ ID NO: 51223 - DNA, 1578 bp, Bovine  19866881154489
catggctagatggtgcagactcagcaggtatccgagatggatgagacacatgctccttctctggtgaagttggagccctggatgcacagaccctgccgtcccctgggtgaagctgagagctatacgatctcttccccatcttaggcagtgcgtggggtcaggcactgtaattaactagagtgtgtcctgaatattcgtactaccttcattgagtgtgattttgtcttcttttaggaagcaggaggtttttaattaatttctccatttcccacagagggaatgtgtgaagttttgctgaatttgtgtggtttagggggtaagaacggcccaggacctcctattctgccatcctgctgatgtcattcttatgtgaaaatattttctaattcaacttcaaaatctatctgataaaaacctgatgattgtaggaaacaggatttgcttgttgcaacatacttttttatttttagtagggcaaatcctgacaactgatcctgtgcttttctcttcatgccatactttcattagaggatttttctaacccagtggattactatttcggtgacttcagtgattttggtctctaatatatttttatatttcttaagtatctctaatttcctttctttacaagatcattatatacttcatgggttcaattctgagacttcagatatcatttataaatatgcttaggtgtctaggaaatctttacccatgaaagtatttttcatatatataaattgtttagccaatgatagtgcaaatttattttaaaaaaaaaggacacattattaaaaaaagacccatacatttaaatgaccagacaccaacagcttgaaatctagcaaggcttagcatcatctctgctaattgctgctgttgcaaattaatgggaagccttttaaatctcctgatagtggttatgcaactttctgcagagagagaactctaggcagaacataacagatgcggtcattaatatgcagctgcacatgcttcaaagctctgggttttgtgaatcattctctacctcattatatgtctcattgccaaaatagatcagtgagcctcctgtctgagagacaatggaatggtccattttatagaagtcttattcctttctattaagaattgaatatgtaaaagttaaactgtaatctctttgagaagattattttgacaaagcatatagtttaatcattattataacttttacagctaaagttacttgtttattcttgatccaattgcaggaatagttaaaattctgaatttccatgaaatcattgatgggttattttatggacatcatcagtgtttccagtattcttagaaagagaccaggtacatcatacagaatttgtattaattttttgttcttctttaaaacaaaaacagtggaatttctaagtaacttgcatttaggtagccatttaaaaatgtatatgtatacacgtgtgtgtttatacacatttgtgtgcatgtgtctacacacacataatatatacaaacatatattagcaaagacacctagaactaagcgaatggataatagaaattagcattttccctgtt

SEQ ID NO: 51224 - DNA, 1442 bp, Bovine  19866881159824
aaaagttctttgtattatgaaatgtagttgaatatatccagatgaaaagaaatgttcattaatatcctattcaacttcctatagcatcttatgccagttttgttttttaaactgttttaaacaaattcatgccctgatcttttaaaacttttatagttttgagttgcagtaattgaaatactcatatgtcagtgaaaactgaagtaaaactcaatttcttacaggtaccgaaaacatacgcaaaacatttctgacattcatggcaattaaatgaacacatgaagaaaataatcctgatttaatatggatgtaaggtaataagatgttatgcaaaatacactttcaaagagtttctgaagaacatgtgaaaaacaaagtattactcaaatccaaagaatcctatttaataaaggctctgctactagcagctatgatagccaaaagacagaagagaaatgatagaatgattaagattagaaacacaatgcaccaaatatttgtttaaataaaccccaaaagttggttgcaattactttatcaacaagctatgaatgcatctggagcaaagtatctaaatcattttgataatcagattcctgaacagtcacagtcccacagtcgtaagtgcaaggacagtatgttatatattttcagtgatagtaaagggagaatgtcacaaactagacttaataaggaggtaaagagaagcagttccaatggaatgaatgaggtgatcagtgcacataaacatcagattattgatcatggaaatagtattttaagtattgaacacctgattctgtattcatttataactatttacttgcaataatttagcattattgatttttaaagaaatgtaagccaatgtattctcaaatgataagaatagggtccatcttcacttatttttataatagttatacctaacatttttctcatatgtgaacactttacatcatctcaaactttgcaaaaaaaaaaaaaataatgaaaactgaattctgcttcaccagttactttggttgtagcattttacctcaaataaagagtcctcgactagcatagctccctcctaatccttctaaaaaagtaaacccctaaaaacacaaatttctttcaagtaatttaactgtgtccaagaacaaacctgtttccaatagccaacaatataaaatacacaatatttgcatgtttagcaatatttgactagattccaaagaaaacagaacatatgatttataactagtagagaaatcaatcaaggcaaatcaagaatgacacagatgttagaattagtaagtaaggacaataaagtattttgaatggttgacaaattaaatagagacataataagtatagaaatacccagagcggacttcaagagatgaacactataatatgtgagatgtacaacagtgggacgaaggttgatggcaagt

SEQ ID NO: 51225 - DNA, 941 bp, Bovine  19866881245944
cttctatttccccaagtatctggagctctaaacttccatgacttatttttcctttggtgactgttgtccaatttgcttttattggtcttcaagtaagaggtggaccttttcaaatccaatctcattgtctttggttcagcacattttccaggttccgctgtttgtgttttcttggaaatgcaggaatgcaagagcattttaagaagaccagctcttacttttaacatttcacaaaggaacagaacacacttgatgtatgttctccgagtataaatttatggcacatttttcaaggcattcactgtcaattcagctacattgctattttggactgttttatgatgtccatttttctcagcctgacacttcggtgggtcctaacacacacacactcactggggaagtctaaacactagagaaatacagggctatcaatcaagcagaaaacaggtgctgagaacctaccaggggcaagttctctgccgggagagggtgatacagagagaagcaaaacatcgtccccagtataaaggagcctggggtcttgttaggaagccagaatacacatcatgtaaaccaaatcactagtaagcacaggaaaaacaccactacattctaaagaaggatcagaggagaatattttaagatgaagttgatgcaaaaacttaaagttgcttaaatacacggtcagcacttttgacatatttcagcatttttcttcactccgtttgagataatgcaccatagctccagaatcacctaaggtcttttgttcaccaccaggaactgcaaacccgtcttctgaattcatttatctacatgggactggactttgagtttgcccatgagaagcatagtatgagtcttggaatgcttgggcatggggctattttctctagcaggagttgcagccagacgtgcagacagacatagacatcagg

SEQ ID NO: 51226 - DNA, 1163 bp, Bovine  19866881281321
tagagttttatgcattaaaatttgatccacatttgtgtgtgatgtgtgcttgcatgcatagttctaaagaagggttctgcaaaaatatacatcacattgattttataacaagcttccattattgaaagaaaggcttgaaatgatgctaaaattttgtcagggtgtaagtgggtggggagacttgaaggctgagggcctgtggatctgatatagaccaaatgcgtaacagatccttttagccatggatgtaggtgggaggagctggaaaaaaaaagggcaatggaagaaacaatcaaaggttataggacttttgtgataggttgattttaagtaatgcgtttcttagaaattatctgttatcagcctcagcctggggagtgtatgcagcacttctcataacacagagttaaaaatcatgtcaatcccaagtattcatgaggcttccctggtgactcagtggtaaaaaaaatttgtctgccaaagcatgtgacatgggtttgatccccgggtcaggaagattccctggagaaggaaatggcagcccactccagaattcttgtctgggaaatcccacggacagaggagtcagggactaagtccatggggttgcaaaagaattgaacacgagttaaagactaaacagggaggggaaaaagtattcatgagcaattttaacaacagttttgaattggatagtagagaaaaaatgtggggttgctgtatattcaacagtgttcacatgataagaaagtaactgagtctattgtggatgaagaagcagttaaatttttgagtaactgtacaggaagctacagataagtctctgctgttagaacatcacttcagattcaagtaataatggtgcattcttgcataactttccccagatattgattttccaagatgccccagggttatattaataagtttaattaatgtaattcatcattaactccctagttagtatgggaattcagcatatttctcccctgttattacaaagttcctgattttgtgtgggtttgacctagtttacaattgtttaggactggaaaatcacaccattttgactcccacatcattcttctgacttctgagatgctcagactaccaactcctggggaattctcccttatcctggaccacagcaccagccatgggtt

SEQ ID NO: 51227 - DNA, 815 bp, Bovine  19866881296186
tgttttgggatgagccaagctcttgatatgagaatatttgttttgtatatatggatagttgatagaaagcagtttaaagaacaataaagtcccaagaattaatttcaaatatgctgtaaatttttaaaaatgcaaagaaaattaacttgcactcattcaagttacaatgaggctgattcttcctttgttagacctcctatgtctctgtctgtgtattttttttattgagtcaagtacgtattttggatattcccttaatctaagactgaatacggaaaccttcaatatttaattataatctggcatattttccaatataactagtcattctttgattcctgttattgtttgttttgtcttattttgtgttcgtcaatgggcaaaataaaaagaaaatgttgatatgagatgtaggagaagatgaaggttcaaataggtttatcatttctatttcattatgtttagttttaattgaaaaaaatgcaactaatcctacatgtatttttccacaaagcctgcaagattgaaaagtaaatgtggcatcagtatgatttatgccacaatggacgatttttcctaaaaatctcaattaagcttcctctagggctagcagttttgaaggaaaatactgtacttttccctgtggcctccagtagaaatattctaaagttaactaacactttttctttgtagcaccatataggaatacagaagggccaaagccttgagatgtgtcaaattactttcggaaataatgacttgttgccatggtaacctagaacctaacgaatctatcacaagatctcagtccaggt

SEQ ID NO: 51228 - DNA, 904 bp, Bovine  19866881378242
cctgcacctcaaaagcattcaggcagtttgcagaaagaactgactgacatgagcagagggagaagactgaaaacccaccattctgaagtctcttactgggaagacttactgggaacagtttccttggcttcacaatccatatgcccttctctgtggtacaacggttaatgcttgagtcaagcctaattttaaaattctattcagtaagtccctttgagagattgtaagaaatggttattcaatttaaaataaagtttacatcaagcatccctggagaagggaaaggctatccactccactattcttgcctggagaattccaatccatggggtcccaaagtggacacaactgagagactttcacttacatcaagcatgaatggagaggaagattttgaaatgatagttctgttagtgggaatattcaccctgtgtatattaacttattgctattttgttggttgttgtttacttgctaagttgtgtctgactcttttgcaaccccatgaactgcagcctaccagactcctctgttcatgggatttctcaagcaaatactagagtggattgctattccctcctccaggggatcttcccagcccaggaatcgaaaccgcatctcctgcattggcaggtggattctttaccacgatgccaccagggaagctctgttgctgttttacattgaccaattcatggcacacttaaaaagtctcatttagaatgctgcactattatacaaagctcaagcttgcctttactattactggatattaagctaattgttataatataaattttgttgacatcttagcagaaaattgattatggcataaaagtatttgttcagttggtctcacatatggaaaatcttaattgtagagctcttggacacagaaatatat

SEQ ID NO: 51229 - DNA, 619 bp, Bovine  19866881894658
ccactgactcatgaatctgagcaaatgagtgaatggatatgaatctgagcaaactccaggagatagtgaaggaaagggaagcctggtgggctatagtccatggggttgcaaagagtcagacataacttagcaattgaataacaacacaatattagtgatagtcacttatatatatttaaaacataggattgtttagcttgacacttgaaagcattacagtatttgagtccagattttagttgcatgtctttctttgcatactatttaaagttaaagccttctataggaactccatccacaagaggtggcaagatttcatcagtgaaagacgtgtaagttttactgaggttctcccaggtaacgttgcataatattaagtcataatgctgaagttattagatctgagcaaatagcataattaaccatctatgtttaaataggagacaagtgagaatttataaactaagataaaatatgcattatgtaattaaggtatgtaacattcttttctgtaaacaaaagcaaacacagcttttttccacagcgctaatgtcattttggaagtaccatgcttctcgagggccatcaataaaggcactgcatccatctttgtcaattt

SEQ ID NO: 51230 - DNA, 882 bp, Bovine  19866880386091
taatatatggtaatatagcgcacagaactttgcctggatggaagaggagtttgggggagaacaggtacatatatatatatatatggctgagtccctttgctgtccacctaaaactattacaacattattaatgagctatatcccaatataaaataaaaagtttaagtaaaaaataaataaataaaaacaaatcagaaaaaaaaagcttgttcttctaagcttgtcatttggttcacactttctctggatgaagaatttagaagagtaattatatatatcttgaaaaaaatcttcaaactacagagctgaacttcagagaagtttctacaagggctacataacataggtgaagctcttttccaagaggtaacaaagccaggcaagatctcaaaactggtcactgttatgagagtatgtgcttttcataaaagagataaaaaagtgaaatgctttttccctcccttcaaggaaagatgtgacaatatcagaaaagatgagaaaagtaaaaaaacctacctcatccaagtcatcatcaggagtagctggtgttcggtctgttctaaatgaggccatggatgatgtttcggaatccatggagtcctcatcatagccaataaatgggtccaaaacaggcctctaatggagggacagtacacatttaccagaagaactaagtggggaaagtcagcacattaccaacacgctgtcaactgtagacatgcaatgaacagagaacacacagctccttcaatgcttctttgataaaataaacatattaagcatgaacaccataattccaataaatgcttcttctggggtatttcactttgatactttggaggaagattcattcatatttggctctcttcataaaacccttgg

SEQ ID NO: 51231 - DNA, 1198 bp, Bovine  19866880388068
agataaaggaaaggagtgagtctgaacaaggctgtatctcatccagaaaactatgagatgcttagaaaggaagggattccttctcactggaaaagaaacactttttgtttttttatgtttttattcacttaaatattttaggaagttggaggaagtaagatgcatttactataagcaaccaagagaagtaaaatggtcactgcttccagctctacagaatttgacaaaaggtcagaggctgacactgccagcagagcacctccacttttcattcttccttcccatcaaagcttggactgaatacaatttcttcttcccaactctggtgggttttgactctgaactgtttcgtgaagccacgcaagggatgagatgctcaactaaggatcttctgtctcacacaacaccctcactcctaccttgtccaaaagtgttaggacaatgcacgggatgaaacgtactcgagcaatggtctctgagcactcccatcaccaagccaatttttccaggatacacttgaccgacttctacctggacctccccactcaggatctctggagctcagagaatcccagagatcattctttgagctccacagttgattctagagcactcttctcattgggatgacctattcccaaaaccatggggtccctacagcctgatggttaagaatagcctgtaaaggcccatggatgccacctaatgtgagtgggggaagtgtgggctctttgaggtactgatcactgctataattacatcccagtttcggctgctccatgaagaaagggaccctgtctttttcaccttccctctccaaggcttggcacatagtaggcattcagtaggtatttgttggatgattggctaaagatgctattgaaacttttgaaaatgtctcttattggtacgcataggaaatatttcttctcgctcattagtcactttgcataaagtgcagcaagaagctctgagcacagcagctgcctccatttaaacaaggtgataaaatctttcatctcgagctgaatttaataaacacacatgagaaactcattccaatggggggaaaaaaatgcccttattcttttcctgaggagaacagatctgcccaaggtgggggaagggtggtgggtggagaacaccagagccacttctgtgctcagaagccacaaacaaagctggaaaggggctgaga

SEQ ID NO: 51232 - DNA, 1479 bp, Bovine  19866880397545
tcaaagctagcaaggcagtgatttgaaatatggcctgtggtgccgcctaggtggtttagtatggattacagaaattggaatgaattccatttataaacaaaacttttttccccaaaggtctaccatatgcgagccctttgctatgaacagctgatgcagttcagtcattgtggtacaggaactcccaacaacacagaggagacaaatatattttgtgctaccaagtagattagctgagacatgggccaggtaaagccatgttcagatggtgtgggaaaccgagttctgaagaatgagtaaggagaaggaaaatgaacttaaaggagcaccctgcagaagaagattataagcaaaagaccagaagtaagagatagtgcagctggtacttagagctgcaagcagtttcctatgagcagaggggcggagcagagtgcgagtactaaagggagtaaacatgatctacttgtgtaagtgcctgtacctcactgtcgatgtgtaaaaaggtcattagattaaaatttttaaatacatgtagatactctagaagaggtagctaaaaggaaagaagaaggcataaaaagtatctggtgcctggaagccctcaaaaatgtcagttattagagaaataaaactacaaagcagctgttttctgagatggataccttatttgttctctgatttgagctagaacaaaggacagaatctgggtaggccaaacagaaatttaatgtagtggtcaatagccagacagacttgaattccaatccaggtgttaaatattagctctgtacccatggccaggtttttaacctctctaagcctgtttcctcatctgcaaaacagagataatatacttcattcacaaagctgttgtgagggttaaatgcaatactatatgtaaaataattagcacaaattgacacagagacagcactcaaaagtggctgctcgtattattacaaaaggaggcaaaggacatgtggcagtgattggagaacattcccagaagatgcatggtgataaggacaactgtgtccactgggcatacatccatcttgctgtggctaggtctgttgtaaagaataatcccatggatgaataggcagacagccaagatggcttgatcttccacactagctctagccaggaaatctctggagtgtgagtagaatgtgaatcacctgcttactgtaaattaattattattatgcacccagcaaagagggaaaaagtgcttggtcagaattaatcaccttaaaaaacccagttattttagattcattacatttgaaatatggtaatgagacatttgtcacttttataactctgtgggggagagtgcctattgtaggatggaaaaggattaacataattttaagagtgtgctctcctttttttcctttttccgtattcattgaaggctactatataatatatgttgcatatccccactttacagataaggaaacaggctttgag

SEQ ID NO: 51233 - DNA, 1609 bp, Bovine  19866880508873
tagaactgatggatcctgggattccagttcaaacttcagtttggagaactctgagctcaatgaaccatgtcataaccacatcagcttttcttctttctttttcttttgtttttcccttagccaaatagaggctgaatggatgggctcttggcaacctcatcacttctattgtgttctcatcattatttaaacaaatggtattcactggggtccaagtcagaagacaggacacagagaaggctttttatcagtcagctggactgctctttgcttttcccaagtcttttgtgttccccgagggtcctcaagtgtggagaagctcacaaaggaactaaaatggacacagcctttgtctgagaagggacagccagtcagtcccctctgcccctccgcagatgtcttgatccttttgataaaacagcacttttttacttaaggcacttacacatgctgttaaggcactaggggcggcagaaatggaaagagtcatgtgcaggttttttacaagaatcaatttaggcactaggacatacacagcacagaaaggtgttgaaagatgctggctctgcagacagtatgcctccgttccaataattataaaagtgatctcgaaaatgctttcacctagcgagacttagatccctcatatgtaaatgggaacaattattacaggtatttcacagcattaaccagagaattaagtgaaatactgcatgcagcatgtttattggaacattttgtgctttttttatactctcacttttataactatagctaaggatagatttatggagggaggtggccttgggtcccggaaaggggaaaaattatacaatgtttcaggcccaagtccagggagtcatgacatttggagaataaaggcatctgcaatttatcttttcactctagggtatacagttagtgaaatattttacaaatctgaaaagtttcaagtaaactatactagtttaacacattgatgcttgaacttatttcccataccacatttcccataaataatagtccaggaatttttttctttgttacctctttgaatcctataaaaatagggtcagtttagttcagttcagtcgctcagtcgtgtccgactctttgcgaccccatgaatcgcagcacgccaggcctccctgtccatcatcaactcccggatatttgaaaaaaatcagtgtatttgaaaattcataatgaatgttaggatacagtctctgaccaggcctgtatgaaaataacataattcagcactggccaaattaatttgaatatgaagtactgctgtctctactgctgctactgttcttgggagtgagggagcagaagggtgcatataaccacaccttggagagtggcggtccatgggacttggtttggaagctctccagattattcccaggagtggatctgatgttaacctgtctcactcaaatgtgtgctgtcagttcaagtgtttgcatgcagagtgtctagtccatcaaaaagtgttctttgcaacaatgatagtgacactaggcgttgttcaaaaatagtggctcttagagggggagaatgaggggaaggcagagttagggagtttggggtggacatgtacaca

SEQ ID NO: 51234 - DNA, 620 bp, Bovine  19866880548172
aattaaagaaattaacagtcttgaattagataactagtacaaccactttatccactccctttaagaaacattatcagataatatgaaatagaaagagaagacactgtggaagcagggaccatttcaccctataaagatcaaggataacatgcttcaggaaaaggactttcttgctctgtggggtggttctcagaacagcaaccaagtgcattctcaacagactcacctgcgagcctgcgagggggtgaggatacttacaaaagctcagcgcacattgcacacttgttgccgtgcgtccttccgtcaggaccaagaactggatcattttccctcgtgcatccaagtcttccatccctcacataaggccgaaaatcactacatatatcctgaagaacagagaaaggaacgtgacatttaccatcctgatggtaatgcttacaacactgccttcagaaattttatagagcccagtggccctctgctcaggacacactagctacctggagcagtgccagtgtgtagaagcaggtcattaagtgctgtgtaattcacatggttaactatagagctcatttacttgtttattcatttgttagtaaacgtggatagcctgtgatgtg

SEQ ID NO: 51235 - DNA, 947 bp, Bovine  19866880623720
ctggttgaaactgcaaatgaattctatgtggcacatactccctggggccctgactcctgacaaagaaagtggtagaaagctggatcagtttatgagacctgtgagctgtgagatcagggtcatgctgtgattacatgaggttcaaggagcatcccttatgtcatggctgcacagtgcttcccacaggttagataggtgtcctgttattacatttagccaaagagagtatagaataggaggtagggatgggatctgcaaattcctgcgtacctttggagaaaaaggtcagattcagaaggctagtgcattacctccatatatgagacacagtagattaatggacagactttgctggtagattttgcccagatcagctggcttccacactggtgtgacagacatggaatcacttcacacatagcaatcatagattaattctgtgctctagagtccacaggaccattacacacttacatgtccattatcatcttacatgttgatagtgctctactgttgacaaagcagttccacacacattatatctctagattcatagtatcctggaagattttgcagaactgagaagatttagggaggtctaagttgttcaagttctctatcagtagctcaataactagcatatattagatgctatgcaccagacactatgcttaacattttgcatatcttttctcctaacctcagactagctctgcagagtaccactattgcctctgttttacagatgagggaactctgagctgtcaaaggatctgctaaagtcacacaacaaatggcagatccagaatttaaactaaagggtatgacttcagaacatattctcttgacaattttgctatactgcaggtaggtgtcagtgatagaactaaaacttacatctgctaaaatctagttcagtattctttctcccacctactaggatacat

SEQ ID NO: 51236 - DNA, 764 bp, Bovine  19866880687565
agctcaaaatcccttttaacttatgtcctataaatgaaatttttgccatagtgaagttttagtggtagaagaataaatcttgctttgtattttaaaaaaagaaaaaaacaacactgctcacataggtggcatggatcttcaggaggacagagatgatgtggggctcatgggtcatcactgaagtagaacaagtatattctccactagtaatagaacaaataaagttttgccaaatgatttttgctacagtattttatttcaacttactctggtgattttcagtttaaagctctggccaacttgttcttttttgcctattgattgtcaacatgttttgtaagcccattgtgtgattcatgtattcagtgtcttcaacttaattcataagttcattgttttaaaatgaagcatgtctttttaaccttcctaggttttcatggaagttataaaaataatattcatcagttctgtgctgatgcaaaataactggatcttatgtgttatattacatcaaaatagatgcacagcatagatatttttaaaaaaatatttaattgcattttttgatctgtcaaaatgggcaacatagacattttgttttttaaatatttaattgtatttcttgatctgtcaaagaatggcacagcatatatatatatagtcatatatatgaatgtgtgtatatgtacttatctactatactgaaatggctcagtataacttgagagatcggttatcagagcaagtcttggatgactgtttgc

SEQ ID NO: 51237 - DNA, 3273 bp, Bovine  19866880725445
gagagttgtctgagaaccacaccggctattgtcctatagttcttgcccaaccaggaaaaatacccattctatcctcacagccttcctcacaactgaggaaggctatgagggttcccatgagtacagagggggacccatccctgtctaaccctcagctggaacctggccttcacccgccagtggctgctgacaggcaaccaggtccacttgagagctctggccatgggaaacacttcccttaagcgagctgaaataggcttctctgcagctttcacccacatgtcctaatttcatcttctttaaccacaaagaacaagtctcccattgcctcccaagagaatctttcagaaggccgcagactgatggagtgcttgccctgtggttattgatttccatgccattctgtggtgttcccacagttacactgtttcagtcatagtttccaggccttcttagtcattgaccaacatgttctaatatttgtctctgcccttttttgaaggcaaaagatactggaatctgggccccttttccagtataaacagagatgctttccttagcagttcagttacacaagatccagtcactgtacttacgtgactccattaatgacagattatggtgtgtctggtgcgctttagagctcggcccctccccacccttttaactctgcaaatgatcctaaaagatgtcctccaggtctactaccctcgtttgcatccacagactgaggattctaatatcttattcaaatgttctcctgaatttcatgattaagtatagcagccttgtgaatatctatggatgcgtgtcttacaggtgttttatcttacaaagttcaaattgaacccacccactttctctctatgctccatctctgcactgaggatagtaatagtatttacttcacagagttgttctaaagttgaggatagcaatagttctaagaagtaaatgaatgaatgaatgtgcataaagcacttaggattgtaactgatgaatttacttacatattgctattatcagaggatatagaaaacaaataaggtataaagtttgaagagggaatggttatatggaaaaaatgaaacaagacagattgagaagtgttggtagaaacaggatgatgctacagggcagttttggaaaaaatgactatatgttcctcagtgctcttctttgtgaaatacatgtctgaagaaattcttagtgtattcttaaacactggtcattctgagcctttttcgttattaaaatgctcagtatgaggaaccttctttcctatgtctgaagtcactactaggtccaggatttctctgaactcatcagaagaagtaagttcatgatgaagttaatttctgaagaacaaggattgcatttgaagatggcaacagcctgctttgtaaggatttatccaggtcaaatgtcaacttgctaccaagaaggatcttgtggatctggaaggtgactggttaggcatgacattagagcattgctactcaaagtgcagtcctcagaccagtgctggtcctcaatctgttgctgttctgaatgtgataagtatgggattgagaacaagcatttaaacagatgtgtatcagtcttacagagtgcctttatgtctgttaaatctaccagtagagaaatgtgcactcatatttggcacatgtgtgataaaggacttgagtatctgtagattttagtattcatgaggagtcctagaatcaatcccccatgaaaatggagggcttggtggtatatgtttcatttaatttaaggcattggtttgtgatgaatagaaaacaaacaagaaaaaaagaaaaggaaagaaagaaaagagaagctggtattttttatgacagattgtttgaaagcactgggcaatgtggagtcatgggttccagtcctggctctgacaccaactcatattatttcctcatcctaagatatttcttcacattgcagttgctggtattgattatcttgtggagtcaaatatcttggcacctcattcttctttgggtattactgtcttcattcatggatgaaaggtcttagaataactgatttttagtttctatttcagttccacagatgccataatcccaagaatctttagaaaaaagtctaaataaaaattgagtgaagctgcattgctctatttcaagctaaacaatcctgctttttggtaaaagcctaagtatagcatagattctgaatgctttacttcagatccccataagaagcatagtttttcttttggtggttatctctctgttgtttttttattaaaaagctctctttttcttgctgctctcaggttttccccatgaattgcaacattttatagggaaaaatttctctgctgggtattcatagactgactgacgattgtcttgaattttccaagagagtctctgagaatgttctctgaataaaatctaaccagcattataaggagtttagatcttactctatgactaaagagaaatcataagatggtgctaagaaggagactgacaacataatttattttatcaaataacatattggcggatctttgattagactgtaagggtacaagactataaacacagaaatgtccaaaggctattgcagtattataggcaggctataatggtggtttggcctatgggatataaaaaataggttatgcaatctagtttatttatcagccttggcagtgaaatgctgtggaattatttataattccacatttataatttagagttccacttttaaatttttctgagctggattgggatcatagttttttttttttttttttaatggggttataattagtagtttgtattggaattaacattagctcacaaaaagtcctatcttagattattactgaatgtcctgttcatatgagtgtatggaatcagaaaatgtgcgggtattgaataactatagatgtaggatttcaggtgatagagggcttctatctttctatctcctgcactgagaaaagacagttcacaaataaaagtgctagtgtagaagtcagaagccatcccagacaaagtgctggtttgttgggttcttagccctggagctacccagaagatagagagacctgcctttggagacaaactgtcttcagtcacgcagaccccactttagctgagtcagcatcacagagcaggaagccattcaactcattttactctggactgtatccaggcatttcactgggaagtaaaagactgagaggaagaaataaggactccacctgggtaaaag

SEQ ID NO: 51238 - DNA, 1697 bp, Bovine  19866880747689
tccaggagatagatcatgatatgaaaaggttagtatcagtttgttgtacagcagaaactagtgtaactttgtaaagcaattatactccaatataaaaaaaaaaaaaacaacattttttttaaagagagagaaaaaaaagaatgtacaaagtaagctcctaacattctctgtggctgtcttctctcgcagggcacgtgcacatcacagacttcaacattgccacaatgctgcccggggagatgcggatcaccactgtggccggcaccaagccttacatgggtacgggtcccctgagctgccatggccactaagagcaaagccttgttttccattcctgtggacaccgtgtactggaggtccagtcatctgtagggccttgcagctaggaatgacaagtccctctcggactttacctggagagcttctgatttcacaggtctgaggtgaacctcaggaatctccttttagcaagcatccagtctgatcttgattcaggagggcgccacagactacctgtaaagaacgttagcttatgagttattaaggacagtttctacctacttcctgatgaagaatattaatagttcattcaataaatacctactcattacctctgtttttaggtgctggtgatcttgtagggagcaaaacagacaaggtctccaacccttggggcttaccttttagtgagaagagtttaaaaaaaaaaaaaaaaaagaatcacatagagaaggtacagcaataagtgggatggtaataaatgatttaagtattactataaccacgatttacatactcctgcataaggatgtaagttcacaaagtgccttcccattataattttggtttaagtgtatcatcgctataatcccatgagcagtttgcaggcaaaatatttgaacttgaaattaaaggcaagagcattgccaccttctttcaatatttcattgtcttacttgcagaactaaagagaggaaaaacaagtcatctgtaggggaaaatgagcctgattttatgtgatgtttgaaaacctgcaaatttcctggcttccaattatcttcaggggtattaagtcccctttgtcacttttaaaataatggacacatacaatacagtctattttctgccccaaatccacagtactcaaatgataaagaggaatctccaagcctgctggtctgagtttattccccaggtttcctgggtttccatattaagggctattttcttgaagccaagtcagaaaatgtgcatctgggttttccaggcctggtttccatggtgagaggagtaaaggaagatgatcttttttttctctccccagtgattttaaatacaatgcccatataatttgattctcctcaaaattggcatttccagtctttttcaccacatagagctaagaaattggaatccagtcaagtttctctgccctctctaccctcatccttataattaacaattaccaatatttattgaaagccttgtagggatcagacaatgtgttaagtgctttgcattcattgactcatttatttttctcaacaaccctgtgaggcaaactgtaattatcaccattttacaatgaggagaacaagaaataatttgctcaagatcacatggctaataattgaaaaagcctacatttaaagccagctcttttgactttagaaattcaagcttctccctaaaagaaa

SEQ ID NO: 51239 - DNA, 783 bp, Bovine  19866880776081
ttgctttcactattaaaatagactggaaggccacttgccaaggacattatagaaggaatttacccatccaacgtgtgtgttggtggtggagagaacagtgtataaacatgattttcatctaatcctataatttgatatatcttcggcaactttcttaacccagagaactttgaaacagaaataattcctttcagtttttacagagttgtgtgcctgtgagggttgatggagtgcctgctgtgtggaaagcagctgtctcaggccatggacctgtactgtgtcacatgccatggtagagtcattggaaaccaaatcaactctcttcccccagggacctgacaatcttttaggggaaatgatatgtctgtccatacaaagcacatgactttacccaataatatcaatgtgtgtgtgtgtccccagtcacccagtcatatccaactctttatgaccccatggaccgtagcccgccaggctcctctgtccatgggatttcccaggcaagaatactggagtggtttgccatttcctcctccagggaatcttcccaattcagggatggaacccacatctcctgcattggcaggcggattcttaccactgagctaccagagaggcccaataatatcaatataatgcattaaattagtagagtagatgagatccagaggaacaagaggactgtgtgagattataacattatagttataatgttataactttataacagctgatatttattgaatttttaagtgctttacagggttctatggacttaacaca

SEQ ID NO: 51240 - DNA, 1013 bp, Bovine  19866880799737
atttctcctgttaactagattataggggacttagtgcttggactaagcctagtggagctattatatatttatcattaccatttattgagagccttagcacaagtgacatggattatctcatttgactcacaacagctcctatagctctaatggttaaccatcattctgtgttctggatagagcctctgagagattaagtaacttgaccaaagtgacacagccacaaaagcaagattctgggattgatccctccagggatgggttagttcacaggcgggaaagccgtaattccgtattcacggatgactgtccccacccccttgccaccagctagccacacctgttagctcactaacgggggccaaagttcacagagtggaaggggtggggatggtcaggccaagacctctcatatcaccgttggaacaactgagtccacgtccccctagaagtgattcgtgcattgctctgcccgctgtctgagttagcttccggctttcccccaggagcatgtgtgagtgtagggtggaatctatcttgcgtaagtacagatctgggcccaaggttccttctcactgtctgtccctgtcctcttcccagacataaggagccaggctctctgttctccttcagcagggccaggaacatagcacacgccctgcactctaagccagatggggagctctgcttaggaatggtccgggaacgtaggggacatctggaattcaagggcacagttcccttggctaagttagtctttttttctgtggaagggctgggaagtgagctttcaaagataaaataagatttgattttttaagagaggggttcctctgatgggtggagcagaggaaccctttttgtttggtggcgcaggaaaaggcaggaagcccctgatgaagtgttggcacattgtggtccgggctgcccttacctctgatttctctgtgactctgggaaaaccttattatccccctcagactctgcgtcagtcagatgagggtatcgaacta

SEQ ID NO: 51241 - DNA, 1556 bp, Bovine  19866880814443
tcactcagttgtgtccgactctttgctaccccacgaactgcagcactgcaggcctccctgtccatcaccagctgctggagtccacccaaaccatgtccattgagtcgatgatgccatccaaccatctcatcctctgtcgtccccttctcctcctgccctcaatctttcccagcatcagggtcttttcaaatgagtcagctcttggcatcagatggccaaagtattggttgtattacattctttcatatgaaaaatttatgtgttaactaaataatttgtagtaataaaataattgctattattatatgtgataaagagggtaattggtggaagaacaggagagagaaaaaataacacaaagaaccatacaagcctgacaccttgcagtcctaaagatgcttagctgatactatgttgaatgctagcattttagattcattttcttctaatagatgtataaagggttaaaatctttggacccaatagccataccaccacattccctttatataggaaactagaactccaggtttggactaacttaaatagcagtcccccttcttttaaaaaaactgtttattttatattggacatagccaataaacagtgctgtgatagttttcaggtggagagcaaagggactcagccattcatgtacctcctcccatccaggctgccacataacaacattgagcagagttacctgtctggtacagtcggtccttgttgattatcgttttaactatagcagttcccctcctttatattaaatttctgtgttaggttcatgagtgcacagttaacgaatgtattttcctacataaacaagggattggagaaggcaatggcaccccaatccagtactcttgcctggaaaatcccatggatggaggagcctggtaggctgcagtccatggggtccttaagagtcagacacgactgagcgacttcactttcacttttcattttcatgcattggataaggaaatggcaacccactccaatgttcttgcctgaagaatcccagggacgggggagcctggtgggctgccgtctatggggtcacacagagtcggacacgactgaagcgacttagcagcagcagcagcagcatgtctctgcaggtcactgggaatagaatctgttagtttaattcatccgttttaaacactaacaacatctaattctaaaacatcatctttggaaaagaagtgggggaagggcttagccaaaccagcaaggctttggtgcagtggatgtatcaaagtgttaattatggagaagtgttgcatacacatgaactctagttaattttatattacagttgcttttcaaatcataactcagaggcaacagccttattggaaactcttaagattaataacaaccttattcagtttatagcttagggcagaaccatctgcaaagccgagactcctgggaatactgaccttgccagtgcagatcttattttgccaaaagcataagcaagaattgctttagtcttttcagggatctctgtgcctttcctggtctgtctcttttagcacaaagga

SEQ ID NO: 51242 - DNA, 1365 bp, Bovine  19866880854837
ttgacgaactccttttcctatttggaaccagtctgttgttccatgtccagttctaactgttgcttcctgacctgcatacaggtttctcaagaggcagatcaggtggtctggtattcccatctctttcagaattttccacagtgtattgtgatccacacagtcaaaggctttggcatagtcaataaagcagaaatagatgtttttctggaactctcttgctttttccatgatccagcggatgttggcaatttgatctctggttcctctgcctgttctaaaaccagcttgaacatcaggaagttcacggtttacatattgctgaagcctggcttggagaattttgagcattactttactagtgtgtgagatgagtgcaattatgtggtagtttgagcattctttggcattgcctttctttgggattggaatgaaaactgaccttttccagtcctgtggccactgctgagttttccaaatttgctggcatattgagtgcagcactttcacagcatcactagatccattctatgcccttctctgagctagtctgtgccttgagatgctgatgtctttaggttgtattgttcagactccctcaccaactggcttctgttgggtttggcccatgggaagcagcaataggatgtgataaaggtagaggtgagggtatttgctccttcactcccactcccttcttatcagatacctgtgttactgttaagaatcctcaagagcatgttgttcagtcgcttagtcatgtctgactctttgcgacctcatggactccagcatgccagacttccctgtccttcaccaactcctggagattgcttaaactcatatccattgagtcggtgaggccatccagccatcttgtcctctgttatccctttctccttctgccttcaatctttcccagcattggggttttttccaatgagtcggctcttcacatcatgtggccaggagcacagggccattatctactgtgcagtgctgaaggctagaaggcatcctcaagattttggttgtactaatcattgagtagtaagtcttcttattcacttgctgccaaacactgaacatataaacctcagaactttagggagcagttggcataagtctagttcccagactgtgagtgacagtgcttggtatccaagcagctatggaaaagaacaccaaatgtgtatgcttgtctgcagataggataaatcacatgtcacgtacagaaactttgttattttccaaatgtgtgtaaatagaactgaaactaaaaccgtggaactcagattggggcttgaacccatggtcttttagttgagatcacacaccggtttcaggacctaatgaagctcaggttat

SEQ ID NO: 51243 - DNA, 2417 bp, Bovine  19866880878023
acacagaccgtggtaaacggatttagaacagcaggtagcccttctttatttttaagtaatggtgttaaggtttgtgctttctctacctgggtagacattagaatcacctggttagcttcttaaaaatatagatcaatcttattctccacttctctcatcctctgtctcatctccatgtccagtaatctgcttcattaaattggtagtaaggctttgaattctttatttttacaagaattgggaatcactgtctaagattctttttacttacatccacttataagaaatggatctgataatataataatattgagtcttctttttttttcctaaattgacattgaaaactatcttatttgaaaacaagatccaattttcctaaatatcctgttttcctgaattctgatgaaaatgaactaggagaaagggttaaaaaaaatcagtcattttaacttgttagatttataggagcacaattttcaagctggaggagacactgaaaacctactcctgttttttcactttgtagatacagaagtgactctttgagtgtaatgagaggctacaatgagaattccgagattcacagacatcacgactttccaaagcaagacacttagctaggaaaagattcttgactttcaccatgcttcatttctttaataatcacccaaatggactggattgatttctcattttatggcatttaagattggcatttaaataccaaatgtatttgtttttttttttaacatgagcatactaacatgctagcattcttcttatcaaataagtcttagaagcacattttgagaattaaatggagtcttacctgtaagaggcaccttgacatcaaggccatagaataaaggcaagagagaagaacaagaatagaaacagaaactgcagaagaaaaagaagaggattatgtaaatctgaatttctgtagtgcaattcaggttgtataaaacctcagcttttccatattgctcaaatctgatcatttctcacatacacacaaagtaccttttatttacaaaaaccataccttttatttcttcactggtaaagcaatacaatgaataactggtgttcagctaacatcaactgatacattttagaattctgagagggtcttacagataattggtctaagctccgaattttataagtgaggaaaataaacagagagcagttaatcaacagactaattgcatacaatttgatggtactgtgaagcctagagcttagacctcccgagtcctaatctgctatgtgttattatctctatttttaatgtgtgagagtgtaattaaaagtgatcaaagtgtatgctttatcactcaacactatcactatttggttactatggcagagcaggaagaatattactttgcagggtaaacatatgattgcttatccatggtgggcactcctagaagggaaatggaacagtattagtaattacattggggtaccaggcataacctaggtctgtcctgggtgagtgagggtatgtggtcctcccactggtatgaactacgcttctacatcagagatagcttcagacagtgaacgtatgctgttgctccagcttgtcatgcttctgagatagatatctccttatttgactcacagaagttaaacagagtccgagctgtctctctccaccaagaaccttcaccagagaagaaaaaacttggatggaaaacatgctttgtgtagcactggttgaaaaccaactgtataataaaatcttgtaggtcagatcagttttctcaaatactgatttccttggggatttactcttacagagtcatgaagtcttttggcttgttaaaacccttcaggagcattctgttggacatgatagttttgaataggtcctgtatggtagtctcatattgggcatattatttgcctacttcctttaatggcattgctcacaaggctcttgcttcatggtggcaaaattgcatgaacaagttataaacatggtgtgaagagctatgtattagtgaccagtctaatagaatgaggagcagacactcttttctttttcccattccttgaagatgtgtagtgacaggatgtcacctgtagtgagagtggatgaaggaggggaatggaaggcttccacaattcccatgagatggtcaggtatcagggctacctttctgggcataagggatgcttatcacttgatttacaatacgagtctaaattctatgtcacatggtgggcaggctgtgggcctcagggtcagacacctgacctctgcttttgatttgccatggatggattatatgattttgtaaagttgtttaatgtctctgagccattttttcattatctgtataaaaagggaacataatatctgatgtgtctgtctcaaaaatcaggagaatcaaatgaga

SEQ ID NO: 51244 - DNA, 675 bp, Bovine  19866880921823
gactgatgttgaagctgaaactcttaatactttggccacctgatatgaagagctgactcatttgaaaagaccctgatgctgggaaagattgaaggcaggaggagaagggaatgacagaacatgagatggttagatggcatcactgactcaagggacacgagtttgagtaaactctgggaattggtgatggacagggagccctggcttgctgcagtccttggggtcgcaaagagtcggacacgactgagtgactaaactgaactgaactgtggtcaccctgctctgaactcagaagccctggagggaccattttgtgtgtgtgtatttttacaggccatggggaaaatggatgaaaaccagtttgtggccgtgacaagcacaaatgctgccaagattttcaatctgtatcctcgcaagggaagaatatccgtgggctctgacagtgacctggtgatctgggatccagatgctgtcaagatcgtctctgccaagaaccaccagtcggtacggcctgagtgggtgggcatggagcagagtggggaacatgggtggggaacagggacaggagagatgtgagtttgtggtgagccagggtaatcgggcgaggatgtgttgcaataaccaatcatcctgaattaccagggatataaaacctcagcagtttatttctcactt

SEQ ID NO: 51245 - DNA, 1035 bp, Bovine  19866881013257
gtcctaatttgcttattccctccgcctggctggcctcctgccgttcctggaacttggatgtctgtacccactgcagagctcctgtacttgccctgcactcctggaacacttctgcccaggcgtctgagtggctcgccccgtccagtcttcagccagatagcgcatgcttgtctaggctttctgttatctcaaatcagaacccgcatgaacacttcccatcaccttccgtgcttttattgtttcccataaaacttcgtcataatctagcagagtacttacttattatgcttactgtgtgcctctcccaactaatacattgtctccatgagctggagacacatgtctgttttcatctatttactcagtgccaagaccagtgttcagcagctattacgtgttcaatagacatttgttgaataaaccaacatttaaaaaaagctcttacttgatgcatacattgctaaacacttcacctgcattattctgtggacttttcactaccaccctccaagggaggcctgaatgacagaatgaagacatgggctctacagtcaaacatcttggaataaatcttcccccatcagtacttgccagctcagagccgaataaaggtcagtcattcatcttcactaagtcaccgatagtccatctgaatgaatacaagggaaatattactgattacttatcattggttgttttttgtcagactgtctgaagcaatcagatcaacattataagaagtttttcaaccacagccccagattcaggcttccagtaccatctcatttaattatctatctcatgtgatcatttaagacttaatagctattttgtgtgcactgttttgcaggagtaaagcactcccttgtcttaccctatttcacacaggaaaaacgttaactgctaggttataagcaccctgaaaaatgggatttatctgtgaaatgccctaagtgactacttcagtcagggctcagtgcgttgctacaataatgatacacaaccttgtgttaaatcttttaaatgctctggata

SEQ ID NO: 51246 - DNA, 1016 bp, Bovine  19866881083687
ataaatacttacacagatttggatttagacttacatataaggcacaaaattggctttgaaaggttttggagaggcaaacgggagaagactttccagaagggcccttgttcaaagaaagaaagaaatggagaggttcaaggcatatttaggaaacaaggagatcactaggcggtaaggagtggaccctgcactgatgaatggtggggaaagattggaaatagaagaccagttctcgaatcccaaactaaagtttgaattttaacctgatggtaaagggagccactgaaagttatatgcagagaatttagaatgtaaaaagagattttaaagtttcttcaatggtagaaaattattttttcttctctctcacttgttgagttctaatcagggaacatgatgggaagaaaaaatgtagaactaccattttacttactgagttctggaattttgatttcgctaggctcaagaacaactccaggccgaggtgctaaggtataaagccaaaatagaagatctggaagcgactctggctcagaaagggcaggtaggcatttggttgctcgcacttctgcagatgcagacgattcaatctgaccttccactagatcaccctgtgcccattcaggacacggcttggctctccacagtgatcttcccaaactgtgtccgaatgttgagctctctgtttctgtccctggtgttttgctggccagagtgtgaacccagctacgagagcgaatgaggctgggcaagagagagaatgcccaaggaagaagagcactgcacacttagcctagagtgatcatgaactgctaagaccaagacccacccctcaagctgcattctttgcctctatgctacattgatggttctgcattttaatgttttccatccatatgtatctagcctgtgtgcacttctgacccctttcactttttgcctgtgtggtcacttctgagtccccagaaggctggtcctggattattcagactgaaaaagatagggttagcgagtga

SEQ ID NO: 51247 - DNA, 3398 bp, Bovine  19866881160006
caccactagattagtacagttcttttttttcttttgaatacagttaacatacatcattacctgggagggtttaagatttcaccctggttggaagctgacacgttattctgccacagttaaaggcagtctgacagaagacacagactcctgactcagagaaaagagatgtaattactcaatagcaatagccagagtcccagcgtttgctctggttccccaggcccagcctccatagcgtgacatgaagagggccaaggaaacatacagagaaagcacaatgtgctacaagggaaggatgcccagcttttaaaaatccctaaattttttcaagggcactatgcctggaaattccctggtggtccaacagttaggacttggtgctctcactgccatggcccaggttcaatccctgcttggggaactaagataccacaaaccatgtgatgcagatacacaaaaaaagcattatacctgcctaaactttgccctagtgagagatactatcttatacccaatggcaaacaaacctgtcctttacaccagagagagagactattctacattccaaggctatttcctgtagaaacactcttgaaaagattgtttgaaacacatgcagtcgatgtctctacccataagacatgcagaaagatgagaaagaattgagaattatctccccaaaccacaaatcgttccaaaatatacacaaggcatattttggaatgaaagatcaattctttgaggtaggtactgttattatttccatccccaggtgaactacttgtccaaggacatagagctggtaagagtctctggtgagcccactctaccttggagtacacacacaccttaggaaagagagtcctccttacctctaacctggccctctgtcagctactttaggctttgtgaatggtggcagaaaaagacagaaaacagagaaagaattttaaaagctgaagaaaaagaagcaagaatggaatttttttagatattcataccttttatacacctagaattagagaggacaagaacttttgagttcaccttacagatgagaaaaccagaacttgaccatgggctttctctccatagtcagaggaagttagggcaagaaccaagtaaccactagtaatctcttcctgacagtctttaccttgcacatttacctaggaaggcctagggcattcctctcctacacctttcttacactggtggtgtgccccaaacctggaggacaggctatactacggagtcaatcaataaccaaggagatctgtgacgcagagcaggaggtggagactggaagcccacgcacactatatgacccttccagtcccagggttccagagcgaagtgtaagttcagtgcagttttcgactgagctctagaaccagcatttcagccatgaaggtggcaagcatctttctcctcactgccttggttctgatgagtttatctggtagggtgtcgttgcttatttttctgatttgagtaaaacctttttgacctgttgccttattgagcacattactttcaagacttagagtctactcttggacagatcttttggttctagggaggtgaaataagatcagtagatgagaattatatatcgaaagagggattttaacataacacaggaaaacaattttactagtgctcagacatgaaattttttttttcaggtaatgaagctgactcttcaagagatatggtagaaaaatgaagggattatttcaacatcaagtacccttctaactctgtacatgtttaaggccaatttacaaattttatgttctcatggaattgtagaaataggttacaatggtttccagttattcagtgtacagggcagagtttaagaatttgacttttgacctacagaataattttagaaaaaatattctttttgaatagatggtatgtgcatatcttcaaactgtcttgatagtgctgagagacgatctgaacccccagaatcggcatcagcttcctttttgtctttggaaatggataacgtgttaaattttttatcagatctagcaaagaaaccaaatcaacactttgagaaaaaaggaacaatgctgtttgttgtatttgctaaatatttatgggagtggtggtcccttttccatttctcatgcatatcaattaatacagatagatgcctgtgtggcgatcacctgctcattaaatcttagactcaactagattctaaaatccagggggattctcaccacatcaggttctgtctattccagggaacttcttctccaggcccgtgagtgtcttatgccttttcaaaacatttagctcaggaaaactacctccttacctagttgacctcagagattgttaataacaaaatcaaatctgaccaacatttcttcctttagaagaagtgactaatactatcaaattagtccattttccctacaatgagctcacccagagttaccatatcctacataaacgtgatgtcatcaagacctgctattttctggaaaatgcagcatgacaattttaagtatctacctgtaaattcaaaaaatgtgaaattaaactaatagcacaatgcaatggacgaaaagaggtctttgggaaccaaagtttgagttgtcagaagattccactttttttagtatcacttacaaaaaaagacttatgtataaatataaaagttagttttgcatcataagacctggtaattgctagtgttaactgttttactggttatagaaactctccatatctttatctataaacttaagatagatacttacatttcctacatcaataaacaagttgctaactagaatgtcagtgagtattcagaaggtatttgctctgtgcctgagacatctgaagcaataagcacatcgtttttattttcaaggaaacaagtcaacttgtcttaaatatacaaaacttttgtcctaatcaaatttttgcttaatttttttgaggtttcagaaggcaggctgtgagtgaacagcagtgagatgtccttgaggaaaaaagatggaaataagaagggctaggtggtgaaagaggccagcagagaagacatagacttaagtggaagcagaaatttctgaatgagaatacatctgtcctctcccattcaagactcaacttcacatgtctgatttatgttttccaggtaacagtggagctaacatcctgggaagagaggtagagacaattttgtaattttttttacctccggggctagaagtgtttgttccaaccaaagcgtagtctaactcacctttcaatttagcctcaagttaatacaaggagtttgaacgctggcaaggcttaacctactaagtagtgattgtagttccccacaggtgcttatgttgagggacaaattctcagatacacaggca

SEQ ID NO: 51248 - DNA, 1109 bp, Bovine  19866881299290
aatatatgaagtaagaataggttgaagggggacttccctgatggtccaggggttaagacttgcccttccagtgtaggcggtgcagttggatccctggctggggagcagtccacatcaaagaaaaattaaaagaataaattgaagtgtgtgagtctgttacaggtttcttgtgattgtcaataaaaagatgatgtgtctgtagagctctgtaagccaataattcaggagttcattatgtgagggtgcaggtttgtgaggcagattctagaaccgggagcaattgtgagacaattctaagattaggatgagacagagtctgggattatgggtaaacaaagtctgagattgtgagtctggtaaatctgagtttgtgtgtgtgtgtgtgttgctgtaaatcaggaagaacttagagtttatatcaacccacctgagccaacaaagttttcgtacctgagtggggcagaggcttgtgttttggaggccaacttgggagtgagtgtgggtaaaacagggtttgtgctcacatgagagtgaggcgagctctagagtgtcaacctgggggttgttgggcgagctggaaccgtgcctgtgtgtgtgcgcgcgcgccaagttggatttctcctttggatgggcggcggggacgcgtgatcgcaggaggccacgttagggtcccggcgcgcaggaggtgcggcttggctgggcggggcgaggcgggcgagcggaacacgccgccgctccggcccaagcgctgcgctcgctgactcggggctcgcaggggactggcaggaaccggagcagcactgccgcctctggcgcgaaggctcaggcgcctcctcccgccccagtcactgtggttcggcgcacgctgccggctgctgccctttccgcctttggggaagagaacccacgggccgctgtcgcgatccaaccatggcctcgggccgcagaggctgggacagctcccatgaagacgatctgcccgtgtacctggccaggccgggcaccaccgaccaggtcccgcggcagaagtacggaggcatgttctgcaacgtggagggcgccttcgagagcaagacgctgatttcgatgccctgagcgtgggcagcgcg

SEQ ID NO: 51249 - DNA, 1360 bp, Bovine  19866881416308
tttttttccccccattcttgctatttatgtggttgggaaatagatcttctagttcacctgccctcaggtctttatcaagccaccattctaaagtttctgttgctggtgacccttggaattgattatttttttggttacactgttgtccaggggagatcagcattactagtctcttctgttatcaactggagaaggcagtttccctaaactggtcgtttttgctacttggaaacgtccctggaaaagtagaacaaaggttctactttttgactggaatttactgaggctttgtgaataaggaaaggaaggtaaaatactgaggataactttaaaaggctccttgcatggttggctcttctttatttaagggtcatttccccagagcaacgggttcccaggtatcttcccccaacacatttacctgtataatcatcatcttctcctcccccttcctcctccttatttttattctttatcagtacctgaaattatcttatgtatctgtttatctattcccctgttttagaaagggagtgcttattcattccctgagttcttggaacttagaatagggcatgtctcattgtaggaaaacaacaaacattagtcttaaaaatggatgagtgaatgaatgaatgaacagaaccagacctgccttagggtgcagctaatttttgttcattttttagatatcaacttgcatatgacttcttcaggcaatgtcctccatgactgactggacaagataagtgctccctgtgacacaattcctctgtactcttttatctaaagtaattcattttattgtctgtcttccctccttgagtttcaggtcaagaattagttctgtttcatcctgtaatggactcccaattcctagacaaatacaccccatgtagttggtgcttgacaaatcttttccaaaacataactattaaaagatcattcaacttgatgaaataatatacaaaattaggaagtagcctttttgtttaatggaaaatacaaaaactgaaactatgtgaagaaatcattctattaataatacaaagttaacctaaccaggattttacaaatttctggattttttcttgactcttaacatccctcactcatgagtcattctgttccctccccctagccctgtgactacatatcacaaattcttgcagtgtcattatacagaaactttcagaatatcactcaacaataaatgcttcatttaacccataaagtactaatacctgacattaacaaacctaatgactaaggaaatagttttcccatgagtactttcacattattctgtaaggggtgaaaattgtaatagttggtgctcatattgttacatttggtgtca

SEQ ID NO: 51250 - DNA, 636 bp, Bovine  19866881664989
ggacctagagatttctgcatgactagactcaactggaaagtgggatcatggaagcttttgaggaagaaggtaccatcagaaaaggtgagaaggacaaggaaaacccgagcgttttcagcctgagtgctttgagatatggtagttccactaaacaagacaggcagatggggagagaagagagaagcaaagataagaacgcgtgttcaggtatgtttcgcatgagttcactttgaaacattcaaacagaaatgtctagtaagtggttagtgataggttgtataatttagactgccttgcatatttacgtatgacaaatcctgtccaatgtctcctggaataactctctcaaatcaaagctactgattgaaaggaaaaaaaaagagtaataaataactggaaaggcatattctaatgaatatctgttggggagacagaaaatgtcaatgaaattatgagacttaaaaatttgttgttgttgttcagttgctctgatgtgtctgactctttgtgaccccctggactgcagcatgccaggcttccctgtgcttcaccatctcctggagtttgctctaactcaagttcatggagttggtgatgccttccaaacattttgtccactgttgtctccttctcctc

SEQ ID NO: 51251 - DNA, 1260 bp, Bovine  19866880354241
atggttttgaaactgatgccaaataaacttgtgtatgaaaaaaaatctgtttggttagaacactatgattacctgaacatggatttacaaaaaaaaaaaaaaggtcaaaaaaactgtgcagcaatcagagaataagattatgatgataaaatgagtccaatgagggaaagaaatagctgtaaaaacgccaaggtctaaacaaagagtgagagttttctgaccgtgtcacaggccccagagagcatctcagaaccatactgattcaagtttcctatgtgctccattcggactctaaggattgctggttttttaccatgatgtggttcctgttaccacccacagcacgacacaaaatcaagtgatcaggaagccagataacctctcatactgttttttattttatcttgttattaacagtcattattcttaaatgatagaattaaatgggagctctagtcaaaagctttagagagctttaagtaaatgtttaaaacaaagtctttaacccttctgactatctgttgaatctgaaaatacttgcatacagatatataatcagccttgaagcgtaggagtcttttatcttccacctactgattttactgggataaattaaaacaggaaaaatctgatgatgaaataccaaggctaaaatgtcaccaacacctaagttccacaaagtcatttcttctgctccaagtagtctagtgacacagctatcattgtgccttataatgtggatgtgaccctaacattgcagagctttgaggctgcagccttaacacttcctgtcacagtctttgagtcagtcctcatgcccacacaatacagcgagtttccatttcattcttgagttgacacaggtaagcggatgggtatgtgctcaaactcagagatgttttatcacattaatccaagtccattaatctcattgctctactttttttctttcttttgaaattaaacaattcttacctcttgcccttcactgcttgataataaaaggcactgggaagagtcaagagctgggctaccacttggtcaatgactctctaagacccttcaaacttcatgcttcagtattctctgtaaagagagaatcataatgtttagcccagttctgcaaatgaccagaaaaaaagcacttaaaatgttatgggagaaaaagcataagaatactgactttaaaaaagcaagtggcacaaaataagaaataaatagagcaaagaaatagcagaagaaatcaacaatcttaaacaa

SEQ ID NO: 51252 - DNA, 837 bp, Bovine  19866880478672
aatcttcccctttggctccttctcctctgcctctcaccacagctgaccgaggacaagaaggcccttctggggcagttcccacatccccatcaaatggcacaacggcagacttcccctccacgcctgccccactccagctggcatggagtcatgcctctccatccgccgtgccccaagtgccaactcctcaagaagcaggtagtgatgggtcccctcccacagcagctacagacctcctcctctcaagcacatttcctcatcgtccttccatgacctggacatttcccctgcagaaggcagatagcatggcaactgttttaaagaaaaacgaaaaggcaaatttgacagttgctctccagacgcttccgagtaaagagagtctaagtcttcacgctgtaggtggattcacctctgatttcagcactgatcatgtctctacagacacgacaccaccaggaaccagcctccttccttctgaattacctccatcttccatgcccttcacacgagctacccagactgtgtccccatctcatagtttttccaggaccaagccagtgactcacatagctgtgacagaccattctgagttgccagttttggcttccaaacaggtgacagcttttccctcctccagtgaggtctatgatttctcaacaatgggaggcatgaggaagccagcaaccacagatgttttctggaattctgttgcagcagaagctgagtccctttccacagaacccatgatgtctggctggctgcagcaaacaaattatgatgtaaatgggcacacaattaactctacaagttgggaaactcacccagcttcagccactt

SEQ ID NO: 51253 - DNA, 1240 bp, Bovine  19866880555058
ttatacctaatacacatcattgaaaactgagagaggcgtaaaaactgggggctgaagttcttcagaagcttttcccaggtcttgggcacacagccaaagattactgaactttctaaccactataatcacaacagacaattcctggacagcaacttccacacagagacacctcatgtcagtgaccctttaagtgaatcaaaggaaaatgggctttgaattaagctttgtagacaggaaatatttttaacctaaaacagtgtgagctcctttataataaggagatttaatttaacttgggggatggggcacactgagcgataaaaacattcctcattaatcgctgctaaaacccacagaactacagggtcatattggctgaaacgaaggctaaattccttgataaatgaaatgtaccaagaacccagaattttatcacaaaagccttccctttacaagtgccatagtaatcattcttatttcaaaggcaattgctgacagcagaataagttttgaagaacattagcagaataatctcccctaaacagttacaacagatttttcaaaacagtccaagaaattacagaaatctatttccgaaggattcttgggagtcaaagagtcaagtgtggttacttttaactaacgttcctgcaaacaggaacgttatatactcgaaccctttgcaagacgaaattattttgggtacctctacccccaaagtaaaggagtctcctgtcaaaatagagaggaaaacgccgacatgggaattgcctaaaactctctgggccattccgtgcagtcaaagcacagtgccacccatccgagagcccaagtcatagtggacgtccccaccctgaaatgtgtcctactaaaacacatcccttttcaggtatcctaaacacagcgtttctttatctaaatgaagcatgcctgtgggaccactaggaaggatctgcaacttgtccagaaggaaatgcacttctttttacttccccgcccaacagtgcctgccttcccgggagacagatttctgacagttcgcctgctgttgcagcagcaaagggcggggaaaatcctagcgccggtgctgcaaagatctcccccatccaccgccacccgatcaggtaccggcctggatgggccgtcccgctcctccagaaacctccgcgggcgcaaagcagccgccaagtgcttaccctggtcggccaggcagtgtcggggagggccgccagcagcagga

SEQ ID NO: 51254 - DNA, 2838 bp, Bovine  19866880602739
aaatggcatagcctccacatactctcaccttgcatgggtctccttttcccagtcctctgtccaaaaagagattttcttgggagttttgttatctgtgtcctatatagttctgcataggggccatcctctagacctgccaggtgatgagaggaaagaaaatgaggaaacatctttctctatataaagattgttatttcaatttggccttcccttcccaatctgcctgtagttaccaacttttcatagttttctgatagttccgttttatgttttctccagcggttttagttgtaataagtagatctaatggacttatttgatcttagttggcaccagaaacctttcatgaatttttaaaaatttattgtcttacaaattacagtcgttatttctgatcctcaaactgttctataatgggccaatagaagccccttgagtgttttgattttgattgtgattacattgaattcataattaattttaagggagaattgttatctttactatactgtcttctcatccacttatggaatgtaatgttgttctacttactcagatcttacgtcttttaatatcttaccatttttccacatagataatctatattatagtcttaatagtatttttttagtattttaaatacaattttcatgatactgttctctcattagttactgataatgtatggcattggttgattttcatgtcttcaatgcgtttggtatttttgtttaaatttattttatctatttattatatttttggttttactgcatctttgttgctgcgcatggctctctctagttgcagtgagctggggctgctcttagttgtggtacgtggtcttctcagcgtggtggcttctccctgcaaagcatgggctctaggcacatgggcttcagtagttgtggctcgtgggctctagagcagggactcagtaattgtggtgcaggggcttagttgccccatggcatgtggaatcttcctggaccagggattcttttcttatcctgggaagtcttggcctttttgttgaatttttattttgacagtttttccacctgattctcttgcatttttaaatagataattgtatcttctaaaaataacggtagtttatctttctctttctgtgggggtaatttatcttattggctcaggcctctgttgtttaatgatggcaagcatcccagccttctccttgatatttagtaaaatacatagtgttggaaattatttgtcagtttctaatgtactgtactctttaagaaaatgtccttctcttttgaagttcttaaagttatttttttttcccattaacagtaagcattaaattttgtcagatgcttttttgagtttcttctgaaaaatctgccttcttttttcccacattaatctgttacttgatttcctaatgctgaacctcctttttaaaatttctgccatgaactctgcttggtcatgatgaatcactttagtccattgtaggatttaagttgctagtattttgtttgggatctttacacctagattcataaatgggattagtgtatagtgtttttgttcacttttgttttcaggaatttgctaaccttataaattaaattaggaaagcttttatatttgtttaaatttgaaaaagtttgctatatataactgggatttggtggaactttctaagaatacatctgggacttaacagttttttcctgatagtttgatctatctgggtcagtttatttatttattttctagtaaaatgatttctctaatttagattttaaaatttgttgttataaaattgtacatagtgtttcctcaaaagttttcagtctcctctgttctgcagtttatgttctctttcttgttttgattattatttgagtctttttccttatcaatctgtggaacaattgcctatttaatggttctttttaaagaaccagagtacttttttttttttttgctcctatcactttttactcactttttcttaatttctgcttttatcagttctttttcctcctattccctgggttgaataatctctcattggccagtgtattttttgttgctttctaatgaatggaattgaagttgtaagttccccccagcccgccaccacactgtggctttattcctctggcttctttgttatgtttctcactctcctttctaaacggtttgtcattttagttttgatttcctttttaacccaataattattaagaatagtggatttttacctgtttcctagtaggtttttggagtttttgttgtttttatttctttattactattaataatttatagccctgctgatagtcctttattattaatttatggccctgttctattgtggtcaaaggaatatggcttaggtaatgcctacattttgaaatttatagaaattttgttagtagcttgctaaatgtcaatttttataaatgtcccctgagtatcaagtgctaatagattttattggtaatattgttcaaagcctttatatctttattttttgtttaatataataaatgacattaggttatttaagaaaaatgtatatatatgttgcaggtataataaatgatagatctggaatttgccttaaactatcccagcaggtataataggggtgacagaaaaataaaagaagtatatcaaaatgtttatgattgttacagttgggttatggtatatgagggtttgtattctctaattttatgtatgtttgaactttttaataaaatttttttttaaatcctccctatacttatttgtttttagattgcttgatctgtgattcctgaaaaaggtgtgttaaaatatccaactatg

SEQ ID NO: 51255 - DNA, 2685 bp, Bovine  19866880641782
gacaaagtttcttgtcccaaaattaaccaaaatgatattacttcaggctgggaatggatctagactaatccatggaaagtatgtttttcccaaaacttccatggttcatttggaaagcagctttactgagctctgaagtcatgcagggacttctggtcgctacaggtgaatgctgctctcattcactggaaacttaataagcatagagcagcagttctctttttcagaaagtgttaccagcactgtcaccattctccagtcatcctcttcacagtggcagacactctgctttgtccctgtgccagtgaggcagactgttccacgtggtttgttgaaaacaagttgcagatttcaaagaatcctatttttctcagagttggctatatcagtactgtatacatagtgtacccttgaaatgtcatgaattattggaaaacatgggctgagaatttatttacaaagtcacattagatttaatatcctaagatttgtgaatgacaaggacttaggacttgccagtttgagtataggctttcttgatggtattggtcattcattttaattcctagtctctttgttttgctgttgaacataattttggataagtttactgattagcttaagttttagcttgacttttgttccctttgatatagttgtgtctggtcaaaattaaagcatttttttccttttggcaaaagtgaatgggaagactgaaatagcattagaagctactcagctctttctaaagcttttggattcccaaaatagagaagaatttagaagactgctgtatttcatggctgttgcagcacatccttctgaatttaaattacagcaagaagtaagtcttttgtctaaatgttaattgtattcagtatctgtgatacttacaggacatattattccattatcagcatcaagtatgtggaaatggacagtagctattaatatttaacattgctttttatattacatttattcttaaaaataaattctattgggtatatattcttttacagagtgacaaccgaatggttgtgaaaaggatgttctcaaaagctattgttcacaataaaaatttatccaaaggcaaaactgaccttctggtgctctttttaatggatcatcaaagagatgtttttaaggtaaaactctgaacgtaaagttgaacttatgtaatagatcactaaattaaaatgcataatgttccatgtgccttcttttttttttttttgtaagattcctggaactctacataaaattgtcagtattaagctcatggacattcagaaaggaagagatccaaacagagacgcaggtaatctgagaaatactccttccatgtctcacgaggataagtagttgcattttagcttcagctagactctaactcatcttctcagagctattcagacttagcagagagcctttttatgtcagaaaagcaacctgacagggttagaaagtcagcagtgcttagcacctttacatgcattttataaagtgggggaagaaaaaaatatatatatatatacaagtgggtttttttcttgttaaatctgaggactagatccattaactgaactttttacttttaaactttaaggatatatttattgccagagaattgatccgaagtgattattctgaccatacaaggaagacaaccaaggatgagctgttgaatttactaaaaaatattgatgaggattcaaaactttccaccaaagagaagaaaaaattgttaggtcagttctataagtgtcacccagacgtgtttattgagtattttggggactgagtttccagtatctgtatataacttgtgcattttaagaataaattatgtatcctaaagattcaatcatattgtaatattagatgttcctctaagtatgaaactgtacttaataaaacattttttgtataaccttttgtgaaactgagtattaggtggtgtattgctgttaagtattgatctctctcaggtgagttgatttataattattgtgcacaatactttatagaacatcctgggaatttaaatgatgggacattgcagcgtttataaaataaagtattaaacagttaggatgtctgtaattacaagttaataggagtgtggtttgtaccttgaaaggtatatttcttgaagatacaagatagaaatttaggctatgctaaaatgaatttgtcagttaccataaactgtagacaagtcagaaattgaactgtcctaatgcttttgacaacttcagcatcttttaaagcttattgtgtataatttcaaacatacataaatatggggagaatagaataatgagcccttcatgtattcatcatccagtttcaacagttgtcaactcatggccagtcttgtttattctgggctcccacctcagcagatttcatacatgctatcacttcatctataagatttcagtatatatgactaaaagataaggacattaaaaacataaccccagtatcattattatacacacacaaagtcacaattccttaatatcttcaaaaatgcagtcagtgttcacagtttctgatctcaaatgacggtgacatttatgtagggatcccaacagagttcatacattgcaattggttaatgtgcttcttaaatctttataggtttttctcttgtctctcctcccttcttttctctct

SEQ ID NO: 51256 - DNA, 1265 bp, Bovine  19866880664215
ctgtattacacgctatgaatccgctgagggtggggaagagggtatagtccagaaagaggaagaagcaggagcaatagaagggaagtgaaaagtaccagcagtgcttggaaaaaaggagtcaagtttcatgcagtaccgaagcatgaggaggagatgatgggggtagaaatgagcattgcttaggagactcaggccttgcatggcaagggaagggattgtacagtgatgagattggttctggggagctattggagacttctgtgcaggggaatagtatcattgaaagtacccattatctagggagattaatctgttgtcagtgttcaggttgagagaaggcagaactaaagaggctttctgatggcccaggcattagggacccgaataagggcttcagagaaaccagggaataggtgaggcaggtgagcaactgtgtggcagaaacagattcggcagcacgtggagcatgctctaggcctggaaggcctagcttgatctgctagttggtgtccacactccttaggaacctgacacctggctcattgttttcctctcctcatcttctgccttcatccacagtgggtgtggcttccatggggatgatccagcccgtgtgttgttatggccctcacttctgctcagccagcacatccttcatagacacacctttgcgtagaaatgatgatcaccctctacagtcttgcctttaaaatgtttttaactcagattctcttcctctgcacctctgtccttccctccctgtgggctccgtcccatctctggtcaggtcaatgacctaatcagttctgctatatcctcttcatgtgtgtgtccccaggctccatcctcagctctttatccatctctccaggtggagaatgaattgtagagggtaggagtgaaaaccactgcaggtgtccaggtgagagaggaatgtgtcagaggtagagactcagagaagatattttacatatttttgcagacagaaccagtgggacaagataatggattgggtatgagtaggagaaggtgagggccaaaagactcaaggttgactccgaggtgtttgcttgagcactgactttggtgtcacttgttgagatgtagaaggtacagagaggaggtggttcggtggggcagtggtggggatgggcagatggaattgagagtttggttttgaacatgttagtttatacatgcaagtagagatcaggaaatactaacttgggaggagtcatcaacacagataacatttagagttaagg

SEQ ID NO: 51257 - DNA, 1389 bp, Bovine  19866880669676
gtagttgcaagctgacattcccaccaacagcatataagggcgtgcccttcctccccatcttatccaacacttattatttgttgtttctttgacaacggccattctaacaggtgtaatgtgatattgtactgtgctttgatttgcatttccctgatgatgagtaatattaaacattttttcatgtgtttgttggccatctgtacatcttgaggggggatgtgtgcaacagatgagggagattaagaagtacaaattcccaattatgaaataaatgagtcatagtgatgaaatgcagagcatgaggaatatagtcaataatatattaattctgtgtggtgacagatggtaactattttggaatgtacagaaacactgtatcagtatgttatatacctggaactaacagtgttggaagttcaataatgtttaaataaaaaagtaaagcccaaacatgaaaactcttatgcttaaatctgcccaatggcttcccatctcattctagtaaaagccaaagttcttataattctcaatgcactaagttacctaactgttgttcccttaaacctccaattttatctattctccactccagtcacacaggtcttctggctgctcctccttaaacataaaaagctgttttacctcatttcccctcaggtctctgctcaaagctcacctcacagaaaacttccctgaccatctgatataaaacaacattcttcctctgtcctctttccacattgcctgactctgttttcttgctttgtttctctccagagcactaataaatacttgacattatttactagctggcctattagccactaaaatgaaactccatgaggacagggcctttgctttcttcactgctataaccccagcacccaaaatagtatctggcacatcatagataactcataagtaattacaatctatgttcagtttcagaaaagaaatcaataagttacagctcaatcacctctgattgcctgacctgattgcctggcatcctgataaagcttggaaaataaaaaatgaaggactaagctagtagatcaaccctttcttaaaaaaactcgaatacttttgagacttctattaattctaggcattgtatgagagttttcaatataaagcagagatctaaccaggccactactcaatggatttaattactgaagcccatattaagaacattctccttgggtagcatgctcttatgtccataatacttaagaaataaaacacattccaagttttaaaatcaattagcaaaagttccgtgaaatatgttaaatcccaggtaaacaagccagtacttgcacacaagtaataagttacttaagagtgaatgaatgattttgccttaagtagtcacattactttctt

SEQ ID NO: 51258 - DNA, 2416 bp, Bovine  19866880721700
ggtgtggttttggaaacccgaaggaacagatagtgaaatagaaatacatccaaataaaatagaatggtagctattttaagactggcagttcaaaatgatccctggaaggacaagctaacaatttaaaaccatattaagttaaatcaccacctcataacttatttttttttttaaggtagaaggcctttctagttagccttcccaagggagatatcatcacaaaatgacagatttgaatatttaaaaatgtaaggcttccctatactccaaaataacaaataaatgtaaatcaagggcaatatcaaggacagttttggaaaaatatctgcaacaaattattacacaccaaaggcctttacatgtcatttgaaaagaaagtgtcttcatgctaaaatagacaaaaagacatgacaggacagccttggccactgacaaactagaaagtacaatgactaatgaatacttgtaaataacacactacaaacgtaagactcatttccttttcttaagacctaagatgcttccctgatagctcagttggtaaagaatgcaggagaccccacttcgattcttgggtcaggaagattcgctggagaagagatatgctacccactccagtattcttgggcttctcttgtggctcagttggtaaagaatctgcttgcaatgctggagacctagggttcaatccctgggttgggaagataccctggagaagggaaaggctacccattccagtattctggcctggaaaattccatggactatatagtccatggggttgcaaagagtcagacatgactgagtgactgtcactttcactttcaatagactatgaaatgatgaaagacatctaagatgaaaagttaagcaatcatgtccacttttacaactttatttaacactgtacctaagagtcctagctagtgtagtgcaataagttgaggaaaaaataaaatgcatagagaagaaaaagatgtaaaatcatctgccttaaattctcagacaacatactatgtacaaagaaaactccaaagttcaaccaagaaaaacatactacgaattaattaaaatggtaaaagaatacgaagtcaatgtacaaagatcagttttaaccctatctcatagcaagaaacaattagaaaaactcatattaaaaatactgcttatactaagagcccaaaacatgaaatattcaggggtaaatttaacaaaatacttgcaagacctatacaatgaaaactacaaaacatttctgagcggtattaaagaaaatctaaataaatacaaagatataccatgtcatgaattgtatgttaagatataaattctttgtaaattaatctatatattcaacacaagccaaattcaaataccatagactttttcttttagaaactgataaaactgattctaaaagttatatggaaatgcaaaggactcaaaatagtcaaaacaattttggaaaagaacaacaaaattgaaggaattatactaccacattttaagactttttataatgctacattaataaagaaaatgttaaattgtctatccacaaatgtatatgctgaaattgaagattcatgtccaagaaatgattcttaatcctatgtcatattgtataaaaaattaatttaaaatgtactacagactatatgcatacactcatttttaaaagttgagaaagtgaaaatataaaccatggagaaaataatcagcaatggtcctaatttcttttaagaggttataccccacatacttgaattttacctcaaacttcttgtcttcctcaaactttttctgatcacataattcatcataatcttcttgtaacttagtatgagtttctttaagtgatgataactcacttttaatctcattaatttctccattaagttcttcaacctaatatataacatttaaccaaaatgaacatgtatgtaaattagttgtatataaaaatacttcattaacacaagtgtttagaaattgtaaacaatgaaaatattccccaagtaattactaatattaaaagctaccatttgttgaattgtgctgagtacttaataaacataatttcatactcttaaaaatcagctcccaacttacaggtgagaaatgtgaggctcatagacgttaagtaagttgcccaagatcaggtagaaagaaagtgatagtcaagattcaaatgcaaggctaagcctaggagttgtgctcttaagtactacattaaatcacttcttgttacagatgaaaaattaacttttataaaacttactataaaaattctgtaaaggttaccatttcattgctttcttaaagttttgttttcttgttgcaaattagatacacagatttcaactcaactagatgaagaatactgagtactaagtactacaattagaaactgaca

SEQ ID NO: 51259 - DNA, 1584 bp, Bovine  19866880722967
ccaaatgcatctgtctcatttttaaagctttcccactctctagtttcatcctcctattcaaatttaatcttctacaccaaacacaggttccaacagagagccaagatgtcttctgttatagttttctactgctgctgctgctaagttgcttcagtcgtggccaactctgtgcgaccccatagatggcagcccaccaggctcccccgtccctgggattctccaggcaagaacactggagtgggttgccatttccttctccaatgcatgaaagtgaaagtgaaaatgaagtcgctcagtcgtgtccgaccctcagcgaccccacggactgcagccttccaggcttctccgtccatgggattttctaggcaagagtgctggagtgggttgccattgctttctccaatagtttcctactgtctcccacctaatccacactcattcccaccttggtacctagaataatttttcaactcccctttcatttaaattctactccacctcttatgcccaattcaaggccccttttctccagaaatccttccctgaccactctaaaccctctattttctaaactcctgttgagtggttaaagtcaacactacagtttaataataacttaccagttgttctatatgtgtccacctgcctctccaaattagatgtttcttaaaggcaagaactgttccacatgctttcatttactcccccacatttctagacccaaagtaagcattcatttaattaacttgcaattaaaatagcttatttttatacaacttcacatattacagagcaatttcacctatatttttcttttgatccttaaattgcttctgaggtgtataggcattacttcctatggcatatttttttaaaaatcaccaaagtcagactcctaaaggtgaagattaatttttctgagataaagttccctaatctgtcaataaatttcaagcttaacccaaaaaatgcttcctattttaaaagatgagcactctcaaagttctgaaatagatttttagatggattaacaccaccaaccagttcaattaataaataattgtgaaaagaacacagaaaaaattgacaactatgtctaattttattttctatactattcagacttttaaaaatagtacacaaaataatggtaataagcttaagtgtaattaatattttatcagaaagctttgtttttttaaatagatgttatctattacttacataccaacatatcccaaaagagattgaatatagtgatctctttaagaggtttgctatatttttatctttgatttttattactaaagaaggctcgattatttccatcagaaggctccttctattttatatgggaaagtcaatgtcaaagcattattcacttaccagaaatatactttatttatgcagaaataaactgcatttatttggtgacctggtatttgtttcttgctatataacactgtgtgtgtcttctcagttgcttcagtcatgtccaactctttgcaacgccatggaccatagcctgccaggtctctctgtccttgggatttttttccagcaagaatattgggctaccatgtc

SEQ ID NO: 51260 - DNA, 825 bp, Bovine  19866880768401
agaaggaagcttgttttgtgtgtgttcttagtatagaaagaaaaggagtaaacatgaatgcaggcagaagccttatcaacaactttactgcatttgctctagaaagtaagaaaaaaaaaaagagacttggattaggtagatggtcctaatttaaaatcaatgacacaaatgtgattgtttttgctagtttcagttctttgataatgaaaaggattttttttttttaatttccaaaatgcaactgacctctgtacatgttatgttgataatactggttcagatttaaatgaaaagaaatctgcttccatttaagtaaaacctttcctacttttatatatatatatatatatatacacacacacatatacagagtctttagatttaggcaaaataatatatatagtaatataaattttcatattaaacaatctggaaaatttttaccaagaataataagtagaaaagcaatttttaaaataattattttcttacctggtccaacatcattcctggcctcatccacactaacatttttacaaagtgtcatcgaaacagtctttttgttttctaacagacttactggtctctcgttcagcaacaaaggaatgctagatgttgaagtgctcactgtttgactttcaatttgatttacttttgaccaagaactagggcctaaaaaattcacatacactagagttttctcagtttttttatctgaagttgaaagatcaaaggctgaccttccacttatgtttactaaatctccagatggctttatgtgaaatgaacatgattcttccagctgtccttcactgtaaatttttc

SEQ ID NO: 51261 - DNA, 1703 bp, Bovine  19866880791754
gatcctaaatgccttcgagttgaggatggcagcctggcatatgggaagaaccaaagtttagagtcaggcatttgctcaaatcccagcttaacactcacctgctatgtggcctcaggcaggctggttaacctctttgtactccaattataaaatgcagataataccacataccatgcaatgttgctaaaacagccagaaataatatgtgtaaaatgcctggcacagtataaacaaaagatagctcagctggtaaagaatccgcctgcaatgcaggagaccccggttcattctggattaggaagatcccctggagaagggacaggctacccactccagtattctcgggcttcccttgtgcctcagctggtaaagaatctgcctgcaatgcaggagacctgggttcgatccctgggttggaaagatcccttggagaagggaaaggctacccactccagtattctggcctggagaattccatggactatagagttggactataagagttggacacgactgagcaactttcactttcactgtagcagcctattgaattttacttaagtatcagttttcttctttatttaaagagtgtttataagaatgctttttctttcctaccaagcaaaagacatccattttatgtgaaaatatgatttaggacctattattctttagagatagggaattatgtgtgtgtgtgtatgtgtgtgtgtgtgaaaaaatcaaattcctaactccaattttaatgctcttcttttttcaacctgtttttaaataccccagcaaatcaacttcactgtaaaaagtgtctagagactaaataaaagaaagaatattagcctcttctaattccactatgtagagataactacacatggggttttattgtttacccttccagaaagtttttctctgcatataaacatatatgtgcaaatccacttttaataatcccatacagcaaagatcaagaatcccatttccctcaggaccatccctgcctgtgctaaactttgcaaggaacaaaatgtaaatccttatatcatatttttgtttatttcagaggagcatgtaggtaagggaaatgtttttaattaaacatcctgtcccaagatctacaacctccctaatatgtataaatctccctgtacccaacaatatgtaagcaagtaccaggcaaacaaatgcccacacattcacaatagatgctgaattcaaatatagtcaacattcaagtactcaagccagttgaacatgtgactgagtatgtcagcactccaatacgactccatgtttttaagccaacagatagctcccctataccaagtaccccttacttcccacttcagatacagacacacaaccatgtgagtccaggaaatggaattttgtttccactccacgtcccccatcctcacaatgccaggcagctgacttgggctgcctgtgtgtagtgaccggttcaagcatttcaaaatcagaaacatgcaggcttgctcacctcccccatccccatcccatctcaatccctgggctcccaccccttcccatcaagaggtactactgaaaagccaattttctaaccccactttaggggagcctaggtccctccgtgaggcctgtgagcacttgggattaattgttatttgctatctaagcaatacctttccaagtagccacggttagtgagtgctcatacattt

SEQ ID NO: 51262 - DNA, 720 bp, Bovine  19866880835131
ctgtgctgtactagtttgccatgtcacaaactgcactgtgccagtgttacagtaaggaccgagaaaatctttatggatgcaatatggtttgtgatatacttctctcaagttctcagtgatttaaatgtaatcagaccttctgcattttgcaacaaaaagcaggttttccaggtgactattttggtgagtgtcaaaataataatttatggtggattcctgtcgattcactttgaatttatatacatatatattgcaaaaaaggaaacttcacttacaaaaatagttaatgattgacctagaacataagctacctgagagagaacccatgtctgttttctttccccaggaatccttagcacctaggaaaattgctagtacattaaaaactttcagtaaatatttgttgaacaaacaaatgagagaatgaaaaagtattctttaatctcactttggtaggtcaatcccttttcagtttagtatctttgaacttcaaagacaacagcatttaatctttaaactttcatctctctggaagcttgactcaaatttgagggcatatccttatagattttaatattggagtatttaaatgtcatttaatctgaaaaaatatttctagggaaatgactttagcttgtctggagtcttacttgttctattagctctatttcttcaggtgtcgattcttttcgatttgcagagtttaaaatgtttctttca

SEQ ID NO: 51263 - DNA, 801 bp, Bovine  19866880858570
acaggcatttatcatcctgtgtgataaacacacctggatagggccacctgccctttttcttcttagatcacccttttttcttagatcaccatttttcagatgtctctgttctgaatactacatgccctgcaaacagagtcaaccatcaagctgccaagcagtgattattcctaggtccagctctggtctgggcagcatctggaggcattcacggcaagcgcactttgacacagctgctctcagatacgctcgcctccttacctgcagcccagtcctccgtcaccaaactgagccttcctttaattgcaggtttcacctaaaattcatctgattcttggatctcttcctaattaggattctttcctaattaatctagagttatcttctatccccgaggacctgacgccatccaaccgccctaattaatgcacttgccttcactcccattcctaacatttgcagaacctgggacaggaatacaaacggaggcctgcaggccataaatgtaaatatttaaaagttataaatcaagctgatgagttattaaatgaagtatagtctatccaatcttgttattgattccttcataatgacctcaaggtcagcttcaaatacaaaattctcactctagtctttggcccttggtcctcagccagcccactttcttttctcactcccagctccatcccgcagcacaagggacctcgtgctaacagaaatgctgggctgtgcgtaaaaatgcttctatctcagccacatttctttgtcatctcttaggcttacgggtgcacacactgaggt

SEQ ID NO: 51264 - DNA, 1478 bp, Bovine  19866880909441
ttagcagtctgtctgctagtttaaatgctgcccaattcatgaatagttgaatgaaagcctaccaaatcagtaatgattggggcctccctggtggctcagacagtaaagaatctgcccacaatgtgggagatccgggttcaaaccaggggtcgggaagatcccctggagaaagaaatagcaacccactccaatattcttgccagggggcctggctggctaaagtccacggggtcataaagattcaggtcacagagagtcggacacaactgagcaactaacactttcacaaaccagtaaattgtgtgtggatatgtttaacagtaaatttccatttgaaaaaacagaattttaagttattatgggtttttcttaagtataaaataataaatgttaattttttatgtcaaaataaagcacaaaggaatgaaacctatttcccactacacatcagtattttcattatctattcttctagtacttttttctactcacaaatgtctataaaattgagaatattttacacattcttctttgtatttgctagagttcaactaatatgtagagaacattttaagtttagtgcaaaacttaaacatcctaaatatacaggacaattcattgattaaaatacgaagccttcaacagcagttagattaaggaaatctgtattcttgtgtgcaagtaattgaaatcaactatgactaacataagaaaaagaggagttaatattagaagggtattgggcagctcacaaaactattgagaaccctgggggagaaaattcagaaaatgggctgaagcaaaggaagcttgatcatcaggaaccacaacccagataataccagaggaatggtctggcttggaggctggctgaggtcacaccacaggatatgattgacatcagacactcaacaccattgtagattctggctgtctttgctagtctgcacaagcaattcctaaattgtttctgcatctgtatgttactccctcaagagtcaaggacctgaccaaaaagcacatgaaaagatgctcaagattgctaattattcagttcagttcagttcagttgctcagtcatgtccgactctttgcaaccccacagactgcagcacaccaggcttccctgtccatcaccagcttctggagcttgctcagactcgtgtctgaattgagtccatgatgccatccaaccatcacatcccctgtcattcccttctcctcccgccttcaatctttcccagcatcagaagtcttttccaataagtcagttcttcgcatcagagagccaaagtattggacttaagtttcagcatcagtccttccaatgaatattcaggatttatttcctttaggatggactggtttgatctccttgcagcccaaaggactctcaagagtcttctccaacaccacagttcaaaagcatcaatgctttggcactcggctttctttatggtccaactctcacatccata

SEQ ID NO: 51265 - DNA, 1164 bp, Bovine  19866880926397
tcacatgtaaaagcatgtccattcataaggcctgtgatatttctgggaagagataattggtaccaatgattgtttctgggaagggaacttgagggctggagaatgatgcagagtctgacttttctttgtatatctatttgtattgtttgaatgttttgccatgtgcatatatcagcagttctaattaattcattaaaaaatgaactgtcctttcttctggcagctattgatattgaaatgcaattaaagcataaaaagaatatgtactaattaagcccatcaaataaaatatttcgctaactaatacactattctgtgcaccaagaaaaaagtctcaacaattaggcctgctccaagtaagactgactggttcttgagttcagggtgcagatggtgagacccacgtgtcagggttttcccaggtcctccaagtgttctcctggggcctgccgtctcacacactgcttcatagttgtctagttcttttctgctcttcctcttcgtctctgaactcctggagtcatgtttctcacatagcctggcatggagcaggcccacaatgagtgaggaaagaatgattcagtcttgatcctgccaggagtgaagtctagagatggagaagttagtagtagactgagtcttcccatagcagagcaagtggctggcacagtcagaccccatggcctggtggttctcagctggatgggtggcaaatggagtggtggacatgatgaaggggaactggaaaaaactgagtgtggtgaaggtaccagtccttggcatcccagttttatctccaaacctctgttgtgggggtggctgctggtggaggagacaaagccagcagaacagtgggagtagtaggtgggagagaatttggatgacagcagttgttcagtgaaatttcacagcgcctttcaagaatgaaactcaatttatatttagaatttgattttaatccaggaggaacatgcaggctggttgatatcaagaccctgtaagcaataatttttctgtcagttattaaaatgattagtaattgagtgtgaaagggatgattggtcatactcattcattcatttattcattcatttatttcatatttattggtgagtcattgtgccccatgagggaatacatgatggattagataactcctcttcc

SEQ ID NO: 51266 - DNA, 829 bp, Bovine  19866881014576
tttggaaatgaaagaaaccattctgtccagagtcagtatcagaaagaaatatggctgcttcctactcttctccacttagtgaaattaattttatgctgctctcagtgatgattctctcttattggagttaggcaaaatgaatttaataagttacttttgctttcaaaataagctgcctaaatgttcagaaatggaacatttaattcttgagtggaatttctatgattatcttgtctaacaccaggtataaggattgttagattaaggattattgctttcaataagataaccgtcagaaataaatatgtaagcttaacccaaatactccatttccacccaatgctactttgattctcaaatcaagttacatgcaaccttcaattctttgccaatttactgaggttttaagtgtaagaagttggcctgttaactcaaaataaagacaacagcaatagccacgtaagcatgtcttacttgggcactgagcagtaacactgcttttttgataggacttaaggcactaaatggtggtaaaataaacacgagtatgatgattaacaacttctttagaatcctaaaaaagaagatcgcttagaaggacactagtaaaaaattttttctcaaacaaataaggcatcctgttggcaaacacaaataaaaacagaaggtcatgttgaacctaatacattcacggtctcggctaaactactggaagaaacactagctatccaactaaagagagctacaatagcatgtataaaggttggaaaggcaccaaaaggaggactcgaccacttccagttctaagagtcaggtcggctgtgtttaa

SEQ ID NO: 51267 - DNA, 1341 bp, Bovine  19866881051978
tccttcaacacttgcttctttactttcctggggacatttaaacaactattaatatttgttggcattcctacaacatttgaaaaagaaaataagctcagcatcttcatctcacccaggagcacggagcaataaaatatactcaaggaaattatgatggcacagaaatcagcattaagatcatgtaacgctatattttagcagagaagagttcattacagtatatatatttaaagcagtgctgagaatgctaatcaacactcagaaaatttaatcttctcactgcgtacatgatgctttctcccaagttttattcacccatctcactcaccagtacctaaaagaggaacaacagaaaggatacaaatggagaacaagctctctggcaacgtgcatcactccagataacatgacggtgacagaccggagcccacaggcgagtcccaggtatgggtggctgccctgcaacactcttggccaggatgggggaattctccataactaagtgtatgagcgttgctcagtcgctcagtcatgtctgactttttgcgaccccagggactgtagcctatcaggttccagagcatcctcctaccaagaaaactggagtgggttgccatttcctcctccaggggaacctcccaatccaggtcttgaacccgcatatcctgtgtctcctgcattgcaggcacgtgctttaccgttgagccaccggggaagcccccataactagagtgaactgaaatgaatttctttttgataattttttcaaaaatgtgtgacactcttagagatcattggagctagtctggaatatcaatagctacacaaaaatcttggtgctctggaaactcctgacaagaggaaaatatgaaaatgtatacttctgtgaaacttcccccttaacgcgctaaaatcagcagttctcaaaagagccaagtgtaacacttgccaatcgatctgttttaggatccaaatggctctgctcaaactgctatagccccactggaagaaaaaagctttggcacttacaaatgatcaaaaactccctgctatttataatgatggagaaatgtcactgagaattaaatgttttgtcagtggaaaaacgtggctgtctggagaaggctgtagatacatccagggaattaatcacaggatggctgtgaacactcagtgccctcctagtccaagggagtgcaaaagacaagttttttgttttgaatttttctttttctttttttactgaagaatttttcaccttctcttgcacctgaactctggaatggtatgacacaagcaagtcagaccccaggtgtaacaccttgctcactgcagaggctc

SEQ ID NO: 51268 - DNA, 1051 bp, Bovine  19866881055616
aggatattttggttttatctcgagcttgatgcctgctggattatgagacaatagaaaatcagagctttctattcaggaaacgcattcatctgatcaccctggacacacttgcaattctatcgggtgacattagaggggttatgcaaactcagaatgatctagaactgtgcttgctaagagaacttcctgtgttctgatggaaacgttttatctctgctctgtccaggacagtagtcatgagccacctatgtctactgagcacttgaaatgtggctagtttgaggatctgaattttaattttgtttaatttttgttacatttaaatagccacatatggctggtggatagtgtattggacagcacaggtttataaagtactacattcatggttttcaaactgtttgattgtaattcactatcagaagcacattttatattgtactgcagcacaaacacatgtgttgaacactcacacggcccttggcgatgcccccctgcccctgcccctgcccccatcaccaaaatttcaccagatgaaatttggccttactacaggcagtgcacagtggtattttctgttttattctgttctatctcattttaaaggtgctggtatgacttcgttggttgactttgtgactcacgagaggattgtgagtttccgtgtaaagaacattgccttgcattatccaccccctacctctagccatttcctctatctcatctcctgtctctacatctggcctccttgcagggtctttgtgtgtttgctgttccctctgcctggtgtgattttctctgtttcatctcatgattgcatgcctcacatcctcagatttctgctcagatgctcgctagagatttcctcttacaaccaccctactctgggaaactccccatccctcttatcctgacctgcttttctctgtcacagtgcttatcacctgccatgtacatcatttgtttattgtcttccttcccagctagaatatcagctccacaaaagcagggattgttttgtttgctggtgtatcccagcatcccaaagagg

SEQ ID NO: 51269 - DNA, 2792 bp, Bovine  19866881094507
tcagaattaaattcttccttctctcttttccccaggacatggtttagactccccagtaggcacctgcacatcaggcttggtattccaacgatttatctcttgtctttccatcatgagatgcttggggtcaggaatcaatcttaaacctttctgtagtcatcccaatgcctgtcaaagtgccctgctcatagtaaaagcccaataactggtttttgaactaaaaccataagctctatagagacattgccagataaaatacaactatcctgaaccaaaggcactgcttttaagataaatttaaaaatataagtgtaacatcagtgccaaatttgttacaataaatctaagaagaaaacctcaaccgttgtggttgattagacatctaaaacattacaatggatggctcatgagatgcaggaattatgattcctatcctcttccttagtctccttctcaaatattcacagcaagcatgaaggggaatttttaaagaaaacagaggaattgagggcttcagctcttctccccatcaattatttctctcgctgacacagagaggcagaatctggccccgtgcctacctctttctggtttcaatggatttggctgtcttgatggtgcttccatcctgaggggcatccctttcctgagaggcaggagcatctctaacgggtagtgggaggaccaccgtctcctgagtcaccgggatgacctcctcgtccgccccttgctggcccaggtgctgcttggcataatcaaagccctgcacaggctgcaaagaggaaacagatttgcagtcatgtttctggcaaagtgtgatgctcacagcagctttaagagaagacaggcaggaaaatgcacatgatgggaccatacttagctttccgatgaataagagttaactcaaatctccatcctgatttctgtctctacgaaatcaaagtccacattaattccacctagctacagaacttccatagataagactcagaaaaatgaatagtataaaaaagatgcaaatatgtttacgagaacaagttctttcaaggattttagaccacttattctaagtcactagatactgctaattagaagctcttaaatgctacattaaacaggtcctgcctcttctacataagaatagttctgtcatctcttaagtcctgtgaaataacaggttttgtgactttgccaagtcattgaaatctgaacctcaatgttttcatctgagaaatgaagattatcatatctgttctacttcaccaccctacagtgttacagagaatcacagatctgaaaacaaaagaggagaaacatgctaccacatgtgaggcagtataattattaacaataaaatggaacttatggaatcactctaatccggaccgttccctttagcaggctagctcacctctcatttgtcatgactgagaaattagcaaggtttttattgcagtgtctgaagtcccaagtgaaaagggcagctgtgagcaaaacccaacagacatgtattagtggggtaataaaaaaccaagaagcgtgtttaaacaattcctgtgagtgtctctattctgctctatgccccaaagcagcacagtacggatttgaggcaggatgatggggtggctaggagcagccactctgaaaacagatagcctgggttcaaatcctgtctctgatacatattagctgtgtggccttgggtaagtgactgagattctctgcgcatgtttcctcacctgtaacatggggagaatatagtgtgagcaggatcaaacgtgtatgtctgtgacagtatttaaccaccctcagagggacgctgtgtagataagtaaattcaagcccagcattgagctaagtacctgacacatagtaagtactcaatcaatatttgttcaaattgttttcctgcctactaaatcattggccaggtgaaatggacatcagcgattctctttcaaaaatttggggtgaaacttaacctctatcgtttgggttgtatcagaacttgacatgatcagacattcctcttttagcaccttacttagtcaagaactgtaacaggaaggccagattaaatggtctaagaccgtggcccaacccatcacaccgtgtctcagaataggagggagttttattgctaaatccagaaaagcttcctttttcaagctgtctgtagtatagccaagggcttctccagtggcttggcagtaaagaatttgcctgcaatgcaggagacacaggagatgtgggttcaatccctggatagggaagatcccttggagggagacatggcaacccatgacttgctgatgttcctagaatactgaacctgcttctcctataaacaattaatcaccagttgaacccaactgaaatgtttttggaaactgacctcttctccccaggtccagtgctgtactgactctgccatggtcttgtaatttcgattctgctcctttccgaacccatccttgacaatcctccaaagttatctcccttagaaattaatcaggtcatcactctctcattaaaaactctctggcacccaaactctttggcaaggcattcaagacccttgaattctatgtgaacccatgtgtccagtctcatcgcctattggtcccttttctgttctacccttatcctcccattatcctgttcagttttgttccaactctagttattgggcattggcttgtgtcagggactgtgcttggtgctggaaatacaaaggtgaataataactggctcctctaccctcaagaagctcacagtttcagtttcacttg

SEQ ID NO: 51270 - DNA, 731 bp, Bovine  19866881160098
taatcactagctagattcagtaattattaacattttactatttgcctcacaaatgttaagtcctaagttaaacttcagcataaaattcaaagtgtatttaagaggactcaccttttctaccttgtcataatttttagctttaatctgcagagaaacagaagaaaaaaaaatagaattaacactattctttttagagtattaaaacactatctctgagtgttttgattaagcttgtaaattcacttctatactttcctattaattctgcctttcaaaaataacaaataatagaagtctgaatccaacatggataacatgcattgtaaatatgccttacataaattaattttacatgtaaaaatgttatacattcaatatgttgaaattttgtgaactaaaaattttgtaaaacagtcacaagatgaataaagaaatacaaacaaggcatatttgaatagagctttgaatagatctactaaagacaaaacttgtactttccctgaaggactacgactaaaacaaccctgagtacggtagcaaaaaagatttgctaattttgaccacacaaattttgatcactctgtcaacctgctatactggggataccacagtgaacaaatcatgcatagtctggcttacaattttacagggggaaacaagcgccaaggggagggaactacagggtgctatgggagcatttaagaggcgaataaaactcaggcttgctgctg

SEQ ID NO: 51271 - DNA, 1553 bp, Bovine  19866881204520
atttccattgagagttttgctgtaacattttcataaaagtattcttagttcagatgctccacaaaataaatgtgtataaattcttttcttttaataggagtttgctgttgatccagagaaaatacagttgtattctttgtatcattcactccatcattataaatatcatgtttatctgatatgtaaagatgaggtaattactttttttatcttcttaaaaaagaaatgtatgttttcctgaggtttaagaagattgtagctacaatatttttatatgcaatttttaaaggttgcattccatttacagctactccaaaatattggctctattccctgtgttatacagtatatccttatggcctatcttgtacccttagttcataccttccactctgacgcctgtattgctcctcccccctcccactggtaaccactagtctgttccctatatctgtgaatcttctgcttttgttgttaaatgtactaattagctgtagtattttttaatgccttaaagagaattgttagaaataatttttaaaaatatgtgtctgtgctctctctgttaaatgctgtgctcagattaatctgaggctcatcgcttctcatgggacctgtgagtggtaatgtttttgagctgttatattcgttttacattgccatgataaatggcactttattgcattttcttctctcataatgtataatcatcctgtttaattaattcatttcagtcactgctttgaatatctttgctgtcctctttatcaccagaatgaccttatcccaattaattgcagagaaatgggtgttttgtcccttggcgtgaagaaatgatagttaaaatttaattgtatcttttcagtatcataatttaagttgcttagaaattatgtatgaccataccacttgatggatggaatataaggattaacctcaggggttaaatggttgtacacagtaaccttttttgacaagcattatcagttttttaatttaaaagggttaagttggctcaaagctgtacaatcatgaattttataatgatctggtatggggaaatgtgcataaatctaaaatctgtctagcaaaggagaaagtgaatacggtcacacagcatatgttggctatttttacgatgctctggaatgcaggaactgaccccaaaatttgttattccacttttaacgcaattggacggaattgagaaggtttgaaccacttctagccttcctccttccgcacttggagccgacaatgataggattagaccactcaaatttattcgagatagtcattctctgcagatggaatttttttgaaaaattagtgtttggcaaatttttaaatcctcttttcattcaggatagagaaacagtgagcccttgtgaagagcttataaagtgataagtataaactaatttggtatttcttttcattttagatttcttccgtgcagaaaaaaaatgaagatttaggacaggaagaaattgttcagctttgtatgaaaaatgttgaatgggtagaagacctatttgaaaaatttgggagaa

SEQ ID NO: 51272 - DNA, 2616 bp, Bovine  19866881268465
cttcccaggtggctcagtggtaaagaatctgcctgccagtgcaggaggtggaagagatgcaagttcagtcccctgtgtcgggacgatctcctggagaaggaaatggcagcccactccagaaatcttgattgggaaatcccatcaacagaggagcctggcaggctacaggccatggagctggacttgacttagcaacataacaacaaagtgattatataggagttcattgtacttattcagcccattcgtgtgcttgaaaatgttcataataaaattttggaaaggaaagtaattatattctcctgaccaaaattatgagaatgattttgattaaacaaaatagacggagttgttatttgtcatttatttgtaagaatctaaattcatgaaaggagctgaatttgtttctttaatgtttcatttcaactgtgtacataggaaatttatttaactatggattctcatattttactgtatttacagctatttcagagatgccttatgaaggttttgcacattgatttatggaagtgttatctttcatatgtccgagaaaccaagggtaaactaccaagttacaagtaagttaaatcaggatcttaaggatgcaagtcatgtcctaatttagtcatctcctctcgcaactcttaactccagaggatgaagaaatttaaggatttgaaaaatcaggattctctgagaagttagtaaaacgtggggaaaaccgctttaaagaaaatcactggcattagatttattctggagagttgaatcatccaagcccctcttctatattgaaacactgtactttcgcagctccagaccattttgttcagaggcttgttgtcaacttaataaaaggctgcttcttgtcctggcagcactcttggcaggttacatttgtgatgtgctttttaactattcgaaggcacctttgacagtggtattgtgtaattgacctcctcactaggacgcaccctcacttatctatctttgttgaatataaataatggaccttctcagatgctctttttgtatgtaacaaataggcagattatttctagaaccagaattctttgttttcttttcttccttagtcttatattgaacaagttctttctccctaaattttacttcagagctaatagatcttcagccataacttaccttcttaatcaatgaatcagatatttccccatttgaatctctacatataagagtcagtttgaaggttataaaattatataaaacatggcccctatctttgataagcttacaagtagtaggtaaaagacacaaatagtaggtaaaagaaacaaagtatgtaaattaatgacattaacaagctaaacacaaaagaacactgtatacttgcaaagatgtcattcattttgtttttataaaagatttaaatgttctgatcctttgaacggaagttatgattatgttttagttatagatacattttaataacggtttttctgttattaaaatgtatctttcacatttatttcagaaattatagatatattttaataacagtttttctgttattaaaaaacatctttcacatttatttcagagaaaagatggctcaagcatatgactttgcactggataaaattggaatggaaattatgtcttaccaggtagagttaaaattttctaatacatacacttaataaatttgaaactagtaagaaaaatactaacattttcttttatttcttagatttgggtggattacatcaacttcttaaaaggcgtgtaagtatttacatagttttattttctgtgtgaacactgatttagctacaatataattgatggcatttctcatccaataccagggaagctgttggatcttatgcagaaaatcagagaataacagctgttcgaagagtttatcaacgaggttgtgttaatccaatgatcaacattgaacagctgtggagagactataacaagtatgaagaggtaaattaggagagagtagtttattattatgacaaagtgattttaatttccatgcgttgtgggtttgtagcctttctaacgttaggtacctggatatcagtgctgcatacgtttgttttcatgttgattgtaatgaaaggaccattcctcatgttttgagagtctcatattactgttgagttattttttagagaatactgtaggagaattataattcttacaaaaccatttttattcagtgctaaactacacccacacagtcatacacatacctgttgccactggctcttatgaaagagttccttttggagttccttttccagtgtcgggatgagttgcagtgcacctgtcacctagttacagtgatgtgattattgccttgcaattgcgagatgtgggactgtggtccaacatctttgtttcataggaagtgatttattagtattttattgattaatttttggctgtgctgtgtctttgttcctgcacaggcttttctctagttgcagcaagcagaggctacgctcaggcttctcattgcagtgacttctctcgtggcagagtgcaggctcaagggcgggtgggctcagaagttgcagttccccagctctggcgcacagggttaatagttgtagcgca

SEQ ID NO: 51273 - DNA, 1311 bp, Bovine  19866881309352
tcattgctaagttatctgtatctgactatgcataactattaatctggaaaaattttcaaagtttataaataatagtttgagaacctagaagtaacttacttttctgctatcaaaataatattgattaaagttaccagcaatcccttgcatcttttaatgtctggatacagaagatcataggtaataattttgacctatagtttgtatcttcttctaattctgtatgtgaccaatctccccttacaaacataatagagtataagctataaacttctggaatgaatgtgtgtgcacaaatttatttaagtgtatgtgtatgtgaatttgtttcctctttgcaggaactcaaaaaataacatactcctgagaaatagaaaattctgttctttaagcttttgccaggcattgcttttttctatgtaataccatttataaaattgtattttgttttataatttttagagagatgagattaaaactcacatgcattttgtagttccttccaaattaaatgtttaaaaagtataaatcatattacactgtttgagtgtatatctgtcttttaagactgtgatcttaatgcagatgaaagaaagatcttaatcattacagactgctaaagaccttatgtttgatattttcagagtctctttggttacttgttgcaaagaaatcatctgaaaaaaattttttgttgttgtttgatatttcattttgttttaaattagtttttattggagtatagttgctttacattgttgtttcagcttccgctgtgcagcaaaatgaatcagccatacatacatacagacagacagacatacatacatacatacatacatacatacatatcccttctgtcttgaacttctttcccattcaggtcaccatagtaccttaagtagagttctcttacagtgttctcattagttatctaagtggcaacccactcccagtgttcttgcctggagaatcccagggatgacggagcctggtgggctgccgtctatggggtcgcacagagtcggacacgactgaagcgacttagcagcaacatttagatataattagaaaaagtggtctttttaatgcctcctacataacctataaaaattttactattagtcgtatattggctttacataagcacttttcctcatataactttgcccttattttaatcctctttaaaagaccagaggcaggacttccctggtgatctagggcagggaactaagattccacgtgtcacacagccaataaataactaaagcaagcaagtacctaatgcaggttctgaggctaattagg

SEQ ID NO: 51274 - DNA, 773 bp, Bovine  19866881323982
taattgataatgccatctgtaggtgtagagatattttggctcagctcttttcaataaggacttagaaagctgtactattaatttcaacatgttttcttctcaggcacatttttcttcaggctcccttggttcactcttgacgtttggtaaataaaagacaagtgacggaggagcagcattcattaccagggacagaagtagaggggtcagtccgggagccctggttccattctagcacttaattccatatttcacgttgaaagagtaaagtgagaaatatcctaggccttcctatttcccggcactgcataaataccaaagtcattttgtgtttctgacgtcaggaggttttctttcaagctaagaatagatttaacatatataaatcaaaattaaattcccctctcgtggttaggatgcattaggcaaagtctcgcctgagtagacagatggcaggtgcagcaatgaccttgagctaaagcttgaggcagctccttggccctatttacatctgcattagttggtttatatacaacatttatccctgttctatttggtgtttaaaagggcccatgatttttcttaaacatgtgtggaaatattttccagggaagaagtcaaagaatagagaaaagaggaagaatggtctaaggatgatattttaactctgtaggtttgaatccagtagttttaaatttgttaccttttataataaaggcttttctatatttcaggggaaagttcaaattctcttatgacaaaatttactattt

SEQ ID NO: 51275 - DNA, 797 bp, Bovine  19866881405711
tatgcattttctgaggacatctttgaaaagtggttttctttggagaaggaatttgccagataatctaagaccctgcagagaagtaacaaatattccatacaacatttatttttcttacttctgactggaaatctgtaatctatataaataaagcaaagttgtaaatatttttctgagcactaaagttttgtctgtatgaaaagtggagtggcatgttataaatgttttatggcagtttgatactcacaactggtactcagaacttattcaggcaataccaaacaagtggcaataaaacctttatagtccttcacaccattatgtagtttgtttatgtcacataaatcagagaaaaaatattaaaggaaaattttagtattttaaaaataatattactctgtcaccatatgtgatgtttctttgcccattaagtgaaatttagtttaccttaagtcaatgcaagtatatttccgatgttacagcatgtctacaaataactcataaaacatcacagtctttttggtaaaattaatgatactttggccacctcatccgaacagttgagtctttggaaaagaccctgatgctgggagggattgggggcaggaggagaaggggacgagagaggatgagatgactggatggcatcaccgactctatggacacgggtttggataagctccaagagttggtgatggacagggaggcctggcgtgctgcaattcaccgggtcacaaagagtcggacccgactgagcgactgaactgaactgagtgatattacctgaagaatgtcgt

SEQ ID NO: 51276 - DNA, 993 bp, Bovine  19866881834284
atgcagcagcaccgggggcagggaaaatggtaagtctccaagagaaaggcacaattcaccaaactcaaagggcaaatgcagaatcatatgccatggcatctaaattttatttagatgtaaccacagtgttactcagacttgtgcattttttaagggctcaaacaagacctaaagcacaattgatttcatctacctgtgtgagtttttaagatttctataaagttctttagaattcttgccagtgtacttgaatttcaagcactgtgggggtcagaacacaatctagtcaatgctcattatctccaataataagagtctggaaataaatatcatttagtgtgtatccgaaatctgaaaggaagggccacaaaccctctttgtggcagagatggcagatgtggaaggcctctgaaagcatacaggatgagcctatcaactaaaactgctttatgtcatcctcaggattgggatataactcactgggcagaggaggaacaaatactgatatggtcacagagaacactgggcaaagtagcaaagcacagacgtgggttcggagggacagatccaacatcatcgggctctgtggtcctgggcaagttacctcatctttctcagcctcagcttccccatctggaaaatgggaataattacagtttacatcccataacatgactgtgaagattaaatgccacaataagcatgtcgggtacacagcacagcgtcaggaacatggttaagtgctgacattataagtgaaaactattactttcactgtaacttacacatcacaggggttgttagttaagatagtctccatttaaaggtaattcaagtgtgaacataacagagacaattttattccacaattcccactgtctatggtaagaatatatttcagaagcaaagcgccagcttctcttttaaagattctgttactctgtgtgattctctaagacttgctctggtaaaaatcgacacttttggaagttc

SEQ ID NO: 51277 - DNA, 3532 bp, Bovine  19866880398387
ctcagctgggctgacgtttgaaggctagaatgggaagaatctgcttccgagctcactcaggtgttggcagaattcatttccctgagactgtaggattgggggccctggcttcttgctggctgacggctactctcagcctgtgggtgagtctcccaaatggccacttgcttctccaaaggtggctggaagaactgtctcgagcaaggtctgccagcaacatggagccttatctaacatgacaccatcacagggacgatgacatccatcgccactgccagattctgttgtcagaaacagtcaaggtggagggtgggggtggtgccacagttaccaccggggggtggggacctccatggtggtcacagataagaggtggtcacacctcttatctgtgtcaattacacagtcctcttgtccttcataaccttggcactttagaatactgagccgcttttattgatgtgtgtacttttgaccattgtggtttttttttttttttttttactttttattaaaatttatttattttaattggaggctaattactttacaatattgtagtggtttttgccatacattgacatgaatcagccaagatggtaaagatgaccctataggtgagaccattgtgtttttaacaattactaaaatatttttctcagataataggggacacatgcatgtcatttaccctccctgcaaacttcagcctatgaatcatcacgtgcccctgttttcatttcctgagagatgctggagaagagacatagcaagcatgagagaacatctcaagaagtcatgggcagagaaagacaagtatcgtatgatcttgcttttatgtggaatctaaaaaaatggtacaaatgaacttatgagcttaattacaaaacagaaatgagtcacagatgtagaaaacaaatttatggcaggggggataaattggaagattgggatcgacacatacacggtgctacatgtatataaaccagataactaaaaaggacctactatatagcacaggaaactctgttcaatattctgtaataacctaatgggaaaagaatctaagaaagcaatgtatatgtgtatatggataacgattcacctagctgtacacctgaaactaacatgatgttgtaaatcaactataatccaaaaaaataaaaataaataatgaaaacttaaaaaaaataatggggagggataaattaggagtttgggattaacatatacacactactatatataaaatagataattaataagtatccactgtatagcacagggaactctactcaatgttccataataacctataaggggaaagaatctgaataaaaagataaatatgtaagtataagtgaatcactttgttgtatagctgaaactaacacaacattgtagatcaactatatttcaatttaaattaaaaaagaggtaacagattagctataaaaggttgtgagcctagaggaatgatcacatctttgatagaaatcagaaaattaaggggaagattctggtttgggaagcatactgaacatttattgcttgccctctggaaaccttgatgaatctcagccagagtgatacaggtggagagaatggcaccccaactctagtggcgggtgtggctgcgaaacctttcagagccctgggtctcagtgatcagcttaggaattggcccatcctgaccaaagccatgtagatgctcagttgcgtcttcttagagcttttgaggaagaggcagtatcctgcagagtatcctgcagagctttaccccacgggagataagcctggaactgtggtaagcattctgccatgcgtgttaattaatattaggttttgctcagagacagaaacctttacaataatttaaataagatacaggtgtattttttcttatatgaaatgcagtaagcaattcagggaggctgtgtggtggctccatggtcagcagaacatggtttctctcttgctcttgttcttgactacacggatggttccagacagatgcttgagttttcaggctgtagggaaaagggagatggtgaagagggattcttcaaggacaacttttggcaaattgctcatgacgcttctgccacttgtgtgccactggccacactaccatgcttaactgcaacagaggcatggacatgtgggctttacctcaggaggctgttcccagccgcaggtgagaggttttatgataaaggaagcaaaggggaaatggctgtgggtggacaatgagctttctctgctgctccctgccaacggagagcctgactataaatagagtctgctctgaaggagcagagttgaaagatgagactaaatcaatcctgtcccagtgatagctttgaacctctggatcaagctgtacctgaagccaaaatacccctgctacttaagccagtaactctcccttctttccttattccctcccttcttcattccttcatttctgtttttcttcttctttgtcatgctcctttttaactgaaaaaaatctcgactggtacagaaaggaggatttcccccaaacagcatataagatcacctttatttctttgttctctcaagctctccattcctctcacagttactcagaaaggcaactgaattttcccttgtatctcctaagggtcaaattatgcatctccatgctctatttcctttcagcctaaaggagagggagctgctgatgtttcttagaacttgcctttttggggattggattaaaaatttaaaaatatgttggcttgtaaatctctactaaaactcataagctgtaaatctcagctcaacctattctaggtatttttacttatttttagcaaatgctccttggaattctttccctatttagtaaaaactcctctgtccaatatcttggctgcatacccacgtcctcttcctcaattctgacttttattaacattaatagcatttgtgagaattagagcttaatggattgctgttgatctgagaaccctgccataatagatcttgttttaaaggattccaaacagttagttggtcagcaatccagccttttttttttcttaaagtaactttgctagtagaatgaatttgccccgcctgttcccttggcatctctttttctgggtctttcctttgaagcagacaatccaaaacattaggtttggaggggttttttttcttcagattctgaaagcacggttttcacttaaattattatgcgtctctgtccttacttatatcagtaaagtgattaggagtgtctaccaactgcaattctcaggctatgaaatctggatttttgaatttaaattataccacagcaccatatggctgaagagagaggagtgctcaatttcttatctaactgagagttcctctcaagcaagggaaattgccgtcacagtccaagttttccccggctctccgaggtttagtattactgctgcctcccaaagcgcatgcgcgtaggattttctgaagcggctcaaaaaaaagttgctacaaaacacagcgacgaggagag

SEQ ID NO: 51278 - DNA, 984 bp, Bovine  19866880412746
caggctcccccgtccctgggattctccaggcaagaacactggagtgggttgccatttccttctccaatgtgtgaaagtgaaaagtgaaagtgaagtcgctcagtggtgtctgactcttagcgaccccatggactgcagcccaccaggctcctccatccatgggattttccaggcaagagtactggaggggggtgccattgccttctctgagtctttcctcttaagtgtctgtaaaaggccaccgtctatgtttgcttgtgcttatttgcttaatgcacttgcttcagctcattttcagaaggatgtgatgatatgcatgttggttggtcatgcccccgggctgacttgcctctgcctacttaaaatgcactgtatttttaggtcacccacacaacctttttaagaaatcggggggaacctgcaatctggcttttccctgacatgaagacaacctctaaagatatatcttattgaagtcagtcctttaaaatagaatttaactgaacttttttggcatgactataacctcagaaatataatatgtacttgcctggtgacactgaagtgtctactattttggttagtacagatttcactttgattcttttgagataattatctttttaagatggaaatttctttttctctctctctctctttttttaaaatatttatttgtttggctgcattgggtcttggttgcagcacacaggctcttcactgtggtgaggggctcttcatcgtggtatggggggcttctctccctagttttggcacgcatgctccagggtgcacaggttcagtagttgccccatgggggcactcttagttccccgaccaggggatgtgggatcttagttccctgaccagggatggaacctgggtcccctgcattgcaaggcagcttcttaaccactggaccaccagggatgtctctaaggtgaaaatttcctaggtagccattgccctatcggaaaaaaatgc

SEQ ID NO: 51279 - DNA, 1792 bp, Bovine  19866880421490
gcccctccctccgcactagtttgcctggcaagttcggagcgggtggccggttcgggccagccctcctccaggtcttccttctctgctttccagtccccggggccgctcaggcccggggctcggggcgctcttgaagccgatccgcagggtgggcacgcccggaatccacaccctgccgccccctctcgatgggaaggtgcgaaagggaatctccgcgcgttactccccacccccgcacccacctcgggacctggcgggaggagcggccccacccactgggtccacccggatatggacccgcccggcctaacaccggtcacacgcaactcctctccgtcttccgcaccgagcctgggccggacacacgtacacggtcacctggacatcgacctcgctggccgagaggaggaacagggctaggaggtcctccgggctctcctgcgcgtctgggaggggaggggagaagaagccaggtaaactcgcccggggcgttttcacccattggagttatgacaaatgcacagtggacacccgggccaggatttgagtggggcaagagtactcggattcctgcaagcgcctccttcagttgagtgtcctggacgcagctctggtctcaccctaatccctacactgatggacacacgtcaacctagccaatccaaccatatctggtgttatcaagacagcacgatgcacttgggaatcagaggctccgaaatgggtaagactgcacggaaagcaggagagatcacagatacctacaaacagagcaaagtattctgtgtattgactgtaacttctgcccccacccccaatggaggcacacggagctgcagctgggtttctaaatctaaagttgagttgatgctcttctgcaaaattagatgggttacactctccactgcactcatcatttttgtgcatataaatatccagtgcaatctggaagtttctaaaaattacctagaaaagagctttgaggatcttaccctcccccaacacacacacacacacacacacacacacacacataaacacacacacacgaaaacaaaaagattgataggtggtccctatgtaggaactcataacacaggtaaataattcaacagttaaaaaattactaaatggaatagagtcagctctcatggggccagttctccaagcctgacccttttctagccccatatccttccaggaagctttcaaaggtggttcagttctagaaattttcatggagaagcttctggaactggtgagacatggttgtgcccccaaataaattacaatcccaagtgtccacacagtataaaaagagatagccgcgccccacccgccatgagactgcatggtagaaaggaccaaactttgaagccagactgggctgaattcaaatctatgaccttgatcaagtgacctctttaagccttagtcttctcacctgcaaaaatggaactaatgttactagtggctgggatgagaatgtttatttggttcaaaatatcatctcttcccatgggaggaatatgttccctccatatgaacctcaggcttggccacggaattcttttggccagtggacagaacagatgtaatagatgctacatccaaacataagtctaagagccatcgtgtggttccaccatctttctccccctcctactaggggagcagtgtgtctcagttcaaggctgtccttcaaattgggtcctggattaaggaaatgtgtgacagagctggccacatgcacaaaatctttgctatcagctgctgagatttcaggaaccat

SEQ ID NO: 51280 - DNA, 1688 bp, Bovine  19866880442551
tgaagaaacagaggtaaagtggatttcttcgagtctcagaatcccagggcaaggagaaggattctagtgggtttggctgcagagcctgcatcattttcagcctcacacatggttctttcttcctatttaaagagcagcgcttcctcttgcctcggccccccacttgctctttgcaattatctaatcctcagtcctttgcaacacttaaagctgcagttccccaccattagaaggcattagaatcacacagagagctggacaaatgtgcaggtttctgggctccactcccagaaatattgatcctgtcagcctcggtgagagctgggcatctgtaggtttatcccaggtccattacatgacggatccctttatgggatcaacttgggtggtacagccagatgcttgcagagtcccttttcctgtctctgtgtctgtcccttggcacctgtggacttttttttccaggagaccattcttgtgccacttgagcccactttgtccaattgcactgaaagctggaagtgcctgggaaagcatgtacccctgagaacgtttaactaatggcagtggcatgaagttacctgaaactcaactcccttattcaaatcaggatacctctgaggtttaactaagactctagtattattacagcttcccttggcggctcagggggtaaagaatctgcctaccaatgcaggagacacaggttcaatccctgggtcagaaagatcctctagagtaggaaatggcaacctgccgcagtattcttgcctggagaatcccacggacgatgagcctgcggtcggaggccatggggtcgcaaagaatcgagcatgaccgagcacagatgagacctgaggtcagcaatccccaacatttttggccgcaccagggaccagtttcgtggaagaaactcttccacggacggggggctggggtggtggtctggggatgcttcaagcacactgcatttaccgagcacctcatttctattgtcacatcatctccatcgcaggttatcaggcgttagatcctggaggctggggacccctacatcattccaagtcctccgtccttcaccagcctggtgaccttaactcctctgcccctcagtgatgcaggggtaacggcacccacgccccaccgggatgtgaaaaggtgacccctgaaattcagctaagagcacacagctacgctgccaggatcctgatcactccccactctctggacaggtgaattcttagcagtgattcttccactcgggaatgaagaggaactcaaaaagtcaggtgatgggtgatgggtgatgctcgtgggggaagggagccaggtgggaggcagcctccacccgcccaaaccaaggtgaaatttccctcaagtccactgaaatcagaggagcgagccccagagcaaggctgacttactgcactgctgagaccaccttcctgggctcttttctgaaaacccataaatgtgttctcattcattaaatcaccagcaattatgccttctcaacactctgttttcaagactgcgtacaaaaatctgtccttaataatgaataaaagactatattaaaactagacttgcaaacgggctcacaaatgaaagctcctctttaattggcctaagagctgacagaagctgaaaaacagcgaataatccagccttccgggccatggctggtc

SEQ ID NO: 51281 - DNA, 2226 bp, Bovine  19866880443351
ttttttataattaaaaacattataaaaaactttaatttcatttgactaaattcaggtgctttatttgagttcactcagacaatggtaataaatgacagatgacgcttccccagatggcactagtggtaaagagcccacctgccaatgcaggagatgttaacagacggcatgttcgatccctgggttgcgacgatgccctggaggagagcatggcaatccgctccagtattctttcctggagaatcccatggacagaggagcctggcaggctatggtcaatggtatcacagagtcggacactgctgaaatgacttagtgcgatgactccactataatttctgctactcttaagttgtgcaagttagtggtaagtgacatttttaactccttggatagtttctaggatactggtcatatatggaggacttggatgaataagtaaaatgagaatatttaaaatgtgcatttcctgatttctgtgttgtcagcttttggaatagtggtttatatcccaccactcaattttgatatatttagtgttctgtgtatcagtttgtagacagagtagaggccccatatagcagcttgatggatgtgatacaggctcccgctgcgtcctgaggccactgagctggtgtgtattgattattgagtcctctgacctccaggatcacactagtggtaggcttgtaaggggtgtgtctctagcttcttgaatcttaaaactggaagaaatctcagagtgatttccagctcagtgatctcattttatttattaggaaagactgatgcttgttattcattgtaactttagtatttccagtccaggccagtcatctccctatcagaaacactgagtgccttccagggctcatgcatcctggccttgtgggagatgagactccctcctggcaggaaaagctaagcctatcggagcggagaaggcaatggcaccccactccagtattcttgcctggaaaatccatggacggaggagcctggtaggctgcagtccatggggtcgctaagagtcgggcacgacagagcaacttcactttcacttttcacttttcactttcatgcattggagaaagaaatggcaacccactccagtgttcttgcctggagaatcccagggacgggggagcctggtgggctgctgtctatggggttgcacagagctggacacgactgaagcaccttagcagcagcagcaacagcaaacactttagaagagaaccagaagtaggactatacctgtatctaactgttttctgcaaacacagtgactatacaaatgttgcatctctaacaccgaaaagtctttggagattttattttatttttattttttaaatttatatatcatcttatcccaatttgactaacctcctttttcacaggctgaaaaaggtttagaaaatcaagatttgggggagtaagcaattaatgatagctgcaactatgatctgtaagattctgctttttctgacttctagttgtattattagaagtatatatatttctaatacatatatataatatagtacatagtacaatgtactatcagaactgtatatacatatatatacatagtacaattctagttgtgttattattagcttctctgaaagctcagttggtaaagaatccgcctccaatgcaggagactcctgttcgatttccaggtcaggaagatccgctggagaagggaaaggctacccactccagtattctggcctagagaattccatggactgtgaagcccatggcctcacaaagagttggacgcaaccgagcaactttcactcgttcagttgcattattactttttatattttcaataatttaatttgtgaaagatttttgtcactttatagaagatttcctaagttgtagatataagttaaaacttaaagctacaattagaggcttagtatgactttaaggtcatgcactaattactgttaaaagtataatgctaatatacaaatgtataatgataatatagcaatgaaaataacatccactccatatatggggtttactatacatgaggtacctttctgaatcttttagatgtatcaattctgatccttacaacactttgaattggtccaataattatgctctttttacttctgaggaaactgaattacaaagtttgaaaaattttccaaagccatggctattaaatgccacagtcaggatatgaattcatgacat

SEQ ID NO: 51282 - DNA, 1300 bp, Bovine  19866880456365
aaaagtccatggtaatctcttgttattttcttattctaattgaagcagataactagtaggaaaatatatcaaaactaatacaattatgtaaagttttaaaataaaataaagaatatatacattgttcttgtatttttttacttcacaatattctatggagatcttcacatattaaaatatggggatccttcttcatttctgtttttttacatctgtatagtgtgttccattgcatgtgtgcactatgatttatttaacctgtccctgttaatggatattaagatttttcaagttttttaatctgaaacggtggtgcaataagtaactttctacactcatcattttgcccacattttagtatctctgtaggataaattcctagaaaagaaatttctgtcaatagtatcagattggccctctcagaggttaatttataaacttgatgcacttacaataaaaattgctgtaagagttttctaaatgttcccctcccaactaaaaaaattgttttggcattcatatggaaaaataaaacaaatttaggaaaactctgaaaaggaataatgaatggctggggaaggggacacagttggagagagtcagcatacctagtattaattcatggtgttggtaccttttttttttttttttaaataattattgaggttttattataacatggtttaaaatctggtagaattagttgctctccttcatccagcaaactattgttctctttatgttttcttggatacttttttcttttaataaataatttctggactgagtattaaacacccatgatagttttgtgggtttttaagagatcatattaaatttataaatttgtcttctgatactgtgtttttttgagatttaactaaatacggctttatgaagataacctcaaaagctagctcttacggggaaatgaaaaggggaacctgtagttgtgaatatgttatattaaactgacacagaaacttctggattctttcctgtaggaaagtgactatttcacctcacaaggagaattccgtgtagacaaagcaggatcccctactttgttgaattgccttatgtataaaatgtcatactacagatttggagaaatgcaggttagttataatctttgtttttttctataatctttattttataagctttattctagatttattcacaggaatattttaaaaatagtcttgtttgactctaaaaagcaggataatattttggttgtgctctaaagaaaaatgtgctcatctaaaattttttctactctgtttactttctgaaa

SEQ ID NO: 51283 - DNA, 704 bp, Bovine  19866880559301
actctcctttgggagaggactcctaacctcgaaatgaaaagcatgggtgtaagtttcccataagtgaaaatggggaaaatgtatctggcctgatcatcagaggactgccagacaggatatgttctggctaaaagccaccaggttatcaaccccacacttgctttctaagcttatttgagatggagctcatttctttctgggtccagtaaagtcatgaaaactctaggaaacttttgaaatggtatctgttaggattactgaagccctaggaagctatggaatttgaaacccctgaaaaggatagtatatgcaaggggaaaaaaaagattaaattcatgagttttgcacttgggagcttctttttgatgaaagagttttaaatagttttgaaatcattgtactttgttttgtctgttcttcaacgcattaaaagcttttagaagaatcatccatacaacattggtaattgcagtttaaactgtatgagggaattaaattcttcaaacttgtaatcaatgagtaaatgcttaagaatagaaggctttcaaaatgtccttcattaggtatatgagtttaatgaattgagcattaaacaaaatacaaatacagtgccttttcctttctatacacaaaagccccatggacatcaaagagagaggctgatactcttttaattcctggagttattacactgtgtctccctg

SEQ ID NO: 51284 - DNA, 1326 bp, Bovine  19866880623290
tggaacgtgaaaatgctatataaatttgctttgaccaaatgatcatgaatgaatcacaactgctactgagtgtttggcatttttactttcacaaaggttcagaaactgatggccacagacacatcttactttacaaactagtctttgtaatgggagtggcacaaattaaagccagaatgtctctgaaaaatcttggctcagttcactgataaccactcttcgcatgaagaactctccagaaacagctgcttcctgcggtaagcttaagtgcttagtttgtaaggactgccctcagcaggttggcacttgatatctactttgtatttaagccttggtctttacaaatctggcaaatgaaaacctattagcaattttcagtaatttttcagacaaatcgaccgatcttgagttactcttttatagacctgacttcatttggtacccaccttctttgacaaatacttctgtttggggaaaatgttggttactcgaggtttgtggtctagtgtctccctgttatcaggggctttcactttatatatccttacaagccagtgctctgatgtgaaggcctcctccaaatgcttgaatttaatgtccttgtttccaatctcagcattacgtgtccgatcaaaacctggaggtgtacggaaatccagctgcaaaagtgacatgagtagtggatgttaaacatactgggaaacattcagtattagaagggaatgttatcaccagagcacaactctctctttttaaactagggaaacagaatcagagtgatatactgttaaccagtcctcgtatgctgctaaccagacaagaagaaatcagcaagagagaaactcaatgcataagaattagaatggacgaggggcctgcaggcacaaaaaacccaaaacagcaaaatgaaatccatgaaaacccttcttataggttttcagagcaaacacagaagggcctccctacctggaccttgcactaccaggttactttaccagcctcaaagttcttcatctggcaattctgcatgactggctcctttctattctctggtctcagcccaaacaccatcacttcagggaaatcttttctttagattgatgactgagaagtctcctccactgattcttttattctatagtgtttgttgctaaaatttttattttcaaaattatctgcatcctccactaggaggtaaggtgcacgacgactttaccttattcagtgtggctctctctcaccagtgctacttgtgaaattagagcacaagtaagcctgatgctaaacatcctggaaagtggcaactacaaaggacgttaaaccaaa

SEQ ID NO: 51285 - DNA, 2770 bp, Bovine  19866880678984
tccactgacgtgttccactcattcccccttcccatccccttcccctgctccccggcaggttatttccgaagagcactccctcataagtcactcaaatctctgtctcagggaccccacccttagacagacacctagaaatgttgtaagcatgtcctttcctgaaaggggggaagagggccaacaccaaccccacaagccctcatgccctctgatggcccagagtccccaccagagatggctttgtctggctgcccattcctgctgtttatcaagcagaagctctggtgaggctccttaatctggtagcactaacagaaaccttccaggcagaaattgattaatttctcactccatcaaagtttaagtcatcagggatctcagcactcagctaatgcattttgagaatagtttcaattctgtgagcaaatgtggttggaaaaaaacttattagcttaatgtataagaaaaagcatcctttttggtgcccaaattctgcctgtgtagaacaaccaaccaaaggatacataaaactccagatgatgctgggaaacacaattttggagaaaattcaggcaagtcttcagatctcagtgtttgaaaagaagcccataaatgtcccatcaagagaaggcaattgtaggaaaaacaaaaccttagcaagtggtatgttgacaaatagtccacttcttcaagtgtagatgacgagggtcatttcatgtaaattcaacatagatgtggatagtgtaaatataaatgttcaaaatgtcagaaactgaccaatgggaaaaagaaaaataggaaaatcaggtcatggaggaaaggttgtgaatgaaagaaactaaacaagagttccgaaaacagtatctgtacttcagtgaatcagaacaggaactagagaaagcaggtgtgggagttaccatgccggaccaccagggaggggaaccagcgggggagttaccactgccggaccaccaggggaaccaggggtgggggttactactgcccgaccaccagggaaaccaggggtgggaggcattcaaatgcaggaacctgggaaaacagagcccatcggagggcctaggaggctggaaaacagcccaccgtgtccttaatccttacatcctagaaatcagaaaaaaagtgaaaatcactcggtcgagtctgactctttgcaaccccatggactatacagtccatggaattctccaggccagaatactggagtgcataaccattcctttctccaggggatcttcccaacccagggatcgaatccaggtctcctgcattgcaagtggattctttaccagctgagctaccaggtaagtccaagaatactggagtgggtagcctatcccttctccagtggatcttcctgacccaggaatcaaaccagggtcttctgcattgcaggtgtatcctttaccaagtgagctacagactctttaagggaaacccccaaaaaagtgaaagtttctcagtcatgtccaactctttgtgaccctagtcacatggaattctccatgcaagaatactggagtgggtagcctttcccatattcagggaatctttgcaacccagggcccaggtctcccacattgtaggtggattctttaccagctgagccacaagggaagcctaagaatactggagtgggtagcgtatcctttctccagtggatcttcccgatctcagaatctaaccagggtctcctgcattacaggtggattccttaccaacttagctatcaggaaagccctgatagaaatcagagaaaccccataaagagaagggaagaagttcatagacatagctttgagtttggacactggattctgtgatggtttcctaggtacttgttatttgtgaaaccaaaagagtctgtatcctgagatttctcagcctgtcactaaatcctttaatattgtggttaaaaatacaaattttagattagactttactcctggatccaatccaagccctgctactaattcactgtttgaagtgacttaccttccctaactcagtttcctcacctaaaaataagaatattaataatacacatctcatttgcagcaacatgcatagacctagagatgatcatactaagtgagtaagtcaaacaaagacaaacatcgtgatattgcttatatgtgggacataaaatactacacaggtcttccctggtggcacagtggataagaatccacctgccaatgcagaggatgtgagttggatccctggtccaggaagactccacatgctgtggcacaactaagcccgtgtgccacaactcctgaagcccacacatctagagcctgcactccccaacaggagaagccgccgcagtgagaagcccacacaccataaagaagagtagcccctgtttgctgcaactagagaaagcctgtgcaaagcaacaagacccagcagcagccaaaaataaataaataaaaatttaaaaaatatgatacaagtgaacttatctatgaaacataaatagactcacaaacatagacaacagacttgtggttgcaagggggaggggaggtggagggacagggtgggagttagggatcagtgggtgcaaactgttgtatacaggatggattaaacaacaaggtcctactgtacagcacagggaactatatccaatctcctgggataaaccataatggtaatatagtaaagtaatgctcaaaattctccaagacaggcttcagcaatatgtgaaccgtgaacttcctgatgttcaagcggttttagaaaa

SEQ ID NO: 51286 - DNA, 1972 bp, Bovine  19866880698904
actcagcttaattaagtcctgtgttgatataaataaggttctggtttaactgagctcagcaaaagaaaaagtgtgtttgttaaagttctttggttgcaaacaagagaaataaaattagatgagctcaagttcacagaggagggggctttgagacagtgcagagtctcaaaggcctggagactgctggacacacagcctcaggagagaaaggacttggcgatgacaaaataggaggacacattcagtaaagatatcttccacgttctctccccaaagcagcttcatctgcttcctggaacctgaaggttcagccaagaaacagactcatctttcaatttcagccccagatgcccagaagactgacaagtgtagagctggtatgtggcgctggttcagatagcacagccagagatgaacttacacagaaagactatggtggctggagaaccggctgttaagatgggagttgttcctgggaaaatggggagttgttgtctcattagctgatcaaatatccccagaagagtccatcaaagaacagcatcttccctgatggctcagttggcaaagaatctgcctgcaatgcaggagacccaggtttaatccctgggttgggaagattaccctggagaaggaagtggggactcactccagtactcttgcctgggaaatcccatggacagaggagcccggtgggctacagtccatggggtctcgagagtcggacaagatttagtgactaaactaccatatatttataccaaaatatttaaacactctgtgattccatagaaggtgtgtgatagcaagtttggcagttggggtggataatgaggaattctttaggccattgtttcatattctgcaagagaatgaccaccatttccagcttgtcacagggaaagtaacatggattttggacaactttccagttcctcttaacccttattttcttttttattattatttcaaaactttaaaaaaatgtttatttattatttatttatttggctgcaccgagtcctggttgtggcatgtgggctcttagctgaggctggagggatctagttccctgatcagggattgaacccaggctccctgctttgggagtgtggagtctggacccagtggagcaccaaggaagtcccgaaccttattttcataatgtaaatacgtttgctttttagttagaaatgttgtgatttcttactgtgtcgaacaaatccttatcttaatagaagtaccaaaatccacttaaaggctaacatatatgacttatgaaagtgtactgttggatttttatcaatattcccttcaaattcctaagaactgatggcatgatcagtggatctcagtttttaaatgtagtaaaggtcatatttttaagctatttcccccagtcattgtcttttccctaagtcccttcctctttaggcagttaggctgttttgaactccctgcctctaggcagagacacaccctggtgggcagctgaagtggccttttcctggcttgggtttccaaagtccttggccttgtcatgtggcaggagaggacagagagcccaccctcagaggagacagagaaattccatgggtgagaatagaactgagttgaggggaggttgctgagtagactaaagtttcttcagagttgcaacagactgcttgataggctgaaaggaagaaattcagggactaaatatttggaaaatggcaagtcttcaagattgtggctttgtatgctttttccagggcccccaatgggcagcaaacttaaggtagatttgaaggaccaaggggcggctacgtggtctctgctgaccgtgtgactggagcggcccagagccgtagcggcacaatctatctacagacacctggggagagtcttgtgcacttgggttctcctgtccttacgaagcccactgggcacagaagcagctgaatattctcatgcgaagcaagccatagat

SEQ ID NO: 51287 - DNA, 1732 bp, Bovine  19866880707766
atccatggaaaaattcttccaccaaactggtccctggtgccaaaaagactggggactgctggttcaggaagtccgtgttctccccacgatttctaccatttccaacagctttgtgtttctcccggtcatctctggcttttaccgaatctttattctctgcttacattctttttctatatcagtatccacccaaatgagagttgatggctctttctctttgagtgtctttctctctgttatttccctagatatcccccatatgaactgtgcgattgctttaagcagagatttgtcatgggatagatgacaccaataatactggatttctgtattcttgaataagatgcctaatcatttctgctgcttgagcttcagatattctagcacagcgtaaggtgcttctttctctctcatcaggctccagatctcttttctttctctcctgctaatctgcttttgccactcaagattatatattgcatggtagtggtttagtcacttagtcgtgtccgattcttgcgaccccatggactgtagtccaccaggctcctctgttcatggaattttccaggcaggaatactggagtggatttccatttccttctccaagggatcttcccaacccaggaatcaaacccaggtctccggcattgcaggcatccacaggcagattctttatggactgagctacgaggaaagccccatatattgcatatggggccaaaaaacacacagaggctgtgtaacttggctaagatcatatgattagtaagagcagagctacagtgcaaatctaggtgcgctatgcaaacccaaatgagtataaaaatcacctgggaatcttaccgcaatgcagattcagagtctgctgctttgggtgagggactggagagcttgcatctgtgacaagctcccaggttgacacccacaccacaccatggtccgtactctcagtaacagaacctagagagtgctgcttatgtttctgtttttcctattcaaaccagtgaggctttgccttgtggttcaatgtctcacacaatctctgaatttttcttcttgagccaaatgggctggggctaagggggcccttcccttcaaagatccaggactcctaccaggtcagagattccacctcacattaatgaaattaattaattgaaaagctaccattactcagatctaagaaataaggttcccttcagaaagggcaggaaagattgatgtaggcaaggtgatttagtgttgaaaagtaggacgtttgatgttgaatggtgacagtggatgttttaaattctgcccttctgtcccttctgtagtcaacttggtgagaaatcgactctgcccatcctcaagcttctgtgaaatgcaaactgctaggggagcttgaaagagcttccaacagttacacatcattccacagatgttctcttactgaaggcagtttcttccatgacgctttttattttttaaaatttttttaaaaattgctgttcttcactttgatgttcaaatttgtggaggccctgtgactgaagcaaagggtgattagtgcctgggaaagccacttgtcactgaagcctgctgctgctggggaagagggcagtggcagagtcgggcagagtgggcgcgtgtgtttccctagccatggcaatgctctcaatacaagaatggccagagttgtgatcgcctcatgaaagcaaccagtattgagtgcatcatacactgccat

SEQ ID NO: 51288 - DNA, 1155 bp, Bovine  19866880733794
atcatcggtactagcatgaaagcaggaatcattctatctgtgtgattcactgatggatcccaagcaactatctgttgaatgaatgaatgaacccccagggtccctttcgtttcactgaggtgcaaaagaatccatttatgacacagagtctgcaggaatcatctcagtcaattaggacaacacagctgaagattcaggaaaaataataactctgctatcagtttaagtttgccaagaaaatggttaaatttaacctcaaaaagataaaatgtttacatactcattgacattcaactctatggagaactgctaacatttagggagaagttgacttcgagctacttgtcgtagtcagcatttctgtaaattcctaccataaaaacttgtctcaaaaagtgatgtgttgaaagagaagaagaaaatataacaccagaatgtaaatcatatgttcttgactattacagaggatgtcataatgcttaagagaaaaggtaagtaaaatgaagctattaactatggaatccactcattttttaacttttattttgtcttggactataactgactcacagtattgtggtagttttaggtgtactgcagaatgattcacttatgaatctacacatatatccattctttttcagattcttttcccatataggtcaccacagaacactgaacagggttccctgtgctatacagtaggtccttggggattatctattttctatatagtagttggaatatactcatttttaatcaacaaaaagaactatattccaattatatagcataggataaataattatttcacaagcataaaatatgatgcaaatctcaggtaaaaaagacacaaaattatggaccccccccccggtggttcagtggttaagaatccaattgcaagttcaggggacactggttcaatcccttgtcagacaggactaagatcctacaggctgtggagctgctaagctcaagcaccacagctactgagcgctcactctagaccctttgagccacagctactgagcctgagcatctcaagctcgtgctctgcaacaagagaaaccactgcaatgagaagcctgcataccacagctagagagtatccctctcgctgcaactagagaaagcctatgtgcagcaacgaaa

SEQ ID NO: 51289 - DNA, 1171 bp, Bovine  19866880748029
tgagtgagaatctcatgggtctgctccatcatgaaccaccccaccaaactgtggattgatggatgagtcccacgcatgtcccttatcactcaccattccagtaattatcaacccggtgctgctctcagtattagcagttctctgcctacgggcttcctcttaaccccagcttgtggggcagtatggcagtgctgaggaactgtcctaaatcagcagcacatgggaattggtgggtatgcagagtgcttgctttgatagcaccagtcctttgaccctctctttcttttctctgttggctgtgccatgtggcatgcgtgatcttagctccctgaccaggggtcagacttgtgccccttgtggtgggagtgcagtcttaaccgctggactgccagggacgtcccctttgatcatctcttagtccatcctgtttgccttggaaagtgctagcagctcagacatgtccgactccttgcaaccccatggactatagcctgccaggctcctgtgtccatggaattctccaggcacaatactggagtgggttgccatttctttctctaggggatcttcccgacacagggattgaatccaggtctcctacactgcaggcagagtccttcctgcctgagccaccagctccttgctctatgacttcatgatctctctcactaaagagatggcatccagttccctatcacttgaatgtaggttttgtgtgttgtcactggtcttaggatgttagcagacttgttacaaacagaggcttgagaaatccatcgtgcatttctgctttctcccctattcctctgtgattgccacgagaggatagccaggctagtcagccagaggatgagacatacgggtcagcgaggcctttgcagaacagctgagagtctggtgacccctgggaacatacgagagagtccaactaagatcagcagagccaagcagccaatccagagctgggctgcaggtgcatgagtgagcttagcctgagatcagaagaacctgcccagctgacctgcagacacatgagcagactaaagggttgttattttaagccactcaattctccttgaactaccagtctggaggcttggtggttcgggcaggaaaggttaggttcttgacttctttggtaagcagtagtcttgggcattagacattgtta

SEQ ID NO: 51290 - DNA, 1320 bp, Bovine  19866880757760
tctttctttttctatttctctgtggcactgaaaatattttcacaggctgatattggttaaattcattcctctaattctagggaagacataaacttgggccacgctcaagaaacatttatctacttcgtcccccagtacacgtgtcacctctctgcttcctaattacacgccgtacagcccccggtggtaacatttattcctggtacgacaagcttcagatgaaattgcccatcttcaatattgctactgacagtctaatgagaaagtacagatttttggctaaagaaaacaatgcctcattctggaaacttatatgggcttttatctcacttccttggggaaaagaaacaagagtagataaaaggcagatttcactgcttgaaagaaccaaatagagttccagacacttaacagtagccactgtcaattgtaatctgtttgtattaaagtttattaaattatcaagcaaggtttgtacatcaggttgtatccaccagctgtacttcagcaccagccccttagattgggatctgttggttcttctaaagatcacactactgaaaaaaaaaaaaaaattaaaaagtcacactactaaaacctagctttatttagaaaccagctcttagccaagcactgggtattattattgattacatctgggttgcagccaccttggatgacttggagaacttgggagttttaaagatgaaatgatcagattcagcattgtacccaacctgagagaggcagagagatttattcagtttctacttgattgaaaatcaaatgttaacctagtcttggctctagatgagtcttgttcatctccttattcaacactggactcctgccttgtgccagtaactgaggatacaatgttgaaaaatagagacaaagtttacagtctggaaaggaggtcaaataaaaacaagtatctttcacagaggggcttccctgatggctcggtgggtaaagaatctacctgcaatgcaggagacgcaggagatgtgggttcgatccctgggttgagaagatcccgtggaggagagaatggcaacccactccagtattcttgcctgaaaagtcccatggacagtgtaacctggtgggctacaatctgaagggtcacaaagaatcgaacacgactgagtgactaagcacacacactccccttattataagctgtgattttgaatctccttccacatttctctttaaaaaatttttttttttaaatttttggccacattacacaacatgtgatgtcttggttccctgaccagggatcgaacctgtgtcattggtagccaaagtgtagag

SEQ ID NO: 51291 - DNA, 1036 bp, Bovine  19866880772121
actgtagcccatcaggctcctctgtccacgggattctccaggcgagaatactggagtgcgttgccatgccctcctcccaagggatctttcccaacccagggatcaaacctgggtctcctgcattgcaggtagattctttactatctgagccaccagggaagcctagatttatgttataacagaaaacagtttttcacttggctcttttttttaacatgcatttgttcagaatgaatgactgactttcacaagccatagtgaagaactgatctattccacttgttgtaatatacaatctggaccctctgctgggcactggcacttctgttggggtttttgctgggtgagatggcagcttctagcagtgccaagaaaacttaagtgctggggttaaactaagagctctgggtaaatgttgcctcaaaacggctgctggtaccaaagccaaataagccgaggaatcaattaccctctgatgctggcactgtcagatgactagagccatcatcactggaactgctgggagagaaagctctggttaagccaggcatctgatgatgctaagaacagaatactcatctatttcccgggtaattgttttctcttccgtaagctccagctgagggacgcagccagcgtcagtccgccccaagtggcagctcttccaacacctgggcaccatttcttccttcgttcagatatcttatcaggaaacagcgaagttttaatgagagacaatgagacctaacccctgggcttccaagtgccagctggtggggagagggcttctggggtgacagacacaatcactgcttccattagaccacactgatcgctcactgctgggagcgatggggatttgcaacttgattaaaactggagatttagtggctggagtagaatttctcagataattgctggaaatgggccaattccttcactggactgagttccatgtggcagattatatgctctctgactgaaaccagatccacgtctaagacagagacgcttcttaaagatgcacttttcagga

SEQ ID NO: 51292 - DNA, 1833 bp, Bovine  19866880852889
ttaggagtttgggattaacagatacacactagtatatataaaagagataaccaacaaggacctactatatagcacagggaactatattcagtatcttgtaataacctataatggaaaagaatctgaaaaagaatatatatacgtatatagttgcacacctgaaactaacactacattataaattttactgtattaaaagtggaaaaaaattttacatcatgttgttaaacttgattagggtatttgagggtctgaatgaccagtagggtgtggctggtgccagccttactttatgtggtacctctgacatcctgagcgacatgaggagggtgttttatttatttatttaaaatatttgcttatttatttgactgtgccagatcttggttgtggcacatgggatctttagttgtggcatgtgagatctaattccctgaccagggattgaacctggatcccctgcatgaagagcacagagtcttagccactggatcaccagggaagttccagggagagagcacttggttaggttgatgaaacccaaaagcaagctcaggaaggaatctccaaggctcccgatttgcaggatcactggatcttgatctctttgttgctcatggaagctttttgtgtaatttaaaaaattttcagctggacactaagatggtcccctctgtgccagggagtttggaagaactgtttttacagtggaatacatctgatccccaggaggggagagttttggtctttttaactgatatgcaactttttcattctctgcatttaagagaacctgattgtaagtaactctgtgaccacatattacaactcagaaacaatcctgacgttttaccactgtctttttctggaagcattttccaaaataaataaacaataaaaggcaggcggaggctgacattttccttctcagggcatcattccaggaccctgaagatcctcaaatgaacttgccctcatctcacaggtaaggaagcagccccaaagagatgacatttagttcaaagttatactctggctttgtgacggatagaataagaaactggctctctgctcctcagacaattttggaaaaactccagaaaagtgttgctaaaaaggatctttctgccctgtggtttttgttatacagcaaagaatacccactggtttctcattatctggctgatgccctgaaattcattcagtgttctggtttatttattagctgttttgagtgatggagaacaatttcaaaatgtgaagacagctattcttgaaccctgtgttcccggggtattaaaagattgtgttgggatatcttatctctgaacctgatgttaatttcctctaatatattgcaaagaataagtcacttttttttttcttttgggcttgcaacttacaggattttagttccctgatcagggatgaacctgggccctcagcagtgaaagtgctaagtgctaaccactgaacttccagggagttccttatattgcaaagagaactgggcttaatagttgcttttgtttttccaaattatgaataaaccagattttaaagctgcttcaaatctatctgtagatagatgcactctttctggtgatgttaaaatagaagatgaacttctgaattctgaaaggtgcctagctaaatctgattatgttgcattacacatttgagacttttccctggggactggtgtttcctcccaggtctttaggacagaatattctttggtcatttggcagtggttctaccctgaccttgatgtgctggcgaatgtgacatgtttgtttctattgtacacccctccactcttttttaaacaaa

SEQ ID NO: 51293 - DNA, 912 bp, Bovine  19866880903749
ctattgcatgtgagagtaaggacctctgaaaatctgcttctccagaaaaacaatgaatcagcaaaattgtgaaagtcaacttttccaaaactctggaaattaacaaaaggtttgcaacaacccaaggaaaagaaccacatcttggtaagaataggcaggattgtggcattttaatttgctatcttctgatcccttcccctctccagcttcacagtagccttgaaaaccacagttccacaatcaaagtgaaaactagcagccactgacctccccaaatcaccactccagagaattgttattatttgatctctcttgcagttccctggacactgtcattaagcaagtctttatgggacttgactcagagcttactctgagtgagcaaccttttcctcaggggtatttatcaaaaactatcagcagcaattgtttaatattgcacttgcctgaggtggcaataacagttgggacagacaacaagctgaaaagaaacttaaaaggaaaagcaaagtttgtaaagatctctgaaaaaaacatctctgtaagtccagataatcacgcacatgtacaggtttctgtacatgcccagtgccatgtacaaggccagaaaaatgctgaaaaccaggaaatcacctctacattttttatggtcagccatttacttactatccaagtcatggggttcctactatggaaatgtgcaggtccatacaatctgctctctagaacagttttaagagaccaaacagacaaatggccagacaatagatgaaaatagaactctgacccataacttctgcagcaattagtctaggaagacaaaacctctgcagcaatcatcccagacaaccaagacttggtcaacgaccaccagcttcccaaatgtttgctcccagttccaactcatgactg

SEQ ID NO: 51294 - DNA, 788 bp, Bovine  19866881059559
aactaagatcccacatgccacggggagcagccccccccccataaaaagatgaacctaggagccatgtctgtacattattctctatcctgattgtctcattttatatacacatgtccaagtggaaatgatactaatgtgacttttatcttaaattgctatatagcaattcagagtgttaagtgtattattgtttcttcagtcattcctggaatgctgtgtgttgaatctgtcactttactagtatcaacagcttaacccaaattaactttcctcttctacccccagttctatgagttatttcctcagaatacagttcccagcagggaatttatgggtcagtggcaacaaacagcttctttgtgcttagttgttcttatttatcaccaaactgtagcaaaaaagaaaatatgcaatattaccaatatttcttaccaccgtaacctataattatttcgagtaatcttgcagacaaaataaactggatttccatttgctgaactgctgaggaggatatccctgttctccacaatgatgtcatgtctcggattttctatcttcatctctcctcaccacttccagagagaactttgtgtactgatctttgggatctcagtattttggatgaaaaccatttaatcttttacactgtccctttatttttacccatgttgtggcattccatttaatacttattctgttgcttctggctgggctatttttccttttggtctttagctattcgggcccatctgtcttgtggacgatgattttctggcttgcctcagtgg

SEQ ID NO: 51295 - DNA, 997 bp, Bovine  19866881065881
aaacatcaatcagagtaaatgccaaaaaaaaagaaagaaaattctattcctactcatgtcatattcaaactttagaaaattaaaaataaagaaaaatcttgaaagagatcagaggagaaaaacaccttacgtatagaggagcaaagatgaaaattatagctgacttctcctgtgaaaccattcgaggaagaagagaatgggtggaatgtttaaagtgttgaggaaaaaaaaaaatcaccaacctaaaattctgtatccccccaaaattatccttcacaaatgaaggacaaatactttctcagacaaagaaaaaacgagggaatttgttaccagtagacctgccttatgggctccccaggtgattcagatggtaaagaatctgcctgcaatgcaggagatctgggttcaatccttgggtcaggaagattccctggaaaagggaatgactacccactccagtattcttgcctggagaattccatagacagaagagcctgacagactacagtcatgggatcacaaagagttggacacgatggaacgaccttcactcacacacacgcacataggcctgccttttaaatgttaaaagaaattcttcagagagaggaaagtaatttaggtcagaaacttagatctacataaagaaaggaagagcagagaagaataattaaatgaaagtaaaataaaaacgttcgttttactcattcttaatttaaataagttttttcttaataatagcaacaaatatattgttgtgtatgctgatgtatgcatgtgtgtgtttatgtaagcctatccataagtaaaatgaatgacagcaatgaaaaatgggacagaaagaaggaattaggattattttgtttttataaggtacttgtactatccataaagtagtatagtattatttgaaagtaaatttagattcattgaaaatgtatattgcaaattctagggcaaccactaaagatctcactttatatatttatataatatt

SEQ ID NO: 51296 - DNA, 885 bp, Bovine  19866881080839
agattaatggaggcgtctgcgttactgcagaaggagagaaaagagagacgttaataataatgatgacgagggtagcagcttctattatgggccaaggggctttataggagaggcgaccagaagtctcaccctattactccatctagctccaagcccagaatctctggggaaatgtgccttcctctgagtcagctccacgtatgatttctcagagcccaggaatgatcaatttaaatatttcaacaaacaatggttgaaaaaacaaataaggtaaccacagatgactcctttttggataaaagcaaatagagtcacccaggacatccagtcctgagcacgctctatccagccagagaagactggcaggcactccagtccttggcagtgaagcgatgtccttggtcagccaatctggccgcgcatggttttgcaaacagataagacttttcgtagcaaggttatatcctgtttcctcttctaagagccatcttggaccaaaccttgtcccactctctcaggactcagccgaaagctacaagaatgagccaacacactccaacatccagatttttttctacgtaagtcaaagctagagttccatactagtatcatttcctatctgcagagccagaagccaaaactcagggagattaagttactcaccccatcagtaggacacaaagcacagatacaaatggatttctcctacttcaagattattgttctttctgtttcatcatttataactttttcatttctaactacagaagtaagtacataagcgtgatgggaaaattggaatatacagaaatggattttgcatttcttttcaggctcattcttttatcattacatgcatgcaaaaaacacagttcacatttcatc

SEQ ID NO: 51297 - DNA, 903 bp, Bovine  19866881161820
tactataaccaactacagcatgtcaaaatcaggatatgtgctcatattttcctagtaatttggtcgcattaaattaacattttaatatgaaagcaaacaaaaaaagcttaaaagaagtagaatttctcaaaatcccatgctggggatgaccatccatctagctacaacaaatatatccttttcttcagtctaccaaacacctaatgattagccgcaacactaaatacaaacaaaattcatttggctaacacctagctatctatttaaaatctttagagaacagaaaggtgattaattaatgtaaattagttatgtaatagctagagtaaacataatgtgcatgttcataaaacacactgcacttgctttacacatctgcaaataattttcttaacttacgaaaaggaaaatataagacaaatacagtaaatttcagattttgcctcattctccagcatatagcctctgattctgaatgatatataaacaaattctagtcttaaaaaccaaataagcaagcatacatcgaatcactttactgaacaaatatgtagagaagtatgttgaaaattcagcaaacaaaaagcactttcccccacagttttcctacttaatcacaagtgaagtctgatgtctaagtagtgaataacggtttgtaacttttgaccttctgttggtcaagttcttaccagtgctatggtggctgttattccaggtgttgttatccaccagagtggttctattagccatcccagcaatctgatagccgtaatcccaccaagacatcactcgggcatgttcatctgtattctgccttagccaaaagtaagcttctctgaaatcatctaaaatattcctggttctgaaaagactcacaatattaacttaaataagaccttataa

SEQ ID NO: 51298 - DNA, 1130 bp, Bovine  19866881194140
cataaacacacacacacacacacacacacacacacacacagcaaaatcagatcctcgaggactagaagagttcctatatcatccacaacacagacgaactaaaatacttagtttcaaaataagtttgcccccacttactacctctgtgatctcagtcttctgctctgcagcaggggtccccaaactctagaatctaatgcctgatgatctgaggtggagctgatgtaataaaatagaaataagtgcacagtaaaagtaatgtgtgtgaatcatcttgaaatcatcccccacccctgatccatggaaaaattgtcttccatgaaactggtccctagtgccaaaaacgttggggacctctgctctttagaatgtatataatcatagcccccaccttatggggttatcccaaagacttaaataatgataatgcatttaaattctagcacaatgcctagcatatagtagacacaacaaaaatttttttcacctagtcaggcattccaaaatttccgcagcaatctaatggaatattttcccattcattgccttctccacactcatatgagatcataaaagctccaccagtttccataagcgtaatagctttataataaggccagttggcaagctaagggattatcctcagaactttcaaagagaaatatgactgcattcccacctaattatacatcaaggcatccttaagaatctctcttacccctggggggggactaggaatattcttaatgataaccaaggactgtcattagctatcagaaatagattcagaagtcacagatgcaaaagacttcaatcaaactctttatattcaggtccattatgagtgataatagactcctgtctgcttcatggattcttggatgtatttcactgcttctacaattgcacttcaaatgctatcctgcttcctaataataaaggcacatgttcacttcagcagaatttttgtaacttgattaaaggacccaatgtcaaagaatctctagttagcactcaatgggactttgaacctttaatcatattctcatgtctttcatcagcccacttcccagcacctacattttgagctgcttccaggtctgcctgtgtctttctatccattacaacaa

SEQ ID NO: 51299 - DNA, 969 bp, Bovine  19866881206501
tgttcttgcctggagactccccatggacagaggagcctggcgggctacaggccacggggtcgcagagtcagacacgactgagcgactaagctcacacagcacacaacacaaggcgtcaggaaacaactccagcacagtcaacagcattctcagggcccgactcaacatttttagagaaaggtcttaaattattttgtcatcaaagcaaactcagttccggctctcaacagaggatagaagagctgtgtggctacagagctttaccaaggagacctcgggtttgaagaatcctgtaaaacaaaatgtctgttcctctcaccatttcttaccttcagagaatttctgaggcttatgtaatggaaggtcaagggaataaaaactcactcactgtcttcccttggttcggtcaatatgatatgaggggtgggtgggagaagcctcaccattgttcttattttatcttttgccccacaaagtctttgaaattcccaaatctttcaaaattctcccaacccaacatagatgatcactttggtgaacactagtgaagtggaagtgaagtggaagcgttagtcactcagtcaggtacagctctgcgatcccatgggctgtagcctgccaggcttctctgtccatggaattctccaggcagtagtactctctaataaattaaggttgcaagaaagaaaccagaatccttggctattttagaagctttctgtagcctgtttccatgagctcttgttccagaaaataattagcagcaaatggaagtactgcagggaaacctggggaacactaggcggtgtccatggaccattaacgaggaacagtttcttggaaaaatggagccagcatcttgtaccaggtacatttttctgcttgatttctggttgggtgcttggaagagataaaattaaaatttggttttcctagagcaggagagtccctatcacttaaggaagaagg

SEQ ID NO: 51300 - DNA, 943 bp, Bovine  19866881331423
tggaaccaaggagcagggctgttagccgcttgcttcattgccattgtgccaggctacatttcctcgctcagtagctgggtcctttgataatgaaggcatcgctatttttgcacttcaggttcacatattacttgtgggtaagtaacacttgatgttttgttatcattaatacccatgaactttctactgaaagttgttattatagttgcatgcagaaaactgttactgttcatgacaaataagtcacagctccaataaaagaggctgttggaaaataagctgttgatttttttgttgttgtttctttactagtggagagagagaggtcaaaaatacttaagaaagctgaagtggggttcagtggcttaggatgttgaattctgtgtgtgaaatttgcattattttactgttgccaagttatttcttctttccctatctgtataccttctgtttctttttcttgtcttgctgtattaactagtacttccagtatgatgttgaagaggtgtagtaagatgatcctcgcctggttccttttcttagtgggaaatctttgagtttctcactattaaacatgttggttatacgtttttttggtcttatttatcaagttgaagatccactttagtttgttgagtttatcatgagtggatgttggattttgtcaaatgctttttctctactggtacatgattgattcatgaacaacacaggtttgaactgtgtagatccatttatacatatatattgttttctattaaatacatactacagtacttcacaatttggttgaatccatagatctggacccaaggattatgtaaggtccctactataaagttatatgtggattttcttatgccaaggaggtagtcactgctacaacctctgccttgttcaagggtcaattatagttacatatagttgtaactatatgtaaatt

SEQ ID NO: 51301 - DNA, 1522 bp, Bovine  19866881490108
ttcaatgcattggagaaggaaaatggcaacccacttccaaatgttcttgcctggagaatcccagggatgggggagcctggtgggctgccgtctatggggtcgcacagagtcagaaacgactgaagtgacttagcattctcccccaaactccccctcccagccaggctgccgcttgacattgagccgagctgcagtaggctggcctgtcataaagggcccgcttgtttgtaggggtggcagttgttgcttcttcttctgccttttcctcccagttccggatgccctatgggatttaccaggagactttttttttggctcctgtttgccctcaggaggaggcatgggtatgaattaaaccgtgagaaacacacagtgaatgggaaattaaaggtttttcgcctcaaatttactgcttgtgaattcagatgacagccattagataataaatatagggttagccatccacagcagaattccttggctcccgggtgactttcctgatttattgctgtctatgggacagtctttcaggcagcgagaggccttcctttctgatttctgatggattctcattctactcagaatctacaagtatggttctccttacagtcttgctgaccatatagattctccagtaagtatttaattacatcttggacttcatcacgactttgatcctaaagaaaataaggagcaggtcaatgactgcttacaattttgtgctaagcggcttcttaacattttaaaaatcgataatgctaccatcgatcaactcttaagggctgtaaggaaagaaatgaactgtggccacacggctcctgcacggcaacccctgtgctaagcgttttttgtacctgagctaattcaactttcatgatggctcttaagggtaaatattatgatgccttttttaaagattaggaaattgttgcttaataagaaaactcgaataactcacctgaggtcacacagcttgaagctggtagtgctaggattggaggtgggggtgaaacctggctgtctggcttcaaagcctgttgaaaaatctgccttttcttgggttggaataaggctcccaaacaatcaaaatgtatttcagtggattaggcaaatttgctgttgttgaaggattgaagagggtgttccctggcggtccagtggttaaaactctgtgcttccattgcaggggcacaggttctatccctggtcagggaactaaaatcccacatactgtgcaggacacacacacacacacacacatgcatacaaacatatattatatacaaataaaaaaagtgttaaagacatagcttctttcttcctcttcacttcaagggaaaagattgaagttgaaagtagatgactattgaatttcagtataatcaaagtatatttaattctcagagatttctccagttacctgtttataaggtaacttgaaagcaatacagtgcttcccaagtttatctgtcttactaattctgtccaagctcaaatccagagaaatgcgtgagctaccatg

SEQ ID NO: 51302 - DNA, 1575 bp, Bovine  19866881491951
cactgaattctccaccatttatgtttggtttggactccttccaataaggtttagaaaggtctgcagccagttctaaaggctaagtctgggaacttcccctggcggtccagtgcctaggactctgagctcccaatgcagggggcctggggtggatccctggcccaggaactagatccctcatgctgcaactaaagatcctgcatgccacaactgagacctggcaaagctaaatttaaaaaaagaataaatattttttaaaatgctaagactgagctgtacatgcaaagatagaccttcagcgtacatttggtgaaacagtcttgttgtctctggaaatacacagagatgttacaatcaatccacttaggccctcaacatgagcggaggaatgtgaaaaactgccaagtcgcctgagaagaaattcagtttgctttgaacacaattgcataaccttaccaccccctaacaatgctcatctgaggaagacgctgtttttttttagcttttagagatgactcagagaggactgatggcacttacctttcacaaaatgcagaacttgatttgctcttttgcaataattatatcccttcactagggtaatggttaccataaatagcataatctcagaactgtcattattatcaaatatttatcaagtcttccctccctgcatgcgtagatagtagagattaatagagttgattagaaacagccagtgttctgaatagttcataagagagaattcagaagaatggaaaagacacaattctcttgaagctaggaatggcctggtctcttcttctgtgggtctcatctctcgttgtccttctggagcatcctgtcctaaatgtatgctcccaaaagtcagtgcctgagacaagattttgggtacaagccatttattcaggaggcaatcacagaagcacagaaagaggtgggaagtgagacagtaacaggaggaaagccaataaagggtctgctcacaaggatgttactgctgttactgagtttcagtccttctggggaaccactggtgcctgcatagcacacatctcagaattgtcccttctcccaaagggataaagagatgtggacattcatcctccagctcctgtccctgtgtgggtgaaggttgctatcggggcaccctcctcaccaggccccacacatgccactggcagagagatgcaggcaagggggaactttgtgcgagtagaggggttctccacgggagcggcagaccacctctgtgggaggggaaggggcggggggacggggaagtgagtgggccgtttatgacaactgccacatctcctttgctcatttgggtaaaagttagttcaggaccaaagccatcatcagaataccaaggattcaagacattctaacattatctgaaggcaccctatacttttcttgtactaaaaattatgctgtatctacttgagtcctgaataacatttcccaatgttgaatagcctaaaaattagttctcatagctggattattttttttatcacaagtgtggtacattggcatttttcttgcggcatttttttccgatagggcaag

SEQ ID NO: 51303 - DNA, 1729 bp, Bovine  19866881730642
cagggtgctcagggctggtgcactgggatggcccatagggatggcatgggacatggaggcggcagggctcctctgtccatggaattctctaggcacgaataccggagtgggttgccattcccttctccacgggatcttcctgacccggggattgaaccaaggtctcctgcgttgcaggcagattctttaccatctgagtcacctgggaagcctcacttgatcacctcacaaatcctgggctactatcttctggaattttttatgatgggcataataagcctcatttttaagccactgttcacagccaaatctatccctgactgttgcaggtgggatctctattttgcaggtgtagaaactgaggcacagagtgacctacatggccttgctggtaagttggggagtcaggattggtctgactctggggcttgctttcttttcaccgccctggaaggaacttggagaccttctcccccctcattttatagatgagatcactgagggctttgcctcagggtaaagcagccacgcattccactgcaaggcagtcattgctcagcattattcctgttcgctctctctagccctggccttccctgggaagggcccctgtgctgtcgttagcgattttctcgcccagcgttgggtggcatctctttctgtgagtagatgatgtttggtgggtttttcccggtcagaagcaggcactttttcgggctgtgtgttcagagctctcacagcctcgtctcttgcctcctgcagtccttcggaagatctttccatgtctgtcctgtcctgtcttcattcaggctcccaggacaggctgagggggctcttggaccctgtgagtcttaggaagctctggccggagtcttaattgccagggaggcctcccaaatccacactcccaaatcagagtgtggactttgggtgaagtgggatcgcatgttttgaatgcattttgcttctgggattcttatgtagctgagttccaccctattactaataccttaaaaatgggcctcccgacccctttggtgaacttgggcgaactttacagagctttactgtgtacatgttccagctgactcatttcttgagccctaaaaaatggagcagaacgaaagccagtgtgtgctgagaatgctgttgggagagtattgttgcacacttatttatctgtatctgtatcatattgcgttttgtcactttttacactagcagttttgtcactttttatactagcaatattcttgtggtcatttttattctcccagctaatctgcgcctttttcctttttgtgagaagtctgcccttgaaaccttggcccaaagtgcattgtaacactgttttagtcatttaattaatttggagtttcctgtaactgaactttttgttaaacatcagtttctgtgatacccttgcagtgagctgaaattcaggaaaagagtattgaaagccaaaactctacattttttttttctcacatttttctcacaagataggattgacataaaagtgctttagaaaatctctgtgtcagagaaacaggactaaacttatggagtcaagcttaagcctggggggcgtcatcttttggaacataagcaaagcataacctatctagaaagagactaaatcgcagttgcttatgtcatgaaattgaatttctgcttatctagaactggcttccttttcctttccagcaatgtagcagttattggtatt

SEQ ID NO: 51304 - DNA, 2277 bp, Bovine  19866880413257
agaggagggaagagggttcaggatggggaacacgcgtatacctgtggtggattcatgttgatatatggcaaaaccaatacaatattgtaaagttaaaaaataaaattaaattaaaaaaaaaaaaaagaattgatgcattttaactgtggtgttggagaagactcttgagagtcccttggactgcaaggagatccagccagtccatcctaaaggagatcagtcctgggtgttctttggaaggaatgatgctaaagctgaaactccagtactttggccacctcatgcgaagagttgactcattggaaaagactctgatgctgggagggattgggggcaggaggagaaggggacgacagaggatgagattgctatatggcatcacagaatcgatggacgtgagtttgagtgaactccaggagttggtgatggacagggaggcctggcatgctttgattcatgggatctgaaagagtcagacacgactgagtgactgaactgaactgaactgaactgatgttggtcatagcttttgttccaaggagcaagcatcacttagtttcaaggctgcagttaccatctgcagtgatgttggagcccaagaaaataaaatctgccactgtttccatttttttccccacttaaattgccatgaagtgatgggactaaatgccatgatcttcattttttgaatgttgagctttaagccatctttttcactctcttctttaaccttcagaaaaggcttgggaactgataaaccttgacattcgtatctaaaaagccagtgttactgtatatatttttcagtttggataaaagttgatgaatgagtgaaagttgcttagtcatgtcctactctctgtgtccccatggactatacagcccatggaattctccaggccagaagactagagtggatagtctttccattctccaggggatcttcccaacccagggatcaaacccagatctcctgcattgcagacaaattctttaccagctgagccacaagggaagcccaaagttgatgaaatttaacctaaatcttcatggacaattcataagaattctgggcaaccagaaaggcgattgagttcctatagtaaatttggaatttgtgggcccagccgctgatctgagccttggtttggctgcttctcttcccttgtttctgtgaccctcttaaaatcagcttcagggcttccctgggggctcagtggtaaagaatccacctgccaatgcaggagacatgggttcaatccctgatccaggaagatacaacatgtcggggagcaactaagcccatgagcctcaactattgagcctgtgttttagagcctgggagccgcaactgctgagcccccatgctgaaactactgaagcctgcacacaagagacatagagcccgtgctccagcacaagagaagccactgcaatgagaaacccgtgcacggcaactgaagagtagcccctgctcaccacaactagagaaagccctcaagcaacagcaaagattcaacacagtcaaaaataaaatgatttttaaaaaaagtgaagtaaaatcagcttcagaaggtcaagtgaggcagtaattgtccctcttttctaacatcatgttggaatataggcatgatgatgatgataaggatgatagtaatggtaacataagtagactctggctaaagcatttgatccactggcaagatcttcctgaaacaatactacagagtaaaggaacaggataatcaggagtcttttcatctcacaggaaatatgggagcttagtgctctgcccatctgcctgcaatgaaatccagctatgtgttccttctgctattcctagttccatgaagggcagactttacaattccttgatgattaaaaaagcaagacacttgaagattaaactagaattgaggcaaaggttcataaatctccttttagccacaagaagaccgaagactttgcctccaaaatcgcggggataagggacctgatgtgctatccatcaccttggatgtgttcaacattcagttatagaaaggagctaagttttaatggaatactaggaacagcatctggagacaatcaggtatactgatttaaggtatcacagagagtgtgtatattctgtatcatgaaagatagaggatcttttcttgtgaccaaaattacagatcttttctgcaaaagtcacccaaagggcatctatataccacatcagagccaattgcaagattctcagtttttcccgcctcacatatcttccattttgac

SEQ ID NO: 51305 - DNA, 1298 bp, Bovine  19866880456358
ccctcagagaatgaaaactcatccccatgatttggggagatgaacgagggggaaaagccttgagaggtcattgccaccactagggcaatttcccacctgacccctcagatgtcagttgctgcagagcagactgccaacgggagagaattggcaaaggcctcctccagctctgctctaacaggctgtgtctgtggctgccctttggcctcagagctgacccacctcatagggagggatttcagggccagcctctctctgggcaggtgagattgggggaggtccaggcttaggtgcttgtcctgctttgtcttaggggttgttgagggtgggggagatttgcccatagccactgtcctggtactgctggggaagggaaccaagggagcccctccctgcctgcctgggggctctggggctccgggttccagacaggttgcagaggcatctcattaggaagctccctgactctgggtgtggggacaggctattcgttcaccctgcttcctgaaccatcccctctccaactccccattctttccaagcagtttgttccttggccagcgtctgggagccaatttattcaggccctgaggtttgttttgttaaggattttaaaatgtattaagaaaagtgcaaagagctttgtcatcactttcccctttctaatgtacttgagtgattggatcaggaagtccctgttggcctcttgcactggcgggccaccaggggtggccagctgtctcaggggcaggaagcaggggctcagtccccttcatgccattcctctggccacataacctgcctgggctgtaatgatctgagtacaggagaaggcggcgggtgggtgcttctctctgttctgtctcttcactccctgttttacaggggttggaagtttccaggagtcagagcccgggactctggggctcccagctcccggggtactctacagggcatgaggaggacttgagtgatgacagtcactgggaaaggggggcgaggtgcctgcctccctcctctctgatgtgcctctgccaggctgcagggcatgggccaggggtccccagggtctgtcctaagggctcttctggctgtggagaggatgtttgatgttgctctgagctgagcttgggcactgaggagagaatgttcatctcaagatgagtttatgggtattataggttcagctgtataccccactaaaatgatatgttaaaggcctaacccgccagtacctcagaaagtgatccttctttctttttttggtttagaaattaatcttattggcaatagggttt

SEQ ID NO: 51306 - DNA, 683 bp, Bovine  19866880494239
ccccttcctcatgtctcccctgggtgcagagacccccctcaaatgtggctctgggctgcatgggtggggaggaggacatgcttctccagatgaataaaaactgaattaactgagaggaactggaactgtgcgcatgagaggacagtttgacagaactaccacaggttccctttaaaaaagaatctgcacctctctcatctaggattggcggtgaagtgtgattcagttgacggtgtatggacacttctgggtgtagggacctgccttctccccacagcgggtctacccgcccttctggggggtgacctgtgcctcaccacagccctgagtggggaccctgaggttcgggggggtaagccggggctgcgtgggcttcagggctttcctcacctcactgccccacctccggctgttgttagccagacttttgttgcatcaggggctgttcctgcattccctggccttggagtcagtcttctcctgcagttctaggctaaggctaaattctgggctctgctctttttgtggtgggcaggaggggcggtgagctcatccctggaaaggattagtcatcagagagacagggacagatctaggggggcaggacagaggacgggctctatgtaaatgagtcatcttccctgcagctccgaggccccagcttgacagctgctccccaggag

SEQ ID NO: 51307 - DNA, 3147 bp, Bovine  19866880517019
tgaggtatcattgtttgctgttccatggaattatgacttgtgccgttgtgctttatcctggattgagagtaaatgtgtctttttttgctgccttgatattgagtcattcttgtattcattaaatccaacttgaacacaggccagttgccagcagtattatattccttatgagtatctataaagctttattcaaaatttatacttgaccctagaatgtctttttgggggggctttgccatgaggcatgcaggatcctgttccctgaccaggtatctaaacagcacatgctgcttgaaagtgtgaaatcttaaccactgaaccagcagggaagtcccagtacctaaattttcaaatataatactaccaaactaatctgaaacaacaagttgtaaaactaaactaagatctggtttagttgaggaacacatagtatttgcatgtattctggcgcaaatgcactttccttgttactggggcagccagattcaaatcctcgctagccatctgcccacagccagtgagtgaatatagattaagcatttaacctctctgggtgatgtttccctcatctttgtaagggagataatactgcctgcctcatgaatgtgagaggaataaagatgttttcatttgtgtggctttgttcacagtgattcattcaatcaagtgttttttaatggttgttcattcaactcttggaagcactgatatgacaggaaaacattaactcttttaaagtaggaattattgataagtggagaatattggatttttgttgacctgctacttgtgttccatgcctcgtcttcccattcaggaccttcagctcagaagacagccatcagtcactgagacctgagagcatggctactggtgatttggcagcaggatccatcttattattacagacagtatttggaatgctggggaatttctctcttctttactgttatctcttcctgtggtgtactggggataggttgagaaccgtagatttgattgtgacaaaccttattgtagccaacatcttcattctgttttctgctggattctgcagtccaatgacaacttttgggtggaattgtctcaaaagtggatctgcatgcagagtttttgcttatcttcgtggagtgggcaggggagcatccattggcatcacatgcatcttgagtgtcttccaggccatcacgatcagtcccaggaactccaggtgggcagagcttaaagtgaaagctctcaagtgtgttgttccttcaattatcctgtgctgggtcgtgaacatgatgttaaatatcatttatcctattttcgtgactggaatattgagtaacaaaagcatcacaaatagaaaaagtttcaaacattgttctgatgttcccaatgatcattatggagaaacatatgcagcaatgatgtccatgcctgttgtcttttcttttgtggtcatgatcttggccagtggctccacggttttcaccctgtacaggcgcaagcagagagtccaaaatgttcatagaatcaatggctcctccatatcctctgctgagtccagagccactaaaaccatccttctcctggtgagcatctttattaattttaacacgctttcctccatctcttatattattttgggcatttccaacaattctagtttgttcatttcgaccatgtctgcagtagtcatttcatgtttcccagctatcagcccctttctgcttatgagtcgtgactccagagtatccaggctctgttttgctgggaaaaggaatgcaaactcccccactcttaagagaaaggtgtgaatggtatgtatttgcagtatattcattggtttattcactcaatccctcagagtcctaggtaaaatgtgagtggtttaccagaggatggtaaacaggatgtggtgagcatcttcctcaaagtaaacaatgttgtgattgtaattgcaaagaagtatgatacagttatcatgtatggacttctgtaatggacgttctactagtgcttgaagtcgaagagttcagaatgtatgtaataataaacaccaggtcctcaaacagtctgcttcttatagacacatgtagaagggtgtaacttaaaagtatcaatgcaagtttgctagaaatggagtaggcatggaatattaggaaaaggtgggtggaaatggaagagcatgtggcaggttgttactgaatctgaaggcaatggggaagggaatttcagtccttgagtaaagatttgtgaaggtaggcatgagttttgtcaattttatccttagaatggcaacagttgtttaggtgaaatacagtattttgtggggagatgagtgtgtttaaggattttcaggtagaaatggccagattgaagtgaagtggtgtacaggagagcataaaattacattttaccatattttaaaaaatcatcatgtgattgtgataattgaaaaagttgagaattgcatggaacttggattgtagaaggcagagttttctttcttttgtgaagatgaccatattggtaagtagaggttttcaggtgcatgctcacatatccaaagctatgaaattactttgtagtggagacttccattaaattcagagcactggaggaagaaccatttgaaagggcaagggatccatgctgtgcatatggagtttgtggctcctcagttttcaaggtgcacagtgagtattggcttagtgttgttgttcagtcactctgtcaagtctgaatgccagctcatggacggcaacactgcaggcttccctgtccttcaccatctctaggcattgctcaaactcatgtccattgagtcagtgatgtcatccaatcatttcatccttagtcgtccccttttcctcctgccttcaatctttcccagcatcagggtcttttcaaatgagtcagttcttcgaagcaggtgccaaagtattagaacttcagcatcagttcttccaatgaatattcagggttgatttcctttagaattgacgggcttgatctccttgcagcccaagagactctcaagagtcttcttcaataccacagttcaaaagcatcaattcttcagcactcagccttctttaggatccaactttcacatccatacatgactactggaaaaaccatagctttggctagacggac

SEQ ID NO: 51308 - DNA, 816 bp, Bovine  19866880594305
tagaccacgaggacttaacaacaggcaaaacagcagcctacccagaaaggtgagccccaggaacagcacagagaacttaagacacagtcatcaaggctgcttgagccaggcaggctagaaggggcatccagcaatcctctgacctcgaacaggactgcacagaatcccatcccaagagggaacaggatctgcctccagagaagaaaagctcgccaccttccttggcagtcttctctgtcaccgctgctccctaacgtctcttctgggttgctcatgctgcagccttagctgttttcacttcttttcctgtgctttggctttggaaggaggcagttgcagacagcttgagcacgcttctgagggaattgaaagcatcgttcaagggagccaggaaagggacctttcctcctcagtaacctcccagagaaacaccggtcctctagtgtacagcagcagatcagggctcagtggtatgcacgtacttttgttcatgttcccttagtctactccccccttctcaataaacattgtctttcacctcaggccaaagggctcagtgccccagatgtcaggggctgcttcccttggaaaagccaaactcgcaaggtcagtgggattgtcggagcctagacccagagctaaagggcttgtttgacatcctgtttgagggcgagcatcgagaactagacccggctgacaagctgggatggggtcctcctgtcatttcagggttatagacattattagggaccccttgtttggtgcaggtttctgaacccccagctaagaaagtgctccattctcttagatgctgtg

SEQ ID NO: 51309 - DNA, 2431 bp, Bovine  19866880613162
atagtgaatggaattgtttcccttaatttttcattctgttttttcattgttagtgtataggaatgcaagggatttctgtgtgttacttttatctcctgcaactttactatattcattgattagctctagtaattttctggtggtgtctttagggttttttatgtagaggatcatttcatctgcaaacagtgagaggttttactttttcttttccaatctggattccttttatttctttttcttctctgatcactgtggctaaaacttccaaaactatgttgaatagtagtggtaagagtggccacccttgtcttgcacaactaattttcaagtgagaaataaaacaataaaacttcagtgacatatgaaaagcctttaactagtatttgaggaaatgcacggaaaataatttccttttacagaaatggaactcaggagaagatttggaggtctgtagaggcatctctatgaggcaatagtgctatagcttctactgctgtaattgaagccacaaaaggaaaatttggttcaatagcctgcatgatataatgataatagggaaggcagcttcagctccttccctttagctcctctcaagcttaagaaattcatatagggaacttccctggattccacactcccaatgcagggtggagcatggtttcaatccctggtcccgcatgtagcacagtgcagccaaaaaaaaaaaaaaaaaaatcatacaggaaacatgtcctagcacagaactgttcagctcacagagaacctgcctatattcaaagacagctactttgtttcagcaatacatttagtgttatcattatgccaagaaatgaatagagttgcaaaggagacaaaaagtagttgtcagtcatactgttctttttttttaagtatttatttggctccatggggtcatagtattagttgcatcaggcaaactcttagttgtagcatgtgggatctagttccctgaccagggatggaacctgggtcccttgcataagcagtgcagagtcttagccgctggactagaaggcaagtcaatcatactgttcttaaaggaagcacaaagttatgaatgcctttggagggttggtccctcggttttctgctttcatactgtatcttcctctataatcccctttccacatctctcccaaccctgatgctagataatcactaagaaggacagaaggaccctgctgatctgtgacttgtcattctgtatacacaacactttttgagtagcttacaattgcatcagcaaagactgaattttgcagtttcagaccatgtttatagttaatgttacttcagtcattatgttggccttccaaggtggcattagtggtaaagaatctacccacaatgctggagacctgggttcaatctctgggttgggaagatcccctggaggaaggcatggcaacccactccagtatttttgcctggagaatcccatggacggaggagcctggtgggatacagttcatggggtcacagagttggacacagctgaagggattttagcatgtatgcccagtcattatgtaaggtaggataggtttatttattttaataggtttataaaagactagtgctatggagaaggcaatggcaccccactccagtactcctgcctggaaaatcccatggacggaggagcctggtaggctgcagtccatggaatcgctgagggtcggacacgactgagcgacttcactttcacttttcactttcgtgcattggagaaggaaatggcaacccactccagtgttcttgcctggagaatcccagggacgggggagcctggtgggctgctgtctatggggtcacacagagtcggacacgactgaagtgacttagcagtagcagaatgtgaaaagtagaatgctgcacattctgctgattacaaagagtaatttggggatttaatgacatttaaacatttttacatggttttccagggaattcaaaactcctttggaattataacatttgttttaagccgcaggatgacaatatacacagcatggttaagtattaagtgaaatatccacaactatttttacatgtttaaatataggacttgtaaaatagaacaaaacacacccaggttttctggggggagaagttcttatcaatgaagcgccaaagtgtaagcagatgaagaggctctgtctcactggcttttcattgccttgtttacattgaccgaggtggctgttgaggaaaaacagaggcgcttttgattttaccggttgaaagaacttttccagaaatcacacacacacacaaaaattaaatactgggccccacataactatttcagaaatggtatttttgtagctacgtataaataaaaccatttccaaagcagaggtctctgtaggaaatttcagaccagtgtttccattattaaatatgt

SEQ ID NO: 51310 - DNA, 1655 bp, Bovine  19866880646278
agctcccaaaggttagaggagaaagagaaaaaatacttgaagaaataatagctaaaaattctccaaatttgatgacaaatattaatcttcaaatccaagaaatccaacaaaccccaagtgtgataaacttaaggaaatctattcctagacacatcatagtcaaaaagttgaaagccaaagaaaaaaagaaattcttgaaattggtaagagaaaatgattcatacaaaggaacaaaaatgtgaataatagctgatcttgcatcagaaataatacaggccagaaagcagtagagtaatatattcaaaatgctgcaagaaaagctttctaattaagaattctatatcaatcaaaagtaaaaataaggacatttccagtgatcaacaattcagagaatgtgttactagtcaacctgtcatttaagaaatactaaaggaaatcctctgtgcctcagtttgcttttctgtaaaatgggaatcataatagtatctatttataaacttatgacaaaaataaacaagattatatgtgaaaattcctagagcacatcttggcatatggtaagtgcccagtaaatacaaatgaattgcaagtagaagagctgtgtgcatacactcaataaaccaaatggccctctgtgcatgcacccctcagcactttgccatttaccatttgcaatgaagcgataggtctagatgatctctgaatttcttgtatctcaaaaaactctgagactctgatttttaccttagttctcttcttttacatctcagtcatctcccttgactcacctcagagctgtcccacgatccattttccactctgtaccttttccacagaggacagttgttttaaatatgctccgtttacctaagaaggaaggaaaaaaattaacaaaataagaagagtggaaaatataaaaacacatacatgaaaagtctagagatgaaaagcaaaatacactggaaaatactacaccttgtagttttttcatcatccagttggcaaaccctttcccatattgtaaagcaactcctgaaacatcatttcctttaggcagacttcccaatttgattcccagaaagagttccacttatgacactcctacagctacttcctctagtgcatatttaacttggttcaacctgtcctaaaaggcaatcatcctcaatgcatgttttcctgtttagtgacttgacttaaatgctaaattgttctttgaagcctctatatgtgtagcaatgtcagtgaatctgtctttgaatttaaaaggactgtaatctcatggttagaaaggactagacttactatcaaaaagataaatctaaataaaagtctgatgccctgaactactttttcagactttatgcctgctgctgctgctgctgctaagtcgcttcagtcgtgtccgactctgtgcaaccccatagacagcagcccaccaggctccctcattcctgggattcttcaggcaagaacactggagtgggttgccatttccttctccaatgcatgaaagtgaaaagtaaaagtgaagtcactcagttgtgtctgactcttagcgaccccatggactgcagctcaccaggctcctccatccatgggattttccaggcaagagtacggaggggtgccatgccttctccgactttatgcct

SEQ ID NO: 51311 - DNA, 1310 bp, Bovine  19866880701078
aaatgacagataacaagtaatacagtttttctcccaatcatacgaagttgaaaactattaatagatagaataccgtttaatggtgcacttaagggggtgagaccgaagaagagcaaggatgtgactgtgtaagtctggagagtggttggggatgctgatgggaaggggcttctagaggacttctgaggtgctatcgtgttctgttttttgacctgttttttgttctgttttttgacctgttttttgagtggtggttatgcaggcacttgctttatgattattgccaagctatgcaattatgtgttaagcactttatgtttgatatgagaacacatgaaaatttaataccaataagccctttaaaatgttcatcttaatttaccatgctgttactcatcatcattgataatttgaagtgagtgacatcagtttttcttttatggctatcaaatgcttggagagaaggcagacttacagagaaaagctttagatgtgtacatttttattggtctacaaaatgttgtggctacttacaagtggaggactttttgatacaattcaaaaggcagtttttaaattccagtgaaacatttcatcccttggttagctgtgatcaggtgttcttaggttgctgcacagaagagcgtgtataaaatggaaatcagcctatggttttagttgtgagggctacaggaaatggggtgaggggtgaggtgttgattctaagaaaacatgtggtctctcaagctctgataaatcagggtgctttcatttttctaaaagagacttaatgttttagttctaagatgtttttgaaaaatgaagcagctcataatagacctgtagtttaagatgtttcagacttaagctgtgcttattacatgaatatgctaatgaagcagccagtctccttccttttggaatggtagatgtaaagcaaaagataaactaatttctgacctgagaaaagacagttggcatttgaaaattctaattgcagtgtggtttggttttctttctccactcgaatgtgaacttggataatgccagaataaagctgaatctataaatattacccaagatttaggactcagccatactgttaccatgaaatctgttggccacatcaccacatttctgagaaaatacatggcttttttacattttaaaaaagttagcactaagaatccatccaagatgcaattgtttttgtaattagattttttcccttaaaatactcttttgagggcaaaaactgtaacagaacagaagaaagatgttttaggatatatttaaagactaactttttc

SEQ ID NO: 51312 - DNA, 716 bp, Bovine  19866880721507
aaaaaggaaaactgagtggacagcatagttttttctattaagagttttaataacagctccttgatggtcttatgaatagaagagctcccctttattttacaagaatatattttaagcaacagcagctttcacatgacactccttgcataatgatttcaaaagagaaaattgtgtttatgttttgggatagcacttaattgccaggaacataagtaaagaactcaaggcagcattactattgaaatctgaaagaaaacagaaagcttgcagtcccattactgcagtgcaaggtgattcataattaatataattaataaagaagttaatatcaaagcagttgggtcacaagccccaccagcctaaattgttgatctaatttagctaataaccacttttccataaccactcctattacaggcagaaaaaaaattgataaattcacacgggccacaccatataccttcatcaactctgcaaaggcattttgtatagtgcctgaggaaggactttgaattgattgtctagaacagaatgggagagagaaagaaactaaaatggaaatctgcaattacagctcaaaatatctttagggaagcaaatgatttcaaagcgcaaagcatgggtcagccaccctggatgacaaatgaaaatggaaaaagacttctgactgctggcacctctcacaattcacagaacaactctcatctcccccggtc

SEQ ID NO: 51313 - DNA, 1257 bp, Bovine  19866880763995
tttgggaatgctctgcagtcagtttatgaatccccattttataagtgcccttcccaagcccatgggagtagctgaaccctgggaagggcccaagcagccccctgccacaagaagcaaggtcagctcctaaaacagcagcagagccagctccctggggcaacaccggccctgtttgggtaaaggctgcaagacacaattgcatcattccttgggttacagtagacatggcgagaccgagacatgggttcagggcagcactgactttgtggtcaggtctgcattaactgctccttctgagaaaccagttcctgtggctgggaggcccctggtcctggtgtgttcctgccgagaaaggaggtgggggggggggaggaggaggaggaggaggaagcagaaactgcagcagaaaaaaagagaagattctgaaatgggtgcgggggagggtgagtgtgtgtgtgtgtgtgtgcgtgcaggcgcgtgtggagaagaagagaagtgggtggggaagagcaccgaattccttattgttcgtctaaaggatacttgagatgaaatctcaggaaaattgtgaggatgaatttgcactctttcacacacaccgcctcaaattctgccttatcttgagttttggtaggcggaatgctctgctctgtgaaatcaagaaaacaccctgctttcttgtcagctctcggaaggttgggctttcgaaaatcccccaaggagagcggaaaggtgggaggtcctctagcatgtgaagtgaagtgaagtgaagtcgctcagtcctgtctgactctttgcgatcccatggacagtagcctaccaggctccgccgtccatgggattttccaggcaagagtacgggagtgggctgccatttccttctccaggggatcttcccaacccagggattgaacccaggtctcctgcattgcagacagacgctttaccatctgtgagggggctaccaaattattctccagggccccagtggtttccacgactccctgaggggagcaggagggtaaaactgctgctaagatcagacccagcgggattcttctgagggatggaagacactgataaccaactgcgactgcctccttctctgtattgaggagagtatgttgactttagcccagatcctgatacagcctcagggccacagcctgtccagggcccatccttagccctccctccctggttcccgcctcctaccgggttgaagcagtcacgagctaggctctgctccaactctag

SEQ ID NO: 51314 - DNA, 986 bp, Bovine  19866881088400
ttttttctctgtgctgtgcattctgtatgatttcttcacgtataccttctaattctgtaattttctcttcagctaatctatttaatccagttttcttgttacttttacttttagaatttctgttatgttccaattatttattgctacataaattatctccaaacatagcatcataaaccaatcatttattttgctcatgattttgtaggttaggaattcagatagagctcagttaagagattctggcttagggtctcttttgcaattgcattcagacagtggttaaagctggaagagcagaggactagagaagtgatggatagccagatagctctccttatttatgtagcctcagaacctctgcatataggaattttacatgggcctgacaactcctgggcagttgaactccttgcatggcagctcaggacttgagtacaagtgatccagtcaacaaaacaaaaactgtctcacatttctgacatagcctcaagaagtcacacagcactacttataccagattctattaattacaaatgaatcacaaccatattgctcaaggaaagaggcacagaccccacctctcaatggaaggagtataaaagacatgttgtaagagaatagcacatgggatggaaaatattgttgataccaactataagcaatgaatttgaaagatacaatctactgtactgcatgattttttttcaaatcccttctttttaaaacatgatatcctgttcctacctacaagttttgtccttcctctctttttttaaacatctgaaagaatattaaagtctcttttgcattgtgtcctggattgtggttaagactccatcaagcttttgcatggctatgtttgctagggtgtcaatgggattcactgattccacataaatatttagtttaaattcttggcacagggcttctacaaaatgaggttattgtgagaatttgagactgcataggcagcacagaataag

SEQ ID NO: 51315 - DNA, 988 bp, Bovine  19866881092655
tggaaatatcaggcattgtctagactattgtctagactagaggacccttcttgagttgtctgattctactgagatctgtgccttttattgtcatcaatgatgctgcatctctagaaatagacgttaacttctggagggctgctgcacaagattcctgttcatagaaatgcaaacgaagatgctagttctgcatcaattaataaattcctcccccatccttgactggttatatatatggatctacgttctgtgactgtaacattttactggttcccccagtaattaatgagttaaatgaagtccaagtcacatgtacattttatatttgcatgagttacaattttccagggctttcctgatggctcagcagtaaagaatctgcctgcaatgcaggagtgcaaggagacacaggttcgatctctgggtcagcaagatgccctggaggaggaaatgcaatccactctagtgttcttgcctggagaatcccatggacagaggagcctggtgggctacagtccctggggttgcaaagagtcagacacaactgaagtgacttagcatgcatgcatgattttccactttaaataattgtctttaaccatgttaaatatctgtctcagacttccctggtggtccagcggctaagactcctcactctgaatgcagggttcaatccctgttcagggaactagatcccacaggctgcagctaagagtttccatgccacaacgaaggcccagtgcagcccaataaacaaataataaatgtatttaaaaaatcagtatctgtctcgtgcttaagctaaaggaatagagaaggagaggaggagaggagagcagggtagaaggacacaggagaagagaagagaaaagaaaggaagtcaggagggaaggactgaggcagagaaggggtgggagaggaacaacataacctaggaggaagccaaagaaaagaatcctcttgtcctgcaagcacgcgaatgcctctt

SEQ ID NO: 51316 - DNA, 1863 bp, Bovine  19866881162147
ttgaaattgatgtgtgaatttttatataatatatatacaaaactctttgcagaatatgagttacaaatatagactgggatctagacatatcctagcccatgacttgcctgttcattttcttaagtgtcttttgatgaacagaagttttacattttgatttctcagtctttatggttactgctttctgagtccagtctaaaaatatttgcttagctcaagatcatgaagattttcttcaatgctttcttctagaagctttgtctcttaaccttttctgtttaggatcataaacaatctcatatgtttacccagttttttcagtacagtttgttgaaaaagtttcctttccctattgaatttctctggatccttcgtcaaaaaactaattagctactctccatcttgatgtctaattctacttggttcgtttttatagtttccatttctctgctaagattatccatttgttaatttattgtgtctgtctcttccattccatccttgaatatattcataatggctgttttaaagttcttgactgttgtgctagttatcaatttattgcctctcagagctaaatcaacctttcatgatctgctcttgctaatggatcagaccctttaatccctattgttgcaattacaatgttaatttttgccagtagaggaagctgggggtactttgcaggagaaagttctatcctggttccagcgctcctgttcttgttcgtttgctcttgttgtatgtcttaaccactggactgcaaaggaagtccctaaggagctgcattttggtttgggttttatttccagcacctggccctgtccttggcatctgtaaaagtagtgaactggatttcattccatagggtgactcctaggaggaccaggccaaagacccttccccaagagggtcaccagcaaagaaggctctccctgacctttaatcttcgcctcttcctggtgtaactggcaggttaacctctccagaggcagccaagacctccctcttatctcctgcatcctccaagtcagcatggaaatgaggtctcccaggggccacagctgcgatgtatggccctcagttggctcttccccaagtctctcccataaggagcctccctaggaattatgcacagtcctctcaggcatcgtatcctctcagcatcgtgtcctgctcccgccagcatcacttcccaggagaaggcagttcattttctccctgaattccagtccctggcacagataaacccctgggaagcatttactgaaactttccaggcttttctcagcatgaacactttacacttctgcagtaaactagactgctagagtaaggcaaaggagttgtcagtgccacgctgctgcatgctgccaaggagttcagggtgggaggtggtgggagaggatggggtttctcatctcttccaacccaagcagaaattaggtctctcacctgagcatgccaccgttcccccccaggccagcagtattcctgctcactggtctaccttcgggtgccctaaaagatcatcctggatttctgctttgtcattttagttcatgtctctgcttctgtcccagtcattcactatgaggaccccacctctgagaccacccccctgccatgtccaacccccacaatttacaaaaggggaaataggaccaaggagaaaaggatcacagctcaaggtcacagcctgcaggtctggtgggaacacacgttaggaatcctgactcgtaacagggggctttgtcccatccactgatctcagccagaaagaaatggtcttgccactgctgagggcttatgccgagggccctttcctgggtcctggatgatgtgactggctaacacataaac

SEQ ID NO: 51317 - DNA, 734 bp, Bovine  19866881206288
ctcttattgtactttgtaacccttagtctcccctcaaacctaagacagagcacctggtcaaactgaaatgagaaagaaatcacctgaagatcgaaaatcagagaatcaggtaaactgccagttttaccatttccacaaggtgataaacaaaagagagagaaagaatcgagaaaagatactttttcagtcatcacaacagcagcgagggaataaaaacacgttttccctggagagagattacctcgaggggaccagatacagacacaaaagataattccccttggggcttttcttttcctctgagtttgtgagatctaaaaaaataaaaattaaaaaattaaaacgtgtatcacaaaacaatcaccacctcaacacatttacttctcttttctcacctattatttctccaaacgttatagatactgcgtcttcagtaagtaaactgaccaaaggtctattccctattgatcacaatcttttcaagatttagatgactccttttagactacaagtaggaaccgacttctaacttcggttcccgagctcaaagctcggtaaagtggatcttcaaggtttagcaaataccctcagctgaactaaagggtacagaatctctagcgctccctacagctcagagtttgaacctacctaccacaaaaaaaccccagttatcaaagattggctacctcgctctacttttcttttccgcttaaaaaatcggatggggagggggg

SEQ ID NO: 51318 - DNA, 828 bp, Bovine  19866881267368
aactttttcttaaaggataccagaaacattgctggatataatttaagattagtgttttctctttcatagaaagaacgtacatactgggacatgagtacagttacagcaagtctaggtgtgctaacaaaacagggcacattcaagtacaataagattttgcttgaaattaaaaacaaactacatgagattaaagcattaaaatcatatttctcaatctgaatacatgttaaaaaaaaaatcaaaataaacgcagaagtgctagctcacatttttaccatattacaaaagcaattggtacccacgtccataaaagcagcaacaaagctgcttgtctattgaagagtagtactactgcaagttggactgcattcaatgctagttgtaaaaacaccagctttttttttcagaagttggtatctgtacaaaattgaagcttattttcttcacttctgtcccttcaaaagtctttacacagtaatgctaaaacacccagctttgagatcctgagtcaatatattgccactttctttttggtagcttgagcttcatagtgtcaactgaccttgtgtatccatttttaatacagtctcttcctgtagcatgggcaaatattttaaatcttcaaaaaaaaaaaaaaaaaaacccaaaacgttttaagttatgatgttagaatggcaggactttttctttagggaaggtattcagttgtgctgcaatgtattagattctataggtggagcagagtcatatagtgtatctgtatcatgtgtaggctcaccagctaacgtacaaggattagacaggttccagcaccacagcacagaaaaa

SEQ ID NO: 51319 - DNA, 1592 bp, Bovine  19866881529524
tgggcgggtgcccaagaatatgcaccgcgggacgagtttccaggtgccgctgctgctgccatcactgggcagggaaaccacactttgagaatcactgctctaggaagactgtcctcattccatccttgagcccaaaggaagttcaagcctttgtttaaaacacccagatcatcacatggtctggtctctctctattctccctccttcttccgaccatagagtctgtaagaccaaccctgttgtcagtaatgctgatggcctttcctggggaatcttcgtattgttatcagaccatttttctgtccctgcaaagactccatccacgtggggtagctgtgaagacaggagatgagaagagtagcaaagacccctttcttaacaaagctatactgaacacacgtttccaaactctacatccaggaggctgtgtccttatccgtaattggtagtaaccacagcagaaaactcacacagggactctgaatgacactggtggagaatacaggcctcctgttccagccaggacttggaacaatcatacaggttgtgtatttattcagaccttgccatcttggcaatgaagaagttttgtggagtaaatgagcagaagatggagaacttttctgctctgtgtttataggttttgacatttcccaaacgatccatcttgaggtctcacatcaagcaggcaagcagccctttgacactcttgttagaagtttcacactatttattttttgccctgggaagcaatctagttctctgccattgaggctgtcaggcagtaacagagtgcctgagctcactccgttgtttatggggctttctctgaatccccaggcctttcccatagatgagaaaaatcagtggaaaatctctcagcaacaagcctgaatggcccatctgtcctcagctgtccccaactcactctttgtttagtgtccctcacatcgatcagctaggctctttctactctgggctgctcagtcttacctggacgtttacactcagttaaaggaactttgagaggagaatggcccagacggtgatggacttacatgcatgccttcccaggaaagacacagggaacttggaagatcttatctagagaagggtcctctgggggacaccactctgccttcagatatccaagcagctaccaggtagaaacctcttggtcttgcttcctgtgctccagagggaaatcctattttgtcaatcaggctatttgctggggttttttcttctccaagtgggcttccccagtggctcagtggtaaagaatccgcctgccaacgtaggaaacgcaggagacacaggttcgatccctgggtcataaagatcccttgaaggaggacatggcaacctattccagtgttcttgcctgggaaatcccatggacagaggagcctcagcaggctacagtccatggagtcataaagagttggacataactgaatgagcatgcacacatgcttcttcttcaggcatctaacctttggtgtcccgtggagctttcctctctctccccctccctagctaggaaatttcacttcttcttctggctctaaatgtcgtctgtaggctgatga

SEQ ID NO: 51320 - DNA, 702 bp, Bovine  19866881681163
aattgatttgtgggaaattcctcctaagatgaaaagaagtccctaagcaaggcagcttaatacccaaacataacaccaggcaactgagagcgtttaaattgagttatgtggtcatacaagcatagctgaataaatcccaaatctttgctgggcccctgcctcctatgtctgtgccgaaacgggcaccagcagactggcaggcacagcagagggctgcctgggcccgtcagcagtgcagctggaatgtcccttcaaagggcctccttagccaagagccttggcaggcctggggccagcaagaagggcacagtgggctcttcctggtgcccaccgccccggactgtgtgcctccactggctgagagcactgcccaggctctgagggaggccctgggaagtggctgaggccctgcaatcaggtgggtggagtttggaacctctgttctttgaacgtttatgccaatgtgacctaattggctgagcattaggctggagaagctagatattcctgtttaaattcaaacccaaaagacactctaagggggtgatttctgaggggcagtggtggtgggaaaaccagcccacatttgctttgtctcccatctcttgtggcgagtaaaatgtttcggtctttcccaggttgtggggaaaagatttgggaatcatctttggctttctggcaggtttttttttttttggccac

SEQ ID NO: 51321 - DNA, 1099 bp, Bovine  19866881696649
tagatgtgtacagctatttaccatttcttctgggagggtggatgttcacattcatatgagacaaaacaaatcaagattcaactagacaggctgctgtggactttgggaattggaagagcaaaaataaaaataaaaaacaaacccagcaacatgcaacatactccagtaaatcacttctcctttttgtcttgttcttaagaaagaatttaacaacctcatctgtgttgtggacatttttatgtacttaccactgagttttaaaaagcatgaacaaaatatttggctgaactggcctctagactggaagctagatagtaatcatggtagatcttgctcaagattcaatagtgagtatatgtattaatacatcatttcatctgtccaacaatagctgttcccttttttcttgtctttttgagcaacctttcagaaaatttcaaaattttaccagattctgtaggtttcactacttaagaccaagtgagatcatttaaacactggggatgagagactatttctttcaattcttattcaaattctgaccttcccttcaacatcccaccattatgttctttctgaacctcaagagtgcattgagtttaccttcctcttctacagcttgtcttttagatatgattcacttgggaagaacctagaatccttctacagcagatatcacagactttgattcagatgttaattccgagcattttgttttacctataaaggaattaatgttatttaattccaataatattagaacaatattattgttcaacaacagtgaacaacaatattgttcacaaataatgttatttaatcctctcaatgtccctgtaatcttgggtattataagtaccattataatgaagaagaaacagatgaaaagagttaggatctttgcccccaagagatgaatcacaagaaattgctctctcctttaatatagttctcctggtccagttacctaataggaggcctttgttaaaattcctcctggtcttacatttataaaaacacctttatggattgagcaaacttccaggaactttaatgggaaatctcctaatgaattccttgaagtgccaacacagttcag

SEQ ID NO: 51322 - DNA, 1190 bp, Bovine  19866881707503
tggaattgatcatgtaccagtggtatcctagaaagtaagaagaggaaagttactgtgactacagtaagtatagaagataaaggtatgaggatttggcagcatctgggtacaggacaccccaagatgtcacaatgaggagtgtttgctactgagaagaggggcactgggccagccttaacaatgactcaccctctgcaaggctcctccagctataagtggtacaggactgtgatgaaaattatacctgtcctgcctttggaaattgccagcctgctggctgtaaaaaacactgctggctggcttctgttaagaaatgtccaaggtcctgtagtacacagaggaactgtttcacaattagtgttgaccttgtgtatcagtcaagaacccaacttcatgttgtgttaatccctacgattggacttagtgcctgaaactctgcacaagtgggaatttcctttggttacttttaccttcctggagaagttaagaataatgattaggaacatagactgtagagttgaactagatataaattctgggtgcattaactgctagctgtgtgtccttgggaaaatcacctaaactctctgtgtcatggtttccacttctgtcaaatggaaataattagtatcaacaacatcatagagctgtctaaggattagctgatcctcaaaggctgagtcacatacaaagcaggaagaatacacagtagttattcacaatattacttactcattctcaccagtgataacaagaatgttctaacaacaggtttcaagaaagaaaaaaagaaccacacacagcacattgggaataagaaaataatgatagtgaagaagaaaaggaatgatgcccacaaaattaatttacacttagaatgtcatgcagacatgataaaggcatttctagacatgcaaagcctcagaacttttcactctcaagtggtctttctcaggaagctgctggtatatatgtttcatcgaaaagaaggcctgggacttccctggcagtccagtggctaagattcttcactctcaatgcaaggggcccaggttcagtctctggtcagggatctagatcccaaatgctgcaactaagagtaagcaggctgcaactaaagatcccagacttcccaggtggtttaagtggtaaataaaccaccccccacctctacgcaggaaccacaggag

SEQ ID NO: 51323 - DNA, 938 bp, Bovine  19866881721792
tgctgagtatatcgctcgcccatgcccttgcctgcactgttgcggttgatgatgcgtccctctcaggatggttgaggggaccgggtgagaggacatgtccagtgcccagcacagaggctgcacccagggcctgagacagatcagtgctggcctccccatctcacttccaggctctcagagctgaactccagaggccctgtcactggggccccatttgcgaaggcggcaccagacagactgtgggaatgagcttcacagcttttgtcaaagtggcataataaagcccccaagtgtctgctctctgcaaactgggatggcagatcaattgtggcataaacaaaacagcaggcttggtgcgaacccggggacagattccgcctctgcagagtgtgagtgggggaagggggaattctctgggtggttgggtttgccttttctctggctgaagcttcaaggtccttctccagagccagcctggctccccacagattgccaagagtttggggggactgttcttccatcgtgggaacatctggctaggcagcagtaccaggcatgaccctaccgccctcagcacccccagaactctgagcctctaggtgctgatggggaaggagggtggaccgtgccccctccaccctgcctctggagctgagctgacggtgggtctgcaggaaagcaaagggaggtgaagtgggcatgggggccagacctcaggaaaaggccagtgagagggaccctggcgttgggtgtcctctgtgatgtcagggaacctcctacctgcctgtcctcttcattttcggcagaaagtgccatagccagccatgcatttggtgtcatttggggcctggagtcatagccacgaggagacctcaggcccaggtctggcccagcccctgagtggaggcagcagggaaaagctctgcccctatccaggg

SEQ ID NO: 51324 - DNA, 1652 bp, Bovine  19866880354909
ttcattttacataaacttggaggatttaaagtcatttcagactttcctccctgatcatatgcttaacatgccttcaatgtgaacaaggagtttatgagtcactacatgaaaaatttcaagatattatcaatttttaaaaattctactaggtaatgaaaaactcattcatccatcctaatatgatgcattcctaatcattctaatagagttacctttttcacaattattgtacttgataagtatccatttttgtaggtaacatgcctataattactttaaagatacaaacccctatgaaaaagtcaaataaattaaaaataaataaaacactacactaacttttatttgacactaagatattaatttattcacttcctatttcttcttagatctcagacacaaaagcccatagctgattgacactattgaagactaagatattccctatatttcttttgaaaaagtgtactccaacacaatgttataagcatgaactgagttagagttagactatatttggacaaaacaatttataagtattgacaaaaaaatttcatatcaattgattgaatctccacccttccccccagtgtttttactaaaatcagtttaggatgcatataaagagacttctgagttcccttgctatttcatcataatattctctgaacagcaaattaagctttctattctaatccttatcttaaacccacttggtagttttgaggaaataccatagcatttttcatttcatatgtaatcaaataatgtactagaggattaatcaattagctggttaaaaaaattattagtaattaacatatgtactgaaacatgcctaagtatatcacatttaatagagaaaattcagagaagtcttccaagcacagcagtcaacaagtataattctttaagctgttttggtttactgaaagccatgaggaaaaacctcttcatgaatcagtttttctgtctgtttaaacaaaccagacttgtctcaacatgactatatataaaaagtcacactgatttaccagatgaatgtaaaagactttaaatctacagtctcatgaaagtatttttcaatataatatttggtaatgataaagtaaaaataacaaaacatcctgttttccttatgattgtcattataatttcatgtgcaagttcactaacttaactggcttgatttagcaaagtaccaaaactgcaagagcaaaattaattttttttcttagcaaacaaaaggttgttttttatttctttaattttttaaaatgatgtgatagtcataagaattaatgtagaggttgtaaacgaagcacatggtttcaaaaactaagaaatacccaagttcaggatgaaaacattttatggtaatctttcttcctgtaggcagcaattataatatggtctcacagtatttgattaaatttacctgtctctgtctggagaataatggtcatccatgacacggtgtctatccattcggttaattgtattataatgtcctatagcagagcgtgtccctcgaagtccctgctccacatttcgactgaaatagtaagatccattaaatatcttaataaaccataaattatactaaaaaataaagttttttaataaagacagtagaaaaagacaaaagatca

SEQ ID NO: 51325 - DNA, 1709 bp, Bovine  19866880391760
atagacttagaaaacaaccagtattaccaaagggaaaggatgagggagtttcccaaaattaggagtttgggattaacatagacacactactatttataaaatagataaccaacaaggaccaactctacagcacagggaactctactcagtactatgtactaacctatatgggacaagaatctgaaaaataatagatacaggtatacctgaatcactttgctgtatacctgaaaccaatacaacattgcaaatcaacccaggaatcgaacccagggcctcccacattgcaggcagacgttttaccatctgagccaccggggaagcccctgtaaatcaactaccttccaatataaaataaaaattaaattaaaaaaccccagttctcagagtccatacatatatgtgtgcgtgtgtgtacatagtcctttaagacaatggtttccaagtttgagaaacttcctgtgccagtattctcttcattattccaaccaatgctctggctttgtgataaatttaaacagtcttcatagtaacattctcaaacatttgagagaaaagaagaaatatttcttacaaatcccttgaaattctagatgaacatcatttagctacttctcatatcattatgagatcaacagcatcgagattttgtgggtataaacattctgcacaaatacacagcaagatttaagaattttatgtacatttcaggtccaatgccaataactatacaatatttataaactgtgtgcatttcagcggctttattcatttattattcattcactattcacttactcattactcatttatttcttaaccacagtgtgatgagaacaaattaggcatgcatggaaaatagagggagtctcttaatcacaatgaagtctaattcctatttgttcatgtttcttctttttctttattggctaaagcttcacttatttatttcaacatacatacgagaaaaggcttctgattaccattcagtttaactgaattgtacattgattgtacatcagcagttatacactgcttaaactggtgataccatgctgacataaaaatggaaaatggaacatctttcatagaaatttggcttaactgtctggttgacttttaaataggcatttggtttttcattacatattaaggcataaaatttataacaaagttacttaaagttgttaaaaatcaaaggcagtaaagaagatgaagattatcttaaagcaataaaaattgcaggattttaaatagtatattgcaaaaaaaaaaaaaagcccgtgaaaaacattcatggtatacagatccaggtcaaacatcacctagattgggcataagtgaattgctgcctgaaggaagttctatttggagctctagtacattaggtaaacagttcaggctgtgtgcaaagtggccgacgtgggtaccaaactaagcaactcatcatcagctgactcccgtttaaggcactcagtgttacagacaccttgaacgtaacagtttgtctgtcttgttgatatgaaacttcataataggaagtaacaatacagatgaaacatgttttcctcctaaaatccaattcaaaatggttccatctaatatgctttagttatactccccaaataaggtgagaagctcagatctaacaagacagaggcctcaggaagaggtcaatttgtggtgtcatacagaaattctctgagata

SEQ ID NO: 51326 - DNA, 2156 bp, Bovine  19866880417584
tgtagcctgcccggctcctctgtccatggaattctccaggcaagaatactggagtgggttgccatttccttctccaggctatcttcccgaaccagggattgaacctgggtctcctgcattacaggcagattctttaccaactgagccaactttaccattcttgcctggaaaatcccatagacagaggagcctggtgggctacagtacatggggttgcaaagagttggacacgaggttaagcaactgaacatgcatgcactataccaagtaggaactttttgtcaggttaattattctaaatatttatagttgttgagaactatttgaagctcttttggtcaatgaagagatgaaaatgtttttagaataagcttaattcttttaatgaagattactaactgtgtaaaaaagtgagcatagtagctgtctaaatatttgaatatttgtcactcctcagtttaagtgtttataaaatattattttatgttagcattgtgctttattcattatgctttacatttactatatttaaagcctttcactaacattttatgtttttcagtaaattacaaaatactaaaaatcttagtgtatggataactgtaatcttaatatttccaccttagattatcgacacaatggtcgggatcttcaaagctcaacattgtcagtgccagaacaagtaatgtcatccaaccactgttcgccgtcagggtctccacaccgagtagatgttataggaaggactagatcttggtcacccagtgtccctcctccacagaggtaagacagcataacattttataggatgatattataagcctatttatcttaaaatattattagaaatttataaagataggttcttacagaaaaaagttatttaggggaaaacatatgtgctagtcaatagcctatataatgagagtaatacaaaatatgggctattttgtaactttggatgacctaaatatgattttattttaagttcatagtcataaagaagatacaaattccagtctcatatatatattgagcagatctagttagacccaactaattgtactcatgaatgatattgacattttaagaaataggaaagaataaacatttgttggagcaatacaattaagaacaatcatgagaagactaaaaggaaatgcatgagcagtgggaagaattgtttggaaatctacaattccaggacttatatttagaggaaaattctaatcaatccagttaagttatagaaatgcttattggagtaagaaccatggaaatgtttccgaatcaatccaattaagttattgaaaggcttattagagtaagaaccaaggaaataatgtttctgaacaggaaatatgtgcataatttcacattttatatacttcaatgtttaaggcaatttgaacccttagaattacaatcttagaacacttattttaaatgagtaatggagttatctttagatatttaaacttagaattttaggttgtcatcttaattttatacatggcattagactgtctaagagaacaagatttattatatttataaatttaacttatttaattagaaggatattaagtacttaaatgtttatttagacaattaaagagaaaatttaacattaaatttataaacatagtttaaaatatttgaaaaaaaacatttgaagatttaggtaagattgtaaatgggactaaaattattaaaagtcttctgaaaagtaactttaaatgtggtagacttatcagtagaatattaagatttgtaatctgacatttaaagtgcaagagagaataagattttaaatttgtagttttagtaaattaaaccgtttctcataaaaaaaaaaaggaattcttgacttatcaaagaatgaatatttgaacacaccagtagaaaatagacatcgattttagattagattcacctgcacttaacagaaagcctgtatggaaaagaatgtgcttagtcactcagtcatgtccaactcttgggactgcatagactgtagtctgccaggctcctctgtccatggggtactccaagcaagaatactggaatgggttgccattctctcctccaggggatcttcccaacccaggaactgaacccaggtctccttcattgcaggcagactctttaccgac

SEQ ID NO: 51327 - DNA, 1290 bp, Bovine  19866880472982
cttccgtgaggaatgtattacacttatatcactattgattatgccatatcaaacatttcataagaccaactgatttatacttttgttcaagttttgcattaactgtatagatttctttttactttaaatttatcactgaaattcttcttatttttttgtaggcaaatacagaaactcgaccagaattggctttatttatgataaaatatctgatgacattaattgttggcatctctgctgtcttctgggttggaagcaaaaagacatgcacagaatgggctggattttttaaacgaaatcgcaagaaagagtaagcatctattgaattatctgacattgttttaaaataaatagatcaaataccaaggaactattcaaatcatcactgtaccagagtttcattatattacctggtttttcaaagtcttttgaaagtcttgaagttttttttcatggagagagatgctttattttagtatttgttacagtagtctttgacatatactattctattgaaatataaatacaaagtttgtaaaatgtacattttcttttcatggcttataatatatccagtattattactgctatcattgaattcattgttttgggttcagcattgtaaataattttatcctttttaatcagtgataaaagatgaaatgggtcaaatatcaatatatattaagcaacatagaatatgattcaaacgtggtatatgatcattacctttaaattttattacacatagtactgacttaacatgtcacttatttgccttaagatggtaaaaatttcaacttatggaatattctttaacaacatagtagacttacatttatgagtaaatagttaactttattatttatatatgttataaattgtgtgctatcaatgtaatacaaagttttttaactgtttccaattggtttgattagtgaacatttttgtggtaaaaattttagaacctttttacaaattaatttttgaagtctgaagaattcatttaacgggactttaatttctttgaactattattataatatctctatccctggtggctcagacgcattgcaggtggataaaaactccacctgcaatgcgggagacctggattggatccctgggtcaggaagatcccctggaggagggcatggcaagccactccagtattcttgcctggaaaattccatgaacagaggagcctggcaggctacagtacatggagtcagacacaactgagtgactaagcacatcccatatttatatgcccacactaacttcagaata

SEQ ID NO: 51328 - DNA, 655 bp, Bovine  19866880498253
ctgaaaagaagaaacgcttattgtacctgcttttaaatctgagttggtaccagcatttatagttgatttatcttagccaatgcacactgaaacaaagttttaatcctagcataagaattgattttttaaatgatttcaagaacataattagatatattttttgcccatatatatagatatagatatattcatgatatagatttaagatcataaatatatacttaaatttatgagaatttcaaaacagatggatagatcagtgcattccaactctaatttagtaataacactcagggtttctgtattcttttagaactatcacaaaattttcaaaatagtctcaaaataaactttaactcacttcgatttgatatatgtcattaatgacgtctaggagaaagagatggctgtgaaagcaagtgaacaacggaggggtataaagaattcaacatcacgcatgtaagtgatgatactgaattaagacattgtagaaatgcaagattttacatttctattatacttaattaactaggtagaaaatgacacagttaatttttaatgttttcagtgcttaaaaaattagcttggcttctagtactgaatacctcagatgatgaaagtaagaaatgtatgttactttttatttgcttcctaa

SEQ ID NO: 51329 - DNA, 2129 bp, Bovine  19866880561283
tcaaaatggaataaatccaattaccaaaacaggagtagttgtagactgttaagaaagttatagattgatgatggccatattcttctgtatctgtaaaagtctgattagtcttgaggttcaccagagaaggactaaaattttgacagctggagaggagataagaagccattgaaaattagtgaaaattatggagggttctccctagcagagaaccccccaaagatatgtaatttccatggagttccatacatgcacaaataagaattacgacaacaaggaacattcattgagtgtttacttgcaataagagcaatgaactaagaacttttcttgcattagatcatttactactctgaacaacactgtgaatttattattcctgatacacagatgaggataattggagttgactaacgtgcccaagtcgtaagttatctgagatttgcatctacatctgaattaggtctaactcaaaaccctctggcccttaagccttaccccaggaattcctggtagactgtgacttgaacatgaaggcaggaattctggatttggctgcaggtgcagacctatatgacttggtatttctcaattttatgtaagagcaaaagaggtgatggttgagatgatcattttagagtgcttggcctggtgagtttaagacagtctgctgtggtgcagactatgcctgagaaaaggggattcttgtacctgagaatattggtaatattaattaaatggagagcatattaggagaccagtaggactgaagtgatagttaagataatcaagataggaggacaaaattaaagatctaggagttgaagcaggactgtgtaacaagaaacccccagtgtggctgtgcccggcacaagtgtggctgtgaaatggtgatagaaaagaaaacttaggaagatggataactgaaataaaaatattatatagttgaccgaccacctgcattaatgctaggatttttaatgctttcattaaagtaagcccttttaataaaattatagtacctagtgatagggatgttagtcttgaccattaaaccaaacctgcaatatttcaatgagttcaggtgcaaattggaattcagaggtgtccgcaatagtcgaaggagtagaaatcattttctttgagaaataactaaaggaactagtttaacttaggacatggaagggacttaaggtatttagagaactgccatgtgagaaagggtgccttattgcaggtaatctgaaaggcagaggttgggtggaaattacagggaagcagttttggcttggcaaagtgggtggtgctcagaagtgaaactggcagtgaatactagtggttcagcagttggatgacaacggctagaaaacattcttgtgttgggtggaaaggtcacttgaggtgattattgaggccccttattacttcaagataccattttaagccatcaagaatgttgagtgggcgcctcaacaaagaatgtgaagtaaaaatagtaattttctaaattaacctgaaatcctaataatgtgtagattaatctaaggaacctaagtgtagagcgcccttaacgagaatagcatacagtcaagttttgtatgtatatggtattgcaggacctgatagcataaataataacttactgactgcttgctatgtgccaggcatgccttttaagacttgctttatatgtattaactcacttaattctctcttttatgagagtttgtttctgttatttttctccattttgtgcatgagaaaactcaggcacagagtaatctagtaacttacttggggttacaaagtgttgaaatagggattcaaactcaggaagtctgattccatagcttttgctgttagactgaaaccctaaatgggtagtttggtatatctaaagggtaaaatgctagaggttgaaatgaaatgattccagaaagttaagcttccagattgacacatcttttatgccatgtaaaaatggatgttaggaatgagatcaggactgttggttcagttgctaggtcatgtctgactctttgaccccatgaattgcagcacaccaggtttccctgtccttcaccatcttccagagtttgctcaaactcatgtccatcaagttagtgatg

SEQ ID NO: 51330 - DNA, 838 bp, Bovine  19866880667142
tctgagtaatggactatttgtctttttaatcctttcagcatatttagtatgcttgaataatatacctggaggtgtatttattctgcatttatcttaatgactagaaacaagctggaaaaagttatacagatgttatattaaaatactgctttttttggttttattatggaatatttgtgtgactctaaaatctatcatgactattcactttgaataagagaattgtcagagttcatttaattttaatctgctttatctttttggtcttttatgattgctaatcctttctttatctgttcttggtataatttgatttttgttcttatcagagtccccattaagtttcattctgtttccagtgagacattttagtatcctaaggtcagttaaaattccattgcatttatctattgcctaaaattttaaatagactattaaactagtgctaaactttgactttttaaaagtgttacatgtttaaaatattcagtcaatataattaactgtgtttctgataaaataagagtgttgtgcaggtattatgaacaactaaatattacagaaagtataaaaattatataaatcacagctatatcctcaaaaagctttagatctattagggaagatatgttatataacatttcagtagcaaaaaatactgtaagatttcagaaagatcacttctgactggagtgaaattttggatgacttcttgaaagatttataatttgagccagaatttaaagatgaatgaaatggatataggagtgcatatcaagcctagaaacatttagtagtataagttcaggaaaacagagtatgcatcagagaaacgtca

SEQ ID NO: 51331 - DNA, 1557 bp, Bovine  19866880683856
actagtccttcaacctggaatcccgttttacatagaaattcctccacagtgaaaaaacaagctaactaaatcctgtttttcctctgtgttttgttttttgctttataaacatgtgccttttcacaagtcctccagactttcacatactaatatatatataacctgcattccatcttatcaagcctcttctccaacattaaaaaaatattccccttactgttcattttaataggcaaaagttatacccctctgatgtctgtgtcaggggaaaaaggaaccacaggttggcagattctttaagaaaacaggtattgccacataagtagggtggggatgatcgcatgtgactggattgtcttcctatctggttgaggttagtatattcaagctgagcccagggatgtaggcctgaaacaatctgcttctaccagctgtgacatcagtgaattgaaggcaagtcccactgaatccagatacctgtctctggttcaagaccctttccaagttgggagaactaagctgtgcgtgcccgcaatacccatggcctagaaatgtgttcacttccctccacaggtcagacaaggttgggtctggcatcatcctcacacagggagagtcaaatggtcactttatggtctttaacaagtaaaataatgttttttgaacaaacgaacattttttgctgtaataaggtagtaatagcttattaagtacctaaaagatgttgaattaaaggttcttaacctgttttctgcctagatccaggtaagatgatatcctaaactctgatgggcatatttaaggcttaatgtcatcctctgatgtgcaaatataagtgtatcccttttctttctctcaagagagtatcggtgtgcaagaaaagtgaatcactactgaggcaacatttaattcatcttaagacaaaatctgttacgaataacaaattacttctgacattttacccagtgatcataccaaatgagtttctacaacgtggttggtaaatgctatgttaaataatttatgaagtgtgtgtaggtataggtgacagttcctgggcctgagggcttacattatagaaagatattaacataaaaactttaaagataatataatagaaagtaagttacttatataaagtgttttttatttatttttatggatttcattttttattaacctttttggagcatagttgctttacaacatatcttttgaagtttataatttaatctttaaaatttaagtatagttaaattacagtgctgggccagtctctgcagtacagcaaagtgactcagttacacacattctttttttcacattcttttccattatggtttatcataagataccgaatatagtttcctgtgctatccactaggagcttgttgtttgtccatcctatatataatagtttacatctgctaatcccacactcccagtcctttcctcccccttggcaaccaaaagtcagtcctctatgttggcgagtcgctttctgttttgtagatacagtcatttgtgccatgttttagagtccacatattagagata

SEQ ID NO: 51332 - DNA, 918 bp, Bovine  19866880722153
tagggaagcagagttacaaatgaaaagagaaagggaaaaatacatccccaatagggggaaaaaaaatccccattgaaatcagaagaggagggcttctctggtggctcagtggtgaagaatccgcctgccgatgcaggagacatgggttcattccttggtctgggaaggatcccacatgtctcagagcaactaagcccttgcaccacaactgttgagcctgggaaaagcaactactgagcccgcgaactctagagcccgtgctcttgaacaagagcagctaccacaatgagaagcttgcacaccacaactagagtagaccctgatttctgcaactagagaaaagcctgatcagcaatgaagatccagtacaattaaaaaaaacgtcagaagaggaggctgttcatatgcaacatacccccaaatcagtacagggcttcccattctttgtagggttctcactcaactgtttcgttgttgtcattgttgtttttttaagaaaattaattctccaaaaggcaagatttacttaatgaaaactaataaattagaatcattcctaatgtaacaaccaaaaggcaatctcctattaaattaattagccaaaagctatatgcttgttcttgaaaacaaacagaaactgactattgctaacttcagcagaaaaggaatttgttggaaagatagaggataggttacagattggatgggagggctagactccaagcttggaaatttgagaggagccggaaaaagtcagggagcaggaaccaggccaaaatcccactgcaagaaaggtctatttgtgatatctcagtggacatgactgccatttttgccctaggctgctgctagatgcacctccacgtgtgaattcaaaactgcccctgtataatagcttcactagcctcaaattgaaag

SEQ ID NO: 51333 - DNA, 1221 bp, Bovine  19866880805609
tgagtcgctcagtcgtgtccaactctttgcgaccccaagaatcgcagcacaccaggcctccctgtccatcaccaactcccggagttcactcacactcaagtccatcgagtcggtgatgccatccaaccatctcatcctctgtcgtccccttctcctcctgcccccaatccctcccagcatcagagtcttttccaatgagtcaactcttcgcatgaggtggccaaagtactggagtttcagctttcgcatcattccctccaaagaaatcccagggctgatctccttcagaatggactggttggatctccttgcagtccaagggactctcaagagtcttctccaacaccacagttcaaaagcatcaattctttcagcattagtccttccaaagaatatttaggactgatttcctttaggattgactggtttcatctccttgcagtccaagggactctcaagagtcttctccagcatcacagttcgaaggcatcaattcttcggcgctcagccttctttatggtccaactcttacattactactgtaaaaaccatagctttgactatatggactccctgttattaagttactacatctaagccagtatatctttcacctagactactgaaatagtcctaacagatctcactgggcttccccggtggctcagtggtaaagaaccagcttctaaagaaggagtctcggagagaagggttcgatcactgcatcatgaagatccccggagaaggaagggaatggctacccactccagtattcttgcctggtaaatatgagggacagaggagcctggcgtgctaatccatggggttgcaaaagagttgagcaaccaaacaacaacaggtctcactacttaccactcttgctaatcttacagtcaatttctctgattctttaaaatgcaaatttatccttgtccaaaagaccccaaaggaaaaaaatttcaaagtccttattaagtcctataaggccttaagttccctgatctttggctatgtctccagtctcattttctaactctttctcttactccactgccaccagactggctctctgcctctcagcatcccatgtatatgtcaggatcctgcatttgcttttcccttcatctggaacactctcctccaggtagtcacacagcttgtgtcttggctcaactgttacctcagagaggcataccctgccagccctacataaaaattata

SEQ ID NO: 51334 - DNA, 1853 bp, Bovine  19866880824852
cagtccatgaggtccctgggagtcagacagtccctgagcgacttcactttcacttctcactttcatgcattggagaaggaaatggcaacccactccagtgttcttgcctggagaatcccagggacaggggagcctggtgggctgccgtccatggggtcgcacagagtcggacacgactggagcgacttagcagcagcagcagcaacatatattaagtgtgcaataaacagttgttgacaaataatgaaagcttgtcactaacattcttgaaaattaataccaatatgaaaataccattagtagctttcagctgaaaacataatttacctatcacactcaagttcctcaggccatcggatcccaaaagtgtccattaatttcttgcaatcagaatacactttctcacaaaatttccgacagggtggaaccacatgaatttgctcagtgcaggttggtacaaaagctttgcaaaggaaagtttcaacatttggtgaacattccagatttgcaagaggaagaaaaatctattaaaaaaaataataagaggttagaaaacattttaatacaacaaatgaattttttagcatatactttttcacttagactccaaaagaattttaaatctcactctcaatacaatcaaatctgaggagataagtgtttaattggacataagaacccttcatacacagtggaatattaatttatacaattatgcatttttaaagcagacattagggttaaatcaaaagtatgagttgattggtagatgaaataaattatacaaatattcaatttataagtatatgctccctggaggaggaaatggcaacccactccagtagtcgtgaatggaaaattgcaggcacagaggagcctggtgggtgatagtccatggggctgcagagagtcagacatgactgggcatgcatgcaagtatatcttaaaatatcctatcactatactgagcatactggagaataaaggaatgtttggggcggagggaacagcatgaaaaatggcatgaggatcataagaatatggtggattcagggaaagaagttcagtattactagaatacaaggtcaaatacttgaagtcaaggatgtagtagacagagatgagactgaagaagaggttccttgacctgatcacagagagcacagatgacatgctaaattgcttggattataaaagaaggagtgggatactaggagaattttaagcaagagatgtctacagtctgacagctgtgtttgaatgctagttccacatttactagttttataactctggcaggtaacttaaattcactgtgccttagtttcttaatctgtaaaacggcaataataatagtacttgtctcacaagattgttatgaatacaaggttaataaatgtaaagcgcttagaacagtgtcgagcatatagttacgtactcaatattcaacctagtggctcagatggtaaagcatctgcctgcaatgcagaagacctgggtttaattcctgggttgggaagatcccctggaaaagggaatggcaacctactccagtattcttgcctggagaattccacagacagaggaacctggtgggctacagtctgtgggatggcaaagaggtgggcacgactgagtgactaacacacacacacacaagattgttatgaatacaaagttaataaatgtaaggtgcttagaacagagtctggcataaggtactcaagaaatgttagttgttgtgactattaccctttagggagtgtggataggttctggaaaaacacggtagactgagcacacatgtttatctcctttcccccctccctgcttccttattaacaggacagatc

SEQ ID NO: 51335 - DNA, 1688 bp, Bovine  19866880903329
caagtaatgaagattggtatgaagccaagaatgtcccctccaccatccgtaaggcccaattaaagactgtctcttgtattaattcacagtgttgccctagacacaggcattggcttctctgtgattcagtgtcctggtttctaaactagaagtaatagttcttccttcacaaaatttttgacaggctgcgatgccatgatttcagtaaaatttatcttgtaaactgaaaaaaaaaatactatctctttgaaaatgttagtttttataaatgctgctttgacttgctttatactgtgtatatgtcttgcctccctcagtggattattagttccttgaaatcagggacattatatccctactcaagcactaagcacatacagagagcactgactaaaggataaaatagttgaatggtggggaatcagtgctatatatttggaaagtggaactaggtcattgaaagaagtggagtgggtaaaaaagaatatcacagctcttagaactgttctaggggagaggcacaacttaggtaacggatcctggggtaaaataactcaggcggtttcactccccaagacaggagcccacagaatcccatttctacttgcagattttctaatagctgtgtttgatgatcatatttaatcatcaaataaatttgtgcctctacaagtgctttatggatttatgcctccacaaatgctttcttagtcttgacaatctcaatttaagtttcttattccttttggatcttgtgaagtgtttctcctcacatagcatctgagaaaacatattctattcatttacttcataacggctcccttgaactctttgttgcttccctaaccattagaacctaagatgtgcttgcaaacaggacttattattgacaatcttcatcttttgcagatggaagtgatgacagaccccactgctttgtataaaaatattttgctatttctatacaaaatattttattaatggaaaccacacattatgttatattgaaatattatgacttgaaatttgagtatctaatgttgcttgtagatctgcagctggctggtattttaatttttaatttaaatatgactgatctgaaatattaagaaaaattctccttggatcattgcatttcaaaagaagaaagcaaatccagttgtttaatgatgatgcaatcttttatttataaattgagatcattagcactcacctaatgctttctttctactaagtatattcctaataatgctaaataaaataaaggctctttataatgttaaattcaccagagcaacatagcaaagtatggaggtaagaattattaataacatgttaaaggaaaagactcatttctaaaaacagtttcaatgagcgataattatgcaaataagcactgatttttaggtaatagttccaaagttgtgccgtcttccccactgaattttgaacgcctgcaggtatgtgaaatgccttattcttattattcaccaaattctctagcgtagtgccttctacaccgttgactgcttattgaatctaactaaaaatcagtaagctctgctaataaacccacagtagataggcagtgttttgacttaaaatattgacacttgaaagaaaaatatctaagcataagaatgtgattttcctcaattaaaatgttgagatttttgacttccctgaag

SEQ ID NO: 51336 - DNA, 1225 bp, Bovine  19866880954002
ttaagtttcccaagcagactctgagcagtctaagtaaatattttacactagatagtgttaactagaacaacttcaattttttttaatttaaattaaattagcattattgaaaaccgataacaataacaacaacaacaaaaaaaaacccatgcagcaaagcaaggaaagcataatactacttttttaaaaaacactatattaacattacctttccatatagggatttcctaatgaaaagtggcaaagaacttgtacccaagtattgcagtaaaagcaaatagaattataattacataatgtaaacaaaataaacccaacacattttacttggattgtgattttgttctatcaaagtcctatagttttcgaaagttgaactttatatataatatgcagaaaattcatattttagataaggtacaaatttatttgccagtctcctcaaggagtaattgcttggaaaatgcaagagaatgtagatgttaagtgatataatgaatgatttaaagagacagtaaccttagtgtaataaaaatgtcaacagtataaaatcagctatttgtgtcaatattacagatataagtggaatctacattaaatgccaacctgaaacttctgagttttagtattcagtccatataaaatcactaacaaagattgtctctttaaatttttattgtattttaatccccatgcagaattttacaagctggctcataaaatgatttggaagtcaataatatggtttggagcaacataccaaataaagttttcctactatgcattttccaaaaacatacaaataagggttaaaacacaattttagattctatcaggcagacaaggcctttacctgaaccctaggaacaaaaggcgttgttcttctactaaggctttggctctggtaagcaaaattaaagaaaaaagcaataaaacaaaaccaaaaaggacaacacgctggaactaaaagaccaaaagtaaaaaacacatacaactatcccttaaatccatttttccatgacaatatatatctaaattaagtacttcaacataatgaataattttcccaaaattataaaacagattaagaaccatataaaatctgagaagttttaaaccaaattttttaatgtatcaacataacaggaattaagactgaatgtaaaacaatataatcgggctcatatattcgaaagaagaatgtaacataaatacgagagtcaag

SEQ ID NO: 51337 - DNA, 1137 bp, Bovine  19866881024369
aaaaagctatgagagaatagggactccactttgtgaagttttatctttcacagtgcccactaagatgaccttccttgcaaagagtgataaaaatgtttacttaatgggaacagtaagtagcataataaatgtacagtaatgtctgtggtttaaggaaattattaaaataccatagaattcattagcaaatttttaataatttgattaagagtataatatttatgcttggaaagggataatgcaagataattttcatttatagatgtaaatggatagttccctaatatctttcacaaattctgctattctttccataaataataacaaaacactagaatgtgagatgagaaataagaaatatttcacataaatttaatgattatttgtagctttaaaaacttcactgcaatagtttaacatctggagcaacatagttttaagttattttattaatatctataacaaagatgtactaaatcattcattcattcattcattcattcaaacatgtactgagtagttactagatatcaactgttatcttaggtaccatagatataaaaatgaatgagatgggtacctaccatcaaggatttacaatccaatgggattcagagaaatttaaataagttatatacaaaatgttattaatacacaagtgacttaagaatctaaaaacaggcttatatttttctgccattaaaacaaaatagtccaattagagattgggttccctgtgtcatacagcaaattccccctgcctggctatatatgttaatgtataggtttctatgctactctcttaaatcatcccacctctcttttggactgtaaccaaaagtctgttctctctgtctgcatctctattgctgccctatagataggttcaacaccagactgtatccaaaagcctgttctctctgtctgcatctctatctctgccctatagataggttcatcaacaccatctttctagattccatatatatgcattaatatatgatatttgtctttctctttctgacttacttcactttgtataataggttctaggttagaccacctcattagaactgactcaaatgcattcctttttataggggagaattatcccactgtggatatgtaccatacctt

SEQ ID NO: 51338 - DNA, 1611 bp, Bovine  19866881028795
tttactgatttgtgtgtgtgtgtcttttcccccctacgcgattataagctctatgagagcaaggatttctatctgcttggatcaccatatgccctcagtatttacaaaggtacctgacacacactaggagctcaattactattaattgaatgagtatttgtatttacctggcggctcagactgtaaagcgtctgtctacaatgcgggagacccaggttcgatccctgggttgggaagatcccctggagaaggaaatggctatccactccaggactattgcctagaaaatcccatggacagaggagcctggtaggctacagcccatggggtcgcaaagagtcagacatgactgagtgactttacttgtatttcccagtatatcaagcaaagaacttgtacatatgtagtaatcaggaaatacttatggtatgaaagaaccattttagattgcataatttacattttacaaacacttttgaaatcccctaaaacacacagccagcaatcaagctgtgacatggttaggtctggaatcaccattgttccctgacttcccacctgcctagatggggaaactgagaggtcaaggggcttgtctaaggttacaaaaaggaggacagtcttttgccttctcccactgagtgacttcactttcacttttccctttcatgctttggagaaggaaatggcaacccactccagtattcttgcctggagaatcccggggaaaggggagcctggtgggctgccgtctgtggggttgcacagagtcagacacaactgaagtgacttagcagcagcagcagcagcaaaatggaatcacggttgctctatgttctggaatagagatctgcaatttgcagaatgggatgttatttcacttacaaactgttgtgtttctgtatgtctgtgttgcttccaggtttatgttaagaggatgttacctttgaaagcctaacagtgctcattatcattcttagcaacaataggtaacacattaatttgggggggaaaagcattaaaaattcttaaaattaaagcaaaattggtaaacatcacagtccatttttttgtgttgatgctttttcaggcttttgattttttttaaaaaccttttttaccttctgttgactttttatctttttaataaagcagataaaggagaaagctaattgtaggcttttatggaacctgttgaaaattggggagcctttgttttatgatttggagaaaatttcagtattccctgtctattctttaggagcgttaataaattttaagtgagaccgaggagagggaaaatgactaccaaaaatttgagataatacccatctgcgatgcctaacctattgttttaattaacgacccttctctggccttcatcacgcggttgggggcggggaggggggagagaagcggaaacagctggagctactggaggtcgcagttgtcctgaacctgaggtgcgcgctccaagccgccagccctccgaggtgctgcagccgccgccgccgccgctgcctcccccctccggctgctgattggcggggacctcagcatcagcagcatctcccggagaggggagggcgccaagactgactcgcagccaca

SEQ ID NO: 51339 - DNA, 1315 bp, Bovine  19866881094104
ttgatgtacggcaaaaccatacaatattgtaaagtaaaaaaaaaaaaaattaattaaaaaaaaaagcatatgaacacaagctatgtttaaggaacagctaatagttctttagaatagtaatattaaacaaaatgggatacatattagaaggtaagaatggaaaaattgcttgggaccagattgtggagagctttaaatctctcagttaaaaatctagaatgttctcctttacaattatggtctttgaagatttttgaaaaagtcacaaatacaaacaaatttgtgttttttgcatataactctgatggtataattacaacagatttgaaaaggatccatttaagtccttgttaaggagtcccagccagaggctattggtatagtccaagctagacataattgttattccttcccgtgtttgattgttgcctccatctaaaatgatcttcatccaaacccaagtgatccttcactatcttctcacagaaaaaaatacgtgtagtgggcctcttccagattttcaacagaatgcaattatatctgccctatgcctaaatttgatgagcccctggagaaggaaatggcaacccactccagtattcttgcctggagaatcccgtggacggaggagcctggggggctacagtcaatggggtcgcaaagagtcggacaccactgagcgacttcactcactcacacactcatgcctaaatttgatgagtcaaggcaattatcaagcccttttagctttttcagtactattcagtctattacttagtctgattctcttaaaaggcaaataccttgaattactttattacttaccttttttttcttttatagttgatttacagtgttatgttagtttctgctgtgtagcaaagtgggtgagttatatatacacatatatacacttttttaaagattctgttcccatatagatcattacagagtattaaatagagtttcttgtattattcaataggctattaattatatattctatatagttgtgtttatatgtgtatcccagtttcccaatttatgcctcccacttccctccctgataggacctaattaatatttgaaagggagccctgcttcatatctccaatccattactttaaaaaaattttttcttcctgctaccgattcccaggatcattatcctactgctaaattctcatgtcttatttctgttacaacttttgggatgttacagattacagtatctgtaatatctatatcctgggtcctaataaaatacataaatattctgcaaaaaattatataatgagtcatgtaatatttaaag

SEQ ID NO: 51340 - DNA, 947 bp, Bovine  19866881095526
tgtttaatatcacaagtttatgctcaatttatagcttttacatgtcaatcaagatgaagtgcttctgaaaatgtttcctaacataaatgattgtaaaggtaaactaataatgcttaaaggagatctcttcaaattagttaccaggcaaagaaggaagaaccacacactgtatacacatataaggttgtaacagactgaggcaaggcagtgtttggtaattgtgtctccatgatgcgtttctctctgggccttgctttcttggttccagacttaaaggaagatataaaaactacagataggaactctagcgatggatgggatctcccgcatggaagcaggcaagaaactgagatggtctagagcctggaagattatattagttttatgttgctaccgtaacaaattaccatcaatttagaggcttaaaacagcacaaatttattctcaaatgtgatctttcgttagggtccaggtacagtgtggctcagctggttacctgctttagagtctgacaagcccgaaatcaaggtgttcacaggactgtttctttctgctggctctgggcgtgaatgctctttcagcctcatttctttcatggttctttaattgttggcaaaatttcattccaagcagctgtgggaccaaagtccccatttctttgctggctgtcagatggggtcatgctcaactttggaggccgtctgcattcctcggttagcgaagagctgcttccactgtcaaagccaccagcagctggtccggttcgtatcaggttccgagtctctctgacctcgccttctgccccatcgctccttcacgtccctcctttgatataattctataaatgactcttctgcctttctcttcttttaagagctcacttaattccactgggttcatgtggggcaatccaggacaatctcctagttttaacatcagcacctagg

SEQ ID NO: 51341 - DNA, 1634 bp, Bovine  19866881162239
aatattttggtattgttatgaatatagtttggctctgcagattctctgaagaagtcttgggtacaccccctggggtcactagagcactgcaattttgaaaattgctagactataactgctagactaaaggtagtctcccaccttatcaccaacagagtgtttgtgtattgacaggattgtagaagataactcaaactctcagttaccttgcctattttttgtttgatttctgtttttgtccttaagtttgtctatgctctgattgtcatgataagcaaatgcaaaagatctttgctgagtttactttctaagaggaatggtggggggctaagtttaatatacagtgagttgggatagaggtttttcttgaaataattctgacatcttttgaccatagcctttatttgcagagttgctgcagccattgagaaatttggtttaaaactcaggaacagttttcaaaatgtattttttaatttgtaagaaatttatagaaattttaatctttatgcatattcatttttgtatgcatgctgtatttaataatggcactagtgtgtatttctcttaagtgtttttgttttaattttgtgcaatctcttttatccaaagaatgaattagtctcatgcatctcaagatagctcaacacatgataaattgctgttgtcctaagatttgaaatacagtttgctgttaggagcattaatatagaatcgtgtggatttcttctttagtaatctgtggctattctagttttttttttaaactaatgatgcaacaaaaatagataatgtagagaatcaaaattgttattacctataaccagctatttctgtttctgtgatatatacccaagagatgcttgtatatattatgtgacacagttggaagtcttgtggtatgatttggagctctttgtctggaaaggtctttcaaggttggtttgaaggttattggtggaacagttctcactgtgcttgcctaattacacagtgcttgaactggaaaattaaacttaagggtgacctcccctctctagtgatgcggccctcatccacttctttcttttattatgtttccacccgagcatttttgtttgtttgtctgtttcttagatgttagttcttaacttgttttttctcagtaatattttcaaattcttattgagttttctatttatctaatctttaaaactattttagtcttcctattctctgtgtgagagttggtttgtgtctatagagcaggattgacaaattttagttacatccatctggaaaagtgtaatattttttcatacaaccaagactgcaagggtgcagaatatatgaactcaagattgttgtgatgtaaaataactttttcactttagtggtatagatctgaaattcatttgtataaattatttgacatggttgaaagttttgagattgatttattatttttgtctggaaagtgctaagactcccatttcttctggttgactttgcttaataagaattagagtcatgtgaatagggagacttaggaaaatttgattttttttcattgtggtggttccccctctgcctaaatatattttgatccagtgcttaagtgcaccttagcgttttgttctctcaaaaacaaatat

SEQ ID NO: 51342 - DNA, 1347 bp, Bovine  19866881165338
tggatgtgagagttgaacctaaagaaagctgagcgctgaagaattgatgctttgaactgtgatgttggagaagactcttcagagtcccttggactgcaaggagatccaaccagtccatcctaaaggagatcagtcctaaatattcattggaaggactgatgctgaagctgaagctccaatactttggccacctgatgagaagaactgactcattggcaaggaccctgatgctgggaaagattgaaggtaggaggagaaggggatgacagaagatgagatggttggatggcatcaccaactcgatggacatgagattgagcaagctctgggagttggtgatggacagggaggcctggcttgctgcagtctatggggtcacaaagagtcggacacaactgagcaactgaactgaactgaattgtctcccttgaaaccaattttcactgttctcacatattagttcaggttgtctgggagggagctgaaaagctgtgaacatgatgttgatctccttcaatcatcaaatgctcccagagccccatagcttttcagacctgtggaaataaattctctgggagcaacttccccactgactcttctctctgcaggagtgaccagccaagcgtgaggctcatggaggactccatctgtcacagggcattagcgctgtgagtacacatcgtgctcactgagcagaagatacaaaacaccctccgccgtctcggcacaagcctgagtctgacctttcctctcagagccagatctagtgtcagtcactcaacagcagcaggctttctgcccaagcacaggagcaacacagctggccctgaagatgctgaccctgcatgtcagctctgagggaagcaagaaaaagatgctgaacacaacagaatggacctcatgccctaggtcagagccccctgaatttgcccgggacatttcctgggacagcaggaccctgggacaggaggagcgtggctgtggtctaagctgggaggatacaggcccatgcagaccaataggcatctttctctgctaatgaggaccctgtgcccaacctgttggagcaggaaggtggaaaatgggacatcctccttatcttaattcagatcatcatggccatgatggctgctctcctaagaccactggggctggtcatattgttcagcagtatcgtttaagcttctctttaaaaaaaaaaaaaaaaaaaacacccagagcaggcccaggaaagtctgccctctgcccatggtcacatacgagaaagattgactttatacaaatatttgaccttcatttgctagagacacttccatgcaaacacgcacacacacgcgcacacatagc

SEQ ID NO: 51343 - DNA, 1015 bp, Bovine  19866881266133
tatttactttttgaatacgtaaaataatatacaaatattttaaaatactacaatgcaataaatatttgtaagtcattattcaaatggcaaattaatactttatcctgtcaagaaaaatgtttgaagtaatattcattttagtttttaaaaatactggtttgcttacaaaactgtttcttctttttcctgagcactccctggactacatttcctaacctcccattttccaatatcttgtgactgagttgcagccaatgaaatacaagcagaagtgagctcactatttccagttcttgctcataaacactttcccacgtgctggctgaatacacagggctccaaggccctacaagagggtagagccacgagacgaaaagagcctccaactctgaacgaccacagggcaggccactgcccactgggaataactgatatttggactggtatctgctcaatgaataaacttcttttgtattaaattttcacagtttatattttaaagcagctggcattatgttagctaataaacagagcaattcgagggtctggttccgaattcaggtttctcatacttagttttaataatgtcatagttgaaaaagaaacttcataaagaaacaccgtagatcatataaagtataaatgtaaagttcatcattaataatagtggctataaatctgtattttattaattttcctgagaacttacaatttttagggacttgtcagatcttagagtgtcactgcatttgcttcatccgcacctaatgaaaagcttgacataaggttagaattttcaggtctacctttttcgtgtagtcgcagcattggtattatactcaattcagtttctttgcaagcctcttgcaatctctgtaagcctctcgcccactttctcagggataacggaactaacacctccaaaaaggcatatgacacctgacttacactcagaccaactgagaaaactagggtaaagccatatattaagtatggtaggcttaatttctttttc

SEQ ID NO: 51344 - DNA, 1298 bp, Bovine  19866881277464
ataagtatgagttcgaaagaatgtcccattgctcagctgcaaactagaaacccaatcaagtaaagaaaacatttttttctagggggataattgcatcaagtaaacattcagttatgaatttaatttgtagatggggaagcctaaagactgacttaataactattagatgatttgaagaaacaacttactcatgaaaattaaactgtgagatatttttaagtgatattttaaaaacctacatgtctacagaatgcctatattccagctagtacaatcctatatcaagacaacaatttaaagagcacaaatccccatgttaaaagactgtatttgtatgatactatgcgtttcaatgtactttcacattcagcatcatatctgatcctataaaccacagaaaggacattttatcaggtgttctctacaggtaagaaaataaagaactgattaataaggatcagaactaaatagttgcccaggttcacaaacaatttcacaggatttacctcatttgattttcacaacagcatattggggataaaagattattctccaaatagcatattgggatatgctaagatttgcttttctcagatgaactaacttgacataaggacctagagtcacaaggtcggcccactataaaggcaggccctgaaccaaggttccaaaacttgtggtctttatgtagcactgtcaccttcctaagattatgctattttcacaaacaaacagaagatggctgtttgtatttaggaagccaaaaatggtgtgttgtggaaaatggctgaagtttgcagaaaggtgtgaggtaggaggggttctctcccatattagattaattgaggctttggtaatctaaaagaaataaaatgagcaaaaggggaagcaaacaaaaataaggaagaatggctaccatgaaggaaagggaagattaggaaaagaaattagaacatatttgtttacaagttaagtaatagaggtcaccatatagttgcctactgaaataccctaaacagtcacaagtcctcagtctttcaaatccatcttgttcactgtcaccaagctattattctataaaacagatgtaattgagtgaaatatatgataaattccttgctattttaacgtatccctcagtctctcccattttattttttgtcaaagtgttattcatccaagttagcagggaatgctgtctttaggaaatatctaccaatgccattataaaatctattcctatctagatattatgcaaatttggaaattaagacatgggtattggtactctctttact

SEQ ID NO: 51345 - DNA, 721 bp, Bovine  19866881366250
atctcaggcacgttgtgcaacgccactattctacgtaccagaagaagtgcgatgaatattaattgttgaattcaattcagggcttccttggtccaaataaattatggcttcaataggaagaggtcctgaacactcagctccattgaacgtgaaataccaacgctgacagcatgcacttctgcattttaaccgaagtgagccgctgaacaaaactcttagggcactgtttgaacgcatctttgtgaatgtacattcctatcacaaacacagaaatagggtttaattagcattttcatttttaatttaaaagatgctttcaaactgtatcgtgaattttattcaactattcttttccccaaagtacatttaaaaagctcagcttttacagagggaaaccagttctctgcaagatggtaagagacactgatattagaaactctaagaaaattgaattatggctttcttagaattattcactccattgagggtatctctcagttttacaaaaacagccacctttcagaattttagactaaaccaatctatatatttacttttctttttcttccaaaattatttcctatattttggatgctttcagattacagcagtaaaccaaatggaatccgtgccatcatggaacttacattctagactgctgctgctgctaagttgcttcagtcgtgtccgactctgtgtgaccccatagacagcagcccac

SEQ ID NO: 51346 - DNA, 1174 bp, Bovine  19866881415412
gcttcagtagttgtggttccctggctctagagaatgagctcagtagttgtggcacaggcttagttgctctgagacatgtgggatcttctagaatcaggaactgaacctgtgtctcctgcattggcaggcagattcttcaccaggaaagcccagattcttcttttttttaatcagaattcaaaactgcaaatgtttaacagtttataattcattaagaaaaaaaaaagactccaggcaggaaagagcctaacatgaaagcacatcctccccttactgcctccccggagtaaccagtttccatcactgaggccaacttttaagtgatttacaaaactgagtagaacggtagcttgcttaactctttttccttcttgattgggtctttctctttgtcggtttttgtcctgcttgagtttgggctggtctaaaatctggttgcatctgagcccagtgaacatcagagtatataccacctaaagaatgcaacacccatagtgtgctgtttgtctggcaccttgtcagggcacgaggtactgttgacttgaaggcaagcaccacctgctgagtcactggcacgacctcctgatacaacccgtggtttccatagtgacatctcagggaatagctcttaagagaacctgactggttagagacatgagcgatttcctttaatttgagctttttactaatctagaaatgggagcatgattttgaccataataacttttccagtcaaaatcttttggactaaaatgcacagagatgtttgaaaagtgaggttatcaggatagaacactgagagagaaaataagaatggtggtgatacgaaagtgttgcttaagaagatagagaaatgttagtaaatgcaaaggatttacagtagcccatcaggaaagaaaggttgcatcaaatgccttgttattaattcttaccacttagtcactggcaggacaattttctctgatagagccagaggactcagattgttctcgaatgtattttttttttaaataatctccactcattatcttattttcagaaaaaagaaagggaaaagaacaatttcccttccttgccacccacttaaaaatgtgaacatagcacagtctttctgtcttttcctttctttcctcctccctcctttctttctctcttccacctcccccatttcctc

SEQ ID NO: 51347 - DNA, 891 bp, Bovine  19866881663945
caaagagttgcaactgagcaactgaattgaactgataatagttgaaatttgcaagcccttattttatacttgcatggtgctgtgtgttctacatacgtactctcatttaatccttatgacaagccaaagcattggatagttttactatttctattttgcagcagtgggaactgagactcagaatataaatgatattgtcaaggatgaacactaagtggcagaactgggaaccagccaatagaatgcaattctaaaacacagaaacaaacaaaaaccccaaaactagtttgttgagtagaagctagtcatttacactcttgggagtaagtcactatttcctttcatagttatcacagtgaggaaggaagatactggtcatgatcagacagtgtcctagagcttttaactgatgtattgaaagattaagaggatataaggatggttccctggcaggtgtggtaatggccaaagaagcatgcaaaaaccaagcaaaaacaaatcatcctaatatcccaacaagaaaaaagggaaaggcaggtaaaacagaaatataaaaaccaaatatataagtgaaaagtctaattacagagagatgccactgatgagctctgatgagaaaaggaagaggcaggcgtccatcagtgaggcaaggggcatctgggcgagtatctgtgggaagggaggcaggggctggaatatagtgaaccgggaaaaatgctgatggtaacaaaaatggctcttttagtgccgggagccagggtgaggaactccgcccgtggcaaaggtcatgaggaaggaggctcagcatacgcaaaggcgggattgagcctcaggagtccccctgaaattctcgagcatctacccccaaaaccagagtctgcctactttctg

SEQ ID NO: 51348 - DNA, 4084 bp, Bovine  19866880373503
atgaaaatctctccctcatccctatgacttcctttatcaactaggatgctgaaggagcacatatatagttatgtcacttaagtctcgtgatttaaaacagtcctcctcctttctcttttcactgactttttctgacaatgacctgttggaaagatgcaggatggctgcctaaggacttgtagaatctttctttttttctgggtttgtccgattgtttccatgtggtgatatttacctcagtcttcagtactctttattttctgcaaagtagaatttaaatctaaaggcatgattagattcagaataaacatttttggtaagagcacttaatagcaaagttgtatatttcatatcatatcaaatcaagacccacataatatagttatcccactattagtgaagctaagattaagatggtgactaaattcctcatttagagttatatttttccctttgtggtgggcaaataatcccggggtagtgagactttagcaccatacaaatattttagttctttatcagtcgttcatctaataatgttaatatttgttgatggtcctgaatcaattatatcacagggagtttcaaaatggtgataaaatgggattaaaaatattatggtaaaatacacataatgaaaatatactatcttaaccatttttaagtgtatatttcagtagtgttaataaattgacactgttgcacaactaatctccagaactgttttcattttgcaaaactggaactctataccctaagagttttctcatgctttcagctttgtaagcttgcaattttctgtgaaaaatagccttttctcatcaaggtaggctatctgattaccctgaaatagtttttaatttaaaatataggagtaaacaattaaaaacttaatttttccttttatcaaattttaaaacaagccattaatatataatagtaatctcaaggttttttggttggtttgtggatttttatatattcaatgtatttccatcaaacacagtcattctttttgatgttcaaattgtcccaagcttggccagtgggagtcccttcaaagtggctcttaaatctttttggcatgaccctatcaggctttgaaagtaagggatatgtttgtttaaaggcactaaagttttctttggagaacagggtcaaacctgtattagccgaagcacaaatagcatccttattatagaaaagtgccatagagcagagtaaaataccaaggtcctaattcatcaacataaggagaaataaggtgaagttagaagaccttttaaggcctgttctcattttatattgtgtgatcttttaccatatataaggttgttttaccattttgttattattggaacaaaatatttcgagagtttgaatgttattaggtttttccttaaataacatctttattactttcttcctcttctgatagtcagcttcctgggccatggattaaaggactgtaaattggaaatgtgagggtggaaatgtgagggtttcacacgcatgtttcacagttataaagtccatcctcagaggaagcctgaaggggtttgcatactaacctttgccttttattcaaataaaatgtggctaaacattccacatagagaaggtcaaccttataatgctcgatcaataagctgctgtcttgtttcctgcagacggctttatttcctctcatttgagtaaacagaagaggttttatcaagagtttaaatgtataactgaatttgtgaggaccaacatcataatacttgtatcatgttttcaaacctctggaagataccatctgacattaaaaaaaaaaacttttgggttttgaaaattgcctttttccagtgtaatgtggataatggtcatcccataagcagtcattcttttccattcatttttctttttcagaataagtgtggctcagttttatccttatgcccctagtagtcactatgacgacttttggttaggaattggatatgaattaccagttttttttgaatactttgaacacatactgaatgttgggcagaagtacaaataatacagctgcataccatgctaataaaaacaaaatgtttgccttgaaaaacagtttcttctcctagaaagaagtattatggaattctgtatttattcatcaatgagtttagtttttacgtaaataaaagactatactgtattttagtatagatcattttttatatgtatgagaagatcattaactttttcaaagaaagctaaccctttaaaaatgtgttaagtggctttaattgcagaaactatgaatattgttatatctagtaaattgagttcattctgtgaattttccagatggtgagagcaactggaagaatttgatacatttcttctcattcgtaatattaatgaattgtgaattagtacagttgtaatctgtactggattgtctgtataagaccatagagacttggcatgagaaatacccagtgtatgtatttggatttagttattttctccaccactgtaactggatttgagatatcttatacggagtatgtataattaaattgctgaagtaaaaaacaaattgaagtctggtaaattagaaataaaaagaaaatgtcaaaatgaaaatatgtatggctgagtccctttgctgttcacctgaaactggcacaacattgttaattggctgtactccaaaataaaaagtgtgtgtgtgtttaaatctgcctccacacacctcctatccctgtaggtatccctgatggctcagtggtaaggaatctgccagctaatgcaggagatgtgggttccatccctgggtgggaaagatcccttggggaaagaaacgtcaacccactccagtgttcttgcttaggagatcccatggacagaggatcttgggaggccgcagtccacggggtcacgaaagagtctgacaggactcggtgactaaacagcaacaacaggcatgcatttttattgatgttttgtttttgtgtatatttgtatatgttttgtttttacacaagtatttttaaagaatataatgataaagtcattactcttctctgaaatgtctactggaaattattgaagattcttttccatgaatattatctttaaatgttttggcattttaaagtataaagatgaataacatttttgaaaaaaggaagtcatgatacttaatagctgaacctgatattttttaagtttttaaaaaatgacaagcatttatattcttgagagacagttcttttaaaccctggtccctgtgaaagtgagtcatttcttccaaggtacagctcatatgtcagattttctgtgaagtcttttctaatttccacaagtacagttaataatatctctttttcctgtctctcccaagaaatctgttggcaattaccaggttggatttcaaaatcctaaaaaggtcagtttttcttatataaatttttcctgggcaaccagccctgtattgcttgtgtatttccagtgagcgacatagaggaaagcattatatagatgtttgtgggttgaatgaagaccagtaagtgaaattaaagttttttttctttgaaattaaagttttaatagagtttatactattaaatatttttcttgtttggaagaagtgaatatttgactgagtttgataatctttctaaggtagagaaaactctgaagtgccaatagtaatgtgaattgacttagagagaatttgaaacagattcttatatggagaagatgaagatggtcagctggtaacaactgctcttctatccagcactgacttacccatcctttcctctttcctgcccctcagtggaaaggatagcctccttttattctgtggataaggaagctccaagttgcaccctagaatcctatccccatcacttttggctgtctcagagatacccttctatgaattaactgctaacctgttctgtgtctgttttcccttcttctagacagtggttctcaaccttggctgtacattaatgtcacctagggacctgtaggaaaaaaaacccctgggctccaacagagatcaactgtattagaatcttgaatcctagaatcatagagt

SEQ ID NO: 51349 - DNA, 1392 bp, Bovine  19866880451658
cagctcatctttgatcctattgtcaaaatagagatacaattgcagtttctattcatgaagatctaggaagtaaaagtaatttcgctctataccattagaactgccacattctgaccctctcccctgtggagattcagtgacatgtgaatgatggttttccatttttcatgccctagttgaaatcgggtccaggggggaggtgtcactatcacagcaccactcacccagcagtgtgagcatagccctggaaaaggattgtgagtctacagaatggagacagacctgccagggcacatgagctcaggtgaaggtggcaggtgtgtggctgttcaattcatattttggcaggtgcaagatggcttcttttaacatgtaaaagcaaaacaaagctgaaaatagtatatgatctgtagcaatggcaattgtataatgaggtttacgttagtctctagtttccatggatttgagaaaatgtctctacattttgctcattttccaggactgtccagccctttgtgttttctgacaacctactgcctatgaagtgggctgctaacctgcttctacaatgagctgagggcaagggttagtgtgggatggactgggttttttttttttttttttctgtactaatttatccttaagataccagaagtttgatgcatgactatttctgtcttataaaaatgatgacaacataattcaccaagcttttaatcctgtgctaggcattaggctatgtcctttgaatatattatcttatttcattaatcttattaggaggtgacaaggggagaagaaatgtacatcctccaaaaggggatctaatatatttgggggcagaatttttcgtttggtaaaagtaattggtgatattgagtggggcatatacagtcctgagatgcaatgaagacaatctccatcaatcctataccttcagagactcgtgtactgcatttattttcccgtttcctgcgtacttgttatctcatttttctttgatgattagaagaggtatgctctgatggtctcctatagcaagcccctgagatgtacctgagctacagaggcaggattatttatctgaaagtctatggactaggcacctgacaagtttgctctaattcaaaaggaatcaaggaaactggaccgggagctggctcacacatccagtagtgtgttaggcacagtgccaaatctacagtaaagggaaatgcattcctgaaatcccagcaagaaaaatattgtcacacccggtggtgatgtgctgtggaagagtaagtagaagttgggagaccaacctggaaaactcaatcgccaagtataaattcttttagagaagatggtaccaaaatctaaaacttcagatggttttggaaaatagcatatttt

SEQ ID NO: 51350 - DNA, 3753 bp, Bovine  19866880517134
tgacgcatgtttataaataaaacttcttcccacaagtaagactatgtccttacattaggaattccatgagtgactccactccatgtatcaacattgcttcagttaagttcagttcagtcgctcagtcgtgtccactctttgcgaccccatgaatcgcagcacgccaggcctccctgtcccatcaccaactcccggagttcactcagactcacatccatcaagtcagtgatgccatccagccatctcatcctgtcacccctttcttaagatcccaataaaccccattctaaaaggactactacaacaatactctgtcagaagccacaaagaaataacctaaaatcacagagtattattttcaaatgatattcccaatctgataagttacaatcatattttaatgtacatcctttgatacttattaaattgaataattttccatacatttatttactaactgagctttatcttttacatcctttgccaggcaccaatcattttttcttatttgggataaatatttgcctcaagtcctttaataatacaatttggaataaacattacagacttctccaataaattacagagaaatacaagacacaatttacagttttttaaaaactgacaatttacacttttttaaaaaccaactcaagacaatcactcactagaccaaatactaagattcaatctttatttgacatacatttttctgttaaaattttttttcaagtaaatgaggttttaatcaatcctttaaaatacttaagatctgaagtatttttaacatacaacttaacagtattaactaatgagtacataataacatggtgatttccagtatctctaaaatctacaataattacaaaactggacttagaattcagtgaggtaaaataaggattatgatcatttcagtgaggagaaccgaatgccccatttaggaaagacctatgactgaaagaaagaaaactcactgaacgactctgttttgaaccttgatttaagttaaggttaacttaaccttatcatctaacttaaccttagttcatagttaatgattacgatcatcttgagagttgttactgttgtttagtcactaaatcgtgtccgtctctttggcaaccccagactgtagcccaccagactcctctgtccatgggattttccaggcaagattactaaagtgggttgccatttacttctccaagggatcttcctgacccagggattgaattcacatctcctgcattggcaggcggattctttactatggagccaaacaattattaattaacaacccaaactcaaaaacataacaatacttaaggtaaaataatttattaaaaaaatatatatatatcactaaatttactgttcactgcttctaaacacatatttatttaataaagtacttactttcactatcatctttaatatctatggtagcaaatggcaaatccaccagaaaatccatggtgttggcttcaaattcttctgacatttcttgtttgcttgatacactttcacattcattggaattcacccctataacataacaaaaagaaaactgtattatttttatttattttttaattcatatcctaagctaaagcacggagaaggaaatggcaacccactccagtgttcttgcctggagaatcccatggacagagaaagcctggtaggctgcagtccgtggggtcacacagagctggacacgactgaagcgacttggcggcagcggcggcaagctaaagcaactcaactaactgaactcaatataaattaacatctgttaagaaatggtaaaattagtattcaaacatactgtaaactacttatttagttataccatatgctaaatttctataaacccatttttatgttaaacaactttaataatttcctgaagcacagtacttaactcaggattaaagttgagttaatcaacaaacctcaagatcctttataagacacattttcttaacttcaaaactacatttttcacataacttctgaacacaagccaacaagattttggcaatctctaccatgtttatttgttaacaacatcaattatgtgttctcatctgtacaagctctgacttttatttttccttatggaaagattgaaaattttttttcattccatattaacatgggaaattcaaacattaaaattcacacattaaaaatacatagctctaaatatgcttttctagaaattcagtggttaaaagcaaaaagatcttatagtttccctgatagctcttccaaagacatgtcctaatactagagtgacatttcacacctggtccttgtttttttgttttcttttttgttttgttttgttttcttattatgagtagaacaattatatgcctcaggaggaggttaggggaaaagggtgtctgtttaaactgataaagtcaattgctaaacttatcagctggtggtctccccataccattacccttcatgcttttagacacaaacgttgtttgaaccagaattgaacaaaatcctgggatacttacataatttttattctatatattgactaacaattaatttaccattgaagatattaaagaagtcatttatttcattgttataatcctctattttcatatatcagacctttaaaaccacactccattaagaatgtggcttacaatacacaagataataaatattcatcataagttatagttaacataagccaaaaaaactaaatttttattgtaatttcagtaatctttaatattatttacagacacacaccctacacacaggcacacacacatacctattttgtagataaaagcaaaaaatgacagctaaaacctttttattgctgatttttttatatcaactagtcatgttcaacaccaaaatcaaaaaagttaatagtacactcttaataatgctatttatttatattacagttcaaaccttattaagcttgagtgcctggcatgcaggtgttcaacaagtgttagtttaccatgaatctattcacagctattgaaatatgtgagaacaagtaaatgtttcctttctatttttacacttgtgttgaaaaatacacagcttatatttaaacaaaagttttaataaatcaatacctacctatatttggggcaaatgcacctacactgaaaagatcatcactaatcacttagcttacacaacactataaataaaatgtttaaaggtttttacattttttaaaaaataaataaaattcttgaatgcaatggtatgtcaaaatcaacaagagtctagaacttgaaacacaaaattttttctattaaattacctaatagctgaaaacctttttgtagatattaattattaacaggctttcctggtggctcagacttggtaaagaatctgcccatattgtgggagacctaggttcgatccctaggttgggacgattccctagagaaggaaatggcaaccgactccagtattcttgcctgggaaatcccatacacagaggggcctggtggcctacagtccatggtgttgcatgaattattaactcagcaataagagaataccacttgcaagtaactcttggaactccatgttctatggtcatcctatagaacaatgtctctcaacagggctcaaatctgaaacacttcctccagttctctaagctccagtgttttggcaaaggttggcagatagaattaaacacatccacatccagccccatcacttcaggcaaatagaagg

SEQ ID NO: 51351 - DNA, 1814 bp, Bovine  19866880554308
cttgctcaaactcatgtccattgagtcagtgatgccatcaacaagcatagcctaccctcaagtatttatttagtgtttaatctgtggattattcacattctttcaacttttaaaatatatctgtgtattttattatttactttcgctaacataatgttatggttatgtcctctttggactacaggttaaaggggaggtaacaatgaatactgaccattctgcaacagagtagtagcactgccatgggttcatagtagaagcaaagagagaacatctgagaaaatggggctatctcaaaatatgtattttatgtttgttatttttgttctttcactcttgttgccacagtctaccaagagttgactcttggtcagaatagaagttattgtcaattcaggtatgtcattgaattatttatatatgggaaaatttgggaaattctggaactgattttaacatattctttgtagactcttctcaatatttctaattttctagacttcagactttattcatcaagatgcctcagagtcttgcacagtgttggtacttactagactcccagcggacactaatagaattaatttaaatttcttttcatgagtgaaaaataaaggttatatttcagtgtcctacacttaaaggtcagttcccaaaagaccctatgataagaaagggagaacatacatgagtgattataaaatgttaacttttaatttaactttaaattaaattttaagtttcaatatttactggaaaataaagcatgaactggcctgtaaaccagttgctagaagtgaagaaggaattagtccagtggaattcttggtcctttaatcctaggatgaataaggaaagtaatttcaaaggctaggttatctttccaaaaacaaagaacatagaaaagctattttagaaatgcaaaagcaattcagtacctgcagagctggtcaatggcctttttgaaaattaactttttattatctgtctgccatatacttgctttttaattttaatgcccaagctctatttgaaataaagcagctatttccatttgatcaatggagcagttccctggtgtacataataattcaatttcatgaatttatatgtcaaaatgatcatttgcagttagtgtttctagagaaccataggttataatccatttaccaaggtcttgtgattggtatggcacatcttcctcattctcaagtttcccaggaattccagcgttacctcaacatgcaaattatcttcatttcatagatataaacctgaaatagaaacttgctcttaatgagattttatacctgtgagctaacagcgaataccagaagcatgggaaaatcgaaatttaagatgcaattatccctcttccaaggttatgtgagaaaaaattcagatgttactcattttattaaaaaggtaaagaaattgactttaaaaaaaatctcaagtattgcatgggcttcccaggtggcgctagtggtaaagaacccacctgccaatgcaggtaatgtaaagagacatgggtttgatccctgggttgggaagatcctctggaggagggcatggaaaaccactccagtttttttgcctggagaattccctggagcctggtgggctacacgtccatagttttgcaaacagttggacactactaaagtgacttagcatgcatacatgcaaatattttatattgcattcttgggatgctgttgatggccttgggaaccaattatgagaactgcattatccttaacaccctgaaagaatatcaaagagaaggtaatgctctctggaagaaacagctt

SEQ ID NO: 51352 - DNA, 1032 bp, Bovine  19866880585452
aataacttgattgcctcccccgcccccatgttttattctgttgtctaaaagtcagtaacagagctattgttaggtttggttacaaactgcttgtttttaaccttatacctggaagctggggttagattttttttttttcctcaagtgtagacaggggaagtggacggtctagacagaggagagtcagcattaatgaggacgcggaagcatttcttgttgaggaggctggtgtggctggagcttgggatgtgtgagagagcatgagaagcagaagatgagcctcgtatttggactggagtcagtcagtgcggaacctgggagattatactgagcagtttggtctccatactccctgcagagccactggaagcctttcagaaattttcattgctattatttatttgaaggaagaggcataattgcaaatatctgtattgcagaaatactacatgccaggttttatggggaattaagcagatttccctgggtatctgtgctggtgaattttaccctcagttaaaggcatctacccaaggaaacctccttttgtatttcttttatttatggctttaggtgaaattgccaactccagtaacacttttgtatttctgtgcaataaaatctggtgctgaggtttttgggtggtatttattgtactggtgactaggatcaaatatttacttaacctaattttaatagtaaatctcaccgttaccagttaagtacattgtttttactacggagtaataacctgaagcttggcagtactgatttaagtaggtgtctttggtatttgttgctctttattatgaaataaatttgtgcccagtcttactgtgaaccaagctgggcattcaaagatgaggacgaaggctgagctgcagataacttcacagtgaggaagactgatgccaggaactcaaaaacggtcatttcagcagtagaagtacctatagaaaaaagaacaacactatgaacctggatgaagagtgaggaaagggtcaggagtgacaactatactgaatttattta

SEQ ID NO: 51353 - DNA, 1717 bp, Bovine  19866880617576
cctttgaagtattaactagtatttttcctttcgttaatgaagaactgtcacagactcctgatcaccaacacagtctcaacgctggctcttccccctaccagagaaagaagcggacgtgactgtcagagactgatcagtggccaaagcacagtggatttccgctggtcagagagtaacagtcaatggcttagcaataaagtaggtaaataaaccagatccacagcgagatagaaagaatattaagatgcttggtccaaactatattgaaaagtggcagctattgtccaagaagacagctatgagactcagcttaatcagcagttcttcagagtcccaagattgtgctggatgggtccatggactggatacttaaaaacttttgtaacaaacttttatagaaccatgtctactctgaagggcattattttcaaactaaaattcttcaacatcattattatgtaatttcgtggaagctggcattattctgactttggaggtgaagaaactctggtagagataaaatgaatagcaaaagatgagtgcctgtggattcccactgtgagttcccacttcctcttcttgacattcagcaaggcataaatgtcaccttttcaggcattatttctggctgttggtttgcttctcccccttttccagttgcttttgcaaatcacatcatcgttgtgagaacccacaagaagagcctctcttcactggatatggatcatcatgaaggtagctttcagcatgacaccacttggaaatactggccatttggtgagaaaagtaaagaacacaatgttcatggaactcatatggagaataactcaagaccttgtctcgaaaaccaaacatcagggagcatttctaaatatgcaaagaagtcaacatttccctagcagtaaccaccaagctgagcccctgtgctgtacagcagcttctcactagctagctattttgcacatggtagtgtataaatgtcaatgctactctctgtgatgatctagagaggtggaatgggggtgggatggggtgggaggcagggcaaaaaataaagagagagagaaatttcactagcaggattctttcagtgagagccccaaagagccaatctaggtaattgagaagaaacattcaattcaaagtagtagttaaaattactaccttgctcatacagtttcctagttaatgttagcaaaagacacttaacatgtcctaagtctggttatataccgatgtttgcatatgaatccaacaggctattagactgattataaaacaatgaatttgttcacctgaaagaaatgcatttatgtagtgacacagaaatcatgtggctgacgcaaagcgagaatgctattctctgcttctctcccctcgcctccctcactctccaaatcctcatatacatccaatgacttatcagtctccacttgcacttactgcataatatgaaattcactgttcaactggagacactcatttctgggttttattgtatttgattacaaggaaaatatctgctgggacttccagactgaggtaatttagcataagtgtgcatgccatctggaaggagtaacaatattccttcaattctgggagggatctcgttatagcctctggcggaaatcagcttttgtaaaaatgctttctttgacagaaggtgtagaagtttcagccaccaaggtttgctccaacttctcttggcaacagg

SEQ ID NO: 51354 - DNA, 1262 bp, Bovine  19866880701898
ttggttgagatgtctgcatttaaattgtggagtttaaataagtccttctgcaatatggtgattctcatctaataatcccatgtttctatcttacatggagttaccttttcaagcactcaaaaattatttttaaaaattcatgttgatacacaagggaaaagacgtatctcatggctgcggacagaaatcaaggaaaagagggaaaaagcaagagtagatccaaggatgcaaggtgaacaccttgtctgcctcctgggtcttttcttcaactgtccgtgctgccaccatctgatgcttctccttcatggataaaatatccttgaaaagatggtctcctttgctctattgttttaaacaatagacataatcaacaaataagacaaacacgttacacctacagcaacacaaacataaaatggcggtgtgggtcagcgaaacaaaccagacgaagcggcacataaaagggggacccagtctcagcacatcgtcagtttccccagaacacacaacactctagggttgattctggaatatggacattaatatcttcagaaaagctgaaaacaagaacgtaaaagtagtacaacttcagaagatgccgctatggtgttttaaatcttaatattgtcaaaagcttttgcggtttacccggtttttcttttgctcgtctgctttaaagagatttgtcccttccactgtcacacagaaatttaaagcaaataacagctttgctttttaagaaaagggtgaataaaaaagcatgagaatagcgaattcaaatgcctacaatttggcaatattcaaagtcagactagatgatgaatttaaggagaagagaggggtgaaaggaaaaggagagaaactgttgggtaacatctgaacatacttttaaaactgtgtattaaacataggatgatcacgatttcctcaagcaaaacagatgagctgatgaagttcttggttgacaaaaggagagactttggagcatcagaaaagaacagatgcagacgcaaatgaagaaacattttaagaatgtattttaagggcaatgcttatgttggtggcggagagaaatgaaccatggagagaaaaaggatgagtttggaaagacgggtgaaaatatttttaaaacattaatctggattttattactaagaagtttcaatataagttatataattaacattttgccagttttcaacagagctcagcagtcttcaaagctaaatttaactctttatcctcacagtaataaccttaaa

SEQ ID NO: 51355 - DNA, 1231 bp, Bovine  19866880737838
catttttccatgccatgcaaagatttttagattttcctgagtttttgcagatggcaatagaagctcctagatgagctatccgtactatgcttgtgcatgcatatggaatatttcgtttactcagatgcatgacctatttctcaaggagtagtgtaattgaaagctataatctacaggtggccctatgatttttgaaatgtaagaaagcacttaaagttcagttaaaactttttttaatactaccttttattcctacaaataccatttatcaggaccaatctaaaaaaaaaccccacaagcaacatttgtcagggcctatttcaatgaaaattgacctggtagtttttctcacatcttcttttaaggaccatttgatatgtgggtggctgggtcccacatttatgcttggcaaggacgtgaaaccaagatgacgttcatttattttagagaaagaccaaatagaagcagcttctggcagctgttatgtttattctataaggattaaaaaccattgctggaatttcctgaaaaaagtcaactgttttttcccccaccaccattccctcctctttttatatgatcctggaccggatttcccatgaggcccaatatgctctgagtccacctttctctaattttactttcttcattatattcacagaatgcaactctagtagtagcccaaatctgaaaggtgaatttgcaggaacaaaatgccttttaaatgtaactatgagaaagaaggtttattagccatgttgagttccatggcctcctcttcatgatttcttaaacaactctgaacaaagaaatcagaaccctttaaggcgtgaatcataaaaaaattacacattggctttaattttcaaatttggacaaactcatatttgtaggtggtgatatggcttttgagacttggcatttttcttgctttattatgtttttttaatcgtaagtttgctttgtcttatttttggtttcattttttatttttatcctattgggtttttttttttttttttcttccttttggattttcccccttttattacgttacatactgctaggacctggataaggcccaggaggaaatactgaaacaccaggctagcattagtgaactcaagcgcaattttatggaatccacacctgaaccacgccctaatgaatgggaaaaacgacgtatcacacctctgtccctacagacacaaggggtatggactagctattt

SEQ ID NO: 51356 - DNA, 913 bp, Bovine  19866880763177
cttactttgagtcttacacagctaaattagctgaagaagatgagaagcatttttactatatttagttgctgttaagcattatcttagggcttccctggtggcacagtggtaaagaactcacttgacagtccaggagaggtggattctgtctctaggttggcaagatcagctggagtagcaaatggcaacccactccagtattcttgcctgggaaatcccatgcacagaggagcctggtgggctcctgttcgtggggtcacagagtcagacacaactcagcgactaaacaacaaacattatcttaactggcaagcaaattttaagactagaaataatttaccccataattctatccttttaataaaatttaattcaataaaaaatttacgtgtttcatttccatttccagtctttttacctagacacacttataggtaatactgtaataatagttttatagatacaatctcataacttttaacattgggggttttttgaggggaggagaaagttggttccgtttctggtcatctgagatgaaatagactagactgtctggatggaacacaactctggcttttaaattttcacaacggaatgacaactctgcctcttgttcaccttttctctaagcatgtggttctcacttttatcagcaacatagacttcatgcagaacaagagcttgtcagagaaactgacagcatctaaaagctcttatatctaatatagccaacaggacagagtcgaataggcaagcacaccgcctgttttttcccccaagctctacctttgtattgttagatcaatagaaagcgcaatccagaatcacactctctcagctcttcatttcacactatattctttataaagagttaatattggaagatttcaggcaagaagtgcgtttgtcc

SEQ ID NO: 51357 - DNA, 2444 bp, Bovine  19866880795636
ttttataaacacataataattttgtgtcagaatttcttagtgcatatcattgccagacctctagagtaagaaaaaaatggtttatatgaaatttattttggaagctgctgcatattttgttagccaatataaaatacaaggtagtattcacatgccaaagtgaatatatttcacttagattagttcataattttttccctgtcaaataataatgagcatggtacgctgtacaggacaattatttatagcctatattgaatatgatccagtttctaaatgttctccatattttttgctcatatatattttatttgaccctcttagtgccctgaaacagtaagaaactataatagtgaactcataaaatgtaagagcctttgaaaggtatttccctaactcttcagctaactggctggaaagtcaatatgccgtctcaagatattaacattataactgataacagaaggtaacacattgggagttcggaaatgctttaaggaaaaatatatacttaacgaacacagaaaatacctaagtgcagaaaaaagtgattttgtttttagaataataatttctgaacatcttctagttattgatgactcattagttgacaacctcaaattaatgattaattcgcaaaccctgagggtgactgattcaaatgagctgtataacaaacactattaatgtgtactaaaatgtatttaaaatcaactaagaatatttcctcactacttcagtgattaaaaattataagctttcttttattccaaaataaagtataaatggaatgccttttgctgggcatgggtttttaataagcagaaaaaacatatggcattttctcctctcccccaagtcccatacttcttcctgccctcctccttatcttcctgtctttcctctagtacatgtggtttattgaatatggatgcaaatgactcattttagttccatagatcttgttcaaagataaaataatggctcagaagagcttaatggcataattttcatggcagagttacaaagttaataaatcaaacacaagaagtcaaactataaaataggtattgaaaattctcattccaaacactgtgctttctctaatgttagtctctagtatatcaccacacccccaacaacccctccacacacttctaagatgtaatgaaaatttcaaactatagattctggctgaaattttaaccggttctaataaacccaaaatctattcatcagattttgaatgtatgtttttaaaaaaaatctttaattggaggataatcactttagttttgtgttggtttctgtcatacaaaaatgtgaatcaaccataagtatatatatatattccctccctcttgagcctcttttgcacccaccatcccacccctttaggtcattacaaagcaccaggctgagctccctgtgttatacagcaacttctgctagctgtctattttacacctggtaatgtgtatatttcaaagctaccctcttaatccatcccactctctccttctccagctgtgtctacaagtcctttctctacatctgcatctctattcgtgccctgcacacaggttatcagtaccatttttctagattccatatatgtgcattaatacatgatatttgctttttctctttctgacttactttcctctgtaagacagactctaggtttgcctctctctctctctctctctgtgttagttactcaattgtgtctgactctttgtaaccccatggactgtagctccccaggctcctctgtccatggaattctctaggcaagactactaaaatgggttgccattccattctccaggggaccttccccatcccagggattgaacctgggtctcctgcattacaggcagattctttaccaactgaaccaccaggggaagccttatatatgttcattaatatactcatcaatatatgatatttggatttctctttctgacttcattccatgtaacaagctctaggtttgcctacctcagttcaactaatttttttaaaaagctggatttgattttaattgacattgatactgggaatcagtagtcctggattcaagtcttgatgctgccatgaacttgtgtgttccactgtgcattaactcttatgttcttattgcttcttgattttagatttgtatgtttctattagcaagtattttatcttttgtaccacaaatactgggaccttgtctagattgtaaaccattacactgctaacaaaatctctacatctaatttctagagaatacatgttcctggagagtatatagtgaagtgaaattcactcagtcatgtctgattctttgagaccccaaggactatagagtccatgaaattctctaagccagaatactggagtgggtagcctttcccttctccaggggatcttcccaacccagggcatcgaatcaa

SEQ ID NO: 51358 - DNA, 3739 bp, Bovine  19866880827421
ctatcacatacaacagtaactaacatgtgtccgggaggggcaaatttcctcttagccctcttgagttcttttgtctggtctaatactaaattagactactaaattcctctattgtaagaaatggttcttgttctcctggttagaacaggggtttatactggtacttcctttcttttctttgatcttcataccccaggggaaataggctgagtctgatacagttacccagctagacagaggcaaaggtgatgcttttactaaaggctgtcctcttaacatcacattgtagtcaatcagaagaactgcacagcagcttagagaaagatggtcctccacacctgcctgccccctgtctatacaattttaccctcaggaagtataattttattttgcctttgaaggattaagttatggtaggaaagcttaccaacgagttatttttagctctagcaagtaaaacacagcttctgtctctgttccgaagtagagtagcaaggaaagaaggggagggtgctgcttactgccttgtcagtctgctgagagaccagaagcttctgtttcacaaggaagcagtgattacacttatgggaatggcagaggtcacccagacacaggtggggagcgctggttatcagtcatgagtacacatttctggataccacccatctgggccccacggtggaacacatctgtgtaatccattaggtgtgcagcttttgctatagtaacaaaccaccaggactcttttttttttttcctctaagtttgatttttgaagatagggcttccctggtagctcagttggtaaagaatccacctgcaatgcaggagaccccggtttgatttctgggtcaggaagatcccttggagaagggataggctactcactctggtattcttgggttttcctggtggctcagatggtaaagaatctgactgcagtgcaagagacctgggtttgatccctgggttgggaagatcccctggaggagggcatagcaacccactccagtattcttgcctggagaactccatggacagaggagcctggcgagccacagtccatgaggtcacaaagagtcggacatgactgagcaaccaagcacacatatgactatttacacaggatctacagaagatttagagtatacgggaaggtgctataaataatctatagatttaaagtatacgggaagacgtacacaggttttatgcaaatactaagtcattttatgcaagaaacttgagcatctggggattctggtatctgcaagagtcctgagaccaatctcccaggggtaccaagagataagctgtaccttccaacacaccatcaacataacacttgtaatttgcagggatcagttgatgataattgaacctcccacttgaccatctactccacacagtagtgtattaatattttctcaaagtattttttctttttgctagccattgaatgcctaaatctaccagtgtctagccttaagaagtactaaatacaaggtataaattaacgcatgaataaacatgtgtaatcaatttactaatctgtaaaaactcaaaggcagtttacacaattatctcctaaagaaaattccaaggaacctaatcctgtgagacatgccaagaaaagtttcatgtgttattcaactggtgagaaatagtacattctgtagcctcccatcccacttaaaaattcacagtgcacatcatacaatgaagaatacatgaaagccttcaattaaacacattttgaacttcccaaatcaacttaaccacagatgccctttcatgcttaattaatacttgctgatataagagaaccaacattctaagaaaaccctgggaaaacagtaacccaattctttgttggttcaaaaaacatttattaagccctggaaacaaaaataatataagggtgatgaagacaggcaacattaaacaagttaatatttaataggaatgatacttggtgctatcaccacctaagataaatgtgaaacctggctcacggcctactgtctactggaagagacccatgaacacgtgatgagtagaaccaatattaactgaagtggcagagacatgcacatatagctacatacatgtatatatgtataagtgtgtgtatttgcacacactcataggaagggagaaggttttccaggcaggtgagaagcaagagtgtccaatgtgcagaggttttgtgcacacattggtcttatccagtggttttcaaaatatggtccaagaccctctctgggggtgctgccaggtcaagactatcttcacttgtgtgacatttgcactgatggtgcaaacacaatggtggggaaaatggctggagccttggccagtaataaggcagtggcatctgactgtgatagccgtcactgtaatctccaccaccacactctcacagtttaaaaaaaaaaaaaagatcaatttcatctaagaatatactaaaggaagcattaaaagttattaattccactaaatattaaccttgagtacgtatctttttactatcccgtgacaaaacgagaagcacacacagcacttctgctacaagcccaagtgtggtggttcttggcaggaaaaagcactcatacaacggagcggcaagccgaactggccactcttccactgaatgccatttaacttgaaagaatgactgacagaaaagctacagtgactcagatctggggtgtttttagaatgaataaagggagcttgttagttcaaggaaaactgacagtatttgttactaaagaaaaatttgagctttcaagcaaaaattaaaatttggaaaaactctattggccactatgagctctagagtctttcaatactttaaggcttttcagaggagagcggtagtgacagcaactaatgtgatgttatccaaatgactcacacatgatgctgcaaaatgcataaaagatcttttcaaatgcaagacagaccaaaagattttaatgtaacagaatatgagaaactctttgatataagatttcagattctatgctgcaacaaaccttgaagaaactaccacttgtcaagctctgatatagtttcaaagactatccacaattaactgaataggttgttaaaacattcctcccttttccaactatatccaggtaaggctgtattttcttcatacataaaacacaacagggcttccgtggtggcttagtggagagaaatccacctgccaatgcaggagacacgggttggatccccgatctgggaggatcccacgtgctgcagagcaacaaagcccaagcaccacagcggccgagcctgcgccccagagggccggaacctccgcttccgggccatgcgccctgcagcctgtgcccggcaacaggagagaccaccgcaatgagcagcctgtgcgctgcaacgaagtgaggcccccgcaactagagaaaagccacagagcaatgaagacccagcacagccaaaaattaatttttctaatttttaaaacacacacacacaacatactacaacagaatgaaggtaaaccattgatgagagtccagctgtctcccattaaggcaggcaataaagttatctggaaagaagcaaaacaatgttgcccttcatttcctgctttggaaacagttatttttcattaagagtgttatctgtattatgtaatgggtttattactgctatatttaagctaatttaaataaacacttcaaaatcttttcaacttcaattt

SEQ ID NO: 51359 - DNA, 1417 bp, Bovine  19866880838762
tttgggattggaatgaaaactgcccttttccgtcctgtggccctgctgagtttgcaaatttgctggcatattgagtgcagcactttcacagcatcatctttcaggatttggaatagctcaactggaattccatcacctccaccagctttgtttgtagtgatgctttctaaggcccacttgacttcacattccaggatgtctggctctaggtgagtggtcacaccatcgtgattatctgggtcgtgaagatcttttttgtacagttcttctgtgtattcttgccttctcttcttaatatcttctgcttctgttaggtccataccatttcttcctttatcgagcccatctttgcatgaaatgttcccttggtatctctaattttcttgaagagatctctagtcttgcccattctgttgttttcctctattatctatgcatatttttaagcctactttataaaacctgggaaatacttctattatctttaagtattatgatgttttatcactctctcaaatagcccaaatcatttcttgaatggttacattgatgatttgaaaccccaacaatgtagaaatcttagatttctttttgtttttaagtgtggagatttggcatctagagattctgtggttaaaacagatcttaaactattatgtgaaggttatattaaaatttttgcattctagctcaccatgtaaaggtacctcacatgtgcgggtaccagtgaacatttataaaaaaatgaaccttattattctttaatgatgggttatttatggaaattattttattttttacttcatttttgctttgtcaatgatattttctttaattaaaaccaaaattctccaaactgatttatgttgggactgatttatactatatgaatgccgattgacctttaagttttatctgtaaatcatcattgtcttggtcagataaataatcataatctttaataatcacagatcttccttggctgttcagctttaatgtgaagttttatcctcctgatccttctcaattgactgaagatatcaccaggtactttatgtttatattaaaaatgattcatacttatagctctcatttctgtgccctgggggaatggtggtaatttcagcattaaaagaaaaatatttattcttgagtagagttttagaagtttcctgggaagtgaatattccaaaatactttgaaatgtttctagtttcaaaaattttgttcatgtttctttaattccccacttacattcaagtaatggatttttttttaactgcagcaatcttgtgtcctatgttatactgtcaaaaattactggtacttaatatttcaaattttaacactaagatggtttttattgtgtaacctatgtgtgcctgtgtaagatcttatattacaaaggtagcaaagg

SEQ ID NO: 51360 - DNA, 997 bp, Bovine  19866880844947
aatctgcctgtaatgcaggagacctggattcagtccctgggtgggaacatccccctgaagaaggaaatggcatggacagaggagcttggtgggctacagtccatggggtcacaaagagtctaacatgacttaaagactcagcaacaacaacatgttaagcttccatcttttctttaaatgatgaggtaccttggaaagtgtctgggctatgaagaagggaagcaaagactaatttgtggtccaaaacctgaaaaccatcttttttagctttaaaaatatagctttgcagtctgatgtccctggtaatagtttgagaaccctctggatccatttggaaaattagaggctgcttaattttactatatagatacccaattttgatgtacttgtttattttttgaatgaaagtcctttccttattatgaaggagaaataccacttgctgccgctggatagtgagactaattcacgtagattttactagaaaagaaatatatttccaagggacaaaagagccttaaaaaagccctgcaaaatatattgtcaaacaaaaaattccctggagaacaaggaccatgctaatattatataacagacaaagctgttctggatacttttattattgaagatgttttctgatcagagcatgtaacttttagtacgtcctaaggtctcctgcctctttgaaccacagctctctctgtaagttatgggttaaagaactaagttcatttcactctccagtaaaaaatagcttcttgagattcatgttggaagtcatctgtggagaattcttacaaaatagttggtacttactttttgctaaaactaaattaattagcctaacagattagagtagcttttatatttcctttattccttatttttttaaaaaaatagtgacatcttacaaaactgaaatggagattatagtggccatacaatgctggcaatggtatcttgaaaattaaaggtcttaatttttctgctaagttat

SEQ ID NO: 51361 - DNA, 1105 bp, Bovine  19866880955139
ttaggaagtataagaacgatgcttctcaataattgtcacatttttttttttaaggggaggagggaagatgaggaggaagaaagggagcaaagaagaaaaatatctggagagggagaaggaataacaaaaacgggcaggctgagagccgactaaaattaattcctctcctttgtaggtttatttttcttccgtgtcaaaaggtctagaaaatactatatcccatatccaaatacatacaactacatttcaaagggaatatttgttaaattatctatacagtgagggtaaacaagagttattttttaaataattcaatgctgcccaccctagttaccttaataacacattccatcgtttgtttggtttattttaaagggataaagggcccataagagagacagaactatttctataaagatataagtaaacatctggtttaaattaaacccacatatacaaaagatatgaactgtagccctttgctaactcaagtctaggcaggatcagattacattcagagcatgaatttcctccagccttccactactttttaacagaactcaaattttgttcagcttttctcttttccacatgcgtgccagtaaaggctggctccaggtcaggccacaaggtaatggcattctggtgtagggtaatcatggtagttccccatccctttgccaggaaaacatgtaaaagtctgttggtgggctcctggggaaggacgcctgtttctagaaagagccataagaagagaaggcccctctcctaaacactgggtatgtgattcccagaaatgctgttaccatctggaataatccatgaggggggaaggcctggagacaaagtggcatatagcagaaggcactgcaaaagttacagagaagaggaccagcctactgtgcatgctactggtgaccaggtcctgtatttgagcttcccattacatgagataacatactgccccttgtggtttaaacaattaaagcagggggtacagttacttgtaatcactattagtttctgcatattctgaggcaagcattagaaactaagacctaagaaactaggaatacataatagtaccagctcagacaattactcc

SEQ ID NO: 51362 - DNA, 2721 bp, Bovine  19866880992544
taaaaagttctcatcctaaaccactttttcatgatatttaagccagaattaccattttgtgccagctaatatttgaagatgcagttatactgttctgagtctgacattctagagcatgcacgatttttacgcagcactgggctaggttcttcccacatgaacatggatcttcttcagctgcttcagtattcctgtaaaccagtctaggacttcactgcacctggaaaaatctctcagaagttcacctgtaaaatcctcgaagagtagtgtggacttacaccaaaggcttttttgagcccatgtattctactgggatttccctatagctcagatggtaaagaatctgccttcaatccaggagacccaggttcgatccctgggtcaggaaaatcccctggagaaggaaatggcaactcactccagtattcttgccttgagaatccatggacagaggagcttcgtgggctgtagtctatggggatgtaaagagtaggacacgactaagtgactaacacacacacatgtgttctgttacacaggatccagtaagacttcctcaaaatctcctttaaatgtcttttttcccttgatgtttcatgacttgagtcaataccctcatgttgcccctgtccttgtctcctctcaaaaacacattcctcgtaccttttcttctacaattctctggccagttttcctcctcctccttctcactcctggatcttttcctccagatatttccttcatcttttctcatctgttgtaatttatctttttctcaagttcctttgctattttgggttttgaaagtggctgttgaaagtgaaagtcactcagtcatgtctgactctttgcgatcccatggactatacagtgcgtagaattctccaggccagaatactggagtgggtagttgttcccttctctgggggatcttcccaacccagggatcaaacccagatctcccacattgcaggcttattctttaccagctgagccaccagcgaagcccaagagtgggtagtattaagatgttgaaaagttttttttttaaatcttctgtgtttcaatttattttaatggagacaataccaatacctacttcacaggatcggtgggaggcttagtgaacgaatagatgtaaaatgcttactctagtgcctgaaacctagtgaccacacaagaaggggactgttgttgtttcaacgttgtgtttatttgtattaccaagaactgtggtgagacatggagaggaagaaatatgtcctcggggacatcattaatttgatcaatgtagaggtagaggaaactctgactgtaagacctttgtgtattattattaggagcattttaactaccaggctatcaatattcttttgttgggtgtctcggaagtgacatcgtaccttgggaaatcttaggtgttattgcgtatcgtcccaccaggaaaacactgtttcctgtgttactgttctccaggttgcaaggaatagagaaatgctgaggttatttgggtgaagaggatttattgtaaagatctgtgggaagtcagatcccaggccagcacctcatgatttgtccagtcacagtctgcagataatggaaagattgttcagtatgaaacagcttgtctgtatgggaacgctcgtgattcagctctttcttatctctgctgtctttttggggttctgctgctattgccagtctcctctcttgtcattttctctctaatcctgctgcctccaggcttctatatgcactcttttctctggggatcacttggtttgctagtttatattcaagctattttccatttagaagttggctaatattgtctctgggcttccccgctggtgctagtggtaaagaacctacctgccagtgcaggagacgtatgagatccctcgggcaggaagattcccggagaaaggaatggcagccctctccaatattcttacttggagaatcccatggacagaggagcctggcaggctgtagtccctactgctgcaaagaattggacacgactgaagtgacttagcacacacagcattgtctctagctggaaatagaggagggaaaagtcatcattcctctttgttctcagtaggttgagaggggtgagctgatgagggaccaaggattttgcttggataaagatacagtttttgtacaagaattttgcttggatacagttttgtaaacatacgcgtttagccttctgtgcagctctcaccatggttatgccccgcctcacatgtctggggaaatgacagtagtcattcctgttgaattattgctgtcctgaaagatcttaaaggccatgaagaatgggttctcagacacattcatttggagacaaataaatattactgccagcagaaatggaatgttgtctgctgatttgacctttctgtggcaagaataaagctcttatttttaggaaagaccataatgatggtgagtcatactgtatatttcaaggataagtttctggaaagatacatagccattgagtttttccactcagtcagggacccagtctgtaaaagaaggatattgggctatgctcttaagatggacaagcattgtgtaatttttaaaacatttatacatcccattaaactttccgagttatccctccaggatatttaagaataggtagacaagcatgatttgattgaaaatcctgacagtgttctcattttaatcgttacttatttt

SEQ ID NO: 51363 - DNA, 1249 bp, Bovine  19866881063494
ttttatacttggccaatgcttgtacatgaatatctctattagaacaatataaaaatttcctaaataatattgttattttaaaagtgggaatcatgaatttgttttctttcaaaaagtattgctttaaaatgaattactagcaaggggcttccccaattgtgcagcagtaaagaatctgtctgcaatgcaagagaatcaggttctatccctgggtcaagaagatcccctggcaaaggaaatggcaacccactccagtattcttacctgggaaatcccatggacagaggagcatggaagctgcataagtccatggtgttgcaaaaagctggacacgacttagcaacaaaacaatcagaaaaaaaaaggttataagaatgttctagttttaagaattataaattcttctcaccctttcaagttaatgtaattgagatagtaattagcctgcccatctttaagtaggtctcaagaataaggaaataatgacagataagcctctacattgttattcagtctcccagtcatgtccgattatttagagaacaaaggccatggagaagaaggccatacttctcccagtcaggtccagtggagggattgggacacagccccaaatacaggtgggattttggcagcttctgtgtccttctggcaggacagtcttaattgatgaaggactaggggctagaggagccctttcacctgcaggaagcttgactccaaagcacagtctacaaccatgaagggttaggaacctctctttttagatgtactcagtcctcctttattgtatgtctttaagcccaggatgaggtaaaaagatagtcacatgaatcttttgaaatctgggagcacgaacatgatttgattaatttatttttttatttaaattcaggctactgtcaactaagcacccactgtgtctaggtttaattctagctattgtgaataaagggtctcctgagtcaatgagtgagtagcttcttttcatgagaacaaagggtattgaaacaaagaagacttcagcatctttgaaaggataaagcagagtctccagagaggaaaaatacattgcatcttgaggagcaaagcagatgcacttataatgagtgagttcatcagcttgaaatactatatattcttgaaatattcatatatccaagactttcaccctgattatttttggacattaaaaaaatgtgcaggccggtttaataaactgaagtatgaaagggtaggaaatttactc

SEQ ID NO: 51364 - DNA, 972 bp, Bovine  19866881066215
ctaaaatcactaactcgactaaaccagaaattcaggaacgaaaggtttacttacagtacatcacaatcttgaaacacagaaaacaattctaccttttctggcaacacctgcatttactggatacaaggcaatataaaggatgaattaagaattggtgtctgtcttgaagaaatttataatctagaatattctcaaggataatgctgtgtactgtaaagaaaatattttatcaggattgatcagctatctctgtgcctgggttatcctaacttattcacacaactcccttctggcttttggaggtggtgtgttttgcttcctttgcccaaagcccagtccttgctcacagccttcagttactctgacctctagttttgactcagttatgcaaatgagcttcttacggagaagcactctgaaacttcaaaattattattctcataaagcatgcagccaccaaggctggatggagatctttagcttcattatgagagggaaactgggctgggggtccggaaaggggtcttccacttaacctgagttacattcatcttctcctaaagatgatggagcaagactaaactttatttaattttcaaactctgcaatgaactctctcttctgtcccctcaatttaccatttcatccttcatatgcagcacagcttatgtctacagagacccatgaattatcccagtgcatgggtccgacttggcaggtccttacggcaggagctatgtggaaaccatccatgcactcaaaggttacctcatatgtgccttttccacgcttaatctaatgtctcagatggtaaagaatctgcctgcaaggcaagagactcaagttctatccctggatcgggaagaaccctgggagaagggaatggcttcctactctagtattcttgcctggagaatcccatgaatggaacagactggtgggctacagtccacagagtctcaaagattcaga

SEQ ID NO: 51365 - DNA, 1777 bp, Bovine  19866881071620
atattgtgataaaacaggagagaggatgagacagagattcatcttttgctgtgatgatatttctactttgagaactaaaaggaaaaataggccaaaaaaaactgccgaataagtatcttaattgaagcctattaaataaaaaccccagacagccccacatggggccttgattggaagagaacacttaacaacaaatgaggtctgtggacttgaggacacaagcaggctaccaaaacatgatgttaaccatagataaagacagaaaggggaaaatagatatcagcaggggaaaagaagacagaatcaggacctgtaggtgggaaaagaaaggaacctatgcattaatgaatgaagtcatttgtttaagagcaatattcactgtgatttgcaactagaaaaatgtagtcaagcctaagtgaaattcattacttccatcaagtaaaacctggaacagaaatattcaactagtctttcctgccaatgaaaacatcttcttgttaggtatgctgctgctaagtcacttcagtcgtgtccgattctgtgcgaccccatagacggcagcccaccaggctcccccgtccctgggattctccagccaagaacactggagtgggttgccatttccttctccaatgcatgaaagtgaaaagtgaaagtgaagtcgctcagtcgtgttggactgtttgcaaccccgtggactgcagcctaccaggctcctctgctcatgggatttgccaggcaagagtactggagtgggttgccattgccttctccgcttgttaggtatagtggaacaatttaacatttgtcttaagtgagacaatgtatataaatgcatctgatgccctggagataaaatggggctattcaataagtgttcctgttccattcccttccctgcgagcaatctgagaagcagctccaaggcagggcatcacgtccacggttcgtagcaagtgtatcattcatcccttcaaaattaaatttcatggctggtgagaagttcaagacgtcagagtcattaggtcacagagggactctatgtgtgatccctccctactgttactctggcactttctgctattgtccttggctcttcctccctgacagctgacagctcgacatttctcttcacggccagaagctaagtgagtgcatgttcatccacttggcaaatgtgctgtttcctttgtgtcttagccaaccaaaacatgccattaatggaagacatcagccaaagtgtcccggctcccacaggtcccctcacccctgccttaatatatggtaaatatttacctcattttctatctttgatctcatttggttttttctcacagaaacaactatgtacctgagatttctagtgaagatgtcctaaatttctccctccaatgtaatttcacaattagtattcatgtgtcttatactcagtggaggatattaagtttgtgtttatctcctggaactataacaaattatacagaaataaactgtcctaaaagtaaagaggtcatcaaagagtcaccacgtcaggttgtacaaattttgccttaaacaaggatttctgacccaggtgactgggttacaatctagcctttgctctgtttgccaagcagtacccagagcgggagatttcccctaatttatagatagataccctagtgaacagagtgatcctggacatgtcaatattaatggaaaaaaaaaaaaagaattgagtaaacatatgaagctgggtgttatgtagccaaatagattattccaataataatatcaa

SEQ ID NO: 51366 - DNA, 1000 bp, Bovine  19866881122399
caagccagaatgtttcccatggctggaccacagagtgagctacttagcttggctatgagacagaggtacagctgtaaacccttatgattctgaaggcatattcagttggatataaatatctataccttcttatgtttatgtaattggtccttgagatttcctttccctggaaaattagccttgtcctttccccaactgaaagattatgtgtcatataagggtccagcagactggaggacctttaaaagaaaataaagagaaggccatttacacagaccacccagggaagggaggcattttgccatatatgatgtggcagatgggattattaacagcaaatgtgatctcctgcttaaagcttccacgtatagtgctcttggctgtgctatttggttaaggacacaaatgtcttagaattacagacccaagaccaatgacaatattgttaatatcaccactttaacagccagctctgtatctcctcagggttcctaacagtgagtaaagagaaatgagacagaactctaggatttaaccagcgatgtgttctaagggcagctgaaattaaaactgaaagccctgcctgtcctcgtttgagagcctttaacaaggtgttggaatgttattaatgaaatagagtctataaattgcctataaaaatgttgaggcttcactgactaattttgtccttccagcaaagctaggagataggccaattgttttctccattttacaggtgtggataaggtgcagaagaagaacttgcctaagtaaatgagttaataaggcagagatgaatataagcctagggagcctttctcttattcctgtaatatacccaccatccttgtttttacatcatgacattggcatggggtttcgaagcagcattctgatagagagtccaggctagcaggctaaattcacacctgcctgtcagtgtcttcctacagcgaggcagtcaccccagtgtcttggtgccttaatttcacattcccat

SEQ ID NO: 51367 - DNA, 1245 bp, Bovine  19866881162555
catccaacagaaagcaagcttttctttccacaaaccttgcctctttattggcttttgagtggtgagcacctaacctcactgttcattacattagttcaacccttcatgataaagataagtatactgagaaacattgtgatcatcgctttgtcggtgttacttgggaaggtaattcaattgtttttatttatcttttttactttttcgtcatttcacttattccacaaatgtattttgaatgccttctctatgccaataattgtctaatatagtaaagaaataaagaagatagataatttttctatcataccaagcatccagaaaagggaactggagagaaaaaatttaattattatattcatatatgattttaaagttttccaagtaattttggatagcttattctagttaaccatgacaaacaagtttcagttatagacacaaaactttcagtgtttcttcagacttaactcatagagccttctttcctgttcagcaagcatccttctatgtgagaatgattcaagaactattgtcgatctgactgtccaagcagtatttgaaaccatgcaaaaccagtggaatttaatacatgtttcttttctgataacaaccagacttgtacaaattagggcagcaagaactaatgctccctgaatcagttgaccattgatgatcaaaatattattaactgtcagggacttatctctaacaatggtcttttagtctccaaggcagttatcatactgaaaatcacccagacaggtgagaaatggctgaccacacctataagcaaggccaaatttaccccttgggtactttaaataattggcttactcactgcccaaaatggattctctgactggccatggaatttcaaggttaaagattttaggggatcagggaatgagtcagaatatgcaactcattgcccataggaaatgatcagatgatgtaattataacctacttggggatgttccatggtagagactgcagccaatggtgagtgttatctaaggactaagtcctctatttcttgggcacagaagcttgaccaggagcaggatataaagacacagtgtattggctaatcaatgtaatttcggtaactatgatttgaaggagcgtataatttagtggctggagaaggaaatttagtgggaggaaagaagaaattttagtgcatggcgtacttttgcttaaaggagggtcaattcccatagccagtggattgaagagaaga

SEQ ID NO: 51368 - DNA, 1998 bp, Bovine  19866881188283
aaaaatcagacaggactgagcaactgaacccagcacagaaggaagtttgtagtgaatataaatgtacagcctgcagatcaactgtctttggtcagcaggacagctttgtcaagctgttgtgggagcatggagaattactggacattttatgacaatattactgtacatcacatttgcataatgtttgatataaccagtttgaacatttgatctttacaccgcctacgtgtgccatatgtagtgatgaagagacttaagtcaggaacgattatcccctttttacctatatctgagtggaggcaggctcttccttttatattttgaaacttgcagctggctacccagtgaggggcagttaggaaggcgaacagtacagagtctcatggccagggaaatttgactgagtgaaggagaaaaacaaacaaacaactttcatctattttttaggttcttctggctggtttaagaattaaactgataatttaacaggagaaaatcaagcctagtaacatacatatgaagaatctgaacatgagagatagcaaagacagacaaaatgaggtttctaatgtcattctagactggggtctgggactttaacgtgaaggaaggcaattcacaggaagatgaataaacagtaaatgtttggtaaacatttgctggggcatgcagaatcaaggggacccagagaggaattgtgacaaacagactttgctaggttcctctctgtctaagacacctacttcatattatactataggtatctctagtgatagttctctttcctggaataggccctcaacctaacttcgattagatagttaagggggagataaaaaacatcctgcattcttctgcatcttttctcatgccaaagagatacattggagggtggcaaattttgcttccctaccggacatgacttccctgatggctcagtggtgaaaaatctgcctggaatgcaggagacgtgggttcaatccctgggtcggaaagatctcctggagaagaaaatggcaacctagttcagtattcttgcctgggaaatcccatggacagaggagccttgcaggctacagtccatcaagtcacaaaggctcagatgcgactgagcacgcatgcacgggtcacgagtaaacagcaacagttgctacaagtccataagatcttcctcaaatgccccaaactgctagttgatttataccttaaattcatgcagccaatttattactttaaccatcacagggacacattatttgctgatgacttaccaccaattataagaaaccacaataaagcttcaattagatattttccctaaatactatgtgtgagtaaatgtgtgtatgatgtcatatacagagaaaaggtagctagtggctaacaggactcagaggaggaaaggataaaaaaggagaaagaatctaaacatgtaaatttaggagtcagaaggtattttttattgcatccacttgtaatagagaaaggcattctgatcctgagtttggttcacctcaatcaacaccagcaattttttgttgtatctggtctacaaagacaagacagctgtaacctttcttatttctcttccttcaggaagggtgatacatagggaattttttatgaaaaaagaatcaatatttagagtgcatcttcactttagaaaggtaggaatgatcctaaatcaaatgtatctgacatgcaactctttttctcctgggacacatgaaggttgcaaatgaaatacatttaccctccttgaaataaacaatctttacttgtgggaaaactgtacaaggtgaaaacagaatatgtgtggctttgtgaaatgttacacttttatagctgatgtgaaaaatttcatttgggatattttggtccaattcagcatcaaaattcaatcaccatccacttgcagacaatacaagcgtaaatacatctgttgcttacttatcgagtctaaatttaaaatgagaaacacagaaggtttgctctgat

SEQ ID NO: 51369 - DNA, 1233 bp, Bovine  19866881238657
acagagtataaataacgtgtttctgcatgttattttgtaaaagccagcattttttataactgtataataatccacttggaaccttgaatgatacagtattatgattatggctactagtcactgattcccagataccatgccatgtgttttatttacattatccaattttttgcccttaccttcaaagggaaattgaagttcttcccattttacagaccagaagttagtcttaggcatgtaaattaatagtcagctctgcctgactctcaaactcatgccctttctactgtaaactgatttagttgcctctctggctggggtaaatgggcaggtgagggcttccaagtatagactaatttgtaattattattaaaggatctgaggaaaagaaatttgtatggaaagggtagagagaataaagggtggctgaccttagcttttcttgcaaatgcttaaaaactgcagctatttcttaaattttattaagctctacaacttttgaagggcatgctaattttgattagttttaaatccaaggagactaagtgattagaatttcacctacagtcacaaaactctttattgtaatagtaaaaagacactgttgccagaatagccattcagaatttccatctattactttgccctcctgattcagtttctgtaaataagtcacaaaattaggaatccatggaggatgtcgggcttcttgttacagaagactttttgctctggatttgaagagtgccatattgtacattttttttttcaaaggaatatcagaattatgagtgttacagtcttgactaattgttctctctactctttcttccctgttcttcacagatactttttgtgccttcagctccggcaggacattgcctcaggtcgcctgccctgctcttttgtgactcacgccctcctgggatcttatacactgcaggctgaacttggggactatgacccagaagagcatgccagtcatgacctcagcgacttccagtttgcccccacccagacaaaagagctggaagagaaggtggcagagctgcataagacccacaggtctgtagacttgcttactggggagacagtggccgtggtgggttcaaattgcttctcttagcgctggctagacatctgagtatagctgacagggttgatcagtttgcccttgtgaagcttcacctaggactggtcaagatagacttggagcactgagatatcctttca

SEQ ID NO: 51370 - DNA, 1936 bp, Bovine  19866881248688
tcctttagtctgctaacttgacacataaaattaagcatcacatccaaataacaaaatatcaaaatagcttaattcaatagatggatggacctagctcattaatccaaaaataaaaaaatttttaaatgaaaataaagaagccacagtacccagtgcagatgttagggtatcaagcgccttcagtagaatgtatctgaaagtttgaaaagcagtactttaagcagaaatgtatttcattcaaaaaataatagcaaatgtatgaagagcacacacttatattaagactggaggtttattaaatgctttatcgtaaaatattaagcccacactattacaatacacaggctcgatgttctaacaagtaacactgtgcctcaatcgagggaagttcatgatgccaatacaaggtggaattgtggggaattacaaatacagagatattttccttttcctcttctacaactgcaatactgatgttcagaaatgtttacacattgagaaaaacttgtaaaatttcctgagtgttccattaaacaatttttttaaattaggttaccctaatggaaaacatgaaaatttcctggtggaaaatctattttaatatttattatcttcaataactgagaaccataatcctaaatatttattatgccataagaaagtctttggaattatcataaggctttctagaacaagataaatttcaaggcaatgtaccaaggactaaattttattcaaccaccaacttagtgatatgcaaagataaaagaaaagtcaaggttagctgattttcttccaaataacaggaactaagaaatattaggggaaaacaaggatgtaggaatgagtggatattagatgaggagagagatggctagggaaaggtactgagactagttagcatttactagcatatattttcattcattagtcaacattttcttcatatatataattatttcaagatagcacttctaaacactaaattggttcattcatttttcaagtcagttgcaaagaaatttcaatccagaatatctaaagttaaagctaagagcattttgatacttacccctaagaatatctggcattctcagctgtagctcttgaatacatggtttcttaataaaatatcactaaaatagaactgatgttgaaaaaatacaagctacctagagctcagggtactagtcacaaccaactttaccaattcatatcagttacttacacagaactaaacaagtttaaccaattcaattatttagtttgaacagaagccagatattttgccttttaaaaatttaaccaatcctaaagcaatttttcagaaaatgacacctaagatttgcattgaatttatacttccagtccacactttggtaccctggcttttctaaattggacactttgctctatgtgtgatcatcaagatgaaagaatatgatcatcgatgaaagaatatgttcatcaatgaaaaaactttaaagtaaagaaaaggaactttaatttggatggaaatactttatattcatattaataaaagagaccatgcttttggaaaaaaataaaatcccacgtagtatacagagtattgcaatcgtaagtaatccaaacatataaccatctccattacacagttaagcagccaggtctaatatactacaaaccatttgattaaaaaggcttgtaaccaaaattttaacaaggaaacaccagtgaaaataggtttaaaatatatatatccttgtaaaataagatatgttttccacattaaaaccttgtttcagaagttccccgcttcaagttgttactcaaaaactcatcatgttcaaaactcaaattattgtgagatcttgagatcataagaagcttctccttattagtaaagtctttcttgattgcagcctggggcacaagcagcctctccatgggtcct

SEQ ID NO: 51371 - DNA, 967 bp, Bovine  19866881261148
cttctgggattgacaccatgagaacgtgttaagatcaaaagatgacacaaatcattctctttgaaacactgattgtgggcacagttgagtcaatctatccgctaatctcatttactgatgaaatactgaaacccaatgacatgaagttacaaccatagtccatcgaggtcacagctacactggcagacatgggaatagaacccagattaccgatttatacagttttgattttttttctcaacagtgactatagccatattttaaataaatgactattgaatcagtttgcttaaaaaaaaagaaaaaaggatgtgtcaaaggagaaattagtactttgacactgcttggatcattcttttagaaaacagagaactgtaatgattattctgcttaataactgacaggaagctagatggcatatcatacaggtgctgaattaatttaaaaaaacaataataaaagttattagagtgaaaaaaaaattgagcatatgagaacatcaaagttgatcctgaatctaaagtaactatggaaacattgcttagaaaaattatatgtattaactttgtggttcacggaagacattagcatcttcaatatttaaaaataaacagtctcaagatgttcctatttacatttttagcaagtagatatgtagtctatggagcatattttagctgtcattaagagagtcactaacagtggaatttcctcacttctagctttgaaatttcccccttaagacaaaatttgcattgatgaaaatataaataggatatgtcttgattgaaatggcagtagttgcatgaaattatttcctaggtatgaaagaaaagaaagacagagttcatacaacacattgtttgtataactcccagataagatgtaaagcccagcatcctccacattggtatgtggggcttattctcaggcgactcagactaggagaaggggctccggcttccca

SEQ ID NO: 51372 - DNA, 1738 bp, Bovine  19866881283084
ccggtatcttcttgataatgtcttttgtgatgttcctagtgttcggggaacactgctttggaccaccatcattaaacagaatgttctatagagaagaaaaatatacctacttgcagtttcttccagtaatgtcataactaggctcccaacagcaaaaacaccaccaaaattctcatcttgtcataagcgatatcagggaatacacttctgagtcatcccacaaccaccttctgcaagggatccttacgcagccccaacgtaaaactcacctggtatcaagcagtcatctacaaccagtctaatattatttctgtgtgaagtaaactctaaattctttagctaaaaaataacagtggttcaggaggcttttcccaaataagctaacaacaaatccaccaaggttaactgcacaggataaatgcacaggctgcagacgctgcattttaataggtcataagacaaaagcctgtcaaactcaatcaactccccacactatgacaaggccaccaggctggagcctacactgatctcgcactttcaaatcctcttctccataagctttggaacgctgcagttgacaggcataaatacctaaaccttgtcaaaaaatggaattcacttttgcagttttggtcgttagctcctctatcattttacaatatttacagcactgccaaagagttacgtcaatgcatagcatgtattcttaaaatatgagactataaacggaacgatttttctagcttaggtaagcagatcccaatgtgaaggccagtcctccagttggtcggctgaaggtgccatagaccgttagcatatggaccctccaagcgtgataaaagcaactttccccaggcgggaaaagctgtaattacaatggaattacagacatgccatctggaatgcttaaaaactttttacttttccccaagtagttctactgtgagcattagtacattcaaaactactcagtcaaagttttaaacgactactttttaggtcatgctggcaagggacaagctttcactttggcaaatatatttgtttctttggagataagattctcaaaatgcaacatctgtaaacgtgaatttggtagaggaatctactggagaatatgctaggtattccaacccttggaacccaccaaaaaatttcaagccaacacaatttcaaagtttaaaatttccctttccaactttctttgtgatccagctatgatgttaaacaacaggtcatcaatatatcatacaacgtgcactggaacactccaaaagagacagtccatagggaaggtgggggtcctatgaacaactgtccaggtcatcagcatcaattccacagacatttattccttcatctgaggtgtcaatagtttgaagagacaattctttgttaaacctaaaaacagaaagcttaaacttcacaagtatatatgtaccgcccctccctcccccaaacactcagtagtttcctcaagggtctaagaacattctgggcaatgtcaacagtaatgaaggaacttacagatgtagtctggctatcacaatggtactgcttttcattttgttagaaagaagcaacgtaacaagtttcttttcgaaggaaggttgttaggcaggtaaattatatcaagaagaagcatgaagaagactttctaaatttggatgtttgaatctgggcaatatggtgggttttcacatttcttcaatgtgacaacatattaaatattcagtaa

SEQ ID NO: 51373 - DNA, 1582 bp, Bovine  19866881297639
attttttaatatgatatcagaagaacaagtgacaaaagaagaaatcaacaagtgggactaaagcaaactaaaaagcttgtgcacaacaaaagaagagatcaacaaaatgaagaggcaacacagaatatgagaaaatacttgcaaatcacctgatttcatattcaaaacttcatgacaaaaatacaaacaatcctattaaaaagtgggcagagaatctgaatatttttccaatgaagacatgcaaatggccaacaagaacaggaaaaggtgtactttcaaaccactaatcatcgggaaaggaaaatcaaaacgacagggaggtaccacttcacccatgtcagaatggttattatgaaaaaagcagaaaataaatgctggtgaggacgtagagaaaagggaacccttgcgtactactggtaaaaatgttacactgatgcagttattatggaaaacagtatgaggattccttaaaaaaattaaacatataattatcatatgctccagcaatcccacttctgggcaaatatctgaagaaaatgaagtcactatctcaaagagccatctgtgctcccatgttcattgtaatgtatttcacgatagtgagaaatggaaacaagctcagcggccatcaacagttgaacagataaagaaaacatggtgtatatctattaaaaagaaagaaatcctgccatttgtgacatggataaaccttgaggtcttatgttaagtgaaataagtcagagaaggacaaatactgcatgacctcacttacctatggaatcaaaaaacacagaacttacagaaacagaaagcagaatggaggttgcccctcactccagcggggggagtgaggcagggaaatatgttggtcaaagggaacaaactttcaagtataagatgaataattctgaggatctaatgtgcaacattgtgactatagacaacaataccgtatcctaaacttgaaacatgctatgagaattgttctcaacataaaaacaaaactataattatgtgaagtgaaagatgtgttaactaatctcgttgtagaaaacatttcattttatttatagatacatagatatgttatcaaaccatcaccactgaacactttaaacttatataatgttatatgtcaattatttctcaataaagctggaaaaaaaagaagtaattagaatcctcacacagtaaatgtcagctcagtttttggaataacagccatgacctccagaagccaaaagcccaatgttatacttacaaccttgggtctgggtcaggcagacacaaagggtgtgagcaggaagatgcacgttattttctatcctcacatgtaatagggattggaatacaaaagcatatatgccaagagtgagaactggcacctaaaccctccttctgagccccaccacttctatttaacacatgtccaaggccaattatgctgataccatcattcctagcaacatccaagcagaagagagatgggttacaggtccatctggacacactaccagtgagggccttagcaactgctgcctcctcaaaagtgaaaatatggcactccagagctatgctaaaa

SEQ ID NO: 51374 - DNA, 1477 bp, Bovine  19866881490429
actcctggaacatttgggatcattgtgcttgtggtccctacactgttggaaggggctgtcatccagggagcatgggtctgtgtctattttgttcacgctgttctctgagcaggcgacccaggtgggtacaatgtgaggtcggctgtgccctaatgtagcatgtggacacctgagagataccccctccccaaagccctctgccctcttagtcactgatcccaccccccccaaacaagtcaagcaaagatcctgaattttgaactttctgggtttactccctttcccaaagactagccaaccatatcaaagtgtcttgttttcagagtgataaaccttgctttattccacaagaaggaggaacttggagcttacccaaacctccatggggagttttgttgtccaaaacattgcttcagactacaagggaactattgaacttaccaccgcagtcagtttgaggtggtttttgagttccaatttcagtttttccacaactgctattttgctgcagaaataatttacaactacaataaaaatacttctggttttcttctaagagttggaggggaaaattattatagtgttatgattccattttcttttgtggatctcagtaattttgagcaaaattgttttcattcatttgttcaccaaatcattatttagcgagattcatttagtagttgctgttgaatcatatttatgacccattttggtcaaatgtgaggtcatcttatacatggtaatgtagaaaaacggggaggaaatcatgacctaaacatttattggttgctttctgatgagacatataaaagtcctcatagcttgcataaagtagtacccaaagtacccacgctctgtaggaagttcattaattaataattgattcaataaatgttacatgctggtaacaggatatggtaggcatcaaaacagaggttgtggtggagtgtacgtctaagtgggaaagacaggtctgcttcagagtagaaagtgcttgtgaggaaagtaaggaaatctaatgaatagagtgcctgggtttttgtagatcgaagggtaggaaggacttctctgtgtttgagacatttgaactaagaccagtcttgcatactgaggaaggggtgtgtgcacgcatgctaagtcacttcagtcatgtccagttgtgtccaaccttttgcgacctgatggactgtagcccaccaggttcctctgtccgtgggattctccaggcaagaatactggagtggcctgccatgcccttctccaggagatcttcccaactcacagattgaacccacgtctcctgcagctcctgcatttcaggtggattctttaccactgagccaccgaggaagcacattggggaggggaagtaggctttattctcagggcactgggaaaccattaggaagtttttatttgggagcatgatatttgaggtcatttattaaaaatagggttgaggggagtttcccgg

SEQ ID NO: 51375 - DNA, 1067 bp, Bovine  19866881733276
ctataaccatcaaagctccctctggaacatgacacactgcgtctgagcaggctgttgcctaggaagtcaaacaattattacccattacctcacaaacctgcagagatccaagtgtttgccaaaaagatacaaggccaatggtgaatgcagccaatgactaacagcagctccatgagccaaacgtcacagcagaagaactggtatcactctgagaagtttatatggacgcagttatgtcagcaaaaatgaaattccaatgtttatctcaagataatacttcacgaaggatagcacattgttcatacttttaaaataaatgaagcataatctcgggggaccattagcccttattttgtttccaggccctgcagtgaccaatcatttctccatcagatcaggaaaccatgtaaaacaactctgacgatttctcataacaattgtttacaaaagctgtgtctatacatgcaatttcctgggtaaatgtacatttaaaatcgtcattgccttcagatagtccccaaagtctgaaaacatcaacttattaagcctcccaacaacaacaaccaaaaaaccattcattcagcaaaaaaaggactcagttcctaacctaggaattagaaatttaatgatgcccatgatcttgagttccttaaaaatttaaagaagaactacctaaaaagcatgtttctaagagtctcacatttcaaggccaattcaactttctgctgaattttaaacagtttatccaacactgccaggatctgaagcatttccaaggaaggcaaagtcaaacttctacatcatcatttatgtcgtaagtgcctaagcaaaatacaagcatccaccatgttgtatatttatttggtggctgctgagataacttcaaaagatgggacaaaaaaaccggttaagggtaaacagaaagccagcattccaacatgtttttacaaattaggtatctgagtttaaaaactcttagtcacgaagtaaatttgtccttcattactaccatgaaaagagatcatatcaaatcaccaactcatgtaacctgtcagtctagagcacat

SEQ ID NO: 51376 - DNA, 763 bp, Bovine  19866881998972
ggcttaattttagttactgatttcagttgaagagaagggacctttgccagctgctatggcctgaatttacctttatacatgcaggtacttttccccagaaatatgataaataagaaatagatacatagaggaagagcattagcacatgctcaatgtcgcaagaatgtagaatacactccagctataaatgtccgtacttgaagatgctctaaatgatgaaatatttagagttatttactgatgaaatatgagtgatatatcatttcccaacaaatgcaaggtcaaattggtcactgtgtaaatttgactggatgtaggcgtttgctgtgtgcagtgaactgtgtatacatatggtaagaagaaggggaatgagaaggtacatgagaaaaaatatttgagacatatttttgagactccatagctcatttggagaagtgagacagtcatgtttaaaatgttaaagcagcacaatagaatagtatgattttagagttgacgggatctttcagacagtgatcaagatcacagtgctagccagtactatgaagtacaaacttattaggagcagttgaacataaatgttatggaaactaaaaagaatggaactgtctgagcctggaagacagatcaggggaggcttcctagaggaggcaagttctgatgagcatgtgacagaaggggtttccaggtagcatgctgctgctgctgttttgtcactaagttgtatctgactcttttgcaacccccacggactgtagcccac

SEQ ID NO: 51377 - DNA, 992 bp, Bovine  19866881163144
cacagttcactaagcacctgatttctgatcatcccctgccattgtcacatggaatccagacaacttgctgcagtacagaggtcacttctggaaagtctgtctgcttagaaaggccaggcccagcttctgacttaggcttcttttatttccttccccagcttccctgccaatggctcaacctccccctttgtctgcctttcaagaaactatagtcatttgggaaaacacacttgaaatggatttactttctagggttgaaaatttaatatgtttgatgtgataaatgtctcctttattaccattaaagcaaggaagggagggagagaataacaaaagtggaaatgagattttgaagtatcaagggtgaaacatttttaagcaaactgcaatagatcctgaggctttcaaaggttgattcctcagacaatttattgcagaagatttggcttctgagataattggtcttcttagtcctatgactctcctgagattgccagcttcccccatctggattcacaacatggacaggtgttttctgtctggaccaaattactttaagtgttacattcatggcctaatgtctatttaaatgcaacagatttttgctctgtgacctttaacatgtctaattccaattctgatagagatgggaataacacaattgagaaggtgcttgccctttgctgaatgatgtgtattgagatttgcaaacaaacaaacaaacaaaatccctatgctatgagcgagagagagagagagagcaagagagaaagagacaaatgcaggacctattctaataaattagatacttttatataagttgttaacctaagcttatttgtgtaaccctattcttttggctttcttacatttttcatatgccgagaggctgaaaatataaaagtggtcttggcctctctcaatatcctgctttgcttgctcctggttggtttacttccaccatggctcacctccctaaaggcaacacaaat

SEQ ID NO: 51378 - DNA, 1074 bp, Bovine  19866881310849
tctctattttgaaccagcccattgttccacatctggttctaactgttgcttcttgacatgcacacaggtttctcaagagacagataaggtgatctagtattcccatctctttaagaattttccacagttttcacttatatgggatatttaaacaatcaagctcaaagaagcagtgaatacaattgtggctgctagggagtagggtatggggaaacagacagcttttcttcaatgaatataaagtttcagttatggtagttaaataagttctagagatctgcagttcaaagtggtgcctatagttatcaaaataatattgtgaacttcaaaatttaatacagtagatctcacgttaaatgttcctaccacataaaaggaagacaagaggaaactttaaatataccagtgattttaattgtgatgatactatcacaggtgtttgcatatgtctgattcattaaattgtaaacattaaatatgtacaaactttgtatgtcaattacacctcaataatactgttaaataataaagtcagggaataactgttttctaatatcctttgtaaaatttccaaattgcttcccataaatgtactaccagtttctatcagtgttaagtaggtgtccaaatgcaatgaatccttgccaatattgaggctttatttcttgaacaaactgatgggttaaaacaaataatatatccatttcaaaatttgctattgtttgaactttggtgagattttacatctttttaatatttaatcattccatataattatttatttgatctgtctgatcatatgtttgatcatttttatttggtcttgatattttcttattgatttgtataagttcaaagaataaaaatgaaaaaagtatttttccagtcatatttgttgtaaatgtttcctcaattaatctttttattttgtttctatattttgggcatacagaagctttaaaaacttgtggtcatattattgattttttcatttatttttttctttgcctttatgctttaaaatttcttattcaaagcattaagaaaaaaacctttatgttgtcttttttaaac

SEQ ID NO: 51379 - DNA, 663 bp, Bovine  19866881344667
tgattttggagcccaagaaaataaagtctctcacaggtcattggcatgaaatttgttgcataaaaacaccaataaaaaaatagttaccattaacccaagaagtgtctctattttcctgatttaaagtagtctttgtaaaattgttccaggttactcttagaagctcaaaagagaaataagtgtttgtttgcttgtttgtggggaaatgtgtgtgtgatataggattttttttaaaaaaacacagctgcaagtgaagatttacctggttgtattggtgatatatcaaacctagccttgttgtttttgagaacccttctaaagagaatttctagaaagttgtagaacattagtctcatgacttggccaaggagttttcaaaatgaaaaaagaacatcagaaacctggaatgaggaagcagtagaagtgaaataggcagaaaagaggtttttgatgtcccatttcaaagatgtgtgaaataatcaggaatctccttctcaatgcagaaactttgaaaccaaagttgcacctcaagatggaagcaatattagagaaaatggggggcttccatgaattaccctattccaagacagcaaagattatctaaaaaactagtgaatagtaaagtttcttgccagtaaagactctgcaacttgtcattctttg

SEQ ID NO: 51380 - DNA, 1995 bp, Bovine  19866880501623
tagggcttccctggtgggaagaacccacatgccaatgtgggagacataagatatgtgagttcgatccctgggtcaggaagatccccgggaggaggcaacccaccccaatattcttgcctggagaatcccacagacagaggagcctggccgggctacagtccatggggtcgcaaagaatctataaagtatttccttgtctttttgttcgtttgcacttatagttgtggtaacatcaaaagtgcactgaatttggagccaggagacctgcattttaatcctgactttgacactaattagttatatgtatttaagccacttcacttccataggcctcaaaaccatcaaaacctcaaaacctcaaaatcacatggattttgatccatgtgatcttttctacttaagtcagttctaccatttcagggttttatgattcagcttttacagtaatgccatgttccattaaagactttatattggctttccatatttttcaacctaaggccttaaatgactacttgcttccatttctccttatatgttgcctgttactgcttttcccatttcttcccctccattgtttctttacctccaggcaaagattatgagaaagagatatatcattgacaataaaacgggtttgttagggaaccattgaccgaaatcacccagcttggccatgcaagatgatagccacttgcttaagtgcctcacaacaagaggtctagagaaggaacatggttctgtcactggaaaaagtcaggagggggaaaaagagggaggacatgatcaacttcccatagtcctttgctctggaatccatcttggatgagagatgcttgtgtcaccaggaaggtgattggccagagacgacccagaaactaactccattaccataaaacctgagactgtcatccaaaaggcaaagcagttctcttggtttcccttacctggcttctctccacctgagtgccatttctcataaagtctcttcccttgtcagtatgtgcgtcaccctggacaattcatttctgagtgttagacaccagcccactatcaggtcctcaaaggggtaccctttccttcagtagccccttactaacctttttttctggcattgaaactaagagaactaatgcatgaaattgtaaaattataaaaattaaatcaaatttcataacataggcatagaatggtcttatttttgcaaaaccaaagatacacatacataataagtagatgtgttaggatttatgtaggatgtgatctaaaaagatatatacaaaactgctaaaaacaattagccctggaagagaaagtgtgaaatgaaagagtaatatcaataaaggcttaacttttaattataaacttccctatattaatttcttatcacaagcatgagttatttttataaaaaaatgctatcatttactaatattgattttcatttatataattttaagtgagtttgtagtttactgtatattgggtataaacttattaacaagaaagtgagctgaggtgaaaggatgtttattagtataaacataggaaattcattggagaaggcaatggcaacccactgcagtactcttgcctggaaaatcccatgggtggaagagcctggtagactgcagtccatggggtcactaagagtctgacacgactgagagacttcactttcacttttcactttcatgcattggagaaggaaatggcaacccactccagtgttcttgcctggagaatcccagggactggggagcctgatgggctgcggtctatgggtcacacagagtcggacacgactgaagcaacttagtagtagcagcagcagcaaattcctaagtataaccaatgagtgaatctaatttcatctctaacccaagcaggaactgatgctttcttctaaaagtaacttaagatttgcatctaggttaataaaactaattacagtaattaaatataataggaagaggaaacataagttgaactaaa

SEQ ID NO: 51381 - DNA, 1515 bp, Bovine  19866880632010
tcttctaagtctggaaaagctaaagcctatattcctaagaacatgataaaaatctaaaacataaaagcaagtaaatgatattcttatgccagtctttgaaaagattttaaagtcagtcacccttttgttcccctcatcttaacacaacctatttaacttaaaatactcaattcagatttcaattatccagtcaacagataagtatttttaaaagactgcatacagatttaccttgttgtcagccaaaatctgtgaagttttctcataaactgctgactacagaataaatttcattatatataacttttatttaaacagaattaaataacagaatgatgagtgatattaaaactagttttgagatagataaaagcatataaaatatagacattatcatagttaacttttgtatcattctcaaaatataatcttatttctttcagaaattcgtacttatactaacagcaaaattttaatcagtatagactaatgatcagttagacaatgtaataaaattcacataccaaatttcaggtatggaaagattgcattaaatacattaaaataaagagaaaataagaatattctgaataagtattcagtagtttaatatatgagtgtccagtgcatgcctttcaataacagtgttttttctcataataaatttatggttagttaaattttgtcacttctactaatcctcagtttatttggggttgttcatcatacagttttatagaaatacttgtaaacagtactagattcctttttaatttatccaattagtgtggtttaatgtcaaagacatgaacagtcaagcaatgtatagtgatttatttctaaggtgttctgtagaaaatgatatttgaattttctattagccaaggtaatgaaaacaatctccaaaagctcctggtgatttttatgaaatgacacagtagagagaggtatttaatcatattcaataatacatttttcttttatttcataaagtatgatatttatcaagttcatacattttaggaactatgtgaactatatactagaataaatgtaaaagaggcagaaagcactgtggagtatacttggaagtactccttggaaagttttaaattcacctacagacccctctctgcatggaagtccttatttcctttgctcatgaagcttctttgcagctgacccagtggaatatcatggttttactttgccctttgtccccgaaaccaagtcatctatgaatagtccatgaagtcagcagggtaaggtcatttgcagacagagttgctgagttagaaaaataattatacaaatataaatacaaatatatatatatatatatatatatatattctaatttggataaatgatatattattataaaataattcatattctatattcccggtggtcactaacaatttccatacctgtgtgcatgtctttaagtctagtgcacctgtctttctttctgttctgctcctgtgatcatcgaaaccaattactccagtctcc

SEQ ID NO: 51382 - DNA, 828 bp, Bovine  19866880788182
actttagagagggtagggtcacatggatcttgaaaatgtgataaaacttttatagtttctttcttttgaaaacacactgggtgcacacacacacacacacacacacacatataaactttgcacatcatcatacagttcaagcaaaccatgagactcctccgtggagcctaggttacatctaccttctgctcttgccactaatatctggtccattgaccaataccatgagcatgacttagcacttgttcgatatgcagaatctcaggccccatcttggatttcctgaatcaaaacctacattttaaaaagattcccaggtgatctgtgccatattcaggtaggaaaacccctgctctagaagaaagctatacaattaattttcatactcaatgaaaaaaaaaacactatcatatatcactagacaatttcaataacttcaaacatttttctgaatttttcccagatttttaccctgattcaaatcagctgggaattctcccaaagatatacctagaaataaatgaggaaggtagaacttaatcatagctgggaattaactcctttaattttaccacttttataaaataagtaacagtaaaatggtattaaacacttattatttggtacaagttataaagcttaaagaagtacactcttgtaagttaatgctagtaaggtatgatttacaaaggcatagaaatataatcaaaagagtcttcatatttctttaaaagtttaaacagccatgaaattccattacctagaaggttagacagaagtggcagtgtttaggtgtcccataaggaaagtgtcagttgtaataacaaa

SEQ ID NO: 51383 - DNA, 2081 bp, Bovine  19866880958299
aagacagaagtcagattgcatagcagccagaaggaatcaaaaacagactcagctgacccaaaggctacaaggccacaaatgtcaagttcttccctcagtgcctgctgctgtcaactacaaaacagtctttcctggcaaggacagcaggtcacatatctcagttattgctcaggaaataacctgtcagcacatcatctctgaacataaaggacaagataactgtcccaagttctgttagccaaaagtcccagtcctctgaggaagcagtactatggaacgtgggccattctcattaatattatctctaacagtctcttgctctagtaggaaatattttggaggcaataacattttgtagtattgtttttttttttttttccaaaatctttcctaatgtgatttatttctaaatttgtatataataaataaggaatatcaaatttgaatgattatcataatcaacactgatttttttttttaattttctcttttgtatttcaaccaaaatagaacataacagatgtagttccaaatccattaagagtatttttgggttatctgtagggaaattagcctaatattaaaaagagatttcaaaagatttataggaagaggcaagtaggcaaaatggccctgtcagggcatttcatgacttatatgggataaaggtaaaactgtgtgatttctattataatttctcagctgttactcaaattgattataaccataaaggaatttcatattctgattcaacaccatgttaaatgactatgcagtcttctaaacaaatgtatgaaattctgcttcctcttcctagtactagatttacataacaagatcttttttaaaattgtcatcacattttctgtttaatcctaaacgtgtttttttttttttttaatagctaaagttggaatttaaaaacaaaacaaaacctggtcacatcttttgattgattttggaaactagagggaattgcttaatacttttaatccaagggagaattatctggatggatttcaagaaaatcctaactccttaaatgtgacattttagaaaatgttggttaagtgtcatgctttttccccggctttaaaaagtcacaatccaacagggtttaaaaatttgataaacaaacacaaataacaaatagaaaagtagagctactcagggaagtgtgtgtgtgtgtgtgtgtatatatatatatatatatatatatatatatgtatgcatatgtttgtgtgtgtgtatgaatgtgtatatatagtggatgtgttaaactgaaagcaaaaaagaaacagacatgtctttcttgctccattgaaaattcatgcccaaaatattaatgactgtctttgatttattatttttgttgtctactttcttttgaaaactgacatttcaaattttgtctgttctgaacaagactcacagtgttatattatttcactgaatgaaaacattaacgaaatacaatgtgtgaacggaaacattctgtgcatttatgtgtgaacttttacaagaaaagatagtatggtagtagataaggggattggggtgaatctagttctatatatacatttgaaaggaaaataaaatcatttctttagattcatccttgaaatataaaataatttaaaataatttctggaaaaatgatggaaccataaacttggaaagaaacatcaaaaagtaggttcagaatataattaatcatatattttaaagaaggaattatgtaagagacaaattttaaatctatatcaaaatcaatatggttgaaagaaaaaaaaatcacatcatatcaatagatgcataaaaagcattggacaaaattctacacccattcatggtaaaaactctcagcaaactaggaatgtgataagaagcaagtcaaggatatctgctctcactactctattcaacattcatactgggaatcctaggtaacaaatgagacaaaaaaagaaaacttatggaaagggaaggaagaaacaaaactgtctttgtttgcaaacatgattattattgtagaaaatgccaaagaatttttaaaaattcttcaaatacaaagctaatat

SEQ ID NO: 51384 - DNA, 1005 bp, Bovine  19866880996023
accggggagcctggtgggcttctgtctatgggatcacacagagtcggacgtgactgaagtgaattagcagcagcagcagcagcaagcttttgaacaagggatcatgacttttgtgtactcagttacttaccaaaaccatccttgaactacatcggttgaaagatcccactgaacctaatttcactaatagttccagcaaatccctgtaaagggtagccaccgggccttcaaattcagaaacatttgtgggcaaagtccttcccacagtagcagtctgagacaggtctctgaatacaagcgcttctgttgctgcaggattttgaagtaagattgtgaattgaagaaagcagcctctagagcttctgactgaaaaagctgttttctttccaaagagacttgactttgaatagaacccaggtctagtggaaaaggctgaggatacttccttatcttgccattttaagttattggaaatataaacttgtaaaaaaaaaaagtgccaaaaaactgaaatctcctatgtgtactgggtaatgcaaaggctagtttgacctttttgatacagttagatactaagaaaggtatgtggcataatctaaagtgtcactgttagtaacatccttattaataaaaataatatgttctgacacattggagaaattttattgtcaaggaaggaaatgatgtagaggacttaagggtagatttccaaaaatcattaagaagggctgacacattcccaaatctggaaaatataaaataggaaactgttaagctgatactaaatgcaggatatattataaatagaggaaatgaattggcatgggttaaagggaaggagttattgggagaggaagtgaaggatctggacctgctgtgtggatattcatcatgcaaagatgttgtagagttcttgtatcttcttaaaccctagaactcctattatcagctacagatgcatgttcttccaggcaaataagacattatctagaaagagaattagat

SEQ ID NO: 51385 - DNA, 1673 bp, Bovine  19866881258929
aaatgagtcgccagtccaggttcgatgcatgatactggatgcttggagctagtgcactgggccaaccccagagggagggtatggggagggaggagggaggagggttcaggaatggggaacaccatggatacctgtggcggattcattttgatatttggcaaaactaatacaatttgtaaagtttaaaaataaaataaaattaaaaaaaaaagttcacaacatttagacttccgaaagaattaagtgataaggaagatgtaaattactgctttctttaccttatgagcaatttggtaggggagatggctcagtggtaaagaatctgcctgcaacgcaggagacacaggttcagtccctgggttgggaagatcccctggcaacccattccagtattcttgcctggagaatcccatggacagaggagcctggtgggctgcagtccatagagttgcacaccagtgaagtaactgagcacgtatgcatacagatgaatatattttagaaggacttttacagctcttaaagttttagaagagtgttaagggctctggcactgcattgcttttttgcaaaccatctgcctgttttggtctgtctttcattgtggttttgcaaaagaagtgatagtggtattataaggttactttatatagtctagcgcactgaatgattattagttgaaggagaaaacatgcttaggttagaacattagtttcctattttataactgtatcaccattgatcttttaattgttccagatgaatattttgtctccttgcctcattcttttctccctattcttagtaaatttgatctagcaattagtagtattttcattgtatttccttgaagatctgtgcttttcagcacaatttagtatgttcacagtggttttcaattgctttttcaacacaagacataaaaaccttttcatgcaaacaagaatatggaagggataaacccaactgcttaggccagatggtgaaaaatcagatgacagggaaaaaaatcagacagccattcaactcctatttttcttccatcttctttgtcaatgaaaaggatctttaaactagatggggtgtagcaaacatgtttaaagggatcgaagaattggtaatataataaaagtacctggctgcattgcgccaagtacttttttaaaattgcatcacgcctctaggctagacgaatcacatccccaaattctgagggaactgacagatgttgatgtagcactactttgagtaattttttgcaaaaccactgggaataacaataatgctagagaactgaagaggggaaaatgcacttccagttatcagacatgaggaaagcataggtagttactgtcatttattgttgaactggcaattttccaaagcagaattgtaaacaatttataattctatatgataaagaaggtgaattcactaagatccaagcttctacgtcaagggtatattcttctctttgtgttgctagagatgaaaagaattacgcagaaatggatggtgcacagggatttacgagatatttagtatactcatgatttccttgtgggaaacactgagaaaggtggaaaatgggggtttgttgtttcatagtcagtactaattaacaagtcaatttctgtttggggagaggaggctaataattgtaaacaaactgg

SEQ ID NO: 51386 - DNA, 959 bp, Bovine  19866881304514
ctgggcccctgggaattccatttgggtgtgtgtggacaatgtattcttgtgttttaaagattcagccttgtagcacttctgtgtccataattcttattgacttcagtgagtattatgcatccataagagctatgagatggattattagcaaactgataatagcccagtatatgctgccatgatttggggggaaagaaatcttttgtgaattgtgctttcatactgaaataaatgaagaaatgcattgaggaaaaagggtaactgaattaattactaatatgtaattatgttgagaaagctctatcagattaacatttgattttacatgttatttttagggacaatttctgggatgataactccttcagattatatagttcagcattggccctgagatttattgatatgatataacttccattatcataaagctatgctaatcaactttctctgtgactcctagtggtctccttgctaaatccagtgactatttttgaatacttgcttccttagtctttccattgccattctcttcctatatttttctgacaccatgatctgattgtgtttatccaacactctgtctatgtcttttcagacttctttgcagcagcatccttctctgcccagccattatttattgagtccctcaaagtttatttcttgacccttttctcactctgctttctcccaacagacctgataaatggtcatggctttcattactgccaataaatagagatatatacctttatatttcctaaggaaatcttcctctgatttattcaccaactttattcacaaaaatttattgaagacctattctttgtgaggcactgtgtacacaccaaagatgcaatagggggcaaaaagataaacagcatctgttctcaggggaacaagtaacacctggtggaggagatatgcttaatgaaataattaaataggataatttcaat

SEQ ID NO: 51387 - DNA, 2849 bp, Bovine  19866881371061
ccttatcctcacctctcccttcatagttttgcccttaaaatgaaatgaaacacagtttcgaaggtttctacctatattattaatatttattattaatagcaatgcctctgcattgaattgacactttgaactctattttattaccgaaatgacttttataccacctccacctgctatggctcataatatcttactgaagtacttttggacatcacataggatatgggtgattcacaacccataagcaattgtcagtgcagataatagctgactgcacaagctaatttatttgagatctctaaagaaatctcgtttaatatccggaagttcattccttagaactcaacaagatgccaacacctaccatcaaagttcatgttctgcaaataatgatgtcttattataatttttgaataaatatgtcctgcttattaattaaaattgttctgtgcacaaaacatataattattatgtttcctgtcagctaatgatgagtcagagtactgagatgattacttttgagattaattatttttaaatattgcaggttatacctactcattatacttcatctacagacttctactgtatttgagtaaattttagataaattctctcatagaatatgatgctatttttgaatgggccatcattattcactaactgtactaaattttgtctcggtgaaggaaagtagaagatgataaagaagacaaaaagtgcaaagcaaaaggctggaaagcctaaggaatattgtcctgaatgttctgtgtctcaacatctccaggctacctcctgtgaacctagcaaagcatcagtggggcttctctcccttctgacttttggttgggcaaggccattgggaggccctagtagaggactggagggtgggagaaaatgaggtctgcgttttcttttctggtttcctcctgacagagctttatcagaggctgtgtttctttccaaggccatgattcctgaaggccttgttatagatgcagttccccctgctccttattccttcaggtcacagaggaggcaacgtcttcctctacttcctccacaaatcatcaggaatcttatgattcctagcggaatcatctcccacattgatttcttttacctctgtcccatgtctatattctgtcatccccccctctctctttggtcaccatttctgagagttccatctgtttctgctagtgtttgattgttacaggtaaaagagcacaaagaagaagccaagtgtgcagccagcacttgctggcttgaagcttcttttggtacttcctaagctgtgtgacctcaaggcaaatcgcttactctgcttgggcttactttagaactgtgcagtgaagggcagttgaaccagattctgggctctaaaaattctattctctgtatgcagctcaagttatagaaacggccatccctatgatatgccactaacaaattctttagtcatgtccaaaggagtggggggcagggacagccatagtggaattgatgttagcacttagtaatgttgtccatgaactgagggaaaataattcatacactgaaatcgctgtgttcagatgtttctccaagtgattttatttaatttttttttttacatatgatggtgaaagtgttagtcactcagttgtgtctgagtgtttgcaaccccagggactgtagcccaccaggctcctttgtccgtggaattctccaggcaagaatactagaatgggcagccatttccttttccaggagatcttcctgacccaggaatcgaacccaggtctccttcattgcaggcagaatctttactgtctgagccactagggaagcaatatcatcaaaatagagatatattccttgttaggtctgctggagtgactctatctattgccaggttagtctctggttttaagtgaagcactgtcaaccattacttagggaccagttcgatacagaagatcatttttgggtcccagcttttcttttgtttagaaagaatgtttggtgaagcatcacttttctgactaacacgtgtacgctctttcattggatcctatttactgccttcttctccttgattgcatcattgcaagtgaaggaaaatagagtggcaaatggaagcagagccacgatgatcactgggaatgggaagtacagggatatctcatttcactgcactttgctttattgtgcttcaaagatactgtgttttacaaattgaaggttcctggcaagcttgcattgagcaagtctatgggtgcaattttccaacagcactatctttcaattaaagtatacattttttagacacaatgctatcactcttaatagataacagtgtattataaatataactttatatgcacgaggaaactgaaagatgtatgtgactcactttattgcaatgttaattttattgtggtggtctgaaaccacacctgcaatatctctaaggtatgcctatataaacatttgaagaatctgtatatttttgtatggttatttcaatggatggtatagcagctgtgtcagttactatgttttcagggccctggtttttaatcagcagagcaaatggaaattttactgatgtaacctgtaaaggctgtggtggggccctgagtccttgagccaaaaacataaatgatcaaccaagatggagagaagccaactccaagataaggataacaatattgattatagtttagttgcagtgatctaaaagagagatgcaagaaagcaatacctcagtaaaatgctaggatgataactttttaaggagtaactaccttttgctgttaagagggaatggtgtcttacctgcaaagtgaaagtgttattccgtt

SEQ ID NO: 51388 - DNA, 1512 bp, Bovine  19866881975793
tttggaggattgtgaatcactgagtccatcagctagtagagacctatcaaggaaactggctggtgtttgaccaatgtataaatgataaataaaccatcattaagataagctactgagatttgggagttatgttatggcaggtagcatcgttactctaatacacataacaaatttaatttatttgtattactaatttgcaataaaacactgattcttgagcacttgacaatgtgttgaatatgttgcttagtgctgtgaatatattatcccatttaaactcagatcaaccttattactaggcaggtatatttgtttttcctgttttacatatgcaaatccaaaacttaaagacctgattcactcagagtcacaaagatattccaaagaaagagaaattccttgaagatagagcactatgaggcaaacctaaagtaaggttatcttctaagagttaaattagcaaaattcatttgtgaggttagtcatctataaatgcattgtcgatgtaaatttttgttgaacaggtactctgaacttattcccaaaccactaattttagtgataatagaggatgcatgggcaaaaatccttggttttatttttttacattttatagtacacaggccactatgtcctgattaaaatgtattttacagccatttcttagggttagaaataatttttgttatggtatctttccatattttatgactttaattaaatttctgatttctgttctgaacactgcaatataatacagtacaaaacacaatttaatcattaaatttgtggatcattttgtgattttcttcaaagcctatagcaccgagggactgataatagaagaataatgcgcactaaaatacactcccggaagttccacaaactccatcctcaaggacttttctttctcccacaacctaatagcaaatgcacacaatcaaaaagtctcatcaggactattcctcaattgtcatcatctttaaaaaggaatctggtcaggggcacaaggtaatataaaggatattttaaaacaactacatatactctacaaaggctctactgagacaaataacattgacacagacatgcatgtgcatttgtggtcacattagtggtcacagaatacaatatttagtaaaaatccttgcaaacttattaaactaaaggtaaagtaaatttctttgtgaaaatatttctcaaggtagtttcctattatccatcactttttataatataaaatattacaaaacaaagtaacatttctcttgcccttgtttctgtgaggtgcagtgatgatatttgaaacaaatgtcaaatttggcaaccaaatccatcacttcatttaattgtgaaaatgtctaacatcttattttagtttaaatttctaaaaattccttgttttatatagtctacatccttgtacgtgcagtcacacaatagataaaccatgtaagtttatatgacatttgtcatgataaacataaacttgagtaagaagatagaggctgg

SEQ ID NO: 51389 - DNA, 1468 bp, Bovine  19866880353892
ttcagatggtttgttctttaattcaagccaacccttaggagcaaatgccatttgcaacggtttggttcagcctggcctcggcagctttctgggttgtttaatgtcctgccaaatgtaatcactgaatggacaagacacttgcttcgggtccttctgtaaatggtgtgtctgcaaacacagcctccaggagccaccatctggtgttcacatatttcttctccatggctccccaagctgctggggtctttagcgagcctttaaagtgccatgttggactttcaggagcacccatgcccctgatcaggctcccaaatcccagacctgcccattccaaccagcccatcaaccaccacatggtccccattcaacagtgcctggtggtggaaggacctggcttgattctccacacttcacaccacagaatctcggggagaatgtagctgtactatagtacgtgtgcatgctaacagggacttctggacctgattctgtggaaatcgctctaagggagctggagaggccgcctctttaacaaggttggcatggaggagagaacagttggtagtgagaaggtgcaggatttacatggaaagtgaaagtgaaagttgctcagtcatgtccaactctttgtgaccccatggactgtccatggaattctccaggccagaatactggagtgggtagcctttcccttctccaggggatcttcccaacccaaggattgaacccaggtcttccgcattgctggcagattctttactggctaagccacaagggaagagttacaaaatttagctcaacatcagggaaaatcccccaaaccaacagatcagccgccaaactcaggaatgcagggcgaagagcaggaccccagggatgcatgtccctgtagcgagttcatcctccccaggcgggtgacatggggcaagtcagttctcacccctgagctgcctcctcctcctgatgatggaggtgacgtcacagctccaggaaggatgcccgggatgtggcttcactcctttgttcaaagcagggcaatgtctttagcaacaaagcactactgctttctgaggatcagcaggggattaagagcccagagatttataaatgtcatggctccgtctgcccggcaggaaagaacctgggactgaaatgttgcctctacagacacggcaggatctgtacccatacgtgtttgccagcaaggactcccggggggaaaatatttgactcaaactcagagtcacttcagacagaaaatgaggcaatgaaggagctcgtctgaaataagtagtgatgaaagcgaacattgatgatgcccctcatacacgctgggcctggagcccttaataaacattatatcatttatatcatccattcgacaaatatttatggagggctggctaggtgccaggaatcatctgcagagggagccacaaacaacatagacaaatatcgctacctttgg

SEQ ID NO: 51390 - DNA, 2596 bp, Bovine  19866880386548
ctcctgccttcatccattcattgagcatttcagtgttgactgtcccaagaactgtgtgggggcaccgaggtcccagaatagagtaaacaaagaaatagacaattggaaggcaggatggaaaataatgaacgtactcaagacacttcctatgggccaggcaccatggatattagctcacttcatcctcctatgtgtgtgtgtgtgcatgtgtgtttgtgtgtgctcagctgcttcagtcattccgactctctgcaatcctatgaactgtagcctgccagactcctctgtccatggaactatcccagcaagaatactggagtgagttgccatttcctccttcaggggatcttcctgatccagggatcaacccccttttcttgcattgcaggcagactctttacccactgagccacttacatcatggccacagatctctatttctcagttcttcctatttggtgtagaattattattgtcttcttacaggtgaatgaatcggggttcagatgtgctaagaaacttgatcacaaagcacggaagtagcacagcaagatgtcaaacccagagagtctgatttaaagtgtattgtcctaaacatgactttggatgattagtgcatgtgtaatctattgttgcaggggagggtgctggtaaactatctctcaaaaaaaaaaaaaaaaacaagaaaaagaaggcagcgtttgcaaatacccaaggtataaatgctcccaccatgactgatttgaagttagtataagtactgatgcatgagcttcctgaaattttaaataattggttcttgtgaactagtacaaattaggccccaacaaaggactgaaggtaagcatgaaatactggtagatccagaggagatctactagcttcccacgtggcactagtggtaaagaatccacctgccaatgcaggagatgtaagaggcacaggttcgatccctgggccggaaaaatcctctagagatggatgtggctccagtattcttgctggaaaatcccatgagcaaaggagtctggtgggctgctgtccatggggctgcaatgagtcagacatgactgagcacatatcagaagagaagcctgcctaacatagctctcaggatttcattgcaaaattcaagaggaatgagcccccaactccttttttgaggtacctagagcagtccttttttttttcttttttaaataactttttcatacttttttttttctaaatttttggccatgacataagcatgcaggatcttacttctccattcagggattgaagaaccctagccctctgctttggaagcatgaactcttaaccaccagaccaccatggaagtcccagcccgttccttatgtgaagacaaaatgttctcaatgtttccttagattctctgagatggtgcagtatccttccaacgaattgttttttgcccaagatgattcagcttgagctttgttattgaaaaaccaaagagtcttcttattaagaaatgcagagggaccaacccacttaggtcttttgttactggaatcgggaaaatggtcttccatggagcagcagccagtgtattgacgtcaattcaatgtggcttccatggagagacacgcttttctgataattcagggacttgtattcccagaacaatagaaattgtcactctaccaaaggacaacctagcagcatgatcctcgggtgcacttaagcatgtgtttatacaccattaactacttggcagagagaccgagggaacattatgaccacaaataacataaactgatgtcggcaaagctggtgccagtgaaagagataccggtgatgaagatgaattatctccaaaattacaacagagcccaacagtaaagtacaattcaatttcaaagggaaaaggccttacaaacattgcacagattcagcaagagaggaaagtgggaaataaatgtctattccgagggccacctgaactttgcagtcaggtggatctgagcttttctctctgctgttttccacctctgtgaccttgaagaaggtactttccatcctgaagcttcagattccgtttttatgtgtgcttagttgctcagtcatatccaactctttgtgaccccatgaactgtaccccgccaggctcctctgtccatggggattctccatgctagaatactggagtgggttgccgtgctctcctccagggcatcttcccaacccagggattgaacccagatgagataaatgattcaaaatgtctccaagaaataaatgcagaatacgtggatcatttagtgtcattctagcccataattcatattgttatactgttcatggggttctcaaggcaagaatgctgaagtggtttgccattcccttctccagtggaccacattttgtcagaactctccaccatgacccacccgtcttgggtggccctacacagcaaggctcatggtttcattgagttagacaaggctgtggtccgtgtattagattggttagctttctgcgattgtgtttttcagtctgtatgccctctgatggagaaggataagaggcttatgggaagtttcctgatgggagagattgactgagggggaaa

SEQ ID NO: 51391 - DNA, 1774 bp, Bovine  19866880480115
aacatgatgaggcatggagatgccagagacgggaacccacacacgcgtaactcagcttttctctgaacatgccttctggaaaagatgagaagagattctccaggggctacatacttgagggctatgcagagaatgtagttcctcagctatcttgtttggttcaccagtttattaatgatattttaaatttgttaccaacacttgaaaattgggagatttggggcttccctggtggtccagtgtttaagaatccacctgccaatgcagaggacatgggttcaatccctggtctgggaagactgcacatgtcgttcaatatctaagtgcgtgagctacaactcctgaagcacaagtgcctagagcccatgctctggaacaagagaaaccctcttgcaccgtaggagtaaaactagtaaaaactctctagcaccgcagctagagagtaccctcactgcttgccacaatgagaaaaagcttgtgtgcagacatgaagacatagtgcagccaaaaataaagaaataaacagataaatgaaaatcgggagatttccttaagaagtctagattcctggcttctctggaaaattcagaagctctagtaactctgggtcagaattcctgctggcaggaattactgactagctgctgaccctctagacagatgggctaggccccccttacttcgcctttacgtctgccgggggctctgccaagagttattaccaaccttggtccctgtaggcatttgagtttgatactctctgtgttgttcctttgcttctgactgccagctacatattccaggctgtttttctcactgggcatttggcacctcggccagcctgcttctcagcatctccaggtgattgcttcacacctaacccaggctgtatctgacatggctcatctgcctgttgtggcaagcactgctggttttgtttttgcccaacaaacatttcctccccgcctttgttcttctgaaggaaaaggcagtatgttcagccttggaggatgaatcacagttggtctaggttatctgtggaaattccaattcatttccaaaactgcctgggttttgtcgtggacacgtgacccagttctggccaatgacatctaaggagtagctctactgggagtttctggcaaaacgttttctccctcataaaagaagaattccttccttttggaaaactgccatgtgaagatgtgatactttgagttgtggcagccattttgtgaccatgaggcaagacctaattctctcactgagaataacagaagacaggaagatccagggaccctcatgatatcactgagctgctgctagttttctttactatgagtgtattttgcaagccacaaatgcacttatgttgcaagatgtgttggcattttaaaaacaattaattgaagttgaacacatttctaaaccatatatctctctcaccaggtggatagtaagctccaaaaaggcaggattgcatctgtttgttctctagtgtatatatgtatgtgtatatatatatatatacatacatacatacatatatatacaaggcttagcacagtgtctggcacatagctgctgctgctgctaagtcacttcagtcgtgtccgactctgtgcaactccatagacggcagcccaccaggctctcacatccctgggattctccaggcaagaacactggagtgggttgccatttccttctccaatgcagaaagggaaaagtgaagtcgctcagtcgttcagtcgtgtcagattcttagcgaccc

SEQ ID NO: 51392 - DNA, 1131 bp, Bovine  19866880480220
tgtaaaatgggttccattctcctcttctgcttagggttatttcgaggcatcagttagatggtccaaatgaagaaagctcttaatggtaaagctccgaggactcagcggttgctgctgctaaccatcccccaaccctcaaatttatatccctttgcaaaagctgaaacccaaggggaactgtgatctcgcagctttcatggccagaaccggcctccaggtactaggttctaaaaagatgcccaacttcctgggaactacacgtccctcctccctcttgggagtccaaattccaagaaatgtagctaaaattggctctcgaacagcttttgcagagcacgtcgcagttttttttttggtctagagagccagtttccatgatgaaagtggcacagaaggagagacccagctaaaaacagccaccgccccgactggtgttaacaggatgcagcctccctaagtcgcttcgggggtttggacgcttcgacttccgcagcagctctccccatcaccactaggtggcagcatggcagcgcgctgccgggaccgcgccccccgggaccgtaacaaagagccgcttctgaaaaggatgcccgtaaaatacgcaccagtcaccaaattctccactaaattatctcccttttatttgggggatttatttgtattgcaggagctttgcggaggtatctcttctcagaatcgtctaagcgcaggtgccccagcccccagcccactggatttggcattccttatgccttgcgtccagcgtcgtaatggaaaaacttgctttagtttagaattttccagggtaagtttggcctcgatctatggagagtgcactagcctgggactcatggtccagccttgagggaccgcttgcttccccttctgagctgatgggatggagttttggctccagagtttggctccctgtattcacgtcattaaatcatatgggggacgggccattagtggaaacccctcctggcccacagcgaggaatggatgagtcacagatgagaatttctcatcacaaggactcccatctttgctgcttttgctcttttctcagtatcaccggcgtctggcatatgattagccacccaacaaatagcgacttaaagggcgtcacgg

SEQ ID NO: 51393 - DNA, 1102 bp, Bovine  19866880483029
gttggggggaaaaaaatcctcaaaggattgggaaatagaccatgatgtaaaaaagcttttgtgtttggtttggtttttgacttgtgaagagtactttggatagttcagggtaaaaaatgtatcagggaggaaagtagagagaattcctgtggagtcccaagtgcctctgtgttgtggttagccaaaaagaatgcgtcaggtgcctggaaagaaaaggggacgatgagacagcaaaaggatttaaggtgtatttcagaaagatggtggggtggagaaggggcttatttttttctctgtccatcctgttcttgtgcatttctgaaacactggggtctccgttcatcccaagaacgtgccttggttcagcacctgaatttggaaatatcaaaatgtatctacattgcatgtagactgtattctgggtacgtcctagaatgcgatcctcaaaatagcctggggatctaagtaggattgctctccttttacagataagaaaactgattcaggttggtttcagcctcattcagccacaagaatctgctaataaatgtgtattgttaggcatagtcttgaagtgcctgatctcctccgggggagggggtcagaatagaagtctggaaaagagatgtgttgttttgaggtccccggggctctgtcttgagtttccgcctctgtggtgaggaaggtgatgagtgtctgttttggggtgtgttgagaactcccaggatcccacctctgttcattggcccctcctgagacttgaacgctatctgtgtctctcccctgtatgcttgcactcagcacttacttttttggttcctggggagttattttctctacttagcatgtgcctaatattaaatatccccttcctaatatctcttctttttcttagtagacatcagggataattccattaacatatgcaaataatatgctctcacatgtgtgcgggcacacatgcccacacacacacacacacacacacacacacacacacacacacacactgccttgtggccccattaaagccttcctacgcatgccagcccattttcagaaagaggatactgcttgcaagtgactgtcccttctgttgatt

SEQ ID NO: 51394 - DNA, 1303 bp, Bovine  19866880509928
atggtaaacgacaacagatactctcgttagagcagaattagtgcaggttttacattcaagaggtcacaaaacagcctggctggtgacactcgggcctaattatcgtgcctaataattaccttgactaactagagcaaaggttttggagtatgtttctattcccagacattgagtcatcaatgacccagaagaaatcatttcgctctatttgcatcttggatcatccacttggaaacacccttggccaacccctcagggaaattccaaaggctttgttaattaatatttggaaacagtgtaatttgtatacgttgggactgtagaaatatgacatcagtatgttttgtatcggagaaggcaatggcaagccactccagtactgttgcctagaaaatcccatggatggaggagcctggtgggctgcagttcatggggtcgctacgagtcggacacgacagagcgacttcactttcacttttcactttcacacaatggagagggaaatggcaacccactccagtgttcttgcctggagaatcccagggacggagcctggtgggctgctgcctatggaatcgcagagtcgtacacgactgaagcgacgtagcaacagcgtgttttgtatggtgggttcatttattttattactcagctatgctccaggggtacttaatatttattaagctcctattctgagccaggccctgaagtaggaactaggagtgcagtagtgaacaagaggaacccctgtcctcatgcagctgagagtctagtggtcaagacagacgatacatcagtgaagcaataaataaaataatcacaaactgttaagcgctatgaagaaagctaatagaattctgccagatagcagcaggaggcacccacttgttttaagctttatgtgtttattttattttttgactgctctgggtcttagttgctgcacgaaggctttctcttgctgcagtgaccaggggccgctcttaactgcagtgcatggtggcttcactgttgcagcctctatggtgcacaggctcagtagctgtggcgatcaggcttggttgcccaccccatacagtccctcaggggagcccaagggaaagagtccccaaagtccatcatggtaccctgcccattaatgcaccctgtactcattcttctcccttcctcgtctcacttcgctccctcttagaacttggtggaatcagctctcagggctgggatggggcacacgacgtgtctagagtataaaacgtaaggatgcacttaaactgattgagggataaacacgtatggtctgtcc

SEQ ID NO: 51395 - DNA, 2819 bp, Bovine  19866880541576
cttgtaagataagtgcttaatcctacaaagtacaagagcactgtccatttacagggatccctcaaaaccatctccccacctacccccctcctggaaattacatttagatattgaatcagaactgtgactaaatttaccactacttacagctgcatgtactgtgacactaccttgctaattttattgattctatttaaagtgctcaattattaatatagctgcattcttttctctgaagaccacaccctgaaaagaaggaagaatgtgaggatctgcagagctcatccacactttccttgaatcagctaaacaaagaataatgctgctacacaaccaaattccacaaaccacaattaaccactcctcaggtaaaagaggatggtaaaaggggatgtatttcattttacagaaataggataaaaaataaaactaaggctggactgacaatctaacatttgcaataatgcaagaatttcatgtttgtttaaaaaggaactcaatgtctttcatcaagttttctgaacaaagaaaaactagtacactgttaaaacattttcaaatcaagtaaattagggattatttcagagttcagcttctgagtccattcttttctaagaattaacactaaagaaaactgccagctatagtcctaagaagatatattccaggagcacaccaacagcaccaaaatcatagaacattcatatctgtgtatgccctagtcaaagagcctggcacataaaaaggacttaaactaaaaagtaactgctaaaactgagtggatacactgtgacacctccacacaacagaacactagtcaggaaggagtggggaggagggagcactgcactgtttgttaatatcaacaatgtgaactcaaagaagcatctcagaaacattatggcaagtggaagaagccagtcacagagggctccacgctatacggttctatttgctaaattaaagaaaggtaaaaaccatacctacaacaatcaaatcagtacttgccaggggcaagggtgaggggatagatatatcctgtttactaacaaagtggttgtcaaattcaacttatacattttaaaagaatgatctttatgtaaattatactcccagaaactggaattttccaagtattatttcaaaatttcctgtttgggtgaaacctaaagtaattccagagaacgttcaaaaccctcaaataataatggatgctaaaagtcaaaatttaagcaaatcagttacataaaatcaaagttgaccactgggacaccatttaatcatttcccttttttcagtaagcctggactattagttcatcattccctgaaactaacactccattcatcactttattcttacattctctaattaccatccccaaaaactgcaagatcaacccaggaaatccaaaataaaggacattttcccctaaagactactatcttaatttgctcattcttacacaagaataaaaatctgaaaatcaagtctgctccacagccagtttcaacctattttgataattttgaaatgcacaaagttttattgcaattatcagtttttagccgtttaaaagcatttaattacatttttactaagattaaccctcaaattcagtttctttttccacagaaaccttgccaaaaatcaaaaccaaatttccaaatcttcaaaaatcgagtaatacacaaaatctaaacccactgttactgagagtgcaatgggcaagaatattcaggcacgtatgggggagggggggcgggattaactgcataaaggcactaccaaaaaacacaaatcaactcaaactgatcagatttcctacctacagtgagatgtcaaatagaaggtagacctgaaaacaaatatttgatgcagttgccagggaataacaccatgttcacgtgagcacagattattccaactagtttccaatgcacttaaatgcagggcctacaggaaactgccttccacgagatccttttccaaaaacaagtgtccctcccacctctgtccttgagacaaactcttcttccccagatgcccaaacagcacgtctggccggctggagtgctgggcctctcaacttgggcactactgccatctgggacctgggatagggattggtaggcggtctcacgcgcagcaagcctatcagtgatgacattagcgtgtcccttgcaggcgtgctcagtcgtgtccgactctctgcggctctatggctcctgccagggtcttctgtgcatgaggattttccaggcaagaatactggagtgacttgccatttccttctccagatcttcctgacccaggaattgaagccgagtctcctacatctaaccactgagccatcggggaagccccctaaagtaccccaaacaccgacaaatgcgggcgagggggccaaacgaccccagatgagaccccgttatctggaggtgacatcacaccagcggaatcctccagttgcaagctactgacacttaagtggctggattccggggcaggaaacacttcggcgatcgagatcgaggcggcccttgcactcagagcacccgacagaaacccggacgcaggctaccctcctcccgcccccagccagcggcgtggccgcaggttctctttacctttgtagaggttcgtgacggcggtggctgcgttttggaagggaacccacagagaaagtcctggttgctgacacacccggtctgaaaaacgacgaaaggaagagggaagacaaaaaaaatagaaacacacacagagaaacacacaaagacagagagaaaaagaacaagcgatgaaacttgggcgtcgat

SEQ ID NO: 51396 - DNA, 2258 bp, Bovine  19866880548594
tgcataatagaagacaagatgtaattaagtgctaaatgttgggctgtggactggaagcaattggatgaagttgcaaagaggccaatttcagctcagtgcaaagcagaactttctggtggatggacctgctccttaaagatagggcaaattggtggtagcacatcaaaaacaacaataatagcagtaataggagtaataataatcatctgcctgccaatgcaggatacacgggttcgatccctggtccgggaagatcccatatgccaaggagcaattaagcccatgaactacaactggagagtaacccccacttactataacgagagaaaagcctgagcagcagtgaagacccagcacagccaaaaataaatcattttttataaaaggcttttacacagtaatggcaccgtggctttatttccttttaaaatttatttttattgaagtatagttaatttacgatgtagtgttaatttctgctgcgcagcaaagtgattcagctacacaaatatatattccttttttatattcgtttccattatggtttatcataagacagtgcatgtattctcctacgctatacagtgtcgtgtatccattctacatataaaagctgacacctgctaacccccacctcccgctccctcctcgccccgccccccgcccccttggaaaccaccattctctatggaaaccagtccatagaacggaatccatgcgctggtgcaccaatgcatgaaatggaagccagtccattctctaagaccatgagtcagaggctttatttccaagaatcccaagctggaaacaacccaaatgtccactgaccagagaatgaatggagaagaaaaataaactgtgatatgttcatataatgggatactgctgctgctgctaagtcgcgtcagtcgtgtccaactgtgcaacaccatagatggcagcccaccaggctcccccgtccccgggattctccaggcaagaacactagaatgggttgccatttccttctccaatgcatgaaagtgaaaagtgaaagtgaagtagctcagtcgtgtccaactcttagcgaccccatggactatagcccatcagcctcctccgtccatgggattctccaggcacaagtgctggagtgaggtgccattgccttctccgaatgggatatcaggtagcaatgaaaaaaaagaacaaaacactgattcacacaacaacatggatgactctcaggggcagtgttgagtgaaagaagccagatgcagaacaatacctactgtttggttccatttatactaactttcgggcagaattaacccgtgatgagaaaggtcagaacagttttacctctaaggaggtattatccaaggaggaacctaagggacccagctggaagctgggatcattttatatcccaatctggattttggctacacattgtattttatgtaaattttctccaagtgtaatgtttcagaatctttatttgataggatgaaaaattttggaaaaggtagtaatgatggtgatacaacatcacgacggcaatttaatggcagtgacgtctacaatttaaaataatgaggacgagaaattcaagatgtatatactttcctacaacaaaaaatttccaaaaaaataatcaagctgtacacttaagatgtgtgccctttactgtatgttatgtctttacacataaataggggggaaaaaaactgtcaaggactatttcacaatgtctacatgatacagctgtgatgggcacatttctttttttctgtttttctttaggaagacacatcctcaatgttatgtcatggcttctgtgactgaacacaggtagagaggtctgattcacttccttcttcattctccttctccaaggattctttctcttttttagatctcttttgtttaacgttcagtgaatcatcttcctctgttgtctgggtgaaggtttggcagcccttatatgaaagaaggtatcattggactcaagggaagatctgaaaatctgttgtacagacgaatcctttccctccaacacataaccttcccctaccccaatgcatttttggttggctggctggagaagatgtttataaaaagggcacaattaacatggcagctgcctttgttccatgcaaataaaaacagcagagaaaacagacatataattacttgggcttttttggtgcttgaatggtactactgctgatattagtaaagaacatgccaccgaattgtactctgagtgtgggggg

SEQ ID NO: 51397 - DNA, 2231 bp, Bovine  19866880709125
acccagtgactctgatgcacattgaagtgtgagaatcactgcctagaaagtagtgttattattaccactttgcaatgaacaatggaggcccagaaaggtaaaatgactgtccgagttacatcgaaagtggatacgacaagaatcgaaagccaacaagtctaacaccatagcccagtcccttcatcgcggtgctgtcctgctcattatctaagaaatgagcatggattaagtcagtcaacatcaggcaaaaacaagcacaatgagcgtaggagtgatccttccaaatctcaacagctgagccataacgacagcctgctaagacaaacaatggtcctcagaaacataaaatttaacttaaatgtccacgaagatgggagtagttaactaaattatgacacagccacatgatggaatacagtgcagctttaaaagtgatgcttgccaagatttccaacaacctacaaaaatgcttaggacgtacgaaggaaagaaactcacatacaaactccaagaccaggagcaccagtgtgggcactttccccaaagagtaacatgctggtgaggatgtgggaagacgagtgatttcacacgctgctagagtgaacataagttatacagttactgagtgggacaatttgacaatagacacttaaagtttaaaatgcacacgttccatgaccccaaaagtctaactcttagaaacaactctagaaagatactcgtacatgtatatgaagaatcaggtcagggtgatcatcactgaagtttagtttctaatggagaaaatctgaaacaacataaatttctataattatgaagattggataaataaaccatgggatagccctattgaggaacacaatatgtaggttacaagaaatgtaaatattcctatatccatatatttacatatacacatgcatacccatatagatctgttcacatgcatctgcacatgtatgaattcatatgtatggttacatacatctgggcttccctgatggctcagatggtaaagaatctgcctgcaatgcaggagacccgggttcaagccccacgtggggaaaatcctctggagaagggaatggctacccactccagtattcctgcctggagaatcccatggacagaggagcctgtacagtccatggggtcacagagtcagacacaaagaacagatacaaagagtgactgtagtcactcagtcaatacatacatctacatatattcacgtttatgtacatgtgtagatatacacactgatacacaaatatatacacattcatacttaagatataactatagataggcggtggatagatagataggcagatatatagatctcaagcgtaggtttccaaggtatactgttgagcaaaaaaagccagttgcagaaaaccaaggaaggatgctgttacttaaaaataaaaggacatgagaagagaggaagaggggagaggagaatgaacaaacaagccaacagatcccacaggcggacatacaacattctctactctctgcacagttcagcaatgagcatgtatgactgttagtactgaaacaaacaaccacggcaaaactctggtcccactttgggggacaagcaaagagcccctcttactggtgcagcgtgtgcaggggggcctccagcttctccgtctgcccgtagcagctggccttggcctcggggatgtaggagaacttgtccaacatggaagacgcggccgtggtcaggatgcccagcccgtctcgcaccctcgcctccaggctgtagtcccagtcgtcataggagacggaaatgagtcccgatggaaactctttggggatgagctccgtgttcccggagaccaagctgggcacgatccagaagaaatcatacccagtgaggccgagggagcgggcctcgctcaggatgagaaccgcctcgtctttggaacagtagagcaagatgacggaagagtggatcttcttcagctggacttgggtctttgcgtcctcgaaggacgtgtccagcgtgatcacgttctgcatgtcccagcccacaaagctgttgtccaccgtggtcttgatgaagctgatgaagtccctgtagccagggaagatggtggtcaccagggagaagacatgccagtcgtaatcctgcatgatcttcagcatgactgtggcttgctgctggatggacgctccaaattggaagaaggtagacgtcggatcctgccaaggggtgaaaa

SEQ ID NO: 51398 - DNA, 1048 bp, Bovine  19866880719315
cttgaaagctctaacatgtgtgttttacagcctgcatattctcctccccaataaattctggcatattgttctgcctctttagttaagtctgttgcaaggaacacttaagaatcttaagaatacacagagggagaaagaagtgctgtgatatcagagttcattttcaatgaccctgcaaccaaatgtctcccatctgtgaagtgttaggagaattaagcgctattgttcggttccttaatgtctccatttggagagcgttttagtttggtttaatttctacattgtgcacatcttacatctgagtttgaacaggagccattgctagggacaatcagattagaatatcaaacatcagtccctctgaattgcatggttcttatacaatatcacaacccatgcataccgaatcagcccacaggcacctggttttttggtaagaccatccatgtacccaccaaaaggaagtcaaattaaatccacatttaaaacaggtcataacactacttctaattcaagcctgaattttcataaccattttctcttccttctttccttcctccctccctctattccttcattctttcctccttcctttgtaaatttctttcttcacttcctccttccttcctttctttcttgcttcttcccttccttcttctctccctcctctacctccctcccttcctctctgtctgtcttcctttctttccttttcttttaagatatgtggccaaaagtcagcaatacagaaatgtgggaagaacgctaatttttagagaaaaaaagaactcgtggctgtggtcccaggacagtgatgagatacacttgtcttctgacagccttcagggttgctggggccagtgcatgctcccaagtgtgtgttttgaggatgcgctgagaatgtccttcctgtcatttgcagcaccccatgggccttcttttacaattggaaaagctatttggctcctctggggcctggtattcaacaactccgtgcctgtccagaatcctaaagggaccaccagcaagatcatggtgtccgtgtggg

SEQ ID NO: 51399 - DNA, 1876 bp, Bovine  19866880745058
tgatgctgggagggattgggggcaagaggagaaggggacgccagaggatgagatggctggatggcatcactgactcgatggacgtgagtcttggtgggctccgggagttggtgatggacagggaggcctggcgtgctgcaattcatggggtctcaaagagtcgaacacaactgagcaactgatctgatctgatcatgtcctccaggccaatggaggaaaaaaagatggcagccaaatgatcataccagtaggaaacagaaggtgcccacttggccttgaggaaaagaaaggttggcagctttgggaactcaatgtgcccatcttaagaactacatttcccagcatcccttgcaactaagaggatgatgaaataagaggaagtcattgggtggggcttccaggaaagctatttagagggcactgacttagcttgccctcttgccacttcctccttccttctatctggaatacaaacaagattgcaagagtagcagcagccatctttgaccatgaggtaatcttaaggaaggaagctatatgccaaggatgatagagcagaaaggaggaagtcactgattaatttgtggatgtccctgggctaccactagactttttatctaagtaaaaaaacaaaacaaaaacaaaaacactgtagttggtataagcaactgtagtcagggtctctgtactaacagctaaacagaatccataactcattacagtatgtgaagctcatggcaatttgcacagtgctaaataaatgatatttgaggatgtttttgctttgctttcctcttagccactgtttatgccactcttccccattacaggagcatgttccttctatggctgttgcaggaagggggacctcttccagggccggaaactgggctcttgtcgaacactcagaaatgaattgtccttgaagacacatgtgctgacaaagcaagagactttcctggaaatggggtgccctgggtggagagcaggagggtcagggaacccaggaggactcctctgccacgtggctcacagtcttgggttttatggtgatgggattagcttctgggttgtctttagccaattattctgactcagagtccctcctggtggtgcatcccttgttcagccaagatggatgccagaaaggattctgggaggtggtcggacatgtgatgtttccttttgacctttcctgaactcttccggttggtggtggcttattagttccgtgttccttaccaggacctcctgtcgtgaaaccactcatgcaaatagttactatggtgcctggccagggtgggcggtttcaatcagcatgcttcccctaacatggctagtccgcagtctagattccctggtggctcaaatggtaaattgtctgcccaaaatgcgggagacccaggttcgatccctgggttgggaagatcccctggagaaggaaatggcaacacactccagtactcttgcctagaaaatcccacggatggaggagcctggtgggctacagtccgtggggttgcagagagtcggacacgactgagcaacttcacttttcagcctagatgtgtagctgcaagttgttgccagttatgagatagtaagtcgtcaggttaagaatgagatccctcattctgactgctatccgaggggagcatcacaggcaattaaacgaattttcagaaagtcagcctgtggccttcccaactagccataactttgcaggcagtaccctgctaaatgattccttgattgtcctgaaaactgtgacactgttttctaaaaacagaaacaaaggcttcggtccctttgccaatgtgggtctcaccagagaagcagcttctccctgagacaagatgtttacacatcaggcgcg

SEQ ID NO: 51400 - DNA, 962 bp, Bovine  19866880781649
caccctccatccatctctttcccctctatgacaggatctcagggctttgcattcacttacaacacagatgagttgatgacccagtccgaaaataaaaatggtttttatctgtctgtacaggagtgtctagaaatacttctgactgagaggctgtttgaataatttattcatctgagatcatttcaataatctattcactcattttcataattgatggcaatggcaaatgatcaagggtatggcttttgtcttacatttatatcatctgtcagcttaaaaatgccccatcaccctcagacagcttccttatcaagctgcgtttgtgaattgggtagagatggatactgcagatgacatactggttaattctagctctattagaatactgcctaggttcaaattctcccttcactactatatgaccttgggcaagtcattcatcccatgcagctatcaattcctctcctatacagtggagctctaatgataacttggaaagcaagaagatcaaaccagtcagtcttaaaggaaatcagcactgaatattctttggaaatatgctggccacctgatgtgaacagctgattcattgggacagaccctgatgttggggaagactgaaggcagaaggagaagagggagatagaggatgagatggttggatggcatcaccgattcaatgggtatgaccttgggcaaactccgggagatggtgagggacaggaaagcctggcgtgctgtagtccatggtgtctcacacttgtgccgcacacaacttgctgaccatacaataacaataactgaagctgtcatttactgatcacctactatgggcttccttggtggttcagatggtaaagaatctgctgcctacaatgcagaagtcctgggttcaatccctgggttgggaagatctccggataggggaactgatacccactccagtactctgcctcgagaac

SEQ ID NO: 51401 - DNA, 1055 bp, Bovine  19866880807981
tttcaggagagctaacaggacagttctggccatcagttaccgaagccagactccccaaagtccaggccaacacagtaggatcatagcccaataggaaattagcatcccacaaaggctgggcagaatattaaacctcacaaaagacagtacaatgttgagaacaatgagagatgcgggagtcagcagagctggaattgccagcacaagatttatggaagataaacaaaatccatttgatcaaatgggagatgaaattgatctgttaaataggatggcgggaagtcggggatctctgaatacacatttccttgttgttgtaagtcattatatacacaaacacagatagacacacatacagaggcagaaatagttgtgaaatgtacaacaaaaacacacatgcaaaggcataaatattcacagagacatgcaccaccctcttacgcatgagtgcccgggtttatacacatgcaaaggcattcacctgtgtgcacccactcaccttcaccctcaccaccccagacaggcagaggggaatacctgtctgctgggagaaggtctgtccccccaggatttgtcctcagagttagagcatttcacctgcaaatcctgccacggaagaaccttccagctgatccttagagtcccttcccagcaagaaagctcagccctctctagccccggggccagtcctgaccttggctagaaaggatttaaagaactctgggcacggacttccctggcggtccagtggttaagaatcctcctgccaatgcaggggactcgggttcaatcccaggtcgggaaatattccatatgccatggagcaactaagaccttgtggtagaacacttgggtctgtgctctagagcccgggagctgcaactaccgaacccatgttgcagcaactaccgaagcccttgtgccctagagcctgcactccgcagcaagagaagccaccgcagtgataagcctgcacaccgcagctagagagtagcctctactcactgccgctagagaaagcccgcttgcagcaatgaagacccagtgcacccaaa

SEQ ID NO: 51402 - DNA, 744 bp, Bovine  19866880813286
tggtaaagaatccgcgcccccagtgcaggagacacagtagacatgggttcagttcctgggttgggaagatcccctgggggaggaaagggcaacccgctccggtattcttacttggagaatcccggtggacagagcggcctgggggactacagtccatggggttgcaaagagacagacacgactgagcacacacgcacgcagcatgtctctgggtctgtttctcgattttaaattttactccagagcctcctagatccaattgcccagagatgggagaaggactcttgtgaagtattgtcagccctgagatgcctcatgactgacagctctttgcagataaggaccatctgccaagtggccctgagggctcctgccaagagaagagaggctcgagggagcaggaattgaaaataaccgagtttacacacacacacattcttaccaacctccctcgcatgcctaaaatgttaagctgcaacgacccaatcctcaagggtatttcagaaataattggactggagcagacccactgagtccatgccccttaaagataaaaaccaacctcaccccatcacatatccttatccataaacagtggacaggagctcaagagaaactgagtctgcttatactgacgctttgctccacttgagggaaccctctgttgcctggtggggattgtcctttcccttaaaagtgaccctcaagcctggaatgtctgtgaaacagcagaaaagatgagca

SEQ ID NO: 51403 - DNA, 1086 bp, Bovine  19866880936749
ggctcgagtatgggggtaggtgtttcatcagactctactttttgatactattctctccttaaaaaaaaaaaaagagtccttgttacctaaccctgggcttggtggctcagatggtaaagagtctgcttgcaatgtaggagactcaggttccatccctgggtggggaaggtcccttggagaagggaatggctacccactctagtattcttgcctggagaatcccatggacagaggagcctggcaggctacagtccatggggttgcaaagagttggacacaaatgagtgactaacacttccactttaacttgttacctgaggttgtctttagacaaatttctccaccttcatcagactgtacattctttaagttgtatgctaattcatgtgtgattctggaggctaacacatggttctctggatagaaggagtgatggatggaagacagagatatagtgcccttaaccccttccctaaaaaccaccttcttgggactctctccagctgctagtccttgccttgcctggaaaggtctcagtttctggaatgggtttaataaacgctgggccagtcgggaagtgtggcaaggaccccaaacacttgcctgagcgtcgcatgtgaactgaaccctctggtgctccttgggtagagagatgttttattaaacaccaggctgtggatgacggctcactgcacttaatgcattacttctctggggctgaaataccacctacaacattgctgcattcaaagcatgactcctggaaatagcaggccagcatttcagagcagtaggattttttttttttaaggaatggaattcagggtggtcactggagagagtatttgactgtcttgccaattatccttctcaaattccttttcctgtatatgttatatttcaattgccctacaattgagttatgtttccatcagaatcatacaaatattccagctgcagggcacttatgatggaaagtaagaattcattagcgcagcccttgtcttgggctggcagcaatcctgactctgtaacatgctcctatgcttcacaccaatttatctgagttccttcctgatacctggg

SEQ ID NO: 51404 - DNA, 1196 bp, Bovine  19866880941321
tttgggctccctggcaatgcaggagacccaggttcaatccctggggactggaagatcccctggagaagggaatggctacccactccagtattcttgcctgtagaattccaaggacagaggagcctggtgggctacacagtccatggggtcgcaaagagtcagacacagctgagtgatctaacacttgcacacattctgatattgagactacctgccctttgctgcataatttctatataagctggcaccttccccttctcctcagagcagttctttcagggttacttaagatgctgccttctggagtcaaggtcctaaaaattcccactgattaaaacataactctcagctttcaggttgtgaatattttttaagtcgatatagacataaaatctcctaggggagactgggcttgtgtctttcatatctcttgtatccttctaacaccaagcctttgacagcatggtgtcatggggaaacaagctcatcctttcctgtatttaaaagataacttgcctggagagtaactttatgagaagcgtgcacatccttgcatttaatgacttggattttctgcctctgcctgctgcctggacatgactgtcacagggtagcatctgtgttaggggaaacacactgaccgaaactgcccaccctggtcaggcaccatagtaaccattcatgtgagctattttacaacaggaggtcctggtaagggacacagaactaacaagccacaccaactggaaaaattcgggaaaggtcaaaaggagacaccacgtgactgatcacctcccagaatccttctctctggcatccatcgtggctgagcaatgcctgcaccaccaggtaggactctgagtctgaatgattggccaaagacaacccaggaactaaccccatctccataaaacccgagactgcgagccacatgacagagcggtcttcctggcttcccttaccctcctgctctctgcctggggtgccccttcccaataaaagctctttatcagcatgtgtatctcatcagacaattcatttccgagtgttagacaagagtccactctcgggccatcctcctccctgcaacatctggacaagccaaggagtggctgaactttccaagaacaaacggagcatcaccgagcatcagcctagagtatgaatggggggcagtctgctgcagcctcacaggt

SEQ ID NO: 51405 - DNA, 1020 bp, Bovine  19866880960781
tgtggtcaattgcaaggccttttaaaatatatggttttataacccgctcaggttacacaaatgtttgaaatgcagacacctcattcctgtagcagaaatattagacgttgctcaggcaaaaggcatcatctgataaaccagctactcatactttgtcatatccaagcattgtgataaactagtgcttaccatagtgaatgtatttataaaaccataagagcatatcagagtggaaactaaatcccctttttcttatctctatagaaatgttttcccatctcagcaaacaggagagcaccagggaagaaggaagggagatgctgtctctcttaagtttccaatctgatttaaaggtcattcttgcaagccaggcatccccttcctgcttctctgagctctgaggatatcagtctggggtcaggaaagagagcagaaaatgagcattttttccctagtgctcatgtttgctgacctttgcttaataggtatttatgagttgcatctatttccaaactgtgaagctctggcaggaatgatcagtttcaaagcatcaggtacctgttgaactattatgtgccaagcattctgcaaagcactgtgctttgcatgagtcattccatttgatctcccagcaatccaatgaggtcaatcgtttccttgtccccattttacagatgaagagactgaggcttaaacaggggaagtggtgtggtgaaattgtgcagctataatatgacaaaacttctcatacaaatcttttccagcagaaccttctgaagaccccagagagaccttttctttttagaaagaatgtttggttgaggcatttatccattagttcccattccccagtggttgaggatttttcctaggagagttaacccccaatactcccaggctttgtttaaacctggaccaaacagtttcctgaagcccttggagaaaatgctggggcagaaatcagaaagacacacagtgcggtctatggggtcagcttgaaaatatttggggggtatttat

SEQ ID NO: 51406 - DNA, 1619 bp, Bovine  19866881015674
aatcctgttggctcaacgttcaaaacatatccaaaatctgtttactcccactgcgatctcactcaccattacccctcacctggattcctgccaagcctctcaactcatctccccacttcttggtctgttccccacacagcaacttgaagggaccatttaaaacataagtcaaatcacatctttcttttggttaaaaacttgcaatgttgccccagttcactcaggcgaagagcctaatgtctcacaacatctagcatcacgttgtctctctgacccatttctcactgtctgtcatcatcataactgttaatacctaaagttgatcacatgctgggggctaaggttttacgtgtgttgaataatcccataataatcctataagatagatcctattgttatcccattttatgggtaaggaaactgagtcacagggcaattaggtggcttgcttaccacttatttctcacaagtgatcagccacgattcctacccacacagttttggtccccctctatttttagcatcactagtgaatcttgccctcagcaattagtacagtggtgtaaaaggattaggctttgaactctagcttcaccactcactcattgtatgaccctaggcagctcactttacctcctggcatcttagtttttcattcataaaatgggatttataatagggttggtattatcatgatgattagtgaaagggctggaaaaatgcctttcacacatttgggatgccactaatacaagacctcttttggttcctgtctcctcccctaaagaaatggcaaaatggtacattcatccaggagatgagatattgaaaagagcatccttctgataccagctgccagagtaccagaggtttcaagactcccagcaacacaaaacactccatcgatgaaacaagctgcagaatccttctacatcttgacagaaggacatctggggtttcctgtccatgtccagtaattcacattttctatggggcatatcaattatgcatccacttgcttctattaatatttcaggcttcataagcatcaataaaacatacattaattagaagtttgcaatcatatcatcccttctccatctcctcctgctcccagccttatttccaaagctgagcatgagggtgtatggtccacagccataatgatttttctttttttgaatttatttttaattggagaataactgctttacaatcttgtgttggtttctgccatacatcaacatgaatcagccataggcatacttctggcccctccctcttgaacctcctgccccatcccacccctctaggttgtcacagagcccgggtttgagctccctgcatcatacagcaatttcccactggctatctattttacgtatgataatgtatgtttccatgctactctgtcaactcatcccaccccctccttccccaactttgtccacaagcctgttctctctgtctgagtttccgctactgcccggcagataggtttatcagtaccatctttctgctaagtcactttcagttcagttcagttcaatcactcagtcgtgttcgactctttgcgaccccatgaatcgcagcacgccaggtactcccctgtccatcac

SEQ ID NO: 51407 - DNA, 1075 bp, Bovine  19866881040332
ttcagcagtttccttgtagaagctggtttgactgtagggtgcagtggggtcccaatgtgacatctagtttcacagactcctgctgtcttgaaggaaccttagattgaattgattcacaaacaaactgctagactcaactgcgaactactccaaatagaacgtatttcaacttggtatcaggtcacagtcgtggctcagacatctttgctgtgaagtttccagatcaatcaaattcaggtctgcttttggtttcaagcagcagccgaagacacagaatgactcgtgcataaccatgctatcacccactccagtactcttgcctggaaaatcccgtggatggaggagcctggtaggctgcagtccatgggatcgccaggagtcggacatgactgagcgacttcactttcacttttcactttcatgcattggagaaggaaatggcaaccctctccactgttcttgcctggagaatcccagggacgggggagcctggtgggctgccgtctatggggtcgcacagagtcggacacgactgaagcgacttagcagcagcagcagcagtgtgtatatttggagaaggaaatggcaacccattccagtgttcttgcctggagaatcccagggatggtggagcctggtgggctgccgtctatggggtcccacagagtcggacacgactgaaggaacttagcagcagcagcagcagcagcaaccgtgctatcagctcacttgtgtgttagatttgcatgggagtgatggtaattgatgatactgtttatgctaaatacggacattaagtcattttaaataccctcatggacattaatcttatgtcctttggaagactttatatttcaggtggagagaaattggcctcctgtttgctctgtttttctccttaaattcatcttcctgaagagttaatccctcacattttcaccagcttggaagtaaatcactgcttattatccagagtgaaatgtcttctggtgtttttgcacatgtgaagtgttagctttaaggcttcttcccccaccggttagaaatcacccaggagttcacggggccagtcaag

SEQ ID NO: 51408 - DNA, 1256 bp, Bovine  19866881074964
ctctgcctttgaatatgctatctaggttggtctaactttccttccaggagtaagcgtcttttaatttcatggctacaatcaccacctgcagtgattttggagtcccccaaaataaagtctgacactttagtcgtgtctaactctttgcaaccccatggatgtaccctgccaggctcctctgtccatgggattctccaggcaagtatattggtgtaggtggccatttcgtcctccaggggatcttcccagggatcaaacccctgacttatgtctcctgtattggcaggtctgttctttaccactagcaccacttgtagattccatatgtgtgcgttaatatacgttattcgtttttctctttctgacttacttcattctgtacaatagtctctaggttcatccacctcattagaattgactcaaatgcattcctttcttatgcacggccataaattattgagtaccatccttgtaggcctggggtgtgcccgccccccacaaccaggtctgaacaattggttcagagaaccttggtaagcagtcactgagcgacaaaagcaaccaaaatctattgttttctctcctttttagaagagattaaaattattcatgaagggctgctcagctgaacacttggatcttttcccctctggacagcagggacagatttcctggccagcactggctgctgaagaatttaacattggttaaaagcgaacatctcctccaaggggggacattaatacacttaatgtttagggagtcttggtagcctgtgctgcgaggctgccaaccgaattacattaggtcggtacttttgcttttgatggggtgaacaggtggcctggatgccccgtgcacacatctctattcacctggatcaagtgcatgcaggtgtgcgctcttcagatctctgaagagtgggttgaccggcatgctcaatctgtcctctgaccacacacgtgtagtcactgggtgcggcagaattgaggcagttctcatttctgctaactgagggcctgggtacctgtaatcattttttttctgagattaggcagagacaggaaggaggctgatgctgggattgctccagagcaccctccgtgtgctcaaacacccacagacacaatgagagcaatcagaaacccaaggctgggcagccaggacacacagcttgtcatgatgaagctggactttgaacacgggtctgtcggctcgaaggttttccaaaattctttcatacatacccagatccc

SEQ ID NO: 51409 - DNA, 1879 bp, Bovine  19866881131731
tctatgtgctgtgctgtgttcagttgctttagtcgtgtccgactctttgtgaccccatggactgtagccctccaggctcctctgtccatgggattctgcaggccagaatcctggagtgggtagccattccctcctccagatcttcccaacccaaagatcaaacctagatctcctgcattgtaggcagattctttaccttctgagacaccaaggaagcccatgaatactggagtgggttgccatgctctcttccaggggatcttcccaactcaggaatagaacccatatctccagcagctcctgcactgcagacaggttctgcaactatactcccatataaaataaaaaaattaaaaaaagaaagctgagacttgaaatgtgcccgtgcaggtgggtgttttctcctgtgcctccaacacagccaggaaaagagcttctgccagctagctgctgccctttcagcctgagacccagaataaacacggatggaacaaagaccacagagatgatccctgggcttgtggcagcaggaggtggagccaccatggcccaaggcaagctttcccactccacctgtgctcccatgagcaaaataaatgccaattgtcatgttcttccgagatgtcacagcaataactgggcaacacagctacaagtcactacgacacagaaaacacgggtgttgatctgactgaaaggtaccaatgccctagagagaatccaaagattcagatgctctcatgtgggagttaaatataaaccacatttaggtttcttgatgacactgtgagaacccaaggtttaaatctgggagtagagggtataaggcattatgccctttgctcaagtttacaccaactgtacacacaaacctctgcctctttcaacactgtgtttggccgcagtggttgacagaccgtcctccccagccctggacaagagaagcatgttttcacatgtgtgcatgctcagtcacttcagttgtgtacgactctttgtgatcctatggattgtagcccaccaggctcctctgtgcatgggattctccaggcaagaatactggagtaggttgccatctcccactccaggggatcttcctgacccagggagcaaacccaaggttcttatatcaccctcattgacaggcgggttctttatttctagtgccacctgggaagccctgcattttcgggaaccatctccaaatgtagtctctgcccttgaacgcagcttctgacctatgccctgaacttctgtttcctactcacacttacccgtttctagggttcacctgccatctctgctgcttttgcttttcccatctcagtgttggcaaatccaagggctccaacatgccattggagccagaacaggattctaaaaccatgtcctggagcaatgggctatgttgaaatccccaactaaaaggagagatggacagaaggaaatgctgctggagagagtcagtccagttagctggaagctccagaaacaccctcattccattagactgcaagcccatgtaggcggaaatggtcttttttcaggataggcagccaaggggtggactgtagtggaaacccatggggtttctactaactcttcactgtatagcaatcacctgtccttcatctgcccataggaagacagtaggagctgtcgtgttaggacaatgtaaccctaccctttattcactcctgaggggtccaggaaagagcctttgacccaaaatcgatcaggaatcattcctctggaatttgaaatttagaattcggaaaatagagactgggacttattacagcctagttgtgtgatgtcactgctctagaaacagtgatggacaggggagcctggtgtactgtaatccactgggtctcaa

SEQ ID NO: 51410 - DNA, 2815 bp, Bovine  19866881164504
tttgcgtgtatatattcttgtgtgattctttgactatgtgtgtcttcctaattagcctaaaaattcaatgcaagtaaaaatattgctgtttgcactacagtatctttagtgcctagcacagtgcttggcacgtagaagccactgagtaaatatttacggagtaaatgaatctctattaaacctgtctacaaaccccagactcagttacagccctttgtaaataggaatgtaggaggggaaagtgaaggttgtctgtttctccccatctgctagaaaaaatcttaaagagttgagatttttggtgtttggaacaggagcccatcagactccgagaaggaggtgcaagctctcaggatccagggcaatgttgacacagcaacttcaggtccggatcaagttttccacccactgcacatttccaccctctttggctgacccatgggtgcttacttagatgtgttgggaagggagggaggaacttagagaagatctcagaagttactgcactctggggactcataaacctttgtagcctatctctctgtgagtcagccttgggctggagcttttgcctgcctcccacggtgtagaatatgtgatgtggtcagtgacgtcaccgaagattctgctacgggctttgcctctatttgtgttaccttgggattttaggtggagaaggaaatggcaacctactccagtattcttgcctggagaatcccatggacggaggagcctggtgggctacagtccatggggtcgcaaagagtcggacacgactgaacgacttcactcacacttcactgggattttaggagttgtctctgcaaggaagagaggatcttggagcaataacatgattactgcagatcaattactaggagcactagtgggaaagtgcctttggattcagacgattccatggtatagctctggttccaccacttaaaaagctgtgcaagtttgggcaggttgtataacctctctgtgcttcagttccctgaactgtggtgttggagtaataatctttatcatatgggatttgtggggattaaataaagtggtaatattggcatatttccttagcacatagaagtgctcagaagtgacattgttttaattatagcatcagatgctatgggggagctgggagcaatgttctatattaccagggaacacgggaatgcctttgcaaattaagtcatatttgagctatattttacaagctaacttcccaggtggtgctagtggtaaagaacctgcctgctaatgcaggggatgtaagagacatgggttcaatccctgggtcaggaaggttccctggaggagggcatggcaacgcactccagtattcttgccggagaatcccatggacagataagcctatactccatagcgtcacaaagaatcagcagcaacttagcacaaccacaaaagtaacataatagtatctgccatgtatgttacatgctaaataaattctgtgctaagcgcttcatgtatatttttggctcattcaaatctcactatagttctgaaagcatatgctgtgtccatccacattctacaggcaaagcaaagttcagaaaggttaagccactttcccaaggctgcttagctaatgggtgaagccaggatcagcatttagtttgtttgactccaaaagccattgtcttggccactgaactacccagtctcttaaaggttatgtttgagttttctaagagagatggaaaagaaagggatggatgtagcatattccaaaaggaagagcctgaatatctcttcatctacttgcatgtttattattgttggcttggaaggcaggggagtgatcagttttatccctcattgttctcaggcacatgccagcacctaaccagcgttcagtaaatctgtgttgaatgaatgacggatgtgatgggctccattttctctctatcctgtgttacacatcacagcatgaggcgatgaatgtgtttatttgtccaaataactctaccgccttccgtaacttaaaaaggaaggtgtctgtgaagctggacagttttgtaattggccgcgtggcacgtttctcaacaagcagcaaacattttccagtccagatgctgaagtcatctctgagaacagactgattgccttctctcccgacaccctgtcccctctcctggtgtccagcatgtctgaattctctttaagggcctgagattcatttctggtgacacttacattccaggaggagaggtgagagggtcacatcaacagagacaagcccggactcttggcacttagctcttcagacaaggtatttttccttgaggttgatgctacaaataaagcgctgacctgcggtgtcaagcagttgcatgtgggagcaggagtaggaaggagaaagtgcgaagctgggggcagctttcccccgtgtgtatgcgcagagtgccaataagctgtcaaataaaattaaggttcaaaacatacagccttcaatttgattccgctaagatgccggctgctgcagggagggaacacaatcgattctgttttgacaggtctcggtgttcgctaagcagcaaaagtctccactctgtacctgattgataaaagctcacctgatttgcaacttaaatagaaccccatctgagcttgaagggaggcgctcatcttcccaccagacctccgtcccttttgctcttggacttcctcttccttttcctctttctctctttcttagcactttttaaatttctctccctctcactgtctctcttctatacttagaggaagagtttatacaagtccctaatacctgccaggcatt

SEQ ID NO: 51411 - DNA, 1019 bp, Bovine  19866881206151
aaggagaggggtgaattaaggactgtttccagggttgagatttcaagaacctcatgtttggtacatgggagaaaatattgtgctttttattaaaaaaataaaataaaatcactgaaggtaagatgatgagttctgctctgactctattaatagagtctgagctctcctggaggctgtgaagaggagctgatgaaagacagccatgtctgagaaaggtcaacatagagatgatacctgaagagtgagtaagagatgcctgaacatgaagtctgagggcaggagggaggggcagggagtgtgaaatgtgtggagagaaagaggggcttggattttggcagagctgcagaagtcaaagaggtgggaactcacccagaaaggggaagatcatgactgtctaggataggggactcaaggacaatgggagtgactttcaacgtcaagtggatgcacctgttggctttcatgatgagagaatcgctggtaaccttgatgaggcctgtttcagaggagagattggtgcagaagtgtgtccaggtcacagctgatgggattagtaggaaagagttccctgtcatcagtggaggaggggtgaaggatgacaggtgtgcagagacaggtaagcttgtggggttcatgggtcatccatagactgtgaaatcagaggcagattcatcagctgggagtgaggatggagctggcggagttgcggtccctcgtgggcaggtgtgaaggtttgaaatagttcccagggaatggaagatagccagtcaggaaaagggaaaagaactgctggtcagagagggaatccttacattcaaaagtgtttctgcagttatgtgatgttctccacctctatattttggtttacagaatgatttacagaggggaaagtggcccggattgactgaattgctgaaaggtggtgatgggcaggtgtgacaggaagacaaagtggggcatgatagctgtggaagtggcagaatgtctattgatgtggtagatgaataggtctgcgttag

SEQ ID NO: 51412 - DNA, 1415 bp, Bovine  19866881281595
tggcctctaccggctctgagtcctgtgggagagacagtcatgtaaaccagtaattatggcaaaatgagatgattgaatttgcatagggctggaggcagtgagaaacatggcatgttttgaaatcagagaacagttcaaaattggcagggagaaagaagctatcaaaggaggcacttgaaagcaggagccagatgggtaaggagtttgggctgtcctgggaacagtggggtcattggatgagaccagctgtacgcttggtggacccaagattcctcacttgctgcctatatttttgcaacatgggtcagaaaccacatatatgatcaggaaccacatataagattggctgttacaggtgtgtgttgtactgtgctcagtcgctcagtcatgtccaactctttgcaaccccatggattgtagcctgccaggcttctctgtccatggggattctccaggcaagaatactggagtgggttgccacgcccttctccaggggatcttcccaactcagggatcgaacccaggtctcccacattgcaggcggattctttaccatctgagcaaatttggacaatagtgctatagcatgcactataggaaggtcaccagtaaattctatcccagtgatataacactgttagagtcctgccctggtttcaggagcaggcagtccatgcagactaaactctcctgttcccaggctatgtagtgactgggagatgctcacctgcaagaaattgctgatgcggattcattgtaaactgtcttcagtatcaccactacccctaacaatgtgctttggatctaccagctgcatggtatgctgctgaacatgtggcagtgcctgtcttagggatccagctcagagggctccatctccaggaagcctaccctgaatgcacagggatatgaatatgagactatgggttctccttccgtgacatcctggatatcttgtcaatagagaactgccactgaaatataactgccacttgcttctaagttctccccattgggagatgagtttattcagggtggaaatcttgtcttactcttcctgtgtctctagtccctggcacagggcctggcacatagtaggtggttcacgaaactgttcactgtagatgacacaaggctcctctcctacagcagcttgtgttctgatctgaggatcagctcgagccagggagaggaaggaatctcaggtagagggctcaggaatagtttctgaaacccagaagtcaaggctgactcttggggcaagtcattttcaatcaaagatcgcagcgacggtgtccagcggtcccctgcagagaaacagcttccatctacagcttagtgacatcaggggtgatgctgctgtcgatccagtgagggtttgctagaacaccgagagggaaacgaccctgtttcca

SEQ ID NO: 51413 - DNA, 1309 bp, Bovine  19866881439271
gtctctactggcacagtgtgcttctggtagagcaagcaattttctataaatgaagaaatagagctgaactgcaaattttgaaaatggagttttcaggagattatgtgatctgggagatcatattgtttcccgaagaaggtaatacttgcctggcatgagagaaaagagatttcatgcgaagtgctgcaaagctctgaaacctcttcaaaaatcatctgttctagcaacaccaccaacaaaaagcctgagacttggccactgtggtattttttttcaatattgaattgctttttttgttttgttttgtctccagggaaaactcatctacaagtgtataagaaaagtctatgaaaaagttagacttactttacaaaatcactttcctgaaatatagctacctgctaaggcaacaagatgcctctatggagatgaataaaaatcagatgctccaaagtcagaattctggcaatggtcgaaagtagtgtcatatgattgtcacttcttccccaagctgttctggggacccaaggtggatactggggcaaacttcaaggaaatgtcccattgtgaacagcaaggaaacagctggtcgtgtttggagatcagttgctaaaaatacctccatatgctgaggccaatcacccatggtggggacttgtcagatttctcttcaataactcctcagcttgaagtgtgcatttgacaactccagacgctctactaatggtccgagatataactgggaggaaaccgggatctccatctctggcgcccccacacggatggaatgcagttgtgaagatggtattggtctccgttgaatattgcttccgtggtggctaaaatggtaaagaatccgcctgcaatgcgggaaatctgggtttgatccctgggttgggaagatctcctggagaagggaatggctactcactccagtattcttgcctggagaattccatggacagaggaacctggtgggctacagccctgtggggtcacaactaacacttccacttttcactttcacgtaatgttgcccattgctcctccctaaagtttccaatacgatttacggctcatgtgaagctcataaaacgaaagctaaacaacagtgagaattacagaatctaattccaatgccattttggcatcactgactcaatggacatgagtttgagtaaactccgggagttggtgatggacagggaggcctggcgtgctgcggtccatggggttgcaaagagtcagacacgactgagcaactgagctgaactgaacaacagtgagaattacagaatctattccaacg

SEQ ID NO: 51414 - DNA, 1309 bp, Bovine  19866881496555
tcaacgtgttcttgtggtgtgttatctgtgtacacacatggcattgcatcatgattctgtttggtcacatgtgatctcattgaaggcatgcaaatgttgtagcatgctgcacaggaattttaataacatcctagagcatatccgggtgctcgtcagggaggctgctgactggctatgcttagcccatgtgttttggtgttttttttctagttttcaatggaattagttactagcatttaaaaattgagggacatccctgttcgtccagtggtaaagaatccccacttctgttgcagggggcacgggtttgatccctggttggggaaataagatcctgcctggctcacagtacaaccaaaaaattttaaataaaaatggaaagttttcctgtataatcagatggccattttctcctataaaaactgaaaattggccttgccttccgctaagaccatcctcagcaagagcagagaatcatcatctcctttgggtttgccacactctgtcatattttaccacagtctccattgctctctctccttgacacccaggctcagctgctatttttcattccatttgtgctatttttctcaggcccggcctgccttattcattcaccttccatttctggcttgcacggtcatctggctcatgaacacagaacccagtgtcctttccacacatccgagaagggatggtgagtgaggggaagggtggtgcagaccccccaccccctgcccaggggtcccaaagcactctgggcgcccccgtgcttttctggacctgcctgctgcagagagaagaagccatcggggatactgaccctgctgatggagaagagcaggcccggccggtcggagcagacgcccgtgaagcagaagcgcagcttccagtagaagagatgctcccagatgaaggtgatgaggctgagcgccatggcggccgccagcatgtagaacacgcctgccatgttgtcgatgtccagctggctgctcatcacctcgttcttctcgttgtggcagatccccgtgagccacagcgtctccagctcctccatctcccctggacggaagacaagagccacaggcagtgaggagcagggcccgtgccacggggcggacacccctgcgcttgcggcagacacgtgtgacttacagctgcacaacctcaaggggagggactgagctccgcattcactccctggtcagctgaagataacgatggcaatacctatgtaacatcgttgtaggagaatgaactgagatcctgtctagagagaatttggcgtagtccctaatctctctctctt

SEQ ID NO: 51415 - DNA, 1462 bp, Bovine  19866881516335
cagctccaggtttaatggctccaagccctagaatgttccttcccagccttctcactgcatctctccatcatttcctcagttctcttctctagaggctgccccagctctccccaactcactaactcagctttgatcaaggatacaagaggggatgtgagcaaatgactagcttccagcccccctggaagccacctgctcacttatactgggtctaattagagaagccacttttctccatgaattacagagcttggttctcctcccctggagcaaaacaatggcaccatgatggaaagtgacctctctcaggcacacagctgtgggttctacctctgaaccacctgttcctctagtcagctatcagttccagactcaactgacccaaaaggggagttgccctgaaaacccaagactctggggaacacaaattaaaaacccttgctctgacaagaaagcaccatttggaagatgggaaaacaggatcagagagggaaagtgactgccccacagtcaccccacgaaacagtggggtctgcgagccagagcgcagacctccttcttcgcagtccaatacactttgccactacatcacttcaacctatcaaattttgcatgatttccttagacatccctggataaaactcaacaccatgtccaagggaggtgccctatttcaagctcatttagcattcagcatcagttggagctgattagagttctgattagaatgctgaaatcatttttacttccaagctttagtaatttagtatcaggtgggtatttgtcaatagggacttaaaagaaattgtaagcaaatcataacagaaaggaaagttcacacacacacacacacacaatctttcttacattagctttaattaggttgacacagattgatctggaaaaatttccaaactcaggatgaatttcccttttatgattgtgaaaatcatgaggtttttcagagaatgggacttcagagataaatcgacagacaaggcagctttgggctcctccagtgacagcagggagacaaagcccttgattaaaggcagacacaacagccaaagccagtactcttgagtcacacaaacatgccatcgggatcccatttctgtccatctcttgctgtgttaccttggttgcctcactttctctgagtctccacttccaactctgtccacaagccccagtgcacagttcattctttactaagtagccaagacttttccaaaacataaatcaatctgattaaaagccttcaacaaaatcccatttaatttggaacaaaaccaagattccacaatgcagccaacctgattttgcatcatacggtcgtatgttacatggctacatgtaacaaaaactttggtatgttcacataaccaaacaggggcatatttttctcacaggacaggaagtccaagaagtggtccattagaaggtccaaaatgcccttgaa

SEQ ID NO: 51416 - DNA, 941 bp, Bovine  19866881733456
atctgcggttttgaaagtctaatgaacctgctaagctacatttttccttcactggctcagtcatctggaagagccaaacattcgcaatctgattgcattgctcttcattacttcctattctctctcctccgaaaactccattaactcacatcggaaacacttgtaggtaatgcttctgagcttttgtgtgaaaatgtaaccagtgactcttcaaggacaaagatgacatctctcccagtgtttccattcagttagctctaaagacttcccaagaaggttagcatctttgatccacagacatactgagctggagtctcttctggattaaagttccttccagacagatgttgagtctgttttaagccagtagagagtgtaatccagagctatctcaaaatatttctgggtcacatcatagacccgacagatggcagctcacgactgctctgtgtgctcagccactcagtcaagtccgactctttgcagccccatgggctgtagccgccaggctcctctgcccatggcattctccaggcaagaatactggagtggtttgcctacaccagggattaaggatcaaacctacatctcttgcatctcctgcattggcaggcagattctttaccactagtgccacctgggaagccccaccattgttctaatgatttgctttgttgtggtgtgtgagtgtgtgtgtgtggtgtctggaaatagccatcctcctgggtacctgaaaccagaattctacagcagaatctgtcatgctcattagtcaagtgacagatgtcatcacttcgaagtgagaaaacatctgggataagctgtttgatcattttccatctgattttctgaacagttagtgattgggacatatcaggtgcccagtgaagttcactgcagtctttcagattctgccctgtgagtacaagaattcagggagg

SEQ ID NO: 51417 - DNA, 1112 bp, Bovine  19866881902401
atgtgtttgttatacttaaaaatggataaccaacaaggtcctactgtgaagcacagggaactctgctcaatgtcatgtggcagcctggatgggaggaggcggtttggggaagaatggatacatgtacatgtatggctgagtcccattaccattcacctgaagctttcacaacattgttaatcaactatactccaatacaaaatagaaggtttaaaataaatacataaatgcatttgttgataaattgaacagaaaattcaaattaaacctcaggctgacttttccatttctttgtagtctatgaagagaaacccatgggatttctgccaacaatgtttgaactaacttgatctgaaaatgtccctcaccttctgacaagacctttgaatcaagctgttgaaaagactctgatgtgacaaatacccacctagggtcttcctcctcctccccttggaggcagctgagtgatttgtcttcaatcaccttgggcacctgggcggccagcctctgagatgagcagagggttcttgtcaatcctccgctgtatacctcaatctaagttgtgctgggagaaatctcacaatgagcaagaggatttttttttttttaaggtgaggcaagatacttatcttaaaatcaaaggcagttgacaggcaggaaacacaattctctttgtctggacacatctcagatgagcagagaaagaatgaccaccgggaagtcctgactgatgtagaaccactccttttcagccaatgctcggggagagatttacaacaccttctgtttatctgttggctgtaaaatccctcaatttctgcgatttagagtcattgttttcaatttgccaagaggttcttttctccagggagttgtgatgaagtttcccttgaagaaatcactattcataaaccaggttggtgtcaaaaagaggctggagctcctcttactgtcttgggaatctctgatcagattcagctggacgcatgggagacaggagagcccaaggttaagagtatgctctttgaactctgccagaccccggactggagggctggctttgtccttcactagttttagaactttgggctagatgttgaatgactccaagt

SEQ ID NO: 51418 - DNA, 699 bp, Bovine  19866882037858
ccacctgcacttgcttcccttctagagttttctacctcagagcagagcaccatcagctcccactcactaggccaaaatcatgacagtcttttgactcctctctcttcccccccttcctccagttttggttaatctccctgtctatatcctcctacatgcctcctgctcccactgtctgatttccatctctcatcttctcctacatgaattatggtgacagtctaataactggtctccctacctccaagactgacccacctttaattctttctctatatacctgccactggaattgttctaaaatttaattctgggcatgtcatccccaactgaaagtcttttaataactccccatcaccaaatcatggaaagaccaagactgttggcatgtctgtcatggagtttcctggttggttctgtattttttaatatttgcttaattagctaattggatgcattgggtcttagttgcagctcacagaatcttggctgcatcgtgtaggatctttctttgtggcacacagactctggaattgtggcacgcaggctcagcagtcgcagcacgtgggctctctagttgaagcggatggctttagttgctccaaggcacgtaggtcttagtctccaccagggatagaacccatgtctgctgcactgcaaggcgattcttaaccacggaccaccagggatctcccagaa

SEQ ID NO: 51419 - DNA, 834 bp, Bovine  19866880142970
tctgtcctttttgtgcccatttttgcatgaaatattcccttggtatctctaattttcttgaagagatctctagcctttcccattctattgttttcctctatttctttgcattgataacttaggaagactttcttatctttcgttgctattctttggaactctgcattcagatgggtatatctttccttttctcctttgcctttagcttctcttcttttctcagctatttgtaaggcctcttcagacaaccattttgcctttttgcatttctttttcttggaaatggtcttgatcactgcttcctgtacactgtcacaaacctctgtccatggttcttcaggcactctatcaaatctaatcccttgaatctatttgttttaattttttgggagttttgtttgagttttctgagtgatctcaataataaaacagtcttttatgacttgaatttcctaaggttctaaaaaacagtgtgtaaggcatgaatgattcatttatatttttcacactgtgtatctatctttaatgttgtaaaatggttcacaagtttaaaaaaaaagaaattaaaagtgaaattacatgtcactttgtgcagttattataccatatatgtacaaaagactatcgactgactcttttgtggcattggctaaccgaaactcttaattcatcactcctcacaaaagccctgctatgtaagaaagacagtcactgagcatagttatttatgtagagacagttttatagaacatgaaacagtgggctagaataccacctgttggttggcagcaagtgcatagagctcattagtactttattgctttttctgcttag

SEQ ID NO: 51420 - DNA, 1951 bp, Bovine  19866880646900
tcagcccctccttttccctgatattcctcaatcctgaaggaacaggggcaagacaagaaaggaaataaacttttgtatacaaagtttaaccataaatttagcaggagaactcagggggattctgcaccctaccaggctcctccatccatgggatttgccagacaagagtactggagtagtttgccattgccttctctgtttcaacagtataagcatgcctaaatttaatccatagagtttcaaaagatccaaatggccttaatacttcaccagtctggaagaatttggggagaaatggatgagtttcagaggtttccagaacaacctgggcctagaaaggattttcaggaaaagtccaaattaatgtagagccccaatcaaccctgaatattcattggaagaactgatgctgaagatgaagctccaatattttggccacctgagttgaagagttgactcactggaaaagaccctcatgctgggaaagactgaaggcaggaggaaaaggggacgacagaggatgagatggttggatggcatcactgactcaatggacatgagtttgagcaaatctgggagacagtgaaggacagggaagcctggcatgcctgcagttcatggggtcacaaagagtcaggtatgatttagccgctgaacaatgacaacaacaagaatcttatactcaacctacagctgattgaagaaaccgttatctctaatgatccaaactgttagggaatccttgactgaaactgctgccatgcccacgcatgagttgcatgagttatctcacaacaagagctactaataaggaaactaactgggagaattcaggaggggccaaaaggaaggaggagctatcagtccatatcttctgccaacctcccagaatccttctctttggactccatcttggctgagaaatatgcacactaccaagaagaatcccgagtcaaaccaaataaagggccaagcaagataactaaccagagacaacctagataccaaccccattatcataaaacctgagactgtgagccacacggcagagcagttttcctgggttcccttaccttgcttctctccacccaagcacccctttccaataaagtcttttgctttgtcagcacatgtgtctcttcagacagttcatttctcagtggtagacaagagcccgtgcttggaccctggaaggggtccccttcttcaacaaaattggttctagagggaataagacagaggggacaactctgccccagcctccagctctctcaatatgtctcactatagttccctttccctttatgagaatttcagtccaaaatgctaggaaatttggaattcctatcaacaatactttaaatccgaataatcaacagctatgttctatgcccccttcccccatctcagcctgacaagaattctagctctttcagtaattttcttcattctcatttatcaagttctctctcatgctttctgaataattaagaaaactgtgtgaccttgtttgcccttggagttcatcacaaaaatatttccttttcggcagctgactcttgcagcactcggatatgaaaaacctgtctctagtgagggcagctatttttattgttttccttctgaaccagctctgctttgtcagccaaaatatttgtatccttttcaatttgccctttcaatactatttctcaaatggtatcatctgtgtcttctccatcctccaggcacagcctgaggagggcagctggcctttccctgctgcatttagcctaaagaaactggctgccaccacctcactgaacaaaggcttctgaatccacattccagatgtggctgcctactccttttagagttcctctgaaccatctaccccaggcatcatcaacctgtttcaccaatcacctcccaggggccaagcttccttcattgtccatattccccaaactct

SEQ ID NO: 51421 - DNA, 1826 bp, Bovine  19866880660869
tttgcaggttgagagccactaatggctttccaaaaagccgtttcagtagaaaaggtaggaaagggccaggttgccatgataagggagaaaatctctaggagattctcactgcactctaggacatcaaagcctcagaaattctgcttatgtttattcatttacttttagcctagtccttcatgcttcctaattcacaaattcttttttcaagcaacatgaattaatgtaaaaatgccatctgtttttcattagaatgcactttaagaaagacagatttagaagctatacatatttaactacaaacttaaaataatgtactgaaagaaataatgtagaagagatcaatggaagctttgtaataaataatatatcatttcaaaaaattctgaagtgactattttaaaatctccttaatttttatgagaatactggtgggccctgatatttaccttggctaccccactccagtactcttgcctggaaaatcctatggacggaggagcctggtgggctgcagtccatggggtcgctaggagtcggacacgactgagtgacttcactttgacttttcactttcatgcattggaggaggaaatggcaacccactccagtgttcttgcctggagaatcccatggacagaggagcctggtgggctgctgtctatggggttgcacagagtcggacacaactgaagcgatttagcagcagcagcagcaatatatggaaaacatatggtgaaaagaagaataaagctatattgctttgggggatttttagatttgcttatctagatttgaacagaaactaaataattactaagtatattgttgtgagagggagggcagtgaaactgctgatgtaagatgagcaaaaaatttgatctatcattcatactccctgtaatgtgtcagaaacaactattttctttcctacaaaatgtgttactggattggaaaatatgataccatcaaatagcccagcaccagtgtatctagtccattactgggtattgtgggacttctcatgctaaagtggctgccttagttcagttcagttcagttgttcagtcatgtccgaatctttgcaaccccatggactgccacacaccaggcctccctgtccatcaccaactcccggagtttactcaaactcatgtccattgagtcagtgatgtcatccaaccatcttattctctgttgtccctccctccttcccaccttccaatcttccccagcatcagggtcttttcaaatgagtcagttcctcacatcagctggccaaagtattggggtttcagctttagcatcagtccttccaatgaacacccagggactgatttcctttgggatggactggttggatctctttgcagtccaagggactctcaagagtcttctccaacaccacagttcaaaagtatcaattcttcggcactcagctttctttatagtccaactctcacatccatacatgaccactgaaaaaacgacagctttaactagtccaacctttgttggcaaggtgatgtctctgctttttaatatgctgtccaggttggtcataacttttcttccaaggagcatgcatcttaatttcatggctgcagtcaccatctgcagtaattttggagcccaagaaaataaagtctgccattgtttccattgttttcccatctatttgccattaagtgatgggaccagatgtcatgatcttagtttcccgaatgttgagctttaagccaactttttcactctcctctttcaatttcatcaagaggctctttagttcttctgtgctttttgccataagtgtggtggcatctgca

SEQ ID NO: 51422 - DNA, 689 bp, Bovine  19866880926412
cctgatgtgtcccggcctgagaaagttgtggattccaaaaagcttgttagtccctcccaggcagtcatcagtccattagacaaagagaaaagcaatactttctactccacttggcatctattttgcttattctgaaaagaaaaacatgttagctaaattataatctgacttggcctttatttaacattttcaggggggaagtgacaatagctttagtggtaagcacaactgatagacctgataactttatttttgcaggttcccccccgccccaagtcattagtgagtgagagcccttaggacaaaatactagggtagaaatttaagatggcaatgattcataaaatgtctttcttgtggagccctcattttgctttcatttatgcctagttagcaatctattattgaaacctttttttttgaaggcgaacactcatagtaccaaaacagttaagtatggcaagaagagaagagtgataccttgtctctaagaggttagttaagacttttccatccatgtaagtatagacttgcaatgaactttgtttttcttgctggccattaactttttttttttaatttcattgaacatgaacatatggtgctttcttgataaagagcttttattctaaagagttaatcctcaaacatggatggatgtttaaaaaataaaaattctctatgtgagt

SEQ ID NO: 51423 - DNA, 818 bp, Bovine  19866881220574
acaggcctgattctatcccccagtatcctcagcttcatcttctcccagtcctgaccgtcctgatgtattctttaaaatcatttgcaaataagtttctgtagtggatactttgttcatagacctactttagaacattaatttacttttttttcgagatcagaactatagttcctttttttttaaagtcaaaacagtccttattggagtctctagtgcctctgaatctgaagcatccaaagaaacaagtggtctggggacacatgaagtttccaccattttatttgtagtttatttattaagagcaaaaaacagcaagtaaaatagggccctgtctgaaaatggacacccaagaatgccaagagactgagagcatgctcaataatgcagagtagcagccgtgctcggcaaatccattccatggcccactcgtttctgtctgcagttaacagactgaaaaaaatgaatgttgtctcaacccagtgaccaaaagatattcacaaaggcccctggattagcatcagtgtatttagtacttgaaaaatagaccactaagctaaagaaaatcagcaaatggaatgacatggcaaacatggatagaaagtgagaatttaatatattttaggcctgatttcttattaacactaaaataattcacttcttgtgaaaagtccttggcagcctactaataaggattaaggagaatcacctgatcatttctattagatcagcccagatgccactgcatttgatacagctctgattccccttgccctcccttctctcaggcaggaaaaaaatgtgtaaattaaaatcaagca

SEQ ID NO: 51424 - DNA, 1182 bp, Bovine  19866880465904
tttgggaacttttttcttttgtaaatatgaacgataacttcaccaccaacaataatagtttgcacaaaaaagtgactatgattatttgtaccttacacattcaactgcgttgggatcatgtgattggtttgaactgtcatcaccatcagttagcaagtcactaagctgccttgcagcagctgaagagcagagcgaatggggactgtgtgtaacccaatgccaccactggcgccaacccacagagcgcatacagttgcccggagctgaggccacacgcccaagcctgtaactcaataatcttgtcaaagtaattggccacaggtggtccacacagctgggtgaacagctgagcctgttcactatttatgaggctgtcttaacaagttgcttgaagttgggtgtgctgatctctctactgtacatggttctcaccctggagtgatttttgcctcttaggggatgtctgaagacattttttattgccatgacttgtggaggtgttgctattggcacctagagggtagaggctagggatgctactaaacatcctatactgctcaagacagccccctgcataacaaataattactcagtccaaagtgtcaatagaactaaattggagaaatcatgctctattaaaacacagacctgggctccacctctagcaaatttgctttgctttgtttagcagaacacagtggctgggtgatgatcaggaaccacagagaagatgacttatccctgaactttccaggccttgaacttgagaaaggtattaatgggtcctgaatttggcaatggaataatgtgtttcctctcatatgtgtgcgtgtgcatctgtgtgtgtgtgtgtgtgtatgtatgagagagagagagagagaagaggaggggaaggaagggggaggggaggagaggggaggagaggcgttgttgcgaaaaataatttgcaagcagagacagcaatccaaatctgaacaaagaaaatcgttgaatgctaagccccgacagcacatgcatagcaatgccaggatagtgaatgattgggatgactctaacccaataacctccaataaaatgcacacaaattgtatacaaaaagcagaatccctcctcccgcctcccctgcaacagcaagcaacaaaaagcaagttctgtaaattcagtccttcaccaacatttatc

SEQ ID NO: 51425 - DNA, 2486 bp, Bovine  19866880467290
ccagcaacagggtcttttccaatgagttgctatttcaaaacggaatttaagaggtagagagaaagaggaaactctatgatgatgtacatatgtctcttagagttcagaagttaaggataagttccgtaagaacacagagtcctgaatgaatatatgtgaatgtagaaatacagaagcaagaggaccgtgtgttgcttctcaaactttgaacaggcatgagaatcacgtggaggagttgttagagcagattgctgggctttgctcctagagatgctgatttgatggttctggaatgagttaacatgttgtaaatccttcctctaagccaatgaggtaggcaagagccagtttttcagcactggctgaaaagttcttgtaagattagagggatccatcaaaatctgtggaaatttaaagccagtttccagaatccaaaagtagtcaagttggttcagtggttcctcaactttgccgcacattggaaaaacttgagaatctttaaaaaatgttgctccctggctcccacccctaggctttatgttttaattggtacagggtgtggcctgggcatcagtcaggatttttaacagctcctcaggtgattctaatgtgcagcaatgtcaggaagcactaaatcaattaatgctgcccaattctcctgtaaaactttatatgagaggttgtatagttttggtgaggttgggcgagtcactcaatttccctgggacctgacccctccaccctagttacctgttgatcatttccaggcattcactgtgacatgccctgttttcctccttgggaaaggaaatatgtttcacattgctactgaattattttactggtggtaaaagaattttgctatgaattcctttgtaaggctcatcttagatagtgggttcctttagtaaacttaaagtatgattcaaaatttttgacttacatccaactatttaggaacacattttattgagtaaagatatataacgtgtctaggaatctatattggagaaggaaatggcagcccactccagtgttcttgcctggagaatcccagggacgggggagcgtggtgggctgccgtctatgcggtcgcacagagttggacacgactgaagtgacttagcatagcaggaatctatatagttgaagacatttgctataattgtgtaatagctgagaattaaggaagctgaccctccatctccatagccacagtgtatatatggtattatatggtattggttcatagtggtcaccaccatctaggccagaccaattcttcttttgcatttgtatccttgtggcttctctgatttagtccagggaatattagaagtgaaaggaacttgaggttatcatctaatctgcttgttatagaagacagtgtaaaacagatgaagaaattttctaagcctgtgcagccaagagtaacagtaaatacataatattttctgagtcgtattgtttgctatgctctggactaagtgctttaaatgaattacttacttttgtcatttaatcttaaaaaatcttaaataattttttgcttatttaaataatttaaattaaataaataaataaattatcagatgggcattgtaattgtctccagattatagatgaggaaattgaggatcaaagaagttgaggaatgaaaagttgttaattttagcagtttatctccagagcctatattatatgaggctgcctctgtagtccaagtcaggatttgagctagagctcaggatttttgttcccctgttaatttttgcttgtgttctattgatgcctatgatctactcgtcctgttattctgttacaaagaaaaattagattaatgaaaaaatgacttttctgtttgatattttatgaactgatttaagcagtagaattgcattaaaatacattatgtttgccagcaagttattgttcaggtaagtgttacattcttaaaaatagtaagatttccttatgaggctgctttttgctttacataaaagatgatttattttttgggcggcttagatttgagatagcatctgtattaaaatacaatttttttttctaaaattagtttcagataattatgtaattgtatattttttggtcactttaaatttctagttatccatatagaaatggatgttttattttttaattttaattttaaaattttatttttgtcttaagtaagacaaaaatattagatgatttaaaatgagggcaaagatcctcacattgagtgtaattatattttaggaccagctaatgtcttatctcggagaaggcaatgggaccccactccagtactcttgcccggaaaatcccgtggacggaggagcctggtgggctgcagtccatggggttgctaggagtcggacatgactgagcgatttcactttcacttttcactttcatgcattggagaaggaaatggcaacgcactccagtgttcttgccggagaatcccagggacggcggag

SEQ ID NO: 51426 - DNA, 1297 bp, Bovine  19866880468231
acacacacacatatacacacacactttcactctgtgtgtgtgtaactcagtcacactgctgtgtagatgaaattaacacattataaatcaaatatactttaataaattttttttaaaaaaagaataacatagatgcccttgctcatgtgagagacccaccatggagaaagcctgaaaaggaccaaaagatttcaaccctcagcaaggagaaaactaaccactaagtggactgaaagggacggtgcatgggaaacaaaaattaaactgctttaggattgcaccccaccagtcctgttagtcattccaagtgtgtgcatggtatggtagcatgtgcttcctatgtgcacacaattcctaaaccatggaaactgaatatctatgtcaacagatgtatttcctgaaactattctaggaaaatcaagtgtattcagtgagccaccaactgccaaatattgcaataccacttcagatgcacagtaacattaaatgcattctgcctctgctatctacacattagtatttactttccattaagactaaataccaaaagctaggcttgcagaggtcttcttgttacctttatagagaaaagaaaacaagcacagtttacagagctctgatctccaaagacactttgagaataggaatcagcctatggcatatactctgggaactttaataatagccacctaaagtgtaaaatccaatggactagttccaaattgggaaaggagtacgtcagggctgtatattgtcactgtgcttatttaacttatatgcataggacattatgcgaaatgccaggctggatgaagcacaagctggaatcaagactgccaggagaaatatcaataacctcaaatatgcagatgacatcacccttatgacagaaagtgaagaggtactgaagagtctcttgatgaaagtgaaagaagagagtgaaaaagctggcttgaaactcaacattcgaaaaactaagaccatggcatccagtcccatcacttcatggcaaataaatggggaagtgatggaaaccatgacagactttattttcttgggctccaaactcactgcagatggtgactgcagccattaaattaaaagacgcttgctccttggaagaaaagttatgacaaacctagatagcatattcaaaagcagagacgttactttgccaacaaaggtctgtctagtcaaagctatggtttttctagtagtcatgtatggatgtgagatttggaccataaagctgagcgctgaagaattgatgcttttgaactgtggtgtggagaagact

SEQ ID NO: 51427 - DNA, 819 bp, Bovine  19866880469417
tttggatgattgaaattgtaataatttgggaaactatgttaggaaaataatgtccatatcctcaggctgacccatgatctattgcctcttttcaagatgatataatgtctgtttttcttttgttttgtccttgtccgagagcactccacaatctcagaataaaccaaagccatcatgcactcagatgtgtgtgcctaaacacactgtgtgcatctccctcacgctcacataacactgcatcgcttgcttatacaaacaaacacgtagctactcatcagaagtgctctattacgcctgaaagcaggcaatgctaaggccaactacgaatattagtcatcaagtctggacacattccttcagcctttttcctgctaacaatagatagagcctgattgtgtgtagagaagaatatctttagccgttagatacagaccaaatacatttgcaaaaagatatattggtgaatactgtgttgaaattgtgatatacagagagatgttcttcaatagggaaaaacctataatgtattaacaggagactggattatgtccacagggcacttgtctggtgtaacttgtaaaacttaaaagtcaagaggatttctcatttgtgagacccttgtgtaagggtatataaacattcctttgcatttacaaagagaaatctggcttctacgaaaaagagcctttgcacttaaaaagacaaaatctgatttctgtggttattttcctagtaaatttactatattaaacacaacttttgggaatcccctggaagtccagtggttaggactctgcccttccactgcaaggggcatgg

SEQ ID NO: 51428 - DNA, 841 bp, Bovine  19866880473474
ctgagtgagtgatatttccccccaccatggcagtttactagaaagggctgcttagccactgtcagggtgtggagagtattttgggagaacgcaaaggtttttttctcttttctttaagggttgaatagtcttctgaaatagcattggctactctgaaagctgcaccatttcatctgtcaggggaaagtcttcaagaataggtgactgcctgctggcttgaactgaaaagctggacctgggcatttgaaggctcctcacccttccccctgtttttggagtgtgtgcttgtttaccttcccggctccttgctgccagaacttcccaaggatacaaccttgggttaataatgtggtgatgagactatctggactgtggacgtgactgaactcaggcaaatcttccgaatagatttgtaaactcctgaggaagcttgagaaataacatcatcttaaaaataatattttgatcccagaccataccatgtttctggctacccaaattgacaagctttacccaaattaccatacacagtcacatactgtttgcaactgactccatttttagcaatgtcaaagggaagaaggaattctcaggacggtgaatacatttgatatgcctaatactgctctcagaaggtcaactccatgcatgtccttcccacaggccagcattccccagcactcttcatacagccccttcccgcatgaacaccccctaggctctgccaagttccccaccagcgcctcagccctcttctccttcaggtgtagaaggaaatctagacggtcggcattttgacggctttggtctccgtgatgcccgcttccatccaagataaggg

SEQ ID NO: 51429 - DNA, 2416 bp, Bovine  19866880544558
acattttccctaatgcttagaggattgttgtgagaataaaatgagttgtacaaagcagttagaactgtacctgggacagagtaatggcttaataaatattagctattatttgctattatctgcctttctttcttcattcttttatcttttttgtaccatgttagtgaatcatataccttctaaagtctgcctttcagccctctcctgctaaaaaattatctcagtttgccaacacaattttgttcaaaggaaaatacgtttacaggttgtcacctcttttaccaaagaatgcttagagaattactatatctaaataccagttatctttcactattttcctagtgcctatgattacacagtaccaccgatggagaaagtgcttgtgaaaactgacattcagatagcccttccttctgggtgctatggaagagtgggtaagtgacttgagacacagataactatttgtcatgctcttcccttgtgatcagttctttcttcttggtttaaaatttggggtgtataaatgagggaagggatattgcttggactgtgtcctaaaataaagacatgccagctgcgagggcagttgcaatcacttgaaaactttcctttatgtagctacatttgcctctctttgcttttcttcctcccccagattccttacttaaggttttaggacactcacattagcctaggaggttgttctcacaactgttcactgtgagaaaaactgaaaatataggtgatgtttaactggtggtttttccagtggtaaccaattctcccctcagggatcagatggcatatgaagtcagatttctttgtgaagatgtttatttgttttataagaataaagatgcagggttaagataatggcacatggcatcttatatcaccaatataagtaaagtttctaagccctgagaatatcaggcccttagcctttcccccttgggtttcctcccatgaggtgttctaggtaagggatgctcttcagtgcactagaggaaaaggcctcattgtgggaggagagaggataaaatgcagggcaagccaactaaaaatcaaaccaaaaaatgcgggtttgattttttttcctgcagcgagtcagttatcactgtagaaagagtttaaaacttcttttcaagagtctaattacttgctgactgacttaagagtaaacataaaggagcaaatggagctgtgatcccagggggatcttgttagccagagtctgagaactgctgatacttgaccctttaaaagaaaactgaaatgagctctctctcatttgaactctttttggctgcactgacggcatttttagtgtattggggcgggggggggggggggtggatcaggagatgaggtgaaataacggtgaaggcaggaaggggtagcatttaccaacaaagtgcctgatttaagttactctggaataaaatactagaaattaggataattaattgtaggcctgttgctcaagtcagcaagagttaaggtatataacttagcttcttactctggttcatttgtttcattcagatttgtcttttggcatctgaattatgagtaggagtcccaagttcaaggttaacctctgctactctggttgggtttatgcccctccccttcttacccatactgcaacggatctcctatcttaaaagtcccttcctctgccccatgtcccttccagcttccatcctccctttgtgatcaaacatctggacagcattgtccacggttttcaccacttgttcactttccatttctttcctgcagaccacagcttcaacacttatcctcagttgcctaaagacatgctggagtggtttaagttggttttgaattaaaccttgtcaatatttttccaaacttttctactttgatcgtacaatgtgataaatacatttttaattcagaactgtctgctaaggttaagatacagatgttatagggatgagagtggcatgcttagattgtgtcaattttattcagtattgcccttcttaagatagtcaatttatttttgtttgtttgttttatagctcctcgttctggcttggcagcaaaacacttcatagatgtaggaggtaatatatttacatttttattctgtaaatatttacaagtgtttattttgtttttgcagtaatcaaatgacagattttatttttatcaagaaaagaaaatgatttttgttgtatcttgccttttagaaatttctgtccctaagtaaaagatgattatgatacagttttgaatgctatttgagtatgtctacttttttaatgaccattatgtgaaatgttgttattttactcacaagctagacactatctgacagataggattttgccttggtttagtgataatctgcatttagtccaaaaagactgttcacagaaggaag

SEQ ID NO: 51430 - DNA, 1114 bp, Bovine  19866880554694
ttaaaaaattatatatacatattttcaaattacatttttcacttaatctctgtatttttttaggtcactgtcagaagaagctattgaaaatgcctgcctgccatgcaatgaggtggccttggaagaacttcgtgggcaatacattaaagctgtaaaaaagattaagcgtaagtctctaaagagatccctaaggttttaaggtggtttgggtcttttttgtaactaatcgtagtaatttgggggaattttctgaactaccttaatctgagatattacctgtttttagaagatatcattgatagcttttctaaattatgccatcataggtgattttacccaagtaaatttggagtttgccactaaaatttgagaagtggcacaaggatagagatatttttatactgttaattatcctggggttttttggggactaaaatgtatgtgtgtatatatattttaaagtataactgacatatatcactatattagtttcaggcctgtaacataattgattcggtgtttgtttatgctgtgaagtgatcaccacaataagtctagtttccccatcaccatacaaagttacaaaatatacaatagtcccctcttatctgtgattttactttcatggtttcagttacctggggtctactgtagtccaaaaacatgaagtggaaaactgcgtaaatagttttaaattgcaggccattttgagtagcatgatgaaatcccagccatcgtgctgtgtctgcctctggaagcgagtcgcccctttgtccagcatattcgcctgttggtcacttagtaccacctcggttattggacccactatcactatatcgcagtggttgtgttcataacccttcttttaccgaataaaggccgcaaagtgcaagagtagggatgttagcaattcatatatgccaaagagaagctggaaagcgcttcctttaagtaaaaaggtaaagttctcgacttaataaggaaagaaaaaatcatgtggtgaggttgctgagatctaccgtaaggacagatcttctacccatgaaattgtgaagaaagaaaacaattcatgatagtcttgctgtcacacctcaaactgcaaaagttacagata

SEQ ID NO: 51431 - DNA, 974 bp, Bovine  19866880596890
tgaaagtgaaaagtgagagtgaagtcgctcagtcgtgtccgactcttagcgaccgcatggactgcagcctaccaggctcctctgcccatgggattctccaggcaagagtactggagtggggtggcatcgccttctcctaatgaacatggaaagcttataaatgaaaaggaaaatgaaaacacatagcagcagcagcatggtggtggaattatcttctgatctaaattagctattcagccaaaggaaccataagagattatggaagagagagaaactttactgggaattccaagccaaatgctgtccattctctgtccctcctgtgacaaagtagtgccctaaactttagttcggagtgcccagaacttcccagggcaactcataatcttggaaaggggagtgagaggaagagataggacagacagctggggcaggagaacacccaaacttcacaaaagttctctcaatctaaaatgacaatccaggccaaagtcaaccacctcaaaccttccccaccaacaactccactggattcgatgcaactccaaaccaaaccctggaagagcttcagagagttcctgagccttttgtagggtgtcctgtactcagagtaactatgtttttcaaacaaaaaccaagacacattgtctgacaagaatgagtgtatttatggagtaaacacatacaacagggttaaaaaaaaaaaaagtaggtaaaaaagagtacaaaattcagtcctacaaagcaagatattcaaaagactttccaagatatttaaaaaatcacagtaatagacattctttattgttccttcaatgtttagaatcaacctatagacaaaacatggacgacactgcaatttacaatggttacaaaacaaaaggtaaatgttttaaacaatcatgggtcataaatcaagaaatagtggaaagaaaagcgggagagaaataaagcaatgattcaggaaacagagg

SEQ ID NO: 51432 - DNA, 1253 bp, Bovine  19866880610829
tttcattttaaaatgcttaatttctgaatcaccctagagtttattgtgatgtttggggcgggaaaacaatttttccaaagtgctatctggctatcataagactacttaatatagaataattcctcattccatgttttgaaacaattaagtttttattcgtggttggacctatcttcaaagtctgtatagtactgaatgaaagagaattctatttttgtgactcaacactgtctgaattgttgctttccaatatattctattaagtgttagggctggactactatttcttttccagaatattttaaatttcttagccctttcagttttccaaataaatgttcaaattattgtgtcaaatttcaaaactaagttcagtttattggtattctgactagaattggtttatagtaataaagtaagttgggagaatacaaatggttgtaatacctgatacttctagtcaagcaacatgacatctctggaaagaagtgctgattatttaccaaggaaagtataagactactgacacagcacataaaacaacagttacatgtgtgaaaggatatatagctaactgctctctgattctcctaaaaatacggcaaagtagaaaaagattttgttccatgggtaggtccccagattgtgagagtttcattgactctgaaacacattctcttcccctcaactacatgatactgatgagaacagatcccactagttgggtcctgagctaatgcttaataggcactatcgcatgtaatccttccacaatgctgtgagcaggtaggagtccctgggaccaagatgaggtcctcgagaaggttgttcccaggagagctcttacccgtttggccactgactgctcttgtagctcctcccacttcttctgttctgctcttacaagtgctttatactctgcgagctctggcagttcttccagccaccgatgacgagcattctgcacagctgtttctaccttcaggagagcaattgcaagagacagggaggtaaagtaaggtatacaatttcagaaagatcccatttgcaggaagcctctatgatttcctgtgcattttacactgttttgcactggagtaaactgattttcaagtcgtccccccaccaacctttatctccagcagtgaattcaatccttctgttctaaatgttccatactggcccatgcaagtaccaaaccaggaagcagaaaactatacatgtttaatggccactacaattaatagaaagag

SEQ ID NO: 51433 - DNA, 2694 bp, Bovine  19866880623057
cttatttacctctttgtaactgttttctactcactgtatttgttccttgtttttccctttgctttctctgatttgagttgaacattttatataattccattttctctcttagcaatgagacttcttttaaaagaaatttgattggttgacagttttaattaactgaagcctaccttcaaataacactgctgcacttggcacatagtacagacacctcacaacagaatatgtcccttcctactcttcctgtcccttacaacagcagtgcccttcacttcacctatccatatgacataatcaaccaatacatggctattatccttaattaaaacaaaagctatctatcaaaacaattaagaataagaaaaataactgattttaatatatggtcgtttatttcttctctgatgcttctcctcactttacacagtccaagtttctaacaatacaaatttccttctccctaaagaccttcctttaatatttcttgcaggacaggtcttttggcaatgaattttctcaattttgtttccctgagaaaagccttatttttccttcaatttgaaggacaatttcactggacatagaatccaggttggttggtttttttttttttcttctttcatcactttaagtactttgctttcttcttacatgataagtctattgtaataatttatttatttatgtaagcctcatcaggtggcatacagtatttccctgaccagggatcaaacccacaccccctgcagtggaagtacaaagtcttaacctctggactaccaggaagtcttgtaattcttacccttgttcctctgtaggtgggcttctctggtggctcagatggtaaagattctgcctgcaatgcaagagatgcaggttcaatccctgggtcaggatgatcccctggagaaggaaatggcaacccactccagtatccttgcctggaaaatcccacagacataagtagcctggcaggctacagtccatggggttgcaaaagaagttggacatgacttaagtaactaaacaacaacaacttcatttatagttattataaaatattggctatatttcctgtgttgtataatatatccttgcagcttattttatacctaatagtttatattgtttaattccctaccattattttctcctccctcaaccaccttttatattatatacatcaaatttaaatttaattgtctatctcctcccataagataatgtctatatgagaatgtaaactgtgtcagagcagggacttggtcagtatctccaatgtctagaattctgcctggaacatagtaggtatttaacaaattttttttttaaataaatgaacaggaagaatcactcggaatgcttacgcattccaaccataaataaaagctttgagagtaaaggcaagtgttttcaaatgattgcaatctgaaagggaagtttttcttggccatccacataagcttttcacaattatagtatacgaatgtggaatcttatgtcatgggtcatcaaccacaggaaaaattaaaataaatctcaggccacaaagcagcagaaagcaatacttaagggctagagaagggattcaacaattagtcaccacttgctttgccaggagtggttgagagcataagcgcaggggtgagacagacaagggtttgagtccttaccaccaggccctcactctaccactttgagcaagttagttactctctctgagtctgaattttctgttctgtaaaataggggtaaaactttcctgagttgtaagaactacatgacataacattcttagcacaacccctggcacattaataaacctttaatataggctggctttactcatgtattatttttaatatattgttatagtaagactcaactcaccatcatactttccattaagtaacccagcagttgcacacagccacctccagcagaattctccaaggggcaaggaactgtttactggctatactcataagaatcttcactttgtggtttggtaggtatacctaacaggaatctacatatcataccattaatagtttgttgatttcagacttcctagggagtacatgtgctttcccagtggcttagtggtaaagaatctacctgcaatgcaggagacacaggtctaatcactgggtcaggaagattccctggaggagggcacagcaacccactccagtatttttgcttggagaatcccatggacagaggagcctggtggactacagtccatggggtcgcaaagagtcagagttgactgaagcaactgagcacacacacagggagtacataaacattgaaagtaatggaacccatgctcagatgagaactctagtcaacaaattacagatacccatttggaatgtgttttccacatgcttcctactcccttgctctgtggagctggtgactagcttttacaatgaggctagagggggagaccctgtgctgatatggtcagaatttctcctctgtggagaggaaccacaatgctcttgctctattttactgcttatatcttttacttagctttagttctcctgttactaatcttatttctagctcatgcacttcttcaaagctttctctgagtcttgagtcttcttactgacctgaagagcagctagatgatacaaaagtctgtaacaatccttttttcctttattcattcaacag

SEQ ID NO: 51434 - DNA, 2058 bp, Bovine  19866880684180
taagcgtcttttaactggagaagggaatggcaaaccacttcactattcttgccttgagaaccccatgaacattatcattagcctttacctaatgcttattattctgtttgtccaaagttttatcacttcacaactgagaaactcatgcatataaaataggagtcccttgaatttgttttgattaccctggtcttgtctgaaaaatactttgcatttgggataggaaacagaagggctatcctggctataagacgccagactcacagaagtgggttctggcttaggaatgtggacacactgcagacatctcacacagaggccaattcttacaatgatgtggtcagacgtggtagagcccagctgtttgctccattgagaggggctttagctagcccacacaatctctgagactgtgtctgaactggatccaaatatccagcctgccgaggctcacccctcccctagagtgactggagttgggttgttgcagggctaacattcagagcaactggtaagaaaagttacaaagagtaattgaaaaaatgtaatgtatagcagtaaagtggaatcatatccttcccaccataaactattaagaatcaggtaaaacagtttatgtttggctttggtcagttgatggacattttttgatatttttaatctatgccaccattaatgctgctgagcgaatatcatcttattacctaaatacatctttgccttaagacagtgtgctctaaaataagatttcctgggttcaaatccccattctctacttctaagctatgggactttagctagctagcttgtttacccttcctaagatatagtttccttactgttaaaatagtaataatggaatttagctcagagagtttctatgaagatgaaataatgtgtctttagcacttggcatatcttttctctttgaattttacctttaatttgctgaatgctactgccacttgcatggagctctaactctgacttttgttagtgatgggttggtgggtatatctgatgaagtacaaaggaagaggtctgaatgctacacttttatttacacaaaaaagtaacttcattaatgatttgtcttctttattaatgattttttgtgctgaaacctggagagtaaaatcttttggaatggaaataatccaacatgtctactttagacttcaaatatcttagtgctttccaacttaaataagacattcatttctagaattaaaccttgtgtgtgtgtgtgtgtgtgtaagtagaataagtgccatccagttagtttgcagttctcaagaccaaagtcagcagaggagaaaacttatatctttctaatactttgtattcagccacaagacatagtagggtttagtgttgttgaagaacaaatggtaacaagacaaagcaattgtcatttgatgatatttgttgaagttaaataatatattacctattaaaaaggacaaagttattaaactccaaaaagtcagagcatgaaaagaaatcataattcaacactatatagaattttaagaaatgcaatgaaatgaaaatgtgataattaatgaaagggaacgatgaatgcttcattcgaatgaagcaggaattaccctgtttatgagataagaagttcatacgtttaaagtaaaaattgttgttttaaataaaagatgatcaaagtataacaggacatatttttaaaatgaatagttatagatgggtattaattgaggaagcaaaagaactttctgcttccccagatcttcatctcctgaggcaaccagttttaaccatttctgtttttatttcttctcatgtttatcctcctgacaccatgcactgtgtttgtaactctgtgtctacatttaaacagtacatattggcttcttgcggtgagagatggggacatagctcacttggatctatacttttactctctcttctctttcccattttaaaaataattattgaatgacttttagttattggtatttaaaaaaattaggttcttaaacctctgtttcctgaatcgattgctttatttctctccacgctttt

SEQ ID NO: 51435 - DNA, 2528 bp, Bovine  19866880723565
tttaaatgatgcctagttagttttcttttctcgtggttggattaaaatatattttatttataaaataaaactataaagcaaagaattgaagctttttttgagtatgtggaagagactaatacaaataagtaaaatattaaaagatgttgattaaaatattaggggtagtttgatgctaaatgtgattattaaagatgtgtttgtgttcaactataatttaatagttgtcctgactggctttccttgactgaaccaacagctatgttcaatgggcagtttttgtttgatagacctatgcatgtgaaaatggtgagttcctgtgtatcacttcaactttccaacctcaaattttacctgctttcttctgtgttacagatcttttaaattgtatattaaccatataataaacttttttgcaactaggatgacaagtctgtccctcatgaagactaccgttcacacgacagtaaagcgccacagttgccgcgtaagtgacgctgctcctagagcagtgcaggctgtcctgtacgaacaggcctgtttctgcgctcgcatccctgctggccctcctccgtttgatgttttgagttatggaactagtttgtcctgattgattaggaagactgaggacataaatatttgccacttttcttttcctttttgtagtttttcctgattataaaagcagtatatactaaaaagtttgttaaggtcttatgtgggtggggagaaagtctttgtaattttattatccataaataacctccattataacatttttgtgaatttccttccagtgtttccttatatgtgtatttttttttttacatatttgagaactaccacataaataattttctttttttttttgtttagcattagaatgtaagcactattccttgttataaattctttctaaaatttttttattggctattaacgtatcatatggatgctccataactatttcagtgttacctatattttgggtatgttaactttttttcctttaatcaccaacagagttttccctttttcttttctttttgtatacaagtttttggtatgtttttggttatttcctcaggatagataccttgaagtagatttataggttttcaagtgatcagtgttatcaaattattttccaaaggattataaaacagcaatatacttaacatctgtgtctcaatgctccatcttcaaagtgaggatgcttatggtacctactttgtggattggcatgagtattacgtgagttactatataatacatgtcaagtgcgtagaacagctctggtataatgtaagcactcagtaaatactcttattctttttgttacatttttctggttattattaaagtttttttatcataaactgttaatttggacaaatataaaatcactcatgtagctatcacagaccatatttgttttaggtgatttttctttaaaataacattttatagataaagattctcctcttaccacctcccactagataactttacctagaggaagcaacttatggatacagtgtttatcattttatctacattttaataatttgattacacatttatatatccataaatgttatatgaaattgttttgctggattcaaaattgggtgtgagtgaaattatattgttcatattctgcaacttgctgtttttggtttaacattgtttttgagatttcatgtatattgaaaaattgtagctctaatcctttcactttaatggctaatgccacattttgtaaatatatgtgtgtgtgtattttaggttattctaatttttctgttataagaaacaatactactttcaggagaatttgttctctttccctgaaaatgctctgttctctcaacattggtaaaagtgtccgtggtgtgtagtgcttaggggaagatttttacctattaactttatttactactatttatatactattatttactatatttactgttgcttcttgagtccattgtggtaatttctatttttctgagaattttaccattttttttcattttcagatttgttggcataaaatagtctcttttaatttgtgccgcagctatagttctgtcatttttaaattccaaaggtttgcaattcctctgtttttcttagtcagttttgcttggagatttgtcgattttattagtgcttttgaagaagtaaattccattttttatatcttagtttatgctcttagttttatttccttttctatttctttggatttagtctcttagttttgtcctaactccttaagttgaacgtatacttcactaatttgtagcctcttttgtaatacaagtagttatgactatcaatttggccactatacacaagttgtgctagagtgtctttattgtgatttaatttttattaaattaccattatgatttcttcctaagtcatgtatttttgaatttccaaatgtataggttttttcttattaatttctaacttagtgtggctgtagatgtctgtatgattgtgattctttggaatta

SEQ ID NO: 51436 - DNA, 680 bp, Bovine  19866880730419
ccttctcaaagaaacattcattgtaaagctaaaagctccacagacacacttccaggccggagtggaggagtcacctaatcacaggactcttgacagctggcagacaaaccaagatgtcttctaggaccaactagaaacccagaaaactgtataactggaaacaacgaaaccacaactataaaccacttcattggatttccaacgcttattcttgacttcactggcaaaacaaaaccaaatcctggtttaaacaaggctatattcagcctataagctttttgaacaagacaatataacattccccaaacaggtcccatgttctctgcttccttgcccttgttctccgtgtctctcacttcccctgtctgcctaatgaatgtctactccatccaaagtctggcttagatgtcacttctcccacaaagattcccccagctcctttccctaactaaggcgtgagacccgcccttcaagcccatgctaaccccttgcgtcttcttcctcactccaagccctgtagtttttgtcatgctcctcttatcaccctccatagctcggagacactgggggagttctcagctttgtgacctagtgcacgttccatgttagagtcaaagggaatagctactgaatgaaacgaagtcaaacgaaatcagggaatcatccagggaattggtgga

SEQ ID NO: 51437 - DNA, 1130 bp, Bovine  19866880734400
cctttccagtgaccttgtttaagaaaacaagggtctggtccagcaatcagccgggctctctttgtgccaaatccatatggctccgcaacctagtcaacatccaaaagaaacttcatggtttggaaggaaaacctgctaaatgacattggcatgaaacacctggccccagctgctttgtttttccccttcccaaaacagatcttttcatctccctagactctctgatccgaagataagtggtctttaatagtagtggttctccatggacgaaccaggcgtgtaccccagcaaggcctaccctccaatgttggcagcaggcaaagactcaaaacagcattaagagcatccactaataaagctggaaaggccccaggcatccttaggccaaacgccttgccttacagttgaggggacagaggcccagacagggaaggggactcagccgaggtcacttggctaattaataacagaactgggatcagaacccagtcctgactcacagcttgctttgcctctagctcttgaaaactggaaatgtgatagttagcagtatacttattgttagcaaattccagcatgacaaaatatttagatgactgagaaactttgttttattaaagctttctactctccttctgaaaggtctgaagattgttggcatatagaactcgttcgtgtggggttaaaactatagcaagtttattaatcttgtctttaagtataaacttttccaagttgaagttcaaatggaatccagacaggaaaagaaaatataatttttaatatgtgcttttgctatgttgcgcctaacaatggctagaaatttgacccagcctgttattgttaaacttgataatacatcacttatatttaaaacaaatgaatgtgaacataacacttcatgttttaacccgtacatagttcaagaatgtctgaaattttttttttgtttcttgctgatgatacatagttgtgatatctttgcctcactttttaacaacatacatgacaaatgtgtgcaaaatctaaagcataattacttatattcaaaatagaaatataccctttgatattctaagctatttttttttcattaaagagatcaatttgtcctaaaacaaaatcaagcc

SEQ ID NO: 51438 - DNA, 1464 bp, Bovine  19866880789423
cctcgggtccttgccatggggcctctcacagggcagttcagaacatggtggctggcttccagcagtctgagcaggcaggagagccagaaagggcaaacaagatagaatccagggtctttttgcagtttaatattggaaatgatgtccctcccatcagccccgccattcaccaggtccagcccacactcaaggggaggggattacccaggggtgtgagtaccaggaggtggggctcattgggggccatcttggaggctgctgaccatgcctgtgggaggactaggtggagatacccagcaggaacacggacatctgagttggaagctctagggagatatctggactgcagatacagatctgggagttagaagcattttatgagcaggaggtgaaatcatgggaatagatagtcagccaagaagaacatttttttttttttaaaggtattcactaattactactactattattctactattaactacaaattgttaacttcttagagaaacttcagactgagagtaaaaacaaaaacatgtagaaaaagataaatgtcaccaaccaaagctacttgtcactcctaatgtgattaaaactttcagattaggccataaaaatctgggctagggcatgtggcttttcctgttatgattagaatattattaagattctgagaaaaagctcattccccccaaaaattccataaaataggtgactaattgaaaactggaaggtctcctgatgaagaaaaatagtccagttcattttctatcagttttaagctacaaatctcatggatctcagtgtttccaagtttggggtagtgaatattataaatattcatataatatgattaatggtagtcatttacaggccgactcccacaggcccacgatacacctccccttggtaaacacccagcccagggagtgtcacagaagccttggtgagctaaaaggatgtcacagtgaaggatgaaaaaacacctcctatgtcccctttggcccatgaacttttctccctctgtgcctttgcctcatgctcatttcttccttctggaatgttctacccagacagttctatgcagccaaatcctaccctcccttcaaagctctgctcagattttgtcttttccactaaggcttcctgactggaccaccccaccccacctccctcctctctggactcctgctttggtgccactcatttctgaagaccaatggctggggtcacttactctgcttgcttttatcttattcatcaggggttggcaaactatggcttgtgtggcaaatatgtcctcagtgtctgtttttatatgacttgcacttgcagagttgttattgcatttttaaattgttgagaaagcttgaagaatagtattttgtttcatgcaagaatgatatgaaattcaaattcaaagtccataaagttttatgtggtcaataaaatgcttgcggaaat

SEQ ID NO: 51439 - DNA, 1844 bp, Bovine  19866880793386
tgaatcatctcatacaagggacctcaataagattataaacagatttaactttcagaggccagaaggcagtgggcagatacattcaaagtgctaaatgaaaaaaaaagtcaactgagtcccatatctggcaaaacggtccttcaatagtgagggtggaattaagagatgtcaagctaaacaaaaattgagggagctccttaccactagatgttccttgcaaataacattcaagggaggtgtgcaaggtgaaatgaagggacactagacagtaacttgaaggcttatggagaaatgaagatctcaattaaggtaaatacatgggcagttataaaagctggtgttatcctaacaatggttagtaactggaccttttgtttcctgcatgatttgagagactggtacatttaaaggaaaaatattcggacatgactaagtaactaacacacattttcaaagaactttctatgcttgctattttgaaggattctacaaattaagaatgagtttataatccttgtttttaaaatacaaaaaggacagtgtcgaactttcatcaatcagtaagtctttaataatgttgtaaccaaatctggacacatctataaaatcaaaatgtatctagaatacttctgttctattgtttcattagaaagttaagcagatactgccccaaaactactaactctaaaataactttcactttaaattgaaaaccacacaaatttctctaatttataggtatgaaggaactttactgcttttgatatacggattatatgttgtggtgctgtgttttgacattaaaattaaccaatatattataaagaaatgcagtccttgctgtacctgtcttgtcaaagcaatagaagagagaagtgaacaacagctactgatgggatgggaagaagaggatcaaccattcatccgtaggcaatcaagaactgacagtggaatatttcatgaagattctggctactcccaactttctttaagtttacatggtcttagtcaggtttgtgaaggtaataaccccatcatgaccactgttaagtctgttactagcaaaacttaatttcatttcaattcggcaagtactatatacttactactttaaaaatactatgggaatttagagatgatcaagaggcagacctatccttaaagaagtttccaaatatttcagaaaaaaaaacaaaatagctaaaatatgaacatttaaatactgtatagagaaagaaataaagtataaacatagttcctaaatgggacagatggtaaaaaaaatttgatgaggatggtcagataggaaagattatcacagagacaaactaagccttgtagaacagtaagattttaacaaattgatttacggtaatagctactgaagttttatcagacttcatatgtcataagtaaatgatgcagagctaagagtaaaaagcattccatggattgataaagaaataacatgggaaaaaggcttgtcaagtactaacataactggaggactgaatgtgcagaatggaagcagaagaaaggtggataggaaggaatacgacagtcttaaatgctagatcaatagcatttgcaggtttgcagagaaattatcagaactgaaatatgagataaaagacatgctgctagaccaactgatgtgtttaacagatgcttagacaaggtgaaggcagtgggaatacaagaaaatagatgtgagacaatgcagaggaagcatcaccaagaccaggcaactgaagggctacatgggagcagagataattctgaggcttttgatcatgacaaagtaaaatgagaataccacttacaaatctaggaatttaggaaga

SEQ ID NO: 51440 - DNA, 1959 bp, Bovine  19866880808001
accctccaggaatttaaggaagaagctagaaaagccgtagaaggcattctgtagatgactgtccctcggttcacttcggcactgagttaaaactttgagagccattttcaggtcttcatcctccttccattcaatgatactaaggaaacagagtccattctgtatgggatcaggatttcaagaaaaccccagtttttctagctacctaaacaagccatgactcagtggctctccaattatgaccaccatcaccacctccctgaaattgctctggatcacagtattcttccccaggcaccccttcttttcttggttttcctaaaaactattatgacacaaagtcagtctctagcatactgcagcgagtctcctctccatggccatgcttctcccccgtgtctcacatcaccaccagcatcattccctctccccaccctgattgctcttagtctgccctgcccaagtgttaccaggtccgagcaagaggagcagaggggaagggatcatcctcagtcccctatctcctctctctgaatcagcttgtctggttttgaatatttcgcaagtgttcaaaatagacaaaaggattacacagggatggcatttgccaaaacccatgtcctaaatatctggaattccgttttggggatagaaactgaaagggaaatattcagcccagcatcagtaacgggcgagagactcttagtagggctgaaggaacatgctaagtttcgtgcgtgcagtctgtgcttgcgctcagctacagcgaggccagtccgcccagcgggggaagccgcagaagtcgcctgctccggccgcttccctgagacatcttgctctcatttgataaaataacaagctgcacatattaaatatatttccttaaaacctgtgtctgaatttttggttgacctgaggtcacagtagtgttttgttttcagttaccttcactggaatattttccctcgttccaaagttatattttctcctgatgacaaatttgaatgttaaatgtgttccaggggaaagagaccaaagactatgacatatttccttcctgagggattttgtttcagaagtggaagactatatttctaggggcaattataactggaaactctttaaaaattcgagttgggagcccgagattttggtgctaccgttttacagtgatgcctgccccacactggctcaggtaataactctggccctcggtgttcggttctagacgttaatgaatgcctggatccaaccacgtgcatcagtgggaactgtgtcaatactccaggcagctatacctgtgactgtccacccgattttgagctgaatccaactcgagttggctgtgtcggtaagatcttaaacacttttcagagaaacacattgttggttatttctaaggcaacatggaacattgcattctcaacttctgaaaaaagtaataaaataacacaacgaaatgtaaatatttcctgaatctggtttatattttcaggtccttttctctaggtcaattcccagtgtctgttgcggcactttttagtttaaattatggtttttaaacagtttcagaagtaggtttgaattttcaaccctgacgtagaaagcatttgcctgacacttcttttgtttgcatgtggtaaatagatacccgctctggaaactgctatttggatatccgtcctcggggagacaatggagatacagcctgcagcaatgaaattggggttggagtgtccaaggcttcctgctgctgctctctgggtaaagcctggggcactccttgtgagctgtgcccgcctgtgaacacatgtaagtggacatcctcctactcattattattgttagtccagctctgtccagttctcctgcctagctccagaggatagaagccacagagagacagagctgctactggtctgtattcttcagctggtggagggagtgggggttgagggg

SEQ ID NO: 51441 - DNA, 4515 bp, Bovine  19866880825987
tcctcaagtaccagaagcagtctattcatggctttgaaaacaagtaagagcaagcctgtttgaaaaatagcaaatacctttttatgctaaactagtgggttaagattagaaaagttaccaagagtcaaatcatgaaagattttgtgtgataatattagaattaatgctgtggctattgcaattctataaacagattttagaaaggggagtgctatgattacattttggctttagaaaataaccataattcaaattaagcatgaaaaattaaaaataagtatttatataaactctcaagctgacagtaattaataaagctataaattaataaagcagacattaataaaggtataaattccaaaaagctgtagaggagacatcaggcaagaactgtcaactacattttggatgatggtaagccaaaagaagaggagtagctgactgagcagagaggagagaaagctaataaaagctaaaagcctaataaaatctaacaagaggaagccaagaagaagcaagatgagctgctctaaggaattttggaaaggtcaggaattgatggtccctgttgcttgtgaagatgaaggaaatgggtggagcaaaaccaaacaatttatgaattgagaatctgcataaattatagacccttctttatgccccaaagtcaagtgagtatctctgccctgccctggtagaaagcaagacatttgccctctgaagatgctgaaccagcagggttctggtctcaatgataccagaggactagacagaaataggttgaagtggaagtccacattttgaaggatgagacttggaaactttcccttagctccatgaatgttgacatccaagcttatactccccatagaggtgcctgaggagtcacctttctttggagaaagtgaccagtcttcccctccaaaacactaccagtactgacaggggagttacctaacaaaatgcctgggtttcacctcatgactctacagggaagctcaccagtcagtaagtgatacctgagtacaaagggcttcagttagctttttattccttgacccctaaatgtaagcaggcagccaaagacctcaagatatacaaggaaattctctaatatgaaagataaatttaaaaatcaaaagaaagtatacataaatgggagaaataaaccatggagaagagagagacaatgcaagagaaaaaactttcattaattaatagttattggatccatgaaacaacaggatgcaataaaaaggaaacagtaagtgaacaggaaaagcctcttgaaaatataaaagcagaactattttttaaaatcaataaaagaattggaaggtaaagttgagaaaatattctagaaagtaatagaaaaacataatgatgaaatataagaaagtgaaatacccacaccaaggcatatcattgtgaaatgtctgaatactagggataaagagaaaaccctaaagacttccaaagagaaaaacagttcccacataatcgcaatgacatggatttcataaaagcaataccagaagctaagataggaaaaatgacttcaagattacaaggaaaataattactttctacctagaattaaacacttggccaaactttcactacaatataacattaaactacaggtactgtcagatatgtgagtgtgcggcacatttacagtaaccaatattcgtttctcctttctttcctggtacacagaagactatacttcccagatctctccaggttaggctgggtcatgtgctctgatcaagtggctgtgagcagaagtgacatgtgtcgcttcctggacaaagcactgaagagagtgtgggctccatgttttctgaagagcctcatgttgagatggtggagccgcatgtttgaagtggtttgggttattgaatcaccacatgagaaacagctgcccgggagagttatcagaccttcagcagacatttgtgagccagaagagacataatacattaaaccattaagatgtcgagtcttatttgttactacagcacagtccaaaaatatttcaaaatgcaccatttctcaagaagctaatggctactctgtaacccagcaattccactcctaggcaatattccaaaaagaaatgggtacacacatacaatatgccacagcaaaaaaaaaaaaaaaaaacaaaagaataaaccactgggtacaggcaacaacacagatgaccctcgcaagtataatgaagactcaaaaggccagatataaaagaatatatacttgatgattcttttacatgaagttcaagagcaggtaaaactgacagtgatggaattcagaagagcagtaacctttttggggatggagtgatggtggaggcattgggaagaggcctgaggagccctgaaagcactagagatattcaatatcttgatctgggtggtggttacatgaatatacatatatgtgattgtgacacacaaaaattattgggtaggacatttatgtttagcatggatgtgtgagttgggccataaagaagacccagcgccaaagaattgatgctttcaaactgtggtgctggaaaagactcttgagagtcccttggacagcaaggagatcaaaccagtcaatcctaaagaaaatcaaccctgaatactcattggaagaactgatgctgaagctccaatactttggccacctgatgcaaagagctgactcattggaaaagatcctgatgctgggaaagactgagggcagaaggagaagggggtgacagaggatgagatgattggatggcatcagtgactcaacagacatgagttcgaccaaactccgggggatgatgaaggacaaggaagcctccgggggagggctgcagtccatggggttgcaaggagtcagacatgactgagcaactgaacaaaaataacaatactttactatatgtttgtggtacttcaactaaaaagaatgctttaaaagaaactactggagactgtgactcatccaaatgaggacataagcccaaagtaggaaagtatgggatccaggcaataagaaatcccccagaggacagagatgaagggaattcctaagcagatggtgggtctgagggtggcagctgtacaacaggctggagagtcatggctggagacagaggcagagggatcaaagagaagcatctagaaaaaaggaaaaagaaaaggaaactagattatctgagtgttcaactctattcaagggaatgttgctattctttcaaagaatttggggaggaattaatgataaacacatgaaaaactaagcaacaagacacaaaaaggctattattaatataaaaaattgcataaacgtgtcaccgcattaactatggctgaactataaatttagccaaaatattgttgtacaattacattgggaggatgggaagaaggatagcagggtgggaggagtgtgcagggaaggggtacggtgtaaaagctgaattttcatcagctgcagaggaaaaccagaagagactgcctaaatttaaaaaataaggaaatagctgccaatgcatattatttagcaacatgaaagcaaagaaaataacagttgaaaatgtttcaactcaagatggagaagggtagacagagggctgctatttttcattgcacaccttgttatatcattgacttttaaagctacatacataaagtatttcagcaccatgctgaagcaattaaaagacatctcacaaaactctaagaaatctaaaataaaagaaagtaactcatttcaaagtatattttgatccaattaattttttttaaagacacatttacagtacctagtaattttcatcggtggaggagacattgtaaaatcatgctgtaatcctttcggggatccaaaaagctgggacatcaaaccctgtcaacttcagatgtttacttcaaagaaaacaggatcatgagggagaaaaagttctatcagttatcaactctatcatagctaacagcatgataatattatactacaatttttagatgtaatcatttgtggtcactgttttaaatcctgcttatgcaatttaaatgtgctcttaaaaagttaggttctgtgttaaaggagtgtagtcccattaaaacaaggtaatttgtacctagaaggacctagtcttgcaacttatatagacctttagagtcaccaatgtaggcaaaatataattgtacagtgttggctaagatgctaagagtaacaagtaacaacaacaaaaaaaaaactcaaagtggcttaaacaattttttaaaagggggaatttacttatctgaaaatgcccagacgtagagctgctcaaaggatgtcacgaaatacccagtttcctgcgcttgctttctgcttcacacaccatggtgtcagctctgtcctaacgcgggcacctctcttggtttaagattgctgctgctctcttctggggctaatgcttccttgttcaagtacattgggaagtgtgggcatctttgacagataattcccagaaacattctcaaa

SEQ ID NO: 51442 - DNA, 875 bp, Bovine  19866880826873
acttatcaaagcaacagtgttttattagaaaatacatttagtgagtggtccaattaggtgatctgggatattgaaacttggcctttttcataggcagttcaataatttgaaagacaaaattaatccataacaacattcctatcattagttgaaagtaaataaggtttgttctgtccaaaattgtaatgtcaaaatgtgttttcattgattccaatccctttctctttctcatcctttttccctctccctaccttcacggcaacatgtttaataatttaggtctctggtcctctctcactctttatgtccattgagaatttaatataccatagccctcctggacttcttgctgccttcttgaggttaattcagtgtatcatcactccctccaaaaaaaaaaaaaaaaaaattaaccccaaaagtataaataatttgatctaagaaaatctagtaagacagagtgggcctttcttggtagctcagttgataaagaatctgcctgcagtacaggagacatgagttcaatccctggattgggaagagcccctggcgaagtaaatggcaatccactccggtattattgcctggaaaatcccatggacagaggagcctggcaggctacggtccatggggtcacaagagttggacataaattagcgactgaaccaccaccacagtaagatggagtaaggataactttatacataattttgtgcagaatgtcttaaatgcaccttttaacattttctctataatgttttctactgcctcaaaaattctctttagcttctttaggcatacttagccttccttgcccgattagttactaattagttcactaaaacaaaacaaaaacaaatccagagacaagaacc

SEQ ID NO: 51443 - DNA, 908 bp, Bovine  19866880852174
agaattccatggacagagtctggcaagctatggtccacaaggtcgcaaaaagtcagacatgactgaatcaacttagcacacaaatgcatgcagatgtaaatgagtatcttccctctccccaccccaaatctttacatataatcagaaagagtaatatcagaagagtattatccatagattgaggaggaaatggcaacccactccagtatttcatggacagaggagcctggtgggctacagttcttggggttgcaaagagttggacatgactgagcacaaacacacacgcatattatctgtagaatatctgactcatttgttcaacaaataagtccaacctctatgagaatacagcagtggtccagatctaaattctggcctccaggactaaggtaccacctgcctttgtgaggactatcacagtttataaagtacttttagtttatttgattgtatagccacattagaattgttagtaaaactgctgtagggtacagtctgtggaacaaatttcttcatgtggtgggggtggggggcctccttctgggatcctaaaacataaccagccatcagccttgaagtttccagccaaagggcagcaatcatgagtcatagcttatccccaaggcccctcttttccccttaatccttcaaatcaataagataattactgctcttgtctgaaggttttacattttctattattcttgttgactgcagtcaatttttaatgtttatttttaacttaatgattttcgtggagagattttctagttcattggaggtttggggttttatggtagatttaaagaaacataagaatataattttgtctgattttcttttctggcctaaatcttaatttggtgatgtttgccaaggggagtttttgtgagtgtgtctgtttc

SEQ ID NO: 51444 - DNA, 3133 bp, Bovine  19866880864527
tttagaaggagatggatataattgcaataaataaataatcggtcaactcatctaccttaaggattgattctttcctcagcaaatggaggtcagagctatacaaggagaatgatgagaactggctccaactcccaacattttatctcagcagccagtccctggactggaagtccttactgtgtcatttctggagggggcctctgaaatcctatacattctagcacattatcaccaggaagagaagtggttgttaacttcacatgcaataacggtagtagatataattttccattagcctctagtctcacctaacagaagggtaactagggaatgaaagacaggatttttagataatcttaagaagcttcaacttgttttgtgcctcacttccaagagcagagtctgggaaccacaggtatcagcatccctcgggagcttggtagaaatgcagaatctcaggcctccctaactcaggcctactaaatcagaatctgcgttgtaatcatttgggtgatcattacattttgagaagtgctggctgaaggcaggagagggagaaagagagatagagagatcagttttacaggtgggagaaacctgaggcacagagaaggtggaaggtaaaagcccaatgtataattttacttaaagctggcttttgagtggtgtgtagaaactgactcatgacataaaccctggccaggagaggcagtactaacagtcttcactaagttccctgaagcccacaagcatcacgtcaactcagctccaggtgcagagctgcctgtcgacgacatgtttattgagctcagcgcgtgcagagcactcaccctctccctttaaattggaaacagattgcagcgctgtaggcagtgtcattgagaaggtggcaactgtcttgttccaaagtcacccagagtgaaagtgaactctaacaaccctgggccactctggttggagagtaactttctaaataaggcttcttcttcagtttttttttttttttaattccctaaattagtggttctcaaagcgtgatgcccagacaagtagactcagtatcagggaacttgttagaaatgtaaaatcctcaggtctcaccctagacctactgaataggaaacgccgggtgtgggtccagtgatcaggcacaagtccccaggagtttctgatgcccactaaagtttgagactcaatgccctatgtcattaaaaaaaaattagaaatgaaatgtcttttgtccagatttataggtaatggaaatagagattttcttcttggatggccattatatttctgtactaccaccaataaaggaaaaaagtcaggttctctatcttctaaagaacacttttgcaagtagtgtttctgtcctagcacagacacatacacacacacacttctttgtgaagcagatagagcatgtatccaacctccattctccatctcagtagacaaggaaactgtccccaagcaatcagatgtttgctctccaggagccaggctggtctgagttttgtattttcaggaaacatctgatgcagaaactctgtaaagtcttgaggaagagacatgtccccattgataaggctattttatctcatgcaatctgaagtcctatgatctttttggaggcctgttggactgactgaagttgtgggaaatcttggactagtttattatttttttaaatatattttttgttttaatgtcttcattaatttattacaatattgcttctgatctatgttttggttttgtggccatgtggcacatgggatcttagcaccaggaccagggattaaacctgcactccctgcattggaaggcaaagcttcaatccctggaccaccccaaggacatccctgggctagtttttgctttatttgtacagttcctttttaatacggctcagtggagctagtgcatctccagtttgttccaaagaaggggctcagcaacctgactctgccttcttatttgcctttgattgaaatttggaaggctccacaagtccctgggggttggggttagggactgcgggctctcctctaagagaaagactaccagcccatagaggtcatgggtgtgccttagtccctgccatgttcgtcaccgtgtcctgccaatttaatgtcctccccccatttctagaccctgagagtgtactgtgttaagtgcatacgtgactgggagtcaagaggaaggaagctcgaccaggaaggcggggccacactcttcagaccacagggccctgtggcttctggttctaggttatacatgagaggcagactctgagaagctgcctcgtggtggaggatgaaacactaacttggatgcaaagataagagctctggtctcagatcttatgattcactggccacataagtgtgggcaaatcatgtaagctcttggacttcattctctgcacctattaaatagaagtatttaattctattaaacagaagtattaatatctgctctgtatgtgtttccagaggtgttgcaagacttgtatgaggtctgcctctgaaggtaacctgtaaccgggggatctctgtggagaggtgggggctgggcattccataggatccctccagctgtgtggtctccactgcttgtccccttggggagacctctattgctcttctcccccatgggaacacacagaatgtctttcaaggggaccacatatgcttcttgcaacagtgcagtgattctttagcagtgcttgtgtaggcctggactcagagccacccagaggaactgcaagagggtccctcacccctctgcacccatgaggctctactgccagtgccctcttccgcccaaagcatagaatccgaccccatgaagacagtctctgttctgccgccacgaagctgaatagagtccattctgtttcttctgtaccttttatctcaaaggattgccgagcacacaatacacttcacagctcggtcctgtgctgttagacaataaagggtctttcactgaccggcgctgctgaaatgccaccacctccgccatgcagctggcagacagctgttctgagctgtgcagaaaacatctctcaattctaggtcatctggaatgtcatacacagagagttcaggaggacagcacgaagcct

SEQ ID NO: 51445 - DNA, 481 bp, Bovine  19866880883447
gagaaggggacgacagaggatgtgatggctggatggcatcactgactcgatggacgtgagtctgagtgaactccaggagttggtgatggacagggaggcctggcatgctgcgattcatggggttgcaaagagtcggacatgactgagcgactgaactgaactgaactgaatactggaaagggttgccatttccttctccagggaatctttctgacacaaggatcaaacttgtgtctcctacattgcaggcaaagctaagaccagggaagctaagtccataatctatgattcttaactttttcatgttttatatttgtatatctcttgagttacattctgcttaattctttcagccctattattcactttgtaaagtcttttttcagctgtgtctaatctgctgtttctaattccagtttaaacatttatgtggttttcaaaaaatgacttctcactagtttttataaactctgctccttgc

SEQ ID NO: 51446 - DNA, 1017 bp, Bovine  19866880902729
tgccatgtgtccgctgccttcaagaaaattaatcgctcctctgtctagccagcaagatagtggcttcgatagcccatttgtcaatctagactaattgttgtagagtatttaagaagagtcattaatatattgacaacaaaactgaagggaagacttgaaactgaaaatatttgtgggccctgcatattttgagatgttttagtaacatccatcatataagtaaagtattctcataaaactacttgagatattaatgttgccttcatcttccaaagactttggtggtgtgtgtgtaatctgcttctgtgtggtgcttgtatttggttgctaaaccatctatttttatacttataaattagctctctgtgcagttttaaattatttaaataaaccttgcatatggtctgtagaattgttatgaattgttttttaattcacaatgtagaaatgttatgttggcatatttgaaattcacccagaaaaatgtatcaattttgatttgttatgtatgatcagccagatttaatttttgaagttagctatgtttaatgagtctgtatatttgctctgcacatagtttacctggaaatatctgctcaaacttttgatcctgctttcagttactggaaatgaagtattgcaagcattgccacagactatgtacctgtatcctcacttcattatttcaaaattagcttgaattttttttagttggcgtttgtgttatttcagatctcctgtgacatgcagagactttgtctctcttatggtttcacagtctttccttcatctgaagcattactttttaaaaatggaaataatctttgtcatacagccccaaattttaaactcttagatttttatgttcatttatagtgcagaattggctaacttattaatgctgtggttgacggttacattctaaaccacgcagaaatgaatgaccacttaaatatggttgcctcttttttgaatttctagagatgggtataaagtattaggtgttgccctaaggtg

SEQ ID NO: 51447 - DNA, 1088 bp, Bovine  19866880928347
ctcttcaaagatgaaagagggagacatgatttgaaagagatcatgggagtcaagagagacagtgcaagtctaaagctgacttatttcttggacaactgtacagtttagtccatatagtccaccctcctctaaccctttcttctttgcctaatcttgcaatcaaaattgtcaaatatatcaagtttcttgttggttaaactttcattttacattctacagtaagtttcagccttttagtcctatctgttggtggggcaccttttgtgaccagctttaatggcctctatatggcttaaccaagaaacaagcagatattctgaatgatgcttggtctgcaaattttcttagtaaaattatactacaaatttatcattaagaacaaagacctaggacctgcctctatatataaggtaatggaatctctattaaaatgatctagagtacagtgggtttggtaaaatttgtaacattggttaaatgtgaagaaattctttccagcaagtcttgactgcaacagattttctagaaataaattccctaaagcagtggtgcctaactaagtgtgggcaacaataatcaccctggagattcttagtcagtgtgcagtgggatttggacacgtgcatttgaccaagctttttaaacgattctcacgtgtaccctgctcttaagccatctgttttatttgcttcctgaaaagttgatgatgctttaaaatgaaataacaatagtccttctctgagctgtaatcacagaaatttcaccttctggtactcctacacacaatggcataattcagagtcagcttttcatgatcatgttaattaacagatcgtgtactcagtgtatagtgagaactcagtgcatagttctgagtttgtatgttaactattctgattcccttgaacttttgtggaagtaatttgtgagtcagtccaaagtagttttgtagcaataaatgcttttgttgactattggctagttccttattgtttcctaacagacactcaccttagtgtcaatcttctgagctacttgcattcttaagatccatgtgctggttttatgaaattgaaaggctacatata

SEQ ID NO: 51448 - DNA, 1327 bp, Bovine  19866880930998
ccagttccatagagtggaaatttctgaaccatacagcattctcccactggctgcactaagcaaaacttagctataactggcttttcctatctgcctgtattatatagtattaatattttgctcttcagatcattaacctgggatgactgggacataattattatttccaaagagcttggtgcgtatttgtggaattgctatcctgtgctataaaacagtgatcacgtgcaagcatataaatgtccccaatcatcaaaatctgtgtgttaccagtaaagttgccaagaggccaccatggttgtccagttagtgatacattttcagtccatggagtagatcttgttattgtaaaataacagcagaaactcagttctgaggttctaagtgcttttaagttttcggtctctgccatattttgataccaatcaggcacagatttttgtcaggaatcttcttttgttgactaaatgggttttgattggtggcctagtgattgggttttgcttctgtggcctcgctcgtcccctctgctttggtgcctgccttctacacagttcactcacgtgttctgagtaatgctcgttctttcttccaacttgtctgtcttcagttgagttcagcgccagaccccgtgctggaaacagtctcaggaatttttcattcatcagacattttcttccaaagaaaaattctgagaataggagggtcaccttgagagtatattaatgtagttcagttgtgtgtatcgtgtgtgtatgtgtgtatgtgagagatgagagagagagagagaagcaacgtatgtatcacatacccataagcaattgaatatttggtaggaagccaattctagaaataacacttcccaaccagcatatcgaaactatctcactgtcatttatctgtcttgatattacagaaagcccatatttatatgaggcacttctcagatgtggttaaatagctgaacttttgtccttgctttaagttttcccccagatctctgagaattgataatatcactggaatgcggtatgtatctgtttcctgtagaatgaacttagggctggcagctagaatgctagtggtcttggattcccttgccctgtcatttcatagaagcagcagtgaagttcccctggaggaaatcccacccaccacgccaggattccgtcacatatcattggtctgagccgtgtgtacttaacactcaggtttctgggagacttggccaaatgtatctgaagtaagaattccaaccataaaatttatatataaatatctgaatgtgatacgatgaaaggcttgctcacagaggaaggaaaggaag

SEQ ID NO: 51449 - DNA, 1716 bp, Bovine  19866880999042
gacctctaaggaaggagaaacaacagaaactttaattaaaatgagtttccagaactcagatcttgaaattttaaaatgcttcatctaccaccacaacacctgcctccttctctcttaatctctcctgttcttcctatgccataggtatgtgaacatctatttccactaactttattgagtaatggcaaatgttaatttgagtaggaatatgtctacattgggcttcccaggtggcgctaaaggtaaagaacctgcctgccaatgcaggacataagagacgtgggtttgattcctggcgcaggaagatcccctgaaggagggcatggcaacccatcccagtattcttgcctggagaatccccatggaccgaggagcctggtgggcgacagtccatagggtcacaaaaagtcagacatgactagtgactgagcacacacaatgtcaatattacacagagaaaagtgatacaagggtgtcttctccacatcaaaaaacaaagaatgggcctgatagaattatcaagatgtaattgttcctgctaggatctgcaactcaccacattttggctcccaagagtactgtcacatttcttgaaactgggctctagctgaggcttccttggtattcataaatgtgggtcttgctatttaaaaaaaatttttttatcataccgcacagcctgtgggatcttagtttcccaacaagggactgaaccagccccctgcattggaaggcagagtcttagccactggatcaccaaggaagtccctggctcttgctattgagtcaaatgttgatggtgtatttatcctgaacctcatcaatcacattttctgtattttttctcatctgccatcagctctttctttcatttgacatgaggcagttaattaagctggtgctaatacatctagacattctgcatggaaagtgagtaacgtgagcagcccagattctttccagaaggttgagtgtctgtgaagcctgtttagtgaggtgttttcccctctttcccatttcttaacccaacaaggcattgctggctatttttgtcctttagagaataaaaagttcatgtgttacccacatataacagttcaattatcaagcaaaaattgtagctttattctgtacattgaaaagttttccagattttatatttcttttcattatattctcaaattattctcctagtatcattcaaggaaaatgtatttgttctaatatgttgatcaaataaagcattgaaaaggggaaaaaaaaaaaaagaaaataacagcagtgtgatgtataatagcagggcttctaaccaatatttcattgtgtcatacagggaccacgcaagctgtgtgttaaagagatgaacagtggcatggcaaaaaagcaggcctggcttataaagaacaaaatcaaggcgttttatgcagcagtggcagcagattgtttcagggatggtgtccgaagtctccttcaggtaaggctggcattgagggaataagtacagaggctaaagacaattagcactccgtggtaatgaagctcccaaatggaactgtccagttaggcagatgagcatcagagatcaatacagatggttaaggaattcattttgaattcctggggataggcagagctaaaacagaagcagagaggttctattacagtgaactatgagtgatacacggaaaggaaaatgaggtgccttggccaacagca

SEQ ID NO: 51450 - DNA, 2445 bp, Bovine  19866881015126
tggcagaactgggactcaaacactgtccttctgctccccagtcacgaactgctcccaccagcccaggctgggagttttgacctaagtcagggtttgtctgttcccctctcccttgcgtatttgtccatgaccgaaggcttatgggaggtcagaggtgttttgcagggctctggaagttttgtgtcccagccaagatcagtttagcattcttgttaacatactgtatataatggatgtctaaaaatccgagagtataaataattagcaataccgtgtcactgtttctttcagacctgcacttcaacttttatttacttttatatgttgctggcttagggccacaaggctttccatcaatagggatggctgctgatgggagtgatttgctctctcccccagtgctgaagagacccattctccaaagaaggtgtttttagatcgagatgggctattgatgacactgtagggaatacagttagtaaaaccatgccataaattgggctggtgtcggtttcctgattgaatgatttgctctatttggtcatgaattatatattcctttttggattgatcctttctcccactgataaagggacagtattctacccagtgggtttggcccctgacctaagaaatatactgatgcatcaaaattccctgagctaatagctgggatgaactctggagactgtaaatctgcaaaggcagagaggggccaggaaggcccgtgggctacaggtctcccctcactttgtatgcgtcgactgccatgatggctgagcaattcctcgtctactctttacccaatgtaatttgcaaattgattgttcttccttggaagtctttcttaattaaacagtaactgcaattattaccctgtgacaaaggggacatctttgtgtcttggcagaggatagccttagctcagaagattttcttttgtggaagtgcccaccatggactattgtgtacagaactctactggataagtccttcttgaagaatgagatggcacttcttgtccacaaagaggtaggattaggtgagttaataataaggtcctattacaaaatatatgtagaatgcctttgcttttcagtgcacttattgctaacattattccatttcacttgcacatgatgtgtggcaaacaactgcagtctccatttgttagatgagaaaactgaggagagagagcttagggggttgccacgctcatagagaaaagtgagaaatgagaggagaatacagatgagctccctcctgtgttaacctatctgctctccattttgaattatctccaaatgtgttcattcagcaccaattttaacgtgccaactatgattggtctctgtagggatgaatagaattgccatgagtgaacaggcatcttcaatggacatcagccttccaactgcagaagtggttctgaattcttgataggtatcagaaacatctgggaagctcatttcaaagcacagctgcctgggccacagcctggggttttcctaaatctggaatatgccccagcatttgtgtgttatgtgttaattgccgaccctgtgcaaccctatggactgtagcccgccaggctcctctgtccatgggattctccaggcaagaatactggagtgggttgccattcccttctccaatgccccagcatacacaatttcaaaagtttttgaggtgtatcagatgacgagtcagagtgtgaggcagagaactgagcttttatctcacccaggattgcacaaggaaaggtgacatagaatgaggagacccaacattggaacccagtcagcctggagacttgtaggcgaacgagtgtcagaaccaggggtgcctcagagcccatagaaaggcagggacagtcttcattccaaggaaacataccagcatctcccagatgaagctcttctgacttgagccaggtcaatttaacaggcaagaaaagaaaggaagcccacccccttcatccatactggatctttctctcttttactgctttactccttctcctctttgttgctttctcctttccttatccatattcaaaatttccttccttcatcaagatcctacttgccctccaatgcccagctaatttgcaaattttccccctgacatctttgatttattctctcaagaggggtctctgcgccttttagcactttgtacctctatggtttttacttagctgtcatatacaaggtatatttctgccttggagattgatcctctgttcatctttctccctcccagtacctaacacagaacctgacatactggaggtgactagtatttgttggttccattgcatttttcttactaaactgttactacttctgggctgtgtgtgctcagcttgcttcagtcatgtttgattatttgccatctatgaactgtagacaaccaagatcctttgtccatgggaattctcta

SEQ ID NO: 51451 - DNA, 974 bp, Bovine  19866881019909
aggaattgctggaacttgcgtatatccttacaagtcgttttcctggtgattgcggagcctttaaatgggagccctggtgtgactccccctgggggggatgcctccttttctgttaccactttatttcagttccactctctttggaggaaatgatgtgtgcaaagccaagggcaggatcgacctgttctgcaaacaagggaatcatttactatctgttaatttattgcagcggagtatcaggcactctgcagcagtgggccaggaataacgtcagcaggcagcggtaaggacttgttttgaaatttactaccttaagcatgtgcagaggcagccctgggccttcctgtgggtttccagttggtccctttacaccagtctgatctgaaccccttctctgactctcactgtgtgatctacttgggacacttggaagcccccagtggcagaatagaacagtggctcagtgggtcctagggttgctgggtgtgggtgtgggacttcatactgaagtatcgggtcctctcccagggtggtcgatgtgagcgagatacagtggctgtggtagctcatttatgagaaggggcagcctggccctcctttgggtctactgctgtcaagcacaattcagggttacaagttcaggtgaacccctgcacattttgaacattttcttaactaacaaggggtcagtcattaacagatggcaatagggatccatcttgtatttcgtagcaggcagtgatagcagttagctgaaagaaaatgaaatgtttaagtgtaggagttagaaccagagaaatactggtgccatgaaagaaattaaaagggagaattggaacaagtgtaaacacagataagaaagaggaagagattactttattaatataaaactaaatgatttgattcaagagaattatggctgaattgactgtcagttcattctcttggttggtttcatcagtgtgtatggatga

SEQ ID NO: 51452 - DNA, 1118 bp, Bovine  19866881032337
ttctggaattttatgtatatctaatgtctttattgataaggcagcaagactttggttttatcagatcttccacacaaactaaaagctggtgtcagagaatacttatacaatgaaaagaatacaactaatccattctacatgcacatacaaagtataccaacaaaactctgcctcagagttttgtgtgattaaaccgtacctctacttgtttatttctataacaatattctttggactctgtgtttttttgcctgcacgagatataaattcaagggtaagcaataggctttcaaactccttagaggttctagtttaatacgatgcatgtttcttaaagttgtcatgcctcccaaaactaggaatgacagttattctatttctgaaatctgaggtccttacaaagaacagcatgggttttgttttgttttgttaggaaaaaaagatatctagaaaataaaagctctgctcatatttgtggcactacgaaggagcaaagttttgggggcaaaaaataaaatattgcaatcctttgaatttgctagagattttttaaaccacaagtaaaaacataagtctcacatctattaaactggagaatgaggaaaggaagaaataccaaatgcaacttcaataatcatacatgacgttgtatcatagctcttttcacttatcaggaacataccttcccccagtctgagtcaacagtttctataagtaaggagagtatatcttgaaatgttttctgtatgcaggcctttagtttttcaaaatattgcacagacatccatttcgaagaacaagtcgacaagagttccaaaagaggcttactctctgaaccactggcttgctccttcagtgtgtcctttaagagaaactccaagacagttaggatgtcttcctcatgatgatggatttccagttggatccgcctggcttcctgcatagtccattctttgcggctctggtctagacacgtctgtaattctgtctccttctgaagaagtagttcagtcttttgcttcataaaatcttccttagctgcagcaagcacttcattaattttatttcgatggtcatctaaaaaatgccggtaatcttgctcattttgttcttgaatt

SEQ ID NO: 51453 - DNA, 1225 bp, Bovine  19866881097313
ttccgcatatggaggtaggcggcgggagccgggagctatccccgaacccctcccgcgccggggccccgccacaactggaggaggaaggcccaatggaggaggaggcggcccagccaatggcggagccacaggggccccgaggcctcgctagccggcccagccctggggagcagccaggccagatcgcgggccctgatttcgagagcgaggacgagggcgaggaattcgatgactgggaggacgactatgactatccggaagaggagccgctcagtggtgcggggtacagagcatcagcggcccttgaagaagccaacaagatgtttctgagaacctccagagccagagaagcagctctggatggcgggtttcagatgcattatgagaagaccccgtttgatcaattggcttttatcgaagagcttttttcacttacggttgtcaatcgtctgacggaagaactcggctgtgatgagatcattgacagagagtagttaaatgctgttaagagaggaggaagctgcttgaggagagactcagcattccactgtcttttgggttcattccaaatagttctgtgccaatgaaaaacttaatcttcccaaaaaaaatttttttttctgcagagtagaataaggtagtgactgcacagttatgaaaaaggaagaaaactgttaaagaagagtatcttagtactgttgaaacctgttttcaagaatgtccagagacacggctttgactttgttgtttactcagagtaatttccttgcatcgaggaagataatctttcatgtttcactgtaaggaatggcttttcaaggataagttatgaccaagatagactgccagtacaagagcccactggtgataattatatgaggaaaagtaactgatgtatccaccttaggacataagatgtctttgagttatttggactgaaagcatattgagaaaactttaaagattcaagtttgtaatctatccgagctgtggttatcaaaggctaaatttttagtgtaaaataaatctaccgagtattcttcagtatctcaaaggataatctacccccaaaagaagtatgtgtcttgtgtgctatatcttaaaacgtgtttccaagaacaactgagattttgtttgtacatatatcttgatcatttttaaagctactgtaatctttaattcaagaaaattcattgcctgaacatttttaaaaatcaaaacttaa

SEQ ID NO: 51454 - DNA, 1295 bp, Bovine  19866881146512
aaaatgcaattcgcctaatgctcctttgacatggatgcttaaaatcacagactgtgagatctggaagagacctcagagatcttctagtccaacatgctggattcacagatgagcagttggaagccagggaagatcagatgccaagaaaaacaactggtatctagacaattgtgactgttgattaacaacccaacaatctttgcaaaaccaaagtatgtctcaaagcaatttacaacagggctataaaaaatatcacatttattttattatctgtattatatttcatagccttcgtactcaaagtctggtccgtggacctgcatcataggcattacctgggagcttgacagaaatggaaaacctcaggctctgtcccagactactaaatgaaaatccattttaacagaattcccaggtgatttctatgcacattaaaggttgagaagcatgagtctacaccagcgctactcaaagttggttcttacaaagatttgtgagaactgtttgtgtccagtctgtgaggaggtaagtacagagactaataaacctcttgaatgttgctaagagagtaaattttaaaagttctcatcacaagaaaaaaaaattatatacttagtgatgtatgttaattaaacttattatggtgatcatttcacaatatatatatcaatcattatgttgtataactgaaactaatataatgttatatcaattgtatcacaaatttttaaaaagtagtaagcagtctgtagaaacttttgtgtaagtttcacagaataattttatataagctgaatccattttagaaatgaaactagtatttgtatatttttgtggcattttctactgatttattatttacagtagattaaaaattatttttttaagtggaattttaccatagataaattcttctatactgtccttccctgctctctactgagaccaactgaaaaaaaaaaaacaccaattggctctcttctcaacttattccatgagccagtgctaacctaatactaaagtcagaccaaaaaaatcctaagaaaaggacactacaaaccaacatcctttatgaacagagacacaaaaaccttcaacacaatattaacaaactgaatccaaaatcatataaaaaagattatacaccatgaccaagtaggatttatcccaggaatgcaaagttggcttaacatctgaaaatcaacaaatacaccatattagtaaaatgaagaacaaaaaccacatgatcatctcaataaattcaggaaaagcatggacaaaattctatgtacatt

SEQ ID NO: 51455 - DNA, 1338 bp, Bovine  19866881159298
gacagcacgaagcctacaagttatagagaaagtctggatttttgtaaaacgcacacaacaaacccacactagtctcccaaccaatcctgagaaaactggactgactcttaaaacgatgttgatttgtttggcaatgaagatccaaactgaccctgtccaccaccaaagtggtctctttactgtaaacaattaggcctcttagaatgggaattgtataaataaaatttgagagtggtagaataaactttatttggtcttgcccccaaataactatggctatattggtatgaatgtgtcctatatgtgtgctaaattacttcagtcgtgtccacctctttgtgacccccatggactgtagcccaccagtcttctctgtccatgggattctccaggcaagaatacggaagtaggttgccatgccctcctccaggagattttccccaccagggattgaactcgtgtctaccatttctcctgcattggcaggtgggttctttaccactagcgccacctgggaagcagtatgtttttgcctaacttaggttaacgaagggtttgttatgtgacagagctgggctaggagctggtaggctaacatgaattggacattttctggcctcagcgtcaagtacattcagatgttcacattccctacataaaaggaaggggcttggggtaatttcagactcctgtctctttttcctttacaacagatggtctctcttagcagagcacacaactagaacagctctaatagccaaaggccatctcagcttgtcctcagattccttcttactactgaaaggaaatccagaacaaattcgtggaggttttcagtaattatttgcataaatgaccttatagtcacaataccagaaatactagtgatatttgagtttctttcaagaactaactacatctgagcacagcattcattaagttctcttcgaaaggatgatttaaatttttgttcagtgtggttcacattttatttttttaactgtctgagtaaatgcaccataatggaggaagcttgaattgtgattatttcattgatctatgcatgtgggtctaatttgatgcttagaggtcctcaccctttcatttcagctgctttttgtgaatcttagctattttttaagtcaacctgaccattttgcagactccttcatgagcacaatgaaggaatgaggggcttaagatctatccaaagaccccactctgtattttcagagagccacataaaacccatcaacaatttgttaaataccaatgtgcgccagagctatgctgggaacttgtcagaaacataggggataagtatatgagtcatataag

SEQ ID NO: 51456 - DNA, 2766 bp, Bovine  19866881163994
tatactactctctgtgaatggactgagacccactggtgagttgcaccgtgataactacctacaacccagtgtcctagtttctttgaatgtcagggtccgggtataaaagagcacatgagacaaagtggagtaacacagtgaatccagaatggatgaaatatggtcttgaattagaaaagtaaaggtaaaaacctatctaaaatgattcttatggtgtctcatacaaagtaggttctgataacattaagagagtgttatcatttctactattactaccactactactgctactttcctcctcctattataattccataaaacagcataatgatgttttaataaaatactgatacatcttaatgacaatatcaatcacaatgcttttgacagcaagtaacaaaacaattacccaactcaaaatggcttaactaacaatgatgtattatctcacataagaggtccactggatgaggcagttcttgaactggttaattcaacacctccgctatgtaataaagaatctagttctttccaccttttctgacctgcttggctaacaatattcgtttttacactcataataatcctctaatgatcagggatgcctgaggcagctctaagcaccatgttctcacacattcatatttaaggctggaagagagaaacctatttccctgtgtccctttttaagaaaaaaaagaaaattaaattcttaaaaacttctctgcagacttcaacttcatcccagtggtcaaaattttattacatgaccattccaaccaataacttgcagaagaaaacataattcctataactgcactacagggaaggggcctatacttcctagatcctgtgtgctcctgatacttgaacaaagtcaaagtttggttaatgtggaggaaagaattgaggggatggtctttgtgtgcacaaccagcagtgtcaaccatagtgatattgcgggagctgtttctcagtgtaagcaatctgatttcagtctacatttttcacaagtcaatgctttagacttcttgagaatagtaagagtcttatttatcattagattcctccccaaaatacacggaatgattttgtagttaaataaggtgaatctattgtatatatatattttccatagttatatcttgtgttcattactgagatcttatcaagttaacaaaacaagattccaggagacttccttggtgatagagtggaaagaatctgcctaccaatgcagggaacatgggttctatccctggtctgggaagattcaacacgctgtggaacaattaagtccacgtgccacaactaatgagcctgtacactccagctactgaagcctgtgtgcctagatagagcctgtgctctgcaacaagagaagcatccacgatgagaagcccgtgaccacaacgaagagcagccccctcttgccgcagcccacgtgcagcaacgaagacccggtacaaccaaacataatttataaaaaaaagactccagtgattactggtcccctatggacttttctttttttttaaatctctatgctaagaaagcctgaaacagtcttattagggctgaatattgttgagaatagagtgtagacagctaaaattaagtcatcataaatatcctctttccagtcctcaaatatttattatcagagtttcaaataaaagggaggcagtaggaagagtgaacactttttgatggaatcaaaatacaaaaataaattttttaatagaagtctatgggaccaaagtgattaaaactaattttcatgaaaaaaaaacacatataaatcccagaatcagattgttaatatatttatattaaaatatactttaaatatataatttaaaatataaaaaggtgatatagggagatatgcagggtgggaaatctaaatctacttgtgaaaattaaaaaaaaaattgtacattgagtcagggaaagtttagcttacactgcaataacaaataacccccaaatcttgcacataatgcaacaagagtttatttttcactcaagaaagtgtactgcatgtccaggcagtgtgccagcacacctgtcctccatgtgttggctcaacattccggcttgattcaatccatgacacttcctaatcaacatatgcattgacaattgctgtgatggaaaaaagtgggctgcaaagttgagactgagtatttaaatgcctcaacactgaattgacaaatgagacctttgctcatttttcattggccaaagctggtcacatgaccatagagggtggggacatgtattcctcctatgtgcctggagaagagaatggaattggtggttaacaatcagaagtactgttcatttgcctatcacatacagtggaagtgagaaatagccttacgggactagatctgatgaactatggatggaggttcatgacattgtacaggacacagggagcaagaccatccccaagagaaaaaaatgcaaaaaagcaaaatggctgtctgaggaggccttacaaatagctgtgaaaagaagagaagtgaaaagcagagataaaaaggaaagatatacccatttgaatgcagagttccaaagaatagccaggagagataagaaagccttcctcagtgatcagtgcaaagaaatagaggaaaacaatagaatgggaaagactagagatctcatcaagaaacttagagatactaagggaacacttcatgcaaagatgggctcaatataggacagaaatggtatggaccctaacagaagcagaag

SEQ ID NO: 51457 - DNA, 925 bp, Bovine  19866881225734
cactgcagttagttgcttttaaggaatagtcatgcttgatttgttactggatttaaccttaagtatgatcatttttccattagccttgtgcagcaagaaggcccagatgaagcgctttctaaagaggaggtcatcttaaagctgaaagcagaggtgcagcgtttgctggatagcaactctgtgaagcgtcatctggtggtctcagttacaaagtgatctcaaaaactctcataagaaaatcgaagctctccaagtggagaaggaggaaaaaagcactgaggtagaatttgtaaagctgtttttcaaaatttaataaagaaaactcttaaagttttcacatttaaattaaacctttgtctttcaggcattcatttgacttttttataagtaaagttaattaactaatttctaactgttctggatctgctttgctacacaggggctttctcgttgcagaaaatagggaatgctctttagtttcggtgcccgggcttctcattgtggtgatttctcttgtttcggagtgcaggctcagtagttgtggctcccaggcttagctgcccctcggcatgtggaatcctcccagaggagggatcgaacccatgtcccctgcattggcaggcagattcccaacaactggaccaccagggaagtccgtaaatgaagtttaaagaaggaaatgccacttaaaggaatatactttcttgttacttttggcacctagtaaatgagacgccaattaggtaaaattccatagccacaaatccagtgcagcgttctttataacaaggcatctgcatttcctcaagatcagcttgttccggtagtgctttcacatctagttagactctccacaaaacgccctcgcaatttgcctcacatttccctggcccatgttcttaaaagaatagtcattctacaatga

SEQ ID NO: 51458 - DNA, 1009 bp, Bovine  19866881273866
ggaggcagagtgcacacgtgtatatacagtgctggatgtttataagtgcaccccgtcagccttttacaggatcatttcatcttaagattgaacatagagtgaattttatatctttgtgtcagtgactgctgaagaaatggaaatcatgtactagcaggtcatctgcaagtcctgggtcatatgtaaatggggaattcatgtttaatcattgacagcagctaatgaacaatcacttacttgtttgaacctcccttcggcatttctgcaatgtggttccgagaattgtacttttctttttcttcctttctacccccaaactttccccagtaaaagagtgctttggcagcaataaacccctccagtgaagagtttctctcacagtaaattcatggcatttctacaggtccactttgatatatctctggtttttggcttttcacaggtcttaagtttcagaacttcgggcgagaataagaatgtaattagctaaacaagaaaatgagataagttaataaaacctcacatgttcatcaggctcctcaagtggcactagtgataaagaagccgcctgatccctgggttgggaggatcccctggagtaggaaatggcaacccactccagtactcttgcctggaaaattccatgagcagaggagcctggtaggctacagtccatggcgctgcaaagagttggacacaaatgagcacacacatattaatcagggacagtagagatctcagagcgctaaatcctttacctgattctgctgtgtatggagaaactgtcctgggccgatgtgcatggcctaatctctgatatgtatgcactgtaaccttcccagctcctcaggaaatgaatgggctcagatatctagctgtgtttagagaaggaaggcactgccacctacaggttgtaaaatcagtgacataatacattaatatttaatttgtagaaaaaaattattttattaatgtaacattttcatagccctaaaagcctcaaagttag

SEQ ID NO: 51459 - DNA, 1847 bp, Bovine  19866881286357
gcagtaacatataaataagaaaataaaaaatcaccatataatggcacctaaagaaacctgatttcttttttttttaattaattttattttatttttaaactttacaatattgtatttgttttgccaaattatattatcctacataattttatatgtaagctttatcttttttatcacaaaattggaattatacccaacagtcaaatttgaatcctgtttttttttttttttacttagtattggcaaaatcattttcccatgtaaatactattccaaaatatgaccttaattgctgcataattttccatcaagttatgacaaaatttattcaataatttaatttaatcttatgcaacacacatcaaggcttttatgactatatacatcttatagttgagactgaaagatcacagcaacataatcttttacttaaaaaatgaaaacttccatgttaggtaacaaagaaagaaatttaggtttatttcctattttctttctaacttattgagacaaatgtaaatattttaatccaacagactcacattggtatgtcatttttcaatttttataaaacataatggaacatgaattttaatttatagttttcaacactgtttgggtttgtttttcctctttgttttgccaagatactctatggaattcttacaaatgagaactgcaaagattcagggtatatgcaaatacagtgttttctgagtgacacgagcaaaatcaaggcacactagaaaatgctaggaaaatctgagtcagtcctatctaacactggttccagacttcagacatgaattcctcactggaaggttttcatcaaaagaaaaataacccttaagacttttccagggtcaataatttttgccctcgtttcaatatgaaacacatggaatagaaacaatacttgttaattctgacaatattcattaggcatctctagagcccacagggatccatctttattaaatacactaaatatttggcaaagagttggaatatgtacaacagaaatcttttgacttgacacatttcctcactagatccttatcactacagacaaagagaaaaaccagctcatttgacagtgcagcttcgtaagtggatgtaagggtacttgaagagtcaagttttcaacaaaaatggttgatcacagagggagaggcataatctggatgaaacagaattggatctaaaaatctcttggaaggtaaatgctgtattaacatggttttcaaatgtcattcttatttggcagcatgtgccttttgtcctgtgcttcatttagattgccaaagttatgctgttttttgtccaatactccaaccacagaaaaaaatctgcccatactcccaattccttactaataatccaattatttacaattattcccatagcacttttgtgatactaggctaaatttacatactctttttcagacagtcccagctttagacagggaatgtgcctaattcaatgcttggataatatctgactcattcctgcaatgtaaatcattattcctagtgcaaataaaatatagcattaaaaatattttgtgttcacagattgctctgcaatcacttccttataagacctccatgaactagggcaatgggccaagcctttctaaaataaaaatgcaattttaattgtttttaactggctttctctagtgtggctagttcatgggaaattctgcatctacatgttcccattatgagtggttaggctcaaggattgttccccagtcccaacagatttggcctcaaggcttgggattgaaccaacgtacatctgcagcctcccatcctcacctccttcccagatctacagcc

SEQ ID NO: 51460 - DNA, 1002 bp, Bovine  19866881342895
tttgctgttaggaaaacaatttctatactgcaatcccttaatgttcttttcctaagtcacatctggctttgtttgggtcttgggatttcttttcttcctttttttacagtcctcacgacggccaccccaatgctgcagtgtcattaacccagttgcagctttgattctactggctccttaccatggttcccgcagcggtcccagcccattgtcctcccccacagagtgctcaatggaagctataactcaggggctgaggcgttcaaagagatttcagggagccatcatctgggtgtcaaaataggcaagaatctaaatgctgagaactcatgctgtgaagaatcaggagaagcaaggctccttctacccctgctgctgaggtatccccttccaatgttctgagagaatgcgaagccccatgtgtcctgacatctagaaacagccttagcttctcctaagatgaacttcaggagcaccttctaggtgaccagcactgtgctggttgggcttccctagtggctcagtgataaagaatccacctgccaatgcaagacccgcaggagatactggttcaatccccggaagatcccctggcagaaaacgcactccagtattcttgcctggaaaatcctatggtcagaggagcctggcaggctacggtccatagggttgcacagagtcagacccacacactgtgctggttgctctacccatattatctttcattatcttccttttatttttcagatgaggaaactgaggctaagagacagaaagtgactttctgtagaggtcacatggtcaccaagagatcaattcacataaggggaacttattacatgtaaattaaggctaagtagggcccagaaagcagggtgaggccattagaacgtgaaaaaagggagcaaaaagagggaaactgaccctactcatcattaggccagatttaggtatcagggacattaaccttctaataacgtaaacttgaccctactttgtgcc

SEQ ID NO: 51461 - DNA, 654 bp, Bovine  19866881373928
ggtggactccgggaagttggtgatggacagtggaggcctggtgtgctgtggttcatggggtcacaaagagtcagacacgactgaacgactgaactgaacacatttttccccctctctatctctatacaagactctgctcctaaatggcatgggttgcttcttattcagctccatatatctagtgattggccagagtgcttggattctattaagtattcaacccatgtgtgaatgacaaataaggagacaatgcataaagaggtcctgggcagccaagccagcatgggagttccgggtgacatagacacagcactgggtggagagacggaaaggagaaattaagaaaatactgatggcaaacgtgccttgaaatttgtgtaagaagtcaagtgcagattccgagagaaaaatgttaaaacaaccctctccctttcgtgactcaccatgcaaagttaatcccacagcaggtcttctcagcaaggcaccctcagtgtttgcctctctaacagataatgatcccaggaagctacaaacaggattcctggggagacttggccctctccctgcctgggagcttgccctaggatgaaccacctgattgccaggtaaaaatagaagactctcagcttctgtgttttctcactcttttcacag

SEQ ID NO: 51462 - DNA, 1146 bp, Bovine  19866881440060
ctggctcagtctttctcatacccagaaggacacagccatgtgtagaacttccttttcaaagtccaagagagaagcaatcatcctaagttctctgcatgttacttcccacttgctaaccccattcacatatgggtatttggggacaaccttgctttcttgagctaaaatcgtcaaaactaagtctgatgtataaagtggataatacatagcactatatagttatcaattttgatgtaataaatatacaccaaaaattataccagaaatgaagcttgaatgacactgataaactttacctacttcattttctgcctgtgcctgcccgtttctggaaatttcagatatgaaattattaatctgaactctccaatgaagttagagacaaataattttatattttcaaaagacaaagaatttgaaagaaaattttgctgtatccttatttgtagcatttgtgtactatgggtttggatagattttatttagtcaagatagttctattgtagattatacacagaattcaaagaagggctaagttattcattaagttgacacaagatttctaaaattactaggatttgtaatatttttattaaaataaaaaattagaatagttagtattttaaatgctctcagacagtcaaaattatttggtcatatcaactaaatcctttagcagttcgtcagtataaaacatgttcatttcttgtttcaggtggggcctactatcttatttccagaagcttagggcctgagttcggtggatctataggcttgatctttgcttttgccaatgcagtggctgttgctatgtatgtggtgggatttgctgagactgtggtagatcttcttaaggtaattaaaagcttttgttctcttcatctaagcaagataattcagtttaatttgcttttccagggcaccagaggatatcattatggcaagatgagaggaaacagatttattgtgcagaatgtggaagctgaatatagttggcatcagaacttcttagagtcctggctctcacacttaccagctgacagattttggaccagcccttttgttcatctggaccttgcttttcaaatccataatatgggttaataatattgtcctatgtctttcatataaatgggtacagatcaa

SEQ ID NO: 51463 - DNA, 1058 bp, Bovine  19866881483514
cgcactgctctcatggctctcatttatgacatttaacttgaaagcgattggtattactgggcgtggaatccagaaatacattggaagagttgttcagtgacatcttccaaatagatttttcactaagctgactattttacggttgtttaaaaaaatgtgtagatttgctctccaaaacagacactgaagtgctacattagggagctcttgacttttgtcctagaacaacacaacaaatagattcttgatatattgtctcctatacaatcttcagaatgttcttcaaagctgtcattaaaagagaaaattaatcttgttccaggtaacatacatatatttaagtagggttgaggtatgagggaacagttttctttcataagacttaacaactttaaattcatttccttaaaaacgacctgtctatgaacctggtagctcagacagtaaagaatctgcctgcaagttctgcaggagatttgggttccatccctgggtggggaaggtcccctggagaagggaatggctacccactttagtactcttgcctggagaattccatggacagaggagccttgtgggctacagcacctggggtcgcaaagagtcggacacgactgagtgactaacacttacacttaggaactttagttacctaagcaattaaatcctgtaataaataactggggacgtgcttcagcaaacagaatttccaatggagtcattaaaatgccacctgcgtttctagtatttgcttgtacttaatgcaggtggattcaatatgactttagaaaagatgaaattctaccaaacaaatttgagtgaagactaatgagaatattttcagcctgaaacacagtacgttggcagtactaaatgtggaaactggaaagtatattatgattgatattaacacatattacatcatgagtaaatttctaaaatatttctagaatttctaaagacaaggtcttgtagggttataaaaatatatcctgtcaagatgtctctgaattcttgaatcttttactagtcttcaaaatatttcatttgttcataca

SEQ ID NO: 51464 - DNA, 1302 bp, Bovine  19866881489846
tcacagattccatcacaaacttgacactcagtttggctgaagttccaatccccgtcaagggcctgagttggagttctgagttgctcagggccatgagtcagaagaatctggactgatttatgattttgggtggaaaccctgtgagacttggcagttccacaaggggtataccccaacgcaggcaaaaactggcggtcttctacaaggtttcactttgactctgagcacagtaaagccacagggctttctgcgccagtcttcccagtacaactaaacctccccagggcagccacaaagcaaaatgcctgtcccacaaaactccatttttaaggagtaccagacctggcttctattgctctgtgagctataaacatactatggtcttcttcccaataattattctttggaatctcagctgctccaaaccacctaagggcggagaacacaccctgtgccttttgtctttctcccagcactcatcagactgcgcttatttcaggcagtcggtaatcacttgctgatgtgcctgggtgtgcacatgcagaaacaaagcatatgctaccgttcactagttagagcagtgtgggtcagacggtacttgctggagctaaaacattctacagtcgtcactgaactggttctttaagcagatgagggaggccagatccaaagatcataagccaccgtgagaagacttttacttccaggaaaactggaaacattaagtaaaagcaactagtgatggagatggaactcagagaacatggcttaagtgctttagaaagagactaaagaaaataagaaatggcataagctacagaacttaccaacacaaaacagcctgtcaggggtagagtggtagccagggttgcaggcacactggtactttcctatgaggttcacgcagcggccatgggggcagaggtgtgcacttagttcacactcgttgatgtctgtttaaaaataagaacagcaaacatgcagccatcagcctctgactctgactaggatgtgggccgaatgactggccccaggtcagtggtcttcctccttacctatacacgccgagatgttgggggccagctgatggccagggggacattcacagcggtaacttccctcagtgttcaggcacacgcctcctcggcacaacagcggatctctctgacactcatcgatatctgcaacatggaaatgacccctactgatgatgtgggaaggtgtcctgccctagacccccatgacctggtcagtgcattcagcacccagctgctggaagtcctggctgctagtggctcacag

SEQ ID NO: 51465 - DNA, 1475 bp, Bovine  19866881501775
tcagacttcacccctgaagcaaatgcatcattcatagaaaaagaatattctgtggtacaatgatttcttgtcactcctgcccagtcactaaaccacaaactgcagggaagacacaaggatataattttgggcaccaggctccaattattttaaacacatcttttcataaaaattataaacaaaacaataagatatcaatttatccacaatacagagggtcacagcatgcttcttccttccaggtaggttggcctaggacacattaagctcctgacatatagaatttcaatacagcttttcgaggaaggagttcagagaactttcagtctgagcaaaatgaaggcaaagaagttccatgatcataatcagtctcataattgctactatctcttcttattctaatcattcttagccttaggacctaaatcacctggggatgttttgcaaaacactgatgcttggactgcaaggagatccaaccagtccatcctaaaagagatcagtcctgggtgttcactggaaggactgatgttgaagctgaaactccagtactgtggcaacctgatgcgaagagctgactcatttgaaaataccctgattgctgggaaagattgagggcagaaggagaagagaatattggatggcattaccgactcaatagacatgagtttgggtgaaccccgggagttggtgatggacagggaggcctggcgtgctgtggttcatggggtcacaaagagtcggacatgactgagcgactgaactgaactgaattgatgcctgagcctcagccctgtcctgccatacacctccctcatggaagatgattcagtagatgtggcatggtgcctgggcatccataagtgagtttgcaaagtgcttacaacacagctgactgctcacctgaatgtctaaccttagaaatgtgagacaggccataaactgggatcactgccatgcaacataactgtgtctctcaatgaggatgggcattctaatcacaacaaagtattcatttccatagggttgactgattatgaggcactttattatatcccttagtaattatattgactacatgctcactaagccagacaacaaatcaaaatttaagagggttaaccaccaactattccactgtcctaacagtctatgaattcacattgccaagctctctctttccagtgtgacagagcacatttatatacacgatatcactgcacgaccataaactcccatttctagcttctttgtccagtatgggtgctggtagttgagtaaaattccagggggatccaaagacattgatcaaacttcacgtcagtaacaccaaaagttaacttttcatttcctccagaattgccctacagtggaacactttgaaatcttcccacacacctgttgatatgatgaaatatgaaatactaaacattatctaataagtggatgccaaaaacagtgaaaccttaaatcaa

SEQ ID NO: 51466 - DNA, 898 bp, Bovine  19866881530534
tcaattcacacttggttaagcatgtcaaactgaatactaagctggtttcacattggtattaatgcctccacaacagttgtttaaaaaaaagaaaaaggaatcactggtgcctgctgtagtgaatactgtgcaaatagactttagagcatatgggtattttttatattctttaaagagagagaagacatgtatatgattcagcattttatcacttcctcttcaaaaccttgcccaaggttcctgcaggcacttaagcatataaaagtaactaaattaaactttactaaagaagcagcagaagtggctaaacttttcattatttaaggaatatggccaagctgttagaagcatgaggcagcactttttctaatctttagcaaagcatgtaagcttaatagatttcttcttctgtaacttgttctaaaatatatcgatgcattttattttcctgctcatctggaacatagtttggaatgaatagcactctttatgtgatatcattaactactatgaagaataattatttgtctcatatctaaatgcactctatttttgcctagggtttaaggtaaggagaaaaaaatggctgaaacaattcttttcatatacattcattcattcaaccttttttaaattaaatgattgtctactccagggattctaggaatactgctaatacaattctaataaaggtgaaaagctccccttagtttctgctcatctttcttacctcaggaaaatccctctctataaccaattccccttggctgctcaggatcctggaccctgggtcctaactctggagactgagcaacatgcagagaaagagctatgccctgtctctttacccctctccccaccagaccgtacttgtgcggtgtactatattaccaacatt

SEQ ID NO: 51467 - DNA, 817 bp, Bovine  19866881719972
atataactgtgttttgattatgtttttaagcatggaggagaaaaattctgggaggaaactgttaacctttaagatacgaactttttcagtgtgtcattttgtaaattaagtttttagagttctgaatgaggcccagacagttaattctccattaacggtggcagttttaatctaagaataaataatctaagaataaaatcacccatttccctctcttgttaggttctaacaacatttattaagtagtatcatgggaaaaactgggtttgtttgaatgctacagctatttaatatggaaacaagaagggttgttaaatgagaactctggtaatatgctaaaatcattgctttgaaaagacattgattggataatttcaaaggcaatagttgagtctccagctgctttccttaggtctaacttaggggagaattttgtgaagtgataaatgtgaaatacttattttaacatagacttccactattggaagcaccactgaggttttctttttgttgttctgttttgtttttaattcacagggagaatgatgaatcagtcaaagaagagaaatctgaattaaaagaaaaatctacagggaataagaaggccaatagattccatccttattcaaaagataagaattcaggcactggagaaaagaagggtccaaatcgtaacagagtttttattagcaacattccatatgacatgaaatggcaagctattaaagatctaatgagagaaaaaggtaactatttttgataaactcattgttggatgatcttcatttagaatggggagggagataaggaaacgttt

SEQ ID NO: 51468 - DNA, 1555 bp, Bovine  19866881820055
tcgtgtccgactcttagtgaccccatggactgcagcctaccaggctcctccaccatgggatttgccaggcaagagtgctggagtggggtgccattgccttctcccatgtcttcctctgccatccccaaaccccactcctccatctagtttccatcttccaaattttggttgagatcctcactgtctttttctttgtccttgtaggtttatacttctttattcctctgcttttatttgtaaagagaaataaacatgtgtgcaccattcaccacattaaatcagaagtatgattaaaggcagctcagttacagatacgtaaagagaaatttgcaaaagcataatcaagtcgaacacagcaagatcttaagcagcagccacaaaagcagtgaagatttgagttcaaggatagttctcattatgccagtgccaactcacagggaccttttgaaaaggagtggacaggatctgccccaaacccaggctcctaactagctctgtgatgttgggctaggtgttgactccctcagtggcttctttggaaaacatatgtattggatcagcccaaaagttcagttgggtttttctgttaacagcttatgggaaaatccggaggaatttttttgccaaccgaataattgtccctccctcggtgggttctgaaggttaaaggagatcatggatgtgaaagagcccagctcagtgccaggcacatagaaaggtggtcaaccgcagccaaagctgattctcccacagcccttggaatcaagtgtgggcccagagggcgactatttgtctctgcttactgttctttgccccattggtaagggggttttagggaaataaaagtaaagtaataaatcacgcacactgtaaccttccaagtctgaagaacactgccccaggcaactcatgcaccatccaggaaagcatgctggcccttctttctcaccccactctcacgggaggcttcctggctctgctcaccgtgaagagcgggacttaggggggaaaggacattttcttaacctctcaagcatgatccttcccctgaggatatggatcagatgacctctggggagaggagaagggaaggcaaaggcattgcatattcatgtgactcttgacccatttaaaggtcacacctcccccagctgcagcacccttcctgggaactctcagcacctgactcccaaggggagtggtcggcccactccttgtgacttagtcacccagagggtggttgacctgaagcccacattccacacaaggttgtaactggaaggaaacttcaagatcacacattcagggctatttcctccaggacatcctcaacaagtggccttgtttggactcacccagtgataagaaattaaataaatttaggggaaaactatgctgtctgtggatagctcggagagctgcaaagttcttatttaaatcatatatcccttcactgactttttaacaactgaaagattaggaccagcaaagaacatcagaatccacccctgccatcaggggagctgtgtgggggaggagacagatgtcaaacaag

SEQ ID NO: 51469 - DNA, 1362 bp, Bovine  19866882012815
cttcctcaaatatgaattaaacatgacttttaaaatgttatttatgattaaaaagtagaaaccatcagaaaagaatttatatatcctcctccccacctaatttgtgactctatatccatcttctatatccatcttctccattccttttgtttcagggaaagaagcagagcttctccagcaaaagtccacctaccctctggagctctgaaaccctgacccccagaactgtctcagggattcccttctctcttctgcatttgcaattcatgcttgtttttgaatcatccaaatcaatgcaaaaacatgctatagaatatcccatgacattcaaacaaaaccccaaatccctcacccaatattctcctccagttgctcaatttccctttcacatacataaaacaatccaaaactctctacttttttcctcttcatcgtttattccaacttaacttttacccactggactccactgaaacttccctcttgaaaatcacccatgatctctgtgctgccaaatattatggactattgtgtatttcaccttaatctctaaccagtcctcggtgcaaacttcccatcttctgctctgacaatatcacattcctttggttttcctcctgcctcagtgaccctctttctgaaattcactggctggctccttctcctctacctggctgcacctctgaactgtgtgcatgtgtgctaagtcgcttcagttgtgtccaactcttttcgacactatggactgtacagcctggctcctctgtccatgggattctccaggcaggaatactggagtgagttgccatttctttctacaggggatcttctctacccagggattgaacccgcatctcttatgtctcctgcattggcaggtgggttctttaccaccagtgccacctaggatgcgtgtactatcttctactgcctacttgacacacaggtgttggaaggacagcgggagtgggggattgagatgacatccttgtcaggaggctcctgtagtagtctgggcaacagacaatagtagcatggatatggagaggagtgtggacctaagggatgttcaggagaaagagttatttggactcggtgattgatagagatggtagaggatgggagaagtaggaatcatggatgacaaccaagcagtatctttcactgagtttcagctggaaggaaaatgggctgcatacagcacatcctttagaaattttccagaaacctgcccaaggaatcagtggcattcattgcttcaagaaaacgatagacacagtaaagaacaaaggagttactccttaactgtgagcttcaaattcaatctgtttttccatctataggcaacaattttaaagccaa

SEQ ID NO: 51470 - DNA, 1117 bp, Bovine  19866880589204
ccccatgttgctttaaataggttatactaaacacatcttcttgcaagttcttgtcatttagttgcataatatcccatgaaaatatgtatatgccaccatttaactgaatattcttttcttgatagacattcaaattatcatactctgttttcagtatgtcccactgtctcgctccataaactatgtctgtgatgtccatgttaatgctttgggctagaaattttcgtggatggttttgtgatcccctcctgacagaaggtatatcttctctttttgtctattgcaaatccttttctgtttcctaccaaacaatggcacattctgaagggttgcccacatctctggttttggagtcactcttgaccctctcaagccctcatctgaaaaaccattgtcccttgtgcgctgaggcaagagtattgtgtgttgctcagcaacataggggcagtttgaatgaaaataggacagttagtagagattggccagaaacacgttcacaggcccggaggatgggatgaggggaaattcagaccaggtctggaaaaggcagtggatagcccgggttcatcatattaaatggtactgtatagtatttgtccttctgtgtctggcttacatcacttagcataatgtccccatactcattcatgttgtcacaaatgacaggatttccttaataaagaggttaaacagagaactgtctcctaattaataaaaggatggatatttcatttcagggttgaggactcatctatcctgaactgtttaaacagacctggcagaataatagttaatccagtgtttagtgtttccccaaattcttacatattctgtagatttctcagagcaggtatggaagtgggaggcagtctccatccctcagaggtgggaaatgggtgctttgcaaaggagtggagccctgccatgtggtctagaattcaagatgaagttcttgggaagtagggaggcgatcagatcagatcagatcagatcattcgctcagtcatgtctgactctttgcaaccccgtgaatcacagcacgccaggcctccctgtccatcaccaactcccaaagttcactcagactcacatccatcgagtcagtgatgccatccag

SEQ ID NO: 51471 - DNA, 3107 bp, Bovine  19866880623575
agagtctagcatctgttttaaccgccctccggtgattctgatgcgtgcttacccttttggcagagtaccagctctacgctggcatgttaagtatgtgttgagttgaactgagtggataactgttcaaagaacatcagctctagagccaagcttaaccctgaggagtcttagttctaccttcagggaagatgaaggcagtaaggaccattgagtggggctgatgtttctttaaagccttctgacgatcccctccttcatatctcagccctacctgcatcttcagctttctgggaaactgaattagaaagcattcttgttgaataattgcaacataagcagttccttcaaatcgctggagattctgagttcctgtgttctattttatgacatctttgtctaacccaagatctcaggtatctttttcctctcttgttctagacattttagttttatcttttacattttggttcaagatctattttatttttctgaataatgttagataaggatgcatgttcattgtcctccacactgataaccttaacatgaggtgggaaatgctgtatttagagcaggatttggggatgccaagagtttagcattgcacatggtaagtttgagatgtctcttggacatcttaagagaaatactgactaagcagcctgatttatgagtctatagattaggagtgaattctgggtcgaagatacaacactgagagtcaccagaaatagtcatgacattgaatgaaaccaagggtttgtgtgcaaatagagaagaggtctgaggactgggattttgatactccagtgttaagagggtaagaaaagatgagcatctacagaataaactgaaaaggagaaccaatgagatgggaggaaactccagaaaagtcaagtgaagaaagaacatctggtgagtggaatgaatgatgatgggaagtgctcctgagagttcaggtctaatgagctcaatcatttataccaggatttggtaatttagaggtcactacagataaaaaaaaaaaaaaaaaaagagcagtttttatggagcacatttaagagagaaagagaagagaagaactagagatagaaaatgtagaatactatacattttactgccaaggagacaaaagaaataggacagaagctatcagtagaaggggcatcaaaactctcatttttctaatgggagaaatcacaacatattcagctgtaaacaccattttctccccctttcactgaatggtgtgttttataccatttcctacagcagcccttttctctttcaacatttttggctcctgaatctctctctggcttgaactctgaaaacatctggctgaaagctcctttttctctcctgagtcattaagttgcaataagaccagaagcagaaggtaaagcctggactagtgagcattcctttgttgccttcttacaagtgactgtatttggtctatttccacccactggtaccagttttcagaacatcatcctttaagacctctaatgacctccttgaccacccccgtcacctcagggccctggtttcactgtttcccaggactgtgtacttattcatcagagcactattgcaagtttgttattgcttgcatgtgtgctaagtcatttcagtcgtgtctgactctttgcgaccccatggactgtggcccgccagtctcctctgtccatgggattctccaggcgagagtactggagtgggttgccatgccctcctccaaggcatcttcccgacccaggaatggaaaccatatctcctatgtctcccgcattggcaggtgaatccttcaccactagcaccacctgggaagctccccatattactaaatattcaatatgactgaatattacatttcagtaatatgatgatttaattaagttctaaatggaaatcttcatgtcaatatacttccttctccaatcccagttccctggaactcattcaaccatctttttctatatacttagtgtgtgccggactcattagggtaactgagacaattaagatatagtattaatacctgccaatgaggaactcatatttgataaaaagagttaaatatgaaaacctaattataaacaatgtgttgttgtattgggggatcccagagatacccaggaatgactacccaggcacatgagagaagcaatttaatttattgtatcagaaaaatatatgaatatggatttttaaaagtataaaagaatagaatagaccataaaaaagcaacagtcatttgctaaatcgtttctcccattttttatgccatatctttatttttcaacttttctatagattttatttttttaattaaaatttttgagataattattgattcacatacattgtatgagatatgggagatccattcagtgtacactttaaccagtttccctaataataatgttatataaaactgtagtgtaatttcacaagcaagttattgacgttgatacaacccaccaatcttattcctcattcagatgttcttatttttacttgtactcatttgtgtgggtgtggatggttaaatctttgtgtgtgcacatttagttctttacagttttatcacacttgttggtttgtgtatccaccaccacagtcaagatgctgaacagctctgttaccacagggatccttattgtcctttcatagtgacagcaccccactccagtactcttgcctggaaaatcccatggacggaggagcctggtaggctgcagtccatgacgtcgctaagagttggacacaactgagcgacttcactttcccttttcactttcatgcattggagaaggaaatggcaacccactccagtgttcttgcctggagaatcccagggatgggggagcctggtggctgccatctatggggtcgcacagagttagacacgactgaaacaacttagcagtcacatccacctccatcttccctccccaactcattttttgtctccacttttaaccagtatcattcttagctctctaggtggtaacctctatattttaagataatattcttattgtattattttttatttatcaactttatacttttttttgacctctcattgtgtagatggt

SEQ ID NO: 51472 - DNA, 1193 bp, Bovine  19866881028610
ctataggatgcttctagatgagcctctaaatgatccttatgtgcaccctccccatagtaccatttttgaaggctaatgtgaaatttccactgggagctcctccagcctattgtagaagatgacctttggcagatggaaaaacaagagaagagaaatggagggttaacagaggggtttggaggaaaagaaagggggaaaaaggaggcatacgagtgagtagtagaggaaggaagggaggttggtgggaagaaatgggactaacaagtagggtgaaatggggtggagtggagggaggcgatttgaaggaccaacagaagagagatagttagaaagggaatagaatgggaagtcttagatgattcaatttctgcaaaaaaaatcagcgtggaaaagtccccaacaatacattctgtgactaagacattatgcagagagatgagctgggggctgaaggacagaattaatatagtaagtaattctatccttttagcaatgtctttctgcatgaaataatgattttatgtctcacttctctccagtccgcacattcttcataacaaacagttccacagtgagtgactatttatgtttcaaggcaacagcctcggcataatggactatgctctgaatctttttctgcaaagaaacccagggccacctgggaaacctgggagagctttccagttgggaaaaatcctgctactgctaactagaggggcttggagtttagaatctggaatcaggcagatcttggtttaagcccttccagtgcttcttacctcttacttaaccttcactgcatctattttctcatttataaatggggatgcttgggggcttccctggatgtccagtggttaagactctgcaattccaatgcaagggacgcaggtttcattcctggttggggaactaggattcccgcatctcacatggtcaacaaataaaatacaaatggaggtgctcatatcgggcttacacatgaaagcatacagcacagtaaccctgaagtacagacaggggttcaaggatggttgattgggaaaatatcaaatctccaatttctgtgcctggaagaacacaaagctgggatggtgaaattccagtccatgagtacagagagaagacatggggtatgtccccacacctcactatgaaagcttacctgattcattccacaatatttaatacct

SEQ ID NO: 51473 - DNA, 1470 bp, Bovine  19866881164580
ttggacacgactgagcgactaacacacacacactgcatatctgttaagaaaatgataaatggtaggtgctcagtggtcagttgttgcttaatacactgagagccttccactgccctaatcattcctaatgttgtatatgttgcgtggggcagaaagaatggagcagacttgaagaatggaaaatgatggcactcaactgcctctgagaccacagtttataaactgctggtgttctatagagctctaaaaagggcttatgcattctccaggacttgacatagaaaggcttgccttgcactgaaagttcaacagagacaggttaagtggcatcttcacattctgcccaatcccaagaaacaccttgtccttgaaccaggacatattcctggttaactggaagagcaattacctcctaattaagtttcatcccaatactttgaccatctatgctaagagccaactcattggaaaagacactaatgctgggaaagattgagggctggagaagaagtgggcagtagaggatgagatggttagatagcaacaccgactcgacatgaatttgagcaaattccgggagatagtggaggacagggaatcctgatgtgctgcagtccgtggggtcactaagagtcaggcatgacttattgactgaacaataagaaacagcaaatttcatcatgaggctcttaggccattccatcctcagggcacaggaagaaggcagagacttatttaagagacttcagaatcttcttgactcaatcatgaaggcctcatttgtctacattactggttttcagctgtgtcagtagagtcctaggtaggttgtgatggtaccttaaatgggcaggtgaaggagcccaggagaaacataagcagttggtatttttcttgcctgctaatgaacttgtattccattcattactctgataataaacaaaaaatataaacaaagcagatacaaacaaaaatacccagctctaccattatcagtcaaaaacccacccatgtcagctacttttctttaaaaaatgaggtgccagatgttgggctaaatatttataagcattatatcagtaatcttcccagatcccttagaactcatcattgagaacttagaaaacattgaattaggcaaaatttcacattagccgtggacaggatttctccctgaagttgtagaaaattacaagttgtgcatgcacagtcctgtccaactctttgtgaccccctgaactgtagcctgccaggctcttccatccatggaattctccaggcaagaatactggagtgggttgccatttccttctccaggggatcttcctgacccagggattcaacctgcatctcttgcagctcttgcattggcaacaagattctttaccactgagccacctgggaagcccaaatatttataagcattatgtcagtaatcttcccagatcccttaagggaagtgcaatttta

SEQ ID NO: 51474 - DNA, 939 bp, Bovine  19866882033160
cagggagaaataaaggaatgagtaacaaaactgagattagaaaccaggaatttatagagacccccccatctgcattctttgccaagagctccagagcagaatatatagatgatgggattcatcctggctggaggactggtctgtgagtctatgatttagactcagtgctcagatgtgctgcctgtggcataaacagttcccatttcattttattttatttattttttttgctttttcttttcctctcagcaggatggccagagtaatgaaagcccttatttccagagcccttcccccaagcattcccagaagcagatcctctccccagcaccctttagaagcccttctactgggataaaaatgaagaaatcttttcttcctgaaatgacagaagagaagctatctcctgcttcatcacacaatcttgcctttgatcgtcgaagccacagtggaatttatagccatcatctcaaatgttacttgctctttcctcttgggatagaaggaagcaaagtgattgctaaatattgctttttccatgagttatcaaaaagaacacacacaacttttttttttaaaaataccatttattggagtttttaaaaaatttttatcattcccaaggctgttcccatgatcttagaaacaaaagctcatcccctaaagacatgtacattgaaggggaaatatcctttattacacagacactggtgtaatcaagttgctagtaaagatatggcagaggcgggtctgccaaggggattgaggttcttgaatttttttagggaaaaaaagactaactccttttatccagcacagagctgagtgaaggctcctctgtcctgtcccacctctgccttggtgaacccactctcaaggtgtgcaggatggaaggagaggcttttaacctttcaagaactgccattgtcatttttccaa

SEQ ID NO: 51475 - DNA, 2922 bp, Bovine  19866880488025
tctaggcagattctttaccatctgagccagcggggaagcccgatgtaaaacaaggtgagatacaaatattgaaaagaagatggccctctgcagaggcaaaaaggggccaacaaattgaacatgtcatttatcaaggaagaaataaacatataaaaattaatcttatttgcaaaaaacaggataatatttttcatctgttaaattggcaaaaatgctagaaatgatcatcaccgttgttgagaaatgtctggtatgtgtaaagagttgcatacacagctattaggaataaaacttggcaaaatgtttctgaaaggcattttaaaattacatcagaaccttaaaagtgttcatattcattgctgccttagttctacttctaggaatttactataggcaaagtgtcttcctttgcattgctaatccctttgagaatctgattaaagtgatgactcctctcttggaaaaatgcaaatgtacaatcaagtttgcatttaattcctcaggtcatgtggtgaatgccaaactccagcaaagttgcactaccgtctatgacaatattaatttgtgtaacatgtaaaaaggacttttcctgttggctcagtcataaagaatttgcctgcaattcaggagaccagggttcaattcctgggtcaggaagatcccctggagaaggaaatggctattccctccagtattcttgcctggagaaccccatggacagagaagcctggcgggctacagtccatgggatcccagaagagtcagacaagacttagcgcctagaacaacagcaacaccaaaatactgttactttagaaaattataaagaaatccataaaacaaaatctgtgagaattcatgttaaagtatatttcatgtagaaaattaaaagatttacatttataaaagttaaaatgtagcatagcacaaattatccttttaacttatgtcatcagctgctgctgcttctgatcttccctttgactccacagaactggtgggatttcagccccttcctgccctggttagcacccctgagtagaactttcaggatcagtcattgagttgcttctctcttctggctaaggccttggagttgcaagttttgttttgtctcctcttttctggagaaggaaatggcaacccacttcagtactcttgcctggaacatctcatggacagaggagcctgggaggctgcagtccatggtgtcgcaaatagttgaatatgactgagcaacttcactttcacttttcctttctaccaaagatgaaaatgtgtaactcagatagggactttaaccccttgaccagaactcaaaacccatagttttccaactgagaccacaaacctggtttcaggatttgatgaagctcaggttcttgatgtctcatcacagaaagaattcagtgagagacaaagtgataggtaagaagtggatttatttagagagaaacataattcacagacagcatgggccatcttggaaggagagagtgccatcaaaatatggtgtggtcagcttttatggactgagtaatttcataggctaatgagtgggaggattagtccaactattttggagaaagggtggagatttctaggaactgggtcaccatccactttttggtcgttggtggtcagccttgaagtagtcatggcgcctgtgattgtgtcatttagcttgctgatgtgttacaatgagtgtatactgaggatcaagatctagtggaagttggcttgtccaccatctcagacctgtgtatgtgctcagtagcttagtcgtgtccaactctttgcagccccagggactatagcccgccagattcctctatctatgagattttccaggcaagaatactggagtgggttgccattccctactccaggggatcttcctgacccagggacctaatgcgagtctcttgcacttcttgcattgacaggcagattctttaccactgagtcacctggaaagcccattttggacctgtttggttctaatcagtttatggcatgtccttataaagtttgtgcccttccctcttccttcctacttcaagaggtatttatgggggagaataaacacatgccagcctaagatgaatctgattcctctttgcaactgagagacctgtccccttaagcaagtgcctgccatcagggccaagaaagagttggcaagaccacatgagtaggaactgagcttggtggtaaagagggttgggatatgttcatagtgctattccaaagagaccctttggtcaggagactctccacgacttatatccattagggagatgtttcaatgagatacaataattggaagtaattgaggaacattcagggctgtctctaaagagaagggataatgagtagcagaattgtagggtgtgagcaagaaagagagaacagatagatggtggtcaattggtgaatcctaactttatttactggggtcctcaagagaaattgaaccagtagaatgtgtttgtgtgtgtatgtgtgtggatagatagatctagatctagatcacatgatctatttacccaacccttggagagagactatttatctattacaatccagattgtttcttcagaacttgtcatggcatgaaagatttggaccaccagctaagaatccatagggagcatggagagggattataggttaggctgtgatgacactgaagactgctgtgctcatcccagcatccaccagagtcagtcacagtggtcttctctcaggacccagctggcctttggaatgtagcaggtatagattaatgaatagactcatctatataaaggtcttccttgacttacaatgcagttgtgttcatgctaaatctcccagttgtgtctgactctttgaccctacagactgtagcctaccaggttcttctctccatggaatttg

SEQ ID NO: 51476 - DNA, 1253 bp, Bovine  19866880670461
aggtttgctttgaagtctttctagcattttcattatcccccagggctctgaaatatcttgtgtttcttgaagctgcactgaattctggaatccattacatattctttttctttttttaatttggcagaaagtcatttaataacaggtaggatgcaaaattaaagccatgtttgctaagtctgaaacaccagaaaaaagcaaaggtgtctagtcgagggaagctattttaattaaacatctttatcaaaatcatccaatttttatttccccttttaaatgtttccaaattatttctttcccatcgtttatatatatcttgttgggagcaatgtggctgaggtcaaatgagtgatgtgatttctgggaaagaaatggagacataccgcatgaaatttacacttggtgaccttggaatgaaaattaggagaaggtcccaaagctgatatcttcaagagaaactgtttgttttgatgtgctgtttccatagcatatgtgtggcttgaccttgtagctgaaaacaccttagatcttatgttattcttcattcagtaagagaatagcatcaagccacaaatatcacttaattataagggaaaatctttatattactcttcccctaaggtttctgtcttttcagaagttcaagcacatgttcagaacatgaagatattctactccatgagttgtgttaacactgttgttgttcagtcgccaagtcgtgtctaattctttgagaccccagggactgcagcacgccaggctcttctgttctgcactatctctcaaagtttgctcaaatttatgtccattgagtcgatgatgctatctaaccatcccatcctctgctgcccctgtctccttttgccttcaatctttctcagcatcaggatcttttccaatgagttggcttttcttatcaggtgaccaaagcactggagggtcagcttcagcatcagtccttccagggaacattcagggttgaattcctttaggattgacttgtttgatcttcttgtagtccaatggactctcaagatcttccccagcttcacaattcaaaagcattgatcctttggggctcagcattctttattgtccatctgtcacatccatacatgactactggaaaaaccatatcttttaccataggacctttgtcagcaaagcgatgtctttgctttttaagatgctgtctgggcttcccaggtagcgctagtgggaagaacccaccgacaagtaggagatataagaga

SEQ ID NO: 51477 - DNA, 1088 bp, Bovine  19866880765070
cacagtcacagtgtaatcattagttaataagtcaaatactgaaaccctacagaatgcagtcaaaccactatggatgagctaggtaaagaacccatctattctgcaaatacaatgaaaataacattattcttctttcacagaatcctgaattttctgtattttagatagtgctgatcttagcatatttctattccaaaaacctgtgttgtgatctattgcacaagaacaaaatactcccaagtctaaacacctcatcattgagaaagtctcgtctactttctgcaaagacatcttgatccacaaatgtcaagtttgccctagctaatgaacttcttggttataataactgcctgctaactgtcaataaatttcagagcttggccaaagcaagatgagcttgcgtttcattggatgcctttaacatccacatgagtgatgatgatttcttttcttatctcccccacgatacagtaaggaggagcagtgtcactggattggtccagaaatgaagaaaatgaaatggtaattctgattttccacccctttgttaagaacatcactcagcctgatgggtctagactttctcatctgctacatggaccccaagaaggcactggtctgaatctaagtatctgacaccagcctatcactttttcctcctgaaacagcagcaaatatcaatgaatgatcctggcatggtctcctgcaaagccaagaagcagcctcaaggtctttaccactgttctccaggtcctttgtctccaaagtacaccctgggaagtgtgaattgaatcccccaggttagggatgttatgttagaatttctatttagagttattttatcttcaaaaatgttaaataaactcaccacagctcgtgtttaatatacaaatggaccctagcacctctggccagtgcatatctcagatgaccagtgtcacatgaaaaactcaaagtctccaaaggagactaccacggaaaaggagttgacgagccatctcgctgttatgatcactcagaatattactgtttacatttgctcttctcaaggatttatgggtttcataaccggttttaacaaagcccag

SEQ ID NO: 51478 - DNA, 1228 bp, Bovine  19866880892557
atgtccttgaaaagagatatatatatattgaaaaattatctcctaaaactctgtctaaaacaaaaggtgatgaaaactaagaagcaaaatggaaaagttaagctctaagcgtaagtaaaaataattcaactatatatgctatattatgattgtaactacataaaattattcattttcatggaaaatgtagaggaaaatgaaaaaaaaaatttattcaaccttcttcaaaacaaaataagcaaaagaaaaactacttggttgctgagattccctggataatgtagaaaagcaggatgttaaatgcctagatttgacctttattcaggacaggagtgaagtgtcattctgcagcccctttgtaacaaggacactattcttatactatttaggtaactgtcatattcagcaaatttttctattactttgaggtcagttaagaaacaaacgtttggtccagaatttttatttaataccagacaggttttccatggtcaccagctataatataacaatggtaattaacatgtatggcttgtgtctggtactattctaattcaatttcttcaatccccacacattctaaggaggtaaatagaactgctgtcatctccttgttacaaatgtgcaacttgcaactcaggcctggttatattattgcccacataggtagtggcagaactaaattcaaaacccaggcagactagtgccagggtccatggtcaaaaccaagaatcagtgaacttttattgtaaaaggcccatgtatgtatttcagactttgcaggccacatggtctctgttgcaaccactccactctgcagttttagcagaaaaacagccatagacaatatgcaaaaatgagtgtggctgtgtgccaataaaactttatttgtagacatggcatttgaatttcatgtaattttcttatgtcatgaaatattcctctcgattttttccccattatttttaaaatgttaaaaaccgtttgtgcaggcagtgggctggatttggtttgagggtcataattcgccaaccccggctctgtactgtgactgctaccctttgaagtctgtggaggaggggagaaaaggaagggcctccaggagaagaggcagggaacaagggaggcaccaatgtggcacttacccaccagaaatctgtcgcataaggatttgggagaagcttctagaagaaaagtcattaggagaggagaactccaagtagtgaag

SEQ ID NO: 51479 - DNA, 1063 bp, Bovine  19866880940946
cctggtgttgctgcagtccatgggggtcacaaagagtcgaacaagactgaacaactgaactgaattaaggttattcatgggaaagaaaaaaacctgttatttttatttccatgtagaaatcctcaggctttccaggtgggactactggtaaagaacctgcctgccaatgagggagatgtaagagaagcagatctgatctccaggtcaggaagattccctggaggatagcatggcaacccactccagcattcttgcctggagaatcccatggacagaggagcctggcgggatacagtccataggatagcacagagtcagacacaactgaagtgatttagcatacatgcagcacacatgttgacacatttacactactatatgtaaaacagatagctagtgggaagctgctgtagaacacagggagctcagcttggtgatggcctagatggataggatgggagcggaaggcaggaggttccagaaggaggggatatatgtatacatatatctgattcacttcaatgtaaagcagacactaacacaacattataaagcaattatactccaatttaaaaaaacaaaacaaaacaagactggagtaataactcaagtgtatcaggcaggggccaagatcagtgaactcaggcaaaccaccttccctgttagcaaggattccttctcacactggtcaccatccaaaaggcatttccagaccccactactgcttagagatcacactagatatcacctgccacctgtaagggtcatggcaggtccttggcaactccatgcatggtggccctgctccccacgatgtccattagactccatgctctcactttctccatccttgggagatttcaatttgtgattttcttagagaacacgtggcctatcacttaacactgtccctgaaagataacttttccatgattgctcactgctgacattttattatttaatactaaaatcccatcagagctccctagcctgataagctaaaaatgaagtctgaaaataaagcacctggcaaatctgatttgcagtcatatccaaatggcat

SEQ ID NO: 51480 - DNA, 769 bp, Bovine  19866881165025
ctaaatttgtctttctgttctcctaaagagaaagtccttaaggtggtttttactctcttaaatggattctcttaaaaatgaaaagccacattttatatgtaattgctgtgggccttttacgtctgatggctttgtaattgcttttcctagatattcctcgctcttcctctttatcttacataactgtctgctttctgagaaccagaacaaatgtggtctcaattaagttttccacaaacatcagccaaaacctcttctctggttctaatatcattccttgtcctcctccgcccagctgagacttgggcttttctttgaagcccagcacaaaacccaactctcccaggaggttttcctggcctgctgcaccctcgtaataatcctttctttggaatctctgccattctagagcctgggctacacacactgaccccgtgttgacagcctgggccagtccctccaacctcacgttacactggaatcgttcagtaaaatgtttgcagaaaaaaaaagaaacgacctcaagttgttcctgcatcatcctaggtatgccctcctggtcgcttcaattaaaagatacatttttgagagtccaagctcttctttatccttgcttccctttgctgctcatcaaggcacttagatgaactaccccatctcccttcagcttgattcagcaataattcacttatacctctatcattaaaaagggaataaccaatcatctttttcatgtttcctcaccataactccccaaacttaaaacatc

SEQ ID NO: 51481 - DNA, 1147 bp, Bovine  19866881356487
gatctgacactcttaatgatgcagacactctggcgggccccttggctccatggcctctccacattttcgcatgccacgaatatcctcaaatacttaaactgggactgggcaaagcctattcacacgcattacagacgtctgtgtctgggcattggtttatgccattgaatgacacagaggggaaaacttttcattttttttttctctgtttgtttatttctctctgaatgattcattcttaataagtttcttgcccaaagcctgtttctgcaaccatgggaaagattccagcatttatttccaatgggttgtgactcctcctgaagaatcttctcgtcttcttccaagtccctttgtcgcagcacctcgggaagttatcttgaaaaatgtctgtctaccattctggacgtttagggaacaatttcgtgactctgtgtttctcatctgctttgcgactctggaagcttgcgactcctgagaacgaggctcagaagggacttattcatggagaaaacattcacctctttcatagatggccaagatgacagggtactcattcacagacccgccatcggtgcttagctatgtcagtggtagaagcctcgaggcagccttgcacattgagtcctgtgttctcgctcacaaggaggacgtgcctggagaggggtgtgcaaacaagtctcccacacgaggaagactggggcaagaagggatctctctatatgtatatttagagtaaatccctgctggagtgttgacataagaggatacctggctaaaaccccatatttcagggtttctatttattgagacacatgttctctgtggtcccataagcaaagagggtgcggctgcatgcagagcatcactaaatctttggtattttgagagaattaatttttaaaatactttttatttatttcccttgaaaagcagagccataaggcacagttctgttaaactaaatataaaaaattaaagaaaaaatcactttaaagcctgaatttttttttttttttccactgacttatagtcaacagtatgggtgaatgccagacactggggaacttaataggagaattaggaaatctgcaggcaggtagtaaataattggcatattaggggaaagggctcagagacagaattc

SEQ ID NO: 51482 - DNA, 874 bp, Bovine  19866881448841
atctgctgctatccgtttctgcttctggtattcaggacatttgccttcccttgtctctctgaggttagttttggctataagacttgctctggccaataaaactgagcaaaagtgatgtgtgtctgtctttagctgaagcactgaagaacgcatgtgttgttccccatgctctcttgcccattactgagacctgtgaaattctatgtgcaggagcctccagcagctggggcttcagactacaggtgtcatgaatcagagccctccaccagtggctatgtgctgtaagaaagaaaactgcacagttttggtcactgacacttgaggaatgtttgtcatcagagtataatgtcccatcctgactaatgcaggcagggaaaaaaaaaaaaaaaagcagctttcatttttggtccagtccttcctccacacacttaaacattctctatcaattattgaggcaagtgacaaagcaaatcaaactggatctgaccttcttctgcctcttggaactcgaagaaacaccaaaggaaaaactgcctagaatactgaaacatataagcagctcttccttgccttctcccctcataccctaaaaacagaccttggagcctcatctccatgaaaatgaaggatgagaacagacaattcagctgaaatcatcccatttcttaaatacttaagtatgggccattgagcatttaccatccttgctatgacaccccaagctcacttccccatgtgcaccgtatgcctgtgggaggctggtcttcagacgggcagctggtggaccgctagaggctttctccattgaagtatgtggagcaagcatattggagcaaaatgtgaacccttctgtctctcagcaacaaagttactg

SEQ ID NO: 51483 - DNA, 3036 bp, Bovine  19866881449171
gaaaagtttttaaagtaatgcttcatttcgaatttactagaaatagtattgttgaagtttctgaaagctttcacatctaaccttcttatactaacctttctttcttcaccctgagattgcttttacttctgcaaaaagaatttgaggaggcagaaaagaagtgagaaggtcaaggcagaaaggaacttctggaacattttatttgatgtcatttatgcacatctcctcattgaattgtcctgacaacccttcgaggtaggtattcctagccctggtagtgatttaaatttaatcgatattactatttcagccaaagaaatcccttgtagaccagacagacacactcaaacgacgagtgcgcaactttttaaggtgtgagtgcagaaatgcacatcgatagactgctttcttcactgaagttttcggtttttttaatgtagatcatttttttagtctttagtaaatttgttataatattgtttctgttttgtgtcttggctttttgactccgaggcatgcgggatcttagcgtccccatcaaggatcacaccctcacccccttgcgttggaaggcgaagtcttaaccactggaccactagggaagtccctcaagtcttactatgaaaaaaaggtcctatgaactgaacggtgtgctgagagatgtgatctatttacaatctccttacctcacccagaattgaacaagcggttcccagaagagcaggctttgctgcagtgacactctgaggagcacactgaagaagcaggatgctatgaatcagagcacagcttctggcattaaggtccctatatgtgtatgtgtataatatgtatgtgtgtatatacatattatatgtatgtataggcttcctaggtagctcaggggtaaagaatccccctgccaagcaggagagagaaaagtgaatgtgttagttggctcagtcacgtccaactctttgagaccccatggtctgtccatgggattctgcaatgcctggagaatcccatggacagaggagcctggcaggctacatacagtccatgcggttgcaaagagttggacatgactgagcacgcaaaaaaaggtggggggtggggtgaggaacagatggagcttgctgacctcaacattcctaaattgcacataattatttagaaaagtgaattccccatccaaggtaaaaaaaaaaaaaaaaaaaaaagccaagtaagaaaaaaagatataaggccttgcctgggccaaatgtcccatcagtgttacaagacttggctgacacgtgacacagggctatcatagtgatgagcgacccggtgaggaggactcactgtatttcacacactgtgttctagctggaggtgacattgttatatgcatgatttttgcaaaaaaatgctacattgaaatgtcaaatttccatcctatttctgcttttttgaaatcttttttttttaaatctctatttctgctttttctaaatctctgtttcacaccacaagccttgagtttattttaaccaaaatagaagcaaacaacttgaaaaacaagctctcaatatttttcacatcttttattttgtcgtcaaaaaaggtcagtgttttacatattccattcttttacttcagacactggtaatgcggctccaacattccatttctagaattagctgcaatttacatgtgatctgtcttgcttgaaatgcaggctggctgtgtacttttctttgattcaaataacagcaatttgtttcccttaaaaagcatatttctctttttcaatgttttctttcattacactggacaaaatactggttaaggggaatgtttcaaagtgtggtttgaggacactctgtccaggcctgatgtcttcgcaaatagactctgctttctctgaggaggtcccctgtgtggttttgcatcccgagttcccagaaggaagcagtggggctcagagagtcacaaaggtaagatgctcatactgacacgtgaaaaagggatcactaagacctccaaatgaagtcttggtgatgcttctttaagggacatcctgacaggtttctggcaaacatttgcaagcttttgttgtcacctcaactacattaccacaattccatgtcaccaggtactctgcgtcacccctcctgttgtgcccaaaataaaagggttcacgttccccttgattcactggaaaactggaaggggtagaatacaggaagagaatttagagaatgcatcttcctcattctgaatacaaatatttggggagatacgtcttcaaccaactcaaacaaggatctgaggcttcctggagggttaaacaagtgttggggtgacagagatcctgggccaatggccttggggtggacttaaccctcagatctcaatggcctcatcaataaaaatgagaggagagaatgaaattgcttcccaatatttctctccaaaggtcatttttatttgcctgtctccagaggaatatttatttgaaaaatattcttgcaccaaaacaactgcctataaaatagcagctctattgtcctttcatatctttattcaaatacttatatacaacccagttggccttccaaagccacaggttccacattggcaggttggttggatccatggatgcgaaactgtcagatacagagggccaactgtaccatgtcattttgctctctaagggactctaacatcctccaattttgttatccacacacggtcctggaaccagtcccctgaagataccttaggacagacagttgtaactgctcactggggcttgcaatcagcaaacatgagcaaggttagccaagcaaactgataaatgcttgtccaaagcaaataagcttatttcagttggcctgcatgatcttatcataaaaaatgacatggtttctatgttctcagaaaaaaagtgaaatcagcttaggaactcctttcactatgcaggcagactctgaagctgggagactttgggacagcagattctcatgttttaccaccaatgatgactactgcagttctggattcctctat

SEQ ID NO: 51484 - DNA, 712 bp, Bovine  19866881603082
aacatttatactgcaagcccacacacacacacaccatcacataaacacactatacatacacatatatatatatcagtctatgtgtatgtatatgaatcattatataatcttgattcacttttcatttcctaaactttgcctggcaataactgactttcatctaccaattaaaatctactccaaattcatgtcttcaacagattaatatgtttttcgaaaaagaacatgtaatctggtaacaggatgggggtggtggtggtagtggtggaaagattttgttcaatgacaggttaaaacaaatcattattttctcaaactattttaccagaaataaattatattcaatccttaaaagatacactttctttgtgctatatcaggaaaatttagagttacaagatcagcaattgcaagcccaggattttgtaaggtaaatgccaccatttcgcatcccaaagtcaattcacagtggcgatttaagagatgcaaaaggcctggcaagagtatttatttcctccaagaatcctctgcaagcaaactgtgcattcagcaattctgcaggccactgtttcaccatgcgacaggcccacttattcacaaacaaatcattaacattcttgacagtaaatccatactggaccattaatcccagctatgataatgttttagtacatttgctctgcccatcatgaatggcagtgttgtttcccag

SEQ ID NO: 51485 - DNA, 777 bp, Bovine  19866880420776
tgtatttttaatgtagggtgttaattaagagagaacatagaggggaaaattacataatttccaaagctctcttcaggttccagcctttctccaactccctccacctcttcaagaaatcttagaaatctacctttgtgactgtcctacttcagctttaagaatttgatctcagaatttgaatgaaagggattacaaactataaatgagtttattagatcatttagtgaataggatatcagagagaaaaaaagaaagagggagggagggagggcagaaggaagggaaacagggaaaggattgagtagacccagcagagaaaataatctcaaaccgctctcagttgttcttatgctaaacaaactaattctaccaacttaagcaagtatgttaccataaagcatactgaggattccttaccctgtcatctgcgcattcaagtaggtcaccatggcagcattccttgtggacttttgtgagatctgtcactagcttggtaacttctacaaactcagccttgggaaatttctggctcaggcgagctactgacctaaaaagaaaattctcccatcaaaatattattaacagacaacgttttatgtgaaagcattaggaaaatactacacataactagaaaatttaggctcaaataacacacagaaataatttgtaagacatattagctcttattttaatgataattctgaaccaaatgttagagcaaaatgtttccttagggcagtacatatgggaggttaaaagtccagcaattcataaaaa

SEQ ID NO: 51486 - DNA, 1183 bp, Bovine  19866880496926
taaataaaataaaacaaacagtttaaaaattagcaatgttctaataaggagaaaggtatggttcttaaaaatacacttaatataaaaattaagagaatcttagatattcatgtgttagaaatgctctatattttcagctacagatagagagatcagataagttatctaaaccagaatatttctgagatttatagggagctctactaatgacagaaggcacaggcatatacccacacttctctggacaaactgagatatacgatctcccagtcacgagtacaacaaacacactattgctgctattttttttttttaatcaaagaagcaactgcttaaaagaaaataaatttcagcagcagcagaaaatgtaaaggctgacttttggagtaaatgtcacaggataaatgaagaatataaattcaagacaaacttacctcttcacaaatacctgcacaaccttctgcacccacttttccttggggtttaagcagacctcgtttccattggtaagcttaacactgaaatgagagagatatgattaaaatcaatatttcatgggcttcaaacaccaccttgccattcaagtcatggttccttgagtacaggcataaaatggaagtccaaactaatttttagctattagagtcccatattaaatgccatggagacaaagaatttttcctttctatttttctcactatgtactcctagtacctagaactttgctggattcttccacgtctcaattctaggctgactaaagtaaaataatcacttttgaaattacttacatgatttctgaattttcacagtgtggcccactctcaataactctcaattctttgataaatttggggtggaaaggtgtggaatgtgtttttatgcattggcatcgaagttctgtactcattcttgacagaactgcagctgtggaaaaaaattaagaatttatttcatccataagcacagcttggctagcttcatgcttattaattccagtgtgatcatgcttattaattccagtgtgatcatttggtgagtatctgtttggtaaacatcacatcttcagcaaatttatccctgaaatcgatggctggatattctcccaggctctgacttcaatttttctctttgttttaaaaagaatcattcctaacaacattgaatggtgtaaaggcttcga

SEQ ID NO: 51487 - DNA, 936 bp, Bovine  19866880571943
gagagaaggaaaaatctacgtgagttgggtggcccatttgggggtcggggtgggggcatcggcacggtgggtggtgatgacgaggacagcaacggaagtgacacttacatgacttcggtttggtcgcagtgggggccgggggttgtcaccttcacgctctggatgttcttgaggtgaatcccctgcaaggtctgcaggcactggcagcgcagttcgttgaccacgggcgcccctgcgggaaggacagagtgggttaggggctgtcctcacaggcacccacccacccccgtcccgccctggggatccgggtctcacctgctgcgcgccggccggcggccaccaggagcaggagcagcattgctgcgcggaggagccggggggcggagctcgcggctggagccatgggtgtctgctcggagggtctgtgtctgcggcggcgggaaggctggcgggagcgctggctgagcgggctctgtggctccccgaaccgagtgaaccccttttatcctgatcagaagggcgttgctagccccggggtcagggaaattcccggtccggaaggaagggggccccgcccgcctcacgcgtagtcagcgcactgaggtgtcatccctgtacccaaatccccacgcgacggtgagtctccctccaccacgctggggctccagcccagatgggggctgtgcgtctcaggccaccctggtcgcggggcagggagaggggaaagctctgggaacactggggagagacccccacagggttggggaggtggtcttagagacttcgttttctttacttcagactgggggaattaaagagaagtaagcatgtagatattgtttagttatctatcctctgcttctatatatttctgcctctctatattcaattttgcttatttcatacatgagaactgggatcagtgtcaaaagctga

SEQ ID NO: 51488 - DNA, 1202 bp, Bovine  19866880573909
ctgctaagaacatatacatagaagttaagaatccaccaggcttccctttttcttaaattcttactctgctttcaaactaatgtatccttatactaattaagagacaagtaaaaggaagtatatgcttagtaaaataattcagacaaagacaaatgctgtatgataccacttatatatggactctaaaaagtaatataaatgaatctatgtacaaaacagaaacagactcacagacaaaaacaaatgtatggttaccaaaggggagagaaggagcaagggagggacagattttaaagagtatgagattaatgaaggctgattactgtacataaaagagataagcaacagaacttactgcatagcactggggattatacctaatatcttataataacatataatggaatacactctacagaaaacaaaacaaacctgaaacagtactctgtacacctgaaacaagcacaatattgtaaatcatctaaacttccatttttttttaagtgtataatatgatgcagtagttctcaaactttttggtcggtctcaggaccccttcacatttttaaaaattagcaagtatctcaaagagtttataggtagagttatatctgtcagtatttactgagacatttaaaaaattatgtattaatttttaatgaaaatagcagaatcattatatgttaacaaaataaaatttttcagaaaagtaattgttttccaaaacaaaataatgcaaaagtaatattgttttatatttttgcaacttctacttaatagaggaaagttaggttctcatatctgcttctaaattcattcctgttgcagttcattgttctggttgaagtacataaagaaaatctgttggccctacacagacataattgcaaaaggtagtttcttaatgcttaattacaatatacagtctaaaactatgtcagtgaacttttcatattcttttatattcaaatctatcagtctctcttacactttgaatggctcttttacccatatgtgattttctgatgttgtaattggtcatttaaaaaatatcagtgcattgaattattcagatctttcaactacgaaacatttagttatatatatcaaaaaatcacactcattaatatcaccactgatctcatgcagaaattctttaagtattgagaagctgccaagctcacactggcagatacaatttt

SEQ ID NO: 51489 - DNA, 3475 bp, Bovine  19866880600060
ctaggaagtacagtgtgcagtaagcttgtccctgtctcccaggtatgattcacttatatggtttaggacttgtccaagatagaagataaaatgtaatttttaccctggttagttactcactagtgtttccttccaatttacaaggagacaaaatcagaagagagaccctagaaatgggcaatttttcaaaggtctcaagtaataatacatttagatcagtcagcaggtggtgaatgggttgaaacaacagtgaaagtgacaagagaacggctgataagtggtaagaaaaaaaactcttttgctataatttaagtaaagatctacaatttcgggtaactccctgtccttttaataagtgtaatacctacctgtgttaaatggaatgaatatatgtaatagtaaatggaataaatggaatgcccacctttgtttgaaagcagttagctttttcttgttcttcacagcatgttttagtcatctcctcaaaacgagcagcaacagttagaagtgtaggagcaaaaacgaaggggttccttctggaaacttcataaacataacttcaaaaggaaggaaggagggaagggggaaaaacaggaaagaagtgaaggaatggtaggcaagggaagggaaagagaagattaaaaaagacagatcaagttgtgaaagttaagttgagaggaagaaggatttcccattactgaaggcttcaaaggaaggcaacattactgagtctccaaaaatgtcataccactgaagttgccaactcccaaataaaaatgatgattgcagttctaatcatgaatgcaagaccctggctattctcttttcttccccatgacgccagatggtccgcagctctccttgtcatgctcaaagaacagctacctatacagactccatctgagattcagagatcataatcacttacatgtaaaaagaaaactttgtgatttaagctttccagaaaaagtctctgcttctgaaactattgcactgctaaacatccattgactgaatatttatctttggtaaaagctgcaccttcccttttgaaagaccatatatttcctgcagtactgcttttgtaccatgcacacacttgggttctggggcttatcccattagaaaatgcacatcattattgaaaggaccttgaaagcaggtttcatatcttgttcatcttctcaacaatgaccacagaatctgacacacaaatgcatgttgaataaactaattgatccgtaaacccagctatgttcatttggaatagatactggatttagcctaagaataattcttcaattagattatttttctactaaaattcaacttacttattcaaaaaagattccctgttatttttgtaagtctggcatttctcctcaggatccagagtagggagaggaggcaaaagtcctatatcagctttcttattatggaagaaacagagtcttctttcaaagtcgaccttatggcagcagtgtgaaaagttatatttttgtggcagtccctccatggcacatatattttccagtaaaacctcattctggacaacagaaaaggaaaagacacattttattcattgcaacatttttcaggcttctgagatgacacagtggaaacaatgagtgctgagtgtcactctttgagaaagagattccaggatgttcccaatattaccagcagagcatctctacccacagccttgacaaccatcctacgctttgggaaactctatcctatcctgagtccccttaacctcttcctatctctcttctgcctacacctcctttacatagtggcttttttttttttttttcccctctctctaggtaacagggtcagagtgtaaagggttggttaagtatttagcggtaatgtttagtaatagctttctagagatgcaggtggttactctattgggaggatgccaagaaaaggggggtgtgacagtagagtacatattgagaggcaggtaaagaaagtaactttacttctgtgcactttgccaagctatcggtttagtcttcctgcctgtatacttatggcatggactgcaagctcatagtcaagccctcctgtgcatcagtacacagaattgcatctctcctaagaaagggccttatcctaaatactgaagtcaggcaaagtaacaacaagagcatagagcatccctctatattttcaagccaaaaattctctcagtgttgacaaataagcttgtttgtttaagaaatgcaaacaatgtacttacagctaattttgaacattctgggagtgtcctgtcagccaagcatttatctctgtattctgtcatggctttaaccaacatttctacttcttcaaaggatgcctcctgaatatattgagcaaatgcaatgatggtgctgcaatagtccacacagagtacacaatgatgacctgcagaatttccagttatgtccaaccaaaatctcataggaacacccacttgctgactaaccttagaaaattatcaaaatgtgaagtctctaagttttataatttcttgacaattcaattgcctcatctgaatttttctttaatactgtattcactttttaatggcatatatttaattaatatattagcattaataattctagaatatatcagatatgcttatataagcaccatcatcatcaaaacaagtttagaggaactcacatatatccaatgttatcatctataaatttctgggtgattctgacatcatctgaaagcaaagatatttaagttattatatatcctggtattttaatattttaccaataaattactatatgtaatacattttaaaagtataaaataaaaaatgatatagaaaaaaatagcatatttaatatgaagaagagacatcatatgagccaaatattacatcttaatcacagttgattatgtgcttaaaaatattcattaaattgaattggcttgaattaatctcaaactcactagactttatatttactattgatggctccccagccacaaccatcaaacacaagcaccatttccatgctagataacaggtatgactagaaaagtagtatgaagtttcattgttaagtgatataatgctacagttgtgcccagcaagagatgccaggcatgctgatggtagtgtaaattatgatgcttctgctgctgctaagtcacttcagtcgtgtccgactctgtgcgaccccatagacggcagcccaccaggctcccctgtccctgggattctccaggcaagaacactggagtgggttgccatttccttctccaatgcatgaaagtgaaaagtgaaaagtgaaagtgaagttgctcagtcatgtccgactcttcgagaccccatggactgcagcctaccaggctcctctgtccatgggattttccaggcaagagtactggagtggggtgccatcgctttctccaaaattatgatactagccaaaattatgacacagatatttag

SEQ ID NO: 51490 - DNA, 1526 bp, Bovine  19866880628619
gcaagaagcaataatcttataaaataggcagaatagtaacagtatagctagtaataataaggccataaatatttacactaagaacttcccgtctgaccagtctgttcagcaccaaccactatctttaaaggaaatgatacattggcattgttcaccaaagttcaccaaagaggtctgagcatagaaggcgagtggtgggtcattgtgaccctttgtagaactgagaaagaaatgttatcttctaaaggagtttcatggctggtgccagaagaaaaatggaaatttgtggctgagcaggtatttttgccatcggggaggtctggttaatgcataagccagacgaataatgcacactagagaggaggtaggagactgaaatgggcagagaaaaaaattgatgttaagtttttcttgtcttgccttaacataggaattttatttcgttagttcagagcgttaatgagaatgacactattataggagtttgttagtgaaaggaaaaaaaggattacccagtggggttttagtacctatatcattttttacattaaaaaagttctaaagctaatataatatgttaatattgcttaatttcagaagtggttagatagttaattgttaaacattttttttttttactttcatttttaaaggttttattattgaatgtgtgaaggcttaatatgcttatggaatttctttctcttagtggggaaaaagaagggaatttaagtaattctttcatcaaaaatccctttgagcttttatttgtcaaacttccttcttcctcgttatgggatttagttaacctcaaaccatatttacttctgtggtttcattctgaaaatgaaaatttggctggtttagaaaaaaaccttccattaacctagattctaagctagagattctcagaggaaattattttctctggcagagctgaagagaaaagccaaaacatttttatgctaacacagcttctggtgaaatgccatacaggtcaccaagtttgtgatccttcatgtcatccccaatgttggccttgaaactagccctgtcccacccatcgcttggaccagagtggaaacattctgagagtgtgcgtgatgctctcctgtgattaataattattttcacatactgcttttacttgtccccaagttcttcaaaattgcttttacacttttactctgagtggctatctcattgtttataagacaaaggaagtcagccaggttgctatttctgatggtacagtgcatgctaacaaaagttttttggcttatacaataaatttatattttagaaaatggaaattttcttagaggtataagtgtgtctaagtgtgcacttgggatggaaaaccaaggctttttttccatctgtaaaatcttatgatcagtacaatgtctcgtacttttaatgagattgaatcaagtttcctccatatttatcatgggtagttacgttaaacaaacatgagaagtatgattttgcagacataaaaataatatctaacctgtattatt

SEQ ID NO: 51491 - DNA, 1208 bp, Bovine  19866880754236
cagtcctgtggccactgctgagttttccaaatttgctggcatattgagtgcagcactttcacagcatcatcctttaggatttgaaatagctccactggaattccatcacctccactagctttgttcgtagtgatgctttctaaggcccacttgacttcacattccaggatgtctggctctagtaaatgtgctgggagttggataaacattaaagttctaaggtccttattttttgactagaaatgtagagttaagaattgccaagttggacttcttaaaactgattgttgtttttattgtataatttctgggaagttttcaaccattcactttaaatgttgacgctttactctctcatcggcttgtaaaaatccaactggacatcaataagtctttatccctgattcttctatgtctttctttctacttttctaatttactacctctttatagctctttgtatctctttaaattccagataaagtctttgggtttatttctgatctccaattttctttgcagctgtgtctagtctgttataaaacttatccactgagttttattttgttagattgtggttttatttttaagagttttgtttgttttcaaatatgctcggtctttaattatattttaaatttctttgtctcatatgtatcagttttcctcaattagctgagaagtgctttataatgcgtgccctcttccctctttcattgagtgtcccgttgtgtcaagctgtacagacacctaggttatctgttgaaaatctgaagtcaccttcatttagtaaaatggtatacagtgggaagttgagaaaatttccatcattctatggaaaagactactgattgtaatctatctctggaaaggagttatgtttatctgcaaatatatttcccacataatatataaaatattaagggtaagtatttatgttttttaaattgaaacatgatttttaatatgaatgaataaagcaacaaatcttaaaattaccaaagaaaaatgaagacaaactcctgatgactctgacaatgaattttattttaaatgtcttatagttatattcatattttcatactatcaaaaccagtagaaagaactgtgaacatataaaagcatcttaaagtaaaaaataaagtttatgttcgaatacacaataatttaaagtatgagattctaattgttcagaataaataaataaa

SEQ ID NO: 51492 - DNA, 1145 bp, Bovine  19866880769715
acataattgattgctgttttaataagaataattgtgatgtgcttatatgtgtgtaatttatgtacttcctagagaatcagaactctgttggcctcccttgtcactacttgaacaaatactgaaagactcaacatttgacaagtaatactttggacacctgatgcaaagaactgactcatttgaaaagaccctgatgctgggcaagattgaaggcaggaaggagaaggggatgacagaggttggatggcatcactgactcaaaggacatgaatttgagtaagctccaggagttggtgatggacagggaagcctggcgtgctgcagtccatggggtcctaatcctgaatatgatggtattaggaggtcaagcctttggaaggtgaggagggctgatctatcatgaatgggattagtgtatacataagagaggctccacactgcttccttactccttttcattgtgtggtaacacagtgagaaggcaccatctatgaaccagaaaacaagatctcaccagacactgaatctttcaggacctggatcctaaccttcccaatgtccatagctgtaagcaataaatttatgttgtttatgagctacctaggaactttgttataacaggccaaagggactaacacaaacaggagcaacaccaacaaaacaaaattaaaaacagaaaactaggaatggactatatagtgacatttaccacaaaactttccataaaccttatcatgaataagcacttttatgcatttttgaaatattattttcataaaaattgggaattaggaaattgagcccagtgacataagaggtgttgcaatgccaaaccaaaagtcacaaaatcctagaaattctggctaatgatggactatgagtagcttactaacctgttggggttttaaagcatggcttcctctggagggtaaactgaccagaccattaataaaatgttttgctttgaatcattttggttaaaaaatttttttcagttttagtaaatcagacggaagtaattttctttggaacagaatgttccttgggaacaactttcatttttccctagtttaaatttgagaactaaactggtgaatgctatgaccaaggactatatcatagaaaagaaaaaataataggggtaa

SEQ ID NO: 51493 - DNA, 1607 bp, Bovine  19866880853382
ccttgaactccaaagtaaagtattctatgctcacattagctggggctaaagaaagaatggttgactaagtgttacaatggtcatcggatgcttactgaaaagttttaaagactagtttgtgatcagttcactttgggagctaagaaaggacttcaagggtcggttggtttatgaattttaaatactgtgataaaacagaacaagtgacaaccttgtgcttgctgacaacaagaatgtgtttattctcaaggcaacaaaaacttggcctcacttggaaagatgatattcttggactaataatatttagaccctgcaagagcaagtcttagaataaataacttagttagaagtaagctagcacttctgttgatcttgagggagaaagaactatgaggacgagtctcctttctcctgaggacaagatgcatgtgaggagagtgagaagggagggtgggcactaaaggggaacctgtcccactgtcaggaggtggactgatttcaattaattgcgtatttgtcattgctgttgctgtgtgtacaaaaagatccttacttttgcttttcagtttgtaattcctcctcttgagctttgcacaagtcctctttaaggttgatgacttggtcacaggataaaggtgaagaaatgtaagttccatcaacttgcaggtcatcaaagcaaggctttctgaaggcatacgagtcatcacagcagtgacccacagcagcattgatgggctctgcctcgtgccttctgcataaagctccaagaattaactttgccttccccagaaaagaattaaaataagagccataagttttgtggtcattaagattattttttttatccatagaaaactattctcaaattctggtttttgctaaactcaccctgaattttatcatctgggaaagagcaagagtgtcaggtgaagcctagttctcaactttgacctccaccttcctattatcttcaaggtgagttcccttggaccccatctctcaaattccttcccagaccagtttacagacaagtgttggcttgaggcaggagttctttatgctgcatcaagttaaaatcaagcctctggtcaacacaactgctaatttgatccagatataagactgatgattggatttcttacttaaaatgctcaaatccaatgtgtttctatgttttataactggacattggtaaccaccatcaaacttggtatatggaaaatcctgtataaacatttgttgaattattggaaaaaatgaataaatgaatggtgaaaggaatccctgaatcttctttcagttacctctttaattttcttgtcttcttctagaacagtcaccttgccttgctccccttgtggtgtctgatacttactctaatgctgactgcaagcctgctctatgcccctctgagtatgaccacacaaattccctgtcacttatgtatgtggggatgaagtggctgaaaccatagagcatcagcattcaatttacaagtttatacattttcacagtaaccaaagagatcacttaaaagcaaggttttaggaatataaaccacaagttccctaaggaaggcatgattgttaataaaaatttaaaataaa

SEQ ID NO: 51494 - DNA, 1307 bp, Bovine  19866880994864
aatcaattatgttctaatatatattaaataagaatgaatgatattgtaagttcacgcagaagtggatattctccttaaaaatgttacgaagataatggtgttcaaaaacagtatagtaaatgaccatcattaagtgcaatcttagaagtctaacttccacaaaggatctctgtagtatcaaaaaaatgaagctatttaaactagctgatcccctctaagattttcttttcttgctgagcccagaccaaatttctgaaaacttcccatttctgagaagcccaaagcttttgacaacatttaacattttaatgcttatcttttgtttatttcctgtgtagtcatctcttgtcaaaaaatttctggcaggccaggattgcaaggctgaacaaaaataactagctaccccgtatgcccaggagatggcaaggaaaagcccacctactgttacttggagccttgcttagtctagactcaatcaaaattcagtactaatttaccccaggagaaggcaatggcacccgactccagtattcttgcctggacactcccatggatggaggagcctgctaggcttcaatccatggggtcacgaagagtcagacatgaccgagcaacttcactttcatttttcactctcatgcattggaaaaggacatggcaacccactctagtgttcttgcctggagaatcccagggatggaggagcctggtaggctgcaatccgtggggtcacacagagttggacacgactgaagctacttagcacagcagcagcagcaagcagatttaattgtaaatgggtagcaggaaaattatatcatgaacaaaagtagggaaaacattcttgacatatagtaattctggggcaactttgaagccaagttaatccctaaatgatgctcctttttcattggtctgtcaagcctaatgtggaaggagacgaactgcattgatgttgccaagttaaccccaaagtaactggccttttccttttcttttgttacttgcatgcaaacaagtaactattttccacttcagctcttactgattgataaactgctatctttgatgtgcttaacttgataatgatatgtctacatcttttcttactgcaatatataccatttcttaaaggtaatacaaagaatagtagacattaaaaaaatagaaacttagaaaaatatgtgaaacggcctgtcacaaactaaatggcctaagtcatatactaaatcattaaaggcctctctgatttgttggaagaaatcaatttagaataatatccccatactgttaacattcaacacagt

SEQ ID NO: 51495 - DNA, 1024 bp, Bovine  19866881144663
taaaaataaattttgttttgcattagtcgaaaatttgctttgagatgatttctttattttcagaggactagattggaaacaaaggttaggtagattatctgttgaattatttgactaaattttacttccttacttttgtgacctaaattttatacacttaatgactttcattctaacattctcatctttatttttctacctaagctcatgtgagtattcaccttatcacctcctagacacaccgggaaatgttagacttgtattaccatcgattatggtctcctgtttgcatgatgctataggaagcctgcacacaatttgtagtttaaatgcaagtcctggtgcagacatgctcaattcagagatcagactcttactagctatgtgaccttgagcacattacttaactgcttagagttaagtatgtatcagatcactctcatgtatcagatcactttttggttctctgaaaacaccatttctgttttggctcagggtcttacaaacactgttctctctatctgtaacatctttcagcttctccccacctcctcgctcattcagctgcttaatttttacctgtttttcagctcttagtgtagaaatcacctcctgcaggaggctcttcctgagccttccaagtgttaatgagttaatgaagtgttctaatgcttatcattttattttcacactggtttgctagtgctaggaagtgaggaaaagggaaatcaactgacttgcccaaggttacaaagcctgttaagggcagagcgaaaacatcatgccaggagcatcctcttccttttctttcactacatctgccttggtggggccagctccaccctggttgcactcagattctatggtatgctgagacataaaatctccagaaagagtccctctttgtgtttctgggtgaggcgcatttcttccccatgacatggtaagtcatcaggtcgtccaagacatcctgactgctactaccttgccagctccaccagtttcccttcacggatcatcaggt

SEQ ID NO: 51496 - DNA, 1209 bp, Bovine  19866881165657
atttaaaatgtgtgaattatttctggaattttgccatttaattttttcatctctctcaggattttattttaaaataggaataaaattatgagtaaaaaatgtatggttatatgtttcttatagtttttatggtgcattactaatccccaagagagatgtatcagatttattggatcatggcagctgtttaccaaattttatctaaagggccgactattgattagagcaacttgtgagaaacattgttctaaatggtcaattagcagcacttttacccaaatcctcagttgagatttatgctaaatcacatgaaattgccaacactggaccatttctgaccaactggaaaggaatgatttcatatggttcaaataaaaacaatttagaacaattactcccaaacaggagggaattttgaaatcttaaattacagtaaagaataggatgattatctaatgaaaatatttcaaatattctcaaacgacgctttacctaacttactctagaaacaatataaagctgcttaaaggcatacatagtactcaacaaccaaaacaaagaaagtaaaaataagaaagcaaaattttaaactcatgatcttggattttttgtgcaaaggaaggccagattcaagagacagactcttgttagtttgtcacatatgtccttaaaattacaaaaatcttttttatttttcttctagacgtcaattttcactccagtctttggatcagaaactaaggtcagagtaaacagtaatatgagaactgaagaagtaataaagcaaattctccaaaaatttaaggtaatctttatcagtgaactgaactataaatatcttgtgtataatttaattgtaaacacataaatggatttttctgaaaaagacataaaagcatgtatatctaaattaaatattcagttccaaaaaattctttcctatgtatagttgactcttgaaaaacacctgtttgaacgccatgggtctatttaaatatggattttttgttaactttttattttgtattgggatatagccaagtaacaatgttgtgatagtttcaggtaaacagcaaagggactcagccatacatattcatatacatggatttttttcttcaatgcatatattactgtttacaatacatggttggttgaatccatgaatgcagtcctgacagtacaaaaggccaactcagggactagagt

SEQ ID NO: 51497 - DNA, 942 bp, Bovine  19866881205151
cctacctaaaagctaagaaagagccgaggcttctaggtagagaaaaatttcctctttgggtttgtttttaaaatttggtgatcactggtcctgacttacaggttagcctagggatcttccttcccctgacatgttggacagttcccacaaaacctagtctccttatctttcaaatatgtattcctctaatggctctgatgcaggaagaaaggtggtttaagagctgccccatcatctatagttggtactgtgaagaccagcagatatacgaagggtcaatatgaccttttgcttctctcagttcatagaacctcttatgtcacagtgtggcagccatgggaaggatgctcccactaatgctaccaacagacatgtatatctgagatggggagatgcaactcctctcttatgcctgagacatcatgtgagcccctgtaatacgcaatgttgaaaatcttaaacataagcatcaaggctataataagttaggtagacaattggcatgttagatcctattaaattataaaatctgctattccctagaaatgactgatgaatttacatcatccttcacccctaaaccattttcaggtgtgtttgtctccaggcagttaagttgccctcgttatatttgatttatcaggattcagaacagcacagtataaagataatgtgctgtggcagtgtgtttcatgctagccttttgtcttgttcttcctcaatgtctaggccaacagtttaccttgtataaggagtcaaaaagcaccagaatttatcattaagacagccttattcacttctttctttgtcccttcttatctcagcaagacctacctgaggtgctggtccacttagctctaaggctggtaccagacttcatcctggcccagtgcctgttggttgatggctctttcatgtaaactacagcggcccatgtcaaga

SEQ ID NO: 51498 - DNA, 1106 bp, Bovine  19866881277104
aaattgtttccccccccatttgaaaaatgttttcttcctgttcttcagaaggcatttgattgaatttaaaccagtatttgtaactagttgcttcccttttttattaaaaagtatctgaaatgttaacaataaattatattctactaatttcttttttaactgcttggtcttatgatttcttggctgtccttttcttggattcattttagttgttgaaggcataaattctctaaattcagaactgtttgtggtttttaaattttaaaagtacttgcatgtctaaaaattattttgttctacagtttagtttagtttagtttgttctacagtttagttctacaattttttaaaagttaattgtgcttcacttcttttcagattgtcttctagcatttagttttgtatttgagaagtaaattttaccaggttatgactctaggcggggtgtgtgtgtaatctgtgtgtgtgtgtgtgtgtgtgtgtaatctgtatgtgtgtgtatatttgcatgtacattttaatgccattttacaagaaattgttttattttgaggctctttttatgataattgatgaataatgatatataccagaagtaggctaaatttataactaaattattttgtactgttgttattggatttaaggaaatccttgaaataatatgtatctttaattctgttagcaagaaatctacttacaaactctagatatgaggattccatagaatttttacttattttaaccattaataatttgtccactttataaagtttatagtttccaaattttcacactaaactgttgtaatttcatagtgagctattggaggcagataagtactttgaagcataagaaaagaaatcatgttgtactattgggctttgtgtttctttataccactgattcttagcatattcccaggtcttgactgaaatttattagaaggatagataagtatgaatgaaagaatgtagatattaatcaatcataaatcaatgaatagacttttgaaagctaaatttattttagtcaaattttcttcagttttatttattttaatcttaagataccagtaccataatgtcaggctctttgttgatatt

SEQ ID NO: 51499 - DNA, 951 bp, Bovine  19866881302260
tagataaatatgaatactccttctagtccctggaaccttacctttatggtagagttgtacctatccacttgccacacagaagcaaaataccctttctgacttagtgtttttacttaactttttttttcttttgtctttagaaactatttttatccagtcaaagtgcaagtggaattgtggagcattataggtattattttatcatgatttgtaatttagggttttaattattgaaaagggacatgctggaaattttatcttccccaataatgctgtgaaaaaatcgatatagacctaattattgaaagcataacttcggttgacttctgtcatcctgtgaaactcataaacattacctgatctttttagagttggctttttaagtttctttcagggtgaagctagagataaaagtgggtcaagtagaaaaaaatgtaaagatcacggtactttacgaattctttatagagccgatattattgtttttataaataattttgacataataaagtctcaaagtatgcaggtattgttgaattgtgctgatggaaatggacaacaagatttttgagaatagattaaaaaggttaaatagggttatatgagtcaggtaaaaaatgagcttttttgattaaatggtctgaaagaaagcctgctttttcagtaaaagtgcagtataatgttgaacaagattgaataaggttttggagataaccaaagccataattcttattttaaataatgataaggtacaactgcacaaaataggttatatgtatttctgtctgctgtaccatgaaaatgaaatgatgaccaaaactaggcaagttctagagcgagagctgaaaactgattggatggggatggagtccatgatcaaggaggactgcagattatacagttatattctcattactccagtactcacatagagtcacaaagtaagaaaat

SEQ ID NO: 51500 - DNA, 1340 bp, Bovine  19866881344154
tttccaatgagttggctttttgcatcaggtggcaaaagtattagtttcagcttcaacatcagtccttccaatgaatattcaggttttatttcctttaagattgactggtttgatctcattgtagtccaagggactctcaagagtcttctccagcaccacaattcgaaagcatcaattctttgacactcagccttgtttatggtccaactcccacatccatacatgactactggaaaaaccataactttgactatacagaccttggtcagccaaatgcttagtatttggcacaaccctgactattgactggacataataagaacctaggtagtgacaaagtagggtcactagagtggggtctagaccagtggttttccacatatggtctggagacacttaggagatcttgaaacactgccagggtgactgtgaggtcacaagacttcataacattagaatgtgtatgcctcacaaccctcccaccaattctctctgagtgttcagtggaagtttcagtgactatgtgatatgtgatgatatcattgctctggtggctaatggaatatgagttggtattttaaactttctgttttaatttctaatacagtaaatatcaatggctataatccatatcttaaagaaaactctttagctcagttcagttagtcgctcagtcgtgtctgactctttgcgaccccatgaattgcagcacgccaggcctccctgtccatcaccaactcccggagttcacccaaacccatgtccattgagtcggtgatgccatccagccatctcatcctctgtcatccccttcttctcctgctcccaatccctcccagcatcagagtcttttccaatgagtcaactcttcgcatgaggtggccaaagtattggagtttcagctttagcatcagtagtttagggccctcaataattttaacagtttaaaagtatcttgaaaccaaaaatttacagttctggaacaatgctgtccagtagaatttaatgccataatggaaatatatggaacttccatagatggcactagtggtaaagaacccgccctccagtccaggagatgtaagagatgtgagttcagtctctgagtcaggaaggtcttctggaggagggtatggcaacccattccagtattcttgcctggagaatcccatggacagaggcacctggcaggctacagtccaaaaggtcacaaagagctggacatgactgaagcaacttagcacagcacgcagcgcagcacaatggaaatattctatcaaactgcactgtctcagataatagccattaggcatatgagactgatgacacctaagatgtgg

SEQ ID NO: 51501 - DNA, 836 bp, Bovine  19866881385143
gattggagtggaggattttttcccctctggcttctgttgtcccagtttgtttacatcagagttggatatctttattttaatccatttaatctataaacatgtgaatttacccctagctagtagagagttaactgtgtcgtgactagcatagtcatctactttttaatctgatgagtctttttgattgagtttacttttatttttttcattttttattagtagttgatgtacagtattatataagttacaggtatacagtatggtgattcacaattttttaaacgttctactccatttatagtattgactatatcccccgggttgttcaatatatcattgtagcttattttatagctaatacctcttactctcctccctcctttatctcccctccctccttatctcccctccccctttcctctccccactcactggtaaccactaatttgttctctatatctgtgaacctgcttcttttttgttatagtcactagtttgttgatgattcttttctatttttaattttcagggtccagcactgatttcaaaaactcgtgctgctttgggagtctaaattacttcaggtaacaaaaagttcagaaaaggctaactataatgttgattctccccaaatattgatccatagcgaaatgcatcctaagagctagcattaaatactttcttaagtcagtcagtcagttcagtccctcagtcatgtctgactctttgcaaccccatggactgcagcacgccaggcctccctgtctatcaccaactcctggagtttactcaaaattgtctctactgagtcggtgatgccatccaaccatctcatc

SEQ ID NO: 51502 - DNA, 1843 bp, Bovine  19866881506723
ttagaatgcttcaaattaatgcatcaccctcctgaaaatttcaaaagaagctatgtaggcagtagtactgcaaattctagagcatcagttccaccttctaaagtgaattctcagagattagtgaattagtgaacgctcagaaattagacagtgctgaacatatgagcaaaagattatgatttataggacataactggaggcaagtcaagttgactggtaaggttatgagtatattaacaaagacaatatcatattgaatataagcacccatctcctggcaatctaaaaatacaagttcagaatgccctggtggtacagtggataagaacccacctgccaatggaggggacacagtttagatccctggtctgggaggattccacatgctgcagagcgattgggtccgtgcgccacaactactgaagcccaggcacctacagccggtgctcggaaacaagagaagccatccattgaagagccaatgcactgcaaccaagaggaactcctgctcactgcaactagagcaaagcccacacaccactgaagacccagcatagccaaaaataaaataaattttaacatatgttaaaaagaaaaaaaagctttgactattagtaaatagtgatggacagggaagcctgatgtgctgcagtccgtggagtcacaaagtgtcagacatgactgagtaactgaattgaactgattagtaaataagaaggaaaaaggaaaataccaagggaaagccaaaggtaggttgatgacctaccctggaaggagagatatgtgcatctactttgtgaagaaaagtatggtgtagggtctcagccaggcagacgtttaaagagaggtcatatattctgcaaaaacttcttttggaagaatattcatcattgcctctcaatcatgtaattattctttcctattaagtaaatgaacaaaagaacttgcatgaaatctctgcatgatctattctattgttttagtgattatcatttataggtgctgctgctgctaagtcgtgtcagtggctgtagagctaataaaacattctccgtcttgacaggtaaataatcataaagaagtgtacaatcctttctttcttttcaacccagtagcttaaaattattataaaatattttggaagttaagaatgatgtaaaaataatctagtaaatagttgttctgctttaggaaataaaaaattataccacagttgaagtccctgtagatgctcctcgaatgcatctctaggagttgcccctattttgaatttgatgatgaaatgtgcagaatcacctggaagttctttctattgggcaaccatgatgacctataaagtcagtaagtaagtgaaagtctttcagtcgtgtccagtgctttgtaaccccatggactacagagtccatggaattctccaggcagaatactggagtaggtagcctttcccttctccaggggatcttcccaacccagggatggaacctaggtctcccacattgcaggtgaattctttaccagctgagccataagggaaacccaagaatactgtcccttatccagcatatcttcctgacccaggaatcgaactgaggtttcctgcattgtaagtggattctttaccaactgagctatcagggaagccctgatgacctatagaactattttaatagtcaatgctttggatctggctattggcagtagaaagtttcaaagtaaaaaatgttcagagagaattaggataatgagctttgacttattcatagtgaaaatttgctaatgttctgataaaacagagaatagcaactcaaaataatagagaatagccaatcaaaaataatttagt

SEQ ID NO: 51503 - DNA, 722 bp, Bovine  19866881561331
tctttttactttctgtcaaactttttatctcccaagaagaacagaagttgaaatcttggctttctagagttcttatttatccaggatacctagtcataccatattaaactttggatatgttttccattctgtctcaaaaagtcacaatttgctctgagatggctggttaatagatgacagggagaagataaaattaagcatggctagggtgtaagacagtctcaaggatgtattgtataacaggaggaatataaccaatattttgtaataactctaaatggaaagtaaccttttaaaatagtataaacattttaaaaattaataaaaaggaaagtaaccaaggcttgtttcaaaatacaatatatgttttactccctaactcttggctaaatgtggtaatgtgttttgcatttctttctttaaaagtttctttccaaaaccatttgtcttaacttattgtgctccactgtactgatagactggacatgaccatgatgattccgtaacggtcagtgatattagaaaccacacagagcccagcatggaacacttgctgaataaatgtttattaatacatttagatatttaatagatttttcattgtgttagtcctaggatgtcttgtttcaaaacattagctgaaagatttttccagtgtttactttagccttcaaatcctaacaataataaaattgtagaatgtgagttttgtgagcagtggt

SEQ ID NO: 51504 - DNA, 1321 bp, Bovine  19866881611209
tatgcagggcctgtaagtgtttagcatcaactgatggagggctctgctacttccttcttcccattgcctttgtttcgcagaccttggagaatccagaagacccccacagacagtacttccagaagccaatgaatgagcttgaatggtgacccatggatttaatctaattaaccttaaacacactaagactaaacagattagcttcccttgtgggtatcacaatagttcctgttcagtctccaagtcatgtctgactctttgcaaccccatggactgcagcacttcaggcttccctggccttcattatctccctgagtttactcaaactcatgtgcattgagtcagtgatgctatccaaccatttcgtcctctgttgccctcttttgctcctgccctcaatctttcccagcatcagggtcttttccaacgagccaggttttcgcattaggtggccaaggtattggagcttcagcttcagcgtcagttcttccagtgaagattcagggttgattttctctaggattgactggcttgatttccttattttaaccacttaatcctttgaaaatgtaatgaaagctctatgccctctccttaccactaaatccacttaagcctaagtgtacaaagttgtgtcagcaattttcaggaattcactgatctctgttaaaaagtcttaaggagtaaaaccaataaaggggatgctggaggtaaaacactagagaataatgaaaggatcctgagtttactgtctttaagtcaactgaaagagaaatgatattttctgcctgctgcttgctgtccctgcattcaagacaggggcttcaggaagaaattcatgatgttgtcaaaagaggaggtagagattggataaggacaagaatgagaaagaggaatagaatcttcatattcaataaagatacgaatgacctatagttttcttattgcccataagagtaaactcaagtcagtaaaaatggtgagtgctgctttcaactgatgctaaaaaggagcaccaggagcaaaaggcagctaagatagagaaggaaagttgattcctttcataattcccttcaggttgccaaatatatacagaatttaagaaaaatctgtgtgttttcacacaaaaagaaaacaaaattagaaaataattcagattgtgtatgggtttagagatgtgagccagtctctcaaaattccccagatttatgcaaaattaggatataaaacttctttatccatctcccctcaatctgatgccctgtgttatctgatttccagatttgtgacccttttgtctctaagctgtttattttctcat

SEQ ID NO: 51505 - DNA, 1301 bp, Bovine  19866881733679
aaattttgatgagatctcaaacttagtttcggagagaaacatgtgccctctgtcttctatatggcctcatatgggcctctgaaatgttctttgtccattattctccatggccacatcctatgtgaatactggggagctataaagcatttatgtcctattttctacttatgcaaatttggggttgaacagttccctcaagtgagcaaacttgaattgggttcatgatttgattagtggtaaaattccttcaaaagtttagtcctatcatctatttgcttccagtaactacacccaaagttcttgcttatgtaattctcaaaaatgatttacttcatttccttgcccccatgtcagttttgcaagaacatcatcccagctatcttgagaccatctaaaataatggtcttggatggaaaggccaaagtcttgatctgatctttgttccaggactaaatcttgacaggactgtactcaaggcctcttctagctttatattttactcttcaaggtctagaaaaactctgcttttccaatctttccaaatacttttatgcatgttcatttctgcaactgttttctgagcttatctgtttagtaatatcttactaaaagtaaaactcaaaatacagtattactttgactcttttcaactatttcctcctattgagactctactgggtcacaatctcaataggtggataatatgcttttaaattatcatgggtaactgtttaaacacctcttttgccactgcaaaacatgggtgtccttccgttctctgatgccagtatctctaacatctgctacatcaccaaggcaatgtaacatattttagggtactgttttagcagtactccacttccagtaccaatttctgggttagtcatggtcattcaagctctggaacatctgaattctcaaatctcaattttctctcatacaagaagtccaaaaaggagtgtttctaatttggaaatatctatattccaagtagtaatttagccactcatgatctttctctggctctggcatcttcaacatactcactagcttcaagttgatggagaaagagtgaggatgcaaggacttcattaagcctggaaatgagcacatcacttccacttacatttcacaggctaaaagtcaattacaagaccacaactaactaaagggaagttgggataattagtctagctgtatctccaagaataaataagtttcatgaatgactctgctacaaggttctaaaaggaaaaaaaaaatgctagataaaaataatagaaagtcactccagaggcttt

SEQ ID NO: 51506 - DNA, 2008 bp, Bovine  19866880376649
tgacaccacccttaatggcagaaaccaaagaactaaagtagcctcttgatgaaagtgaaagaggagagtgaaaaagctggcttaaaatttaacatttaaaaaacaaagatcatggcatctggtcccatcacttcatagacaatagatggggaaacaatggaaacagtgtcagacttcatgtttttggcctccaaaatcactgcagatggtgactgcagccatgaaattaaaagacgcctgctccttggaagaaaagctatgagaaatatagtcagcatattaaaaagcagagacattactttgctgacaaaggtctgtctagtcaaagctatggtttttccagtagtcatgtatggatgtgagagttggactataaagaaagctgagcactgaagaactgatgcttttgaactgaggtgttgggagaagactcttgggagtcccttgtactgcaaggagatcaaaccagtcaatcctaaaggaaatcaatcctgaatattctttgaaaggactaatgctgaagctgaaactccaatacttttgccacctgatgcgaagaactgactcctcctcagaaaagaccctgatgctgggaaagattgaagacagggcagaggatgagatggttggatggcaccaccgactcaaaggacatgagtttgggtaaattccggagttggtgatggacagggaggcctagcgtgctgcagttcatggggtcgcaaagagtcagacgcgactgagtgactaaactgaactgaactgaactgagtacagtgaagtctttgggaaaagtcaataaagcctcagtacatagttcttaattctcacaaagaatatttgtgttaattctctcatgagtcagataattaatcttgacacatcccaaataaaagtgtgtgctagcctcagtggattcttaagtgactttttaaggttttttcaattaaataaatgttaaaacctccttaaagtgtgctctagttatataacagaataactaacaagaggcatagtcccttagtagcttcatagcaacttgtcagagacaaagtgttttattctgaagaggagactaaggttcccctaattctttccccatctgtgcaatatgcattctgtaaggccctcaggaagaatacaagcctacttcttacaacctactgttgctgttgtcagaacacttatttactataccacacactgagtatggtttaaatttctcttgagttaactttcttgtttatatcttatgttttcagtgagcgaggcaagaggcagactatcacatacttttttttttttttaattttccctaaattagatctcagagtacatttttcaagtgcaattgaaattaaccaaattctaagtagaagatgatggttatcacctcatcatcatgttggtgactattaatctacatagacaatcctattaaaggaacagaaagtaaactgatgggaattgaccaataaagcacaaaataagatagagagtcagatgtttaatgtgctgtgatggattcattagataattttaaaaagacacaaagacatggaatcaaatctttcagtactgaccaaaaggattggaactttttcttgctggccaatatacccaaaaacacttttgaaggaaaaaaaaaaaaaagaagaagaagaaaacatcactgtgtctagtaaaaacagtttgtctccaggatatttctcattctcaattgtctgagttttccaagtcaaaccagctgaaatagaaagtccttaaatggctataattcatgagccataacctgggtaatttatggtttgtagtccaagagttcaaaatgggaaggataagcaactatacttcccatctaaaatgcgtgtgggagtgcgggagtggagggagctgccaccctcaccgccagggctttggagcatcatcatggtttgaaatgtgcacatcacccgttagtatacaatgttgcaaggtgtaaattcctgaatgcagtcaatgtgggaat

SEQ ID NO: 51507 - DNA, 3457 bp, Bovine  19866880473263
aatattcaggacaaatttcctttgggatagactggttggatctcctttgctgtccaagggactctcaagagaacatagtaattggttttgaacaccacactgtcagagggaaaagaactgaagtatgtcaaaagtttataaactgagatgctgaagttattggacaaccaggaaacgtttagcttgaatgaaagggaactaaaaagtttaaaagctatttttgcacaagaggaattagagggttctacaaatcccccaaagataaaactgggatgaatagaaattataggggaaaaaacagggtaagggaacaggacagtacacaaatgtatcaccctgagggcaaagaaagctggtgatgtgatggaaaaaccatattgcatgatcctgactctcatgccaaccattggacaggaccattagttcagggcagtgtggttctcttcagagtaaggttaatggcttcagggtggtgagggagctgcaactatacatcagtaagtgaaacactaatgagctacctctttgccagtgtagttaacctactttcttcttcctgtagatattgttgcacctaaaccatctgagaaagttaggaacatggcatattcttaagtctttcaaaaacaaaatccaaacattttggcacctatgtgagcatcagacaactttcccagttgggaagttttccattatgtttagcctggttgtttcttttatccctgttgaggttactaggaaatctcatggaatcatccttgaatacagttttcttacaggttgttctcagtgtgagagaaaaattactgatcattttcaattaaagggatgatgtaggtgaaagatctttgaaaagtattaagtgtaataaaagtacaacctatcattatcattgtttagattatatgactattatgttaatttgttctttagagtttactctataatttcttagaccttgttatttttctgtattgcatctgttcctcttcaaaatgcattacaatgtctcaggctgaatatattaatgtgaactaaaaattagatcatggaaacactacatggtccccttaccatctagctctggtctttcagagtaaaacctaaagtaaaacctaacaaatataacttgattttttagcgagtgttgattttgttctcagatatatggtagtaacatggaaacactcttgtgacccttgagttctaagataatatctacataaatacacaacaaacaaaatatagtgtaaaacttagtgaatgaaaaaaaaaaaaccgcatctgctaaatcccatttttcttttcattagcttagttatgtgtcggatgagaagagaggtgaagttgggaaaagttaaggagcgactaaattgaaacatgaatttctttaacagagattaatagggtataaataggggaggaaatgactaccagaaaaatttgaggaagtgcatgaataatactggtatatatttagccattattgcctctaagagcaattcttttctttatgttccctctttactgtaaggtacagcagaaagcaacataacattgtaaagcaattttcctccaattaaaaaataaattaaaaaaaagtacaaaaaaaaaaaaaaaagaagattagggttccttgggaattccctcgtgctccagctctgtgttttcactgccgtgattcacttttaatccttatttggggaactgagattccacagaccacatggcacagctgaaaaagaaaaaaaaaaaatgtttgaaattcctcagtgacttgtacgggaagcagagactagagattgtgaagttaacagccagcctcacactaacctgagaggagtggactacacttcaggtcatcggacaaataactgaacatccacttcaccacttctagctaaggcgaaactcactgagacctctggccccatcccccacctcaccacccctcccccacaatatccgcaggattccagcccgagtcccaggcctctatcctcagggtttacagaagacaagggccaccttctggctgcagtgatggcagtgggggctggggggatctctgcttggtttactggcaactgctgctccgtttttgtttttgtttttgttttaacctcaggttccagaggaagtcaggtttgtaacttctgcctttattctttattgctctctcagaaatgctgctttggtggagtagacggcacacaggtagcctggaagctgccacccaatgggtgagactgtcaattaaagcaattcagccctccaagtaagtattgattgcacatttacatttgtttcttcaatagaactctgaaaaaataactctcagtgagaaacaatttccatgaagatgcataaatgggaaaaacaacagggagctagattttataagaaataatctgagtagtctaagtactatagactataatgggcttcccaggtggcaagttggtaaagaatctgcctgccagtgcaggagacacaagagatgtgggtttgatccctggggtaggaaatggcagcacactccagtattcttgctttgaaaattcatggacagaggaacctgttaggctacagttcgtggggcaggaggagaagagggcagcagaggatgagatggttggatagcatcactgactcaatggacatgagtttgagcaaactccgggagatagtgaaggatggggaagcctggtgcagcacagtccatggggtcccaaagagttggacatgatttagcaactgaatagcaacaatagactataatacaatgggtatactaagtatagtatcattgatatttaattaaaacataacatactatactatgggtaattatatatgataatgtgtaatataatatagaaagagctttgggcttgaataaaagagatgagttctagccacagttctgccacttgctgagtgggatatatcaaaaacctaccaagacaatgatttgatccgagtttcattttctttctctgaaaatggagatattcatgcatcctctccttgccttcacagaggcattctgagtcattttatataaaatgtctcactccattttttcatttagttatattcctaattcacttcataagaaagcttgtgacaaaaactatcaacagaggagaatgaggtgcaaatagagaatcaagcccatgcaaaatataaatagttggaagttagctacagtttgcttgcctccgtttgtaatcacacagagtctagtcctagactgctctcttggtagcaggagaattctggatgcttcaagcctgctgcttgggttaatgctcaggctccagattgctcctgcagaagtcttaagaacttgggctgagctggcctagggtgtgaatggcacagaaccctcccttcaccagagtgaggaaggaggagtcagcttcaccaaaacctcatgaaccaagcacaactg

SEQ ID NO: 51508 - DNA, 2549 bp, Bovine  19866880620738
ggggaaaagttttgattaaggagaactggccgagatatggataatagttaagtgtggtgaagttttttattaatctctctaaacaaaaactattagaaagacttgaaactcttgaattacatttacttgcttcattctaaaagagctttgctattcctgatatatctgaacagagcttctagaatgactttggattgctgaatgctaccttggaaaccttacagaatggcaatttttagcttttcttttccattttagagctgttgtatgtgctttaaaaataatccaattacattggctggaaggcggtttttctgtgaaagattttctaggggttgaaaagcagaaagaacaacaaataagaaacacttgctgtttattgaatttagtaaaaacaccttatatttggataagctaaaagggatttccacatacatcacgtcacttcatcctcctatcagccctagatttagacagagcaggtgttattattaccacttactaaggatttggaaaattagagcccagggaagttaagtgactggaaagtagtgaagtcaggtctcaaacctgtctcttgactctaaattcattcccctatgtctggttaagaaaacgctcagttcaagttaatgtggattgagtaacacgtctgggctgcctatgtggttcagggaagtgaagtgaaagtggctcagtcgtgtctgactctttgtgaccccatggactatacagtccacagaattctccaggccagaatactggagtcggtagcctttcccttctccatgggatcttcccaacccaggaatcaaacccaggtttcccacatgaaaggcagattctttaccagctgagccacaagagaagcccaagaatactggagtgggtagcttatcccttctccaggggatcttcccgacccaggaattgaatcggggtctcctgcattgagagttctttaccaactgagatatcagggaagtcaagctctgtgaaccatggtggttcatggaaacaccagtttattcagataggtcatttcttacttagtcttagtctaagacactggaccaagactctcaaccagggttcccatccaaaccttggttctttcactatttgccctttctttttcccctttctttttcatttattcctcaaataatcgctttctttccacttcaatccctctggcttaacttgattttaaaaggactttactattaacatcccagaatgactcagtgtgaaggaaaccgcagcagatgcagaaaaggaagtggaggagggagtgtggaaggaaggggggcgctgagggcaagggcaggtgtggagagcagcttagcgtagatccgcagatctgagaatttctatgtccagactggtattctgagatgttccctgctgctctggaatctctgtaaacagagggatttgtctggaatgactttacagctcagcaggaagcatgctaagtgccaggactctcaaaatgtgagtgcagctcagaaatccagggatgaggtgcgctgagctctgcccgcacccaagcagggcatgagggctgaaacaaaccttgcaaagagacaccaaccacatcttggtgctgttatgatgagccacacctaaaatatcccagaaagccattaaaaaaacagccctgaggtctttagttcttttttctttttttcagggtacgaacatccatgatttaactcagcaatactttttcttctcaaaattcttttcaatgagaggaatctaaatctttcctgtggcagtttatttccctttcctcttttttcctcaatggtatatgtcttctgagagcgacatcgagactcaagccttttaagaatttttggagaagatgagagaagaaaagcacgggtactgggggtctctgggctatgacatgcagagttccaaggcagtctgtcttccttgtaaatacaaggtactggaaggggattagggacccagggtaaagccacagggaagcactgttgtgccaaagagagagtccttgggaaggccagctgagctttctgctgtttgaccatgtgcatagcatggctgcccagtccatctcctgtcagatggccactctgtagattagcatagctgccacttggtaattcatcttatttttgtaatggttacaggcaatgactttataggattcaaatcctagtaacactaattactagctgtattaggtttttccagagaaacagagccactagggtatcagtagctctgtctctgtctctctttctacctacctctatgccttatcagaataccagtctctatatctttatctgtctattgatcaagagttttactttaaggaattgattcatgtgattgtgggaactagcaaatttgaaatctatagggcaaactggcaggctggagattcagttaagagttgttgcagtcttgaggcagaagggctggaaacccagacagaattgctatgctttactctagaggaagaattcttttcctcttcagtaaaccccagtctttgcttttaagac

SEQ ID NO: 51509 - DNA, 3045 bp, Bovine  19866880686248
tatagatatggtaagtaactaacagaggcagaagagataaagaagaggtggcaagaatacacagaagaactatacaaataatgtcttaatgacctggataaccatgatggtgtggtcactcacctagagccatcctggaatgtgaagtcaagtgggccctaggaagctagtggaggtgctggaattccaactgagctatttaaaattctaaaagatgatagtgctatacccaatacaccagcaaatttggaaaactcagcagtggccacaggattggaaaaggtcagttttcattctaatcccaaagaagggcgatgccaaagaatgtttcaagtactgtacaattgtgctcattttgaatgctagcaaggttatgctcaaaatccttgctagtcttcaccagtaggtgaaaggagcatttccagttgtacaagctggattttaaagaggcaaaggaaccacagatcaaattgccaacatttgtaaaagcatggagaaagcaagggagttccagaaaaacatctacttctgcttcactgactatgctaaagcctttgactatgtggatcacaacaaactgtggaaagttcttgaagagtggcaataccagaccaccttacctgtttcctgagaaacctgtatgaaggtcaaaaagcaacagttagaaccggatgtagaacaatggactgattcaaaattaggaaaggagtatgacaggctactatattgtcaccctgcttatttaacttctatgcagagtacatcatgtgaaatgccaggctggatgacttacaagctggaatcaagattgccaggagaaatatcaacaatctcagatatgcagatgataccaccctaatggcagaaagtgaagaggaactgaagagcctcttaatgaggatgaaagaggagagtgaaaaagttgacctgaaactcaacattcaaaaaactagtataatggcatccagtcccatcacttcatggcaaatagaaggggagaaagtggaagcagtgacagattttattttattgggctccaaaatcactgcggatggtgactacagctatgaaatgaaagcacacttgctcttcagaaggaaagctttggcaaacctacacagtatatttaaaaacagagacatcactttgccaacaaagtctgtatagtcaaagctacgatttttccagtgctgctgctgctgctaagtcacttcagtcgtgtcagactctgtgtgaccccatagacggcagcccaccaggcgtctccgtccctgggattctgcaggcaagaacactggagtgggttgctatttccttctccaatgcatgaaagtgaaaagtgaaagtgaagtcgctcagtcatgtccaactctagcgaccctatggactgcagcctaccaggctcctccgtctatgggattttctaggcaaaagtactggagtggggtgccattgccttctctgattatttttccagtagtcatgtacaaatgtgagagtggaccacaaagcaggctgagcaaagatttaggaactaaacaacaacaaaccagtggaactgtgtgggagttgtttgaagtcacaccattagttaggatggagttgttactagaatccacatctgaagacttacagttctatgtctatgcacttacttatttttggtgctctcccttcaaacttgaaacttctttagtcattgggaaattgcacctgtgttgatggtactcctccttggaaggaggtaagaggtagtgaagaaacttgtattcacgacctctgtggtgggctgacatatgtgggcatggaatggggtctctttactgaactctaagccaggttatatctcctttatttgaacttcccactgctcacttggagtttaatcttgaaagaccaatcttgtgttaccagacaatgttgataaaggtcattgtttcctttttcacgcgtgttgtcctgtgtatgtagcacagcagggatggccactgcagagccaaaagactgaagtggggataccatgagatttccctagacatctccagaacaggctggtggactctgggtttggtaggctggggtgtggcagaacctgtgagataccattttgacgctgtaattgtgataacattttcacatgcctctgtcttctttgttcttctggcaaactcctattcatcctttaaggctgagtactaatgtcttctcttctttgaatcttcccaagactacttttctccttggcattcccagaaaactgtatttgaaataaggcatttggtctgaatggtttctgagatcacttctagtcttaaatatttcctaggccttttgacttttaagcatttcaagatactggactctggtacccatactgattttttaggagatgaaatctttggaacaactcacgtctctgctcggttggcctagcaccgcttgatcctggtgaccaagccctccagttggtggccagcctggcactggtttcaataaggattgggaggaatttttcttccagggcacacttgctggggtgagttgcttaaagatgctgggccctgcaagtccagaccactcctgttgagtgactctgcagctggtgtgggaggactcctgtcactgtctcctccagctgtgctccttctgtgcctttctataaacagatgggttggtcacttcagagccattcttctcttccctcttccctttctttccatgaagtgggtactaactatatctgctggaaaatcggtgacccaccccatcatcacttttcttctctagaggaaattgttttctttttttaaagaaaagttttattgctttggcaggcaaagggggatacagtaagctcgtattccacaaaactgtgtccctgggaagtgtttcttaagtctctcgtctctggactctcgcccctcaatactactcctctgccaacacgcatgtgcacgtgtgagtgtgcacacacttcagttcagttcagttcagtcgctcagtcgtgtctgactctttgcgacaccatgaaccgaagcacaccag

SEQ ID NO: 51510 - DNA, 1055 bp, Bovine  19866880793156
cgatgtggatcacactggatggcacataattgcttagcttttgcactaaacaaactcttatggctgatgatgctatattttaaatttcaatactcagcagtggtgttgcacatagcacttgcttgataaacattaatatattaatggataaactcattaggtaaggcggacataagaccttattccataaatgactgttgctgattaccacagaacttttgaaccataaaagaaaaggctgattctaccatgaaattctgcatttgtaaacattaatcattgttttttctgactttccttccttccagtcactaagaaaggtgtaatactcagtttttatggcaactaaaatgcacaaagtccctatgttcaaaatcaatcatcccaccattcaatcgtggtggtttcactctggtaagttcctcctaaatcactctgatgatgcctgatttttataagctgtgaaatctattaattatcttttctattgctctttgtgtcttgttacaagtgagagaaaggagaactaatccttttacaagtaagtagcagacatgtaacacacccacaaccaaacctgactctttttctcttcccacccaccttttcttctttcagaagagtttaaaaccaaaaatccagattaaagtcagactcttaatgttaaatgcatttttacagaggcaagtgtctgtgaaagaaattttataggaacaaatgatcaattgcatttttaagagcaactcctacacacgctgctgggtaacttgccaaagggctcattgtatttcccacactagtactaatggctaaggacactcaggaagtgagctaaatatttcagatgcctgggtttcacagctgagaagcttaattttttaaaacttaagtgagataaagtaatggcagtttccaaataatgactgttattcagattctctttcctgatgtcatgggactatgtttttaatccttccatgcaaaagttaatcattcatctaattagataggaaataagtatattctaaaggcgagcaacagattcattctattaa

SEQ ID NO: 51511 - DNA, 2138 bp, Bovine  19866880799415
tttaatgagagcaaccactaactctgaacccccagtaagtgaaacgttatcacccccccccccataaaaagagaattccattcttctaattagtagacctgtattacaaacagagtgcactcaattactatcattagattttaatgtttatcaactgaaaaaaatctgtagagactgtttcctctccctggtcatatcaggacctacatactacccatgatactgcatctggttccacaaagttaaaatatgtactatggactctctacagaaaacgtttgctggtccctgctctagtttaatgggaaatgctgatccgttaagtagctcatttaggttcaccagtggactctaatcaatgttaccaggaagaggaagagaggacaggatggggggtgaggggtgttgaaaaagagcaggaagagaaaagaggaagcaggaaaaagtataggaatatgatgaagtaagcatacagattcatttatgaatgaggcaaaaagaaaaaaaaaatttaatgcaccactatgcttagctctcccaccaaaaatcaagaatcacagcccacaaaagagacaggaggtatacttcaattctaacttaagcagtcatgactttaaaaactcaataaatatttattgagtatctctctattatgacagcttggcactaatataaggataaccaagacagctaagattcctacctagacagagcttacacacaagtcaagtttttttgaaataacaacattgttgataaattatacctctctattcctataagaatggaggaatgttaaaaatcccacataactgtaatgtgtttttggtcacactttttaatcttaaaagctaggatattttagcttaacttcctcttgaatgaatgaatgagatgaaattatcattctcaaacacatttggttgggagctagaaatgaatcaagcaattccagaaatctgagttctctatgcagaagcctagtaatgaatggttcaactaagactgtcagttccagaagcttcttctcacacagtatcacaacagacatgccaagcatcccactaacacttctgaactcgggaagagcttgcatataacagataagtctctgtgtttaactctcagatcatttacaaactagaaggcaatggcaccccactccagtactcttgcctggaaaatcctatggatggagaagcctggtaggctgcagtccatggggtcactatgagtcggacacgacagcaacttcactttcacctttcactttcatgcactggagaaggaaatggcaacccacttcagtgttcttgcctggagaatcccagggatggtggagcctggcgggctgccatctatggggtcgcacagagtcggacatgactgaagcgacttagcagcagcagcatcttacaatttcactgaactctgctaaacctcagtttccttacctataaagcatgagtcatagtatataatgttaccaacttgtatttaatataatggacacatggaatgaggtcactcaaaccaagcccttatcatccccatcttgtagtaagcctgcacacagtgggagtggtccctgtcatcctcacacagagtttccatcaaaacctcaaaagcaatgttttcaggacttgttcaatgtgtcacatgcctaaaccaacacattaaaaacctgctcctatggtttctggaaaccaaaggatggtttttcaaataaaatgaaaaacttcaaaacatctggagataaatctatagttgaacatttatagttacgtaaaatcaggtatatgatttgattttactggggaggaacaatgatttttcctcttccagaaactggtgtcctgggaggaatctaaagtctaataatgaaatcaggatcagtattcacaaaatggcattaagaatgcttgccttagttatttcacagagggacttcaagaatcaaaataaactaaaatgatctcaaaagaaagcacacacataaataagcatggtcatctatgtatactcactaatccagttactctctagcgtcaaaacgggaatgaaggctactgggtcaggagagatagggtcacattatgttagcatccaacatccgcattttcagaacatttaatttt

SEQ ID NO: 51512 - DNA, 1826 bp, Bovine  19866880802194
cttaatgggttattatagaaaatgctcagcagaacacaggagggacatgtgacactgactaatgggaagtagtcatttcctcctttcccattatgtaagaaaaaacaacttaaattgctactcttagattccaaggattgtctagggtatgtcaaataccagtgtgaattttggcgattaggttattctgcattgagactggcatatattattagtattttcctgacttcgttatcaaaagcaaccaagcaagttagttttttgaaagaaatttccaattttgctttgggtttataaaaacaaattcctttaaaaattctgggaatagaaaggtttctgagttcttggagtattccattgatcttatgaatagcaaaaaggtcaaggattttgcttatttgttttccataggcactctaaattttaaaagatttggagactttaagagacttttaagagacacttaatttgttacagatgcattaacatattgaatttatgtgaaagagtgaaggccaggcaaaggatattgggttcattatttattagtggagctagtcaaaacttccctgttttaaccaagtagtggtttggcttctattcaagaagccatcacttaatattgctgtccccagcaattaatgtaccctgggaggggggtgtgcctttactatactcaactagatgggactctagaccttgcaggtttgtcttgcctgtgtctggattggacatgatgcttctgcgtaattagctcaaagtacatgctacccttcctttctactcaaaatgaaactcatcagcaagcctacaaattatgtggagtctgaacctctctcctcatcatatttcaatttccatcacatccccatgctttctctattcctggcacactgaccttttctcagtgcctctcaacatgttccttcatccagcatggaaaactattgcctcatggtcacatggcttactcctgtcctgctcagtctctgtctttctcatgaaaaacttcccttcctgactgtgccatatgcagttgtaataagttctcatattaccatgttcttcacatcacagcatcagttttatatcacgtcttatgtgattgtctctctttaccactattttgagagcttcatgagagcagagatggggttgagtctggctgactttaatttctctaatgcttaggaacttgcctgataattagtattcaattaatatctgtagaatgaatgaatgaataacattaaggttctcttgacctgcacctgatgagttcatgtaggaggtcaatattttattctgaatctcatacttttgggcatatctgcatttcctcttttgtattattaaaattcagagagtggacactggctttcagtcttctgaggtaagtttctcttgtctagtgctcagttcagtctcagacagtggtaggggccagaaccacccctaagggttgtagaacagagaacccagtaacacacacccctcttcttcctatacagagttgttgttcagtcactaaatcatgtctaactctttgtagcgccatggactgcagcaccccaggcttcagtgtcctttaccatctcttgaagtttgctcaaactcatgtccaatgagtcgttgataacatccaatcgtctcatcctctgtaatccccttctcctcctgccttcaatcttaccctgcatcagggtcttttccagtgaattggctctttgcatcaggtggccaaagtattggagcttcagcatcagtcctcccaataaatattcaggggttgattttctccttgcagttcaagggactctcaatag

SEQ ID NO: 51513 - DNA, 3154 bp, Bovine  19866880822641
aaaagaaactgcaactcttaaatgacaactttctcaccacataggaaagccctcaacttgccccttcctcttatgtagggaaaaacccagttcttccctactgcctttctccccactgtgtcccctttatcttcacacagaaacttcactttaggcacttctggcccctgaacgtatggaggttttcccccacaccgagaaattctccatgacaccagttgggtgacactttaactcagttctgacactctctacctggagatagtgtcagatcctgcaagttaagagctccatcccacaagatgtcccaccccccacacttcagatgcagactgcaagaagccggtctccagggcattcaccacttctgtctaatttggcttcaaatctgagattcttacaattgctccttgttttgttttttttttaaagatatatttatttattttattttggccttgttgggtcttagttgcagcacacaggatcttccttgcgttatgcaggatttttccttgcggtgcacagactctctagttgtggcatgggatctggagcttgcagactcagttgtctcggtgcacgggcttagttgctctgcaacacgtgagatcttagttccctgaccaaggaatgaacctgagtcttctgcactgcaaggtgaattcttcactactggaccaccagggaagttcccccttgattttgattgatttgctcgaatggctcatagaactcaaggaaacgtttaccagtttattaaaggatatgacaaaggatacaagcaaacagatgaagagaaacaaagggcaagggatgtggcaaggggcctggagctcccacgccctctccctgcatctccatgtgttcaccaactgggaagctctcttaatcctgtacatttgggattttatggagacatcaccacagaggcaagatcaatcactaactccattttcattccttctctcttctcaagagaatgaaggggtaggggcaggtctgaaaacactaaacttctaattaagactcagtttttagggtagccaggcctcatccagaagacacccaggagctgaatcacaatctctttattaaagcaaaaggcacttctatcacccaggagattacaagggtttcaggagctcagtgccaggaactgaggcagggggcaagggggagagtgggcagagaccatattttctactatatcacactaataatctagggttgaaaaatagtaggacccaggcccagctagggcattgtgggcacagaggaagctctaccatccagaaggaaaaaggataacttttcccccattaactctataaatttacaatagtttatcaaattggtaaaggcacaaagagttgaaactcataagaccaatcaatgtcagtgtatgaaaggtctggagccagaaaatactccatagtagttcccatataaatctggtagaaaacaggaaggacagaaggtgagagaggaagtttccaaaaagagattctagacatgagttgtgtggaagacaaactctggccctatcaattaagcagtaaatgctttgactctctaaattcacccataagttaatatcatcaacaaactggaaaagttgtcataaagatgactgacatgaggttataaatcatataaagagttcctatttgtagattggaaaagctaataagctcccatcaaaaaactgggcaaaatctacgaacagaaaattagctgaagggggaataaaagcttaaaaatgcttaaaagaattggataaaagtttcatttggcacattaacaaaaccaaatataaggtaaaacaataactactttccactttgtgccaagcaaagtttgtttgtgctagatcatagaggctctcaagtactgtccttgtgtggctagaatttattctgtaatactaggaacacactgatagaatatttttttcagcagaagagtaacatcatttcagcccgctccttgatggggaacacatgtatacctgtggcagattcattttgatatttggcaaaaccaatacaatattgtaaagtttaaaaataaaataaaattagattttgcataaaaaaaataaaattggggaaaaggatggattaaagaagatgagattgtctacaacaattgtaaagacgagggaacagttccaaagatggtgtgtgcaggtatgttgttggaaatctaactctggaaaaacccatgaggaaggactgaattatgtaccgactgcttccatccattataccgtctctcagtagacctcgttgcttgatcagtgatgctaatgtatcatgaggctctgtgtaagtggatatcacaagagagcagccccgaacacatttctcaaattgagcaaaggtgtccttctaaagaaatgttgtctttccacaaaagctaggaggcaccagcatcaagaattagggcatttccattttcagaaagtgctttgcatttttttttctcaatgtttatgacccatgaggaacaatttttctcagcctccttaaaatgtcaatgctatccatttttaatggtcctgcttcattgcaaagatagcctaccttaatgagagttcctgaagtttggctttactccaagaacaaagagttttcagatacatattttaaaagatattgcaacctcttagatgactttctccaaatgaacataaatattattccttctttcacagaaataactgaaaagcaattcaatttgatgggcaataatattgagcaaagcccattttcctgctcagatttcttctgtttacttcctatgctttaaccatgttctctacagcttaccatggacgtggttatgcaatgatggcttaccctttaccctgctgtcatctggcccgacagctgtactcaaatgactggagagctaattgactgttttattattattgtttattactattacatggaagtatttttcagaacttttccaggcagagtgctaggtgtgcaaaagtagtatttgggctatagcaacttcctctttctttttgtaggtgggtgcagtcggccttgtggatcccagcagtccttaggagggtccttcacagaaatggaaggataaaagttggtactactgacagagatcagggaaagcatgtgta

SEQ ID NO: 51514 - DNA, 811 bp, Bovine  19866880923240
tcggaatataattctatcttccttttactgttacttaactcttaagttactcctcttgttttttgtgttttttttatgcctctggtcttccagagatcagagaccatggcagctattgttttgtattccctacaatacctaggtctgtgccttgcacatcgtaaagcattcattcatgtattatttatccgttcaacatttatgtactaaactgtgtgccaatgaatgagaagcaaaatgcctcatgtgatctaaaaactgaataattttattcttaatcactcagcatttatccttctcatttcagattttctcttttttaacattatcgggtaatttctatattggcaaatttaaactgcaaatattctcaacaggcttcaactataagatggttgttatattgaaatatgagtgatattccaagaataattttttctaattggaaatatatataagtatagttttaaaactgctaccataggagaggagaaattgaaaactaaagtgaagctaacccagggccttagttttctactccagaaacttatactattattctctaaataaacattttgtagcctgtggtggttttcacaaagggtttttgctaattctcattcagttcagttcattcgctcagtcgtgtccaactctttgccaccccatgaattgcagcatgccaggcctccctgtccatcaccaactcccagagttcacccagactcacgtccatcgagtcagtgataccatccagccatctcatcctctgttgtccccttctcctcctgcccccaatccctcccaacat

SEQ ID NO: 51515 - DNA, 1729 bp, Bovine  19866881004752
ttcttgcctggagaattccatggacagaggagcaactaacacaacactttaggaaatgaacacacaatccttctataccttcattaaaattatctcaagagcacctgtggattatagtttctaacctggaaatacagtaatatgagtgccaaggtttacaatttccaatttgagaagtgtggtgatacaaataacctgatgaagaactctttgttcaccatcactgctaattaagtattaggttgaatccgaactgccaaacataagaagcgaagaaagaaagaatataatgacaaggccactgtcacgcatttctttttttttttttctctctttgcactaggtctttgttgctgtgcatgggctttctctagctgcctcaagccggggctcctcttcttgtggcatgtgggcttctcttgctgcagagcacaggctctagggtgcaggcttctgtagctgcagcacacaggctcggtagttgaagttcctgggctctagaacccacaggcttcagtaactgcagcagacaggctctgtagttgtggcttgcaggctctacagcacagggctcagacgctatggcacaggagcttagttgctccacagcatatgggatcttcctggaccagggattgaatctgtgttccctgcattagcagacagattcttatccactgcaccgtgagagaagttctatactcatttctcgtatttaaaatagaggttgttaatcttgaagtttatatttctgaagaaatttgctttcctaccatcctattttaatttattaatgacctcacactagcaactgtttagcatgtttcaaaaagccaataggaaagctgtgaaaaagctagtgaatctagaattacatattgttcaaactgaaaccttatatgttaaatgctgatttgtgatataaggataaatatactttcttaagcagcagttgcaaaaacagtgaattgattctgccattcagtcctttaaaaactcagcaaatcacccagagttactctaatggaaatctctactgaaacatagcttctttcttctctgctttttctcttgtcctatgaaaaccagaataaactacacacatacaagattctgctttaagattaggctgattctttctcagcctaatattatgcctattaattattttgcattgaagacccatatgagttatacattatatactttgtgaataaataagtactttcactttatcctcagggtgagctaggaaagaatcctaaagcaccaaagtcatcaaatgcatctctaatggatacataatgtggacctcacagcagcctatggttatagcccaactcagttttatataatgaaagatcagggagacagccaatctcctctttctgatataaataagttgatgatgattttgtggctgccaccattaagtatgcaatactgtattgatctaccttttctttcatttggatacataccttcaatataaactttttcattttaacatataccttcaatactgttgacctttatgtccagaagaaatatttttaaaatttatgaggttttgataagtatagttttgtgggtagacctcttacaaatcgttaagtaaatggatttagtaattctacatcttaagtgtgacttcaattaaacataaaaacaaccatcagtaaaatagctctagataataaatatttgttgaatgaataaacaaaaggat

SEQ ID NO: 51516 - DNA, 661 bp, Bovine  19866881150400
cctcactgtcctaaagagaaggtactgttttaagccctttgctcacccactgcaaagcatcagatggttgcaaactgagccctgctgctctataaaaaaaaccatagcttttcccaaatgtttgcttttccacacttgcacctgcactccaccataataataaaaactaaagaaggttaaatagagttgtgtctaattcagaacacaaatgcttaaggaaagatttctgtttttagaagagattcctataaacgatttagcaaatttgagcatataacctgtccaatgtgctagcacactttgctccaagcagccaattttgcaggcaaagctgtggttttcttgttccttctgtgagtgtggctgccatttcctcacggcccagcccgcagtgatgcacaaaccagggatgtatttctcatttatgcataaaagtggtttccttaaattacgagccccaaagttccaagacactcacagcctgggtggccacacaggtataagtgcataaaagtctgttcttagtgtggctcacggactgaacgtattcacttcaaacagctcgtctctctggaacacgccacacagcactccatcagggagaggcatatttgtggtcataatgtactacagcaatggcacaaggagacacacacccaga

SEQ ID NO: 51517 - DNA, 934 bp, Bovine  19866881165822
gaatgtgacactattgagactttaccccctttttcctcaagtttggattccgggaacagaaaagggaatataatcgattgagctcttgctgaaggcctttaactagctgtttgaaatcagaaaatatcaaattagaataatcacttctataaaggttacttctaaactcaaatatgctaagaaagaaaaatctattactagccagatatatctaggttattaaaattacctcagctgcttcagaaccctacaggaaatgatgtaaggtaaaagtgagtcactcagtcatgtcagactctttgcaaccccatggactatacagtccatggaattctccaggccagaatactggagtgggtagcctttcccttctccagaggatcttcccaatgtaaagatgtacataatattataatccatagcaacactaaagaacaaagacagatgttacccacaaagattctttcagtccttaaaccaactacttaagccaacagtttcatgcgttaaaaaaataagttccatgtagattctagtaagatttccaaaaagcctctggatattttttcttcattgtaacggagttatatgttattctaaagtcttgtaccttgtactttttaagccgcagtaaatttaggaaaagaatatctgagtttatgataacagggttactaaaatattataaatgcaacatactatatacattattactttctgcatttagataacagtaacgtaatgaaaagtcactgtataactaaggaaaatggttacgttgatgtacttgatatcccaaaattcccatcacattggtaataaaaagtattttaaaatacttttaaaaagttctattttaagcaagtaggaattttttaaggtttagaagttaataatgtgggaagtatcttagccatttttatttataaaactg

SEQ ID NO: 51518 - DNA, 1893 bp, Bovine  19866881408992
cacgtgggctaagttgccctgtggcatgtggggtcttagtcccccaaccaaggatccaacccaggtcccctgacttggaaggtggattccaaactgcaggaccaccaagcgaagtcccctgaattcattttagcatatcatggtgttgcaaaactgagaccaaatttcttttaaacaattctttttttttcatggaatatagaattttaaaaatctaattttaagtattggattatgtcagacctgacatcagtcaataaatactaagtttgatatgacaaggaacaaagaatttcagactttgtgctactccccagaccttaaattctactggggacacaaaatattaagcctttcaataacatagctcaatgattaagtgaaatattttgcagtattattttgagacaccctttaagatctgctaagtccatctataggtcagagagattgagggaggcaaagtgatctatttgaaggctgtggaacaaagatggaacaaacacaaaagggaataagagagttgagtttagagagaagaactgggcataattttgttcaaaatttcgttctttattagcaataaattaaaataaggtggtgttttctgatgactcataagatagatgttgcatgaaaaggtactggaatcaacaggcacaaacaagacagccaaacatggaaaaatgatcataggtagagcatttgttccacttgccttttatcttttacacctgtgtttgaattcatccaaacttacataaatcctttacacagctgtcgagatcgcacctgaaaaaaggctgaagtagtctcagacgggctaacatttcatcattctgaatacttaaacccaaacaggtttaaacactttgccaaacccacggataacgggcttcgcattgatctttgctctgttcaaatgttcagccgtgtgccaaagtgtacactgcagattgccttgtatagactcccacaatttttagccacagaaaagctcaaaaataacattttagggatgtcaggtctcctttgaaatctactcagtaataatacactttgatatatgtcactagataaagagcagttggctgcttgtacaaactgatctactgaatttaatttttcttttctttttttttttgtaaacaagcagttaaatgcagcatacttcaagagcttatcaagtttccggtatttccactagactgtttccgatgtctattctgacctccacaattggattacttgtaacttggggtctgtcgttaaaatgttttaaaattataaatatgtacattggcattataaaaaatgcacaagtacagaaagatatagaatgaaaaatgcaagtcctcctatactatctttccttccaactcttctccctagaaaaacccctttaagagtttgatgtatatccttccagatcctttgtaaaatgaattactttgtgtgtgtgtgtgtaaatatgcatgcatgttcagtctctaagtggtgtccaactctttatgacctcatggactgtggcctgccaggcttctctgtcctgggatttcccaggcaagaatactggagtggattgccatttccttctccaatgtaaatataaatgctatcataacacaaacattattatgccactatcttttccttaaaatagtgtaaagttttaccaatttaaaaaaatgttgccagactaaggagagactgttgctatctctgggtataggatttgctctaggtgaggacaagtgtgcatttaaaccattttattcaaatttaatcccacactttaatccttccttatttacactaccaaaaattaagaggcttgctttcttggtaaaaagaagaagtctgaacgctaacctttaaggaaatttagggcta

SEQ ID NO: 51519 - DNA, 863 bp, Bovine  19866881793109
ttggcctgctcttctgcatttctcacaagctttcaggcagtttccttgctgctggtatgtgaatcaagaaattatacacgaaggtctgtagggattcagttctccaaacatttactgggcctttcagcaaatctagctatttttttctctttgaatccccaggtggaccatttctgatcattttatctttcagcagtcctaaacactgtagatttatgaagccttaacttagctctatttccctcgattagtttatcttatgttgatatttatcatccacttagaatttcagtcctaatatacgtagctgttgctgtgacaagcagtatatacacatatagaaatgtatagtcaactgctgtgactctcttggggccactttgctttcactggcctttggattctgagttcccttttgttggtctcgccatcagattcatggttttgtcaaactcagtgatatgcaccacctatcagagtcccctttggggctgtctgtttttggcactttcctggataactctcacctgcataaaagaagctctaagtctttttttttttttgtcatctgctccattgtttaatagccccacagaagcaagctaagatgttttaattaacctgtgtgatggcacagcaaacccagccaggtcttcgcttaaatgtgatctagcagagagaaatccctgagcaatgcacataggagagtgacagctgtgcagcctgactttctctccagggtatgcatccccacctgagggcatttacattttcatttgttggttgcttggatcctcctatctacgtgtaatcttcaaaagagaagacttttctaggtacaaataactacctacaaaacagaa

SEQ ID NO: 51520 - DNA, 1674 bp, Bovine  19866880459895
atgttagctgggtcattcctgcccaaggaaatctagataggagtgccataaaacttcaattccatggcctaaggaatccctaatctctggattccaggaatttactctttcatgggcctttgtacttcttcctccatcttcgtttgctgtatgatagtagcagatgggcttacacatataccttaacaatcctagttgttgttcagtcgctaagtcatgtctgactcttttgagacaccatggactgtagcctgctaggctcctctgtctccatactcctcttcagtattctttcccaggcaagaatactgaagtggattgccatttccttctccaggatcttccccacccaggggttgaacctgctactctcctgcattggcaggaggactctaccactgagccaccagggaagccctaacaatccattttgttgttcctgtttaatccttaggttctgtcttaaagatccatatgaaagctacaagggcaatatagacctgtatgaagactctatggggagtaagggaagactcgacagcatgcaacctaaaaatgcttatttactgttctgttttccaaagatgctcttcactgctctcatactccagtgaccccatctcctgtctccttccacacagctctgagtctccttgaattctctgtctcccttccaaattttcaattcctgtccttccatttgccttagttatttaactcctactgccaatttttgcacataaacatttcaaggtgctctgaaaaacagagcaatgattttagacagaagttattgttatgagtgccgattattatctgtcatgttataccttcctccccttgaaagaaataaaatatttgtaattcttaaatgcttctgattcatgccttgttgcctttccttatgcttggagtcttcttgactggtgctttctacctaacacggggagtatctttcaccttcatcttcaaggttcttattcaccacttattccctccttcaggctgtaattcagctgtttcaggaaaggactttgcttctcattatttctgcatctgggctgagtcatccttgcatgaacactacttcctcagttgcttccagttctaaggatacagttcaattttgttctgtggtgaatgctgaagtcatcttcctatctcctcatcccaaattatctccatgtactatgataatttatggagacactcagggctctcagacacagtgtgcctccctaaaatattctgcaccaaattgcttctgcagtgtcttaccacaaccaaaccagatttttgagactgagttcaatagcacctacttgtatggctcattggaatcaactttgatttgaaaatatatgcagaggactcttcaggtaaacatcatctacaattgtgaaaaaagaaccctgaattaacaccaaatgttaatcaatactgtaataaataaataaatatatatatatatttcattggaatatccagtgggatgaagtgatggagaattaacgattgagagctgtatgtagtctcctggatgaatctcatggtagaaatactgagtgggagacaacttacatatgaatcagttcagttgctcagtcgtgtcctactctttgcgatcccatgaatcacagcatgccaggcctccctgtccatcaccaactcccg

SEQ ID NO: 51521 - DNA, 1587 bp, Bovine  19866880595567
ggaacagctacccactccagtagctgctcctgcttcatctaagaccccattttcttcactccaaccctcatgagttttcatctaaaccaggtaaattccattttgaaggacaaacagtacctccttactcttcattcggatataaagattcttaagaaaccaaaatttggtcttcttggaaagagaggctggagatgtgattctgcttttaaaaatgtttaaaaaaaaattactgagcagagatatgtgtatgtatttctgcaggtcctaagaagacatgggttccactatgcttccaattgttttcatgaggaagagacctggtcctcttttagccacagtgaaaggtcttgggggctggaagccaaatctgcaaaagactaaactatcaatatgttaatcaaattataatcaagagtgaaatacggcatctaaaagatctcataaatgataaaaatgattttaattaggaaatgaatgcaatattattattttgtacatcaaagaagatctagtacacaaaaattaaaagatggacactcattcctaactcttatcgtaattctacagtagaattataattctatgtaattctctaaaacagaattgtatctgtgtagtatttcattctaaaatactgtattttttagccttagatccagttgattatttttaatgtctttcctgaagaactatggctcacctccagtaggttctggggatgaaattacttgtgccatgaggatgaaggaggcaggcatataacaaggggttgaggactgtaactgaatattctataagcttgattttacatattttctaggaaaaatatgatagcttctacactgcaaaattctataaaagtacataatttaatagattctgtccagcatgctcacaatttactaaataaaatttaaacacttgtattaacccagatagcaattttagtaataataagtgcttactgggtccactgaagaaataaactcagagaaattacagggcttttgaaaagttaaaaacaaagtcagggatgcagcttgtgtcctatcactgattctcaaatttaagcatcataatcatttggaggggagtaatgataaaacagttgttgcagtgcaatccacatgtttctgcctcactaaatctggggcatttccaataagttctcaagtagtgctgatgccactggtctagggaccacacttgagaaccactgtcctacattaaggaagaacataaggacatcaaagagggagctccatcttcacctccaggagggcacagccacaaatggtgtcagactaagcacctgagaaaaatctagaagacatggttccctaataaattattgaaactcactgtattgaagaaagccactactgaagacaggaactatgggaagtgacatgagaagagaggcaaagtgatgtgcctgagggggaagaccaaagaccagtggacaacagtgaatgcacaaagatgagaaagacaggctgggacctgggaccttttgttgtagtgttgcattgcttggacttggacaaacatctcctcgagcaacaaaataaaaaggaaatataa

SEQ ID NO: 51522 - DNA, 1967 bp, Bovine  19866880688671
tcatgaaacaagtaaatgtttgttttagtacatattttactctataaagacaatttatcccattactaatttttccatttattataaataaatctacatttttaagtgctcctctttttccatatccgtttttgctcagttcctttgtctactcatcctatcttctaaaacactaaaaattctaaaaattcagctgataccatctataaaatatctcctttgaggtagccaaattaataaaaacaaactcatagctataatttattaattgccaactatatgccaggcactatattaagcactaaacatagaatattgctatctttacgactaacctgcaaagtagataatattaaaaactactgatactactattattaaaatcaattacagatgaggaagctgaagaaaagatagattaagcagctcaatcaaggattataaaattggtatgatgtggagctaggacaacctggtgctctgtgacaacctacaagggacgggatgggacgggtgggaaagaggttcaagagaaaggggagatatatatatacacacatacacacacacacacttatggctgattcatgttgtatgacagaaatcaacacaatattataaagcaattatcctcaaattaaaaataaatttaaaaggaaaataaatagagctagaattcaagcttaggcttccttctcaaattttttcctaatttgcatataccagttttttcagataccccaaattttcattcattcttatcccaaatttacatgtaatgtatttgtaatatataataaatattaattattctcaaaacaatcacatataacaattataatatgcataagccatatcaatggaaacagtacatttctacaaaagaatgacacctttttcattacacatgtaatctactatagttcattacagaaaaaagggaaagtatgaagaggtttcaaaaatgaaaagaaaaataacctgtaataatatttcacagagaaaaccactgctaattatgttggtatatatccatctcccaagacaaaattttttattttgaatatttatgagttattcataagaggatttaaataccagaaaaagttttggaatcaaaataatttatcaaagatctattaagactatttccacaatcactttttaatgaaataatccatattccaatgttatctttcactaaaatcgtctatcagtaagtcaatcaaataacccactcagatctattaagtggtatcccagttctttccccatgaaaaaagtttaatgatgagcaattttgttagaaaacaagattttccaaccctagtataatgagttgatcaccctattgctatgtgccaatgcttgacatattatatttaaataactttaattatatcactattagactagatatactaaatattttaattgtacttaatgtcaaatgaccaacttcaataatcaatgtcttaagaaattgatattcttaagaaacatatttaagtagaacagtttacaaaatccactcaaagtccactcatacctcacattacctgtttttctatattgcgaagaagtagtgtagggctacttggtgacatttcgaaatcttgttctggtaaaggatcttgactctcttgaggaatctggggagtcccagaagtgtttaaggaagctggatggtctgcaaattgtacttgctttttcaatatgtcttttggaagtcgacattcttctaggatcactatcccctagacaaacagcaattaaagagttgcaatgaaaacaaattgattgctggaagaacttaaatgttacaatgcatgtgaaccatgctttttattattccctagaaatcagaaaatagacagttggaagtactctttttttttttttttttgaagtgttaacattttttaaatttatttatttattttaacggaggctaattactttacaat

SEQ ID NO: 51523 - DNA, 1549 bp, Bovine  19866880697802
ccggcagtggtgtagggcttcagtccctggtctggagaacaacaggaacacctgtgtggagcagaggggtcagaggttcagaggtagtcagcaaggaggcaatttgtacagaccaatggatgacccagagaaggtagagagtagcattcagagcagaaatattcagagggacagagggcatgtggctgataggtgaaagttgacatcccgcttctggttactaggaggctgtaatatcagagaagggctgagtacttgccacaggaaaggtaggctttcaggacttcactcgggctgcaaagtcaaccatgaaggaggggactgttacccagattttctgccacccagaagtcaccattgggaataagatgtggttataccttccatctgttctctcaaatgtaatttttctgctgaaaaagctgggctgttttgtaagcacaaatacaaattaaaaattagtctttgttctccctgttgaaaataaaaatttccctcccttcctttttttagagcattgacctcagaaaacttgtgagtactttttcatcgctctgacatgcacgtttcatcagttttatgacccagggatatctttctggaaaccatctttttgaaatgcaaacatcaaggggagggagcacgctgattacccagttcccatgggagggtaagagcctaatttcagtaggtgctttgctccaatttacaaaaccacctcttgtcataaagagatgagaaattggtttctcttccagataaaccagttagctaacacgggtggtctccccaattcccacggtaaagttaggatgaactatgtatgacaaaagatgatgttaagagctcttacttgagaattagtgattgtttatccctgtgtctaatgatttgtatctgcctggctctataagggagtgtgaatcctttctgtctttgaaaccacagggtaaactgcctgtgatacacatcacatggtttaatgctttttcaacaatgaaaatgttttccttcttttttacttttgtggaaaggttttctaggctaggaagaggatttgttttttattctattttcccaacagttttcagtagaatgagacctaactaaaactcttaaacatgcctggacctgttggtttcctccactgagctccaatgtcctgggactacctcctcaacagtaatgccctgtgttatcaactcacccaccctccaggggcataagcattcttcctgatatgccatggggatgatagaggatgagatagttggatggcatcacctactcaatggacatgagtttgagtaagctctgggagttggtgacggacagggaagcctggcgtgctgcagtccatggggttgcaaagagtcagacacaactgagcgatggaactaaactgaactgaactgagatgccattcacaggctacagccgaggtggagtttgagctgatatatggattacatcccatcacttatgtacacaattttattcaacaaaagatgcattgtttcatgtgtgctaaaaccgttcatccagtctg

SEQ ID NO: 51524 - DNA, 1738 bp, Bovine  19866880747133
tttcctgatttttaagaacagaaacttatttctgcaatacctccgcggatttaatcttctttactttcttctctgttcttggttatggcagagaaaaattgtgggccattcttatgttatgagagttttgtcagggcaacagtttaagagaacaaaatggattatgaagttggctatgagtgattcccttgctgaattttttaaatgtttttcttaattcaatcaacgatagcaggccttctacttaaaaaaaggtagtattttaaaggtttggaaattggacttttgaaattcagaatcaattttcccctagaaacaatattgtaagtagggataataaaatcatggtaattcacagcagcctggcccataatataaactgtaataaaaacaaatgaaattataaatcatatagtgaaaacttatatttcttttgtatacaagtacttgtgaaaaacctgctagagacttgtacaaattttgggtagatatttcagatactttcaagcacttttgagtttgatgatactatgtctgtcaaatctaatttaatttttaaaatatcaagtaaaacagaagccacttttaaatacatttcttgagatttctagagagccatatttgtacgttctataaaaatagtcattgaagtaggatcaacagttggactcccttatctttataaaagttactagtgctgttaaagtatagtttaagaaatgttacttttactaagcatcatttgtaatatattactataaaatactaaagtggatacttaatacagtatctgaatatgttaattctaaagtggtatattctctcaactatagtgtaaactaaaattattgatatataacatataatctataggtagtttccaccctatgtatagcacttatacatgatataagctagccatggcaatttaatttatcccatcttgaaatactatacacttgtataattgttttagtctgtttttgatttcaataatatattttagccacattaggcatttaatacctttgcaactagccaataggaacttactgacattttgccagaaaaatagtaatatacacatatgcacacaatatacacacacacacttaaatgtttcataataatatgtattatttgcaggggcaagtgtaataaaagggataggaagggaagaaatactatggtgagaactatgaaaccattcaaatgacacttgtgcactcctttttcccctttctctcatttctttgttacttctaagggacctaaggataaggacagttggagtgaagatgataggaaatgggggagaaaattcagcaagccagttgagtagtatgtgtgtgtatgaatggtaggcagggagaacagaggcagctagatccctactcatttctccagttacttacatttcagaaaataccccttaaagttgaaaatttgtgtctatattattaatccatctactctgcaagcaaagagaacttgattagtttagagagtactttttctcaatagtacagtccaatccatggttgctggctggccacaacagtgtttggggttctttagaatgctctgaaaggagttaatataaagttagcttattgttttggatgtttgtaagtttgatattttaatttatgaaatttggttgttgttcagtcactcagtcttgtccgactctgcgaccccatggactgcagcactccaggtttcctgtcttcactat

SEQ ID NO: 51525 - DNA, 1858 bp, Bovine  19866880776557
aataaaattgaagagatcttaaataaataatggagcataagttaagggagggtagaccactttatacattagaaacttaataaagaatttcaattcctcaattttaactatctttatattcaatataaggctgctgtagaagcttttttttatggaaactaacaaggttattttaatagaaatgaatatagccaagaatagaccatgtcatcctgaagaagaacagagctagaggatttacacttaagtgagcgaaagcaaccagacacaacagagtacctagcatatgacatgcatttcaaaaacaaacaacactaatcttccatgttaggatagtagttaccaggaagggagggtagtatttggcagagggcctgggtagggcttctaaggtactgctaatgttcttcgtgacttggtggtggttacacagatgtgtctactttatgagaatttattgagccgtgcacataggttttgtatgctttttaatatgtaggtgtgacttaactacaaagttgactttaaaaatagttatctcagagattctcaaaatcagctggttctgggaatcagccagtttcaagggctatccctgtacataccaggcagtgtgacataccaggcagcccttatctgaccctactagaagtcaaatgaaagaggagatggagacattccataactaacatcaataacagtgctgccagtaccctgccaactgtggatcttacatattacttcctgagctttctcttcctttcttcatgcccttgaagtacaacctgtgtttgggactccctcttgcctgtgccctcaggagagccctttgaggtgtgaccttaatcatagaatctccatgtcctggtttacagtttggtagaatgcagactcaagactgacaccatgatcttgctctcagcacttgtgaaaacttgtgtaaaactgatcatgaggccttgactgtgttacccgagttctctcgaccaccaacctggcctggtccctcagggttctccctgactgactcacaagccaaccataacaaaggacccttggtcttagataaggttcaaatgaatacagtccagcagaagacccatcttagtgaggatccagaggttcagctgaaatgtgaacatatagatttctaagaggctgaaatggatggatatttttagtatagtcttttgtcctctcttcacagatctgcccccagtgccaaaagaaattgatctcagggctctttctgagatgcctacttacatgaagccatgacatgttcctgtggtaattttcctccacgccggctgtactcatgccctcgggctcaatgctgggctcacttgcactccaaggactcccttcttcaaaagaaaaacaccaagaaaggttgtactgttctgtctccctggagagcacattgctacggtatcagggtccatgcttttgaatcctagggcacactaccatggccaatgggttacagggcatagcattgactttagtggaggaatattaataggaaatgttccctttaccaccagctgaaccagcaattacaaagacatttatgatctctgttacagtggcttccattttgagacatgggagcagaggaaaaaaaaaaaaaaaaaaaacacagagccaagtccttgaattgctgagatgagcaagttattggttgagtgtgcccaaacccattccagactgcccagacctcgcaggtgtaggtaagtagggacgccagccaacctgcagtgggcacaaagggtactgccacctccactgggactgtgacctcagctagtgtaactgctcttcacaccagctggctttgctatcagagctacttcaa

SEQ ID NO: 51526 - DNA, 1116 bp, Bovine  19866880818904
tttaactattaaattgccctgagaagactaccagaagatgaataaaaaacccagactgtgctatgtaaggcttcccatgtaggttggcttggcttctttagcaaatatgttttatttgcttaggaaacttaaggcattttgaataaaaaacaattttaattctctgctctcaaaagcttcttatgataaaacccagacattatcagttattggccctaagaaatcctactttaagttggaaaacagaactgagaccattatcaaaataattcccattaattgactatatagcacaacattaaagggaaggttagttattattgataatttgattcatgtaaattgccaaactcagtaacttttggaaatgtcactgtctgcattaagggatgatgacacagagtaactcaaatattgccttcttattataaacctcactgaatcttgtaggtgaaagcagacttggggatcctctagtcaagaggacactgagtactaacaatttctgtggtactgtagtgtgtgttactgtacggacaatggagggtgctggtgtagtataaagctaaggactcaactgtgcgtcctcatagaagatccttggcaataagaaccgacttcacactgtgtgtgaaagagtagtcaaggcattatgttgtgggtgtggctataggaattattttccttataagttcctttcaaagtgtaagttagaaagtattgacttgaggagcagggttatggaataccttagacaaaggattctgcctggacataaaggaaagttggtttttcctcttttgatggacttgcctcttaatggctcagagcaatctcatgaagcagcaaaacaatggagacacgacagaatgggcaaggatggattcacatcacggagaaaaacagcacaaatggagaaaaatgaatcagaagaaggctgcatggatgaagagaaccatggagtttcagagacacagtcaaaactgaacatcaaaacaaactgtggtaccgttggtataccacagagaattttgctggtggtcctaaaagaaaactaggcagatttaaattctttcgattaacatgtctgccagatcacctttctattctgtgttc

SEQ ID NO: 51527 - DNA, 1699 bp, Bovine  19866880822693
gaaaaatcgacggtaattgtaatcagggccaattaggcagaatgagttagagaaactcagtctgactcagccaacacttgaattgataaatgttcatattgagctacactgtttttaaagaacttgcactctctatgaagacattctggtggtattatggggtagatcttaccctaaagggcaacagcacagaagacttaacaaggaacccaaatatcaaatgagagaacctttcagagagtgaggatttactgaggagctttccaggctgaggcaatagtgctcttaaatgcatttcctttactattcctgagtgtctcagggctgagctgttcaatgtttcatgctctgtatttcacatttagtctaccaatctcaaacaggtatgttagctatgccagaacaggagagtcacgttggttaaagcccttctatatgagtaaattgccgtttcacttgtcagtataatttcaaaaataactattaatctatacacagttactgacttttgtattctggataaataagaagttacaagtaagaataaaaaaaaaacagcaatatgaactctaagcataatcacaaaggacagtgcattttaataacaaaaaatgtagaaagtctcctgaagcaaagaataaaaatgtcattaaaataaactgagctttataagttttcttatatcatcttttagcctacatttggtccatatttcttcacagactgactccaaagtacagagtgcttggtaatacggaagtaggctttctctaacttgccagcttcattctgaccatttttctcactatagttacctggtaaaaatttaaatcttcacgcacataggtctgcataactttcaagtctccttctggttttcattttcttataacctgaaactactaccgactttaaagtgttcagcataaaacccaaattgtgcttttattcatttacaacagatggggtcactgtgaaaagggggagcagattatagcttcccttttctgtagctcctttattaaaatcacttgcatcatttttataagactcacactttcttctaagatgtgattcttacaaaggatacacactttattttagaacagtttagtaagcagtaaacctgggccctcaaagtctctataaaaaatttatggccaaaatgacattcatcttaatcacaatacccaaaccaaatagttgtccaaccatgcaggaaccctaagcagaaagaaattccaataacatatgctgaagttacaactactgacaacaaatgttaccagtcctaaaagaaccaagagctattgcttaccagtgagaaatgggatgagcatgatatattactctttttaactttcaatatcttgtcagtctgccaaaggactggtgcttaaaattcattttaaaattgtgcttctgggaattttagtactatcgcttataataaatatatcttttttttttccaattttgactataatatgaaggaaagacttgagaaaaaggctatgaaacagagatgtaaaaaataaataggtacaaaacaaattaaaattttctttgacttatgatggaattgcaccccaataaacccactataagttgaaaatagtcttaagtgaaaatttgtttaatacacctaacctaccaaacatcatagcttagtctagcctatcttaaatggttcagaata

SEQ ID NO: 51528 - DNA, 992 bp, Bovine  19866880887624
aattttctggtggagtctttagggtttctatgtagaggattatgtcatctgcaaacagtgagagttttacttcttcctttccaatttggattccttttatttctttttctgctctgattgctgtggccaaaacttccaaaactatgttgaatagtaatggtgaaagtgggtacccttgtctttttcctgactttagaggaaatgctttcaatttttcaccattgagcataatgtttgctgtgggtttgtcatatatagcttttattatgttgaggtatgggctcatataattctaactaaattccaaatcagttcttaatggttctaatttggctcatttgtctacatttcttagatttttttccccctcttttgttgatttggagttatttatatcatgcttttcttagaaaaattcagcaaagtaatctttaatgtggtatctttgaatctgaaaaataacatattcagcagaatacaagggaatggtattttatcatactgaatggctactttggcagtttcttattctaccattgattttttttccaaaataagttcttattttttttaaagaataatttccaattccatagtaatcacactaattagaattttacaagtaggtatattcttagaatttgttttaatgacattataataatctgaaactcattgtgtacactattgcagcttaaagattcttgacctggaaaataaacacttcagtgcattatctgctgagaaatagtactgtaataacctcaggaattattagaacatagctaacttgctaccatggggtggtttcagtacacacaaaaaattggattctaaataatccaagagcaagactacaacattaaagtgttgactaggtaattttttgaatctcagaatttgagacctaattgttttataagatacatacagactcctatttataagttcatcacattgaaactgtattattgtctcagatcattaggata

SEQ ID NO: 51529 - DNA, 1677 bp, Bovine  19866880902433
aagtttaaaaaacctaatttgttaatagtttcttaagataggtcctcctcacattttcatcacacctgaaagctatagtaaatagtgttgactaaatatacagctctcctgtgatttgcctgtaacctatagagtcagtcttagtttttatttttaaaaaatgtctgactattgctgacacgactgaagtgacttagcagcagcagcagcagcagactattacttaataacttcatatgctagcttctaggaaaaggtgttacagttggcttaaataatttatcaagcatcacaaatactgtattaaaatgctgaacataagagaaatcaacatgtgggcaaaagtaagaaaaattcccccaccttgcttttcaaaaagttaatattatttcctacaacatggcagctgaatgagacatagattctgttgctctttcaggatgagttaatgtacatgctgcgcaaactgctcctgaatatcggagactttcctgctcagacctctcacatcctattcaactacttggtgagtttcacctccagtaggttataaatgttcatttccaagtaagaagcaacaatgcaagaaaaaggtcttaggggattttttcaaataaattttcattaactgtgtgcctgaagttgcatcatagtcagctgaattcaccactgattatatgggaaaactcctcctggcacaatccctggcatgtgatgggcactcaataaatgtctgtttcctccctgtctctctttagcattgtagaacttcctcatgttggtccttaattttagttttctgttgaaaaatgtatgtgtcatttttagtcattctttcccttttcgtatctcactgtttaaaacacatacacacacacacagaggaaaatgttgccctagatacaaagtatttgtgagtgtatttttccatagcaactatctgtgctttacattgtcctcacagctccttcctgaaccctccagaatttgccagtttcttcacattctcctctttataccctaaatgaatatgcagtttggggactgttggcttgatgactgttcttttaaactacaccttaattcaagcagacagatggccaaatgaatttcagtgttgggagaatgtcctttcttcctaaccatcactggtcttctgcgagtggggaaatagaagagttatccatatgcatctgcaggaggatgataaatttaactcaatgctactactctgatgtgcaaacaaaagttgtaattccttccctgtgtttatgactgaggtggttttcattatgaatgcccacctactggtggacaaggggaaaaatataaataagtgtccaatccaattttaagttcagactgatagaaatatataaatagtacctttggatagtatttggtctctcttgtctaaaaatacttaacctctaggaattctcctcccttctaacttctttcatctctagatgttatttggagttggggagaaaaaagacccttgttcagaattctatctcctgtccaacgtttgccccagctcctccacttgttagacagagctctctggctggctggttgctgaacgcctgactggtggaagctgaagcccatggcttctgtaacttgcaaaccttgtctactcccagcagtgcttgctgggagactccatctcag

SEQ ID NO: 51530 - DNA, 1191 bp, Bovine  19866880965710
atggctatgtgcctgtatatattcatatatatgtgtgtataatatatatacacatatatgcacacatataatatacacaatgtaagatataaatacatatatttatattccttataagaaattaccttgtttttatggcatttttgtctttcatcttactgtttggctcataatatgatctcagtaaatgtttttttaagatttgttgttgttattctaggagtgtctggagttttttaatatcccagaatcgcagtcaacacattactttctcatggataaacgatggaaccttatccactataataaggtaagcctgtggagtgatgacgctcatggagagttgtgtcaaaagcctgttatgcctttcctgagggcagcttccctcaggggtgtgtcactgtttaacggtggggagtatggctcttggatcacactgtcttactgtcaacataggtttggactggccacttgaccttcatacccttcagtttgcttgcctgtaaagtgaaggtgatgatggtgtctactttagggttgttgtaataattgaagaagtcaagcaaggtatattgtcactcttattacatctaagtgaaagttaagttcccatattgtaaggacatatatctatttggaatgttaacattattcttgttccactatattaagcatgatcatggaaacctgatctaattagcaaaaggaagcctcaagaccactgacagcactttagaatgattttcttcctcttccagaatgtgttttagtaaattgcctctggctcccttgctcctgacagggtatttgggattgggaaagtgtatctggcttggggagtttgaagctttcctaaggagggggtatattcctgggattttgtagaatttggcaggagggcaaaatagtaagaatggaaaccattagaaaatacataacttatgtttgtctgccctttggggaatgagaaaatgagagtcagagtttagccgtttgaacgattttgtctttgtgtaaccccaccacagacctacgttcgggatatttaccctttcaggagatccgtgtctccacagctgaaccttgtacacatgcatccagagaaaggacaggagctcattcagaaacaggtgcctgaccaccacagttttatgctattattgtgtcatgttactgggatagactatctgt

SEQ ID NO: 51531 - DNA, 1680 bp, Bovine  19866880966112
taagacacaggcaggaaaagattatatatagttaataaatgttcaaaacttagatctggtttgttccatagccctgctcttaaccacccccaatacactagtctccattagaaatagaaggtaaagagatgtaaatcctgaaataacagcgtggtcaaagaaaattaccactgcaataaatggattgccttattttcagtaatatgtctgaaaacatttatacaataatcagatatacaaataattttttaaccaacataaagctccttggcttcaagatgatataaaaggttctgctataaatgaaattaattcctgtttttcataataaacaaaaagtagaagtttaaaattttattagattttagaaagccaaacaaagaattgtgatttacatgttatatattatggctaagacccagaacactgtgatatcactcaaattatttgtcataattttaaaattcactagattccttttttcctttcagtaagaaagaaagaaacactttgtattgtctttggtcttttgaaagtttaaaaaacatgattaataatataaaaaataaacttgcaaaataagaaatacaaaagatttataaatatgaaagaagctaaatatctttaatacaccaaattaaaacaacaaaatatttcatctctatcacttgttaaataaagaaaaagcaatatctagtaatactgaatacaagcatgttcatatacagctggagtacaaacaagtctacaacctttctacaagacaattgtgcagacttcactattagaaaactaccaaggaaatgtatatggacacattcagccaaaaaagatttccatggtaacaccactaaaatacagaaaactgtttgaataccaataggaaactgataaagcatatcactgtaaaagtataaaatgcattatatagtcattaaaatgatgtataagaatgtttaatgacatagaaaacttttagtgaataattaaaaaactgatacacatcttccatgtttgttattaaacctataaatgtgtagaaaaattaatatcttgcatcaaaatggtaactgcagttatatttagataaggagataataatatatttttacttatctatattgtttaaaattctcacatataataacaacaatgaaaaagtgctgtaaaatatagtgtggtgttgattacaatggtttatcttgattctatgaaaagcaaataaattgagttcttccatttttctccatatcattgtggtgtttcatatgtttcttcttactataacaacagaggcagccttcatcccagctctaccctcactagctaccatcacattccagaagataccaggacatgctcgaatgccattgagaatcatgctgggtgagtgaatgatttaagagagtagatgtcgaaaatctaaattttatctaaaattattaaaacgctgccactaataccaaagggaacttcaaataaaaaataaggaaagaggtattttactcacagagactttgtcctttgcctgtttaaatacactaggagcctgagctgattcagcacctgctgctgttgaaagaggagacacaaacaaccccaaacttagtggctaaagatcacataaatgcacttttcataccttttggatattcagttctgtcaacagactaacgtaaa

SEQ ID NO: 51532 - DNA, 1412 bp, Bovine  19866880982227
cattagaacggaaaaagtaaaactctccaagaactgaccatggtcttaaacctaagggcatttaccaactaaactatcatttagactgatgtggaagccataaattatagtgctggcaatactatataagaaaatgaaatataacttaaatgccaagtatttacatcctagagtgggaaaagtattattgttctttgcaataacatattagaatggaaagaattttaaaatccaagtttacttttcaacatgtgctcactttatagccatgcaattaacatatcttgaagaagagactggaaattcatttttaaatttttataaaatgccatattttgtgtgcccctctcttattgtgatagaaactataataattgttatatgaatgcattttgcctttaaaatgggaagaaaatatttatagcgaatgatatattagtcaccccaatgatagattactcatccacattttttattctattttaaatgtggcttgaagattaagtttatttttctttcacttctatttttttaaagtaaaaagtatttctggaattacataactcacatttattttctaaagaaataaatgtctaagtcaacctttctagaccttagtcctaactataaaatcatattatacaagaaagtgttagctgctcatttgtctccgactctgggaccccatgaactgtaactcaccaggcggctctgtccacgggattttccaggcaagaatactggagtgggtagccattcctttctccagggaaccttcccaacccagggatcaaacccaggttttcctgcattacaggcagattctataccatctgagctaccaggaaagaacatacaaggaaagggactgaattaaatcttctctaagccccctttccagctctatgattatattaaaccatgacctttagaaacaactaaagtgcccaacagcaaaaaaatggttagagcccactcatgataaaacgcatgtagcaatttatgacatgagatgaacagggtggcatatagaatagtgtacaattattcacacacgcaattataatgatctgtgtgttttagtatacaaacacacataggcacagccatacacgttaatttaaaatagaatactttttttaaaaaaaattacaaaattatttcagttgttaggggcataaaataggcaattttattatatatctttgtattttttaaattttattcgtagtgcaaaacaactttatgtaattagcaaggctgtttttaaaaatccacattttttaatctttattataagctgggtttttttaatctgggcatttttatcattaaaatatgagtgataaacacaggataagtaactaaatgtaggctagtcaattgaatgctgaattagaacaaatcaatca

SEQ ID NO: 51533 - DNA, 780 bp, Bovine  19866881029524
tagaagatagcagtgcacatctgagtcaacaggaatgaaaagaaaacaatataactcagcaagaaatcaaatggagaggattaaaaagactgaaatgttgaatttatgtatttcactgtatctaagatgtcttcagttataagacaccgttattttatgtatgatctaaaaaaattctgttaagttcttagtagtgaggactttttattttatagttattaaaaaggtctacttagccttatttatgcagaccttttgatcatatatccaccccatgcatgtgcacactcagtttttgtgtgactctttgcgaccctacagactgtaatccaccaggctcctctgtccatggaattttccaggcaagaatactggagtgggttaccatttccttctccagggtatcttcccaacccagggatcgaatctaaatctcctgtatatcctgcattggcaggtggattctttaccactgagcctcttgagaagtataaatatatcccatgtatatgtaaaaaggaaaatataagtgaaataaattggtgtaggtattcctaaaatgttttaacatttataaatttcaactcagagctgttgacatatatttttcctatagaataacttatgctccatcaagagtgttatttcttaaaaagagtgttccactatcccctctgacattctcctaagccactgacccttatactgcaaacttagatgctgaaatgatcacattttgctgcacaagaatgacaatcacaacaagatttctaccaggca

SEQ ID NO: 51534 - DNA, 1243 bp, Bovine  19866881050687
tggagcagaagaaagtgagagtttctagtggtaaagggaagatatggggactttacatatcatccagactttatctcagactggaggaaaatttacttattcattcagtgaatgtttattgagcatcaatttcatgcccttttcctgccctaatggaagtttctttctagacaggggaaataatcagtggataagcaaaattaaaggattacggagtcagtcatatagagaatgggcaatcaggtataagagtaggtactgggaggtaaacttctcaaactttacagcagagttgaatccactgagaatcttattaaaataaagactcaaatcagtgggtccaaggaggggcctgagtttatatattttaaccagctcccaggtgatgttgggattcccaggtggctcactggtaaagaatctgcctaccaatgcaggagacatgggtttattccctatgtcaggaagaagatcccctagagaagggcatggaaacccactccagtattcttgcctggagaatcccatggacagaggagcctagtgggctacactccatggggtctcaaaggaatcagacatgacttagtgactaaacaacaggttatgttgatgctgctgaaccgtggaccatgctttgattcgcaagaagttagatggcaaatgtccagacactcccaccgcccccaaaaaacttcagaataactggagttgttgttatgagcaagtcaaatgtgagtccttctcttcctgcagtagcactgcaaacttacaagcctctttgatgatgtaagagagatttgttccttttaacttctaaactttttcaatttcagccagttactttatgaaagatccattaaaccagtcctaatgagctactgacatttccttctttctgcccatgctcaatgcttattatgctgtataatgaattcttgtggctctggtttggggatgtgattgcatataaccctgggccgtttcttaattccagttctgttccctacttcataatttctttggacttttaacctcttctctgcctgaatgttcagcaccatcctggcctgctaaattctctgatctgttagcacttcacatcccttatgttcctctgtgctgagtagcaaagcttcccaattttcatatcccatcttcttgccacccataccctaacataagtcttggaggactgtgcatagtcacaggaggctattgaagatagtctctaatttcaaga

SEQ ID NO: 51535 - DNA, 1458 bp, Bovine  19866881112767
aatatgtgggtaaaaagctagactatatttccttaataatatagttcttctgcttaaatgtgtttttcctattttctgctgaacccataaaattagaagcaaaattttccagcaggtactatttctgatctgtgctttgcttttctaatttcctttgcttccataatataatacccttaaccttctgctgatggctcagatggtaaagaatccgtctgcagtgccggagacttaggttcgatccccaggttgggaagatctcctggagaagggcatggcaactcactccagtattcttgcctggaaatctccatggacagagaagcctggcaggctacagtccactgggtggcaaagagtcagcagagcacgtggtatccttccactgataaccagcctaatttacaatgacttccttcttaactaagtttaaatgttagcctagctccattcaagttttgaagactccatttgtgtagattaagttgtcatgctaaacaacaatattaattcctataatccaagaaactgtgatatctgtttatttcttagaattatcttcaacctccctcatcagtgttttatagtttttagagtataggtctttcacgtccttggtttattcctagatattttttatgtaattttaaacaaaatttttaaatctttctgatattttgttgatagtatttaaaaaactgcaaccaggtttctgttggttcattgattgtaacaaatatactgctctacatgggatactgatagtgggagagcgtatgcaagtgggggtacgaaataaatgggaaatctcaatacctctctctcagttttgttctaaaaaaactgtattaactggatactacacaacacttagaagaaaacataggcagaacactctttgacataaactgcagcaacatcttttttgatccatcttcaatagtaatggaaataaaaacaaaaataaacagatggaacctaattaaactcaaaacattttgcacagcaaagaaaatcaaacaaaatgaaaagacaacctgcagaatgggagaaaatatattcaaacaaagtgactgataatgaattaatctccaaaatttatagtctatatggctcaatatagcttccctggtgcctcagatggtaaagcgtctgtctacaacacgggagacctgggttcgatccctgtgtcaggaagatcctctggagaaggaaatggcaatccactccagtactatcgcctggaaaatcccatggacagaggagcttggtaggctacagtccatggggtcacaaagagtcggacacgactgagcgacttcactttcactttcatgactcaatataaaacaaacaaacaaacaaccctatcaaaaatgggcagaagatctaaatagacatttctccaaagacatatagatgaccaatagcacaggaaaagacactcaatatcacaaa

SEQ ID NO: 51536 - DNA, 982 bp, Bovine  19866881132394
cgacttagcatcagcagtgcatgtctagggactttcaatatttaataaagcttcatgcagcccctgcatatctaagagaaaggaatatctcaatctatcatgtaaaacactatttctcaagatgagactagcttatgtatttgaaacatttaacaagaacattatggttcttcttgttgcctagagtaaaattcaaattttcaaatggttttagattctaatcatagtaaagtagttctaattctagacaacagcagcattctctgttccctctcagggaaacctggcatcacaagctggttagattgttccttatctgattggagctttgtcagtaattctcatctcttacacctgtctgtaaggtctaagaggcaacgccacttcagatcattgactcatggcactggaatgaaactaacaattgggaatgaaactagaagtcttattgacaacaatggcatcgtaggctcatgaaccagagctatggcttcacgttgataacaagttgtggctagaacattttccctgcaattaaattcctgagacacttctttcttgaatcagatcaaaactcacattttaaagcaggtatttctgaacttcttccagcctcacctgtgagtataatatattaaaaacagagctgcaacctggcgcagggtgaaaatgggggggagggaagaaggggaagtttgagagggagaggacattcgttacggtaaggcagaaaccaatataacattgtaaagcaattattctccaattaaataagcaaagaagatattgtataaaaggaaacataaaaacattagagctatatgttccagacaagtgttgcaactactatagggtgtgttgtttaaaagtgaaacatcaattatcttattctattgtgaagacaaagtaactatagaacaaaacaagatatatggacctaacaattgcccttacaaaagaaaatggttctgctgttaataaa

SEQ ID NO: 51537 - DNA, 1280 bp, Bovine  19866881139038
tccaacccagtccatctgaaggagatcggccctgggatttctttggaaggaatgatgctaaagctgaaactccaggtactttggccatctcatgcaaagagttgacttattggaaaagactcttatgctgggagggattgggggcagaaggagaaggggacgacagaggatgagatggctggatggcataactgtctcgatggacgtgagtctgagtgaactccgggagttgatggacagggaggcctggcatgctgcgattcatggggtagcaaagagttggacacaactgagcgactgatctgatctgaatactaaggcatctttgtttccatagttcatttaagttccccaaacttactaaacgtgaagagaatttcttcagcccctccaggtgttttgcacttctcagccctgacatttttctattagtgactacaacattcccttacgtaagtaacgtcctgtttaccttggagctttgcctgatgaaagacaggcggtccacagaactgatgtccaggaggtcttccacgccgtctgccaggcccgagagagacgaacgtttcagccagtttcctagttaataatttttaaaaaaattagaccattatagcattttctcccaaatggattagacaaaaatgttggcatgggcccaaaaagcaatgaaaattacaggacccaatgtaaacaaaagtgaacaaaaattgtttttaaaatgtacatgctttgaaccaaaacattcactgttggactataagatcacatgactaagatcaggacaaaaagaacctgggcctcttgggtgattaaaagtgtaatccatgtagtccttgtcaaatttcacatcttccattaagtcctgtcgattttacctcctaagtatctttcaaatatgtccatttctttccgtctacatggtcaccacccagtctaagctactgttacttatacctggaccataatgcagctttctatctgatctcccttatccactcatgctgcctccagtatgttttccatgcagtgatcttctagaaaaaaaatctacttgcttatggcttatgttacccccctgttcaacatcccatctggcctctgtagggctaaaagatgaagagccaggtgacctgcaaggcccacaatactctggtctctatggctccaccattgtcatagagatgctcttgtctcagttcttccatgtccctccctcctaatacctttgcatattgcattgctaccacttggagtgctctccttcctccttctcccaa

SEQ ID NO: 51538 - DNA, 768 bp, Bovine  19866881143088
accctactgcagtcccggggggttggaggttggcatgaggaatggaaccaaaaagtcagtgctctggtattcctgaactgttcctctaactttggtttccagtgtctgcacagcccatttcctcacactctaaaacataaaatggaactctttgtaggtaaaatatgttttcaagagaaacgtgtccacatttggactgtgaaactgcaccgtttaaatactatgaaatggagttcctcctacagaccttatttaatttcatgttatcctgaacctttatttttctgaattgtcaccttcacaattatattgagactactcttaaaatccaagtaagtcagccacttaagcgtgtttaaagtcaagattaatctataggcctctatgagtgttattaatatcaatattctaattatactgacgtctttgtaaaagctcagaaacacatctgttaaattttcagattttcattttttatttattttttaatatttatttggctgtgccaggtcttagttacagcatgtagcatctttaggtgtggcaagcaagctcttagttacagcatgtggaatctaattccctgaccagggattgaacttgggccccctgtgctgggtgtatggcgtcttagccactggaccaccagggaagtccaaattttcagatttttaaaggtcatcgttttgacttatagtgatttaaaaaagataagaaccttaaagttggattcagttatttttgttctttcaacactatacagctata

SEQ ID NO: 51539 - DNA, 1164 bp, Bovine  19866881166297
cttgttttacagacccagcaccttaagtgggaagtgtaactgggtcagcataagtcattcttttttgattgacattatccacaaataagcaagtttcaaaagtgtggtataggaaagaaaagtgaagtaactggattgccttaaatgatgaaagacatctactaatctcatgctagatacaaaaccaaaataaaatgaacaaacaaacaaaaaaatctcaaatgaaatgaaagattatattgatagatcaggttcacaataaagatcagttgaaaaatcggagagaactgttctgatagatacagtgaatatcagaggtaaataagagttaatcttgggattttaggaaactataggaagaggatgaagttataaggaaaaggagaataaatcagaaaaagttagaaagaatggtggtctaatcgctcttcgtcagtagattgagataggcatttacgaggaaaaaagttaggttttgtttggtttctgtacaagtgtgggcactgaatgctaattcttgttgaaacacatttatgaaaataatttgaattactagacagtcttggaagcaacacagcacagtaagtgggtaatgactggagccatttttatattctttgcataaactgttataattgttgaccattacattatgaaatcaaaagaaaccgaagctattgcacagaatgtgctacgtttacagcctcactggaatgcaaattcttaccaaattgagtaggatccttgattttgatggttgattttctagttagatgttaagaccagtaattctaacaaaggttaagctttcatattaaaaaaaaaaaaatcactgactgttgcttttctatgctaattagttcttttgaattttcatttttactttaaacttgaaagagaaaaaaatatattctgaaaatgactttaattcaattctatttaatggataacaaggtaggaagtattcatttcttccattagttgttttgactcaaataactgttttgtacctactgatagtctgaatttctaattcttaaacacaatctgtttttaatacatgttttatttgaaaatgtaaaatataagtactaaggggtttaaaaaactgaatgaaaaggaagccaaaccaaaataaaaccaagggacttgaaaatttcttaa

SEQ ID NO: 51540 - DNA, 815 bp, Bovine  19866881172564
tattattaactaaagttcatagtttagattcccttagtttttacctaatcttttctttggttctagaatctcatctaagattctacattacatttagttccatgtctcttcaggttccttcaggctgtgagatgttctcagactttctttgttgtggatgaccttaaaaaatactggccaggtatattacagatgtctctctgttgaaatctgtctgacattttttcatgattagtcttcgattacatttttgggagaaagaccactagcagtaaagtgttcaaataagcttggccaatgctgagttacatgggcatgtataatacaagtttcctgacagcttttgctcttttactgcacacggcaatctcagggtagggcactggtgtgcgaagcatcccaagtaattggctacagaaccttcatttgatgctacgtttattaacatctctaaaaggatttggaaaatacttagatttgcatttcagtccatgtttacctctgggagttcttgccacagacattcaaaggacataaaataatatgagcacccacaacttccagcaaaatgtcacaagttttcccccagagagaggtggaaaagatttctcagtggctaaaaatcttcatcttgaacctaaaaatccaacactgaaatgagcagtgtgttacttgataatcatccatttaaaacattatgataatttgttttcaagagaacaggtatgcaaaagtgaattccttagtctttaatactttcaagtttttaattctttctttatagttagtcgaaaactaacgtggaagaaaggcaa

SEQ ID NO: 51541 - DNA, 734 bp, Bovine  19866881279902
catacttacagctaattatttttcactattcctataagggtttttcctagatagagcaattgggtaacttatttttaaatagtatgtatatattcacacagtcatttttaacaaatgaaacatttttaaagttcaccaaagttttataacttagagattatggcattaagattttagaaaattgctttccttttaacatattttgaaatcaagaaaaagttgctgctatacacagaacagtaaaaggtctaataataattttgcacttacactgatacatttttcctaacggtatactcatccaaatcgtcatcagagctgctatcagttgcatcagaatccagaccctcttcaacatgagacaacaggcctgtagcagacagtgcaaatctttggatttctgcagctgtataccgtgcaaagccattttttgtgtcattccacaatttagtctctgcagtcaatatgttgatgtctggcttaatttcagtgcatttaggtaaactgttatccaaaattgtggtaggttcatgaaaaatctttactttggggagcctgatgtttcatagaaaatttcatttgttgaccatagtgcttaacaacatgctttgccaggagcatctgcaaatgtttctgagttcttctagcctggctaagtaaaattttctgtttacttacacactgaagtaaacgagcattcacttcctcctccttttcagcagcggaggaactaa

SEQ ID NO: 51542 - DNA, 1181 bp, Bovine  19866881314248
ccctacccaatagaaattgcaaagtgatacccagtagatactagaactaaaatgctatatgcaattcaaaagaaccaaaaattatatgttagtagtaatattaaaataagcgattgttcatggatatgtttttttacctaatggaaagacaaagataaaagcagatcaagaatgtagtgggtataatatagttaaaatatatgtaaatctaggtttagcataggatatacaacttaatatgatcattttggttggtaaaattaagaatgtgaatatttaggtaataatgaatataatatagtacagttaattagctgtcacaaaaatattatttcatatgggttcagttcattgaagattttcttctctcagagaggttgggacttgaagcatctaataaaaggaaaaaaattttaataacaataacagtagagtggcttaattgtaaaaattgaaaaaaaatgttaagacaaaattaaatgtagaaaaagtcacagcgatctttgatgtcagcatactaggaaccatttgtggaaaattgataaaaggggtattttttcctaaattattaatacttaagcccagcatcttattgataaactttattattagaaacaaactgagaacacgtcaaacagacaaaacgtaaaatactgtgaaagtatgtggagtgatgcatataggatgtgctatctgactgctattaattctcattttctgcatgcaattattattcaaaagttgaatgtctgtagaggataagtcaccagccatagttaaacgttaatggatccagtgacataatttaaattcaaggcctcattcaaaggaatgtgaataaaatgcatttgtttgggtttttatggccactattaaaagtaaaggaaatgaaaccataaacaactatgttcaaatattgtcatagctgaatcggctttgtggcagtacaaaaccatagttattgaaggggacactctgtttaacttacccagcccatctagattgtagtttgaggttaaaaaatgtacttggcaacttgggcaaaatgcagagtgctatttcatgagttcattttgatgtggttcaattttctgtcgttttaaaagcctggtacaatttacacattttattttttttcctaagccatacgtaagaccttagctcataattaatgtgataca

SEQ ID NO: 51543 - DNA, 828 bp, Bovine  19866881650250
tgttctttctttctatctagaaaaaaaaatctttaattcgcatattgattgccctaaatctcatgggaaactatgcaaggaaataatcatgaatttgtgtagagagatatgttctttattttttgatttactttccaaaattttctacattactcttgaaatttagaaaaatgctatgtaacatgtgaaaaaggcatattttgaagattcatttttttcaaagggcacatattcttggttcttgtttataaatagactgtgttctaaagttaactgtttattaattacattacatagagcagtgataaattagaataggatgccctgagttctctgagtgatgtttgtgatgatgatactgatgatcaacaaggtaaaaaacagactaaggtccaaataaggaaaataagagcagtcaactcagttctttttcttattcatccagggtcaatatcgttcacttttggatagcatgctgtgccatgcttagttgctcagttatgtccgactttctgcgaccccatggactatagcccaccaggctcgtgtgtccatggagattctccaggcaagaatactgaagtgggttgccatgcccttctccaggggatcttcccaacccagggattgaacccagaactcctgcattgcaagcagattctttaccgtctgagccaccagggaagcaccttggatagcgtatataggttaaataaattgttctgtaatcaagagcagcaaaagtgctaccttgggctaagaaatcagtgcctaattgttttaatagctttataaggcagctgctgcttgaattatagaacaaactgt

SEQ ID NO: 51544 - DNA, 3246 bp, Bovine  19866880945732
atttgtggggactggaaggagctaccacagaacatttataaaatgtgttatgttcaagaaatatttcttaggagacgactgaattgtattatattccaaggcttccgagcatgtgaggcacagcaggtccaacttctgctaacatgcttaaaaatgatatttgggtgattttatgcctttagaaagaaaaaaaacaaagttttgcaacaaaggctcacactcactagtcttggcaccacaaagctttggaaaagagtctggtcaaccatcaaaatatggcttttcactgatgaaagattcagtatacagattttcatttccagagggatatttaaaaacaatgtaattaaaatgtgggttagacagaaaaaaaattgctttttccttttcttaacaagtacgtttatttgaagagatttaaccagtacttcagctggtttcatgagaaacagccttttctaagtctaccagagtctctaatcatgagggcgattgtgacacacgtattgctccattcaatcaataattctgttcagcgccccctccatttattacaggattctcattaagtgactgggagaaggcaatggcaccccactccagtactctggcctggaaaatcccatgggcggaggagcctggtgggctgcagtccatggggtcactaagagtgggacacgactgagcaacttcactttcacttttcactttcatgcactggagaaggaaatggcaccccactccagtgttcttgcctggagaatcccagggacggcagagtctggtgggctgctgtctatcgggtcacacagagtcagacacgactgaagtgacttagcagcagcagctgggtttactaggtctactgcatttctaggactgtgacactttcctgatcatcttctcttactcaaaaattatggacttaatttgaattattgacaattaggaatgcatcatgggatggaatggcagaaaccaacaaagatcctttcctgtgtaaaatataaattctaacaggaacagataatctttaacatactaaatccattatctatatgttagagatgttaagaattatgggacattcatcttcataggaagtacttagagtcaggaaaaggaaagttgcagtatttagtagagtaataggatagtcagatatttatgtaccctcaaattcactttctggcttaagctaaaaagtggatcttttataaattaaaaatcctgttcccagagaatgactcagatcatcacccccactaaataagtaaatatgtttttattttttagggatggaatatctaagaaaccatgaaaaatcttagcactattgatgaatttgtgctgctggggttgtctactgacccggatatccagaccatgctctttgttctcttcttggggatttacctcctgaccctgatggggaacctgatgatgatcctggtgatcagggctgatcctcacctgcacacgcccatgtacttcttccttggtcatttgtctttcctagacatatgccactcttcaatcaccatacccaagatgctgcagaatttcctgtctcagaggaaaaccatttcagtgtggggatgcattacccagagtttctttttcattttctctggaggcacagagagctgcctgctctctgctatggcctacgaccgctatgctgccatctgtcaccctctgctctacactatgatcatgaatggacctctgtgcactgcaatggtcagtgcagcatgggtgatggggtttctgaactcactagtgaataatctttgtacccagaacttacagttctgtggtcccaatatcatctcccacttcagttgtgaactgccttcactcttccctctgtcctgcagtgacaccatgcctaacaccatcctgctggctgggtccactgcatttctaggacttgtgacacttcctccgatcctcttctcttactcaaaaattattcttgccattttaagtatctcctcctctaaaggccaaggcaaagccttctccacctgctcctcccacctcaccgtggtgctctcgttctatgggacagctctattcaggtacatcagcccctcttcaggatcagtcctggagcaagttgtctccatacagtatggtgtgatcacatccttgataaaccccctcatttacagcttcaagaaccaggaggtgaaggcagctctgcagaggatactgaggcagcaaatatgtgtctcagggtaagaaatggcaaggagacctttcttctacaagagaagcaatctgcaaaggaagagaactttgtaaacttagagctcctgtggaacttgatttttaatgtagctaattatgtttgtttctcattcaaattgaaaagacttccaaaagctgagagaaatatagtcagagaagtatttggcccatcctgcatctgacagaaaaggttcagagacatcagctccttccatagcctttggaaactaatacagaacagtgacttcactacagtttaggaggcagaacaaggacaaagctctctgagcctaggactttacctatggagttaccaaatgaacccattagtagaagggcaaagaacaagtaaccttgacagatttaacattccagaatggacagttcattaccttttgttcactggagctggtggcaccataggcattagatggcaatgtgtgcctgcaaatcatcagagaatagtgaaagcaaagaatgaacattacatctatgagcaaatgaatggataaagaaaatgtggtacagtcttacagtggagtggtactcagtttataaaagaaggaaagtctgcaatgtgtgatgacatagatgaatgttggagatattgtgttacgtgagaaaagccaatcacagaagagaaaaactgcttaattctacttatatgaggtatctaaagaggtccacttcatagaagcagaaagtagaatggtggtttccagggcctggggaaaggggattgggaaactctgtccaatggacatacagtatcagtcatgcaagataaaaaagagatccattacactgcaatgtgcatatacttaacagtagtatacataaaaacttaagagggaaaaatctatgttgtgttttttatcacaataaaaaataaataagagtgaacatatcattacactaaatatcagtattgcattttgcaacctcttgtctgaaggcacacttcattttaaaacatatcatcatatttga

SEQ ID NO: 51545 - DNA, 1199 bp, Bovine  19866881166810
ctatgacctttttctcttaaagatccaggaccctaccattttatcgaatgtatggcttttagcatattctccagttagtaaaaataatgatagattcatgaaactaataattttactaaaacagatgtttcagaatgagaaaaatggatcaatttgttcataacaaagttttctagacaaggtgattattttaaaagaaaataaagggagctttccttcctataactttatgccattctctcatgtatttctaatgtaggttgtagcatctgacgttgtgagtactcaagagtgctccttactactgcaaactcacctaatgtccttttctatgcagatttattccagttcttcactatcctatattttcatttcagcacctgatatgctgcaaatacttttccaaagttcttttcagagccaccttcacctccttgtttttcagactgtaaatgaggggattcagcatgggcatgatgacagtatactgcacagagaagatcagttctgcaggggatcctgaatttggcataagatggcggagcaaacctgagccaaagtacagtgtcactgcagtgaggtgggaagagcaggtggagaaggccttgcttctgcctgaggtagagctgatgctcaggatggtggtgataatgtgggcataggatagggagaccaaaaggaaggttcccagcccatgtagcagagtggaacagagcaaggcaatgaggtttctggagatatcagagcaggacagggagaggagagagggcatttcacagctgtagtgagggatgattttggcctcacagaagatcatgttcacagctaggaagatgttgatgagtgcgtccagaaagcccaggccccacgagccccacacaagctgaatgtacagctttttactcatgatctgtccatagagtagagggtggcagatcgcagcatagcggtcataggccatcactgagagcagacaggcttcggtccctgcagcaacaaacacaaagaagacctgagctaggcagccctctaccgatattgttttccttcgagacaggaggttctccaacatcttgggcactgtgactgaagagaagcagatatcaacgaaagagaggtggctcaggaagaagtacatgggtgtgtggaggtgggaatcagccttgatcaccagcaacatcatcaagttccccattatt

SEQ ID NO: 51546 - DNA, 2237 bp, Bovine  19866880149141
gcaaaatgataggatactgaaagaggagttccccaggtcagtaggtgctcaatatgctactggagatcagaggagaaataactccagaaagaatgaagggattgagccaaagctaaaacaatacccagctgtggatgtgactggtgatagaagcaaggtccagtgctgtaaagagcaatattgcataggaacctggaatgtcaggtccatgaatcaaggcaaattggaagtggtcaaacaagagatggcaagagtgaacgttgacattctaggaatcagcgaactaaaatggactggaatgggtgaatttaactcagatgaccattatatctactactgcagacaggaatcccttagaagaaatggagtagccatcatggtcaacaaaagagtctgaaatgcagtacttggatgcaatctcaaaaatgacagaatgatctctgttcgtttccaaggcaaaccattcaatatcacagtaatccaagtctatgccccaaccagtaatgctgaagaagctgaagttgaacggttctatgaagacctccaaaaccttttagaactaacacccaaaaaagatgtccttttcattataggggactggaatcctaaacttaactctacttctaatactaacttcaacccaaccctaaccctattcctactttgacctgaatcctaaatgtatccttcatgctaaccctacccctatctcaaactcaacctgaactccaactctaaccccatcttcctcttaaccctaatctcaaccttaactctaaccctaactttaacctgaaacccaatcacaattctaaccttgtattagtcaggttctccagagaaacagccaatttgagtgtgtatatacaaagaaattttcaggaattgctcacatgattatggaggttggcaagtccaatatctgcaggctgcagacccaggaagagctgatgttgcagctcaagtccaaaggctgtctattggcagaattctctctggctccagtgaggttggtcttgttctggacagactgattagatgagccccacccacactggtgcttcccaggtggcccagtggtaaagaatgtgcctgacaatgcaagagacgaaagaaatgtggcttcgatccctgggtcaggaggatcctccgaaataggaaatggcaccctactccagtactcttgcctggagaatctcatgggcagacgagcatggcaggctacatttccatgaggctacagagactgggacacaagttagtgactaagcacaagttagtgactaagcacaatgtacatatgatacaatacacccacattatgaagggcaatctattttactaaaagcccctgatttaaaggtcaatctcatgcaaaaacacccttacagacacattcaaggtaatgtctgaccacatacctgggcaccaccacccagccgagttaacacataaaattaaccatcataaacttcaacccacatcccagccctaaccctaatcacctatctcttctgtaaagagtccattctccctaccaagctgactgtctctgcaataggctggatgaccagactcaaggggcccacctggtgggtggagtgggtggggacaccactggcctcatgcagccagcccgccttggcacagggggttattaacagccagcagtgaggggaggtgggcagaaccacagcaggaatgttatgttctcagacccgggcccaccaggcagcatggacctaggaggtatttgctgtacagagtggtgtgacttcagaatgctgttttaccatttgcccttcgcgttgcatttaagtacaattgtagccaattatgctgatttctatttcacaggcttagatttaatggattttgaatacatattctcaatctatgtaaattatctactctggcctcacatccagcgatctttatgagaggactctggtggggtttttcttctcttttgaggactgtaatttttataggaggatttttttaccaccttctgttagcaccggctcactgggcatggacccaagaaagattcaaaggcagaatgaaagagcattagtgaaattcatcagaacaagggtacactttgtggagagcagaagaaaagcaatagatggccctgattgcgtatgagtcaacgcctgtgttttggatacatgcaaagaactaggattggcgctgcaggaaatcaaatacaagagagatggttaccaggcatg

SEQ ID NO: 51547 - DNA, 1361 bp, Bovine  19866880365755
ccagggtcatattccacaccagatgctaattccttttttagctgcaagatcagatcaaacccatttcctggttggcaatgggcaactttggttagactaatgcatgagattagaagtcctcagactgctgtgactcgtatgccaagaaagtctgcaatttaattaaaacaaaaatgacaacaacaaatcacagaaaaagtctccccttcgggccctgaattagaaggaacctgaacctggatctgccatcagttaaccaagatctcagggctccttcctttggccttcaagactcattgttgacattgtccttgcacaaggacatcagtatgggtggtcccttattcctgactcagactttaggaaaacaaacaaataagcagtggaggaggcccagattctcagtctctaactgccctttgagcccaattcaggatatgcttctgggaaagaagtgtgtctctctcctgggctaatgtaaacggatgaaaacttaatgatgcctcctccccacgttatttttacaggaaaatgttccctgaggtgtacacgactggcttgttacctctgggacacaaatctcccaataagatggtgactgtgtgtcctcatcataaggatctgattctggaagagacctcacagataatacagtccaaactctataatttttctctgccttcttttagaagactccaaggtaaagggatcaaaggacttgccacaattacagagccatggtctgtaacgtgtcctctcagtgtagctcccgaccatctgacagatacagcctcacctgggaatgtactagaaagggaacttctcaggccctgtcccagactttcagaatgagaaaccccagggatggggcccagcaatctgttttaaccacctgaccagatgctgtaaagtttgaggaccactggattgtggtcctcaaaaaaacatatatttacaggggcagaaagttggggtggggaggcagactttattatctgccttgaaagaaaagtgaaagtgaaagtcgctcagtcatgtccaactctttgtgaccccatggaattctccaggccacaatactggagtgggtagcctctcccttctccaggggatcttcccaacccagggatcgagcccaggtctcatgcattgcaggcagattctttatcagctgagccacaaggaaagcccaagaaaactggagtgggtagcctatcgcttctccagcagatcccgagtcaggaattgaaccagggtctcctgaattgcaggcagattctttaccaactgagctatgaaggaagcctatctgccttgagtgtgggtataaatagccttgtttttctcctttctttgcaaca

SEQ ID NO: 51548 - DNA, 2666 bp, Bovine  19866880376672
taaggaagatctgctgctgctgctgctgctaagtccttcgtcgtgtccgactctgtacggccccatagacggcagccaaccaggctcccccgtccctgggattctccagacaagaacactggagtgggttgccatttcctcctccaatgcatgaaagtgaaaagtgaaagtgaagtcactcagttgtgtctgactcttccgaccccatggactgcagcctaccaggctcctccgtccatgggattttccaggccagaatactggagtggggtaccattgccttctccgcctaaagaagatcaaccctgaatattcattggaaggactaatgatgaagctgaagctccaatactttggccacctgatacaaagagctgacttattagaaaagagaaaagaccttgacactgggaaagattgtgggcaagaggagaagcaggcgacagaggatgagatggttggatggcatcactgactcaatggacgtgagtttgagcaagctctgggagacagtgaaggacagggaagcctggcatgctgcagttaatggggtcgtaaaaggtccacaggacttagcaactaaacaacaacagcaacaaaaatgttctgcaagcctttaaattaggagagcgccagaaacttgagcacacctctccttctgtgaccagaaaggaatgagggtgagtagagagcgtggctgagtgtatctcttacttggggtccatgagccaccttaagtctgtgggctgaaggggtggagtctgcagggacttggatgaggaggggctgactgagctgtttggggagcacctgtcttagactctcaaaggtcactccctgtgttagccccagcttttcctcaaagcaagagtcagtcaggaatattactggctgtgtttgagtgtatttgacatcctggagccagataggggtgacactctggcacacagtccatcttcacgactcctccctccttcccacaccgtcactacatttcctaatctgagctagatggccttgggttctgtcccaggtagaagtgtggtgtgaacacccaaaaggagtgctgagcccaagaccaaagcccctgctcccagccctcctgtctgcatgttgcctgggatgcctgagtaaacatccacctgccctgggagactagcggagctgaatctgacttattctccactccctcaaccccagcctgatatccagcacatagcagagactcggcgcacttttcattatgataaacacctagcaggtcagggcgccctggggcctggcacattgcacaagctcgggggtcctgcctgctctgggtcaggttaccagcccccagggaagggtgcagattcttgcgtttgttttcactttagtcttgattagtcgttggaccttgggcaagggctttaatgtctccaggctttggttttctcctctgcaaaatgtgcccgcggagagtagaggcccttccctccccgccacccactccccacctccgaaaaaggcttttttttttttaatatttatttatttggctgcaccgaggtcatagttgcaacatgtgggatctagttccctgaccagggattgaacctaggttccctgcactgggagcctggagtcttgaccactggactgccagggaagtcccctgagaaggctttttaagctgggtagcccgggccgtgtgcacgcctcggctgacatggcaatgaacactccaaagactgcgcatggagcctctggctggtgcttaggacattactggtggtgctgcagagtgagtgaggcagagggaccctgtgcactccctttggctctgcccacacgccctcccacccgccatgacctccactgctgggtctctcacatctcacatgctgctttgcagtgttttttcaggtgtcctcatctcggctcccatctggcctgtgagctcccagagggcaggtccctggtgtccgctgagctccggggctagctccaccgtggctgcacgggcagtggttatacgaggctggggccttcggctcctgagggtacgaaagtaagggggttgcagcacccaccccagttaccgagacgcaagaagacatgggaggctgtccaagccaaagccactgtctggtccaccagctctttctggaagactcagtggggtttctttcagcgcctgcaggtttctgtcaactgatttatctcaagaggaactagaggggggacaaggagaaggcagcaactgacagcttcttccagagcctcagttttgccagcagtgaaatggggggagtggtacctgtctcctaccttcttcctgggggttctttgataggtgaaacttttcacttttaaaaggctcagatgaaaggctctgatgggatgaaaggatcttggggccatattaagtttctccacagtttttgaagcctgagaggagctgctggaggaagtggtcagctgacaggtacttgtgaagccgcccagaaggtgatgctgggcagaattagcatgccaatcagccacacctagggcgtgagggcagcagggagcggagcccttatctggggcaaaacctgtcatttccctgaagagggggttggggcaatgttctgagggagaggacaaagcccagacaggcaaagcctcgggcaagccctcccctc

SEQ ID NO: 51549 - DNA, 1419 bp, Bovine  19866880379026
cttccttcttacttgggaactggtactcttgatttggacctttcagcttaagtgtcccttccccaggaaaacctctggtgaccttaactagctcccatctccatattatgtgctttcacactgaaatggacttttctctccacacagtacttaccacagccacaatttacattgtatgtgtgttattttgcttcacctctgtaacccaacacccagaaaatcttgaacccattgttgaatgaatgagctgcctgtgaaaaggtaagttagacctttgaaaatctaaattatcttaccggtaacatggttcttctgtctcaaaaaatatattgtgaatatatggtaaagagcctacaagtttgcccccagtgatcctcaccgtgggtattcatggccttgtaaagtcaccacccaaaattcaccaggagcaacagaatacagcagcagtgctgacgtattacttccaaagctagggcatgagggacactgccactcttgctttgttctcctttgcatcatgttctctggaggaagacagccactgtgttgagaacactccagcaaccctttagagaggctccatggggcaaggaattgaggtcctcctgcatacggccagcatgaacttgccagtcatgtgagggaaccattttggaagcagtctctagtcccagtcaagccttcacatgaggcttgacctcgtaagaggtcaacataaccctcataagagaccagaaccaccaccactcagttagtgtgtgtgtgctagtctcagtcgtgtctgactctttgcgaccccatggactgtagcctgccaggctcctctgtccatgggattctccaggcagaaatactgtagtgggctgccatttccttctccagggaatcctcctgacccaggaatcaaacccaagtctcccatggtagacagattctttaccatttgagctaccagggaagcccaccgctcagctaagcagttcttcaatccctaatccacagaaactgtgagagagaataaatgtttattattttaagctgctaaacttgggcacaatgtgttacacagcaacaaacaaccaagtatataaaataagacaacccaaaggtccaaaggacacctcatgtgctcttctgaactatcccaggagtcaccagaagcatcagattcagattaaaaagagtgaaaaagcattcaactctcacaaatatgtaactgctctcgaaagttaattaatctgactttctgacttttgcttttcacgagtctgaattatagtatctggatggaagtgcacatacaaccaccataccttttggtccattctccagggcttcttcggcggcttctggttcagtctctttttcagtgttgtcagtgtgggttttggcctgtccattaacgacatcatatcgctg

SEQ ID NO: 51550 - DNA, 959 bp, Bovine  19866880388198
aacagccctgacaggttactagcagcccccacagagggcagaggcttgtgctcaggagcaggttgttcagatcccagctccacctgctgcctaggggctgtgagaagtcactgggatctctttggacctcactttcttcgctgaactggggaaaagaaccctatggggctgctgtgaaaattaaatgagctactaacggcttcttagaccagggtgtggcacatgtgaacacccggtaaacacaactatactttttattcctttaagggaaaatggagttaagagacattagagtgtttgctgctgcacggcacagtggactctgccacactaacaagtccggtcattaagctccttgctttctacaactacagaacaaggggcctggcagacccttcttaagttcctgcctgtgggtcacgtctataattgagcagcagactctaccaaggcagactggaggtccccagctgggaggtgggagaggtaggttgagactcagcctggcccgtggccaaagtctgtgctctctgccagtcaacacccaattatcattcacagcagggtctgcaaaacatttcacttcctctgttccagaaattgtgtgcagcttggtagtaaggtcaggaaagggccgtgcggcaacgctcaccttaaccaccatggttgtgccttcatctttaaacaaggctgtgtggtcacagaggcacacagaggcttcccacacaagtacccacagggctcaagtggagatggctgcagagatgggcagagtccacccctctcctgttatggctcccgggccaggcacgtaccacaggcgcttcaggtggggctatccggagaccctgggacaggatgcccgcgaagttggtggtcctggacccgtgccacagcagcctccggttatgcagctgcttaaacggcttgtaacgctggctttccccttcgcgctctat

SEQ ID NO: 51551 - DNA, 878 bp, Bovine  19866880424763
ctttgtagaggctgccttcttaacaagggacacaagctctcaagtttgcaacaaccccccccccccgcccagcccactgggacagacaccgttcttggtgtttagtgtgggcctgtagcttgggctactgctcattttatattgactcagtttatattgctacttgcctggctgttgtaggcatttgtgtttggaacttcctaatgcagaaggaagagaatggtatattgccaggagggtttagagatggcctcagagaggagataagtatgatcactgtgcatgcttacattagaggaaagtagaaacgacattccaggcagaggggataccatttgctaacttcctgagggttaagagagctggcaggtttggttagctttagagaagtagagaaaagcctgaagagataggaggggtcagatgtgcagagcctagaagggtaggccagaggcagtcttgaagctggtggggagtcactgaaggattttatgcaagggagtttcacaaataacttaggcagtggtggaaggagaacctggagaggaggcaggaggtagggagctcagaaagaagctgctgttagcccaggtgaaaaccaggcgatcctggagaggagcagcttaaggagatgacaaggaagagacagattccagagatgtacaacagagccagccagagtcagtaagggcaagggactgaatccttttttatttaggtggtgtgaacttagggccattttctggacctctgtctctttatctataaaaagtagaaattgtttctgccctggcctttcaaaatccatcaagatgtgaaaaggcctaaattatactgtgaaagtgctttagaaactgtaaaattcctaacagataaga

SEQ ID NO: 51552 - DNA, 2499 bp, Bovine  19866880489792
gaagacgagcctttactagcagggtttgatgtcttccctgggaccaaaataaggtatgaacttaactctattgtccataagaactaaagacaagtaaagtaggagctgattatttctcaacccaagagaacttagattcaccctttcatctagccaagggcagatccacattttgaggggcctgaaacaattttagaggccctctttaaggaagaccttctttctctaccacatacaacttccagtgccaggagcctaggccatggtcgtttttgtgacaccacatcagactctgctcctttgtgacacgctgggcaagtcttcaaagtggttggtgggagtgttcctcgaagctgttcctatacgaggacagctagcaataactccacacaccacataactgtgtgccccacaccccatactaaattcccagcacagcttcttcttagcccagtccccaaatgcctgtggccactccaatatcccttgacaggagggaaaggtgatggagggcaagttggagtagaaataggccttaagtagttaaaatatctttctttggtaactttaataaaaacatataaccacaaaagcacatagtagggtccctcccagagccttggaagggaccggtgaaggaaggggcttaagcttcaacttcttttacttcacagttaaaagtgcttctgaatccaacacctgtttgttgattatctattgtatgccaggcgctgttgccaacactaggaatacagcagtgagtaaaataatcaatccctgaccttgtggcacttacattctacttaaaatagatttgtttccctggctttggaggacaggggaaatggatgtgttggccactactgcttccctggttgctcaactggtaaagaatctgtctgcagtgtagtagaccccatttgattcctgggtcaggaagatcccctggagaagggataggctacccaccccagtattcttgcctggagaatccccatggacagaggtgcccggcgggctacagtccatggggtggcaaagagctggacacgactgagcaactaagcacagcctgactttcagtcaatatttgtggaatgaataaatgaatgatgaaatgaatgaaacatctgagaactaagaactcttatgccactgagacttaggacctcaaaaaatgaagttgaaatgaaagttgctccaaattaaagttggagcaagaaaatgaaagttgctccaaaagccaatgaaaaattatagggatggtaatgacatgggcgttgcaccacgattttccaggacctggcaggactattgttctgacatgccttggcaggtaaccagagattcctgctttctctctacattggcagcctggctagtacacctccaaggcaggtcctccctcgggtctgaaaggtgaaaacagggagagacaagcgagaaccactcctgtgtggccgccgtctctgcttctgctccctggcttccaggagctgctgaagacatggccctgtcacagctgcttatttcacagaactcacagaggcgggcaacctctccctcccctctgccctcccacggcccttcccccatctccagttcataaagacagaagacaatgcacacggattcctgtcaccaaatctgcctgcatctgagtccatcttctcctcttccgctcctgttgagactgaagtcccagctccatctctaactagctctgatgcaaattgtgtgggcttcagtgaaacactggtctccactttaaaaatcgggataatgatagtacctattttactggatgattatgggcattaaataagataatggacataaaaggcttggcagagggcctgacactgtgagcatcagtccagggccctcctcgttgttctgagttctatcccatcctgcctcctcaggaactgcttttctatcagttcttcactctctacttcttcagcgtttcttgtacaggctcctatccatcagcattttttaaaactcaatttatcccaattttttaaaatgacaatgaaattaaaacctttccttgaccccacatgcccctccatctgtcattctcttttctcctccacttaaccttctttaaacagtggtcccctctcactgtctttccttcctcctctttttttctgaatccacccatcactcctccaagccagtcttaccaagatcactaaaatcttcctgtggctgcaagacccaatagacaatcttgagtcttttcttccttgacttctcctcagcttctaacactgttgattgtcccttcgttgaaatgccttttcttcccttgaattccgtaacttcacactctttcaactttgcctcctacttttcctcctattttccctcgtcggtctcctgtgtgagttcctcttctgtgggtccttcagcctctgccctcccctaagtggttagattctctcctagtctagtctcagtgtgcttctcttctattctcctctctcc

SEQ ID NO: 51553 - DNA, 2558 bp, Bovine  19866880516363
tgattttaatatttacctgaggcctcccctttgtttactacccctgcggaaaagtatacaagtcataagtgatgcttgatgaatttttgcaaatgagtacactgtggtaaccaaccccccacaagatgtttacttttgtcagttagctaaaatgagagcttctctgcttaagtatttagaagttgagctctggagtgaatactacctggggtactacttcctcgttctgtcactcagttatttaaattctgccttcctttactcagattatttataaacttttagcagagtacctagcagttggtatcctgtgactgcctatgttgaagaggagagattaccaagaatttattatggagtgtgatcaacttttattaagcacttcatgcaggctaggcagtttacagggttgcatattcattaactcagaaatactgcatttattatactttattataagtagtacaagaatatatcaaatatataaaaaatatatcacttttttccttaattgaacatgggaaaaatgtggttttaattttaatatttctaaaagatggattttattcgatgtgtgttctctgccacgcaacagtgatagggccacaaaagaaaacagatttgagcttcggctgctttggtggaagtacagtatctggaatgagagaagagagagatggtcctgctctcatccacgcagttcagacaatcgctggatcctgctttcagtttgagggatcgttcacagagttaaagacaaaatggagctaattcagaagaaagcaacttgtatattgtgggaatttgaatccctgccatcattataatagctgctgcttagtgagtgtctgctctatgcaaggcactgtgtcaagactttggaacacattatttccacccctcacaagaaagagaagttattttctccattttttgatagcaaaactgaggctcagaaaggttatctgtattttgtacttagtaaataacagaactgagatttaaacacaagtctttaggagttaagtatgagtgaataagctgaaaatattttgcctaaagaatagagaactcagggcaagtataatgtgcagtattttgtggcatttgtttgtttttgaggtctgatctgttagatgtgttttatttaatgtcgaggactagaaatagacgctgtggataaaattgagaagaatctaatcagaataaagagctaaaaattacagctatccatccaaacatggaatagactgtttgagacaatgaattcccatcaccaggaagtgttcaagcatatgttaacaattactaggtggttatgcttttgatttctttatcataatcttttatgtatctgcctcagatttttttctttgctcttactgtgagggatatataaaatattttatagttatactgtctaaactgataacattcatagaatacagaaactctgtactttcatttctcccttcctcacataagttgtatgatgtgtccagtaacaaattattgtagaccaagtggttatgtagagaggatttgaactttgtgcagttcagccatctatctttaatatcctttccaacccatagattttattagctttcatttcataagataaagactagaaggaacgttgaaataatttgttatatttctctatctttccctccagagagaaaataaaaatatttatcagtaaacttactctagcaattgatgtgtgagactaataaccttttgtataattaatttcaggtggaagggtaatcatttagtgctttgggcgtggtcgctgtgattataacactattaccaaaattatttatgctgtcttattagaactgtaaagttaaatacttaaaatttaataggaatgtaatctagaagccttttcatactgtcatggggttcttttgatgagggtgaaaaagctggcttgaaactcaacattcaaaaaactgagatcatggcatctgatcccatcacttcatgacaaatagaaggggggaaggtgaaagcacatttttattttattttcttgggctctgaaaccactgtggacggtgactgcagccatgaaattagaagatgtttgctccttgtaagaaaaactatgagaaacctagacagcgtattaaaaagccaagacatcactttgctgacaaaggtccatatagttaaagctgtgatttctccagtagtcatgtgggtgtgagagtaggactgtaaaagaaggctgagagccgaagaattgatactttttaattgtgctgtagaagactcttgagagtcccttgaattgctgtcaaaccagtcaatcctaaaggaaatcaaccctgaatattcattggaagaactgaagctccaacactttggccacctgatgtgaagagcagactcattggaaaagaccctgatgctggaaaagattttgggcaggaggagaggagggtggcagagtatgagatggttagatagcatcactgacgaaattaaaatgaatgtgagcaaattccagtagatagtggaggacagaagagcctggcatgcgg

SEQ ID NO: 51554 - DNA, 2590 bp, Bovine  19866880553951
ccctggtggctcagatggtaaagagtatgccttcagtgcaggaaggaaatccatctgggttcaatccctgggtcttggaagatctgctggagaaggaaatggtaacccactccagtatttttgcttgaagaatcccatggacaggggagcctggtgggctacagtcaatggggtcgcaaacagttggacatgactgagcgagtcgcattcatacacacacacacacacacacacacacacacacaatgctatggttttaagggaaagtggagagtgaaaaagttggcttaaagctcaacattcagaaaacgaagatcatggcatcggtcccaccacttcatgggaaatagatggggaaacagtggaaacagtggctgactttatttttctgggctccaaaatcactacagatggtgactgcaaccatgaaattaaaagacacttactccttggaagaaaagttatgaccaacctagacagcatattcaaaagcagagacattactttgccaacaaaggtccatctagtcaaggctatggttttttccagtggtcatgtatggatgtgagagttggactgtaaagaaagctgagtgccaaagaattgatgcttttgaactgtggtgttggagaaggctcttgacattcccttgaactgcaaggagatccaaccagtccatcccaaaggaaatcagtcctgggtgttcattggaaggactgatgttgaagctgaaacttcaatactttggccagctgatgcgaagagctgactcatttgaaaacactctgttgctggcaaagattgagggtggaaggagaaggggacgacagaggatgagatggttggatgccatcaccgactcaatggtcatgggtctgggtggactccaggagctggtgatagacagggaggcctggcatgctgaggttcatggggtcgcaaagagtaggacacaactgagcgactgaactgaactgattctaaattaaattaaactgaaaaaagcatgccttcaaatataaacctttgctttctttctccaaaaccgcaattctattcatctttaaatttaacccttgtatcaagttcagttccaaaaaaaaatcaattgcctccacagcctcaaaatgtacatagaggcattcattacaggcatgcctggctacctaagtgctatgagtcatgcttattttcaaagacaacactaagggaatgtcaatcaaaaaaactgtgaaaaagcatattaagaaaaacgttgaaagtgaaagtgaagttgctcagttgtgtccaactctgcaaccccatggactatagcctaccaggttccactgtccatgggattttccaggcaagaatactggagtgggttgccattgccttctccaggagatcttcccgatccagggactgaacccgggtctcccgcattgtaggaagacgcttactgtctgagccaatttaccaaatgtaaagttttaaaatttagattatcagccaacacacaaattggtaaaacaaatcatttaacataaaattttgcaaatttaagtagcatatggctatgggtttaaattaaaaatgctcattacttaggattgtaaagaaaagactgtaaaatcagaaatgtattataaaaaacatggaagtactacccaatagcctttaaaaaatcaggttttaaggggtcaatcttactctaaatcttatttattcaattacaatgtaaaactttttgtgggtatggttaatctctgctagaaacttctaataaaacttgtctataggtcaaaaaatcttcagtaacagtacacattataagtaaaaataataacactatcattccacgaaataaacatagaaactcaagctaatttcagtggtagacataaaaactggaattccttgtcttggtccattttgaaaacacccaactcttagggggtaatccaggcataattaaagtccacgctttttcaccattttggccagtgaaattactactgctttgttttcctttggatactgtcaatgacttatgaacggatgggcaaataagagaatagggaaatgaggcttactaaacaaaagtgggtaaataagtaggtgggaaaacatggactgagtggctgttacaaaggaagactgcttaccaagtgatttgtccacaagcaatacgcaccaacatttaaaaattgcatgtgttagaaaacaaacatagataccaaaggcagaagtgaaggaataaattaggagtttgggattaagagatacacactactacatataaactaggtaagtagcaagatttactgtgcacagtaaactatattcagggaactacattcagtatcttgtaataacctaacctataatggcaaagaatagatacagatatatatgtgtgtaaaactgaatcactttgctgtacacttgaaactatcacaactccgtaaatcaaataaacttcaataaaaaagaaaaacagacaaccaccatccaaaacctaaaacactggaatatagtacaaacagaatataaaataccaaatagcataaaccctgttttattctgctaaacagcaccaaaaaaa

SEQ ID NO: 51555 - DNA, 738 bp, Bovine  19866880600571
actgatgaaaaaaccatattctaagaaacatgagtcagtcctgtgtcagtctcagcatagaacttaatttagttagtatctataaatagtttgcaaatcaccactactacctgaaagttataagaggggagtaataacccccgcacagaagtaggagttgcagcgatgagagtgtactgtcctcaggttagccttcagaggcaggatggaccaagagttgaccgccttctcttgtgagtattgtctcctgtctcaggagttttgtaattttaaaaactttattatcttgtttagttttatccattgtttgtttgtttactaatagagatttgaaatgcccacattttatttatgtggttttattttctgtcaaatgttggtagcattagtgttactgaatgttagcaacctggagtatttttcctgatccactctcctcctttattatgttgaaatttaaattacttttcatttacctagtgctatttttttgttatacataaggctgaatgaaatgtgttttcaaatttttatatagattgtgcttgctataagaaaattaaatctttgagttaacataaactaaatatgtattcaagtatataaaaaagctattgatcttattgttgcctggtgctttacaggcaacagttctctttacatttgggggtaactcttctcgggaagaaatagattttttggtggtgggaagaatttttcccgatatttttaaatgct

SEQ ID NO: 51556 - DNA, 1490 bp, Bovine  19866880715745
ccgggggtgaatgaaccttgcaagttagcgcttggcattcacctggcactttgaaaaaggccgtgaaaggaaacattaccagtgaattgatagctgcatgaccccaagggaggggaagcccagccaaggcgctctggacaggcatccaggtcagagcacaaagccttcctgggaattctcaggactgcagcaggctggagccctggcctcacatttcactccaaaggaggccatcacctaaatgggttgagatgctcctttctgcttctccgtattcagaggttcaaatacccaggaaaagagagaaaaggacaaatcagccgaattagcatctgtttactcttgggcttcactctgaagcagcactggggtatgtcaggaccggaggagtctagaagctgcttcctatgttggaaggcattcatgacttaatttcacatttttttctaagctctggattatgtaggactcctctatgtgattgttacctcggattaatatttcaaattgtgatcttactatgccttggagatggctcagatgctaaaaatctgcccacaatgctggagacctgggtttcatccctgggttgggaagatcccctggaggagggaatggcaacccactccaatattcttgtctagagaattccatggacggaggctacagtccatggggtcacaaagagcaactaaaataataaatatgcctcaaaaaagagagtttgaggagcctgttaggccaggatccgtgtcttttagagggaggtgtagagactccttcacaggtgccctgctgtggcccagatgattttgtcaactttcctcacacccagggactgagtatctctccctctttgctttttcctttttcaaaactcttcacagctactaaggaatagggtgaggataatgtacatcagggctctgccaacattcaaaaagtcttatttatttattttctgctttggccatatctcatggcgggcagcatcttagttccctgaccacggattgaacctgtgtctcctacagtggaagcacagagtcttagccactggaccaccagagaagtcccactatcaacatttaaaaatactgatttatttggctgtgcttggtcttcattgcaacgcttgaaatcttcgatcttcgctgtggcacacagcaactttagttgcaacatgtgaactcttagctgtggcatgtgtgactctaggtccctgaccagggatcgaacctgggccctctccattgggagtgcagagtcctagccactggaccaacccaggaagtcccctgctgtcaacatttttgaagaaaaggaactctttcagatgaaatctttacccaaccccagtatagaaaacaagagggtcgaggtcctctggctaacctgggaagcgggcctggttgacctcaccctctctgcccctgggaagccaacctgtcccaagtcccagaatcctgccatcacccaaatcacaattt

SEQ ID NO: 51557 - DNA, 1886 bp, Bovine  19866880811443
ccttgtccacgatcggggacctcgctgaggtgcagctgctgcagcaggctgtccaggatccgctcctcggtcagggccgcccctgggccggccaggggcagcacccagagggcccagcagagccacaggggctgcatggcactgctggggagaaggaagggcagagtggacgtgtccccggatgaggctccaggagggtcccagcagcggggtgtgctgagagccaggctgggccagctttatagcagccctgggctgggccagggtggtgggaggggggagaggctgggaggaagggagggtcacacccctcagacctcctgggagctcagcatccagacaggtccctgagcccgaggaggggggctgtctagactgtggacagatggtattattgtggtcaggtgcctctaccttggctgggattgctggaccagttaaattaaaaagcttgttccctgatgaagaggcaaggatctctaagtgctctcttccctgtccttcagtcacagagcaaactccggtccctggtgtggacttagagtcctgattcttgctacagctcctctgtgtgcacaccaacaccttggatctctggctaaggaccaattctgcctacaaggatgagcatctgagcctggtgctcaaaggactcctagggactgttgagcttctgggctgtccacaattggaaaacccaatgtttttcccagtgcttaatggggaaggggcgaccttcctagacaagggagcctggggtaatttagtaccaatgggattttgcccaataaggaacctcatcctctccttttccctggctgttcacagattcagagattggagttgaaaaaaacatccagcccgttccctccaccaatttttgagctaagaaaacaaaggctcagagaggcaacaatatccctggctcacaacagttaatgatggatgcctgcctaaagtcaagtctgattcctagcccacagctctttccacaacctccagctgtttccagccagagtccttgttcaatcctctgaagcagccaagtggactcagcccaggtgaccgggggactctatgtgggtagggggcatgtccttcaatttcctgaggcttcaccaaatgaatgtggatttgcatggtagaggagttttagtggggaattaaaacaattgggcaatcagccaggggtagggctgccagataaaatacagaacacaatttgggacatactttagcacatcatttgttgtttatctgaaattcaaatttcacctttcaccaggagtcccatatttttaattgctaaatctggcaaccctagccagaggccaaagagaaaaagccagtgtggattgggaaacttctgacaatgggctgattacccgtcaggcggggagggcagcccccaccctttgtcatgcagaagaagccaggcttcccctacttccactctcacctgtgtctggcccaacaccctgccaggtcatgttggctggagatgctttagtggccccagaggtagatcttctgtctggaaggaggaaagaggccaagggaatagagagtttgggctttcctggtggctcagatggtggtaaagaatctgtttgcaacgtggaagacccaggtttgatctctgggtcaggaagggtcaggaagattccctggaggagggcatactccattattcttgcgtggagatttccatgcacagaggaacctagcgggctacagtccatggagccgcaagagttggtcacaactgagcaactaacactttcactttcaccccgatgaaggaccagtttggacctcgcctagagctgagggtagcacggagggcaatgggctggccgtcttgaggtgggggccacagacccggc

SEQ ID NO: 51558 - DNA, 1450 bp, Bovine  19866880923304
ctttgcttgggttgtttaattgggtctcttcctgattttccctacaggatgaagaggcggtgaagaagttgacagtaaaccctggcaccaagtccaagctccccaagccagtgcagaacctcattaagatgatctttgatgtagagagtatgaagaaagccatggtggagtatgaggttattgcacttttgttatatttatgagcatttgctggggtggatgattggagtgctgagttggcaacgagttcaatggctggtcttcagcctgagacatataggagttctgtggcctggggtacctacactttcacagagaatcattggcctgttgtgaaatagatggtatgttgtccccattgcactttttcccttgaagttgccataaaggagtgtggggcatggttcttttgtggctcaaccaaataggccacttggagttgtcatggaagtccaagatggagcccatttacagtgaaagaactgctgtgaccagcagagagcttctgacacttgcttcatcagataaaattcataccagccaatcatagggtggaggggagggggaagtgatgactggaaaagtggcagggaccaccagccagggccaggtgctctctgtttgtcccctgggagatgaatgttcttgctgcctctaagcttggagccgctttgaaaaagaagcagggaccagcggagtgcaggcgttgcagattagccttgaccatcctgccccttcaccagcttgcttcctctctgcttcttccagccagccttaaagaaggcaagacaaatctgggttgtagagaccactagcagcttctcttcctcagccctgcatctccctgtcttaagcccagcctggcaggactgctggggctctgctgttgttacagtgttgggtcatgacttagacacccctaacaggtgtgaagatagctagggcttctgcagatgtcttgttcaagtagatatacaaccaggcttcttgctaggaggtctgacaggtttgaacagcttatgggcaggctcagcaagaatgcctagagaagaggtgtaccagagtgggcaggggcatcttcatttcatgaatctttcaaaagaaaggttccacataccctttctggctttctgtactctggcttctctgtgattcatagaatttctcagctgtcatcagacccagtctctctatgtgaaatgacttttttttttaaatattgttttatactctaaaaagggctttccctggtggctcagacgataaagaatccacctgcaatgtgggagacctgggttgggaagatcccctggaggaaggcatagcaaccccactccagtattcttgcctggagaacaccatcacagtggagcctgatgggctatagtccatggggttgcaaagggtcagacatgactgagcaacttagcacacatacactctaaaacag

SEQ ID NO: 51559 - DNA, 1459 bp, Bovine  19866880949184
atgggagttgtcagaaaatgacagatatgaaaaataacaactcaggtggaagcaacccaagtgtctattgacagatagatggataagcaaaatacagcatctagatgcagtgaatattattcagcctttaaaaggaagggaattctaacacatgcatatatattcggacacatataacatgagtgaaactggaaaagcattgtgccaagtaaaataagctaatcgcagaaggacaaatattgtacgattccacttataagaggtatctagaatagtcaaattcacaggcatagaaagtagagtagagattattggagctagaggaaggagggaatgaggggttattgttaatgcgcagggaatttcaattttgcaagataaaaaagttcagtagatggctgggggtgatagttgtacaacaatgtgattgaatgcactatttaatgccactgaactatcacttaaaatgatttcaatggtaaattttatgtatattttaccacaaacaaacaaaccaaccaacatctctctttagaaagtttaggaaaccctagtgacttttttttttcccaaaagacctaactcacacaaacagttcagatttcctgagtgttagaaatcaaagacagtgcttattacttctcaagcgtatcctgttttgttccattcattataggactggcttagccagtaaattatatctttatttctcactcacaaatcaacagaaattctaagcggataagtagaatttgggcatctagtgaaagtataattgtcttataacttaactctataaaatactctttgcaattcaggaaattgctagttgcttttcctacgccctgtaaaatgtctacattttcaaaaatctcagatatctttgaaccttttaaaaataagatagctattgtgctttactacatgcctgtctccaaactgatttgtcttaatagcaaataacatgatggaaccccaaattcagttatttgaaacgtctatatacattgggctgcataacaagaagtgcagataaatacttggtttaattataacatttggtccaacacccctaaccttgtttgaaggaaagatctccttattcaggggaatgacttatttaacaatgaaccattcattcccctgtgattgcaccagaagagaattaccaattcttccaagtagcttttgaaagcaagaaattagccttttgggggtaaggaaggctgggaacaggcagggggtaggaaaatggatctagattaattcaatctgggccacccaggaccaggaagccagttccaaattgtggctcagcaataaagaatccgcctggtcatgcaggagatgcggggtttgatccctgggtcgggaagatgccctggagaaggaaatggcaacccactccagtattctcttttttttcactccagtattcttgcctggagaatgccatgga

SEQ ID NO: 51560 - DNA, 1869 bp, Bovine  19866880959929
cacttctcttaagtccttaaattcttcctgtactctttcattcaacaaaagttattgactccactagatgattggtcttccctcacagctaagttggtaaagaatctgcttgcaatgcaggagaccccagttcgacccctgggttgggaagatcccctggagaagggaaaggctacccactccagtattctggcctggggaattccaaggactgtaaagtccatagggtctcaaagagtcggacacgactgagcgactttcactttcgcttttagatgattggtccaggccaaatagcatcctcatttggttccccttcctcatatttactggagcaggaggtactggcgcagcagcagatgtcctgggcctggcattgctcaatctagatgtcagttgggacagaaagaataacccaaaaccctggaacaaactgggtcccaatgatcaatacaagttccacccaaatgtagattacagcaacctgaagatagaaggtccaaattcctaaatgaaatgtttcactataaagctgcttagaatgaaggtcttccagaagccatctgcacaatttatcacttagccaggaaatatatccccttaaatgtacaaaatcatgttggtgtattgtgttggggtttacactgattaataaataatctgaaaaatttttaaaaaggttattgagaatctgctagctgttcgacatactaaagacttggtagaaaagaaatcaaagtcccttctctccaagaacatcccttctctccaagagcagcttcccttctagtgagagagccaggggggtcaatgtgagcccgcaaaatggcaggtggtgatgagtttcttaaaacaattagagcaggataggaggatcaatggacttcccaggtggcactagtggtaaagagcctgcctgcaaatgcggagacagaggttcgattcctgggttgggaagatcccctggaggagggcatgacaacacactccaatattcttgcctggagaatcccatggacagagaagcctggcgggctgcagtctatagggtctcaaggagttggacatgactgaatcgacttagcacgcaggcatgcacacaagaggatcaaaagtgacagcgggggacttccctggtggtccagtggttaagaatccaacttccaatgcaagggatgcaggttctttctatccctgattggggaaataagatgccacatgccatggggcaactaagcccatgcaatgcaactagagaagccccttcaccccacaaggaagacccccccacagccaatttttttttttaagtgacagtcgggatgtgctgcttattctctgtttgctgccccttcctcccatacaattcctgcaccaccctccctcccagccctgttccatgccccagggactggcccatagggattctttcacccaagctcccccactctctgccttcctgttggcttgggcagaaaaaggagatgagaaagcaggaggcagtggagtgctagcaaatgtttatcagccagctcactgaagaaaaacatcctgatgtgtagcatttgcccatttctgtggtgcaaagactccaccttgagagatttcaaactagcttgatattagagcttaaaagagttgaaatacaggaggccctgaaatattaactgggttcaacacagcattgatgggagcagagggaagtgtgagagcatcttcttatctgcttcttgtcctcagccctggcaggggccgcaccatgccctacagcactgcagctcaggacagcagtgcctctcgggccactccagctccaatgagatgctgaaactcattccttcctaccaccgcttcaggcctgggactggg

SEQ ID NO: 51561 - DNA, 1167 bp, Bovine  19866880962611
cttatatctgacactgaaaacctgctaattattaggattgtgatcccttactttgtttgtcatacttgatgaactgaaaaccatctaaatcagcaggaatcagtatgtctattttcttaaccttgagtaaatgtactgctgcattccccaccagaggacgacaggcagcccaggagatgcccctgcccccagcatggggcagctggaggagaggctggcgtcttacctgctggacctcactgaggatggagtatgcagcctggatctgccttttgctcagcttccccaagggcatcttctgaaggtcaatctgaggagacaggggggattttttccctttgaaagctgggcactgtccggcgtgatgatgggagagccggactgaacatcaccccaggccttctgggctccaaaagaagcagacacagtctgtttggccctcctaaggagacctggtgacccaattccacaggctgtgcagccctacccccagtgcagtggatgggagtctgtgagagaagactctttgttcatttacggcagagataagccaagcccccacccctgtactgggtttgaaacagtcccacacttctggaagaaaacacagcaggactctcatctaattcccaagtgaggccctccctggggtctcagagccaaggccatccccagccagaaaataaccataaagtggtgaaaattatttttaaaacgacatgctcctgaacatacatactgacatcaagctaacaatgtacccctcaaatcagtcaccctgaaggttaaacatctgtccctacaacagtgctgctcacaacaccctgggaaccagcaggaaggcagggagctggctgcagtgggagaagcatgaactctgtggccaggggtctggtcaccagctatggagcgaggcacccactccctatgggaacgacctgcctgaatgctggctaggccccctcctctatcagccccccacggggccccctgctctgaatcctgagccgctgtctctaagggttgtttccagcagaactcctgagctcctggccccgggactgcacttagcccatctttggggctagtgtctgcggggcctggaacaaagatggagctggacaagcgctcaagaagtggaactgctatctgattagatgaaatatt

SEQ ID NO: 51562 - DNA, 2035 bp, Bovine  19866880975011
aagatgaaaatatgtggagagaccaaagggaaaagttgattttagggaagaccatttcaaaagcatttgaaatttttggtagatttcaaatggtaacacttcacctgaatgtgatggtgcttaactgaaatccacacaacaaagttgtttggttaaaaagcactcttttgtatagaaacagacttagggaagatattcgaaaggtttcagaaaatatacctttttgctaactctgtgtctcctcacatataaaagacaggagtgtggaaatagaggtagtttccctgaactgtttatagaaatcagattctactgtgagaagcacattcgaacaactattgactgagatgtcttgggggagggaggcactaaagaaagggtgatgcacatgtttgtcatcttcattgtggtaatgggtctgacaggtatttgtatgttcaaactcatcaaattgtgaacttggaatatttgcagtttatttgatgttaattatacctcaataaagcgatgagaaaaagtttcctaaacacttgaaatgcagcctgtagacagcagcatcagcccagaaagcttatgagaaatgcagactcttgggcctccctcctaagtcagaatctgcagtttaacacgacccgtgagtgattctcatacacgttaaatttgacctcttacagtgaatgtctggaactcatttcccaccatgagttgttaacggaaaattatattccctactctgttttagtcactaagagcaactccctactgggcattctttgatggttacattagaaagaggtttacctgtttgctctagaggatgagcagattttcaagaattttcaatatgttaaagtccaaaccaatttttaaaagtcaataattactagtgtatcatattttacctgtccacctttctagggtgtgttctataggctttaatatttacagtgctttagaaaaaattattttctgatcacaaaagaaatgcttattatagtaaacttgggaagcagaatctgtaattctaggtagtagagttatatttaaccatctcattatcaccctcaaaagttactgaatactaaagatagactacaaaaaggtaatgtatatatgacttcttggaggcagcgccttgtattctaacatgcatattttttaaataattaaagctaaatctgaagatcccagctaagtggaaaaactcactgggcttggaatagcagaattcattttgagacatgggtttaccatagattaatgaagcttaagcttcaggatgcctaacacttgctcgggtcacttccaaagcccttggagagaccctggcaatatattcactaggtcaaatgtttctgtaaaagtttctaaattatttaagaccatcgtcacattgtattcaaacttccatcatttctcttctgcagtaaatggcgcaggaatagctactggcttttttgagacctggctaaggaaacaataattgacttagggatatatttcatttgggtttagtggcatgcattgacggtttgcagtcatttccgtctactgttaaattattattcattgtgggtgtaggactggctttctggaattcacctactgcccattatgccaactcagccagcaccatgtcacagaggtacggggctagaggcgagagctctgtgacgctgggcacaggaaatacacgggcgacagagaaacaaggtttgaaagaaaaggagaaacgagcccattaaaaaatcctccccactctcaaaagtaaacaactctttagtggagggatcaattttctcaatgcctaacctaaaatgaaggttctcattcatcaggaatctaagtaatgtcttatattcaattgtaagtgcaccgtacttatttttgtttttgtgtgaagcataaaaatggaatatattggaattcttgtatctgtagaaaacaaacttgcagttgttttaccgaaaggtatgcgtggggagtccagctgcttgccactcaaaagccagtaaacaggccaggttggtagaaa

SEQ ID NO: 51563 - DNA, 1295 bp, Bovine  19866880980367
gcctttgttttgacttttaaaaagcacataatttattctagagatcacattatacccattctttcagtccataaacctttccatagctttggactgaaagctgagatctgaaatctgactgtctaaattttgccctgctgagttggactcagtgccttatttatttactgtatctaggtagattgtactttgaaatatctagcactagcttagatttcatagtctcacgctgggtgaatgatctaaccaaggacgagggtattaggacacaggaatgaggagtggggttacaacctcagtgcagtttttttatacaaaaatgacagttttactgagatataattcacatactataaaatccatccttttaaagtgtacaattcagtagttttagtgtattgacagacttatggtgatacagtcatcaccaatatctaattttaggatgttttcatcatcactgagtttgaagggtaacaaatttgagtcccttggtaaaatggccagaggcagagcttctgtttgaaagatttggtgagggatggaggaatctcacagactgcaagttttgaaggagtacagagatgtcagagactgcagggatgagatcaggcttcactaggaaggtgtgggattaaagaacagtaggatttcatatttggatgcaggagagcatcctttccaggaatactacataagcaaaggtttggagaggaaactgagttgagtgtttttattagccaggaacgagctactctccaagcgtcgagctccactttgtagatcgcagtcctcaccatgaagacctctttgtgcgggttcaaatttcactcagaccagtgtttctcagactgtgtgttgaaagacaggtttgtttgctttaaaatttcccaatctgtcctggacacaacacacgtgtaaaatacaataacaatgaactggtaaaaatatgaaacaagttacacaaggctgaagcttgagtttgttgattgattgattcagttgagttcctaagaacttcggcaccatttctgaccgcgggccgcactttgagagccctcttccaaagcagaggcgggcttaggaaggtgcagagtcaaccgggtggcccaggtaacaggggcggagcgggactgaacccccggtggcccggcccgcccgctgaggggccgagcccgggcggggtcagcgcagggtagtcaggggacacgcgaatcgggagcagaggaacccggagagccggagccagagggacggccaagccccaggagccagggaaccgacgaccgtaagcg

SEQ ID NO: 51564 - DNA, 803 bp, Bovine  19866880988738
tgaccgatggaacttccgtatccccggagatgtctcaggcatatatgctgggatctttaaaattgttttaggcattggggtgagggctgggaaacatgtccatattggcttctgggcctcctttcttctgggtgtggctcaccaaccccctcatggacacagccttcctttttccattctggtttgaaaccactcaggctcctggaaggcctttcctccctctgcacaaagctgggatagtgtttgtatgtgaactgatgggtattctataccccctctgcacctgaccacacaatacctgcctgttctcaaagccccagcccaacgccattccagcttcttctcaggtttcataactgccccgtgaactgcacctggtccttcttcccctggggctgtggggttggaggctgagtagactgccacctggtttagcctctccctgctgactggggttttggagactggctcgctattgcatgagtcagagagaaccccacgtctccaggcatcttccaggagtgagtgaccgctcgctccaggcaggaggagactagaaggtctcgggctcacccctgggcagaggcaggacagctacttggggagtgcaaagatgtgcacacaggctctggcatggtgcctggagagcttcccaccatccccttgagagcccctggcctacctcccagttgagctcagctgggaggcccaggctcagctctaagcaagcctggacagaagtggccatgaagctcaccatggccaggcagctcccactgcaagcacaaacaggcctttaaaaa

SEQ ID NO: 51565 - DNA, 1810 bp, Bovine  19866881007304
atagctgaagacatgatgtaaaagtttaagtactcggttctgttaacatattaccaattaaagtcacaaaatattcctcatcattattcatgcagataactgagaaaaaagatagtgcagaaattaactttaaataaaaagttattccttccccgcctcccactccctatactctacaaaatgttttccctgggactaggccttgaaaaggccactacatattagtttaacatgcattactgtctgcaattaaaaaagctaatttttgtggtggttgtaattacgttataaaaatgtccacatgcataaatctaaaaaaggttgaaaacctacaggtaaatctacaatatattgttttacatttgaccactggtttgtgttatgtaggagtcatagatttggtaaagcattgtaacaatttaggaaggcatctaaatctttaaattctggatgaattttatgtttgaatctacaaaattgcatgaaggctaaactcgagagacctcctatcattctaaaattcctctctggacaaatcatttttaggacactttcttataaatgtcaccttttgaaagcacatacaattacatttgttccacattttatgatcttaacctacacagggctgatctcaattatccatgtaatatcaaatatgataggaagggaaaaacgacgaggggtcctgcataattttcttttaataaatagagagttaggtggtaggaagaaggaactagatgccctacttaccaccatgtacgtgtgcgtgtttgtgtgggcactcacgtgtgtgtgtatgtgtgtgtgtgtgtgtgtgtgtgtgtgcaatgcactcccttttctttgaaacttctgagattaaaataggggagcaatcctgtatgttacaatgatagcattttttgaaaatctaggaaatcaaaaattctccaggctctccatcttggtttatgcttgagttgttatgtgccatatttgctttgaaatctttgattatctgtagttttactaaaattttgaagaaataatccactgttgtctgctttctggatttcttaatcttccttcataagacagagcttgttgatagcatagttttctaaatgcaggtttgcggccatcaccacttcaaagaggtttgaatgaggaaattttttttcccccgtattaaaacagttcttgtttctgtagaaacttcatttttagattaatctgtgatggatgagctatcataattctaatatgcggttctttttctatcagatattgtcatccaccagtaaagacattaaagatgcagcaagcttataaagtactactttcttaaagaaataggaggcattcccatctttattactgtacttttggttatgcaaacactttggagatataaatgtttatgtcccccataaatctggtcagaaatcatttttgattttgttgattaagttaaacagtaggatagagtactgggtataagtggtccaaagtaagataaaagactacgctaaaaatgctagatcttgaagaagaaactggtttatgcactaaacgttttgtgccttggtctaaatattaacatgtctatgtaaaatgacaaaaagaaccagtgttgaatcacattttatttcctgtcattctgctttatcccagactgctaaatgtgttctttccaagaagtttgattgaattactgtacacatttactgtcctgtgtgacagttttgtcattgttagagatttcagtaattaaaacgggaaacagaagcttaggttattttccttatcaaaactatgttccttg

SEQ ID NO: 51566 - DNA, 1069 bp, Bovine  19866881120126
catggagtgtccccgccctgcccacgagtcgccgggttcgttgtctgcttgggtgacaaaagcagaaatgctcgagggagacactaaaagcacccggtccagaggctgccccgggagggtgcagagaaccagcccagtcacactgcatatcttcaagctgcaggaagtcccgacaccccaggaaaaatgtggtgtgcaagccccagcgctaggactggggggtaggctccaggtgccagacagcagggttctggctgaggcagatgtaaaggtgataatcaaataaaaccccccatcacaaagggctttaaaataagtaccaagagtatgccagctacgtatacgtacgccctcccccatggcacagggttgtgtgccagcctatatctatttattttaaaaagcaaacttttttaagttgcctgagaagcagagtgatgatggcaactcttgagagccctagagaacagttcagtggtcaaaaaacagacagtgggatcaggcaatattttcttactatttttatttcttatgaagtttacatattaatacttaattataatttataaactttaatatatggtgcattgtttaaaagataaatacatcatgtgcatttgtgcatatttagtcacttcagtcgtggccaactctttgtgacctcatgggctgcagcccaccaggctcctctgtccatgggatttcccaggcaagaatactggagtgggttgccataccttcctacaggggatcttcacgacccagggatcaaacctgcatctcctgcgtctcctgcattgcaagcagattctttaccactgagccaccagggaagcccaaatacatcatattgctataatacaatcattaaaataattatataaataccaatagtaattaattcttagagaaatattctttatttctcttgacttctttctaatatatttacttttaaattcatcacaaaataacacagatttgtgataaaatatattcacacagcactgcaggatagaaggaaaagttaaattcccttctcctacccctaactccccagtcccacctt

SEQ ID NO: 51567 - DNA, 1635 bp, Bovine  19866881167617
aatagccctatatttattaaagaaacgagctataagtttcccacaaaaaaaatcttcaggctcagatggtttcacaaattaattccataaatctaataatgaaaaagaggatagttagaactgtattattaaaaactcacctttaatagcaaaaggaataacgttcaagagtcaacattatacaggttataagcactagactataaagaaacagaaaaatcagctctgatgaaattcacttcttcttcccttttgaaggtttggcaaataaagctggatctatctgctcctttgccagtcctctgacagagaagagcctcgctgcccgctcctggagagtgcccccacacttcagtccccgggccatgagttcacacttgagcttctccaagcccagcaactccatttctgcaacagaactgattgccagtaaatctaaagtttcctgactgatatcctgagaaaaagaaaaaaaaagacagaaattttaagtaagtcgtccattcctttgtctctaattaaaactttcttcaactgtcattgacatcctatttttcaagaaatttttatttaatatgccatatcttactactgaatcctaataatcatgttattctatacatgttctcaattcaagtaaacattaatttttaatctatatacttagaaacaggtattcagaaacaacctaagtggtaagattccaaaacagataaatcttaatatgtatgaacataacttttcttttttgacttatctagtaaaaattcaaacagcaaaacctacttcacctacctcgcctaccctgtgcactatgagtggagaaaaaagcagcatcctataaaggttcattttagtgagaatcctatgcctatgactctactgatattaaccccatcatctttttaaaaaatatttatttggctgtatcaagtcttagttgtcacacatggaaccttcatcattgtggcatgagggatctagttccctgaccagggatggaatccaggcccctgtcctgggaacatggagtcttagccactgaaccaccaggggaagttccctaaccccataatcttaagctttctaatcaaataatcatgattgtcaaagttctcacttgacaaatttaaatgctgttcaagacctgtaaatgttctatcaacaaagtaactttacagacttacacaaaattaaatacttctaatgacggatgctctgccaggaatgaaagtgttcatctagggttttttgggtttttttttttttttttttttgctgcactgggtctttgttgcagcccatcagctttctccagttgtggtgccaagggcttagctgcccccaggcatgtgggttcttagttccccaaccagggactgaacccacgtccgctgcattggaagggggattcttaaccactggaccacgagggaagtccctcacctaggagttggtttttttttttagttttttaaaaaacatattcagttcagttcagtcgctcagtcgtgtctgactctttgcaacccaatggactgcagcatgccaggcttccctgtccatcaccaactcccagagcttgctcaaactcatatccatcaaatcggtgatgccatccaaccatctcatcct

SEQ ID NO: 51568 - DNA, 1193 bp, Bovine  19866881207703
acctcccagcaaatgttctctggttaatttggagactatctgaggtgcatgtgttttaattacataaataacagtgagtacttaggacaggacaatgagcctcatagttagtagctatggtttttaattgtggtgattgcacaaactcatccagttctggggttctgtatttctctgtctctacctgtaatatggcagcaaggacatttgatgggcaagactgtttcctttctagtgcttggagatccctgaataaaatacactgtgatagttaagatgtaattagacatgtgggtggaaattagtgttcaagcacaccatgtctaagcagagtcattgtgcctgcttttttactacctgaggccaccctggtcctgtgccatagctccaggtcactgagtatacagggctgttggttagaggctgcaggttccaaaaagaaaataactggtattgaatctgaaaccgggaagctttttatagctaaaactgggccacacagttctactatagacaagtcaggcattcaccaagtatgactataacctgttcacttttcttttggaagtgtacacgatctcaatgatcaaaactataatttgaattgtacctccatcttataaaacaccaaaactttcgactagatttccggagtcatggcaggtcctccattttggattagattctccagtcatccggacccagtagcaatagaccttttccttctcagtcatcttaaaaaacacacacttctccttgggactacaaaaggcctgcaatttgtccagtttaatttttcatttgatttttggatttgcttctggatacctaaaaactcccactactgtaaatcctggctttctggatggactcccccatcccccaacgccactgactttaaatgagtttgcttcgccagcattttacattttaccttttaaaggtgatttcaagaccaacccaatggtggaaaatttaaaaccatcattataccattcattatccctccccggcccccctggcacccctaccctgagtctcccaccctttatccccctgttgcggccggaattccctttttgctaatgacgacagaaagcggtttcccgagctgcgtttcttcttccactcttgctgctgcacacgatgcctcgcgcgtctcccggcgactgcgtttccccgcgagttggccg

SEQ ID NO: 51569 - DNA, 1282 bp, Bovine  19866881335088
tcagtagcagtgtgctttccgctggctcccatcccacgtgtcaggcactcttatcagtgtctgtccttggaccagccctggaggtttcaggaagattcatcgcccagaggcacaactctgagtgtgcctgccagagacggcaggtggcggatataaacgcctcattctcagcctggtttggggttggcagccggagtctgggattgagaggaagcacagcctgcacagattcgctcagctcctcagaagtcccactgacagcattctaaacctgtcctatgttgatagacctgattcctataaaaagttcctctagagttgaggatattttgtctcctctgaaaaagaggtgtgctttcttctctagcaccatgagaactacgtggctgtgctttctgatctgctctggctacggggagaatgtgccagttgctatcttttaggtcctcatgtcctaagctgatgttgtttctttatgtgtcctttatgagaattctgttgtgtcttcctgctggagggagttgggacagtagggggagaatggggtctggaatctcgtgcccagccctcccaagcactaacacccccatttgctggcagccctacgtgccccggattctgaacagctcgtcctcagagaaaacagccctgtctccgcagcagcagacctacggcgccatcaacaacatcagcgggactgttgcggggcagtgtctggcacagagcccggaggaccgtgtggcagccgctgaccagggggactgagggctggggaactgcagggctcgtccaggctcggggccctggggagtcaggaggtgaagagacaggtggagaggcggctggtcctcgagctcaaccaagttcaggacttctttccacctgttttaagcacagccactctaaagagaagaaagcagaaaggggctctggcccttggctgagcagggagggcgggaccgccatcaggtggggttcttttgtgcacaggtgcagccctggactctcacttgctcgcctgaggctctatttctttccaggtccccctcctcctgcacaagtgcccagctctgtggctgggatgatggccctggtgatttttagcaggatcatgtgttgaaactgtgtccctccaacccatgagcatggtgacagaatcaaggaagagggggctgcaccgtgttggaagaccttctccctctgagcatccagacactgcccacccctctccaggcacacacacataccaccgataaccaaagaggctgcagcagccacaggc

SEQ ID NO: 51570 - DNA, 1127 bp, Bovine  19866881425412
acaagttaggcaggtatgtctcacagcagttgtgatcataaaaatcatactttaaatgtagtatagaggagctagctatttaaaaaaagcttacaatcaattattttaaaatatttttttacaaaataactttttattataaaattatattcattgtagaaaatttagaaattatagaaaagggaataaaagaaaataatgccactgtgtagagatgacttctgttaatatttgtgttcatattccctcctctatacacttgccctctacacatatatgtgtgtgtgtctatatgtatacattatgtatatgtattttgtatatataaatattttatatatattccctgtcatttttcttcactatcttttctgccctggtccccaaaacactcatatacttgcaccttagactgttgattattctctaatcctcccatacatgctggtggatttgtagcttatccactcttattcttttaaactggccttattctattcttgcagtttggtagtctgtagcatttttccatatcatcatatttttgaatcagcttcagatacatgctttttaatagctgtatagtaagaatccttaaaaaataatcacctcttattatcttttggggaatattcatgttctggactttctcaggtatacttttagggttttaaaaaaaataatcaaacctgtttttacaggagccccactgggtagactctttcctaagactgttactcccattttatagatggtgaaagatagacacccagagaggtatttctggtctggtatttttttcaaatggtaagaatattgatctgttacatatgggaaagagacttgcagaatgggccaattcaagtgtggcactcaaagattcctaaaaaatatgaaggcgccctgaagatcactgtgtaatttcatgagcaggcttctccttcagagttaattgacagttaacaataattctaatgatgctttggtgttgtcagaccttcggggttcatgctttcatgcgtgtgtgcctttttagagagcaattaataagtgttggcagtgtgcttgtgatcctcctgaaatgcttgggaaggatattgtcgttgctgtagctttgtgtattttgg

SEQ ID NO: 51571 - DNA, 1174 bp, Bovine  19866881426630
tcataagggaaaagaaaatttttttggtatctatatgagttgatggatgttaattaaacttactgtggtaactgtttcacaatatatgtgcgacaaatcgtgcttacaccttaaacttacgtagtgccatgtgctaaatcatttcagtcgtgtccaactctgggtgaccccactgactgcagcccaccaggctcctctgtccacagggattctccaggcaagaatactggaatgggttgccatgctctcctctgggtgattttccccacatagtgctataggtcaattatatcttaataaaactggatggagggagttagaaacctcataattaaccatacttcagtctcagcctttttaaatactaatcatagggcatgctaataggtgaatctagaaaagaagttccatagtcaaataagtttgtgagatactggattaaacaaagacaacagaatttctcagggcttttatcatgttaatgaactttgaatctctaggagccagcatatgatattcgactgttcttaaatttatttgaaaatggaattcttttataacagtgcactgtagtaacctaatatttcatggaacacattttgggaagcactactctaatattaatatctgaagactgtatatgaggataaatatttattcatatatttatttatggatgcatctggtcttagttgtggcacgcaggctcagcagttgccgctcgaaggcttagttgttccatggcgtgtgggatcttagttccctgaacagagatcaaatccatgtcccccgcattggaaggcagattcttaaccactggaccaccagggaagtccctgtatatgagtttttgcatctcctattactcttcttataaggttcagaggatttcaacagtgattacagaagaaatatacattttataacttttatgaatcctttatctaacccagatagatggactgtagattttttgtaaatattcagaggaaagctctctagtaatttatggaaaatgagagaatttttgtatcatttccaaccttatctttttatccagaatggcacagattgtctgtctttcaaggctctgggtaattaaaagagaagttatgttttgaaatcaatgtcatattgtagtaacaaggaggaagttgtttatttgtacacaaag

SEQ ID NO: 51572 - DNA, 1599 bp, Bovine  19866881458829
cactgcaggaagcttctttagccatgagctacaggggaagcccagaccacatggtatatcatttcaattaatttgattcatagtttaaaaaacaaaaataaagagacatattcaaatattgatgaagatttaagtgagacacacatacactgttaaagagaaaacaagttgtcaataaatttaacaaatttgaaaatatgcatatcctgtgaaacagcaactacactcttggtttggagacagattctcaattactgctacaggctcaagaatagagacactgcaatctccagacattgttgaggccactgccccaggtgaaatttcacacagatatgactctggggggaaaaatagctaatatttcatacatttgtaaaattttatatgagcaagaatctttaacagtatttctttgctgtatttctctaatattttaggacattttagatgaaatgagaaaagaattaactaagactaaaagaagagctcataatataattgcaatatatgagaactgattttgttatctgtgttgggaaaatcccctggaggagggaatgactacccactccagtattcttgcctggagaatcctatgaacagaagagcttcgtgggctacagtcaatggggtcacaaagagttggacacaactgagagactttcactttcatttcattatacaagaagatgatcttccaggtggcactggtggtaaagaactcacctgccaaagcaggagacaaaagagacacgggttcaatctctgggtcaagaagatctgaaggagggcatggcatcccattccagtattcttgcctggaaaattccatggacagaggagcctggctggctgaagtcccatggggttgcaaagagtgggacatgactaaaagactgagcatgcatgcaagaagatacctataagaatattcattgcagtatcacctgtcatagctaaaagctgtaaacaagccaaatattcttcaccaagaaaatgcattaataacttgtggcacagtcacacaatggaatgttaacagttaaaataaataagctggagttgcaaagttcaatatgactaaatccccaaacacagttttaaattaaaatgcattcttcagaattgtatctgtaataatgctagaaaattttaaatgtgatgtcagtattttatatttttatcactatctaacacagcaaattttcaaatactttttgggaatgatcaatgccaagatcatatagtaaaagagtgattcatcctaatgaaagtcaaggggagaagactagagaggcatgaagagaggtttttcggtctactgtatctttaacatattattttcacttaaaaaacaatagaatgaaaatgtggcaaaatattgagagttggtgaaattgggtagtcatgttttatttcatatctgaaacatttccaaagacagaaagaaaggggaagggagggaagatagagggagacaatgaaggaagctaatcttaggaagttaaaccaaagataaagggtatttatatcagaaaatttagacataaagtcagtttaactatatttatctgtattcttttaaaagttcacatt

SEQ ID NO: 51573 - DNA, 1801 bp, Bovine  19866881656675
ctttctctagtctagagtagccagtaacttacgtgctcagtgttttccgtagtgactacttagccgtggggaaaaaacgtcctaatggtattttaattcaaaatgacttagtaataaatttgtactgttcctccaaaaaatatagtttagtggaaaagataattttaaaaaacattttaaatagaagaaatatttatcaacttgtattaattaaatgaaaatgaagatcattaattttcataaatcaatttatttagaattacaaatattaagaataaaagatttatgcatttcttaattaaacataacagtttagctaaatataaactctgcactaaagttctgcagtggcacaataccaacaaagaatatggaagcatttttaaactgtacaaaaatttcaaatggaaaataatcttgtttcagttttattatacattaatataaaaagtctcattttatgagacatctaaaagaatcaaagccacttctacagctatatcttaaactccaaatctgaaaacaatttattatattttgactttataatattctatattaaaacagagaaaattccaaatacacactttttacaagattaacatcttaggcagggttttccttaaaaaaccgagaaccaaaaaagcccacaaccaaatacaaaccttttttctccattttctagcactggctattgtatttgttttccttataaaattttttttactttaaaaattgtgtaactgttggattttaaccagtaatctggttcaaaaattgtgcaaataaacaaaaaaatatgaaaatagtgtgttatcagtcttttgaaaataaatcccataacaatggcactttttgccctgaattgatgggaaaagacatgccaaatccatttgctgaaatttagcatcttgcagtaatgtttctttcctgctccttcattttctttcaacagacaaacaacaaaggtttcttttataaattatgataaattaaaatatttattattataaaatgatctatagaaccatgtcacattgcaagtatatatcatatatacttgtaaagtccgtatttcccacctatattccagtggcttcctaaaaatgaggacttcccatatctcatgatgttatcttttgaagactgaagtggtgatcaactaaatgaactggagttgtaattttctagatagaatttccacattgccatgcataatgcacaaaagaccatgtttcttcatgttctccactgcagtagttgtctgcctgggttgagttgaattcatgcacattaaaaaaatggtcaacaatattcttccatgaaattatgttatgttcagacattttcagtttaaaaatacttgctaataaacatatataacataagcagtgctactgcagctgagtaataaaagaaaaataaatataatgctggtcagcaatgctggttcaagaagcagtagagtatattaaaatgccttatttggagatttaaattttccttgttttccagcagataggttatttggtgttggaagcctatataaaggaagagaacttcacaaaaacaatgtcctatgcagttgggataattaaatcttctattcagtctctgttggtgttatttgctgcaaaggcatgtaagtttcccatctggctcaggccgctctgaatatgtgcaacatgaatttctacattattctgaaagcaactaaagaaagaagaaatatggttaactactttatctcacaaaattaaaaacagtttttctaaaaagaaaaagcgaatttcagttagga

SEQ ID NO: 51574 - DNA, 1394 bp, Bovine  19866881805775
agagtgccattcctgaaactaaagtcgtcgacgagatcttatcacaaatgcctaaaccgcaacatatttatcacatcccctcttcagaattatgaccaacttaaggggaaatttcctacccatgcactcctatttctggatggcctttaaagcatcagaactacttataattagagagactcaatttaatagtataacatttacgtcctagcatactggaaagcatcgagaccaaatcaatatgaatataacctaaaaagccgttaaatacgcaccaaaatatgccagagctttttgcaaccagcacttttcacttccttaccagactatcctgcttttacagctatctaaggaaatgtgaatacatatgagtcgcacaaaccacctaccaaataatccaatgtcttccaaagtgaaaagctgatcctctttttctgcttgtaaattattcacaattagcctacaaagaattactgtagactactttaacaaacttttcagacctgtgtaccatgttctttatttaagctactggaaagcttcagtgtgattcccccctttctacatttaataagaaacagagctgagcaggaaaacagcttaaaagttacaaattactttttattagaaaaggaatttttaagtgaagatataatttacctttgacaggttgataactatacataatagtgatcaaacttcagagtattctttaatttttaagttttttttttttctttttggttcaatctttgaatctgacaactatacaatcattttattttaaaataattcactttcattgttttacatttttcaatgttgggaagtttacccaaagtttggaaaaacttgataaattctcgtctccaagacccctataataagcattaaaagttacagcagaaatcagcaatatattttattacaagacttaacattagcaatgctttattatagttccatagtttttaaggacatcaataacttgattcaaaaaaaaaaaaaaaaaaaaactatgttcaaaggcatggctcaagtttttcaagccatattttacaaagtatgccataattacattttgcactgatctatacttgaaaataacttgcttgtgaaatcactaaggaaaaggggtcacttacagtttttcaagccttcaaataaagctccataacttgaatcagagataaacaattcaaattcacaataagctgaaagctatatctcaaatatatatatatatatatatatatatatataaagaccaaaatgggaaagtagtgttcaatcttgataggaaaaaaaaaaaaagtttaaagtggaactacttaaatgagaaagaattccaatgacaagacattttctgccaaaacgcaggaatgtgtagatta

SEQ ID NO: 51575 - DNA, 985 bp, Bovine  19866881827497
cctacttcctagaccagatagttttttttttggctacacaagacatatgggatcttagttccccaaccaagtattcaacctgtgccccttgccttggaagcgtggatcaccagggaagtcccaacatcaagacagctgagactgtcactggaaacatttgattttgtctagttagagaaaatacatcttagactaacaacctaaaaagctgatatcagaaatataaattccagagttggcagaatttcttgcttgctcttttataatttttcaaaatgaccttgcacatttggcttttcaacacacaaggcgcaaaagtataacagcattcagaaagcagtaaaataaactgtcaaacagacttccctggcattcataaaaattcaggcctcactcaggaagctagcttctctcacaatctttttggcctaaggtcccaccactgaaatgtttgatccctgtccaggaagttaatcaggaagcatgaggttggctgacatcagaactgctaccatttctgccaatgcacaacccagctactgaatatggaccaatggctctaccttcctcctcctcgtcgtcatcgctggactcactgacatgcacgctgacagcagtgttcggagagtctgtccattcaaaatataccccaaacccaatgtcataattgtctgtagcaaattcccaaaagagatatgatccttcttcatgggtgggtactcgaacagtgactacttctcctcggcccactgtgatcacggaatccgcatcctgccgaatcttctctttaaagtctttgatctggggtcgtgtccacatggatggagctgcgattactggaagagattctaaaggcaacaggaattacaaaggataaagaggatgagccttcacgtgtaggcagcaatctgcataggaccacctgcccagccatgagcaggcaccaagtgcaatctggtctaccttagattgaggactttaaaag

SEQ ID NO: 51576 - DNA, 1734 bp, Bovine  19866880370119
gattctccaggcaagaacactggagtgggttgccatttccttctccaatgcatgcaagtgaaaagtgaaagtgaagtcgctcagtcgtgtccgactcttagcgaccccatggactgcagcctaccaggctcctccatccatgggattttccaggcaagtgtactggagtggggtgccattgccttctcaggaacacctttaaatgaatgacacccgcagagtagatgaccaagcagcagagcttcagcgaggcctgagatggtacatcctccttaaagggtttcaaaagcacattaaaaatgaagcataacaggggcttgtccagtggctaagagtccatgtttccaatgcagggggcccagattcgatccatggtcaggggactagattccacataccgtaactaaggattcgtatgctgcaactaagacccagagcagccaagtaaataaaataaatatattatttaaatgaagcaaaacaagataccagtataggacaagcaaaacagaccgataggtcccctggtgccgatcaagattcagtgcctttaatgaacacaggaagaaacagaggctcagagagggaaatgtgtcgaggccataaggcactttgaggaagagaaacagaacaaagtccagctccccttcagggtctgaatattaaaggcagctcagagggagacggaagaggagaatttgttgacattggcccttagatgagagcaaaggttgacatatgacaagcgatgcttgcataacttcacctcctggactttggtgtgcttacaaatatgcacccactcatccaggttcactcatgagaactaggtaggtggtgagtcttaagcatcacacggagccaaaggtgcagttataacagaactgccactggcagaagcggcggcggtgaagggcaagtatcgtcagggccttgcgcccgggtcagcagacttgacaccttccctagcacagtttgttctttaaacaaccttctgctttctgtttaaacaagtgcctgggggataaaagaaccaaaaataagaagagcatcctgactgcctcccactcattcctccgaatgtttactgagcaactgctagaggttagacggctcagcagtaaagaatctgccagttcaggagactcgggttccatccctgggtcgggaagatcccctggaggagggcacagcaacccactccagtgttcttgcctggagaatcccatggacagaggagcctggcgggctacagtccacggggtcgcaaaagaattgggcacgaccgagcgactaaacaacatcataggttagacgtgcctgtaagtgtctgctttcatcatcttctggtgaatctaacccaaggtgggctgagagtgctgtttcacatatacatcgccatgagtaaattagctggctagtgagaagctgctgtacagcacagggagctccgctcgctgctctgtgatgacctagaggggtgggatggggggaatgggggaggtcccagagggggggcatatatgtatacacacagctgattcactttactgtacagcagaaactaacacaacattgtaaagcaattatatcccaatttaaaaaaagttaacaggaatatatggcaacagacatcattatcgttttcctattttcaagctttatttcccattttattagtaagccttttgtgacaaaggatgatgcccacagatagggtagagcccctatggg

SEQ ID NO: 51577 - DNA, 1059 bp, Bovine  19866880619361
aatgccgtttttagttttgtgattcgtctgaatagagttgccaacctttttgcggccattaggatgtgaggatgaaaaggaggtctgagtaatgtttctgtgtttacattcgtgtgatttctttatgattcctagacttatgtctgttgttcatgttcagatctctccgttttaatgttcccttaggtttttgtttctgttgctggggcctgcaggcaaggcaccacagtatcacgaaattggaagatcaatagccaccctcatgacggatgaggtaacgaacacgcccctggacgcggacactgattgtgaagcatataatgcatattaaattatagactctcttaccttctttggtgattttaaagtgtattttatggatctttctcttacagtattttcctctgtgctgtcagtaatacgcagatttgaataaatcatctccttaatgtagatgtatccgtggcctccctgttgtgtatttgtttaagctcttcactgctgccttaatagagtctcatctctgtgctttttgaacctgatctgctctgactggctccttttttctgctgtttgccccgcccacttggacttcctttctgcgccttggatatgatactcgtggcggcctctggacgctgagcactgtctccacccttcaccccactccctgcatgctgcgccctcatctcagtcagattcctcctgcagcgcttcctcctctgagacaccttgctcagccaccctgttctcccccatccgtttcccttcctttaccctgcttcatctgtacaggactttttgttatccacctgcagtagtgtattcacgtaattgcccctgagttcttgagtgcagggactttgacttatctgtgttgtgcctgccagaacttccctggtggctcagtggtaaagaatccgcctaccaatgcaggagacatgggtttgttcagtccctggtccgggaagatcccacgtgctttggagcaactaagctacgactcctgactgagcattgctctagagctgggagctgtacatgctgagcctgtgtgcc

SEQ ID NO: 51578 - DNA, 880 bp, Bovine  19866880684583
atctcctttaggattgactggttggatctccttgcagtccaagggactctcaagagtcttctccaacaccacagttcaaaagcatcaattcttgggtgctcagctttcttcacagtccaactcttatatccatacatgaccactggaaaaaccattttggagagcatagaaagacatgagtcatgtaaatagacagtgtatataaacatttaagtggcagagagaggttaagagcatagatatatgtgttcaaagttaattgtttcatttcaattttctcctcaatgcaatctgtttgtggtattggagcagggagtgttaaatgaattcttaagatagcttccagttctataatcctccattttagttaaattaagtgagaaagcagaaccagtttttattgctattttataaggctatataggagattgctgttttcaaaatagttttgtaagcagcaaataaacaatcatgaaaaataagatgatattttgaaatgctttgttgtataaataaatgtaaacaggataatttctttgttgttttcaaagatgaatccaactaaattgtgaaaacaagtttatattttgaagtaggtataatgtttgttatttattttcttatagctttatcatccaaatgttgtacgctattataaaacatttctggaaagtaagtatgagttttcgtgatatttctaataaagtatctatgttatttaaatatttttttaaaaaatgttacaaaagaagcttaatcaactcttttctctaccttttctttgttatatatatgatagttgatatttttcatcactttcttgatcagtgaaacacgatagtcaaagatcaaaatatgcttataaaatacttagatctct

SEQ ID NO: 51579 - DNA, 962 bp, Bovine  19866880769548
tttgggaacatcggaaatgctgtttgagggcaaggtcaccttgtaaacacagccaaaagccccactgccgagatgatccaaaatcgcatagttgcctatatatttcgaaggagctttattctgattaatgctttcaacattttcagcaatttgcttcagttcatcctcctaaccaaaaaatgaaaaggaaacaggtcactaggataagcacgttctaaccgcatggcagcctgccaaattagtttaaaagtcaagacttaccactaataaattcaactttgatactaattcttcataagcactgatatcacgaacataatgtcctatatcaatgaaggtctcaaacaggtcggtggggaaaagtctacagagaaaaatgcatacacatacttcatgtaggagttggaaagtctggcctgttccttcccttttggatatggtacactcgtaggtcaattacattaaatatactggccaacaaatggggggaatagtgcttaccaacttatcccacaaaaataaactagagacacatgtctcagggggtaaggaaaagtaactggaaaggaaagttccagacatctgttgcacaaccctgcgcttaaagttaggaacactggactgcacagttaacaatggaagagagtgcatctcatgctatgtgctttttgccataataaaacaaatagatatgatacagattttacagaaattttatttgtaagacatttgggggtatggtatcaaacatagtaggaatggatgcttactggatgtttactgaacacagagcactttcacaaatgccgtttgggtcagtcctcatattaacccgaggaggtaaatgttaacctaactcttgaatgttttattaaaacaaagttaaaatacagatgaataaaaatgaagatatttatgcatcatttccaagctactggtttcaagagtttaggtttattaaa

SEQ ID NO: 51580 - DNA, 1188 bp, Bovine  19866880815294
ctgatactgcaaacattcaaagtctgaaactagcctgccaactgtactctgttgtcttggtaacagaattatacatgtacatggaaaagtcttattgcctaaagcaacaggatgtttaaaaagtgtttaagctgttgactatggcaaaggctgtaggttcaacccaggaggtgaggtttgagtccaattatagacagagatacagaatttgtgctaagataacagtcattcatctattaactgacaaagtatttgtggtctggtacctatgtgcaataaactgtgccctggggaatgcaaagacggactaggcatagtctggtatgtgccagcacgaagtaataaatattaattgattaatcaatgaattttgtagaaagtcataattcaatgaccctagtttactagtacttgactgtatgtgacaaagagactgaaactcctgtctgtattaccaagttatacaggacaatttatttgtaaactgaaataaaatgttatgacttattgaattacaaccaccagtaaatatatcaactaagaccataaaatccagacaaatgctggtataggccaacccctatatcacacaaagtaatgtgtaatttactttgtgtgagttatacctcactgaagcctttaaaacaaaataatctcttatgttctcattcaagaaaaattattcaaatagaccatcacaagactgtacattcacttaagtcaatatataaaaataaaccattaaggtaatttgatttgccttttgtgacttaccaaatagaagttaaatgtaagccagaatcttatggttctgtatcttcagaacagcaagcccttgaaagcatatgagtgattgcagttaaactgcaaagtaggtcaactacttggtgaccactcagattaacaatgggagtatcccaagtgacactctatttatgaccctctgattacatgtaaagagcaaagatgtaaaatcaaatctctattctagtaaatcaaaggcataactaaaagcaaattatcttgttaatatacttgtagtttgctgggaaatgtgtatcaaaaggagattccccatgggctaccttaatatgaaaaatgccgtgctgacattgccaggtcttctaggggtctgggagagccctaggaaggctgccaggtgacatcttggtgggggagatttagaat

SEQ ID NO: 51581 - DNA, 1857 bp, Bovine  19866880921979
ctgatgtattgtaactgacagattatattatccttctttgtaaatcagcgtaattatttagttatgtacttgaattttaaaagctgatgatattcagtttgaatataaatacaaaatgtgtgacgtcaatctatatgccagctattttttaatacattgttagagataagcaaatggaagttgacgtacaatgagaaatttcaaggctgttggatccaaatttaatttgtatttgtgactcaaagtaggcagtgcctgataatcatgagggctagagtgtaatcactgggtaaatgtaatccatttgtttaattgcccagactcctcactgtatttacagttaattggttcccattataggcctcttaatagagactataaagcagcaggattagagaaacctgaaaaagaccatttaatttgtgccctctcactacagatcctcgactttccctacagcagttgagcttcaggcagtttggaaagaaatgtggttaaaaataaattggttgtggtgatcatgtaatcaaaataaggaaattactataagttaatatttttatcactgatttctaaaatttattggtaatttgcagaaatttttacattattttcggacacaacttttttacttacatttaagttttccttttgttcctctgtgtacttaatattttatttaattcattttcaactactgcggccattttatagtgaaatgggaagctgattaggctgattagataaataatggtaaggggcagtatgttgctgtgtttgttgatctagaaacatatctgcaatatattattaagtggaaagatacgttactggtggtatataaattatgatcctattaaaagcagaattatctgaaaatatttcaaggcttcatgggcaaaatgttaaattaaaactgaatgatggcagataaagacgaacaaaacaaaccaaaaagcctcaacaaaacccctttatcacggaaaatttcaaaacttgctgattaaagtttcttttgtttctttcttatagaagcagtacatccccattgacctgtaacaaatagatggccatatgtttccccagcaaagataggtttattgagaatcagcataaaattgtgattcagggtgtgcaaaaatgttgagccacagcaagggaaggagaacagtttcatagcaggcgtggggtggggacaggaagttgagagggctctggtaaacaaagggtccatggcttttcctgggcggatacctggccagccaaggggaatctttcttcttgttggattctactattgatgaagggtgtgagtgcgcccccttctggtcctctgactctattttaaactttcttatttatttacttgttatttagtctacacattcattttattactaaagataactgaggccaaataaattaaattcctatttgaggtctcatcttggttagtctaatctacagggactcaagtctataatgagaataaataacaactgctgttcagtcgtgatgtctgactctttgcaaccccatgggctgcagcacgcaagacttccctgtccttcactatctcctggagcttgctcaaactcatgttcactgagtcaatgatgccatccaaacagctcgttctctgtcaccctttctcctcccgtcttcagtctttcccagcatcagaatcttttctagtgagtcagctcttcgcatcaggtagccaaaatattggagcttcagctttagcattagtcctttaagtgaatattaagggttgatttcctttaggactgacaagtttgatttccttattacaataataaacacaaattgtcaaaatgaggtatcactgcagtt

SEQ ID NO: 51582 - DNA, 1661 bp, Bovine  19866880927250
cgtatgtaaaacatagttactatttctggtagtaggtatgcactgttagcttcaaaatttaactggctaacattcctaccaaagcaaaaacacaaactttagaaaaatagctcatatatctaatcaaataagtgaacacagaaagcaccttgacactgttaatttgccaaactatatataataataatggacagatgaaacaagattctcctgttgtttgtactagagctgcctcccaagcatcatttgggtattcaggcccaaccacaattctgtgttcacccattgtgtgcttgagaccaatgttatctaatataagtactaccatggtgtttgagactgtggagaatcacagtgggaaggctgtgggactgccaccccgtcactaactcagcctctacctccttaacgtgggcactgagcaggaggggtggcactttcagaagcaggtcaagaggcagcaaagctgaagaaataaaagggggaaagacatgagactgtaatacaaattgcactgaatttcagggtggcatgtgtgatgttactgctgacaaagctaaattacctggtctcagtctggatcctattccaccagtgaagtctctgtaagcagaatgagaaggtttattcaacttggatttgactaacatttattgaaagcttatatcccactatggtttataaaaccatatgaaaatataggtttgtttttcctaaagatgtcctcaagagtttaataaagggagaaaagagacataattgaacccagagcagagctgacattctatgagcaatggaagaacctggttgcattacagttgttcatgagctctaagaataattataagcctaaatcttaggcttgaatgattttcttgtcacatttaaaatcaaaatacttgaattaccctggtggctcagtggtaaagaatcttcctgacatacaagagacatagttttgatatctgatccaggaagatcccacatgacttgcagcaacgaagcccttgtgccacaactattgagcctgtgctctggagcctgggaatcacaactactgagcctgtgtgccgcgaccactgaagccgatgtgctttagagcccatgctctgcaatgagagaagccattgcagtgagaagcctgtgcaccgcaactagagagcagccccagctcgccccaactagagataagcccgcacagcaaggaagactcagaacagccaaaaatagattaaaaaataaaataaaaaatacttattttgtatgaaaaagaaatagcatttaaaattttatatgtagtatgttccatgctttattcctgctgtcttaaagaagaaactataactcttcctatgaaatgagataatttttacatttaagaagattatatttttccttattttctcagcattattaccatcacttttttgccctattctaaaacttaggatttccttatcattatgcaagttcgtctcaggacctttcccccagtggaagagtcattagaccctactgaggacagccataaataaccttcaatcttgttttatctactagaatctagagagacaagttcataacatttttttttttaagaaataagaaatatctatcagatcagatcagatcagtcgctcagtcatgtccaacgtctgcga

SEQ ID NO: 51583 - DNA, 1274 bp, Bovine  19866880983894
aaaaataaatatttgattagtaagaaccatgtacctcacttccaagagaccatttcattataaacacagtctccatggtgctcctaacaaacttcagacactacttcaaaaaaaaaaaaaaaccaaaaacccagtagtcacgcataaggggcatgacatacaatattgttatatatagcaacacaaaacacacacattatatacacacacacatatatgtatatgtatctaatctatctgtatatataattcttcttggttcaaatctataatgaagtttcagcatccaggtatttctttcttggttcatcttcaaaatttattttcacacttacaggtttttcagggctatttaaaacaaagaatgagaataagtaattttgaaatggtcaaatattacattcacacatggccaacagtaaatatccataatacctttgagatggctattcatactataaacataccagctgccattactatcttactgctttcttttcatatcagtaaactttgatgcccaaaggcaaatattaaaaagtcttagctttttaatatatatttttgccactgaaattcacattttcttataactcaaaagttattggttagggtatgaagactacgcctgacttaatagctttactttatatatgaacagttgtaacacttgacttttactgacaaacatttaatcaaatttaaataatttaaacaactatttaaatatttaatattttaaaaattatttaacctttgtcagtataaataaacatcagataatttcctgcaaaatggaacaaatttccaaaccttatctccccaaagttcacaaatacaagattctacattttcagttaatatcaaaaacaatgattctgtatacatgaatttaactgattaattataataagaatatctgggctttgaacatttttcaaaatatagaaacatgctatggtttgctgccttctccagacaaaactgaagaagacacctcaaacattcttctgttgaacaacataacaaaacattctctttcctcctaagctattttgaattgaggggcaacctgaatgaaaggcagaagtacttacaaaagacaaaataatattagtctaaggtctttatactaacattgtgggccaggggtgctgacaggagttgaaaattactaaaaattactaaaagagtatctagtgaaatttgggctgcatgaaataatccaaaatgacaaaaagtttaactttaaaacttttgagatcatatatata

SEQ ID NO: 51584 - DNA, 1359 bp, Bovine  19866881008283
aacatgacgtgtgagcgcggccccgggaggcagcggcagggaagaggggacgctctgaatacttaggagggtccccacacagctatgggtttgagagcccatgccaactgttatgctcagtggcaaaatgtacccagaggggagattttagatcaggattcttatcttgaaaagcccaatttcatgtttaaaaagactttcattgagcacaagcttaggtttatttagcgtaagagagacttctataaaagcaagtgaagtgaaagtcgctcagtcttgtccaactctttgcgaccccattgactatagagtccatggaattctccaggccaaaatactggagtgggtagcctttcccttctccaggggatcttcccaacccagggatccaactcaggtctccggcattgcaggcagaccagttgagccacaggggaagcctatgaaagcaacttttggtaaaaatatgttttgcatgcatgctaagttgcttcagttgtgcccaactctttgtggccctgtggactgtagcctgccaggcccccctgtccacgggattctccaggcaagaatactggagtgggttgcagtggccttctccaggggatcttcccaacccagggatcaaacccctgtttcttaggtctcctgcattggcaggtgtttttttttttttttttttaacagctagtgctacctgggaagcttaagcactcctccgctgtaagcttcaaatccctcattgaaatatctcatttctttttagatatttttcaaaaacttgctgctgtcagagaccaaagagaatgggtcaccacaagcggagctcacaaggtgagtggtcccagaggagttcctgcttcagtgtcatggggtgatgattcatgtgcggggtccagagcacttgtagtcaagccaccccacccgtaattataattcgaaaacttgctgacctagcctagaactgccaatctctgctaacccacctaaagaataaatttagaaacagcaaatagagattttctgaaacttctttttttatgctgtttaattctttattgcttaatcaactaatttgattgcctaatttaaatgttgttatacataaactgaccccaggtgtgtggttacaaataaaagaatattagtttggcacaaaagtcatgttagtttgaaccatagggaattaccatggtctgtaggtcagtttcatgtggtttaatctcataataagatggtttagtacctgtgagtcaaatacatatttcaagatgaatgaatgcaggcttaatcaaaacacactacatttatatttatagcaaagccatttagatggtagctgcctagagccaggtttca

SEQ ID NO: 51585 - DNA, 2150 bp, Bovine  19866881167693
tgtaaaagatttaatagtagtttctccatagggagataggtgattttatttagatatttttttgcttatccataagttctatgttttaaaaatattgcttgtgtatcagcaaaaaaaaggcggggggtggggtgggaaattatgtgctgtatttaagcatggagcgcagtcactagcctttctcctttacaaaggcagacttgtaaaatggatctcaatagatgagaaggtgctggttgggtgagtgaaggggtggagtggacacgcatggctcctactccagagcggatgagcatacacagagaacagcatggacacagctcgaaggcctggcagcttagagcgtgctttgcttagggcaggtgtgtgggggtgaaggaggagggggagtgccttgggagaggggccctggtgggtacgaaggggtctcattctgcaggatcttatatggcacaccagagggcaagtgttccccgagacactggaataataaaatcagagtcagaggaagcctttgcagctgttgaagctcatcccttttttcaagtcattagaaaaggaagtaaaatatgacgtttgccttcaagctgacttcagggctctcacccagaatgatcgtcagaccctcagagaatttgtggtggtgtctgtgggctggcagacagagctgccactgagaacacacaggtgtggggatgactgcctctcagggagcacagaggcccgaccttgtgccagaacaggacaagtccaccgtctactggacgtgcagcctgttaggtcatcagagggttttaaagaatttttacagaaattctctcaagacacacacaggttccccacttctcatagccgcttgctttctcaccaggctcctttgtgtcgtcttgttatctgcctgactttcccaggccgttttgtttgcgacccttctatatttaggtcactgattttatgagatgattccagacttgaattcagcagacgctagtcacccttgtggtggcctcgggtacaggtatagctgcaggcccagggctctcttgctctcttttctcagcactgcagaatttccagtgtttatttttatctggtgaaccctcacaggcctcttctgagtgttctcgggagtgactgtagatggttctatctggggactgccttagactttactcaagaaaccaatttgtcaagttggagtccactgtgcctgtggatatttttatatgccatcatttctagggtttattttctcacgaaaactatataaatattgaggcatatgtagcaggctagaaacaaaataaacctcgagctcctggaagtcttgtgccatttggttttctcggcacaggagttttatttcttgtctctgtgctccttttgtacgttctagaaaggaactaacgacaggcaccgaatcaaacaaggcccagactgcaagccttccacagggcaaatgctttttaaacacaagaactctggtgtttctgtcccctgttttcagttatgagctgtggctcctgcagccaccagccacgctcactgtacagccacgttagtgtccgcttcgtgatcattctatcctgaaaacgttttacttccttgagctaccatttgagaatcacatatccttctattttccagtgttacgcattcagagccttgaggtttctcttcagtatggaaagaaacagaccactgtttaaaaggtatgagcttagagaaattcgggtgacctgtgatctttaggttcaactgttttcacaggcctactttgtatgcaaacagtaagaaaagaaaaagtcaaaatgcaaaacatgtgtcctcagatttcttaaaatccacagataaagcaagtcagccctaaatgatatcttaacaccgaaagtttgcagagtgacgaggaagcacacgaatcaaatcagtacacctcttttcattacctgtgactgctgcagtgtttagtttttctctcttttttaagacattaacttttaaagcaatgaaataaaaacatgtgcttgtttttgccccttcagaaatgtccgaagttgatctagacatttccttttttaaaaaattgtggctgtgctgggtctttgttgctgtgcgcaggctttctctagttgaggggagcagggactgct

SEQ ID NO: 51586 - DNA, 976 bp, Bovine  19866881250350
catatgctgttctttcaggttcaaattctgcactaccccataaagagagaagaaactaatgttcaccccctccaactcaaagaaacaaatcttgggacacattctgaaaattaccttcaacttgtgctcctttctgttgatgatgaccgctgtaatctgctgatccatgaagatgaggatggtgcaaagcagagctggaatggcagctattaataaggtccaccaagggttctctcccagggggcttatgatccagcccctacttttatcagtaggctgttaaaacatcgaaaaattcaaaggaagaaagaaaagttttcttataacagcacagactgtgtctaccctcaagaaatgccaaggggttggaaagaactggacactggactctgtcgtgaattatctgcagagacgctagtggggattttcttgtccccgaggcaggtccctgcgcacgtgactgagccactctctccatctggaggtagaatttgcgttctccccttggacccgggaacaaggccatggtgaccctgtgatcctgcatcttgacctgggaagaccttgctgctgcttttctagcctcctggagccccggggttaagctcttgagtaagcctggatgagctttcttgaggatgagacacaggatgatgagacaggggtaggaggcagctaccagtcccttcattcagccctctgtgctgagctcccagacatgcccccaccaaggcagtaaagatagcagacacccaaagatcccacagcaggagaccagatcaccccacctcagcctagggccaacgccacagatttaggaacaaaaagaactgttgtttaaggatatgatgttttaggagatttgttatgcagaaataggtaagtgaagcagagtttcattcccacacacgcctatccactccatataaagtgaagtcagacaatctactaggtcaactcttaaaactattaataa

SEQ ID NO: 51587 - DNA, 1095 bp, Bovine  19866881451706
cgagctgagcttagtgtaaattcaaattgaatttttgaagttatataactaatttagatgacttggcttaatcatgtgaccttattaatctgtagtaatcactttcttcctctcgtccattgtctctctctctttgtctcatttatcttaggttagaaagcgcagtggtcaaaatctgttagcaatgaaagaggtcaacttacaataacccagcatttggaaaagataaaaaagaccgagacagcagtgtaaggaatattgtttctgaattaaccataattaaagagcaggtaaatggttttgcttacaaagatgttttccttaaataaatgtcatccaaaaagtagagttcatgtgctgttcctgtctacgctgtgtaggaactagttctgtttaaaataatcggccctgaggtgatatcaatcaccaggttttctcctaaggcttgacattgaaccacagacagtatatggggttataaccacatcagggccaggaatgcagaacaattgagttcacagcccagaatgcataatgtatgagaaagcatatccacttccttcttattatgttgaagtatatttcgttacttcattatgtgcataatagtatgactaagacttcccagacttttgtcaaatgaaaccaagttgttgacattcctcaaatatggattatttaatctaaactgtggattttcaagttgggttattatttattggcatgagcagaatattctaacatagtgttaaccactcaagtatcatgaagatctgtttaggagaaagaataagcatgtcagagagaaatgggatttctctttgtcatcagtgaacacactggcttctttttcaactttctttgtttatgttcactgtgaatgctgtttgtctgtaactcctggggagacctgtcagttcatggctgtttgttgttgttcagtccctgtcctcacgatctctcctggagtttgctcacactcatgtccattgaggtagtgatgccatctaaacatttcatcctctgttgtccccttctcctccggcctcagtctttcccagaatcagggtcttttccagtagtcagctcttcgca

SEQ ID NO: 51588 - DNA, 2231 bp, Bovine  19866881758265
tagtttgtgagtttcggtgtcccaggaagccctattcggcaagtattagggaaaagttgtctaaaagtgttagcacatgctactcattttatggaggttgattcttagtgatataaaggttagcgttttttatttcaaaagctatatatttcactaatatcagaatttgaagaacatttttgagtaacattaagttagtgttaagggtgccatgtgacaaaaattgtgaaatgatacatcagtgactggagcctgggaaacattgtgtcggaagacagaaaggagggactactctggtggtccgtggttaggattctgaactttcacggcaggggctgcaggttcaatccctattcagggaactaagatcccatataccatgcaccttggggggaaaaaaaaagaaaggaaaaagtgagaggaaaaaaagaggatgggatctgagaaacaaagataatgctagcgccatgtaaagtgcatgaggtcacaaaggggaaagttcacatagtggaaacccaaaatcagccttgcaattgtacaggctgcagctctggcctgaagtgtgtctgagtgtacacgctgggggactctgaaaatgtaataggaacaggagtaatagtaataggaatcctgagaaggtgactgttgagatacagggagctcgtccaaagagtggtggacgcctgccgcagaaacaactgagaattgtgaatgtttaacaaaccttcttttttgaggttaagtatctatgatctttagaaggaaacatactgtccaagaagcttgtacttttacataattaaactttattttactctgtttttcagacattagtgaatttactcagtgcccgagatacgaatgttctgctgggtgctcttctggctctggctagtttagctgaaaggtgagcgcatttttaaaagttgtgctgctgtagcaactcagataggagaaatgcaaaatttattttgttacctacttagttaagatttgtgaataaaaacatgaaatgccatcaatatattgaagaggaacgggatggaaatgcatcattttagaatttaagttggaagagcaaagcagttaaaaatttttttctgaccagaaatatttacctactcttttcattcaaccctcacttatttctactttcaaattgcacatttctttgacagttgaatctccctgactgtctttcttcattctgtcctctatgtttaagacttttaaatatttttgcactttaaaaaactctagataaccctttcagagattatgactattttaaataaaaaacttgaagtatgtttttatgccagtcatttgatcacggttttttttttttttcccagctttattgaggaataattacacatgtaattttatgtatttcaagtgtataatgtaaagatttgatacacatatacactgtgggctgattaccaagaccaagataattaacacctcttcacctctctctttggttctgtgataagaacatgtaaattcttctctcagcaactttcacgtgcacggccctgtgttactaactgtggttgccaagtagttgggtctttagtgcacagtcttctcatacccgaaagtgtgtgcactttaacccacatctccctgttcctgctgcttccggcccctagtaaacacctgctattctgttctctgtttctatatagtcagttttgcttattttcaatttcacatgtaagcgatgccatatggtagttgcccttctctgtttggcttatttcatttaacagaatgtcctctaggttcatccacattatcaacaatgacagcatgtttttatggctgaataatattcagtcatgcacccaattatattcacttgtaactatgtataaatattcaattatcacatttctctatttcatctgtcaaaggacctgtagcttgtttgtgtttcttggatattgtgagtaatgctcctcactgctttttagtgaacaccctatgaatccccctctccagtggggactgtgttaatcatcatactgttactgaacaaatttaagtttatgacgtataatacttactgaatgttggcatttaatgtagccccgctctatagagccatattgcattttgcttctcctcctgggataatatgaggactaagatattaaacatgtgacatttctcatagttactaatacttttcaatttttagtccagagtgtagggagaagata

SEQ ID NO: 51589 - DNA, 749 bp, Bovine  19866881801742
gttctggaaagtttctagattaaaaataaatgtatctggggctcaaacacaagcctaaggaattttagtccttggcttcttccatgggcccatccttttgagaattcacagttcttaggctgaaggagacagttagtgtgacacaggcactggaaacctgaaatgctttcttcaaggtttaaatcaatgataaagacatgtccagtcatcttaaaatgactctcgacctctacaggccacaattcacatatactactgtgcagctttaagcatcttcctcctgtgaaatctttaggattccaaggtatttacttaagaattaagtagactttaaataagctttctaagaaatatttgggatgaaaattccaggcagccaaattacttctatgctcagccatatggaaaacaattccatctgaagtcacttggaagataataccaggaaatcattttcagcattgctgctgctgctgctaagttgcttcagtcgtgtccgactcctagtgaccccatggactgcagcctaccaggctcctccatccatgggattttccaggcaagagtactggagtggggtgccttctctgcattttcagcattacaaggcatattaagaagttcagttgaagtaatctactagcttgaataaaagaactacagaatgcttaagactatctacattgcctcctaacagcactgatgagacatttattaagtgagtaaccatcaaatcttccttcattaca

SEQ ID NO: 51590 - DNA, 2503 bp, Bovine  19866881932488
cagattggttattgcaatgttacttttcccaaagaggatggagggttttatcaggctgcttacctaactagtgctaatcaggagattcctgattggctagtttaagtttccatcttggggagagctgaaattgtaatttagtttggttgaccccagggttagcatgaatgactattttgattgtgagcccattgtcttgttttaaacaggatgctcaagtgagttcagggactgtgcaaggctgacccagttctggcagaagagattatggctgtagttgtcccacgtggggatttagcctgaaagttttaggcattctggaaatccaaggatattttgtgtgttgcccttgacactgtaatgcattggcaagtgcagtgcatttggtggagctttctctggaatttttagggacatgacccacaatgggttctcaaggcaagaatactaaaagtggtttgccattcccttctccggtactttggccacctgatgcgaagagttgactcattggaaaagactctgatgctgggagggattgggggcaggaggaaaaggggacaacacaggatgagatggctggatggcatcaccgactcgatggacgtgagtttgagtgaactccgggagttggtgatggacagggaggctttggcgtgctgtgattcatggggttgcaaagagtcggacatgactgagcggctgaactgaactgacccacgatgagagaggagctccctaaactagcagtgtgctgttaaggaaacttaccgagaaagacaagtaagatggcataaaagtgtcggtgggacttcaggtatttgcttataaatattttggaaaccccaaatatggacacttttcctggcaagcagaaaagtacttgttgggggtaatgagtcagaatatttgaaatcaagaatgactcagaaaatataggctcagttactactataattgacttcccttgtggctcagacaataaagtatctgcctacaatgtgggagaccccggttcggtcccttggtcaggaagatcctctggagaaggaaatggcaacccactccaggactcttgtctggaaaatcccatggagagaggagcctggtaggctacagtccatggggtcgcaaagagttggacacgactgagcaactcactttcacttttcactactataattataaactatgccctaaatgtatccagaggcctttgaatgataaatagtaaatgttactcatattagcatttttattattgtattagaagtaaatgttagtttgtgcatatttaaataaatgttttaagtggatttgcattaattgagaatattttggagcacacaagccaactaaagtttttccttccagtttactttgaaaggaatgcgatgttaattctggggcattgatggtttacaatgcctgatcaagacaaaaaagtgaaggccactgaaaaatcaactgataaaaaacagcaaggagtcaccatcaggtaacaccatactgagtttttgcttattattaactcaagcagtgaccagcaaccacagtgtagatccttgacaactcctactctggggtagagtctccactgaaatgtttgccctttttaaccctctccagtattcttgcctggagaatcccatagtcggaggagcctggtaggctacagtccatggtgtcgcaaaaagtcagacacgactgagcgacttcactcactaaagagatgtttgggtttgtatatgtttcagtctataaaagcaggcctccaagtggcaggggtccatgttactagtgggtagcacaactggttcacccagagtcttctgtcggttgacactgtgttattctttctcctagggactattcagatcttaaaagacttctgtgccttttgaacgttcaatcaagcaagcaacaggtagtgttttcaaagaatgcacgtccattaatgacagagaaatcatgtttccaaaggatccattgaacatcttatgacgatacatctattttcctttgttctttcacgtgtttcatctttcttccagttgtttctctcatacctggttcagggtcaggaagcaggactatgcatccacagcctttttatttctctgctctcatgcctggtgctaacctgcaaaacacatcaatatagaaaggatacgttcttctattgaatgctcagtgtctgaccctgcagagctctaggggagttgatttctccaaaacactgtacatcccgttttccttctccccttccctgcttttcaggctgcccaactgctatagcacccctcttgatgctggctgcaaagtatatctcaccaaaaacaggggaaatgaaggagtgagttttgactatttttataatagctttttttttttttttaatggaaagaatggtactgccacttgaatttatctctagatgtttttttggtttagcttctgtaagacttggagaggcgtagattagaggctatccgtaaggctg

SEQ ID NO: 51591 - DNA, 1843 bp, Bovine  19866880444848
tctcctgcattgtaggcaaattcaataggcatataattagcatgcaataaatatttactcaacacttatttacactgttctgggtgtttgaacaagatacacaaaggtgcttgtcttcttgaatcctctattataactataatatgtacaaatttctagtatatggagctttcctccctcctaaggtttaaggctaacttccttatttgtaaattagtggtaagaaaaccagcggtaaaaatagatgggaaagtgtttgagaaaatacgaggcactgttaattattatgttaatcagtttaagggaatcggtaaacttgctctttccacccctcacaaacgcccctttacaattttctcaatttcttttccaagggccccgggccaaaatggaggaggctggactgcatctcccagcgcgccgggagggggcgctctgtgcgcctgcgctgtcaggcgccctctctgcctcctgggagttggagtcagtcttttcctcagcccgcccagtttgctaccttccccgcctccgcgcctaaccgtgctgcctattgggagatgtagtccggggcctcccggactccaattcccagcgggcttcggggcgggaacccggaaggggaggctagagaggagcgagtgggggaaacccgcgtagccgagggagctgcagcgcggggtgatggtgagaacctcgaaccggggccgggggcgcttgagaacccgtgcgggaattcgggacccggtagcgagagggaagaggcaggggctaaagaaggggctggatgagggggagatcgcttgggggaggggattgggagacgggagccggagggaattgtagaatgggggctggggatgggtcttgaaggtggggagagactcgagctttgggattgattgtaaggaagctcagagttggggaaaggagtcccgagttggagaagggagttggcgtccaggcagaggcccagaagggggcaatttcgagggttttagccgggaggatgtggaaaggcatgggagtcagtgctagatgaatgagagggtctggaggctccgagggagaggccagttctgaaagcggtgggttggagcctctggatcggattgtgggcaggagggcaagctgagatggtgaaagaaagaaatcagtggtagagtggtgtgtaggttaggatccaggactgtgggtacggtggggagcaagagattaggggcctgcctgtagcgatagtttgcttagtccagccagaaactcccgataaaccggacagccacatagggtaatatggccagaagaggccatagagacgacttctgcactcttatttctccagtgggatttagaaaagtgtggtggtttatgtgtatgggcagtccggcattcagatcttttcttcactcctttatgatctgggcaagtgtcctgtctctgaaactcagtgcccttatctattgtgggaacaacatgccactgagaagagaggagtcttcataagatcgtcctcctggctcagggtaagtccttagtctcagagcagttggtgggaagttccccaccccaggaatgtgacttggtcacaggtgctaatggattccctccttttcagtggagccccaggggtgttttctcaaaacgtggcactgatctgggcacatcccaggtcagaaacatgcgggggcagggagagggtttccccacagccattccaattccagttaacacttattttttaggaagtgcctggccttgttcttagctatttgtatgtgctaactcctttaattctgacgacacccctaagttgtaggtgctgttattagctctgttctacagtaag

SEQ ID NO: 51592 - DNA, 1611 bp, Bovine  19866880610396
tgtgagcgagtgctgcgtgcgcccgtgtgtctcggcgtcaggggcttgttgctgggtttccgtgggtgtttgtgtcgcggtgtctgcatgtgtgtccctgtgctgccttcgtctgcagtgtgtctgcctgtgttctcagtctctgtgttttgtcgccgcgtctctgagctcactgtgtttgcccactgctgtgtcctggtgcctgtcaccatgtctattacagcgtgtctctgtcactggcttctgtgggtctgtttatgtctcggacgctctgggtctgcctatatctgtccctgtgtgtcactgtgtctgtccccctatgtgtcaccatctacccaggtgtcccgtgggttttactcaccacccaggccacaggtgggcgtgtcaggcccactggtgcccagagctgcagcccaagcccatcccaccctcgccctgccatgggccaggctgggcgcctgtttgcaatgcctgccccaggtaaacaccaagatccggaacgcaagggccacctccctcacctccgctccctgccccttagcctgccctggactgggctggcccagagccccacaggcggtgcccctaaactggagatgtgccctgacccttcccccacccacggtcccccaccttcccaagcccccagccttggcctttgcctgcttgcttctctttgtcaacccctggctgtctgctggcctctctgcttctttctgtccctacttcctctcacctgcatttctctgtggttcattctctggaatgacccttgtcttcattctgtcccatctaccttggactttttctgtcttttctcagggaaatctgatctctctcctttcctgatctgtctctgattgagcccaccgactctctctggcacctggtttttaactcggggccacgatctgccagtctcttcctgtttctctcgaaccttgtaagtccctctcgaaccttgtaagtccctctcacccggaaccgctcagtcttggtcactgtctctgacgccccagaccccacaggagcaaacctctgctctaccagggtccttagggggggactgtgtggcccctagccttccaccccagctcactggtagatatatatatatatatataaaggtatatgtacatattatttatatctgtacccaggggcaggaggggcagacactggagcctttgtgtagccgctgcccgctgcctgcctgcccgccactcctctctcttcgtccctgcgcccgcccgcccttactccccccgcacagaaaggttcctgtggggcctgccagcttcctctgcctgaggtgtgagtgggcacgccacagggcaaggcgggcaggggggactgggggatttttccagctcctgggaaggtttccgggtggggaggcctctggaaggaatgggacttctcagctgggctgccgtctgtctgtctgtgtctgtctgtctgctgtccctgggcgtcctgggtccttaacctggcttctccctgggagtttgtccatccagctaatgtcattctgactcttttctctgtcaatctgcctcttattccctcctgcacacactgtcactggggcgtctatactaggccctctgt

SEQ ID NO: 51593 - DNA, 1372 bp, Bovine  19866880743873
atgctgggactcctgcagtctccccagggctgaggcatcctcatctcaaggtgacaggaagggaggaagatgccagctgacattgctggatgtggctgagaacagcatccactgtgacatctcaagttggtctctttcctctccactaacttggccagtcatttacacaccactgatcaggcgcctcccagcgtcctggacacagtcctaggagccggggattggaccatggacaagagaggtgccgtctcttggcctctttcccagtttgctcttccctttagtctcggctgtgggtgtaaggcaggggacagaatcagtgcggccctcacgcgagggctgcagttcacagaactgggggcaagagccaggcctcctcctgagcctcccttccttgaagcagccagccaaatgctcctgtgagccagcttcaaaggtgtgacacccccagaagacacaggcaggactggaaggcgaggcctcggggcatcctcttcctctgcccattcattcagcccttcctcccagagcctatcctctgggccaggccacgggcatggtgctagtgacactccggtgatcccatacgctcacttcctggggtcacccatgagtggtgggtgttccagatcgtctgttaatcttgtgaccttgggcaagtttctttagagctcagtgcctccatttactgaactataaatgggcattggacttctggtggctcagacagtaaagcgtctgcctacaatgcgggagacccggtttcaatccctgggtggggaagatcccctggagaaggaaatggcaacccactccagtattcttgcctggaaaatcccatggacagaggagcctggtaggctacagtctgtggggtcgcagagtcggatacgactgagcgacttcactttcactttcaaatggctattataataaccatatcctttggcaaaggggtgctgagtagtatgtaaaatgattaaaactgtgctggcatggtaagtactatacacttgtttgctaccatcatcttcatcatcattattgcacttaaatattttatcttctttagagcttctaatcggagaaggcaatggcaccccactccagtactcttgcctggaaaatcctatggatgggaggagtctggtgggcctgcagtccatgggtcgctaagagtcggacgcgactgagcgacttcactttcacttttccctttcatgcattggagaaggaaatggcgacccactccagtattcttgcctggagaatcccagggacgggggagcctggtgggctgccatctatggggtcgcacagagttggacacgactgaagtgacttagcagcagcagcagcagcagcagagctt

SEQ ID NO: 51594 - DNA, 864 bp, Bovine  19866880796831
tcctacagtagacatatttgcgggggctgttattcaccctccttacacagtaagagtggaaacaggaaaacctatctcccatgaccttcatctgggagtcaaccaacagctacgatgcagaagacactccttaaccggccgcggggcatctctagctatggttaccgtggccgagactgcagagccaacctttacctgctgcccacgggggagatagtgtacttcgtggcctccgtggccgttctgtacagtgtggaggagcagaggcagcggcattacctgggacacaacgatgacatcaagtggtgaggccagggcggaggatgccaaatatctcccgcacagggcatcaagggggaggcggggggccaggtcttcacttggcctgaattcaggcagaattcagggggaaaaacatcgtggattaactatcagtacttcagatgtcggtgaattcactccgatacctggatttttcacttcttttgaaaacttcaagcaggcacaccagacacagtgtgttggaatcccgtggtggcagccaccctttcgatgggtgtgttctcttggccatttgtggttcacgcttgagccctgtgggcccctgagttagagaccagaggtctgagtcttgcttctgagccagggtacccagagagtgttccctaattgttactgaagaattaaatcaatgttcattgactaactcaggggtccccaacctccaggatctaatccctgatgatctgagatggatctgatgtaataataatagaaataaagtgcacaacacctgtagcgcgcttaaattatccccaaaccatctccctcttccccatctgaagaatcgttttcttccacgaa

SEQ ID NO: 51595 - DNA, 1092 bp, Bovine  19866880822361
catgatctcagcccgttgccctcaccccaggttctgattctgcccagtttaccctctggccaagccctcaaattcctttcacgccggttcctctgactaccccatttcctgcagaaactcctcttagagccctgacctggctgcctccccgagactaaatgtggactctgcctttaccttaatagccacgcccacaatcctggatcctccctaacttctactcgggctcttccgagagactctgaccatccacgcctcctacgcgctagtccagcctctaaagctttgaccacgcccctcaatgttggctccgccttctcgtgcctttcactattaccactctgtctcaagattggtccctccgatcctcctgcaccgtttccgctttctgaactagatgatcatgctttaggttactacctcgtggcctggggcatcaccctaatctccccatcgttttccaagcctaactgaggttttggtcccaccctttgcggtacgaccccgctttggacacttacccttcctttttggcgctgcagttgctgctagaggatgtggtgcggctgcggggatcctcgcggcgcaccgaggcgaggcgctctggtgacaagtagcgccgggcactgctaatagagagcacacagttagggtcagaacctgcgaagccagcaggcgagtgccggaggcgggcgagaactttacaggacattcccctgctgatgttcagacacccgagtccatcccttttcatataaacagcctccgaggtcttggaagaggctggggatcccgacttccgcgcctcacctgcgcccagaggtcgcctcctttttgggggaggatggagacgtggcatagccgcccacgcgccgcggaggtcccgagccattgaggggcgtcctggtgggaagacctttcaggagctgacacactagatagatggagttagaggacagaagaggatgagtttgaagtacaggccccagcccctaccacctcacccctctagtctagtgaagataccggaggcagtggtgcctaggcgaggaggagcccggcccttgggggtgccccgcgcgcgcagcgctg

SEQ ID NO: 51596 - DNA, 1476 bp, Bovine  19866880885675
acatttcgctgatcttggcacgtctatcctccctgcttttttaggggagacaggggaagagctggagtattgtaaagtacttagacaccaggtcacttcacccacacatacctcaatgttaaagcagctctgaaccacgtgtctgtcatgtgcaatcactgaaagatatgtgtctcatctagagaagccttccttatggccataacctactagactgatgatgctgaaagctttcggggcctgctgtttagcccacataagaggagattggtctgtggacaggggaagtgggggagggcaccaacctaccgtggagggtttcgtaggcctgaatcacctctgacatgaacatgggcctctggcgggcaatattggccagggagcccagggctgtggtcaggttgatggaggagatagcggggtgcaccatgaacttgagcagctgctccaaggctgccttgccttcttcccacagcacatctaacgagggagagaaaaggaccagttagtaggcggctttctccctggcctccagagagagcagtctttgggaccaaaaggagaaagatcctcgtacatggatggctgtgactggctaaaaaaactcaggagatttagtgcgtgacgagtctgactataatactattaataaaaatctagagatgacgctcaaagcatgggcttgcaatcctgaccaagtagaaataatttaaaatatccaactataaggaatctgtctgaactacactaacgtaaaactttgaatatgtacacacgtgacaacacacagacagaggactcaaaattctctgaaccaccagcgtccttgatccattcaccaaaagtgaactctgaaactgtggcaaatatctttcctgacatttcttgtgcaaaaacctactggatgcgacattatacaaaacagtgaataaaatacagaatgtaatgtagccattctaatggaatattttgtaacatctgaacatgatattgtttgggaaagatgcaacttaatttttgttgagttcaaaacgtggtcaaacaatatagaagaacagctaacatctgtggaatgcttacaatgccagccatataaactcaccaaaagctcatactaacaccctaaagtagatgccatagtaatgactccggatttaccaatgaagaaacaggctcagagagaataggtcgggtgctcaatggcagagcagagattcaaacacaagtcattacactttcatgcctctcagctggaagtattaagcatggccctgttttctataaacaaacccaacaaacacaaaactatgaacatacacatataaatacctatctttgcatagaaaagacctgagaggaaacaatactcttggcagtattcatctctgagaagcaggactggggaaggacggaatttcctttcctactcctccatatttattgcttgacactaaaacgggcatgtactacttttat

SEQ ID NO: 51597 - DNA, 1190 bp, Bovine  19866881041826
atgctgggaaagattgagggcaggaggggaagtgggcaacagaggatgagatggttggacggcatcaccgactcaatggaaatgagtttgagcaaactcccggagaataggatggatagggaagcctggtgtgctgctgttcatggggtcgcagagctggacatgactgagctacaacaacgacaacttctcttttccaaagctcttcgcactttgctgtttagctgctcttccttctgccactaatcacacctcagtacccacctctaggcctaagcggttgtgtttagtcgcttcaggcgtatccgattctttgcgaccccatggaccgtgacccaccaggctcctctgtccgtggaattttcccggcaagaatactggagtgggttggcatttcctacgtcagtggatcttcccaacccacgaatcgaacctgtgtctcccccatctcctatattgcaggtgaattctttaccactgaaccacctggaaagccctaagagctgtcccattccaaaagaccacgccatttctcttaaacccctcgagtatctgtccatcccatcttgtctccagtcttccctcagtctccgccctctgcatcttttgaccctgccccgttcctgcaggccccgccccctaatggagccccacccatcctctagttttactttagcctctctatcaaagctcctcttccctaagtccttaggttcttccctcaaagacctcaagccccgcccccaggaccttgcaaagacacgtgtccaacagctgcgcgcagagaagctccggggccaagcccaaacagaggcgcgatgccaccagtcccactagggcagacccggacatcgcgtcccacacgccatcagaagccaagagcatgaactcgtcctccgcttggcgtgccagggcggtcacctcaggctccgcggaaacgagttgctgttctgggggccttcctggagcctctttgtaggcaaagtctcccagggctctggacactgccaaagagccctcgaggcgccgacggctgatggtgccacccgcgtcatggatgcgttcacgttctcggggacggaggggccgatggtcctcggtgctgaaggccacggcgccggcgcgacttagcaccgcgcgagagtcaccgcagtgcgccaggtacagaaagcgcggggaaaccagtaacg

SEQ ID NO: 51598 - DNA, 787 bp, Bovine  19866881057230
atccacctccctcgccgaggagggggatgggtggggagggggcccacctctctcgttgccccccacccccgcccgcccagggaaggtgaggaggaagtgggccgagggggcgcggccggccgctgactcacaaccgcagggtgtgtgtgtggggcggggtgtggggggggggtggtgcagcggtggacctgggtgggaatgggactcccgatccctgtgtgaataaggctcctggccccctacccacgcacgccccgccgtgactcagtttcgcgtgcggaagatggtgggatcatgcagcaatccgagggcacggagttggaggaccctccctctaccgactcctgcgagacccctcccccacgcgcaaggttcaggctgagtccctacagcctcccgggcttccgcaccgggacccgcagactccacccccacgagacgccagcaatatgaccacgcccctcctgtagagcgccacctggcctggagggcaggagtctgggcaatcagttgaaagtttagaaatggataaactgaggtctagaggcagggaataaatctgggctagagccctcttgcctgagccaccaggactccagtggttaatgagagtaaaacaattcttagggcctagctgatttggtgagggaatcaagcttcctacctgtttcctaaaggagcctgctgcctgggcgataccctgatctttatctcattcttctaggccagtctctgatattaattcttctctgaagaactgagtaatcctctccccttctctaccgta

SEQ ID NO: 51599 - DNA, 1456 bp, Bovine  19866881063587
ggatgtggtggggattagaagcagaaggtcagcccctccagggtcaaaggttcccctgctcacagatcagaggagggtgggaggcctgggggtaaagcactgatcatgccaataaggatgaatgttacttcatcattctgggataatgtcagataccccagactgcaggctgactatgttcctgatctcatttaatcccttcgagtctaaggaagcagacacctccattattagcatcatgcccattttataggtgggaaactgaagctcagggaaaggaggccacttgcccaagctcacacagctggtaagaaggaaagccagaatctgaacccagggctctctgaccctagaacccctgtctgtaatcacttcatttgactgctatgggatcttttgtgtttctgccccagtgctttagggagaggctagggaggtggaaggaaagctggatggcccctcagaggccaggtgcctggtcctctctccagcatcccaggcaggtgtctgcctataccttcacccttaccaatgctcctgagccgatggaaccagcgggccgtgcgagggaagtgactgtagaaggtcgggttgggggctcccaggagatcaagaagcataaagagctcctagggagagaagccaggactgagcagccctgcgggatgctgccaacctcatgcccccctcctcccacctcaccggcacccagcagggccctagtcttacaatagcctggatcctggtggagcccaggccgtggggtgtagactccatgagctgggccaggtgccgggagccataaagcgagtccttgggtccccactgcttcagtgcctcttcaccatccaggaagatcagctgcaaggtcattggcgctgcctgtgggggccagtggtcagggccagctcagtgctagcctgccacctcaacgcacccacatttcctgcctgtttgcacagctgactagggcaaacagtctcctcacttgtagaacctgatagccaagagtacagtctgcctggatttaaatcctggctggattgctcactagccaagcagtagtgggtcagttactaagttctcaaagcatcgacttccttatgtagaaatagagttaatgccacttctcatagggtaggatttgaacccgggtcctaagacagcacgggtttccctggtggctcagtgctaaagaatccacttgctaatgcaggagacgtgggaaacgcaggttcaatccctgggctgggaagatcccctggagaaggaaatgacaacccactctagtattcttgcctgaaaaaccccatggacaaggaagcctggccggctacagtccatggggttgggaggagtaggacacgacatagcctctgaacaacaagaataataaagcagcctaggacagtgcctaatgcatagtaactaaataaggattagctctgatgtaaga

SEQ ID NO: 51600 - DNA, 955 bp, Bovine  19866881138580
ccgggctgtatgcagctcccgaaaatccgaatcatcgttccctcctgccacgagcaaaggagggcatgagctcctctgacgaagaccctaacccactccccttaatcccttggcccagctgtgagcccccttcaagttccaccctcacatcctccctctttgtttaccttctgtggagtcaggggtagatgaagctgtagacggagcttcttctgcaagaggaaaatatcgaggacacttagaagtttagactgcctgagttacagtagtgagccagtcctggaaacttgtctgaattaaggaatcttagaattttcatcacaggacctttagaacattctgtatacaaactgtaaaaccttcctatccctgttatctgaagctcagtcttggaagttcaaatccaggaatcttgatcttagagtcttcaagcgttgcttcactcgtgtctgactctttgcgatcccatggactgtagtctgccaggctcttttgtccatgggattctccagacaagaacactgaagtgggttgctgtgccctattccagcggatcttcccaacccaggaatcaaaaccgtgtctcttatgtttcctgcattggcaaacgggtcctttaccaacagcgccacctgggaaacccttcaggcttttaggaggcttttaggaggtttcaattcattaattctttcaacaaccattatttgagtgcttaataaattccagtcactattttagatcctgaagatacaactgtaaacaaagcccctagtcttctagagcttacactctatagaggagatagacacaaacaattaaacttatggtgttgggtgctaagtgtatggagaaaaatcaaagtaagggaagagaaaataaggggatgctatttcagacaggttggtgaggaagactccttggatgacatctgagaagaaatctgaatgatgtgatg

SEQ ID NO: 51601 - DNA, 1296 bp, Bovine  19866881275549
ccaggaggctggaatttctcccctttcatttccttattgtctctggaggagggtgtgacagggagcgcagggaggcggtgtgaagccagaagctagtttctgatcctggtcccagcctaggacctcaggtggcccctacactccgagaggctttaggttctccatctagaaaatggggggagggggagcagttggaccagctgatttgtgagaactgggggtctgggggtgatgcctgaggactataactttccaatttccctccagacaaagagtcagcctggtggaggggggtgccatcaccccagcagaagggtgcggtgggcaagaagcagtgtggggttccccccagtgctcagttgctgagtgagtgcagaagtttctcctctcattgttctgacccaggtggaggaggtggttttgttgatgggaaggttgaggagaccctcacacagtacgtccatttccagccccctacatgtcatctcttccaaaatatgcccccaaatgctgactatctctagactgtccctcaatttcagagacaatttccacacaccttgtcccctaagcttcaggctgtgccccaaataatgactccttccgcctagagccccacaatttactttttaagatatacctccaaaacactgatttgtagttggtatccttagagcacacccccaggatctgaactatgcaaggcgttcgttcagctgagattctcctaccacctgggagcctccaccaccaacctggtctctgccttccccaccctagaaccgacattgcctccacctctcaacactcccaaccccttccctgccccaccccacgtgcacatcacacctccacagccccaggactggcccctcctgggcaccttgccaagcctcgcaggcctgggtatccaggagtcccaccctacagctcaaaccccagacccagaactcaggcacgctggggcccatgaaaaccccagatcttagtgtctttggagaacttaatccttgcagtcccacatcccacctcaggcccacagtccccatacaggttagaaacccaagtatccagatccccataaccttctggctaggaccctgtcccgcctccacttcataatgttgactagagagcaagcaggctaagacggagtccttgcagcaagaggaatgcaagttagacctgggggaggactctccatcagctagggcaagcgaattattgttctctgccccctattccagggaagtcttgtcctgtccgagatgggactggtgagtacattagcagttt

SEQ ID NO: 51602 - DNA, 1628 bp, Bovine  19866881348722
tgcttactgtagatgtctcaggatacccagactgctgtgcgtctgtcttgttttttttgtgtgtggttctctgacacacctatccctgggaccctctggatctcacactgttggatgtgtgtgtctgtacgtccctttgtctacttgcctgctgcctcaaagagtctgcctgtgcctacatcggtggtgtgggtcattgtgtgtttcatgtgtatttctgtgagtcagcatctgtctgtatgtcttctaaaaagttatgtctctgtaacttatgcctggctttgctacctccctgtcactgctgtggctgtgtgtgagtgtatattggctggctctagtgtgtctctgtctctttcacatgcaggtgtggggaaaaggagctgactcttcctttgggcgctaggggcctctgggggcctctgggtttggggtctaggggcttctattcgtccaggtctctgcctaggctctgagtctggtatctgtggctccaatgtccctgagggcatggctctctgagaaacataggtgtgtttttcacggcccttatttcacagggtggaaactgaggcccagaatgggaaaggccggggccgaggtcatgccgccaggctggctggagcaggtgttttttccttagtttgtatttgcctttcatggctgttggctctatagccactcattcatttagtcagtccattcaaagaccaaaagctgtttctttacgtgtgtgtgtgtgtgtgtatgagaaagtgacagacagacggaggacagaagggagagggatgtttctcccacttcccgtgtgtccatctgtctgtcccctagtgtcatctgtgtccctacttgtctctgtgtcttaatctctgtcctttggtttgtgggcagctcgcacatcctctgtgcatctgtctctcgaatgttctgccttgctctctctctctctcatcctctccattcctctgagtctgtccctccctccctctctgaatgctccctccttccctgggggctctaagtcttcccttcttggggtctgcctccccccactcccttggttctccggcctctctcctcctcctttggcctccctctcccggctccctgagtttccgcctctacctgccacctcgcgggccaggccctctatttctgtcaccgtgcccgccccaccggctgcgtgtcaccccccgccccctgccgcgctggctccccgtcagccgtcccaccagcctcgctgtcctgggcaggctggggaattcctcccggttcctggaaaaaacaactggtgccgagagaaaggccctcagtctccccgggtgcccgcccccctccctcgggccttgggggtctctcccggagtcggccggcccgaggcaggaagccctgcggtttctggcttctcccaggcggcctccggatctggcccccgccccccggccaacagcccaaatattattccgcaggaggagtcggtggcggccggaggaggcccaggctgaaagaggctttcagggcggccaggcctggggcttcctgtccccaggctcaggcctcaggccgccccagtggggacctcaggtggccggaggggcgggtgttgttgtagggtcctgggggggagggtg

SEQ ID NO: 51603 - DNA, 1068 bp, Bovine  19866881561513
acactctcacagaagctcagtgcctacgagccaaggcactattggtgaacagccctgacaaccaccccatgagggaggccctgtcagaaccccactcactgctgaggtggcgttggctacccaaggccatgtgcagaacaagcagaactggggtcccctgaactccatctgcctcctgttctgaaccacactcagcactccctaaatccccatcctcttttgcttctgtaccagctattgtgccctctgctcaagacactctccctctctcccttggcctggttctctccttctcctccaggtctcagctcagacatccctcttctaggaagtcctccttaactgcccgccattaggctgggtcagaagtctcctctgggttccacatccccctaggcgcctccatctcagccctgcccactctgggtccccactgttgggtcacctgtacgtcttccccactggacaggactctggcggagaagaaacttgaggatcaagagcatagcatttggagtctgaatccagcattcaggtcctaattctgtcaggtcctagcagagtgaccttgggctaatttaagctctgagactctacttctttctctgtaaaacagagaagaaattaccctgcctcagagagcttttgtgagaattaaacgatggtgtggccgagcagcgctgcgtgccgtatcccaagcgcttagacgtggatgctagtgttagtaccagtgccctcttttccgaggctcccatcccagctcctctcatcctgcttagcccggcgtcaccctcttcccctcacctgtttgagcactgtgatctttgagtcgttggtgatcagtgctgcctggcccaagagatctaccacctggaaggagggtgaaaggcaggtcaggccagctcctacagcactcctgagatcttccagctaggggtgggtcaccctggagagggcccaggcctccccactccacacctctctctgtactcactctctctgatgtggtcatgccatcgatgcccggcccctcctcttgagtgaagaactggatgccacgctccggcg

SEQ ID NO: 51604 - DNA, 1211 bp, Bovine  19866881693767
catcaagcttaaccccatcgtggtgaaagaggtcttcaatcgcctgctgggcacccagcacggtaggtgatgtgctcgcctccccaccaggggccagctcaaccctggccctcgtttccctccccagcagctcccccaggagaccccacctcaggtgcaggaaggaggaagaggtcccagaggtgagagctgggggagggatgccaccaccttttggtcgggggtgttcatcttgctctctgaggctgccattcaggcttggtgacatctcgacatctgtcccaaagctcctgggccaccctcccatgatacttgggtgatggtttcatccacattggggacaaaactgtgggactgagggctgactctctataagcattttcccttccaggacctcaaacacggggcccatccctgccctacctcaggtcttgcctgaacccctctggctgtgggtgaggggccttttgttcgagtttggactcgccctggtccaaaagaaagaaaactttcaacctagacagactaccagatggcatagggtagattcctcagccctcaccccaggggctggagctaggaaaggtggaagctctctcttccacacgtgacttggcgactcaaaacacgcgcgcaagtgtctgggaccctcgacaccccaccagaagagtgccgtctcccccagcctcatgccctgtggcgtttagcccgagcgctgtgtgcaagtctgttgcctggccccctcttgtcccgtctagcaggcgcccctgtgcctctctgctgtgctggggacctgggatgagctcgtccgctccctgcccttgtaggtgcacagcctgggccgggacgggagagtggttgagtcacaggcgaggtgctgggggcccagtgcaggcctgaaggcctctggttggaatggtcaccagccgcggcctcactggggcgcctcctggtgctctcagtctctcctcccgccactccagccctctctacccctaatcccagatggcgccttgtcttcctctgccgctcccccagtctaggggggcttggacctgtctctcaggcctccatactgtctcctcctcctccccccgttccccatgctgcaggtgaagggaactcagccctgtcccccctgaaccctggagagctgctcatcgccttacacaacattgactcggcaaagtgtgacatgaagtccatcatca

SEQ ID NO: 51605 - DNA, 1074 bp, Bovine  19866880393411
cacagagtcggacacgactgaagtgacttagtagtagtagtcaaatagcatacatttaaatttatagaaacagtcaaattatttctcagagttgtaacattaaatgctcccataacgtctgagagttgcgggttcctcaacaacacatgatatcctcagtcctttctgacttgttctaattgatgtgtcctgaaaacacactgtagctttaatttgtgtttctttttgagtgtttctgactcttggagcttttgttttatttttgctggggaataaaccctccatctcttgcctgattggggagtgatttttgttgtctatggaggatgagagagggagttgagtgacctaacttttatgtagacttcaaactgagcttacttacactcctcccctgccattcctgtggctcaaaatcggaactctgaggaggctcgctgcagcctggacagtgctcttcacctcgtcacccctttccccgggcacttctgtctcagctttctctgcactatcagtcccccctcctccgtttgctttctcttgtctaaaaggttgtctttgtgagttaattcacttaaaaatttcttcagaggaaacagaggaacacacactcagttctccacattgatagtccatctctctcctttagttttcaccttacttcctcatgtatttattcactgttttacacaaaagttattgatgacaaagctaataatctcttaaagcttacttttaatttaacttgtcttaaccaaactttctttccctcgccaaaacgccttttgcccttgatgtccacagtccaaatctgtatgtttcctcatatttctttttcattccatttggtctcattggctggttcccctttctccagtgtcccttcaattaagtgaaaggctaggaatggggagatgtcagcgtattttaatttccagcggcactatgacacaagttatttcagtaaaagtccatgaggatttggcattgctactgttcaataacagcctaattctctaggggaagagagttattgctctatatgcattgttgcctgagctccataagataaaa

SEQ ID NO: 51606 - DNA, 1937 bp, Bovine  19866880418159
ctggatttcaatcgactcagtttccagattgttaggttctttcagtacttcctacttcactgtaaccaagctttggcttcaaagaaaattggtctataaaatttttactgcattttctagtcaaaagtgtgtgcttctaccatggcaggggacactgtctgttactggccctctccttgagaaaccaacagaaatgcgggaaagttggtagaaactgggatacaggcaaagtaaaatcctgttagcaagtctaatgaatgcagagtgtgttctgtccctcttggaagcgttggttttattttgtgggaagtactgagtgttctttacagtaagtgtttgtcatgtaagttactgagatggtgaggagagaagaggatgtggccgctacaggatacagtgaatgcaggctctttcacgttattcattaaagtcgccagtccttctcaccacctcttaatacaaacccatcatcatcgagactggtgggatggctgtcgggcttcatgaagtctagaggtcttcatgttcatcactttaattttaccatataattaagtaatgatggactgaagcaaatgtatttatagcatatgtgaaaatcctggggtaaaaataggatgccgatcaatcttcccacatcctaacgaacatctgcttggtcttaggagcatggcattcctactgacatgggctatgcagtggcccctcaccattcaggcgtctatcctgtacatgttcagctatatgaagcctggaagaaggtttggaatattagaatcaccagcactgaagaatatccacacctgaagccagctagataccggaggggcttcatccacaaaaacatcatggtgagcatctgtggtttgggtagggcacaccacattctgccagaaagaagcaaagagaagagcgacgtattaacagcttaacagagggaaagctccatgcagcaggaagcatagttttcagatccaagcgaaggatgtttcagttacagtcacttttttttcagttcttcaaacataactttaaagtgttattttactgacactactgctaataagcaggcactgatgtcaaaccactaaggagacattacatctaacttgcagataatttatagaagccatcatttcttcagttacttagcatgtaaaactaacaccgtctctctgcatattaaccatgccactcttttacaagccaaactgtcctctttatcaatgtcagactaaaaaaaaaaaaatctcaggtatttacaagaagccacatgtcctgcataattattaacaagtcataatatagagtacaaatgagagatgatgttaagtcatttgttatctgttgtcaaattctctccgaagtgtctctatttggttttgtgtttttacactggtgacaaatatatattgtcaaaagatattgttacttaatactttgtgaggcctctcaaagtaagtaattaggaaaaaatcctaatttttccccaaatcagaaggtctaaagagtactgtggtgttaggcgtaggtctcctgatttagacacgcgtttagacacacatttagatcacacccatgttctgatcatctgggttttgatgatctgtctacaaatcaaactcatgaaaccacctcaagtgaaacctactatcttcccttcattccagctattggtcctgctattcctaattcagttttagcgatttgaacattgcactacccaccccatgtccaatcaagtctctactttccatcaataattccttcataatattgtaatattcactacctatctctttctgtaatatttattgcctttactcttatttgtaaaccacagggctgattcctatttcatctatttacagcttctatccaccccctaccacagtccatcccatggacagtgccaaccttttaatcctaaaatgctg

SEQ ID NO: 51607 - DNA, 2329 bp, Bovine  19866880449489
tttacctttaggtacgctatatgcatagatagatagattccgtaaactttgaggtaaaaaacttccagttatgagacagagctgggtcttttcttctagcaaaactccacggtgattttggtgaacagatgccagcatatccacagcacagagagggagcaggggctgtggtcacacagacgtggcttccggtcccgccccatcgttttctatatgtatggcctgaggtcggcacttttctctaagcctcagtttccccacatcatggtggtaactaaccacacgagttcactgggagatctacacgatacaatacagagaaagcacgtagcacagagcaggacacacggtgaatgctcgacgagcgctgatttcattatctacagttggcattaagataaactaaaatgaatagtaaaaatgtgattttgtaattctcctttaagtttggtgttaaaaaatacacatacaaattataaagatttttttttaatgtggaccattctttaacatctttattaactttgttacaatattgcttctttttttttatgttttggttttggggcctgaggcatgtagactctttagcccccttaccaggaactgaccccacacacctcctgcattggaaggcgaagtcttaaccgccgaaccgccagggaagtcacacacaaattaaatacgctctttttcatcatccaaatccctaaggcaactcattattatacttcatttacattttaagttataattaaattttaagatattaagagtatctttttattataaaaggaacattaagcttatttaaaaaaaaaacccttagaaatgtacagtttttatttggttccttgcctgctgtgtgagatttcccatcaattagatgtctggagcatttccacatagcagagtttgaagatactgagacttttgttcccagaaatagatttgactctctgcctaggtttctactaaaaaagcagaaaatcaagataatttagcctttttggcagagaactggaaactcggagcatagttagatttatactccagctgcaaagatcagtgaataaattttctgtcactaggttacaatagctttattatatttaattagaacttcaaatgtttctgttctgcctaatccttttcctttagtcagtaactgttaaaggacaaataaactgtccaaaagcaactgatactctaggacatctttttcgtgtgaaataaatcatttgtaccaaaacatgtttttacgtttcccctaaatatgttccaatgttacacttaaaactaatacagcaagaactcttctttgataacgaggtctatgtcatgcagtgaaaaactcatataacactaaaataaatgaaaaaggcatattaattgggaaaacatttttaaattcactcagttgaaaaaacttccagttaggaacactgttctttgtaatttttactcaacacaacgtgggctggccccctagtgaacatctagggaagaggccgtttcctgaggactgggccctcgggagcactcatttttggaaggggaagtaagtcagaatgactctgtttcttcaagtctacacgtagcacttcagatacaagcttaaacttgaagtggcatccaagaagatgttttcaaaccactaaagaattttaaagactgcaagatacccataatgatgtcactatcactaggacgttggagaagggaaacagctggtcctgggagtagggacacacgtgcgaattcctttacgtgtcccctgactcacttgcccacccgtctgcatgcactcatcagctgcctaccccgcggcaggaactgcggtagctgccataatgacagctaggatagggcctacctggttgtccagtggttaagaatccacctgccagggcagggaacctgggctcaatccctgatctgggaagatcccacatgccacaaagcaactaaacccgtgtgccacaagtactgaagctcacgcgcccagagcctgggctctcaacagagaagccagcacggtgaggagccctcacccccggactggagagtagtgcccgctcgccgcaactagagaatgccctgcgagcaacgacgactcagcgcagccagacatcaatcagtcaaattcaaaaaagctaatatattaaaaaaaacattgggaggacaagattgttgttcccaatgatatcagaatctaggaagagggaaaacataggaagatttaaattctttggggataactgctaaaacagatacacggaccaaattatgtggaagacaaatcagaacatttagtaaataacaacca

SEQ ID NO: 51608 - DNA, 2500 bp, Bovine  19866880483635
tttatagcacacaactgaaaagactctatgtgattacttatttttgtacgtttgtgagtttggctactaaaatgtaaatgcagtgcggacaagattttctcttctgtctgttcactgagctatctcctacatctggaattgtgcctggctccttatatacctgttgagtgactgaatcacattcttcgtggagcataccctttagatgtgacctttagtgagtgtattcatggtaaactctctccgattttatggtatgtaaatgtctttattcactcttgtctttgaaagatagttttgttgaatttacagagcctacttgatggtctcttcatgtataaccattgctgctcatatttggaaatatagggctccctataagtcacctgaatgtttgtggtggtaagatgtatcagaatccccctggaccctaattgttttataattgtcaaaaaagttaagcaatttggatttgttgttatgaatgtttatgaaatgtttctctccctttcttttagtttggtagaacacttatttctaaatttgatataatgtgatttataataaacaggaaaagaatcattctcaatattattgtcaagattaaatagccatagtgctagcaactatgaagacaattatatgaaacaaataattttctgaaaataatttttggcagtaacatggggaaataagaaaatagtttagcaaagggaaaaacttttgtatccataatctacttctacttacatttattaaatttgctacattgtgaaatggaatgtatctctattattaacatcaaggagacatttgttatacaatgacatcctaaaagaatgagttctaaattatttaaaggagacaaaatgctatttctgaacaccacatgaatacataaatggaatatctggtgactgcttacatatttaaaggtctgatgtggtgactccacccaagcaggataaagagcaagacaatcgtaggtgtacgaaagctcaaccaggcaatgacaagcttggggatgagcaggagatgacaagaggaaaactctgagtacagatttaggtgctagagatattcggtccacttcagaaaatcaacatctactccatcaatgtgctgtgataaggatttcaaggggtatattgatgaataatgaaacactattctttataaaggaagagaagaagacaggacaaaattttactgagttattccttttttggattgatttttcaaatattgcatgattcttaggaataaatcaaaacataaatggatctttttttatatgtctgtgctgatggcttataggtccataaaagatgcaactattttatatgatatgtttaagggtacttagttaagttcacttgctcggtcgtgtccaactctttgcaaccccagggactgcagcatgccaggcctccctgtccatcaccaactcccagagtttactcaaactcatgtctattgagtcagtgatgccatccagccatcttatcctctgttgttcccttctccttttgccttcaatctttcccagcatcagagtcttttcaaatgagtcagttcttcccatcaggtggccaaagtattggagtttcagcttcagcatcagtccttccaatgaatattcaggactgacttcctttaagatggactggttggatctccttgcagtccaagggactcttaagactcttctccaacaccacagttcaaaagtatcaattctttggtgctcaggtttctttatagtccaactctcacatccatacatgactactggaaaaaccatagcttggaaaaaccaagcagtgtagaagagcaaaagatataaggaagaatcagtgttagaaagttggcatctatcagtctgtgtaacagaaaaagaaaccagatacagagtttcccctgtaagctctgctggatgtagtttaggtgggataccctggtgggtatatggaggagagatttgaaaggcaaagcaaagtggagactaggtaggtgttgatgatgcagaggttacacgtgtatgagtatgtaagaaatctctgtacctaaaagaaaaaaagaaactatatataaatatataagaaaaggagaagaggacagagtcaaagataattctcagtgtctagtctatgtaactatttatactggtaaaaacaaacaaagcattaggggtaatgatttctttcatagaaagatatgaacatggttctgaacatatgtgttagaggtgtcaaagtaatgttccactggagatatcataccagcagatataagcagattgatactcccatctgaagctagtgaaagacatttttagagcctatggtttggggaatcactggttgatgagagttgactaaataatccataaagagggtttgaaggataaagagaagacagcttaaaatcatctgggtcacaaaaataattcaacaaagggctgaggaagaggagtctaagaacaaagaggtaagataag

SEQ ID NO: 51609 - DNA, 857 bp, Bovine  19866880559869
aactcgggtctcctgccttgcaggtagattctttaccaactgagctacaagggaagcccatctttagaacaatagtatatacatcctgctaggtttgagctatacttgtggcctaaatgccactttttgtaccacagcctattgccagatgcgtaggtccaataaacatgtttttctcagtcattttgaatatatgattcctggttttggtggctttcaaatctctctcaggaaccttaatgacagagtgacatctttgagaaatgcaagcatgaccacttctgtagcacgttggcttttttgagagccattaaacagaaattataaaagtaaattataataagcctgcaataattaaaaaaccctcattcaggtaaatcctacagactccttttaactttggaagatagattcctaatgctacactaaaacaaacaaaggtaaaagcatgcctttttaacagttccaaaggaattttctttcttagcaactctgctcagaaaatcgattatacactctttaaagaacctcagaaaaaatcaggctgtggaaaataatgattgcttcctaatgctggagtaaggtttgctatagatttgctgcagaattaagatcctgtgtttcctgaaatctttattgacagtagtgaaccaaatcagaagttttctgaaataatgcttccagctctctcagaaattcaccacatcaagaaaactccaaaataaaaaatgttaaatgtctgatagaagggttcaggcaaatgtcccacaactgcctgaagatatttagaattcatatataatcttaaacatatatgaatcgggaaaagtactaatagaaactattctggtacaata

SEQ ID NO: 51610 - DNA, 1525 bp, Bovine  19866880654076
attcagatagaactaattcaatccccatttctgctagcttcttgaccttcaaatcttaatttttctgatgtttcctcactccaagaagtgaaaataatatttctattattggttgcttaaataaatgttgtatggcaattaagagtattgatccattcaacatgctgcatagatttgaatctaggcttaatcatttacaaactggacaacttacttatgtcttccaagtgcgaatttcctcatatgtaaaatagaactgataataagataaaatggatatgttattgataatttgaaaaagactgtgacaaattgccagtccaagttcgatgcatgatacaggttgcttggggctggtgcactgggatgacccagagggatgatacggggagggaggtgggacgggggttcaggatggggaacacatgtacaactgtagcagattcatgttgatatatggcaaaaccaatacaatattaacctccaattaaaataaatttatattttaaaaaagttaaaaccaaatatatatatatatatattaaaaaagaacttttaagagtattttcatctgaaatgtatactcctgttaccaaatatcaaatactttaatagctatgcttcaaccatatattcaatagtggaaaaatattcaatatgtatggaacctgatgatacaaagagctcttcttgctaactctgttcacttagtttataactgattatttttagccaaactagtgatccatttgacattctaaaatatagctgattataattatttagtattaaggatgcccctgtcatcatgtgaaataaatatatatcactgaggtcctaacttgtggatataaaaatctttctcttcatttttgaagctatttagattcaaataaaatatctgagattttacacagcttaccactttcagacttaaatatcccacttttgtccctccagaagagagaaccaagaagcctacaacaaacaaattctgcatttgatttttctttttaatgtaagcagtcaaaagactccctttgtgtcagaaataaatttttccataatccacaagaatggtccttctgtctgctttaaccggaaaaaaaattatcagattcttgaaacaaaaatagacatctatttttagggttttaatctatgcaattgtttctataataatatatttctataaataacctattatttcaaataattttagatgtgatctggaagaatgaaatagtttacttataaaagtataacccttcaagaaaggatacattcaagtttgttgttgttgttgctgctttaatgcaactttagaaagcaattcagtattccaggaaagagaattcaggtagtcccttgggaggaacccagatgtgacacctcgggtttccacctggatggttccattaacacatctgaaacataggagcctcctaagagacttggtgcagcatttggtcttgctgacttattctttctatagacagtcacatttgagatccaggcctgcgat

SEQ ID NO: 51611 - DNA, 1432 bp, Bovine  19866880715991
tggtacatttaactccttgctcttatttaagaatgttgttgcctagagcttactaggcattacgcttagtgctttacatacatcacctgatttaatccacatacctcttctattaaaatgagtaaactgatataaatggtcacatatatgctaatgacattattcagtattttgtcaaaattcaacttttgtcaaatttgttttcctagataagactctacagattgtaaggacttatttttttcttgaccaaaacattgtcccattctctacttgccttatattcttccatcttgtcttcatctgtctctccttcatcctgatacttacgttttgcatttggagcagaggtatcataggaagccctgaaaattaaaactgaaatatcactcacaaatacataagatgtatacatgtattcattaatattaaagaacagttttacaaagacagaataaggcaaatttttcctaactaaacagtatccattcactcggtttataaattttaaaagtatcataacctgattaataactctgtactttatttttgagaaagcaaccaaatgagaaaataagtttttataaggtatgtatggcaaaaagaaatttctacatatcattctaatctgtcttgagtgaaactgatattctaattggtaactacaatactgaaaaattctaaatgctttatgaactatcaaatgaataccacttttagggtaaagtactttttctaaaataaagatttttaaaataaaattatatatagtacataagctaattctcagtctaatactccattttctaactagttcataaatgagaacttacttatattcagaaaataagcatttcataattcatagaccataaaaatcaatgttttccaaattggtatgctgatgcttatcataacaacatacttgatacctaagattattgtttattaaagcaatgatccttttgcaaatattaacatatcatttataaaaagccattattctactgacctgcaagtttctcttgtttcagcaatttctctctgctcatctttgctatttaacacagcaccgatgctgtcggcactttcagctcccaactgagaaaacgcaaaactcaacattagaacacaatacgctaagcatcctttctagccatttgcagcagcatttaatatatcaaatattaaaaaaaaataataatccctaactaccgtagcaagcaaatggactatttaccttccaggaaaaacagaaagtaccttgaaacaaaaccacattatttaagaatgatttcaacagctgaaaagtattttatgctttaagttatactgaaatcaaaacaattaacttgagccaatcttcttttaaagtaaataataaaatatgatttagcagtagtaaccaaaaaaaaaaagcagctaatagtgt

SEQ ID NO: 51612 - DNA, 995 bp, Bovine  19866880729913
aaaaataccaaaaaaagaaattgtttgactttccccatttatgtatgttgagtattttaagtttgtatccttgcttaaagtcttctctccatttgaaaaggcttacactttgtgtacagatggggtcgcacagagtcggacacgactgaaggcgacttagccagcagcagcagcatgtgaggcccgatataacatcagattctgaactcaagtgccatgtttccataacttatggaaacaagttactatcaagagttgcagaggaaaagatcccacagtcactgactcagttatctaaaatgtgatggccctgagtttaatgtctagcttccctgccaatcttcaaaggtccagagatccaggtttttcctattgtgtttttgcccataaaactatatcccaaagattcagagaaatgagtattgttttggaatttgaaatgtgaaatgttgtgcaatatgactgtttatgaaaagagattaattggcctgtttttattgttacttaggaacactgccttatggggatcaaaggaactgtaaagcgtagcacagacggggacttcattcatgctaatgttgatattgacttgattatcacagaagaacctgaaattggcaatatagaaaagcctgtagaaatttttcatataattgaacatttttgtcttggtagaagacgccttcatctgtttggaagagatagtacaattcgaccaggtaagatctcagtggggggaaatgttaaaagttccttgagatataaatgttaagaaagagtacacagtgctttgtaaaataaaatgcttacgacacatttgacccctcttcttgctgtatttcaagtatactaagctcagtcttgtctcagtactctttcagggtcctctttcctatcattctcatcctgacggaccttttctcacaacactgcctaaattagccagtttcacagtactgtccagacctcccaccactctttccctcatagcacta

SEQ ID NO: 51613 - DNA, 2264 bp, Bovine  19866880736145
ccattgtttcccccatctgtttgccacgtagtgatgggatcagatgccatgatctttgttttttgaatattgaattttaagccagctttcactctcctctttcactttcatcaaggactctttagttcttcttcgctttctgccataagggtggtgtcatctgcatatctgaggttactgatatttctcctagcgatcttgattccagcttgtgcttcatccagcccaatgtttctcatgatgtactctgcatataagttaaataagcagggtgacaatatgcagccttgacgtactcttttcccaatttggaagcagtccattattccatgtccagttctaactgttgcttcctgacctgcatacagatttctcaggaggcaggtcaggtggtctggtattcccatctctaagcattctttaagattacataagaatccatgtaaaccacacagcgtggtgtttggtccctgatagcattgtattgtgctcgtgctcagtcatctgcagctctttgagatgccatggcttatagcccgccagtctcctccgtgccatggggttctccaggcaagaatactggagtgcatgccatttccttctccaggggatcttcctgacccagagatcaaacctgtatctcctgtgtctcctgcattggcgggcagattctttaccactgatgccatctgaagccccggtgctgattagacaactccaaaagtgccaaggctcaattttaaaatatcatttaaaattttaggcatatgtctgactttacaccaagtgaacaacagtgagaaatagaagatggaattttgtgacaggataataaagaacttttaaggtgacagaggaaaggatgaaaaattccactcataggcttaaaactccacttctgagtgctaggattaaggtcatgtatccatgttctcatttgatcttcatgccaaacccatgaatatctctgatgtttgtgtgtatgtgtacatagatcgagagatacaggagtttatataaattagctgcccaattgtttttgtttactttagcagatctagctacattatacatatttatattataattagtactttggttgattaagaaaatattaactctaaaaattctgtgccgaaacatacttttgcctattgctgaaaaaccatattaaacactaaaatttctttcccagccttaatttggtcaccaactacttatgttaactactcaaaagataaaataggtcaaaatataatttaggaagcccagataagaaacaaaaagctagcagataatgtcccaaagaatgtcacacatgtaatgaatcctaacataaatctccatataaaactcttttgcagttattttttataaatttgtctttcctatttgctttaattgatatgttcattttgttaaataaatttggagaaaaatccaaagatatataaaatctcccattttactcagttctcaaacccctgtttctttaaattagatcttttttattttttttttttttgccttcaactagatcttttaatgcctgtaactgcttttggctttatagaatgaggcctcaaaaaactaagttagtggggtagcatagagattcaaatttggaaaaataattttggaaatagtcaaatttttgtgttaaattgtattcaaatacaattctcttataatgtttattggatattatgttccctattaatacttttatttgctattgtttagttgctaagtctggtccaactcttttgtgatcccattggctgtagcccatcaggctcctctgtcaatgggatttcccaggcaagaatactggagtgggttaccatttccttctccagggaatcttcccaaccctggactgaacccatctcctgcattgacaggcagattttttactactgagccaccagggaagcccagtacttttataagcagtttcagatttgctcagaaattgttttgcttggtaagagtaagcagaattattttctcctgaggaaatggttacttcattgctatataaatatgtattgatacatagggcagaatttatattagacaaaaaaaaggaaacaatctgaatgtacaacagtagtataaaatggttaaataaattataatgtatgcatttgatataatattcagcatccattaaaaccaatagattaaaaattttggatttgaaggttaatgtgatgagagaaagctcgtatatactgttaaagggaaaggcaaaattcaaa

SEQ ID NO: 51614 - DNA, 698 bp, Bovine  19866880759531
attgcagcaatagtggcaatataaggaataaaatcctaaacttttactatacctaaaaataagcaagtcatttattctagaggaaaagaaattaggatgctattcagaaggaggataacagtattcatgcaatccattttccttcaagaaacaaactttaaaacttatttccttgattacaggttataaatataaaatatcagaaactccctggtggtccagtggctaagactccatgttcccaatgcaggaggtccaggtttgatccctggtcagggaactagatcccacacgccacaactaagatccggtgcagccaaataaatatgttttaaaaatcagcataccccttattctctattattaactataactgtttagctttgggcttggatatgtggaagaatgaacaggtttagggtgtcgagatcagaaattcacttttgaacatgttaagtgtgagggttctaagaggtactcaaggagagattctacaaaggcatttgggtatgtgaaggtggggctacagatacaggaatgaatgaatgacagcaatagtacagtgacttagagttaaggacctggcttctgaccacctggcttggaatcccagctctgttacttagtagccactggtcttaggtaacatttattagctccggtcttcagatcagatcagatcagtcactcagtcgtgt

SEQ ID NO: 51615 - DNA, 2036 bp, Bovine  19866880822097
attgaaatgttaatcatgttcagtcaatttaataaataagtgcatgggaaaaaattaggaacattcatctttcagaccaaaagatctcttcatattcttaatacagaaataataaaatgaatggaagtggctaacataaaatttatgagttagagtttaattatttatatagaccaattgaaagacttcagatatcttttagcccagggatttcttgaggcttgtttggattttacagaacaaaagaaccaaactggggagaagatgaatgaaggtagagattgacttatttgctaatttttaattttgtggatccttcctatttctacagtgtgtatatatattataatacacttaggctttttcagtagggcagtgttacaaataaagtcaattgaaacacaaatataattcatgaaagtttaaaaagtcagatttatgtaaccttataaaaagcactgttattactctgattttgatgggttaaaatccaggtttcatcatggattggaatgattcttgagaaatcactgaaccaatacatacattttgtttttattttttgtttatttgttttctttgactgcatcatgcagctttcagtatcttagttccactaccaggaattgaacctgcaacccttggcagtgaaagtgtggaatcctaaccactgaacctccaggaaattcctcacacggtttattttggaagacaggataggaaaagggcttagagagctaatgaaatcaaatgcactcagaaggctttcagaggctgatacaagagttctcactttctggtgcactgtgttatttccacggtcaggaatttgacatttatctgtctgcattctctctggatggtgggttaaactgtagacaaaacacaagaatggttgggggaataggattaattatctactcgttacccattcaatcaatcaaacattgttaagatcatgaaaatatgtgatgtagtgaatactactgttagaactgagttctcaggataggagaaagaacaatactaccctctgaagtcatgacacttaatgaggttgcttgttttatggtttgtggttccttgaaacaagagagagcagttgtgtgcatgatgtttgttttattgccacagatacggcaaacaagcctctgcaaaccactttgaagagagcatgggacccatatggctggatggggtcagttgctcgggaaaggaagccagtttccttcagtgttcgcagagaccctggggaagtcatgactgcagccatcgggaagatgttggcatctcctgctaccccggcgggaatggattcagattctccctgggtgaggtcctgccacagctcttgagtattcatattccagtagccactgcacgtttagccactggtctttggcttttcaaaaagtctattttcctagatgctctatattttagtaattttatttcagagaaaaatagtcttttgagtctttacaccaatgttacaaaattttactcctaatttttctctacccatcagcctccgtttctcatgtatctgaaagatggaagaaagaaactgcaatgtccattccccaactgattaagtacctattctgcctctcatttagcttgaattctaacgagctatttgagaaaggattgaaaataaatcagaacaaaacaataggtctctttcccaccctccatgattcatttgtctttagtcctgaggccttgtcaatcattgcttgccagccagccactgctgtgtcctaacatagatctttcaagtttctcactggactccaaggtggattcattggagtaaacagcccacctatctttctaagatatcctgttactaaaatacccattagcatcacttattatgaccctcattccaaatttcttcagacttatagtcagataaaaggtacttagctcacctaacagtctaaaatattcgtgtgtagtgttaatcactcagtcgtgtctaacttgttcgaccccatggactgtagcctgccaggctcctctgtcccagg

SEQ ID NO: 51616 - DNA, 1376 bp, Bovine  19866880832397
tattcaacacagtatttatctagaagacttcgaattccaagcgtccatatttatatactttaaaatgttctcataaacaatgagaatatatttgcctctagatttttctgtaagtgctggaagatcccctttgccaggagcaatttcaatgtgatactggaatctactggattctagaatcataatgatgtcttgaccaagcgatgagtactggctctccacaaacaccaggaccgtggtgtctgtccttgaggcatcaaagagcttcgctggcttcacttccatcagccggtatggtaggtgctgcaagtccccacaatctacttctaaagccatctcagacagttcattttcctgtttgtagccattgtacagatagtaagcagaaataataatgctcaccatacagaatgtggcaagcagaatcactgtcctttgaaagtgtctgtgcagcttcatgataaaactcatgttgcatatacttccctcagactgttccaacagaagcaccataaaaaaatgaaagaagaaaagaaaagatgatgtttcagatacttttccagtttcagtcaatagtttatgtcaccattgcagcacatttgtgtcacttgatcaggactcacagaaaatatagtctgaaaagtagaataggatacaacagaatattaaacattcaatctgcagcgttaaaatgagcaagtttttatcctggtgactggcacaagtggcaacctgtcaggcagatgaattggtgtctgctaattaagaaaatgtatcttttcttctcccaaatctgaatgagatcaagggaggaatggaaagagggaagagctccactgaacagaggtctctacccctagtatacaaaaggcactggactaacaaggagtttccttttattccttgaactttggatcaaattgtatagattatataaaccgaatgccacagagatgtcacctgagtgatacactgtcacaacatggagtacaggtggttaattacatatattgaaaattcatagaagtttggatgtattacattaaatcctacaattaagacactgctgctgctgctgctaaattgcttcagtcatgtctgactctgtgagaccccatagacggcagcccgccaggctcccccgtccctgggattctctaggcaagaacactggagtgggttgccatttccttctccactgcatgaaagtgaaaagtgaaagtgaagtcgctcagtcgtgtccgactcttagtgaccccatggactgcagcccaccaggcttctccagccatgggattttccaggcaagagtactggagtggggtgccatcgccttctccgaattaagacactagtttctactttttagaaaatct

SEQ ID NO: 51617 - DNA, 1002 bp, Bovine  19866880841961
ataagctgccttagagttttcttaattgcaagtaattctgggtataagatagtttctgctgtagctagagctattaaagcattagaaatacaaatagataaagattaaatagacataaggaaaacacaacattttgttttaatttatttgccatgaataaattttcagcaggaatcattaatccagtaatacaagtagtaaaattgaaggggttgtaaattaaagtatttattaatctataaggacagataactctgcttccttcgagttgtgtagaagaaatacaagacctacaacaggagtctaagagatcgaatgccaaaatgcctaagaaccttttcctatagtacctccaccctgaactgacatgttataaagattatacattgatggcaaacaaaacaaagaaacacaatctgttgatttttttttttttttaatggggatgtgggtattgcttgagattctgcttcaatgtctaggaacaaaagaaaaggtaacattttgtggctcactgaccaaaaattgactgtaagaatcaaatactcagaaaggccaaggatgtatctagaggtaagcatcacagacatcaggatttcaccctttctgggtactgactgtgcagagaagacagttacttctactaatctatgtcatagaagaaaatatttctgcaaaaataagttgctgttaattatggcaaatttctacaaaagagccataggttttagagaggtcaatatgaatttaatatgatctttagttggaaatatataagggccaagcagtaaacccatattagaaatcaagtttaaaatatgtgaccactgggttcacagtagtaaactctcacagtagcatatttttcatcttgtattgttaacactgtaacagtaagactgtcagcctatagggaaaattaatagctagacctatgctacagagaagaaaaatgcttataactgggccaaaatattcacataaaccacctcagtctatatt

SEQ ID NO: 51618 - DNA, 998 bp, Bovine  19866880907581
cctggtgtgctgcagtccactgggtcacaaagagttggacttgactgaatgactgaacacaaaatatcagataaaattatgaattcatattagcattttcttttcctttaccttgaggaggcagtaatttcttagcatacaaaacagcattaatcataaagaaaataatgctgtattaaatgtctttaaagttgagaacctttttaataatgaagttctgttcatcaaaaataccattgagagattgaaaagacaagccacacactaaaagaagatatttacaaaatcttctacaatatatacaaaattatgcaagggactcttgtcctgctaaacagctcaaaattaaaaggcaagcttttctaagatggcacatctcatcatccatagagcatgatctttagatttaagtgaggattcaagtggaattacctctgtttcacaagaacagagtgatcatgaagaccacattatcagcagaaactaaagggcattatctggcctttaggtttgaatcctagtgaaatgttacagtgtcacacttggcacatgtatttactattttagatgaaaaaaagatacttaccaagtggaatagttgctacacttttcctgttgctataactcagtagaattccagtatattttactcaaaatgattattattaactttcttagtaagtgcaattcagacacaagatgttcagatggaatatgggtgagaagaactattagttttgcctgaattgctcttccttttgtttcttggactattaccttttatgacggctgttaacatactctaaccctgcattctcagtaagtcttttatttttaatagttacattttttaacttacataagccttcatttaaacatgttcagcaatcatctcctagtagtatcagactgttagttaagcaggaatctactgcttgaatagttttcctggggactaaggctccaaaatctgctctaacctaaaagactactttctg

SEQ ID NO: 51619 - DNA, 1199 bp, Bovine  19866881033007
aattccatggactgtatagtacatggggtcgcaaggagtcagacacaactgagtgactttcactctatctacatatcaccaaaaatatttcacatgtaggacatgcttaataactatttacataatgaatcagtgaacaaatgaatgaatgggtgaatgactatgtttagaccaatgttttgagacacaatcacagatacaacttagaagtagttcaaaatcaaagaattcaaaacatactttcttttaagcctttaggtcggttagaaagtatattcctatctaactgtgagcaattcataaaacattttacaatgttaaattcttactgaatttattcagtaaattttagttttttataccacttaaaaatggtttaaccttaagagcaccaaaggcattttgtattttgtataattttagagaatatagtagagtttcataaaaatttggagatttatctaacttatttttaaatgacataagaacatattttggcagttttaaagacatatttcagatataaagccttaaaacatttttatcataatattttagaatggaaaaattagaaataattatatattgtttataattttcaaggacataataaatgtttaaactaccagctcagttttaatttagctacactttcaaagactatttcaaaagactaatgaaaacttgagcacaactttttaattaattaatttatattgacttaaaaggaagagtctaaaatattaccaagaatatgaaagttttttttcttttcagtcttcacagtcctatggtaacatttaatagtccttcttgtatccttagctcatttaagtagtgtgatgaacattactattatttgccagatgctcagtgtctggagaaaagaacgcagtttcaagacttttttccatctgattcagtactctgtattttaccaaaaggtcaacactgtatagaataaaaaattatgtatcaaatttctcctttcacttttatgtgaaatcaatatgtagtataacagagatagaatccaatggcattttgaatgtgaaactaagatgaatgtagatcattttaattttaaattccattaatattaaacagccagtcacattatgtaataaaataccttcacaatgataatcaactatcttcaagtaattcgttttctatctaagggcagcagtttacataat

SEQ ID NO: 51620 - DNA, 788 bp, Bovine  19866881168259
atttcttgagttacaggggtgaaaaagagtgtcttttgttatgtacagtaagttcctttaaactttgcccaagtttatgctaatgaagtgactcgtatgggtccctagatagtttcagacgggggctggttgctagaggagaagctctggtgctcaggacccttctggaccttgtcctgtgtacctctgcatttataataataggaagtaaagtatttctggggcatgtgagtcattacatcaaattataaaacctggggaggaattcttgggaaccctgatttgtagccaagttggacagatgtgtgaataacctggcagttttgtgggactgagcccttaatctgaggggactgtacttaaccctgggtagttggtgtcagaattggattaaattataggacacctacctggtgtctgcagaaaattacagaattgcttggtatggaaaaacccacatatctgatgtcagaggtgtttgagaaaaaacatcttaggaatgtattacatagaaaccttattgagaagtatggaactagtaatatcctgaaaagttttagatttttaatctttctctaccatgaatttaatatcatgtctcagtatatgtttgatgggagtaaaataaaatgctaagaaagatgttctacagtgtcttaaatgttttagtttcaatgaatatacagagaaatagctttgacatacatgaaaatgaaacattttatattgccgtcttgaaatgctatggaaatcacccttgaatatttattaatgtgtgctgttttcat

SEQ ID NO: 51621 - DNA, 1222 bp, Bovine  19866881217734
ctctaaataataaagttactttattggcaggctgacaaaattttagtaatccagctctgtgttcatagctttcacatattatgaggtgtccaaaacattcttttatgctaacaggggtaactgagggtagttagtgaatcactgtttaaaggccttctatcccatttttcacatttttcctagtgttaataggaatgcaacatcccattggcagtttgaagcagaaacctggataaatacggtttttgttttgcaattgccctgtgaattttacacgatacaaattgcttgcttttgctgtttcctattttaaataattattcaaatacaataaaatgaccctctctctgtggtagtatgggaatataattgagagaaaaattcctgaatgttaaactaatttcttttaattgcttgttctgataacaaacaccatttttaaggaaagaatgtacttcaataaaaggattcttttatttctgtagttctgcaacaaatttgattttatcatgaattatagctttaactgattttatctttttgactgtttgcctagagacactatagcagctggaaattgtcagagactagtgctctgaaaatcagaaatatcttgattattagagattataaagatgaggcacagaagtaatgggacttactttttaaaaacaaaatgtgtcctgtacttaaacctgtgttccagcatgacctggaacatggtagaattctttaagaacaaggtctttggtgatgtacataatagcatcaatcatgctaaaatcatttcctgaacacacaccacatgtgtataagggcagtgaaagattttacagagaaggtcacttctccgtgagcaattggaatcattcacccaagcaacttagtctgccactttttgactttcagacagcagacaaggacagattctagtagcagcagatgtgtacaggctgatgtaaaatactgtctttttgaatagataaatctatagagagaatacacataaaataaccctgccacccaaattaattcttctctttttaattctaggaatttaaaattgttaattctagaatctcagaaaaactgaaatagaccatctgccctgtcttagatcctcttttgctcaaacttgtctaggaatttcatccagtttttatttgagggggagtggaaggcatttcagcaaagcaaacaacgaatagcgtgtcagccaaaa

SEQ ID NO: 51622 - DNA, 1544 bp, Bovine  19866881371878
actgttaactgcactatttgttgaatactagactactggagtagccaaagtctgtccaccacaaagcaatagattgctaggtttgtgcttatgtctccatatttcttctcaaccttcttcaaaaagtaagacaaaaaaacaaatattgctttctttttagaggcagttggcacttttagacatatacataaagtatacttattttatgtttgttttttaaataaaaattaaaaaatagtcttaaatgtcaagagaatacatagagagtgtggaatgtgaatataaataatgaatttcctgccattttttttttttaacaactcctgtgaaaaatattggctatgatcttttcctgggatgtgtgactttttggtaaaatgttccagttcacttttccagtaactaactcacagatgttgtcttagctccttgcttagaagtaagcattaacatttactgtcttaatgaaagaaatctaagttcagatctctcatgtcccctgagggccacatgcagtaggtgctatcttttatataccattacccagatttcagggaaatctgagaggccacagtccctctgagaagtcagcatttggtggtttgtttgaattttgggacagtggtatttggatggcattttccatgtggggtaatgccttaggatcctgccgctgatccactgaaggaatgaggtatatcggtctctcataacacagccttgaaatatccatcttgcaaagaaattaatatcatggtgagttgacattctttgcaaaaatcgtatactgtttgtgtcaaattatgctgataagtatgaatcatttttaatgcatttttatttcacatttttggtttttaggtagatgaactaagccaacagcatggaaggatgttttttaactttaacattctaataatctcattctgcttctatctaaatattataagttgtactgaaacttaaactttattttccttaaatttagacattattgcctgagttgggaaatccatactcacaaacactcagaatgataatgggtattatccaacaaaagcggccatattcaatgaaggtaagaatgagattttcttctttcaagtgttttgatttccaatgcatgtcctatatttttagaacatgatttctgatagaaaactcacaatctctgagtatacctacctacctgtcaaccacacacatacaaaaataactatcaccatgcattaactatggattatcttactaagtattaacttagaaacaattgatattattaagtctttgaaatgacttttccttcagtgcttaaaattaaagaagtataaaagcatttgttaaatttgacttttacagcttttgatttattatctctaaaaaattttgttatcctagtctttccaagctttttttgagtgtgagtaaaagactttaaaatgtctgttaggtcaggaaaattatgccttattgctaagtgccaagtactcacccctgtcttccttttcaagctcaatagtagaattgcctggagtgtacagatg

SEQ ID NO: 51623 - DNA, 921 bp, Bovine  19866881376501
gttttgatacctaagattttcttaaaatcggtgtatctatacttgagaatcctctttttctagcatcttttaataactattaaagacaatccaataaattggatattgttaatatgattcttcattatctgagagtcttttgagtgtgaagaatatttgcaaccctttatgctttgttttatatatatatgtatatatatacatatagatattacatgaaataaacatgattggtaagccagtttttcctgactatagactgtaacttaattaaattcccttcagtaatttacatacagttacaaagtaaacatagctaattctttggattatggaaaatttcttaagcagtagaaaaacataaaaattcagtaactatgaaatattttagtatattttaatgtaaaataaacctattttaaaatatgaaataccatatttatttcatcattattaatatatttgctttaatgccttccaaaggtggtagcagtgctcattttgatacctttccatggtcccaatgctaccatatttgaaataaaaagattttatcttagaccaactggattactgaatctgacttattaactttttgattttgtgtttgaggttcaagacctattaacttctatagggtgattaaaactcaagccatcagtttttggtcatctaatgggatcctttaataaatgagtttccttttactttataacttttttataatagtgaattttatggctttcaataaattttactttcttgcaatctggtacttttccccagaatgatgtaaacttttggttttgcttgcttaatattacatcattctttgtgttggcattatatgcattgacctgacttggaacattattggaaacttgtgtttttctggtatcttctaccttacagtgtcatgta

SEQ ID NO: 51624 - DNA, 858 bp, Bovine  19866881447554
atctaggtacttttcagtaagattagttaatttctatttttaatattaaatttcatcaaattaaaaggaattttcctcaattattaaattttgaaaatttggttttgttttttttttttttgcagttctcataaatttttataacaatgatttgatagtatgatttgaagccagtttccccacctgccagtggaagagatgcaagggacacaggttcaatccctggtcctggaaaatcccctgggtaggaaatggcatgtcattccagtattcttgtttggaaaatcccgtggacagagaaacctggtgtgctacagtccatggagtcacaaagagtcagatatgactgagcaactgagcacaacagtaacaacggtaatgtgatttgaaaccagcaaaatgtctttgaaatttgtgactccatgcatttcatatgcctgttgtcttcatagcatcaattgctccagttcccttgaagagttttactatccccattcactcattcactaaatatatgacaagcttgaggaataaagtgacaaatcaaacacaagtcttggttctgtagtagaggaaagccatgctattaacaagtgaatgtaataaaatgctaattctcagggaggtaaacacaacttctttgccagtcattgcagtgtttggtgatcaaatataaaatgcagtgacatccaaagaaaccaaagccctggtaaggtcatagtctatgaggataaatgctgttcactcattttcactgagcaacactactgaaggtgaaataactacctatatctaattttattttgtatattttctcctctcagtttatatataattctgtattcaacattcattttt

SEQ ID NO: 51625 - DNA, 1996 bp, Bovine  19866881464584
ctgcacagagtcggacacgactgaagcgacttagaagcagcagcagctatatagaaatgagaaataactctttgaattctaggcttttttttttcctcaaagaaatgaagacatttttatttaaaattcccacctaataataagtttcacagaaagtcctttgtaagatcctcccctaggccttgtttctccgtcttggcactggtgacattttgggtggaatatttcttttttccccaggatttatttattgactggctgcgctgggtctttactgctgtgcgtgggctttctctagttgtggtgtgtgggcttctccttgtggtggctgctcttgttactgagcacaggctctcagctgtgccagcctcagcagttgtggcctggggccctccaagaccgctgccacagtagttgtgctccgtggcttcagttaatctgcagcacgtggaatcttctggaaccagggaccaaaccagcatcccttgcattgcacgtcagattcttaaccactgagccaccaaggaagccctaaacacttttttgttgtgggggctgtcctgtgcatcctaggctgtgaagtagacccttgggttcataatgagatgccagtagcatcttcaagctgtgacagtcagtttctaggtattggcacaaacaaatgccccaaggggtaactacattgagaagcactgccatagaccccttaaacttaatttttggtcagtttgggataggaaagagaaaaacagttctgaagatatagaagggagactaaaaaagaaaagtgatataaataaataaaattagatgcaagacagcaggattatcctaacatactcaaactgcaaaaaatccaaatgttcatcagttggttaatggttaaacaaattgtggcacatccatacaacaggaatttagcaataaataggaaaataactactgtatagtattttgtgctatacaaaatgattttggattttgaaggaatctcagaaacaccgtgcttcatgaaagaaatcatttacaaaagactgtgtactctatgattccatttatatgaagttctaggaaagatagaactctagtgggaggaatcagatcaggaatgcctgaagctgggcctggtgagagcaaatgacctcagaagggtatgagaaaatgcgtggtggtgaaaatgatgtatgttttgactatcatggtggttacgtgacagtgtacattgccaatatacatgaaatgtaggattaaaatgggttaattttattgtatgtaaattatacctcaagaaagctgtttgaaaaatagatgtgaagatagtgaagagaatatactatagaggacaggatggggaagccatttccagactcatttttgtaaacaatccgtgacaactgacctcatagaagtggatgtgaatacccagggctggagctgattggcaggtctgactttgcttcaggaaaaccccctggcagcctctatttttgcacaacagcttattcctagcagggccagtcagagttgtctcaaagattatctggcagcccccagatccttgggacctatcatctaggaacccagaggctcctttgagaaactatgaataaacaaggtaggaggttagatctacaacacagagtcagccagcaatgtctccttagactctgaggtgccaaaagccaacttcaggaatgccttttcagttctcattcactaactaggcaggtcttcagcatttctctcctcctcagtctttctacataaaataacatgaattaaccatatgagaacagcataaacttgctcacttttttcggagaaggcaatggcaccccactccagtacacttgcctgggaaatcccatgggtggaggagcctggtaggctgcagtccatggggtcactaagaattagacacgactgagcgacttcactttcacttttcactttcatgcattggagaaggaaatggcaacccactccagtgttcttg

SEQ ID NO: 51626 - DNA, 846 bp, Bovine  19866881471190
gaagaaatatgcaaacatgataatcctttggactgttgttcttataaaatatagctatctctttcagacagcaacaacaattagtcatgagttacacattctttttaagatatatcagagtccatttaaagttccaaaatgtaatactcagcacagaaatagagtaacagatgttataaccaaattaggggttcttcccagacatcttttattgacattagagtggtacagaggcacattaaagcctttgaataaagtgctacactctcaacctgaggatttggtggaaaataacttctgaaattgatgtttcaatttcagctgcttgtatacgtgctgaattgcttcagttgtgtcagactctttgcagccccatggactgaggccatcaggctcctctagacatgggatcctccaggcaagaatattggagtgggttgccatgaccttcttcaggggatcttcccaacccagggatggaacccaggtctcttaaatctcctgcattggcaggcagattctttaccactagcgccacctgaagtgaagaagtgaagtgaagtcgctcagtcatgtctgactctttgcaacccaatggactgcagcctcccaggctcccccgtccataggattttccaggcaagagtactggagtgggttgccatttccttctccaggggatcttgccgactcagggattgaacccgggtctcctgcattgtaggcagacgctttaccctctaagccacctgggaagccttcaatttcaactactcgattcaaattaatgtttctaacaagtggctttctagttaatgaatatgtttacagatacgttaattcttt

SEQ ID NO: 51627 - DNA, 731 bp, Bovine  19866881480464
atatggctggcataccccctgggaccaaacatctcttctgcaaggctctcagctcggagggtgcacgcggcccagctgagatcacttcgtagaaactgaatttcagagccgcggggtcttcgtgtgatcgctgatgctgtgatgaaaaggtggataattaaaccgacgtgaaccttaggcataaataattaaaaaccaatctctgtgacaagtcgcaaagctaaaggaaggagtgcctcactgagggagagttatttgttttgcaattaataaaggaagaaaatgcttgcttggagcatcaggctttaaaattacgacactgatgagagtatatatttgagaattatttggtagaggcggaattcttcttgatagaatttcttaacctatttttctgagttatttccatagtgtgtatatatatatattattctgaaagtaaacttttgaaagtcgccttaacaccccctttcagcctgtaagaaaccatttatcatgtccagttaatatccataatgcacaaaacactctgccagttctgccagatagttttgttccatctagtaatgcagttttagatgagaaaaaccctatgggctattcaaatggagaaactggtgaaaactctgacatgtgcattatctgaaatccacagcttttatcatacacactctagcatctaaaagccaagattattttacctaaggtaacctctgcgggaatcagaacca

SEQ ID NO: 51628 - DNA, 1307 bp, Bovine  19866881582205
tttctttaaggagcttactatcaaaaggagggaaaattttttttcctggtaaagtgcagtgcagtgagtggtacttgaacctcatactcacccacactctgctctgtgatgatggttgagctgggagttcacaactgaatttcccagcttttcttgtctgatggcttcttataagattctgcaaagaattctgcacaggcaggttagaaggtggaacatggaatagctattgccccttatttctccacctctctgcttctgtatctgggggaatggctgtggcctttataaagtcgtagagccagttgaggaagcccctccttagtggtcccaccttccctttccctatactcaggtgggtgtccccagaaatgacttttgctcttgggctttgaaaataccacctccccactctatcctaccagctctagggctggcagccacttcctgaagttaggaatttatgatttaatctcaccttcccctttttgctcttctagccttcaacatttctccatagcaaatgctgtctctttagaattccttgtatgatttgttttcctgcctgaaatgtgtactgataaagaagcaaatgtgtgctaccttatagtatgtacaaagccattggcgtgtagcagagagttgttgcagttttcacaaacaaagggatataactctgaagtctgtctcccaatgaattttaaaacaccagaccacaccagcacacatgtagagtactgtacatgagcatcagtaatatttcttcatcacgacaaaataagggccactagggaatgtgcatggcaggggcgggggagaagaaatttgaaaattccccaaatataattcatattctttgaaaaagcaattttacttgtaggcacttattttaaggaagtaatgagaaatgccagcttcccaggtgggctcagtggtaaagaatccacctgccaatgcaggaaatgtggggttcagttcctggtttgggaagctccccttggaggagggaatggcaagccgctctagtcttcttgccagaaaaatcccatggacagaggagcttggcgggctacagtccattggggtcacaaaagaatctgacatgatatagcggctaaacaacaagaaatgaaagatctaggtaacaattaatgcatctcccctcttgggctccatcccataggcctacaagtcctgtgctcatccagcatcaagcccagagttagcaacagagacactaatggtttaatggatgggggaactaacatgtgtgaagcaagtcctggagcaacacctcatggtgtatg

SEQ ID NO: 51629 - DNA, 1984 bp, Bovine  19866881739018
taatacactgtctaaaaacaaatatatgtgcgcttatcaacgtccactcagatacagcagttgcctttcatgccatagtagatttcttcaactgaagctgggcttcctgaccgttcagtctgcctaatccgtcaaagaggacctgtctgggcatgagggcagagacgcagtcacccgacagctccgtgagctggagcgcccagccccgagcccgtctcaggcctgcgctgctcgtgacaccgaagtttctggttaagaacaaacgatgattctctcccaggcgtctctaggaaatgcgccaccacagcgcgcttcctacttactatgggcagaagctgtgggtaaaagaagagctgtgagtcggccacgcccatggtcataaccagttgcctctggtaggcccgctcgtctgtggagatctcgggtctgccgagcagcacgcagttcttcaacaagcagttcatgtacaccggcaggactttcatggaatccggcaaaatcagctggaagagagagacactggtttcagatgcttgtgctctttgctgagaatcaaggcccactgcactttacctgtaaaagagaaacaagatttgctctctgaggttgcagagaggaagaaacgataagccacgtgcagcacctagagcagggaaagcagcacagggcaggttttcagagagcagcaggcggctgtcatgctctccagggccctggcagcttggcacagcgttcctcagcacagctcaccgtggggcatgtggtcccggccatgcctcttaccagctgtatgcctcgcgaaaactcatcctctcgtttcctccattttctcttctaaaataatagcacctctacttcacgatcctggggtggttaggaggattaaattgtttctgatttgtgcagtacttattgtaatgcccagcacacagtgtcatacacacgtttattaaatgaaatgaaatgtgtaagttatttcctaatctgtattaccagcttctttctacctcttaagcaagaacagcatttccaactaccccctcaatctctcttcttctgtgctcttcctcaagcttagactcacagtcacagactcatcagacactgaaggaggactgtgtcacaggttctatcaaagcctcaaggcctctgcagaggaatgagccatagtccacatgcagatgcctaatgtgcactggggatgatatgcatacagacagataaaccataataaggaaattcaaattacagtgccgttcaatatatatatagatattaaaacgggaaatattttgtgaatttattaggtatgtcactaaatgataacaggaaaaaatcaaactcctacaattccacaaacatgtttttcctcttatgtttcctgttttatatactacagctaccagatgaaccctgatttcactttttctttaccttcaattagaacacaaattctctccattcctttataatccacctttataacctttaaaatcaacctgtaccttcttcctctccaccctctctttggcttatgtgagctcattctgacttcattctaactgcctccaagtacataccataatgctccaaatagtaacacaattctagaaacatgagtaaaaaaattacaaataatttgcctgtgtgtttaaccttaccaacacagttttacaaatatggctaagaatcaagagagactgtcatttcttccatttatagtaggtcaatgaacaaaatatccaaaagaaaagcatatacagtagataatctgcaaatataaatatctggtctataaattcatgattttttttttagctttctattttaatattaaaaaaatattcccttaacagaatacacgctgaaaggaaaatttcccttagggctctgttattaataggatttattcctcaaatccctttatcatcgcttctcatgatcttctaagtaagggaatatgtaagacagaactttctaactg

SEQ ID NO: 51630 - DNA, 1110 bp, Bovine  19866882077692
tgctttttaagctactgcatgacagattacatgaaactcaacaaaaggcaaacttttcacagagtattttgtattttccagatttacagagcaattctctctgaatattaaatagtcacattttcaaattttcactcctttcctagattgattgattgctggaggctaatttcaaactaacttctaacactttcagtggagaaatgtatttaaagcaaagatttatgctagtcagatatccatctgtcttctacataaggccattcaaatcctcccagaatctgttttaaaatatgtgcatccttttgctgggaacattacttactcctctcccaaattaggacaaatgctaattattcatgagtcagatggctctcaaatacacagatttcattttctactcttattataaagtccatgaaatgctcctctcgttttatttcatcattctttcctcttcgtcctacccattctcatttacattgtccttcccatcagagatgtttacattagtatattctatatatgtccttaggcatccaaagctatagccctgagaaataatactaactttctatgtgtgtgttttgaatgtacataaattgttttgccctattataattcattctatatttctaagatctatccatattctgtaacttaaaatgattaactacttactgctgtactgtatttcattgcatgtatttatcatgataatccatttccctagggacagatatcaaggcttcttataactttctgctaacacaaataatgcaatgacattatcgtcataaatgtttccttaaaaacttgtacacagtgtaaacccagatgaaggaatgatatgtatacagaatatatggataattaatttcactcaatattatcagtttgctctcccaacagtgcataaagtatctcatgactcctcattctaaccaacatttggtattagctgacttttaaatttttcccaatactaggttgacttcatctgaatttttctgacttcatgtgaagttaagcatctcttcatgtccatataggctatttagactacttcttccattaagagtctatttttactccttgtcgagtttttgt

SEQ ID NO: 51631 - DNA, 837 bp, Bovine  19866880656817
gtggatctatttcggtatatttattacagccgcttttaaagacacatctcagtcggctgctttctcttgtccttctctttgaatgcaagccgacctaaatggccccagtaagaaattaaatataattacctatagaagcgcacaggggacaatgagatcgcaccagcttccgaaatggaaaaaggcgtttggaggcccctcatcttcattcctccccagagttaatttgtctgcatttcctccctcgtggagaacgcttacacgcagcctcacaatgacctgtttagttggcggtggaaaattatgtcatttgcaagcaagctttcagctgtgatattttataattgttaagatgaaaacccgataatcctctcccccttcacataaactgcaatccatctttaaacctgtgataattccgaaaacctgccgcttaataaactaacaaaccccaggcctatgtgattttacggggagtcaatctttgatcagccaagctgaaatgggtctgataaggggacgcccttccactctgggagtcgccacttgagtgggtgattgctgtttcctccccgtcctcaagtgccaaataagcagaagtcttcctgagcttcttatctctttcactttcttctcgagatctctgtcgctttaatccggcatgtctgctgctggttaacaaggaaatcctatgtcaattatcgccaacaacttcctgctgcgaagcagtggggaatcaaagcgtttgagagccttttcacaccagagagtggtgcagggcctaattaaatggccctcatatcctgcagcccgtggaggccacatgatagatagcta

SEQ ID NO: 51632 - DNA, 1387 bp, Bovine  19866880689401
ctatgtactaagttggctgactcgtcatctttggggcatccgtagatcagagaataatatacttagaaaaagaggacttggatttgagttgaccattaatgtacctttggagagtctgctgctgctaactcacgtcagtcatgtccgactctgtgcgaccccaccaggctcccccgtccctgggattctccaggcaagaacactggagcgggttgccatttccttctccaatgcatgaaagtgaaaagtgaaagtgaagtcgctcagtcgtgtctgactcctagcgatcccatggactgcagcctaccaggctcctccgtccatgggattttccaggcaagagtactggagtggggtgccattgccttctccaacccaaagaggtgtcctcctgttttgctagcacaaggctgcccctcccaggatcctctgtgctctatgcatgtgtctctcctggaacagaaagggttaagttgacccacaacccactggaccctgagacattttccttctgggccacatatgtagatggactctgaagacaaacctctctcctccttggaaatcatgaatttttatgaagccagcccagaattcccagaattcagccgggtgcactttgcagaccctaaaatgctgtcaccatggaaggtttcattgcttgcacctgctaaaacatttgaggcatttgagaggcagtgaaacacatttgcttttcattttatctgactttggaaacctttgaagtgtttaatagtagagcccaggaaagatccccgcctcttaatcatttactggtaagtcacattctcggctggtagcctgtcaagcagaaactgacctgagcccagttttattaagtgtcacatgcccagtcactgttcattaaaggtgttttaaggtttgaattatgtaatttatgagaaaaagaaataaaaattccattgttttattaatatgcagcccaagatctctctctaataacaaatgaaggaaagttggataaaaggatggggggcggtgatgattctctggccttcctcggcccctagcacccccatgtccactccacccaaccccaggcaggagcctggcaagtaggcagcactctgggaagggagccatctcaacctgtcttcctgtgtcctctgcctgagacctgatgacaaagcagccaccttcctcctctttccagctcttctgtctgttttccagcaaggcaggaaaagcatttctagagtgacctggggtgatggtgtgagtcacagtcattgagaacgaatgccccttgctttcaggacagctgggagagggtgcagtgctgggcacacggccacctgtttcaggcaaacaatttcatggatcctcaccttacctaaaggaaagc

SEQ ID NO: 51633 - DNA, 1918 bp, Bovine  19866881017766
ctccttcagacggtctggcaagcccagcaggagccagtctaaggcaactggctcctgggaggagaaaaagcaggtgtgaatctgtgatgaataccaaagagggcagccaaaggagcagaaaagctctggcaggggagcttggggacaaaaggccagggcacatgatgtagtcgtggggaagcaggggtggtcatcagggtgacactaaagggcagatagcatgaacgtggatattgctgtgctgtggggtggaggtctacacgattcctgggcccaggttagggaggaaattcagaccgtccctctatcacctcgcgggatcagggagccatagggagaacttcagcctcacggtcaaaacttgtcaaggtagaaagatggtgacatggagaaaaatctccaactgtctagcacccttcctgagaacctcgaaatctttagaaacttactattttttttttaatttttaatatattatttccgggccaatgatttcacttataatcttgaatgacaggaatgggcactcagcaatgaagctgttcgcccactttgaggtacaggtgagaagaacgcatccattctccaggaatttactgtgcccctgctgaaaggcagacaccgatcaaggtgctgggacctgcagagaataagacaaactcggttcccattctcatggaacttacattttggggatgaaagagacaataatggctaagcaaatagaggaaaaacattcagataaggataatgtctaggaatgaaacaaagaactttgtgacagtgatgagtcatgaaggtctctcagagcctaggcctgaatcagaagctatgaaaggagcagagcaacagctcaggcagcaagtgtaaagaccctgaggcagggacttggttatggagatccaggaaaagggaaggtggtcaagtaagctgaggtcaagtaagccctgccaacagttctgggcacttccctttgttccaggtaccattctaagcactttaccagtagcttattaaatgctcataatggaacctagaggttccctggtggctcaggccttaagaatcctcgtgcaatgcaggagccacaggagacgtgggtgtgatccctgggttgggaaggtcccctggaagaggaaatggcaacccactccagtattcttgactggaaaaatcccatgcagtgaggagcctggcgggctacagtccacccggtggttaagactcagattcgactgaagtgacttagcaaggaccctagaaggaaggatttcactattaacccccattgctgtggaaactgaggctagagcggtcaagtcaccctccaaagttacgcctgaaaaacagggcaggcaggattccctccctggcattgggaatccaggcaaatgctagaggacagagaacctctgggcctcagaaaaaaagttgcgagttcgttcaagtacaacgggaagtaatcagatcacactgaacgttcgtggccagtacagtgattattgagcccttttcgcactcaggcaggttgcagacagcctagggtcgcaacctgcgatcctctcgggcgacccggcctttctgccctgccctgcccctcgggcctcccccagcggcttcctccccacccgggcttcgcagattctgggtgagaactagcgctccggcctccggccctcggaccccgaagcgcagagcctagctacccctcgctgcccgcaaacccggctggcagccctgcctcccctccgcctctagctcgggccgtgccgcctcctcgggaagccctccggggagtcccggggaggccagcctggcccagctaacccatagaccgagcgccaggacccccaagccccctggggaacactttctgccctccactcggcagcgagtgcctagcgccataaacccctgg

SEQ ID NO: 51634 - DNA, 1015 bp, Bovine  19866881022836
tgactgattaagatattggaagagcatttggcattttctgtcttacgagctctaaagcagttccaagggcacagaccgcgcacactcaggcaagactgatagctcagattggacatggtggagattaatttccgagcaaggcaacttctaattattgtgctggcaaataaataactgaaacaatcttgaaatatttttggtgttgggggatgttgtggtttggatctttaattccaaattaaagtatttaatgctttataaagcagttgctatttaaactgccaataatatttaacgtgaatttgctcaccatttcctatcctcatactgtataatttataacactaagccctttcaatactccaaaatgccagataaacttttctcatttgctcttaatttggtcatgcaggataataccaacatctgaaggctctttaaactgctttttaaaatgcattcctgtgagcgcacccatgccccctctgctccttgtcatcatccataattatttccaatccaaagcagcccttaatgcacttattaatctggcattctcctcagtgtgaagcacattcagctcgattaatttttaaaaaccctccctttttataggggactgcagatgcttggctattactgaaaagctattagaagttaacacctttctctccctggagactggcatcgtcctaggccttcaaatgccaccctgttttgcattatcagctgctaagacgaagtattagagtcgtttttttccttttcacttcaggattggtaatgctattattagctaatggcagaatcctgcatggcctgtggctagagtgagatggttcctgggctaaaacaaacagatttttagatgttgtggccttctcagagtgtgtacctccagctctggaattcctgtgcttccaagtgagacagacaggactggcctccttgggggatggggagggggagagagagagagagaatgagcttaccttctctcccaggaccccttccg

SEQ ID NO: 51635 - DNA, 1029 bp, Bovine  19866881099752
atgttacagtataaatgaatgacaccaacaagagaacatgtgttagcgatgcaagcaattagttaatatattacaagcttcaacctctgagcaaaacaggcaacacaaatttcctcttgacaaaaggctatagataagatcaggtgggttccggaacaatacaacctcccagaattggagcaatcctccagcaggctgggagggagagatgggggtctgaggaatctggggtctgtagagtgtgagtcaccaggtaggtctcactgtccctgagaatgactggctggactttgggctctttgcagaggagaagtggagcctgaaatggaagaggacatccgggtgtcccccggatctggttcaccacaaagctgcctcctccttgctggggcttcagaattaaagttagaaggtggaatgaaatcgtattgctgttttcaaaggcaaggaggtgcctgtgcaaggtgatgggcatggggatattatatgggcaaatgcttgatcactgctttccagaggagattttaaaaactaaatattgtatattacacagtttctatctcccccttcttctctttcttctctctttcacacacacacataaagatgtttgaaacagaaaaatcttcttacatatacacacaaacagacaatatgttttaggtaaaatacacatgattgatgtacacttggactaaggatttgaataagtcccttagaaataccaaggaaatactgagaatgcaagaaggcaggaaaacctgaattcaccaactcaaaatgtaaaaaaatttgtagacagttaaaaatgtctgcccctgtacacacgcacacctacactttcacacttcctctgtttactaaataacatttcagcacagttttcatcttataaggaaagtgtttgaaacttggaataagtgcacttaattaaaggaaggctgtgaaaatgtgcactaatctgatatgactaatagcaaagtgcatgaaattgctaattagaatttcattaaaggtgcgctttatcag

SEQ ID NO: 51636 - DNA, 2928 bp, Bovine  19866881172650
tgcattggcaggcagattctttacccttgaagccagctgggaaactctgggttgggggttacccatctccttttcttgcccctgagagcagttctttggggcttccctgtttgcccagctacccactaattctgctcaggcccagcactgcccacaggcctacctgcctcactccagttacctgactgaggctgcaggcatcattatgtcccaggagccagcttctccaccttcaatcctggccaagatctaagaatatctccgagagtattccccaacacctgcaacagatgtgcccacaaattacctggtcccaggggtggggagcaggccaggaaagggcagtgctttcctaaaagcattacacacttaatttgcaaagttacatcacacatatgtgcacaggtcaactttctgggagcttatttcagaaccggaggcaggtcacggatcctgagcgtgtccttcacagagaaggcaggaaggcctgtagacgttccatgagtgtcagattctttcacacaaaccagggcagatggggagaggtggatatttgaggggcctgtttcatctctgcacgggcccagtgggtgcctcgacagacaccatctcacttcttcccaggaaagcccctaccaaatgcgcatgcgcggatcctcatctcacaggtgtggaaactgaagccagaggaagtcaggtgtctttgtgtctcttacagaccatgtgacatgggcagagtctgaatttgaacccaggttccagactcctaattctactttttccccaccgcccagtgcagtgagagatggagcaggggtgatacgtgttacgtattactttttagagtgcagttgcacatatccatctggctacacttcaaaaagtctttattgaagtatagttaatttacaatattgtgttagtttcaggtgtacagccaagtaattcagttttacaatacatatttatatatattcttttccagattataatttattgtaagatattgagtgtagttctgtgtgctacaaagtaaatgcccttatttacaagacagaaacagatttacccaaaaaacaaacatggttatcaaaggggaaaaaggtgggggaggaataaattaggagtataggattatatacgcactactgcgctagtagtaatatacacaccactatatataaagtagattttaaaaggacttacttaactataattttaaaaagttatttaatggccttgggtactttagttataagagtcacagggaaagctagggaacctatgtgagattacagccaaggaactgtctacagaagcagtgaaacagcaaattgtaaaaatgagtaagattgagttcactcgacagttgtgtcaaattcagctcatttcattgacaaattaattgccttgaattattattcgtaatgttaaggttttacaaaataaacgtggtcattgcatactcagaggggaccatttagaagtccatttatttctaaaactaatattagatacaatacagttgcaaagttagaaccctcattcttccttatgcttttatattctgcctctaaaatatatttgtttcttctcctagctattgtttttactgtgataaaacatgcgtgccataacattttttgtttaaatgatttttaactgtatcaatagagtccagcggcatcaagtccattcctactattgcactacctatactttttcgtgaaacgtaaaaaatctcttctgaaaattctagcaaagaacaaatggatcaaaggcatggagaaaaagtcagccccgcacgcccccagatccccttccccgggtccagggagcacttgtaagcaggtctgcttgtctagtgagatgtggatttctgccagatttgctcattcggtgagacttcttcactccttaccaccgagagagcgtctcaaacccaagctgcctcttccctacctctatatttccaagcaacgtttccccgaccagatttacattttcaaaaacccttcagataatcacaaacccaagaaacttccactcctctgaggtttaattaggagaaactgtcttcctggtacttccgagtgcctgcctctaaatttcttggcggaaaggctaggttcacggcagatgagtgggagctagcagaacctgtgaatcgcctcccgctctgtccccgtctctccccagcgaccgggagaaggctgggctgcaggtcattgaaatcacattgtgcgtgtgccctctgtcattaggacctagagaatggggacgatcggaacgcagggataacacattagtgatagataatagagtctaaataaacataatcagctttcctctagtctccagaccaaagcttatctataaataccctaatgacgccccaccagccaattacttgtttcttggaagagccccttattaatggcgtttgcagtgagggaaaaacattaattattggacacagtgggatcttttacgtgctgtctggtccggacagcaccaattaatgcaacaattattatcaacgactgtggcagcatactgagcgcagccaccctgggctggcttggtggggtgggagaacctgtgtgctgggggaccatcacccactcgctgttccgggactctgcttcttcctcactgcagaaactgctggaacaaagcagagggtggccagagtgtgttgggtgttccttttttttaaagttatttatttattttaattggaggataattactttacaaaattgtgatgctttttgccatacatcagcatgaatcggccaaaggcatacatgtgtcccgtccctcctgaagccccctctctacccaccctatccctccaggttgtcacagaacactggctttgggtttccctgtgtcacaggtttttccttttaagcctgagcatag

SEQ ID NO: 51637 - DNA, 1572 bp, Bovine  19866881195704
tataatgaggagggcaatgaaatggcattccgagagtcaatggaggagaaccctttagttctctcctcagggaatagctgaacaagtgattgttatcagagaacattctccagagttcccagccatgcaggattactcacttcccccctcatcaacacccactactcggtgcacatctctgaaagattttatacacgtgtcacatagacccttccccacatggcaggtacgccgcacgaacacggtcatacgcatctcactaaccagccacccaaaccccgccggctctgctgctaccccagtcagcacaggttagagatcccttcaacaaaatcacagtgagtgttggactcagatgtctctcatctcctccccttcaaaaaccatgttggaccccacttagtctctactctctgctcttgacacacaccagccttaaccctatgcatttacacctttctaaccatcctatttaaggacataattttaagatgtgtgtgcagaggtaattaccagggtgttcttcaagccttagtataatattgaaaacgcaaaacatcttaagtgcctagcattaataaaatttagagcattcatcctagtttggctgaagaacaaggcaggtgttatttacatgaggttgatagcgatgtgaaagaggttcattgtgtacgtgaacagaaatccatgggttgctctaagttacaaataagcgtactgtaatgctctgtgtctaggctgatcccctgtttactagaaaagcaaactttatttttttttcatctttattaaaagatataaaggcctatttttaaaagcccatgaggggacacatgagttggttaataatgtttactgctcagtcacatgatttcaattttttataatttttctttaattttattctcggtactgtaatttcagatttcacattttgttcgaatttttttctttggtccattcatgttttccgatttctctataagaagtgatttcttctgttatatttttaaaagttatttttaattttaaaaaaaaaggtacttagaggttcacagctgatcatagctttagaattcatctagtctaatgactttagtttccaggtgggtaaactgaggcccagagaagtgaagtgcctccaaaaaggtcatcaaagctgtttggtggcacagccaaggttccctgattattcccgttctttccaggaagtcctgagatgtctctgggatttttataaatatggagaaactgttttcataaagtcacctgcatgaaacccccttccctcccagcaaagttcagcatctcttgattggctcaaaatcaaaggtgccctttactgcttctccaccccttgcccccaggtcgcaataccaatggcatatatcacagcgtaggtgccaggacaccaggtaaatgttacgccaggtttcagcacattattcttgtccaagtctccattgtgtatgcaggacgagtgtgagacacagctccaccctcggcttgccccaccccttggctcatcccagtctggctacatggttaataaacaacaaggccaaacgaacg

SEQ ID NO: 51638 - DNA, 752 bp, Bovine  19866881359525
cacctgacccgtgaagcaccggagaccagagataataaatccgccctccccgcttcgccccagccaccgtgggccattccccacaggcagccccgcctcgggacccgggaggcctagcagtgaacaagtaacatccgcagctcaagcaccttccgtatccagaccaggcagaagaaggcactgcccgggtgcaaatccagtttacaaccaaccagagatgggaagggtccatgctgaacgctctgggcaggctactacatctttcttcatggtcacgactgagttagttactgacttgccagggggccctgggccagtcctgggctcccattgtccccacgtagttactgaaggcaagatggcttccagtcctggtgttcccaagagaagaaagtcactggtagtcaagagatgggagctttcttcgcttctccccctccatgtgtcccccttccctccctcagcctcccagcctctctctcctcagccctttcctcttcaagacccagtgcttcccagtgtctgggagggactgcacagatgtgggggcttctgctcagtccgcatgcccacctcatgcaagcggcaccccggtccttctgggggcccctgcgtgcatgaagtttctctcacgtccgccgggccggccccggggggagggctttgggctccctctacgcccagggtacttgactgttaatgatccccgggcacacttcccccaccctgtcccctagacatttcccttccag

SEQ ID NO: 51639 - DNA, 3272 bp, Bovine  19866881485131
gaatgatttgataagctgaaacttacccaggcgcctctcctcttggctcttctttagtatatttattttttcagaaaacattttcttgagccttgactttgggccaggactgttctgggcacctgtagttcaaaggtccctctctggtggagcggatgtccacctggggagaaaacatcgtacgagtaagtacatgaacatttttacaaggacctcatactctttaagtatgtatcaagtcgtgtccacattcatgaggtttcatagaaaaacaaaaataatctcaatcattttaaaatctgcattattgaaccaaccacttgtaagctgtttccattcaaatctatacagtatcagagtctatcacggcccaaagacttgtcatcacttttgatccatctcctttcattctgggttatctgacagtacaattcaattacaatgcaaacaaattgcagagagaaattgaagagtttaccaaagatgtaaggttttatgaagttgatgagagaaatacttaaacttcacgccaagccaatgacagatgggcatcttgcagttcatcaggtaacaaagggaaggggcggggattggcagaggtgatgaactggtggtcaaaacagaatggctgggccatcaagtggtttaggaaagctttagaagctctaagctccttttgcaataaacagctttatttatgtttgtgttgcgaagatataaagaaacattaaactagggaagccgtattgtgccactatccaattttgtcattaaaaattacattcctcaaaattatcaacacataactttgttcattctaaaaccacagtgtgtgatggaaattagactctaaaactggaaagaataagattaaaacaaatttatttttatggtgtataggttcagttttcaagctaaagtctgaatccaaatttttttttttaaacttccctctattgcctatgaaatattggctcccttgttaggtgaacttgctctttccaggtatgattacccatggataacaaggcctcctgtcatcacactggtgtaagtgttctaaaggagagtacagagggctctgagaccccccagggatcttagctagtctagggaagtgaaccacagctgagacttgagagataaacagaggctagaggtgagaatatgcctagagtgcatcacaaggcaggctggcaaggtctaaagaagtaaaagaaagccagcatggccagaggcaggtacaggagatgagtctgcagatatgggaaagcaccaggatgtttgttttcaccaaaggagcaacaggtcaccattgcaggatttcaggtaggaaactgacagatttctgatttaaagaagctcttgtgggtaccacatggcaggtaccatcttacctcttgtaactagcaaagcctccctggacatcttgtttcttcatagacctaaagccccgttcaaaattcccagactggaatcagactttccagcgttagggccccactaagggacactgcttcactgcagatgaagacagtgaagaagcccagtgagaatgagtgacccacctggcattttgtgttgggagtctttaaggtctccacttccaacgatgagacagtaccagggactggaaatatcctcttaccttagccaaaaaaatgaagaagatgccaaaacaaaaaaattttttcagaacttgggcaataggcagtacagccaatgatccctgaaagaagggaaataagtaaaatgagccctgtgattggcccagcttgctgctggagtttccagaccatacatagcacaaggtggggaaattcaaacaagtccagcaatatagctgagttgaagagacatagttatgaatttggggaggccaaggtggctggaatttgaaggatggggtatctatgaaaagacagaggcgaaaggagaaagctacagcaagaactgtccagttacctgctccctttgagtcttaagcagagtgctgatcagtgcatacatgtgagaaagctactcaagaaggcagcggggagagggtggtgaaacacagggtaggaccaagcaggacaatcgccagagttcacactcggctgggaagggtctgtgttcccatcagccagaaaggagcactcataatatacaggcaccaggtaggtacccaaaagagtattttttgtctcagtactagagaaacattagccatggtctaaagattcctttttcccacccaccaaagcttaaaaacaaaccctagaaataccaaatggcttctaaagaatttatctgtatcccggagcaaagccaagaatatttaaaggaatacaaaatgtcaagcaccacccatggtaagaagtgacgatgtctggcatccagtcaaaaattatcaggcatgccaagaagcaagaaaattcaatccataatgaggagaaaaatcaatcaatagaaacagaccccaaaatgacatagatgatagaattagtaggtgagagtccagctgtctcatctgaagacttccacaagaataatcactgtagagagaggcacaaagggaagtggtcttgtgatagcaatcagatgaaaggcactggaacatcaagagtaagaatgagtctacacacatggttctaatctcaccttaagtttcctagagctcagaaattcctctcaacagagactgatggttctattgcaacttttagactgagtgggaactcatttcaattattcaatcatttgaaattagaatattccttgagggacaagaaaggcatgagtaagtctgagcaaagtccattagaaaatcaatctatttagcagcctttcaaaaatattcaatcgagtgtattatcaggcattaaatcagcattactttttattagaaagatagaatattctggttcggcaacagctcttattcaaacctctacttcacttcactatctgttatcaattctgccatccatatctgctgtttaaatcatgaggaaaaattatttgaaagacaagccctctatgacaactgaagaatattctccattgcagtaattatattattgctgaactgtgttaacatgtaaattcttttctaaagtcaagtgtaggaatacaacatcgggagctagcaatttaaaaagtgaaaaatctcaatgcatattcaaaatgactagttgtgggaataacctttcccataatgggagcacaggtaatctttaacatcctccgactataaagtgggaacccaaattctcagcctgacttttcca

SEQ ID NO: 51640 - DNA, 1426 bp, Bovine  19866880379602
tcagttcaagtctgaatttggcaataaggagttcatgatctgagccacagtcagctcccagtcttatttttgttgactgtatagagcttctctatctttggctgcaaagaacataatcaatctgatttcggtgttgaccatctggggatgtccatgtatagagtcttcttttgtgttgttggaagagggtgtttgctatgaccagtgcattttcttggcaaaactctattagtctttgccctgcttcattccgtattccaaggccaaatttgcctgttactccaggtgtttcttgacttcctacttttgcattccagtcccctataatgaaaaggacatcttttttgggtgttacttctaaaaggtcttgtaggtcttcatagaaccattcaacttcagcttcttcagtgttactggttggggcatagacttggattactgtgatattgaatggtttgccttggaaacggtcctctaggcttccccaaaaggaaagttacagattctgacaagtagggaatcccatgatgaaatggttggtccctgcttgcaaaccccacagtgaagccatcatccaataaccctttcatttgggtacagaaatcccagtcactttgtagtgctttttccctatgacagctaaagatcagcaggaataaattacaccctacaattgatagcctaatagatgagaagatagaacaactctggaataagaccaggatattatcaaggggaatgcagcagaaataaaatagtcagagaatgggatcagaagatcaaattggggaaattgtgcagaaagtagaacaaaaagacaaaaatacagaaaatagagaaaatgctgtaaaaattagaggattaaaccaagcggttcagcatctgacagtcaactaaaacaaggctcatagccttttctgtgccatagacccctcgggcaatctggtgaagcctacagaccccttctcagaataatgctttgaagtgcacaaaatacataggaatacaaaggaagccagttacattgaaatacaggttttaaattgttataaagtaaaataatgatatagtaatatatgatttttatgagcataccaaaaacaagacctagaggtagatgtattgtaattttgaagttgttgttcagtcactaagttgtgtccaatttctttgcaaccccatggactgcaatacaccaggctcctctgtcctccaccgtctcctggagtttgctcaaattcatgtccattggagtcaagtgatgccatctaaccatctcaccctctgcttccctctcctccttttgccttcaatatttcccagcatcagggacttttccaatgagttagctctttgcatcaagtggccaaagtattggagcttcagctttagcatgaaaggtatttcacaatacctgtgttgacat

SEQ ID NO: 51641 - DNA, 1715 bp, Bovine  19866880429596
atgcacgtgcattcaaactccaaagcccatagtagatacactatctgagctcctttttgtcccagtgaatagaacattaataatgatgaaatgggccagtcagtacatcccaagcagagggaagagcctgagggtgagctgggggcacagaagactgtgaggggtgtgcctggggtagaagggtgagggaacatggtggatgtaactcataaaggcaggttggggttttgactggatattatggagggtctatcgtttgatggctgctggccaaccagaatgggggcttctccagaggacattgcatttgggacataaaaacagcctcagaaagctctgactttttctgattttaagccaaatcatgttcatctccctcagcactgctcctataacctttttttagcacaaccacatcttcagcaatttggggccaagcaaacatggtcattcaggacgggtcacttgtccttgcaaggggccttcatgctctggtgacagagatagttggcacgtggctgccctccagctaaccacttctccctctgagaagagtagttattgccttgcatctctgcctcataaaaggggaatggaattggctgggggcaatctgttgggattggtctgtggcatgttgcattagtgtttgaagcatggccttcagaaagtatgtttccatttgttgtacttgatcatgatcagagactcggcttcaaaaaaaagaaagaacagagtttgaactctacttattggatgaaaagaaggagaaaagcaggggtagggcaggaagcaaattgtggaagagactcaatctgtattttcaataacaatagccatttaaacactgctcagattatgtctgatgagcaggaagactcagggtctttggaggaagaagcatgaatccaggagacaaatctccacacaaaagcaacctcaaaggtcaagagaggtcagatttgaatcatagctggaaggaacaatggagattagcccctcaattttttatattttatttattttttcatattagaggataattacaatattgtgatggtctctgccatgaatcaacaagaatcggcactacatgtacatatgtccctttccttttgaacctcccttcccacctcccttcccattccacccctctaggttgtcacagagcactggctttgggttcttttaaaactggagcagctaaagcccagggggtgcaaagacttagttgaggccacacagatggtgagcaatgggacaaagtttgaagtatcttgctttccagttctgggtttgtttgacatcaagctgccctctaggagaatgtgactgtgagcaaacagtaaatgttttaagatgtcagaaacctgggtgtgggtgtaaaaggccaaggatggcttcaaggaggacatggagcgatgtgaaataggtggagagcagagggcattgtagctagagggggaactgccctctacctgcccagaatgtgccaagcctggcatctcagtgtcaggaaaagaagtaagcagattcttgtggccaaaataaattgctacagcagtaaaattaaatcccctttccggaagaaatggaaacctttgtaagagatgagaaatctaaacctttgtgccccagcttaactgatttaagaaaccaacagttccttgcaaggttgaagagagaaggaggaaaatactaggcttgcctcctca

SEQ ID NO: 51642 - DNA, 1285 bp, Bovine  19866880476793
ggctgcaggctcagatcagagaaaccagaatttctgggcctcggcatgaggattttttttaaaggtctctgagcaattccagtgtgcagcccagctgagtagccttgagctaggcagtggcaacatgctagaaaccctgcagagagaggagctcttgggttcctgggctgaatactgagaccatggtcattgcatctgcttcttgagacaaaactctgcttcttcagaaaagggaaataaggaaatgaatcacaatgtatgtttcatgcacccgaaggaactacttaatataagatcagagttaagcactgacacaccctctagaacaagtagataataaacactcaagccagatttcatagaatcagtaagaaacctgtttctcccaaggatatgtctgatcactagagtcagagtattttctgagtcaggaattcagacaataacctgatgggtatatgtgtactcacaggaaaaccagtcccggattcctgaaactggacttgtcttagaaaattcagtctggatggtgactgtactaggactcttaagagttattggctacattaaaacaaaagctttcagtaaagtgcggaaaaaagaatttcgtaattcaggaagagaaggactcacctcatcactgaaatttctgaaggcagccactctctcttccacactttcctgattcaggggcaccagcttcaagcgatcaattatctgtttaacacaaaagccatcagccccatatgatacaatcatcacagtcattccatctcttcaaacacatgtcagcatctaacatgttcataggtggcttcttagtaggaaattctactccccttgttcaaaggctttgattccaacttgctgactgactcaattcctatccttgttttccgaggcagtttttacaattcagagacttcaaattattttgagaaatccctctgtttttagattaaagaagaaaggaaaagaaaaaagggaaaaaaaaagaacaacatagaaatcccttttaaattgccaggatcttacttgtcctttttcacttaacaggcatactggtgacatttcctttgttttaaatgaatcccacaaaatgttttgatttttcaagggcatacattaagcaggacttcaaacacccctcctgaaacttacatcaaaggctctgtcaatatgcccactgtgatactcgtcaaaaaaggtgatcaagtccaacagaagatagaatgtggagtccacaaatttatttgcactgattccctgagccctatacctgaag

SEQ ID NO: 51643 - DNA, 3048 bp, Bovine  19866880587401
attcactttactactatttacaccatgagtcggcaaacttaactccgtaaaaggcagacagcaagtacttcaggctttgccggccatacagtctgtcattactactcaactcggctactgtagcacaaaggcagcacagacaatacacaaacaagtacgtgtggctgtgttccaacaaaacattaacaggcagcaagttgtatttggctcctgggtcttagtctgccaacccctgatttataccttcatatacgttatgcatattcttttatgtgtgaagaaatttaacaatttaaaaatatcacacacacatgcaaaaaagcaatcaaatctgttccctaaaatgaaaaatccaacacagtttatttaaacaaatgcatttcaacacagaacaattcaatcttaaatctacaatccaatcttaactaaaatcttgaagacagaaatttctttcaaaatttatttcatgtaagaaaattttccctattcacttctttcctctgccctcatcctgtactaaaatattcacatcacactttatgtctctgcctatcacagagatggaaaaatacagtcatcagccctttggtttctttttaagcacctgccccaccctatacccattctttcaacgttccaaattcctccccactaaaatgatgaatttaaggtagaaagaaatgaggaagaatggaaatttacaagaaagagagcatgactgataattgttaccaagaaaacattttcccttttcgctcttaataggctgtaaagctgatgcaattaaattataactataggcaactcagctggcatcacagtcctttcactccagcagcatcttttcacataagcaaagcctgcatgctcgagccccggggtaactgcaggcagccaggagctgcagcagcaggagcctgcagggagggtaagttagtggaaacgtctgaaggctggttggggtgttgggcaatagtgtaggggagcaaggatggataataaaaaatcccccccagggttcccctgatgtgcctttaccaataccaacagaaccaagaaaacttagtattttaaaaaaataaaattctggggaggcctacataaggatttctacaacatccttaccaattcagcatggcagccaaaacattcagatctcaagatgagttgaaaaaagaaaatgtggccgttatactcatcctggtgacattcactatgtatccaaacaatgtccccaccttaataccggcacttatgtctttctcaagtttaaggaatgaagactgagcagatgactgacaattcccatgatgcattttccacagagaatctcagccactttccagacccagcaaggtcaccagtaacaacacctctccatcctcccatgacccttccatcaggcctaaaggagcacacactctggagtcaacctcactgggtctgaatgctgactcactactcaccagctgtgtgatccgagagagttattgccctctctgagccttagctgctcaactgtaatacaggggtcacagtcctactatttattgtgaaagtgaaagtatcagtcactcagtcgtgtccgactctttgtgaccccacggactacagccagccaggctcctctgtccattgaattctccaggcaagaacactggagtgggttgccattttattgtgagagctaagcaaaatcttactgatgtacggtaagtaatcaataaatacatttgttatggaaagtggcaagattttttttctgcctcactaaagaataagctccttgagggcaaggaccatgtctaattcatggttgtagccgagagagtccaggcctggcacagtggggatcccaaacatatgtctgtagaatcaacaacccaatgcatgctgcatggcagcagcagccaccggtcaacagtcaatctgcacttttcccccgctgcaccttctcggggctcattcactttcctcttctacaatcaactggcaggcactacatttccaaggtcttttagaagcagcctatggggtcactgacaataagcagacagaatcactactcacgtggatggcttctcatcactaactgctcatcaatttcttccaagtgctcttaaaaatggtgcccatcacttcgtgctctctggcttttaagggaacacttatctgtgtgacccacatttaccaatatactatgtgaaccatttatgacccaacagtcagtgaacccaagcaggaaaatgactgggacgcttctgcacggcaaagctctacaccctttctcaccctgatcatctctgcctgtgacaggggctcacagcttggtcaggcagacaggctggaaaagccaggaaggtgggagacaaagcggtgctgttgacctgtttacgaaacctctctcgaattcctgaggatctggcgtgtatctgaattttacagactgcagccacattcaaggcaggaaagaagaaacagatcctgcccccgagctccccagtgccagtgctccctccccagcagtactcacgccttgacatctgctgtctcctgggacgtgcgtgtgagggtacgggaacgcagacgctcgcccgcctgctggatctcctgcaggttccgttccacatggggaagctctgagatgccctcggtctccgcggcaagctgttcagcttgctgaaggagctcaccaaacccctcagtatccattggggatgcagatcctaggtgggggagaagaaagaagagacccaagtcaagggacggataggcgtcacacactgcctgaacctgtcacaagctcaacaaaacactgggactttttgaaaacagacaaggagacaggtcctcaacaagcagggtttgttcctgaacgtagcccaagaacaacaggtctgacagaaaatgagtcagactgagaagaaatagatcatttctgtccaaattgacagccccaagattgatttctgccaccagaacaaaagcaaagatattaaggcacagactagaattcctgtctccctccacagactcagagcgacaggg

SEQ ID NO: 51644 - DNA, 1681 bp, Bovine  19866880620750
tgtgtgaaaccccaagtactggaggcaaatggggtaccatgacagattccatctaaggcaatgggaagttataaaagagaaagtctgttagtggtttcccaacaaatacatttttgaaaaagaatttctgaatgagaagaaactgcagcagaaccaaacctcccttctctgtgacagccatgatgatcagcgctccgatcccatcagcataagcagtgctgcatagcaggaggagctgggattttcgactgcagtgtgaatgactgacaccgtgtaccagcagggaattaatatgacacgtggttcccaaacattgtcttcgctaagggcgctccttgcgcttgctaagtagaactcagacttaatcttgagcacagtggaaactagcctggcaaacacgactcagctgccacctgactgcctcagagacacaccctctgctgcctgtccttctcatagcccccgagccttactttgttgccaaggagaaaagacactagatctgacaaagcaggcaacctgtatttttttatatatataatacaggattcttttaataagttcttttaagtttgggttgggagcgggaggacagtgggaagggactttggccatgataaaggccatgactgatacattcccatttcatactgcagagcagttttagtacctaaagttctttgaacgtggactaatccatctccaagatggaaatccgttccccaaagacacattaaaacatttttatcatcctttaatatatcctccttatcttatctttccatcacctaagagtggctatgggattaatattttttagatctagtctttgggtgtggagagggttcttcagctgggcatactttggcacacagtttattccactcacaaagctagattgaaaagtttcctctttagaatcctccctgttcttgtgacttcgaagggttgctctaacaggtatgctggtttggagccagggtccgggtttgaggggcaggcagaggagagaacctgctcagagctgctgtccttactctctcccatggggccacctccgagtctgagagcacttggctggctggcctccccgctccctccctgccttggtttttagtgttcttacttttcggccccctccttcccaggagtggaggtgggggcgcagcagaggcccagcgactactgcagggcatatcctgcggcatcgctgaggtgcgggctctggcttgttttctggaagcagtgagatgtgggaatctgcgccaagcaagtcacatcctctccacaggcctcctgtgaccagccggggagagctgcttacacaaccctgaaaggttattgcagggctctgctgcatttgggaggagaggggatttctgctgaaaaacatttcccccctagctgactaaatggccatcatgttttatttcactcgttcatattatgcccttactgcttgccccccaccccagagagtctcccagtacctgacctggacgcttccctttcccggatgaccagaggtagataacggggatggcttgggccccctaaaagggacagaactggtttttaagcaggagcacaagagacttacatggctctcactggaatgtagaccttaaccttggccttatcctccaagtacagcaaccagatgtgccaataagcaacccca

SEQ ID NO: 51645 - DNA, 1110 bp, Bovine  19866880647164
ggcctctgctccttttaggcgtgatgtccttcccctctgtagggcagggcccctggcgagaaggtacctggtctcaggggacacgtgtgtctcagctactgtgtcatccccagcactgtccaccagtacttctggtgacaggtcagagggagaactacaacatgggagttggaggggcccccagaccatctggtccttccccatctgttgcagaagggcgagtggggcccgatgcccagtgtgtaaagaacctatgtaaagggcacacagcaagacacttgcagaacccagacgagaaccttctccctcactttttttaaagttctatagtattgctgatcttttgatgttccctccctcctatagcctcccctgtttaaaaacatcccccaaaccctggcaaggacctcctgctgtctactctaacatgcttgacccactgaagacttgtaactctggggtagttgctggaggaaattcatgcatcttcaaaaattgtgcccagtaagaaaaatgggacttctggcagagaaagtggtttcagtgagtcaggtgtttcccaggttcatattccctggaattctggtttcctgagccttgagcctttattctacacctcccccccaaatagttgtacagtcaagtgagaaaatgctacctcctgcatccctgtcttggagagacacaggggtctttaacatattagatgttctgaaaagttctgtagtttaaaaaaaaaaaaaaccagcagctctttgtgtataattcagagtttcccacacttgtttgacctcagaactctttctgcatgaaaaactgctggcctgtctcagagctggtcttcatccaaccacagactaactagatcactcacacaaggtggtgtccagcttttgctgtttatacactcctgggttttttttttttttttttccagctttaatagtaaaaatatattttcaaaaataggtcataaggccttttcaaaagggggggggtcccctccgatcagcctttcactgattcgaactaaaaggatggaagaaagcttcacaaagatatcccctcttctttatatcctgtgattctgtttttattggcctaagaaag

SEQ ID NO: 51646 - DNA, 1603 bp, Bovine  19866880770574
atatatagcagctaaaacaaactaaaatagatcaagtcccaaaccaataatagaacaatgtgtacagtatgataacatttatggagaatttaccaaatgtataaaaaatactacatatatattaagcagattctatagctagtaaaatataaacaatatagtggatgattgccactagaatcataatagtggtgcctctgggaagaaacagagggaaagaaataagtatgagaaaagaagacatcaaagatttatcagtaaagcattacttctttaattaaaataaatctgaagcaaatattacagtgtcacttggaaattctgcttgatggctccattggtatttcacagtattgtcctcagcactcttctgtatttttgaaagttttcataacagtaatcataaagtccttcttgcaatctatgtattaaggatgaatatttcttactaactctacagaatcagaacatttgctattaaaaggaaacaaatgtaactctacacacgatctgtgtgtatacccacacatggacacacacatgtacgtggcagaagtccagtcttctgctatcagacatgccatgacctgtgtccaacactgtgtctggcacataactgacattccattagcacaggttcaatgaatgcataaagtatgttgtgctgctgggtgggacttcaagagtcactttgcatgaagggaggtttgccactcatgtgctgtgattgcttaagaatgagaatttgcttttgcaggtgtatctgagggttcaccagggggaacagaatatggtgcctgaaggagatactggtctctagtccaactgaggtcattgctttttggaaagaggaaagatgtctaatttataggagaagtgacttttccccattttactctgcacacagcaattctcctttggtagccaagtgacaaagtgtatcacccattggatgagcatgagcgagaggcagaaaggatgttttccctaatttctcagacacagcatggcattgactcaaaaaggactccaggagacttgtacttactttggtcctttaagaatttgccacagaaagctgcatatagctctactggcagagcttcatggtaacttgacctgacatcacatagtttttcggtgtctctttcccatacaaaacatttatgtagcataaaagctgaatctaacaataatttatagaaagctagaaaaacagatgaaagataggtgacagatagagataatggatagatacagagatatcttctcctcatttgagaagatttccactcttagataaaatatagctgccaaaagattgaacaaatatgccaaaactcatgaggctttctctgttaaaaaaaaaaaaagtgagaacctcaggaatgttttgcaattaaccacgctccatgcataacaaacttaaatatgggaattggcaaccagacctgcagatagtgtaaagaagagggttttgagtgcttcacgttgtcttttttggctccaagttaagaggcccaagatgtgatttcaattttggatgcgctaattatgtttgtcaactgtgagctttgcttaattaattagtcatgcaaattta

SEQ ID NO: 51647 - DNA, 1962 bp, Bovine  19866880780332
attctgagctcctggcacatgggttctctttcattccttggatactcccttttgcttcagtaatgttccctctgtctcaaaggctcttccacctgatcccttcttctgatgccttcacacctactcactgtcagagtcaccttctccaggtgtcagattgctttgtcacaagctctcaaggaccacattccctttctttagagcacttgtctcaatttatccttacatgctcataaacactcctgcttaattcatgtctgtctcctccattaggctgaacgccttgtgaaacaaagaccacctctgtcattttaacattatttcccagaagccaactcagtagccagcacattaaaaaaaaaaaaatcaataaatttgttgagttattgatactccagctccaaagtctttctaacattaaaaaggagaagaaaaactatttgggaatacaaaataaagaaaggaagatttaaagatgtaaagattataactttctcaatatgcaagactgatcatagatacaaaaggtcaagagatacctcaaggtctgtcaacatgaaaacatccaatctacaaacagaataatttaggatttaggttgaacagtcacagtccatatgagagctctaaaaatgaacaacattaggaggtgaggaccgcaacagcgagagacaagggctcacaggggacagaagagcctgtactgcacacagatctagtccagccgtggaggtgctgtaatccctgatgatagtcacagttccgggctgcttactgtctctggtctgatccccatcccatcacaccatcctggtgtgtgtttctatgttgcttctgggcatgtgtgaaatgcacaaataaatattctcaccccaaaaaaggtgagaaaagggaataagctattggaaagcgaggattcctccacccctttgttttaagtcttaggggcctatgtgttatacctcagagcttacacagagaaggaatgtgaagacagctaacacatccagaaattgagatggcaaactgagtggggaacaatcctgccgtgtagggaagaggctgagaaacaaggcagacacccccaggccccccacctgactcagtaccagcaccttggccagtctgagggaacgcgcccactcttcagctaaggttggtcttaagccccggcacaagaagcatcctcgtggcctggacagaacaccagtcccatgtggcccctgccaagctcctacttgtggaaaagatgtccacagggcagtttcctcgcagcctgcatggagtcccagcagatggcgcagtcatcgttattgacagccagctcctctggagttgccactgcaaacctgtaaggaaaaaaacggaaaccatcgcagagggcacctggcagaatctctgtcaatcccacaaatactgagcatcacttgcgtcacagatttcacctttctagcagcacacttacagaggaatcatgttcaccatgaaatctccacccacggaaaccatgacaaccatgctctctccagagatcatcaaacagcagaaaaccaatacacagaaaccgactgtgtcgtaacacgacggccctcgttagtgatgacatgagcgcacatttctgggtagattagaggagttaagacacctcagagagccaaactgctcccctggacacaaaaaggatgcctgttaacctcacaccattcaggcttggtttagcctcaggatgccaagtgaacaacctcagtgaggttaagagtatgagagacagaatgtgtgtttgtgtgtgtctgtgtgtgtatgtaagcatgcatgtgtaaggaataaaaagagcagaagcccaaggagacttccatttaataataatgatgataaaaataacaatgtaataaaagaacctaatatttacccagtactggtctcaatatattatgttcattatcccactgaatccacccaaca

SEQ ID NO: 51648 - DNA, 1329 bp, Bovine  19866880816227
tatacagaactaaagatcttcatagtctgctaaatttccaaatggaaatctgtcctgtataagtaaagagaaaaaaaagtcctaaaaagagaggaaaatagctgtaagaaaatgagtcagggaactgatgtatcacatataaaactaatgatgcaataataattgatttgttaaaaacttgttctgcttaccacactgtatctatagtaaaatattcattatgtccttcctttttctgtccttggaaatgtagagttatgctcaaaccactgttagcttatcttgtaaataaccagaagaaactaaatggctttggttaagtataaaacaaatcactggtgttataatcccatatcacctaaattgttattttcgaggtttatcttttaattttataccttcagaattaaggtactgctgattaaatgcagctatatataacagctaagaggaaaagtggttgaatgctattaataattgtgtgtttgtagtactggcaagttgttggtagggaattggttccagaaatcctatggcagtttgttgaaaagagggtcagacttacctagaatgattagtatgctaatagcagttcttcaggattagtactggcaaaatattaatactgaggggagaatgcagtaagcttttcctagcttgaattagttgagagaaggggcattctgaatgggcgaacagtatcttcagtcagttcagccgctcagtcgtgtccgacgctttgccaccccatagactgcagcacaccatgcttccctgtccatcaccagctcccaaagcctgctcaaactcatgttcatcgagtcggtgatgccatctaaccatctcatcctctgttgtccccttctcctcctgccttcaatctttctcagcatcagggtcttttccaatgagtcagttcttcacatcaggtggccaaagtattggagtttcagcttcaacatcagtccttccagtgaatattcagaactgatttcctttaggattgactggtttgatctccttgcagcccaagggactctcaagagtcttctccaactccacagttcaaaagtgtcagttcttggacactcagctttctttatagtccaactctcacatccatacatgactactggaaaaaccatagccttgactagacggacgtttgtcggcaaagtactgtgtctgctttttaatatgctgtctaggttggtcatagcttttcttccaaggagcaagcatcttttaatttcatggattcagtcaccatctgcagtgattttggagcccaaaaaaataaagtcactcactgtttccatgtttctccat

SEQ ID NO: 51649 - DNA, 924 bp, Bovine  19866880832453
gaccttgtaaggactgacatgcagctatttgagtttaagatcctagagctctggacgattataaatgtgttcactctctcttaagggataacccactgagatttagtgttcttgttatatgtggtctcaattatataggtggttatgtcagacctggaatagtaattgatctgaaaacccactcaggacgggggctgcttacgggaagatgagagcctggccactggccaggccgaggcccatcttctttgctgggcttgagcctgagggctgcagacaagacgttaacctcagccccctccatgtcagagcaccgcgaagaaccaggctgcttgcccagccccacagcgttgtcacatgcagtgtcgtttctgtgcagaacatctccgacatgtgggccatggtgaaacaaatgacagatgtgttgttggtgccagcgactgacaccctgaagagccgcaacagcgtggaagtgcgcatggagtttgtcaggcaggccttggggtacctggaacagaggtgaggcagcggcagcacagaggccgcctttaaaatcccctgaaggcagccgttcccgtttgaagtggtcctctagctaagtgctctggagctggtgtgatttaaacaaggttgagcaagtctgagagatgttgtgctgtttttaggagcacttctctatgggaactgtctctgcacagatgtaaaaccacgtgagtgggagccctgagccctgttaggcttttctctgtctttctccaccctgcgtccctcagtacagacacagggttattagggcacaatgccttgggtcaggatcctgggccctcgcggggttcagccattactcctcaggctcttggttttctctcaacattttatttttcccacccagcattttaccacctccaaaccttaggaaagccc

SEQ ID NO: 51650 - DNA, 1266 bp, Bovine  19866880848370
cggtgggggttcctgtctactgtggggccctgatgatgacacacacactggcgattaacctgccccaggttgtggtctggctccagaggctgcttcagccttcccttacagcctggggagggcgggtagccggcaggttcacacagggagacaggcagtgctcagaacagtgcacccttccctccacacccaaagggtgagggcggactcgcccccagtaatggaggaggttggcgggggttgggggcagcatccactgctcctggaatcgggctgggtttgaggacccaccgtcaccctgggagctgagcctctgccctggggctggcagggagagggttcccgactgagccccacgagacacatcctctgctgcctcctgaggagcctctagaagcttgccagtccccagggtgacaaaggctgggctctggcctcccatcagtgctgctccagcctttaagcagcagctcagagctgggccaccctacacagccagcctccatcagctgccagagacagccttatcacaggggtgtgtgacacactcccctggagccagctgggaaggaaaagcccccgagaaggcgtggaagagaggcagacaggaggggtgggaggaggcctgcagagtgggtggtttgattggggaaaagcccaggatggagggagagcaggagagggtaggtgggatgctggtggaggtggggagcagggctgaggcggcccaggccccgctcctcaggcacgcgtgcaccctctctagtgcaggcaaatgggctgtgtggcccagcagaggcctagggcaggagttaaggaggggtgctggggagatgggaggccaggacgaaagcagaaggggaatcggggtcggtccggcctcccgatcctgccatgtccctccgagtcatctggtctcaacatgcgtgcatcatgaaggttcatttcccaccacgcccagggcagcaccctcgcctcttctagccccaccccacctgccagatgcccgggagacgcgggtccctggcaggcccacgcggcacccacctgtgtactcgggaaagcagatggtcagaggtgacttcttgatcttctccccaaagagatctttcttgttgaggaagagaatgatggaggtatcgatgaagaacttgttgttacagatggagtcgaagagcatgagagactcgtgcatgcggttctgcagccccaggcggggagggggagagagtcagacagacagcgagagggacagacagagagaca

SEQ ID NO: 51651 - DNA, 3058 bp, Bovine  19866880898255
attgaggatacataatttttaaatgatgtatatcgcagatgaatgtttatctctgcttaggtttaaagaacagtatagataatctcaagaacagagaaaattagattttttttccttcttatctaactacctaaggatttaaattacaaagccaaccaagaaccactgaccttaaccaagcagtttgtaaggataaataataagatagagaagttctccaccccatatatatgtgttggtaaaattaaactttcctttcaggtaactctgaactttagaatcaaagttttaactgttgctggagaccatggatggaggatgcactgctttggagtttctcaaccactgtttcttctttcactgtggtcttgatgacttcagacacgccacttgttccaaggatgcaaggcaaacttaaaaacacttcactatttatatcataatatccctgaaaggaaaaaaaataggattagagctgaatcactgcaaaaaagttaatatcataaatacggatattttcgtccttttatggtcctagcactacaaagtgatacaagctgaatttttaaaaaactttgctcatttattttctaaatgaactccagttactgtttccgaaaatttttgtgagatgggaagaacttggtcaaagatactccctttatggggaggtaagctagcaccctgcaatatgggtaataggatagaggtaaagaaaaaagactgtcattggtttgatacctggagcagagaggggaaaagcccagggatgtagtgaaaggacgtgacctgttgcatcccaggggctaactttctgagctccgtatccaaagctggctttattccataaccgctggtgctcctgcgtctcacaggtataccctgtttgtctgtcctctcctctctgtatctcattgtccccattccctgtcctggacatggggaaggtcagcactgaaagcgttaagcatcaggctttggttcatggttttaattccttggtaaagtaaattaggcaatgccaaaggttgtggatttgatctttggaggaaatgtgagagtaaattttgaagggttttattgaagaaataaaagatattttttatatctctcttccctggagaccctcattttcataacttggttcctgttggtttagttaaacatggaaagttaagatattgtgtccacctgccttggagctgacccaggtctgaactttttcaaatccttgatgcatttaacttgaaggatatgaaacatgcaagcataggttacatagttcagatttatgttctcctggattaagtttttctttaatgtctgaaagcatagttttatagtagtctttttggggaagaaacccagtattatctaacattattggcaaagttaaatgtattttatataacaaagttcttaaaatgttgagaagtaactgaaaaaagagtgatgagtaaatgtttaggctgagataatttatttcaataaatctttcaaaagccttttttaaaatgctgttaataaatttctgtgattttgtttctttttaaattcatttttctgagagcatagctatttgttttctattgtaaaacaacaacaataataataataataaagcaaactctcaaaaaagaaagaaagaaagaaaaaagattgttagagtggattcccagtggaggggttaacgtgggctctgagggcagtcaaatttggtgacctgttttcagttttcccttccatgttttatttcccttccagtattcctaagtttttgtgaatatttgattaagcatttgggcctcatcttagctgtgctttaggaactttatacttggaataaagcagtaaaggacaacctgaactggagaaacagactgatgaccagctaagaccagttggcatgtcagcctggggtgacctggctggctggggagataaatgacaaccagaagtttatggaatatataaacgtttcttgggaattccaagaattaatgggggtgaagggcaaccttatagaagtccagacttcccatagccaagcaagataggggttagaccaaactatcttctcccatgtgttactctgaaagctggtggtactcacgactccaggttacagtgtgaatagcacttttttgttatattaataatataaatatttaaaactgtgatgagagaatgagaatagcaattacctttgctaaaattgatacagaatggaccttctttttatcattcacaatactgtcaagcaggtcagctactgatagtccaacagaccatgatctttgaccttttacccttaatagttccatggccctaggttataaaaataaaacagacaaatcatgatttcataaaatgcacaaaatatgtataaacagttttagcttatgtataaggtattaattagatatttttatgacacaagagttatatgacaattgttaggaaaaccaacagacagcccagtaattaagcttttcttaaaatattaggcagtccacagtgagtcaatacagatggcctaataatataaaaagatgcttaccacccactaacacttactaaatatgagctaaaataataaatacattaatttttcccatcaaaattggcaaagaataaaaagactaatgggcttccctggtggctcagctggtcaatctgcctgtaatgcgggagacctggtttcaatacccctggggttgggaagatcccttggaggagggaaaggctacccacctccaagtattctggcttggagaattccatggactgtatagtccatggggtcacaaagagtcagacttgactgagcgactttcacaaaaagactgataactacttttagagaagctacagacaaattggcattcccataattgctgttcaaagtgcaaaattatccaagtttttaagaggaagatttggcaacacctgatctagaaacaccagtccattctaaaggagatcattctaaaggagatcagccctgggtgttcttgggaagaatgatgcgaaagctaaactccagtcttggccacct

SEQ ID NO: 51652 - DNA, 1656 bp, Bovine  19866880939710
cagtagaagggagaacagagctcatcaggattctgtaatagtttgatttctgcgtgaaaccctacatgttgttaatgtactttaaagcattacagttgtatgcttgaacatgataatttcactgagtgattatcataattctaattgaaccacagaatttcagtggcttcctttttctgttctgtaattttctttattaatggtaacaggtttaaaaaaaaaaaaaaggcgtactaatgccacctcttaaaaaaaagtctcctcatccttcttgtgtttcaaacacaggcctaaggaaattagagctactttttccctcctttttattttttattttttcctactcagatctttaaaaccagttaactgcatgagggagaaaatcagagactttggaatatggctatctgaggttggaggaagtgttgctactatttttggaaattttcttctctctttcttggtcctgtacctgtactttgctaagaagttacttaatggactaactgggagaatctatagagagatggaaataaaaacaatgaactcgaaacttttctattaaagattctcattacagtgaattctaaggaactatctgaaggcatacttcattggaaatttgtatggaatagtgtttaaaaatttgagccctcaccagaaatttggagatctttcaaatgcataaagacctgaatgcactttggtcattgtggtagtaagatccatctgtttttacactttgggttgtctgcatttttcacacagagtgtatgtgtatctgatgtacaagttaggtgccattgtatttcagaatgttgcagtatacagaggattttgaaaagatcatatcgatcccctttggtaggaagaatcctacatcgtctctgcatttgtgaaataagcacacccatttacgactgttgtattaataagtactgagtccactagttgtctaccattttctcttttagtttttatgctgagggctgtataaagccaaaacacagaattaaacagtggactaccaaataggcatttaggaatggattacttcatctactgacacagcagttggaaaagtacttcctttgtcaggggtcgtcttttcagtgttttagcgacctccccatacttacatgggcttggggtctgaggcagatcacttaacatttctcagtagtctctactctgaggtcctttgcattcaagataccgtgcagctcatctggtctccttgggatactcacagattgaggctgaactggctcacagtttactctagcaacaaggtgtatcctcttagtttatttctttggccacagtggcatggaaaaatgtggctctaatgacatggggttttttaagtaatgaagggggttttctcagtctcctgtagtgaactttagatggtctccctcaggaataggttttaaccatcactgaaatggtttgactgtaaccacactggggtctctgagttctttttttctcttgccccttccatccccaggcagagactcctcttgctgcatatccactatgctccaatgctgtatttatttgatcagaaacaaaagagtttgcttcttgcactggttcagagagaggtcccccaggattgtcttttgttcagtaattggagcataagctgag

SEQ ID NO: 51653 - DNA, 1554 bp, Bovine  19866881001105
agcctggtgggctgccgtctatggggtcacacagagtcgaacacgactgaagtgacttagcttagcagtccccactgggagatgatcttctctcaaggggtatcagtacttcaaccaggcttcttagagacctaacagtctttaaaacccagagggctgcatctctaattggagcacttcaggtccggggcagacagttttgaatggggcctcattcccagttcgggataatgagtttcttgtaggaacagtcctgggatggctccagcttccaaacactgaatcctctcaagtttgttcctagggagggaacctggaccctagaaccaactcaagactctgacctggactcccggtcagcccccatcgcaggctccgttcaggtgcccagaagtattgaaaacaccaggtgctttggctagagatgaagatctgctttctagtccccacctgcccttgaccctggctgttaggaccctgcaggttctggggagacgttatcagctgggtagaagcagctcgggggctccagggctttggcccccgatccttggcctcagcatctgtgtgttccctgggcaggggctggaagcagacagcccagctacactgctgaagctactccacagtgaccagtgagacaaccccttctctgtccctgttgggcgactttgaacgcagcctcgttgagggcccctagaacccaactctgcatgagaaatgagtgcttcaaccttcaatgctaaaggactttgtttagctgagctcaattccagagcctgtcaccctggcaacgggtctttgggggatttacatctcatgcatcacaacaggggaaaagccatttagcaagttggaggggtggttaaaaaaaaaaaaaaaaacaccccaccacacaaaactagtgggcccctctctccccaagagtgcagccacaaaacaaaacagaatcaacaagaaaatttcccacaagcccatgtggcctctgctggcaatcagcccaacaggaactcaaacttaatcaaaccttcatgtctcccttgtgaagctcaggaaattggtaattggttttataattgaattttctgatcacgtatcaaaggaatgggtcctgccaaaggccaaggaatggcttgtctccaggaaggacggccaaggtctccgatggaggctctgctgggaggtagaggaggagaagtaactcgcggtagcctaagaatagagcctgttatttataaccagagaagaagctggtgaccgctgagccccaccctcacaaagtggtctcccccaaacatgcaccctggggcctcagggttcagattcagaaaaggagcctttggcgaagcagggtgggagatgggggaggcagaaggcagggagaccgtctaggtaaggagcttttcccagagctatgcagactgcgaaggaagcctgcctggggcagaggctgggcagagaggggaaggggctggtgcaagaacccttctggaaaggggaagtggggcacaggaagaaacagagaggtccgaggtgtccagccctgggtaatgg

SEQ ID NO: 51654 - DNA, 1080 bp, Bovine  19866881080753
tgttaatttgttttcctggttactaacacagtcattttatcactgaaaactttggccatggaatcagacagacatggatctgtatctcagctccattttcccctagataactttgaagaaattacttactttctgtttcctcctctacaaaaggggacaataatgccaacaaagatggcatgatgtaacatttaaagcacttactcctttgcctggcacatactaggcacccaacaagtatgagtactcctttaccttaaagcacagatgtggggctctcttctcttcttcagatcatcagacttgaccatgaaaaaacaaaaaaaggatttccttcataaatcagacacacagagcagagcagtttaggacgggagcatgctggcagtccagcactgtcattaacagcctggactctgaagccgaagtgcctggggttgacacgtggccccctccatttggcagctctgtgacttgggcacgctgcttagcctctctgtgccttattcactccacaaatacttacaaaggcattacagcagagcttatatattcttgtgggggaaagacaataaacattaaaagttgattattagaataaaaaaggtgagaaatgtcaagggaaaataaagcagagtacgagggaccaggagtgctaagagcagggaagggcttgcaatataaatttggtggccaggttagaccatgcacgtgcagcagaggcctgaaggaagctgggaagtgtacccagggaagatctcagcaaagcagattcagtgtcctgagtggggagaatgcctggcctgttaaagaaatcagaggatgtggcttagtgagttggagggaagcagcagatagtggggccaaagatgtaatgggagacacacaaccactctggtttttgctcagacaaatgagaaccatagcagattttgagcaaaactttttagaactgagatgaaattcacttaacataaaatttactattttaacatctccaagaatgtaattcaggggacttacagtgttttcacatgtgcaactatcatgcacgcacgctcagttgtatctggctctttg

SEQ ID NO: 51655 - DNA, 1014 bp, Bovine  19866881089936
aatcttggtttctgatgaaagattttccagaaaatgccacagggatcagggccattaagtaatgcctttactttaagccaagcctccaacttcaatttcagctcttgatcagttttaccaatgtgaaagcaccagcgctaacccccttcaactttctacttaatttaagccaaatgcatccctgtgggagtctcctgctatcctaaattgagaaaaatcataaagcataccctctttggggttcttgaaccatcaaaatacactcaataaataacattctcaacagttaccgcataatggacttcaataacttaagagctcaactcaattacctacaagttttcaagcaagtcctttcatttaaaagtacaaaaatcctttatttcttcccatgtcatcttttattctaacaatgacaaactatttttttcataaagtccacaaaacaacaaatgagagaagaaatttagtgaaaaatattctgatgagaacttcagagacatttggcatatgctcttctcacaagttcctaaataccaatacatttcccatgtttgtttaaaatcagtatcatttttcagaaacttacttgaaaataagtcatcacctgtttgaaatcacccaatcttaaacattttctagaattaagtcataaaatttccattagaaaaatcaaaaagtctcagaactgggaaaaactctgatatatgatcagctttagcccttgcacaggtgaatttggttaataatcattaaaactgatgatctgtggttgaccttttgggatatataggaagtgataactccctcccctcataggagtttaaagtccagtaatgtgtttcctaagtgcatcacttgatggagaaggtatgatcttaaaaatgaacatttccaggctccacctgagactcactgaatcagaaattctagacattgactcagcaatctgcattttagaaagcatcccacatggaactctgctcaatgttatgtgccagccggatgggaggg

SEQ ID NO: 51656 - DNA, 2891 bp, Bovine  19866881122045
tgagcctctaagatgagacagaaacaaagattttctcaatgtcttatcttttttaaagaaacagtaatattttcacaggagaaagcaaatcagtaaagaacacacacacacacacacacacacacacacacacacacacacacacacacctagagccatctacaattaggtttcctatcagtctactcgggcttccctggtggctcagaggctaaagcgtctgcatcagtctactcaaagtcactcttgaaatctctggcaaacctcactcctatttgctagtgacactgcaggttgccaaagcaaatgcactcaggaaaaaaaaaaaaaaagaaggaaaacagaaaagaagggagggagaaaggaagggaaaaacaagcagcaacaacaacccccctccgaaaaaaagaaaaaaaaaaaaaccccttgaaaactaaaacaaaaccctctgagggggagactaaagcaacttatagggacatactgaatcataaccattcttagcctatgattctttaattggcaaaccaggtttcccataagcttgagcccacttttcaaaaagccatttcatttacaatcagattggcatccagttaggcagcaccgagggaatgagtattagtaatgcctgctttatttctggcaacaaagataatttatatactgataatatccatatatatgagctctgggaaactctacgaaaaatcgtatactctttttacaaatgtggtgtttgcatatggatcagtatttattaaaacatgaaaaagacagcagacagccacaaaaatgattaggaagagggttggcacatcctgcaaatttgatttggtccatctatcagtgtattcctaacatgtactctgaagacagaagaaatgataatcaaaaactttaaaaatagactttcacttggttttcttctgagagtcaggaagaaaagaccattccagttagcctggattgaaaaaaaaatacctagagaaaaatcattttctcttgctacattagggaccttaaacatgaaagctatgctttttgaacagagagaaggatgttggacagaaagatgggggagaggggaggggaaggggctacccagaaatgctgtacgtgttgaaccacatttcttctaaacctcttcctgtttagcgatcaaccacctcctcaaccttgcacctgtcggagtaagggaaaacagagagctatgcggcaggtggaccagggtgggctgaaataaagaggtggcgagctggcataccatacagctttccaaatttgcaacaggaagtgaagcaagtgaagcgctgactaagctgtggcactgacccaacacactagggcatcacatgcatattttttaaggctaagtcctccggctggtgaaggatggcaaagcagtaaagacaactgaagagaacacaatctgtctcagagacactgttgatgaggacggcaggggcagacttccagcatcatgtaagggtcagagccataacagtgggaatcaaccatcccatgttaatcaagctgcccacctgtgtgccaagaactgcttcaggaacacaggaagtactctgaaaattggcagctttctgggctccagtcctcagaatatgtatgagaagtacgccaggctactcatttagaaacagccccacaacctgaacaaacagcactgtcattccattcatcattagtgtgataaggagcttcaaataaaaataaatggcccaacattaaaattctcttctcttgaccatgccacccccagcttatcttaattacattagagataatggaacatccaatttgtgggctaatcagggatgatcagctgcccatctgccctcttccagcctattccctttagactcacatctgaccactggattaggtgcaaagaagaatgtcaactaagagagctaatcagagagaatcaacagagctaagaactaagaggaaggaggacagggagggtctgaagtgaggtgagagacaagaaggaaagaaactcaagggaagagaagagggataaggaagggtatggaagggtatgcagaggtctacaaattaaaagggaagacaaaccacagaaaatgacaaagcagggagaaactgttacaaaccagatctgaatctttcaagttatgtggggaaatagatctcttcaaacacggttaagaaaggcaggcacagaaagaactgggcaactgaattaagaacaggtggggagcactcgagccccattttcataaagggaagagggcaatatgctttgacttcacacccgcttattattgagctgttgctggcttttagaaactctacatatgttctgataatgttgttctgtttttgctgggatgcaccaaatgggaaaagataggacacatttgtggttttgtagcttgttttcttggcattttagcaggacattggcaagttattcaaacgtgaaattaccaccaaaatgccaggaagcggctcacctttgtttgaaaatgattcttgctcagtggcagccttcctgtatccagacaggtgaaaggtcccccctcagggccagctcccaacaccggaacacctccctcacaaacacatatgcacacattttgcactgtggtatgtcacttaaatgttttggctggcggcacatttagtctcagtatggcacaacgttcagagactgccaatttcagaaacacattccgcagggtaaaaggattaataaggctcggtggcattcaacaatcctaatttaatttcattggtcctgtacagcaggagaaatcaatgttggtgaataactcattccaagtgtgaacaaaaaggaaaaaaaccttaaaaaaattttttttcaattctggatcaagtgaatctct

SEQ ID NO: 51657 - DNA, 926 bp, Bovine  19866881123646
tcctaaaaccagcattcttaatgtcttttgggtctcaggttgctttgagaaactgatggaagctgtgaagagtatcctcaggaaaaacagaatctcttcagtctcctgcattgttttgagttggtaaaaacagtatttgtctatcggggttaatagtctcccaaaggcaggctgtgggtctgccacacctgggcttgattgcagattaagaaactggaccagataaatgggattatagccttgttctttgagaacagctattggttctcccaaggcagcttgtcacagtgaacagaggctgggggcacggctgtgactttgtagtcatggttctcgttttggcaaagttgtacacgtgccagtgtcccatggtctttaatttttcctctcctcagggtgcgggaggaaactgaggcagagagaaggataaccggcatgagagccaacaatggtgctcagagagaatgcagccattggacccgagccttcagggggtgcgggaggctggggggtgggggaggagggccaggtggggtgtggggaaaaacttaggaaaaaagcacagaagttttgcaatgggatttaacagcgttttaaagagagctcaactttgagatgaacaggaggctgagaaagcctttataaggtcttcctaaatgatgctgacagctaagagtggcatgcccctgagagtctatgattatctcgaaggaacgatctttatgggagccttattaagcacagagcgtgtcagtgggaggagcagcacagtgttcacagctctagagggcaagtgaggcagcctcctcgatttgcagtgagctttgcagccctttcccattatttccttagcagactgtggggctggtagaagacccccttgctccctagaaaccaaagaacactagggttgttagcgcaggaca

SEQ ID NO: 51658 - DNA, 2238 bp, Bovine  19866881164456
tgactcccctccaaggccacaccccctctccagtatggaggaccttaggggtcccatgagtctccaggtctccctccctttaattagtctacttcccagagcacttaatcaccatcacgaaaccctccacagctccagactatggtgtgaccaaggccacgtcacccacccacatactagaactccttccatctgttacccaactctggctcatcagccgcctcgccaacccatctccctgcagaggaactggataaagaccttggctgagacagcgagatggagaccagagggagggtgtggaacagagagctagcaggtgggtcagaagctgggggcagtgggggcagggagcaggggagtccagtggagcaagtgacatgagtccacatgagatttgtagcaaatgcaaggatctggcctccaaagatgggggcacatcacttcgacagtctgtgactccttggctctgagtggtggtggtctccatgtcatgttctccccccagggtttctgtaagaacccagggtctgggggcatgtgctctctgaactgtgaaatgcttcagccatggagtgcattcatgtgagcatgtgtgcagaccaatgctagtagtctgagctacagtaagtctgctgagtaatgctatcttttgaggtgactcggggaggacagaagcagggaggacatgcagaagcccccaagggcagctgcctccgcacacacctgaggccgcagtgtcctgagagccggggagcagttatcttgggtctggggaagggccagtcagacaacttcctccaactcagagatccacccacctgccttctaagttaaaagggactgggcctgccgctcccaggattctgggaggagggagcaggccttctccacctgctaggccttaaaggctggcagaaagaagtcccctggagggagtagacccctcccacgagggcgctagggactgttacttgagaaccaagcctgtttgtttctatggtaccagggagagactggagtagtggggagacctgcggccagcccaggccagagctctgcctggtgggcgcccccaggctggcccaggctggacaaaagctcactctccaaggacaaggccagtgcctcaattagctgtcctcccaggagcggctccactgatcccctaaaaggcacagcaggtcctccagggttgtaggcggggcccggcccagcctgcaagcctttgccagagtctcagtcagagtgtgccccaggccccccgctgctcttttcaccctcttccccctaccagcggtaggcggtacctttgaagttgggtcctctgttccaactggaaatggctcagaaccaaaattagaggccgcacaatcagcttgcaatttaaaatgccaccgaggcgtcccctgtcccccctacccccttttaaaatgtcatcttaattagatgaagcctggcttcatgttttctgaatttcaaggtaatttctctaggatgtttccctccttttggttatttttatctttggcataaagcgagtctgtgagtctcaccaaagctaatctgtgagtctgcagacacctgcacatgcccaattctctggcagctggggttcagctgcccccctggctctggaagctgagaactcactgacctgaggggtctgaggaaggcaggtcctgaggtctgttgttaattcagttccctccagttaattcagcaccaggccgtctgggcctctcacctaggcaatggggctatgctaggggttgggagaaaacacgaaggtgcctgcgtgggcttagctagccctagccaccttccttaatccagtctgtcacctacttccctgcctagactctgccctgcctggcaatgtccccccaagtgtaggctactggggacctgcagtaataaccactgaatcactcccattccaactctcaaagattctgattaaccgaggataagaacgtctgtttggtgccattaagtctttgatgcccctaaacatttgctaattagctctttcaacaaagagactgtgggcggcctaggactatctcctctgccttgggggcatctgactatgctgttccccaaccaaacccagtcctcaaagacgggtcaggttatgagcttcttggtgtccttccaaattcacatgttaaagccctaaacactcagtacctcaggtctttaaagagactaaaacctggcttaaaactctgcatt

SEQ ID NO: 51659 - DNA, 895 bp, Bovine  19866881169734
aatttattacactggtataatacttaagcctgtaatgaagggtcactgaacagtcattccagtgagtactaggaggagaatcagagctggaagcctcttgctttgtccatgagatatgaatgttcagtcttccagaatgttggaaagagttgtattcatgataaaacgacacttaaaattctaagatcatgggcaccgtatcaggaactggtttatcattccttaattcacattacattggcccattgctgattttcatcagtttcaataccactaaatgctgagttcatatttcctactctaaagtaggtatccctagactatttgtttaggaagattgctcttcccatctctgatttgagtttccaagggtggggcacagcaggagtggcaacacgttgaaatccctgataggaaggaccagaggagcggagtccatctctgagaagaggggatggtgaccgccggctggctgagcaggtgtagaggggctgctttgtggctgctaattaaggcctcttccttgtcagacttctgaaatagacaagcggatcttggacatgggttctggctatgtaagctattttttgtgaattattactgaaaacctagtctaaattgataaaggcaactttatttctccttagtaagtacatgaaataggtatccagctttttcttgggcacaaactgtccaggcaagacttttgagtggcccttgagcttgttctacactgctggcctcagtgctcctttctgaaggagaggggaatcctacttaaatgtgtggcttgatatgggactgttttcgtgccgacacccatgatcttatagcttaggttccccttccttagggccatggcagcagcagcagacttcttagtccaacagcctgt

SEQ ID NO: 51660 - DNA, 884 bp, Bovine  19866881192903
tggattttccaggcaagagtactggagtggggtgcccattgccttctcccagagtaagtagcataagatgattcaaatggttaatgggctatagtcttatggcatggcagatcttatctgtcctgggaatggcccagctgtatttctgactatagttattccttcctcaatgctgcctggtgattatcagcaggttttgctctgactcttgttttctttctgctctttattattattattattattttatttatctatttttggctgcactgggtcttcattgcttttgcatggctttctctagttgtggcggtctggggctgctcttcgctgcattgcatgggattctctgcagtggctcctcttgttgcagagcacaggctctccacacaccagctttagtagccgttgcaggctcagtggttgcggtctgtgggctctagagtgtgggctcggtagttatgacgtgagggtttagttgttctcagtatgtggaatcttcgtggaccagagatcgatcccatgaccccggcattggcaggtgaattcttatccgctgtgccactagggaagtccctgactctaatttctaagtttctatgattgaccagccccagacctactgacaccttccttcttcagttgtgtcacacatacagtcaggttcctgtcctgtaccacacacctcaggggcatttatctctctcagacaattcagcctaactctgccctacacaactgtgggctgacctcacagtttaactctctgaggacagtcttatttcccaagtctcaactgactgatgtatttcctgtgaggtgcagcctattgattagttattgatagccatgtgtgttccttttaaaaatagcttgggtcaggg

SEQ ID NO: 51661 - DNA, 1938 bp, Bovine  19866881223877
ccggggctgcaggggagggggacatgcaccttttgggctcactgagtccagagcccagccttaaaacgcagcagcatctacagattccacacaggaaaatctaccagtcacggtggcagtgatggcccagtgtcccttgtgacatgaacagcatccctctgtgctcagctcacaagccttaaactggctccctgtcctctcccagaagagggatgcagattcccttgggcctcgctggcggcatgcaggaattagacagaggagagggattgggccatcagggtccccagatcctccatgaagtcatccccttgctgtcgtcagtgtcagttgcctagcaactgcctttggcagatggtggcactgagagcatgccaatctctccacagctaaaaatacattccgacgacaacgggtctattttaaaagatacaatgcgctcccaacatcttcccttgtctgcaaagaactgtgccatgccgggtctctccgcgcttctgatttggtctgacggtgtggaagacagtattctaggaaaggaactcaagaccaggcaccacaggggtgcttagcaaattgccctggaggaggatgagggagaggaagaagaggagcagtaggaaatagtggactgggaggaagacacaggagttgggagcaaaccctgtcgtttggtcataatccttccctactcagaagggtggggttaggaagaaaagtcatagaatcacagaagcctagtgctggaagggacccaatcccacttcccagttgggaaggcagaagccctgagagattgagatgagaagagttggctctttgcccttgttcacagtgcaagggctgggattcccaggggtgagtgtgagaccttggaccctcaaactcctcttacattgtatcggcatcatatcactgcccccctgccccaccagcttagtctttccgtttaatcaccataatttgcagctttttaaaaaaaatagagaatagtaagcctatttgtgcattgattaattcaacaaatacttcttaagcacccactgccatactgtgccaagctctgcagatacagcaggggacccatacacgtggtctccaccacctgttgctggtggtccagcaagtgatgttggcatcaagcaggtgaccacagggtgcactgtgcttcagacatcaaggcagatttgggtcgggcccacttaccagttctgcaaccaaaggacatcatttagttagggttgcaaggcaaaatataggggacccagtaaaatatgaatttcaggtgaaagacaattatttttttaagattaatgtgttcccagtattgtatcctctgaggttcaaatttaactgggcctcctacaattttctggagaaggaaatggcaacccactccagtattcttgcctgggaaatctcatgaacagaggagcctggtgggctacagtccatggggtcacaaagagttggatacaactgaagtgatttggcacagctcacataggggttatttttcagattaaataagaaaacatatatacttctatggctggctgataaatgttacttcctctcctctccaagcagtgcttccctggggtttagccctggtcaacatctgagcccagctctcctcccctcaggatctagcaataagcgatggttagcggtaactctgttctgtcctaaggctgagctaggatgagggaaaatctgctggtggacattgacttgccagaagaactaggaaccaacccagctttacttggaatgctggtcggggccagcagttctacactacctggggtgcttgttaaaaatatagataccaggggcttccgtggtggctcagtggtaaagaatctgcctgccaatgcaggagacacgggaagatcccacatgccatggagcaactaagcccatgcaccccaacta

SEQ ID NO: 51662 - DNA, 1489 bp, Bovine  19866881238251
cacaccttttcctctctgttttttcggccccaacctggtcctggccccatcactgtgcctggattgctgcaatcacctctgaacaacactgcagcaggtatccttccccttgcccagccaacttccacaagtgtttccacaccttccctcctttcctgttgacacttacctgctccaaaactttcaacagcatgtactgccgacactctgctgcttggtagtcacccctttcacatctgttcctcctacactgacagagtttattttttagcacatagcttctattctcacctccctgactttgttcaggttattactttgatatcctctttcacttccacgagctaagcccatttaatcttgcaaggcctactgagatcgtgactgttccaggggatcttccccaatcaccctagaattcattcatcattaccccttttctctcctctgagctccctatggcatttagagtctcatgtgattcctatttagttttgccagtcattttacacagtcttggacagtttgaccctataataggaatgttagtcttggctctccaggtagagaacaatgagcttccagagggaagcatccagaatttaggtttattctaattgtcatcagtgcctaccatgcggcactccttaatgggcactcaacaaaaccacttcattgatttttattagtgttcactaggccccacccagggagatggaggtatctacttaaaggggagctaaatattactttacttattgttcgttcttttaaatctcttcagctccctgagataattgcagccttaggtactaagacagatgctgagatggttcttggccaatgtgcagaggcaccaaactcatctttgtgactaagcaatattatcaacagtgttcaatccccaaagtcggcttccttctcagttgcatccagagccaaggaggttccgggaaaatgagatggtcctggcccaaagtcagtggtgtggcattcacagctgatctgtcctgacaaatcagctgagaatgaaaaagcaatctgctaattttatcaatgacatttcaccttgagtattgagtgcagactactagatttaggcagtcattaaagaatcagaggatctctgctcatcttatttagcaggaaaataaggttcattatctgttgttcaaatgcaaacttgtctgcctagggctcaagaaacaacaggaaaaagaaagctctcctttctattgccccacagcagggttctgcctccataagcttaccagggggacaaagttaggactgggccagaaactcaaggcaggtaggtgaaggtaatttcagaagctaggcttccactttaagtacgttttaaggaagcagtttctcagtaagtgtggttattaatgggaaggggctgaagtgggaggaggcagcatctctcctcaaatatacctccgggaaaattcactgcaatcccaagttccagaaattcagaatg

SEQ ID NO: 51663 - DNA, 1267 bp, Bovine  19866881271692
cccattagcatggctacagtcaaaaaaaccagaaaaatgatattggagaggatgtagagaaattggaactattgtgcactgttggtgggaatgaaaaagtgtagcctcattgaaaacatatgcagtcgctcaaaaaattaaacataggatgaccatgtgatccagcaatttcatttctggacatgtatcccaaagaattgaaagcaggaacttgaagagatatttgtacacccagtttcacaaaagcatgattcatattaaccaaaagttggcagcaactcacgtgtgcatggatagaggcatggataaacaaaatgtggtgtataagtacagtggagtattattcagccttaacacggaaggaggctgcatacactacaacatagatgaacctgaggcattatgctaagtgaaataagccagacacaaaaagacaaatactgtatgattgcacttctatgaggtacctagatgtgtcagaatcctagagacagaagtagaatggtggttgcctgtgtctgggaaatgatgggaatggaggtattgtttaatgggtgcagaatttcatctttgcacaatgagcattctggagatacatggtggtgatgtttgcacagccatatgaatgaacttaacgccattgaactgcacggtaaagtggttaaaatcgtaagctttatggttaagtacgttttaccacaattaaaaaactggttttcatgtgttagacttgatgaaatagggcatgtttgcacacagctctcagttctttaaggataatttgaaatagcttgcctttgctctgattatggaaagatggcagatctagcgggttttgaatttctgttgcacgttaagggaaactgtgttctttgttttctcactcgggtcctctctctcttcttctctcccccagacctttggtatggctgaggagtaccatcgagagtcaatgctggtcgagtgggaacaagtgaagcagcgaattctccacaccctgctggcatcaggagaagatgcccttgactttactcaagaaagcgaggtgagttgaatccagaaaataaaccattattaaaaatgtgaggtcagaaaatgcttatctgcttgaccgctggctggcctggaacagctggtccctgtcttcctctggaagccctttcttcatcgccttctagatgcccacatttgcctggattcctccagcatggctggctgcttctgctcaacctcttgtgctaaattgtcctcaaactcctgtcccagg

SEQ ID NO: 51664 - DNA, 3129 bp, Bovine  19866881274252
cttgggtcgttcgtatgttgccgtatacctgaacagggcagtgcgttcccactagcactatgtggtcggtcagaacacattctgtgtgtttttactggacacaactcgtcatttacaaaacagatttcttctcccagatgtactctccaaacacacagcttaaagagggaagggaagggacagcaggccggttgtgtcactcagtctctgtaactattgtccctgctgaggcctagggaggggaggtctggcaggacactgaagcaggccagtaagcacttagcaggtctagctcaaatatcctcggcaaactaggggttggcaaactcctagctatgggccaaagaaactgagaagagtttttattttttatgtctttaagtcattgtgggggaagaaatctaaagactatttcatgacatgtgaaaattttataaaattcatattcaagtggccgtgattaaagttttattagagcacctccatacttatttacctgttaactgctttaaagtggagctgagtagctgcaagggttgttgttgtttagtcactaagtcatgtccgactcttagcgatcctatgcactacagcacaccagacttcccagtctcccccgagtttgctcagactcatgtccattgagttggtgatgccgtccaaccttctcatcctctatcacccccttctccacctacccttagtctttcctagattgttatctgtacttatgaccaactggctacagatcagaggctcttgtatccgccacccccacctctaggtttaactggttcactagagcagttcacagaaatcagagaaacatttatttaacgctcaccagtttgtcatgaaggatgaatggccaagtgcagaggtacataagatggggtccagatgagtctttagcccaggagcttttgtctctgtggaacctgggtaccattcctgttcccctggaaccattgtcccagcatgtaggtgattcaccaacccagaaactcagcaaatctcattgttcaggagtttctatagagcttaatctgcagcccttgcttccccttgccagaggttggtgggtagggccgaaagttccaacctggtcttcctggtgactggccccatcctgaggccgcctagaatagcatctccaagttacctcatttgcataaattcaggtgtgcttaaaagggttcattgtgagttacagaagactcagaacttcaggacattccaggggttatagaagctttgtgccgggaacttggggacaaagaccaaatgtatgtattatactacgctactattttctgacttgattaaatatttaacatggttatattatgtggaaatgaccatatttttcataattaagacacatgttaatagcaagtagaccaaaattatttgatgcatttttgctttaccctttttttttaagtttatttcatcctatatgcaatttggagattttttttttctctttgttaagaatgtttatgtgcatagaaggggcatttttttggacactgaaggacaggtgaatgctaactaatttgaggaaatggaaatctgcccagtccttggctttagctctgaataggagctgtctctctaaagctgcaggctttaattttttcctctagttaattttctcagcatcttctaggtgtggtgaagaggtctgaactggggaacttccacttaagaagcattcaccagtgggtcattgcctttcgttttggaggggaactttttactcaagtgtgatgcacaatcagaatgtgcgtaaacgatgagtcttgctcaaattgaacacactattaagcagcaccaagtgtaagaaaattaccaacccccagaagcctcctttctctctacccctgccccgcaaagggcaaccagtcttgccttctgacagcagtgataagtttgcccttcattttaaacttcaccgggtatttgaggaagtcgttggaggacttcttcccagaggcacagagagcaggttgttgctcagagccctcgtaccctgctgtgctctctgaagggcctttcagtgtttccaggggccctcgcagtcaggcacggagtcctatgacagagaggggccccagtgccatgagctgtccttgctggtcttctcccatccagccccggttttgctgccttggctgtgccacagcccacatgtgtgggttctcagtggcttcttcccgtggagtggctccctcctccacagcttcccgccatgcagctgacatccagtctctgcgtgtgtcctgaccagatttccccaacacagagcttggacttcaccctgacaactccctcttccccatcccattttagttctctctgttggactaagcttgtgaggttattttcctgatcagttttcaatatcttggatcaaatgataccgatatttaaccccttatattttgtggctaatttgatatttatttttgcacaaaggttaaaaattgtctttaaacttgttaaattaaccatgcatttaaaaattttaatgaaacaggatgatgactgcataaaagtatagacttggaaactttaatagcattttttgataaatcagtttccattggttgagttataatgcaggacaaatccagtttttcccaaatatagtattatatacattactgtcttctttcagacagacatgaaacaagcttattttctactttgaagttgtatagcacaattctatgtattatttgcttagtttggaatttgttcacctgaaaactgggctatttcttctaaaataccactgggtttttgtctgggtatttagagggaaagcacttgtctggaccaagtgtgatctgaattcatgccatttatactgtcactgccttatgctgtgcagcctcggaaatgttaagtatcagttggtagttggaagagaatgtttttgctctggtctgtgcttgccagtggatttggcaagaatgtataggaagtcttcaagaaaaacagtctccataaatggaagaacaaagctcctactattcattcaacagatgagcacctactatgtgccaggcactgttctagggactgggtaacctcagtaacaaaacaggcaaaaatcgccgt

SEQ ID NO: 51665 - DNA, 805 bp, Bovine  19866881330716
agtcggacacaactgagcaactaacacactttgacctaccttttctctttcacagtgttgttaagatgaatagagaccatagctgtgaatatcctttggaaggaaatgcagtagagaaatgcaagaggtgataatgatggcacgcatcaaagcactgatataatcaactttgtttcttataaatatttggactccaaagtataaagcaattttgtactccagagtgtaaagcaatgggcccaatagcatgtcaagctggctggcttcaacaggatgcaactctggtacatggagaaattaggatttgcttaaagtcaccccagatgagcaaacgacaaggtctagaaggcagaatctcgtaaggtgaccaacttgtcccagttggattcacccaaaagggggacagagactcatggtccacatctggtggatgaacatcagagtctctggtggtcacagagcccatcttcccatcactgaagagcattcataaagactctgagcaagataatttcatagcctctgtgacatgtcacgaggaatgaaggggtcacagagctcaccttttttaatgacctgctttcctcagtttgtcagtctctgccctcagtggttacagtagtggatctattaatttcaggtatctccccagccacccatctgaagagtacttaatgaattaaacacctgggctctaaagcaccaaagcagcctgacttggtgtccccaagagaatgacatcatcctattgttgtctccccaacatgctgcactccggctacgactctaattcccaacaggtacc

SEQ ID NO: 51666 - DNA, 751 bp, Bovine  19866881410525
tgttgtacatgtgaaagtaatacaatattgtaaatcaactatacctcaatttttttaattaaattaaaaaattttaaagactaaaagaaaaaagaaatctccagaacttgtaattgccacctgtcccactccaaagaccaccccacctccctcccatgtgggaattccagcctcagctgtggtctccagcttggctttaaatttggaagctgacatcacagcaacctgagccatgacttctgcttgtatgtggggcatcagctcagctggcatttgcctagttctccctaaatgccaggctgtgggccaacagctggccactgggccatgactggggctggcagacacaggaccctgggcttggggcggggtgacgggtgttagacttgccgcccatcctcaggcctcgatggaaggagggcaggagagtggtgggagggacaggtgggtctctgggtacccctcccctccctgccccatagaaccagagaggcactgaagtgggtacccgctcaagtgggtgaagcaaagaaagagcccaggtgtcccctaggtgcttgatgccgggccatgactggggacagggatgtatgtgtttgatcttggggtacccggcccccaggtggcctctgacgcccctctcctcccagatccgctgcatgctcaatatctggggtgtgattctgtatctgcggctcccctggattaccgcccagcgggcattggtaagtgctgcctctggcatgcgggg

SEQ ID NO: 51667 - DNA, 753 bp, Bovine  19866881533334
tcgaaaaggatgatataaaattctaaccaggaacagaacgaaaactaaaagctctctaagtgatgcctgttcacccacccaagaagcaaggctatgtgccaaacatggtattgtcagacaggatttgctggcctacctgaaggaattcttttaggagaatttcagagctttcctcaaattcttcttgaatttgagcttggtattccatgtcaagataagtagggttgatccaatcatacaaaatttcatgctggaaaggagcagcagatgtgaagggtaagttaataattccctctgcttttgttctgccaccatgtcataccagtaaaataagactccatactcccaattcagggggcctggattcaattcctggtcagggtactagatcccacatgctgcaatgaagacccagtgcagccaaataaataaaaaagagaaaagcaaatgatatgccacagcttctaagaagagaatcccagcaacaagaatttatccttacatcttgtgggatgtgagggctccgagctatgagaggctcaaagtaggtgggaggcctggtcagtgaaggaccatgaaaccagccgctgatggacaaacgtgacttttcttcagacaagacctcagacacctgagaggacaagaccagcagcacatcaacataaagataagggggggaagattactagccacggcccactaatttcaggacccttcacactaggtgtggaaaccacctggctgggtagtcca

SEQ ID NO: 51668 - DNA, 1480 bp, Bovine  19866881599542
atcccatggacggaggagactggggctacagtccatggcgtcgcaaagagtcagtcactgagcgactgaacacacacacatcattttatatctaaaatgtgtgtcttctagagatcagctgtatgttttaaaaatcctgcctgataatctcatcctttgattggtgtatttagtctatatatttacatcacttttgggcttccctggtggcgcagaggttaaagcatctgcctggaatgcgggagacccaggttcaatccctgggtcgggaagatcccctagagaaggaaatggcaccccactccagtactcttgcctggagaatcctatggagggaggagcctggtaggctacagtccatggggtcgcaaagagtcggacacgactgagcgacttgacttcactttcactttattttctacttggtccatctgcttttccatttctattctttgcctactgtctttttcataaaaaaaaaacaaacaacagttttccattttattttctctataggtttttaactatacacttttgaattactttttagtggattgctctagtgataacaatatgcatctttaagtgagcagtctatttggagttaatgtgcattactttacataaataataacaaccttgaaagtgaaagtgaagtcgctcagtcgtgtccgactctttgtgaccccatgggctgcagcctatcaggctcctccgtccatgggatcttccaggcaagagtgttggagtggattgccatttccttcgccaagggatcttcctgacccaggaatcaaacccggggtctcccgcattgtagacagacgctttaccgtctgagccaccagggaagctgcaaaaatgacgaggctgtatcacaggtgaggtcatgacctcctaacaagcaaaattatttaaaatgctgcacacacaaaagtcactgattactcatggtatgtataaaattatattttgctgtctcgatgatcactgcttatttctcagtacagaaatattttggattatccgacattgaactacgaaacactagttcacaatcacatgtgttctgctgcgcttagtcgctcagttgtgtttgactctttgtgaccccatggacagcagcctgccaggctcctctgtccatggggattctccaggcaagaatactggagtggattgctatgcctttctccaggggatcttcccaacccagggatcaaacctagatctcccacaatgcaggcagattctttaccatctgagccaccagggaagctcaagaatattggagtgggtagcctatcccttctccaggggatcttcctgacccaggaatcaaacccgggtctcttgcattggaggcggattctttaccagctgagttgccagagaagcccacacatgaaagtgggaggtggggggggaataaaacctagcgagctatgttcgaatgaaaattttaagaaagtattaggaa

SEQ ID NO: 51669 - DNA, 918 bp, Bovine  19866881170133
gatttttttttgcctgagatacagctttgaggagaatgtcagggggacactcttgttcccccctttcctatgacatgataaacatcaccccatgccatctggtgtcaccatgcattcggtgccttaattagacttatagcactaaatgaactatctctttgaaataacagaagtacctcatggtctgttatcacaactttatgggctcccggagattttggaatctcagactgtgaaccacccatccagtccatccctgatttacagatgaggaaagcaaagcctccaaactccttagtcaaatgatgtatcagtatgttgaccctctgtttttgaaatctgagaagggaacagtgaagcagtgggaagggtggggtgggggaaaagtgtggctatgttgaaaatgtcagtgatagcagagaaaatatttgcctgtgagaccctgcctgtctctttggacttctttgtaatggttaagacaacccaacagggctggagtcgttagtgattcagaatcggattagccaggactggtggagttactttctcagcaaagggtttcatattttaacatttgtttcccatgacagtttgcttattcttaagttttggcagccatgagcaaatggttgtcaggttttttgttttgttttgttttaagacaaaactccaaattttattttgccaatttaataaactgtattctacctaccactccttctgctccctctgtaattattgatcaaactttgtttttcagttgtggaagtactatgaaaagttttcttttgtaccctgagatatttataattttgtgtaagcacactgtttacagaaaatctaagtggtgcatatgttaactcaaatacccttaaaacacttaaaatattttccaataactaattctccccccaaggg

SEQ ID NO: 51670 - DNA, 1315 bp, Bovine  19866880426663
tcctcgtgactggtgggcacaatacgcacttctcagggtatggatctggggtcaggatcccccagcaggggtctgcccataccttctgtgtagccacacgcctgtgtgagggcctggcagtgggtcagaagcgcgatcctcgtcacggtcaccccgagcacacttccatccttgcacgtcttgtactgcaaagagaaggggccacgagggtagagctccaggcccacagccgccgctgaccctgagctgtgtaagggttgcagcacgcgtcactcagctccccaccttgtccagacctagcgactcacctcaatatacgcagtgtcattatttgcatctttaatgtgcgggaaccaatctcgaggaggtttagagagatgttttgactctgtgacaaaccataatagttttggccaaccttggaaataaagaacaagttcctttcaggcaagcatcactcagaagacaggtgtgacaccaccttcctgctaatggcaagatccacagcagcacaggccagatcaagtctctgtgtttccaagtctaagggcatggtcaaggtgctgtgagcctccaggagccgaagtctgccacatgcaggctaggagacctcctgtgtggacagcgtgttagcacaggccatggggcacaccctccccacccagcccgggctcacctttgaactgcgggatctcccccgtcgggctctttggcagccccttgtggcaagcatcgctcgtcaaggctacagtcaccccacagcttccaagcaagaacccaatctgctggcttcctgcatcctggagacagcagcaaggagatagggtcacgagtagaggtgatggccgctctcccgacaaagcatggtcttaccctgggatggcaccaacccctcagcagaggctcaatcagagagtcagggctcggctgacgtctgcatggtgggggccaaaccttatgctctctgcccgctgcctaaccttggacagggcaagagcttggcctcagtggtgtcatctgcaccatccccttggcctgctgtgagggacgaagagagggagctcggtgtgtgctggtgcgctcatggggtctcgtttcattcccctctggttgaacaacaccatgaccatgggccacagagaggatccaagaacatgcctctggtcaggacactgaccccaagaagtctatgatcacacccatgcccaccacggaaacaaacacgccgcatggagtgagggcaccaccgcatggactgagcagcagcatttgggagcagacactgtgggagaggcaggcctgggtggcgccatcc

SEQ ID NO: 51671 - DNA, 4690 bp, Bovine  19866880659789
gagcacctactgtgtgcacagcacaagcagggctcctttgagactaacacctgtgaggagaggacacacaggcacaaaggaagggcactgcctcagaggcagcatcaggaggccgagcaggaactcaggggaaggagaggcctggaagacaaagcaatcagtggctggaacaggatacaaacagagacaaaaagccacagtgacatgtgagtcctacaaacactaatcttttcaaggagaatacctacctcactgttaattaagagttatcaagatttaaattcctgaaccacttgacataccagcatgcaagcttctcaaatgtcccacttcttggcaatcagtccttgaatcaatcttactgaagaagagccactgtttccttgaaatgctactgtttctcaggccagtttcacagtaaactttccctttgctaaaaaaatcagtaattgacatatgtaaacactcaataacttcaaaaatgatcagctaatttaagaaaatgttaattactactggggggctcccctggtggctcagatggtaaagaatctgcctgcaatgcaggagacctgggtttgatccctgggtccagaagatcctttggagaagagaatggatactcactcccgataatcttgcctggaaaattccatgggcagacgcaggctacagcccatggggttgcaaagacctggacacaactgagcaactaacacacacttttaccacaccggttactatcaacaacccaccaccagtcactttctggtattttttcatatgtgtgtgtccattttctaaggcagggatggctcacaaatgacaagaggaggtaatcatcctgctggatgaaagtctcccaaaacaagactgacaaccaacctctggtcagggatcccacccgctggaggagacgttcctgcacaggcacaagtgtgcacatacttgcgctcgtctactggcaaacctgcacctcacagggcttcttatttcaaagtgtcaacactaaaagctcttaaacttgaccaacatcacaaagtatttgtcaaggcttgttttcttattttttttctttagcttttcctggagattaccatccaactattgcaatgggagcactcagacagaggggtgacaaggtggtggcccagcctttactttaaatctctccagatcctgcacccagagccctggctcgcaacctagtattgtccttggagtcaaaatgaacctaaagaccatctccctgagaagggcatctctacaattaagtaaccacaatacctaaagacaagcccttctagagtttgtctgctgggaagggcagaatcctcattccaaagatgaggaaagattccagagaaacagggatggaactactgggaagttcatgaatgctcctccctcctgagagactctctgctttattctcttctagatattatcaagaccacatgcccacacattgccaccaacatgggagatgtcttcacagtctgctaggtcttctgaggtatctgaggatacttcttgctgctgtctgtgtccctgcccacttgctaggtcatgcactctttctaattacttctcttaatggactgtgggcagagaaaccagacaatcaagattattataatttgaaaataaacaataaactgaaagtttagttcagaaggatattacttcaacaaaaataagttttactgcatgaaatcagttacaccttttgttactcaagttttcttttcctttcccaaggttctcaataataatcctaacagttaagtcccacttacaaaaggagtgcaacaggctactttctgatgttgagaatatacagaggcatcagagagctaaagaattctctctggtcaacatcatcatcaacagaaactttaagaagcaacaattctcctgtcaagaaaattgagctcacttgagaactaacgcaacaaatgtgcacttgacaaagttccttatgaatatttttgcaattgaattattttaagatctacaaaggttcaaaatttaaagaaaataagtcacttttttgtaaagaaatgtgatttataatttttataattttttcatgtatatgaaacatgaagcaggggactcctacctgataaattgtcaaatctctatcaaatacacaaaactccatttttaacagtcacactcattctttttacactatatacgtatgtatatattacggccgtaattttaaattggcatccgcagagaacttctaaattaaaacatcatttaactgctaatgttctattttaaacatttacagcacaatttgtatgaacagttttgcagaatttttcctcacttaaatgtatttcaaatcattttctcttgcttccaactagcttttcaaattttcattagtaaatagtccacccaggaatattctagaagctgagaaggttgaagagtgaatataatcatgacagaccaagaagagtagaatcagcagtgatgaagacaaaagagccatctggtggtttttgactgcttacaaggaataaatacagtcatgattcacatacacttgtgtacaatcttaggaaaaccctaccacttggcaaggactgcgccaacctgcaggcatctcctgccaagactcttctcacctgctgcctgtgcaccactaggcccctggaacccactggacacagatacacagggcactgcctctgtaccaattttatctacctttaggaaatcaccccagtattcagatgtccttgtacttccccaaattccaagtcaaacacttaattcagcacacacatcactcagggctcacatgccactgacagcagccagactgctcttcctggagctccccgcaggctggctcttctcacatggacagttctcaggtctgctctggggttgctgttcttttccccatctcagatgaacataagcattataaagactgaaagcagtgactacttcatatttgttctttcatgagagtaacaaacacttttcaaatttactgaatcctaaaaaaacaaaaaactcaggccagtatcatctgtatgtctaaccctgaaaacctccctgaaaataatcgaatttaccagactaggttaaatcgatctccaggagaaaatgacaacacaactatgttaaacctgtctcaaaatctaggttgagggttagcaaactagagcccgtagccaaaaaacccaggtgttcaggagtcccaaaactgctcagttacagcttattcaagctttgaaacaacaaaagaattggtccctgtaaatcagtctgagtggacctattacagggaagaaaattttcaaagttgagaaaacactagtcagttcagttcactcactcagttgtgtctgattctgcgaccccatggactacagcacgccaggcttccctgtccatcaccaactcctggagcctgctcaaactcatgttcattgagtctgtgatgacatccaaccatatcatcctgtcatccccttctcctcctgccttcaatctttcccagcatcagggtcttttccaatgagttggctcttcacatcatgtggccaaagtattggagtgtcagtatcagtccttctaaggaatattcaaggttgatttccttttggactgattggtttgatcttcttgctctccaagggactctcaagagtcttctccagcaccacagttcaaaagcatcaattcttcagtgctcaccctctttactgtccagctttcacatccatacatgacctctggaaaaaccatagctttgactatatggatctttgtcagcaaagtgatgtctctactttttaacattatgtctaggtttgtcatagcttttcttccaaggagcaagtgtcttttaatttcattggtgcagtcaccatccactgacttctctgaaagttgtagatcctgtgttactctgtgctattctcaagttatgactgcacatttactttaaatgtttaagctaaactttcataatttatggacagtcattgactaatcattgctggatccagagtatagcttattgctttatatttaaaattttaaaaaaaagcacagccttttcagatcagatcagatcagatcaatcgctgagtcgtgtcagactctttgcgaccccatgaattgcagcatgccaggcctccctgtccatcaccaactcccggagttcactcagactcacgcccatcgagtcagtgatgccatccagccatctcatcctctgtcgtccccttctcctcctgcccccaatccctcccagcatcagtcttttccaatgagtcaactcttcgcatgaggtggccaaagttacttaccccaaattatgcatgtgttagtttacctggaattttgtctaaaattttttatagcttccttcttgataaaattcaaatttagacttttctgaaaaatcagatcattgaatctccttgtcatcatattgtggataaatctttaggaatagtatacatttcttttatcatttattgattcttatacctagacttttaatttcttggataggaatcatttacatcactcagggataagcattgttgtaaatttgacatcagttcaattcagtcactcagttgtgtccgactttttgtgaccccatgaattgcagcacgccaggccactcacatccatctagttg

SEQ ID NO: 51672 - DNA, 810 bp, Bovine  19866881170258
ctgtctgtactcacccgtgcaagatgtcggcctcgtgatgcctgtaggtaagggtgggtgtgggtgcagagccacagactggagaactagcacccccccacctttcctgcagggcccgccttgatggggagtctgagacaaagatagagcttcccatgggacagggaggctttctgttcagacaggctcaagagactggagcaggtgtgccgtgctcattggtttcagggctcagaccgtcctggaggccgtgtgcagtggctgacgacacacgccatgtggtcttttctcagtgtcatcctcatgtctgcatggtgtgtaaatcccatttacaccctaagcttacagcagtgcacagctatgaaatgttgttttaccgcaacaagaaaatcacagcttgcttcagggactgtgagggcctgttctctttcacttgtggttttgctgcagatgctacttctttttgtgttcttttttgtacccattcatttctcctctccagctccctgcaactccctttctaaagtaacctgtgcttgctgttttgcattcagccatcatgtgttcagtgaagcctgatggggttccccagctgtgcaggacagacgaagtcggggagctctgcgtgtgcgcggtggccacgggcatgtcctactatggcctctcgggtatgaccaagaacaccttcgaggtaggtggcaggtgagccccatcagacagcttttgccaggtgtgtggaatagatgtaaaaggagatggtgatttctcaatagaacatgttcatggtaattaaaatggttgtactttctc

SEQ ID NO: 51673 - DNA, 2108 bp, Bovine  19866880222782
aaaacagtgaaaatgaagggaggggactgttatgtttagtcctgctctaaaagacgcttactccttggaaggaaagttatgaccaacctagatagcatattcaaaagcagagacattactttgccaacaaaggttcgtctagtcaaggctatggtttttcctgtggtcgtgtatggatgtgagagttggactgtgaagaaggctgagcaccgaagaattgatgcttttgaactgtggtgttggagaagactcttgagagtcccttggactgcaaggagatccaaccagtccattctgaaggagatcagccctgggtgttctttggaaggaatgatgctaaagctgaaactccagtactttggccacctcatgtgaagagttgactcattggaaaagactctgatgctgggagggattgggggcaagaggagaaggggacgacagaggatgagatgcctggatggcatcactgactcgatggacgtgagtctcagtgaactccgggagttgatgatggacagggagggcctggggtgctgcgattcatggggtcacaaagagtcggacacaactgagcaactgaactgaactgaacaaatgttcagtgagtaaataatgtaatttttggtaatttcatccatatatgggagacaaaggaaataagagacacaaagaaacctaccctcatgatatttacattctatttgataacaacaggcaggaaaaatgaaaaaaattacgaaattaaatattatgtaaaatatggtagacaaaatggggaaaaagagaataagtgaaggtgtcaaaaaggtagtagaacaaacgctgagtcaaggagtgaagggaaataatttttcaagtagaaaatatgaattaatgatctgcttttaaaaagagcttatgtaggtgtacatgaagtaggaagcaccaggattctagctgcctgcccatgtagtcaacagtttcagcagaatctgtctgatgtaactattttggaactctgtagtctactgaatgcttgcaaattccacaagaaaacttgagcagtaaactgtggttaatgtaagtcaatttcagccctcacacagtagctgctaccaatctaccacctccaggcctgtgacaggcagctatacatgtgttcctggaacaagctgaagagtgttaccattgttactgcacctctcttcattgttgataccctcccactcttgcggatgtgacttctgggaggatgtaaagggctagaatcattttctcctccttcagttcagtagctcagttgtgtctgactctttgtgagccaatggactgcagcacaccaggcctccctgtccatcaccaagtcccagacttgctcaaactcatgtccatcgagtcagtgattccatccaatcatctcatcctctgtcgtccccttctcctcccaccttcaatctttcccagcatcagggtcttttccagtgagtcagttcttcacatcaggtggccaaagtattggagtttcagcttcaacatcagtccttccaatgaatattcaggactgattttctttaggatggactggttggacctccttgcagtccaagagtcttgagactcaagagtcttctccaacaccacagtacaaaagcatcagttcttcggcactcagctttctttatagtccaactctcacattcatacatgattactggaaaaaccatagccttgactagatggacctttgttggcaaagtaatgtctctgctttctaacatcctgtctaggttggtcataactttccttccaaggcagtaagcatcttttaatttcatggctgcagtcactacgtgcagtgattttggagcccaaaaaataaagtcagccactgtttccactgtttcctcatctatttgccataaagtgacgggaccagatgccatgatattgttttctgaatgttgagctttaaccaactttttcactctcctctttcactttcatcaagaggctctttagttcttcttcactttctgccataagagtggtgtcatctgcatgtctgagattatcgatacttctcccagcaatacttgattccagcatgtgcttcatccagcccagca

SEQ ID NO: 51674 - DNA, 1156 bp, Bovine  19866880423796
gcatatagctggacatctcaaggcatcccggagttaaaatcggggctcatgccccactcagtgtgacctgtggaggtgatgacaggcctccctgcaggcccaaggacccctggcccagggctgacggggcacccgtgggcgcctggcggcctgtctcctggcccctgcttctcggcgcctccaaaatgagtcagagcatgtgcggcgtgggcttgtgcaggtggcagggagcccagaattagctcagctgcttcagcagggctgcagtggggagggggcagccatgccaggcgggggcgaaaggtaggcggcccggagccacagcgggggtctctcttggggggccatccctggcctgggaagggtagggggaagaagactgtctgtacctggcattcgcccagctgaatgagcagggggtctgagcagcaggttaggtgctggtgtgaccctggcccacctgagacagagctgggccgagtgggcacagccaggtcaccccccgaggtgcaggtggcagacaggagaggcatcagcatgctcgctgttgaccttcagcccagagcctctgcctgcccgcagcacacctgggtggccgagccttcctaaacccacgcctgtctaccccctgacagcccaccctcctccaactgctgtccttgttgtgttgttgcgtggtgaaagtcgctcagtcgtgtccagttcttttgagaccctatggactgtaacccgccaggctcctctgtccgtgggattctccaggcgagaatactggggtgggttgccattcctgtctccattttgcaaattacctttttgttcaaaggaatgagtgcggttaaggtgactactttaataaattgccaaatgctttgatgtcccttgcaccttgcccgttctccccaacctctggcacaggtgtgtggtcccagacactggtgggtgtcactcccagctacagcaaaacagggggtggggaggggcctggcacttgtgttaccatcagatgagtcagccaggtggaactgtaaagcatttaatcacatgggtgtcagcgttgtttctcgaaagaacatttttccaggacctggtatgcaggatgggcacacgctgttacgtctgcggttttcacattgtcatgtgaggtgcatgcgag

SEQ ID NO: 51675 - DNA, 1156 bp, Bovine  19866880497768
aatcacagcatctccagtatgttattctcagtcacagatgctgttgttcctgaatataaaaaatttccagatttcctcatcacaagcctgtttgcctttcttgctttatttctgctttctaatattttagcaatagtaacaactgatttttattcaacaatccccaagcattaaactccaagttaagcactttatatgcataatgatactaaagcagtgtcttaaccttaaaatacaggtctgatgatcaaatctctgttttaaataaagaaacagtgactaaatcacttcctccaggtctcacagatagtaagagacagaggaaggactctgtattgtaaggaataattgtgtcactcaaaatggaattttctgatggtcagtctggtgtagccactccagtactcttgcctggaaaatcccatggacggaggagcctggtgggctgcagtccatggggtctcgaagagttggacatgactgagcgacttcactttcactttccactttcatgcattggagaaggaaatggcaacccactccagtgttcttgcctggagaatcccagggatgggggagcctggtgggctgccgtctatgggatcatacagagtcggacacgaagtgacttagcagcagtctggtgtagacctgggataacatcatggagaggcatatcaaggtgaaagtgatttatgatgcccatgagtcccagaagagaaaggcacactgttttatgccatgctgtgccatgctcagagggccacactggaggagggccatgggagtgagctcagcaaagcaggtggggagaacagagagagagagagagagaggatctgtgggcaagtgcctttactgggagtcaggccaagattacagccaaagaggtgagggaatctcgttggtgtgttttaatgtcactaggtcagtcaaaggagggcagtgagggtaacttatggaagagaccagctttactgtactggtgcacctggtcacctgggagggggacctgtttatgaggatgttgaggcatcaggaaaatctgaagttttaaaaatttagagcatagattcttacccaaatgtgtccaatttccaagtgtctcctcagaagcactgaactttcctgctattgataaaatccctttggtcac

SEQ ID NO: 51676 - DNA, 1779 bp, Bovine  19866880514631
cttttcttcccctgaatcttgatctggcgtccactgaaaataaatacacaagtaaatcacattttggacaccataatcaaacacagttttggtaacaggtgtcactacctgagaggagtaaaccagcctccagcataatcaaaaaggcgactgtcccagctcgggggaggaaaaaataacaaagagggaaagaaggcgttagaaacaagagttccattcacggtcacagtaagaattcttaagtccaacttacattcatctttttttctggagtacactcaatatacattattcttctaacaaagctgactttctgattaagctttatttgggttaatattcaagtgtttttagaatctttaaatagtaactgagaaaagagccttgaaatatatgtaacacacagccattttgagattacaaacccttaaattacaactcataggtcaactgcatattctttcacttaagcctcccagtaaggccacttcttaagtgaggccacaggatggagggtcctagtcagtacagaaggcagaactgcagtcaataccattccacagaaatcccagaggaatgaattagtttagagctaaaccctgttaatgaggacaacacagccagcgtgggacagaccactatctcttcatctgagcatcagatacagtagctaagagccacactttcaaaaaccaagtaatcttcaaacgagagtcatgatcaggatgatgagatgctactattaggagggcacagccgattcaaactgaccattttaccttcactctgagttacatacccattgtttgaaataataagcaaaattaccagcacaatttaaatcattttatttcaggttttgaccaaccgaagttgcaacagttattcctcacactggaggactaccagtgcgtcctagtcttgaagaaaggttgcaagggtctcttaaatctgctataaggttcctaatactgctccttctagagtcaaagtgtgagtcaagttctgcctcgtactgatatttagaaatggtcagaagcatgttaacttttttttactcaagattattacaaatgtctgcagaaggcagataaaactgtggaaaagctttatatgttctgatttcttaatgttctttggagatcaaagcctgagtttcaggataggaattaacagggagtttattacaaatccagtcattgtgattaataaggacacctcattgcctcctacactaactgttctttatgacttctcaattatataaacatgatttaacattctttgaaaggtctaaaggcttgcattttacaagggtaacaaaactgtgtgggagaaggcaagaaaatcctcttttcctacattaaatgacaggaaaatatggcaaagaactgtgtcacttgagaaagcattgccaattttaatctcactttacacctccctggatctgattagttagcaaagtttttctctggcctcccagatcataatatcctatacgctctgcttctcctatcaacaaaaggaaagggatttaagtgctgctgaccaatcgagagcatgttcaagttaaagttactgctgtttttaaagggatgttcatttttgtgatttcttattttcttttcacaaacacaaggctcctggtttctattccaaagacctttgtgaatctttgaatcaaagatgagatttgtaatgtcctttaggctgtctctccacagttcatcactacagattcaaacacagatgccaacattttttccaatcacatcaaca

SEQ ID NO: 51677 - DNA, 720 bp, Bovine  19866880622046
acttccgcttatgacacgccctctgacaggctgaggttctctctttctcctcaatgacaaccacctccccacaagactggcttctggggacaggggttgagggtaagacactctctcaatatagggtcgaccttccccatctgtccccagaccttgtgattccagatccttgcagacagacaaaattaaataccaaccttagtgttaaatacaacctatggtgcctgtcctggagcagatctttgacgacaaaagttccggaccccagcaagtacatctgcgggagaggggagacagcattagtgcccaggccgtgcctctcctccagctcttggggcggcagtgggtgggcggggggatacggctggctggctctctcaacacatctgacttcatctcaggagcccagtgggaggctcagaaagatgttcccaaagacaaaaacacctggacattaattcataagccaggaataaagtcagtcttatgttcacctcccagacaattatgtagctttaaaaaaagaagggaagaacatcccacgaacaacaacatggtacttaactgttccctgagatctgtccttgacatcatacacggacagcttgatctgtgtcatctgattgatgagagagtcttgaaagaaggcaatgctgcttagaaatataggatcattggttccctacaatagaaaaaaaaaaaaaatcagaatacagagtt

SEQ ID NO: 51678 - DNA, 695 bp, Bovine  19866880624934
aaatctgactcaccacagcatgagagaaaaatttaggagagaaaattcttttagttttcatatatttttactgctgtcttggtagcatccataacatctaaaagtaagatattagcatggaatgattatacttctgtgtttcagatgataccctaaagatattaaaggagttaacaagcaaaaagtctcttcaagtgccaagtatttattatcatttgcctcatttattgcaaaatgaaggaagccttcaacctgccgtgcagatcggaaatggacgaacaggaggtatgtttattttgtttcctgttgtagctgcgttgctggtcagaattgtgtcttggggtattatgtggtattaactttactgaggctttcaatggctaagtcaaatatctctttgtaaatgtcacattgcacttgaaaatacgcaggttattttcaaatatcttttgatactgatttctaacattaatccacagtgataagaacacactgtatgatttcagtacgtttagaccataaaattgttttttatccctggatatattccagtgtctcctagtttatagtctatgggaacttgaatttgtaacgtactattgtgtgaaaattgtataaatcttaattatgttcagttggttcacggtacttttcaggtctactatatccttctacatttctgtctcttcattcta

SEQ ID NO: 51679 - DNA, 2755 bp, Bovine  19866880627548
actcacgtgtgactgattccactggtcagagagtccccttgactttgtcaggaaccacttgcccccccatctccaaattgtaacacctcgttgtgggcatgagggaggtcctgtctctcgttcgggagagatggaagtggattttggatcactgtcctggtaactccctacaatttagaagattctttgggcacagctcagtttcagtttggggactacttgtatgagaaacacttagatttgaatgcatggggtatggacccactaacaggaagtgacaagtgagaaagaaagaaacacagatatctgggggtgggttttatatttgagagcttcatttctttcctaaagtctgggatcctagttgagagctcaccttctcaaagtggaggtgtaacactccctcggtcgggaaatctccaacagctgaaagttggttttttcctataacatcatccatctctgctggtacattaagatgggaagcttctgaagcatcacaggcttaaattccccacttcatccattactagctggcgatgttgactctcacccttaacccggatcctgtccttttccagcgctgccatttctgaaaaacacggtgatccttctctacccgtttgcacctctcatcctgctctacgggctgtcactagcattgggctggaacttcacccacacgctctgctccttctacaagtacagagtgaagtgagccagggcgccccttacatctgagcagcagtattggtgaggtggtgatttcttgtgaaacctgtaaataaactatcattgtagatatcttaaaggtataaagtttgcaaatttgaagaactataaatgttaatacttagtacattccttaaaactaattaaatgtacatttctacaataaatattttttaaactaaagtgttaccttttattcataaatatttgcacacagaatgatatgcaaagtactaaggctatgaagaaaataaaaaggtaaaactttttaacaaattatttttgaacacgtatccacgtaatagtcatgtgtgtcccatcccctccccaactgttactgacaaggtacagagtcacccccatttctaacaggccacattttaaacttttatataagccacagggtcctaatttaagctttaagagtctctttaggaatcactgaactacaggctgtaaatgtcactaatagccattatttatgccaaaaaaaaaaaatacccaaccaacaaaatgtagtagatgaagagtcccccagaagctattcttactctgggaactgtataacacacgcaaggcatgagtgaacctctgtatcacgctgataatcatggtcttaacaactaaggcttttttttttttaaagactttccaaaacacacaaatctactattgttttctaactgaaaatagtcctggtaagctattattatatatcagtgttaaaaaactataataataaaaaagcttggtactcatgaagttttacctgttttttattagaaggagtcttgaattcaacatggctttttaaacttctttatttcaaatacacatgaacggttgtggcacagagaaacagtgatgaaggcacagtcaacgggaccagttatcaggttttcagttttagcagcaaattagaaaataaataatctgcctttgaaaatccaacaggacctaaaatagtactacagttattaccaatccaaccaatgaagatgttataagggaaatatgtacaatatatttcaggggaaaaaaaaaatacattggtacaacctggaaaagcagttcttcaggcagcttctcccaggggtgcttccaaaaacacccccaatcccaaagacagcctttccaaacgaagtttgttctcaaggagaaatgctttagtttttcaccccataaatgaaacaatggttacatttaatcagctgatctctaaaatctttcttagaaaacacgaccgactacactgaaaacgtcaaatctgctggcagtgcatcttacagtactgtccacaccggccatcattaaggctcagagactgtgtcttcaaaaggtattttcacccaaatttcagcaaactgagcatttcgaacaaataatggaatgcttatcaaactcaagtaccaaatctttgattccagggcaatttgctaatcactaatgctctgaattaaacagccttccttgagtccaagaatatggaatgttccccacagcagacaatccttattctagaacagttttagcaccacagttcctaacgtttttccacacaagcgtttccaggccaacactcagtttacattttttgaatgacatctaaattgcccactcatactctgaagctccagccctttctggtttgttcctctggaaatgctctagctagcaccctaacaggtgaagcgagtgtttcaggcaagaagagtcaagtttctgtatagatagtgatgatacaggtatataaatataaaaaatgcctgttttttttttttttttttagtaatactcctgtagtggtctcttcagcactgtaggttcacatgcattgaagaaatgaagcatattagttatgccatatatatgttaagattactaattaaagatatacaattctcaaactaaatctcacacactataaacactgctccatagcttgggaaatgtttcctttcctttaggacttcagataccgattatgactcaagtctttgactttttgataactttagcctct

SEQ ID NO: 51680 - DNA, 1289 bp, Bovine  19866880744937
aatatgaaaactcccattaaaatattccaaaaattcagaaccaaaatttcacagaagaaatgcaaaaggactatcatacatgaaattcaagtttaatcttatgttaaagcaacaattacaaattacaagacaacaatattcaccttcaaattaaattagcagattatataatatatattaaaattgtggtgataatataataaatgtttcagctattcagaacagcataaaaaacctgaaaacattttaccctattgttcagtaatttcccttttaggaatttaacttttatgaattcaaagtacccattgtaaaactatgtcttttttatttcttgtaagtcatatttaagagcgctacttgtttcaaatagctcaaagattccccagagttcatctgaagtccatacaggtcacaacagaaaggatcataaacaccacagttaaattttagcctcatattgtatgtttttaaaaagaggctgtttcttcactattgtcaatgaaacgtatataactgaaatgtaacttaatattactctctttaaatcaaatttagcaattaatgaaattgctttataattaacaacaacagaaagagttttacgtggtgatttttctctctgtagaggttaacaaatgctggctggtaagcaaccgtcgacagctttcaaagagagtagttcacgcgactctctgaaaatataatctgtccataaaacaaaaaacagtgcctgtacctgaaaatttattcactggatccttactcctgtttgtttctgcttctacacgcttgaattgctgtacaatggcactgagctcagaagagcgctgagagattcgatgttcagctattcggagacgttctttcagagcaagaaattctcgttgataagcaatcactttttctaaaaacaaaactagacgttattagtgcatttcttaaaaaaacacataaaaacaccattataatcaaatctgaactggaacagcagaaattttaaagctgcacttttcagaaacagatactcatttttgaattcactgagacagaactgaaaataaaaaagagtctgaactaacaaagtagcgacaaagccaccagtaacacagtgctatcaatatctgtaaggatgtgagcactttctaattagcactttggaaagctaaagatagggagaaaaagacaacgtttttggaactaacacttaaagcatgataccaacatcatttcttaaaaggtagagacaaccataaagaccctatttgtatgaaggtagagacggatca

SEQ ID NO: 51681 - DNA, 1625 bp, Bovine  19866880868172
cacaaaaccactctctgccttaagaccactaaatcttaagagataaaccagggagtgcagctgcagagcccacgctcttagagatgtgtctgacccttctgctctgctacactactatcatcttaaatattttagagtgctcatgcttttgaaactccattctaatgaaaacagaccctcgatattatttttctttaaaaaactgtggaaaaaaaaactaaaggaaaaacttacctggatgtagtatgtgcctttttcctgagcatacatcattagaaaacaataatctaggttttgctttgttctccatctgaaataaaaatgttcaaaaataagttaggaatcagactcaaagttagcaaaagaaggttagatgtatattttgtaatatataacaatgttatatgccctatatataatatcacatatattgtatatatgataatatgatattatacaaaatgtacagttatatattggtttccctggtggctcagtggtaaagaatctgcttggcaatgcaggagacatgggttcgatccctggattaggaagatcccttggaaaaggaaacagcaacccgctctagtattcttgcctggagaatcccatggacagaggagcctggagggctccatagggtcacagagtcagacataacttagcaactaaacaacaatagtcatacattagatagataggtagacaaataaatggatggagccacacatacatggtgtatccacttaggaaagagtgcaagagaattcacttttctttaagaaggttttatcaaaatacattctcaaaaacactaatcctcaagatgtcctgagggaaaaaggagtctaatgtctagtaagtttgggaaggacatttatttcttttctagagacacattaatatattagaagcattgaaacattcagcagtaagtagcatctgttgaaaaaagtttttaattcaatattttccaaattttcttgactacaggccctcttttcagtgatatcttaatgtctccatgaactagtgcttcctatataggtaaaagtttttttaaaaaaaatcttaaacattgtattaaaatttacaatattaggtccttttgatgaattcttggtagcctacagaaacccactgaccaatgctgaatatagagaagtggttttttaaaagccaggttaacacacacacacacacacacaatagaactaaagctctgaaccactaagtaaacttctcccagaaaataccttataagctgttctgaatttaatgagtctattcactgggtttttttttttttttaaacaaactcaatcctaaatgttttaagtaacatattcattgagagacaattaaccaattatagagacatatctgtctttgtgacaaattaacaactcaagaaatacaataaatctcttcccaaaacatcatttttgtccttttttctggttatagacaatccaaaaatgatgctaatatctcttagattactttgtctttaacaacaacacaagaaaagcttctaactccttcaatgttagagatttagagataaataaattgactgttttattgcagtatgattctgcagaagactattattgtttttatta

SEQ ID NO: 51682 - DNA, 3308 bp, Bovine  19866881060885
gtgagcagcttggagtccctgaggcctctgccgacacatgcctgctcacccacggcagagtcctcacagggtcccttctctgggcggctttcttgcacgctggatacaggctgaccatctttatcttctccccttctgatccttaggtccctcgttcaaagcaagcagtttgaaagcagataaaaagctagaatttgttcccactaacttacacatacaaaggatgagagttcaggatgatggaggagcaggtaactgccccgtgaatcatgtcgcttctttcccccactggcccttggtccctgagctgtcgcacgtctgtcctatgtgtctgctgtggcgttgggctgagagcacagcaaagggacctccaaggcctttgtgaggagctctagcaccttcctctcgtttgtcctccctccagcttctcttgcatgtctggggcagaaaacggcccacgggtcatccttctgaggcaggggtgcaggctgagtgtcgtgggtcgctgtgtggccccaccctgagacccacacaggcccctctgaaccaagatgagggtgctgggctccagaggccctcgggcaccctggatggtggggctagtgttgccataggctgcttggagccgggctggcgggggaccccagagcttcgtgcatatccccgtagccagctttgtccgcaggcctgagccagagtaacagaggagagctttctgtcattcagatcagaactatgacatcgtcaccattggggcgccagcagcacactgccagggcttcaagtcgggagggctccgcaaaaagctgcacaagtttgaagagaccaagaaacagtaagttctcagagggtatctgtcctccttgttctggtgtctcgggcttcctggatttaaaaaagaaaaaaagtcgcaaggggaccgcagaaacgtccagcgtccgagctgcttttgcagggtgggggagctgcctgaggcgcctgtgccgctctttgtgcacgtccaagctgggcggtgacgagtgcccgagggcctgtccctgcaaaacaggcgattgaaaaatccgcccggagaatggttcccccggccctggcggacttggcgggctccgctgccctttagaaaccttggtccaaggtcacagggtgtgaggtctgggaaagacggtttcctttcctggaggacattggtggtcagtgttcccagggtcagagaggctccaggggctgcagggagtgaccaatcagagcggggaaacagcgaggtgggcggggcacgtgataaggggcggggcctcgaggaggagctctgcgggcagggcgagctggtgactagagctgacaggttgagcaggtagggcgacagcagtgctgggagcctgctggagagagggtgcaggggctgctgcagggcaggggcgacagggagagagcataagctgacctgtcgtgtccgacaccgggaggcattggtgatcttcccgaacatcgcctggctagacttaaccttgactggagggctcgggtgtaggaagtagatgggatacgtgcaggtgatgccgtgggctcctcggacctagaggtggaggaggagtgggaccaagacaagcttgtctcaggctggtaggagagaggatggcaaacgaggggagatggtggaggatactggtggagcgaggttctggagaagatggggaggcaggactgggcagtgatcctggaagggccaggagaagaaggtggtatcgcagagaaagaagaagctggggctgcagcagagcagctggtgcagaatgtggagttgaggggccccaacaccaaggcccacgatcctcaggaggtcctgtggagcagtcgtggcggcctggtgactgagtgcacacacacagtgctggccgcagcctcaggccagagcctggctctgtgtctgggtgggtgtcaggacagggcttgagcaggttgaccttggactgcaggggccggggagaaaggacaggtgcagtgggctgaggcgtgagcaggcgggcagagagcacccggggactcagggttcagagggtgggaggtaggcctcagactgggcagcatctctgggatcctgcccaccttcctgcagcccccttgacctggatctggccccaccaagggctcctcaaaccaggccaccagacccacccgaggattcaccagcctggtggtcccctgggaattagggcaaagacagcttcctgtgccaccgccgctctgcacggccagccgcatgtgtgtcgctgcactgcatgggccgtgtggaggtgtgagcgtgcgactcgagctggcgtggggccctggaggagaaagccagtcaaggggctggccctgtcccaggaaggtcggggtgttgataccagttattctgcatgtgaacttcaggactcttattccccaaaggctttttgtagtatttttcaaatatataatgtatatgtttatgtattttcctactaatggcataaaaccgcctgcaggaatggtttgcaccaggggagctctcctcagcccaggtgtagcccaccacatgggcttctccctggggctcaagcacacgcgcagacgctgcttcgaccagggagcaccttgggctcctaagctgaatcctccctgtagtcggggcttcctcaagttatctccagaattttgatgaaagagaacttggtttttacgtttttttgttttgcatttgccgtttgctaacagactgctaatatttcgtcttggttcttctctttagcagttttgaggagtgttggtgagttctctgtctgtggagagtgtgcgtttgggtcttgctctcgtgcagagaaagcctgtcccctcctctgtgaggtgctgcccccgccatgcccccgcaggctcctagttgtagtctcgtagatggaactcccttccaactgcaatgttctgtgataatgaatagcccgtctccagtctgctgtttcaaaccctcccagtctggctgcatcactcggagcaaagacccagctctctctccatgacgaggaggcacctaggccaggcaggtctcaggtgctgaggcttcaagccagtaccgtggtgtgtttgggagtcccttcctggcttcttttactgccatctaaggctcttctgtttttatttccccttcacctctcgcaggaatgaaaccagcttacttttttttcctttggccatgcttcatggcacatagggtcttagttccctgagcaggcactgaatccctgcccctgccatggaagcacagtgtcttaaccgtagaccagcagggaagtccc

SEQ ID NO: 51683 - DNA, 911 bp, Bovine  19866881149830
tgattcatggacttggaattcagctccatagaaaagcacaataaaggtctctggaaggagaataaaagccataaaagaggcaccaaaggctctctcttgatattgttatttcttctggatgtttagaccatccaagactttgcctaatgtctcactgaaacctctggatgttcctggatgaggaatgttccatagcttctctcttcccctgcttctgtcaactaaacctggggatatgttcaccttcaggaacaaggaaaaggacttaatctctctcttggtctctctctcacacacacacacccacacacatacacacgttgtccctggtgtgtctgatggagaagcaaaggagcacggccctcagttggccgtccacagtcttggatgtgctctccagcccctgagagggatctgggagtgtctgaacacactgaactgaacccactctccatgcggagaacccgaagcccttcttcggaagcccctctcccagccccacaacccaacaagggtcctcccagggcagggagagtgaaggaaggccttacctgtgctgtcctccccaaggccttctgcagcctcccgaagcttaatgtccatcaccctcgtggaaatcatgtccagctcactaaaaatcagggagaaagccatgtgagaggaacaagtctaactgaagtcaatgaccgagatggtagtgactgaattttgcccatgaccctggcaaagacagaggccaaaaaataggtccagggctcaagattagtaaccacatcagtgtttatctaaccactgaccagatccatttaatggaaaacagaaaactgggaaagcttcaccaatttatacaatgcagatgcagtttctttctttgaaagaaaaattttcagaaattatgtattgctcaaatg

SEQ ID NO: 51684 - DNA, 1994 bp, Bovine  19866881176774
atgggataatagtaggtcttgtttgatagaaatgcattcccaaatgatatgcaacatattcactgattgatacggaccacttttgaagttttttaatgaatttgttaccatattgtttttgtttcatgttttggttttttgactgtgaggcatgtgggatcatagctccccaaccagggatcgaactcacacgcccttgcattggaagacaaagtcttcaccactggaccaccaagggaagtcctgagatagcacagctttagctctttcttttgccttatcagtgaggttctccttccccaggagggagcgttcagggatagatgagcgagatttttctggagttccagaaaaaaaaaaaaaaaaccaaccctctgctctttgctttatggttgtctgtgcaagattccagaaactctacgtgggggctgtttccttgaaaccgttggcaaatggttactgacattttagccttttctcaacctggcttcaaggtttggtccaagaggcattacagaggaaaagagctcccttgaagggcactggaggagctctgggggctgaggaagggggagtgcattcttcctttcaacacttttaaagcttgctctaccaggaccggatattttcccatttttctaacatgttcacaaagttcccctaccctttctattttgggtgttgacaccatgttctttctcagccttaactaatcaccaggaactttgggttttgtcctctcaaaacccctaggaacttcaaaagccacccacagcacacacaaataaagccagaagtttaagatactacagaaacaaatgaaatccttacttagaaaggcgatttatggagtcagtaaatatttaggagttacaacaaataaatgtaatttttaacagcaaggagcagaggctcaaggtgggagagaagaaaagggggtgcaggcttatttgtagttgttcagtgtagtttgaggattctcaaaaaagcacacacccccctaactgagtccttgtctcttatcttcatgagtcacctgtccattgtgagtgcaggttattaaactggggggctatagactgattcacaatatatttttattccttccacacaggaaatttaaagcacttaatagcaaaaggggtttttaagagaatggtttattccaaagggattatacaaattttattttcataagtaaacttctctttatttgctcaaataactgcgatctgtctttaacttctttctgtgccctgaggtgctcagttgctttcagcgcgtccaactctttatgaccccatgggttgtatgtagcccgccaggctcctctgtacatgaaattttccaggcaagaatactggagtgggttaccatttcctccgccaagggatctacccgatccagggaccgaacccatgtctcctgcattgcaggtaggttctttaccactgcaccacctcggaagccccttaacctccttaccctgcctctgacgcttttatttgggattttgctccagttaaagccaagagtggagagagacccttccaagcttctcccctggctctttgcagatagaggtacaaacacgagcttcttgggtcttcagtgcccgcagggaaaatccccaaacccaccacctaaaatgtgttgcagattccgagtgtgcccatataaagtcgccaacatagctgaagactcagacgttggtcatcaatcgatgtgctactagcatgagctcttctagctggcatggaagcttctcaagggtcagcagcagtggcctccgttccctgtgggtcacaattcacgtgggtcttacctccctgcaggttaagctccctgctctgtaggcacggggccggggcgggggcgtctggggctgtgtgactggcaggcccaggcttccgggccagctctctggtcgccgctgagcgaccgtccgaggccagcacgtttccttaccaatctccttacctggaccggcgggt

SEQ ID NO: 51685 - DNA, 1502 bp, Bovine  19866881199646
acagctcaagtccaagaacagaaaaacttgttcttcaaatctgggcctgagggggcctcttcaggggttctcattaactcaagagggtgcttagcctccaggccccctccacacagtgtgcatctgggcgcctacagaatccaagggagtcctggatccaaagaaagatccctgtgggggctgctcccactcccgctctctgaaccctaactcaccacaggcttctcctcagtttttggcagaattctatcattagctgcagctcatactaaaaaattctacagaagtttacgcacatgaagaatgagaacaggtttaaactatggtattttaaagatacccatgcgttatacttatttacacaatgcaaagaaaaatatctgtatcctgagtacatgaccctgagcccataattaagtacaaaaaagccttcgtgttcacccttacagacctgctcattccataccactctccaggctatgcttacctctgtttgatattctttctcaggccctgtgcctgtctttataatgctcaccacagccgtcaacagcaacttgtttgtaaggtatctgcctacccctgcccttactttcaaggctgtgagcttcgatgcctgtcacatccattgctctctcaccaggagtaaacaacccaaaaatgaagttaaaaaaaaaaaattccattgacaacagcatacaaaagaataaactactcaggaacaaatttaaccaaggaggcagaatatctgtactctgggaactacaaaacattgctaaaagaaattaaagaagacacagataaacagaacgttatccagtgttcacagatgaaaaaaacacgtttaagatggcaatactttccaaattgataacacagattcaatgcaatccttatcaaaatcccacctggattgtttttccccggaaatttttggtttgttttgtttttctttttgcagaaattggcaagttgatctgaaaattcatatggaaatacaaaggacccaaaacaatcttgaaagtgaaaaacaaagatggaggattcatacttctcagtttcaaaactgacacaaatcttcagcagccaggaatgcatggtactgtcatacgcaaaatagctagggagaagctgccatgtaacggaggcagctcaaccctgtgccctgtgccaaccgacaggggagggaccggggggcaggcgggacggggcttcaagagggaggggacatatgtatgatgtccttatggctgatccacactgttgtacggcagaaaccaacacaacactggaaagcaattatcctccgattaaaaataagtgaaagtgggaagctgctatatagcacagggagcccagcccggcgctctgtgacaactaggggcggaggtgggagggaggctcaagaaggaggggatatatatgtatatactcatgaccgattcccattatggcacagcagaaatcaacacattctaatattgtatagaaatatcctccaa

SEQ ID NO: 51686 - DNA, 1082 bp, Bovine  19866881366368
tgccggggtcaaggtttgatccctggtcgggagctaacaacccacatgctatgcagcatgaccaaaaaacctcccaaataaacagtttaaaagaaaaatccagtttaaacaaatataaaaatacaatgtacaacatgattttacacatagacattgtagaatgattatcattgtagaatgattgtagaagaccaagataacgaacaaagggaaaaatcttaaactgagtgatatgacataacaaagtactaatcaccaagaaaaggatctttgtcccccggtgtccataaaatcaagcccatataaataagggcctattctatagagtctcaaattcaagctggaaacaagtgacatttttgtaatgtgttttttttatatttgtaaatgtgttttttttaaatattttctatcagtcattctataagtcatttaatttaatttgatttaatcatacagaagagtggcctcagcatagaacccgtctccaagctgaatgccaaagatgatcttgagtagtgataacttctccctctcctgcctcaaatttgacaccacccaaaaagctggaccagtttgcggagaggccgttattttgcaaaatgtgctttttgtttctcagtctgtgggtggggccatttagggaacaaccatatttgcacagtcagatttttggtggaaagctgtttttgcaagagacactcatttcgtgtattcgcagtactgcttccctgttggcagcaagaggaaatgccattagaaggtgaaagttagcatctgcagctcagatactcagagcctcaatgttggaaagaggtagacaaatcctaaagagaaccaggaccaacatgacacagctcaggtcacgtgtttttgtgtgaccgtgtgtttctgtcctgttggatccaagaggattctgtggaggttactttcttgcttccctagtggatctagagcagacccatgaaacgacttttcctgtgcatgtttctcctctgattgttcacttatctatagatcaattaaataatatttatattgaagtataattgatttacaaggtattggtttttgaggtacag

SEQ ID NO: 51687 - DNA, 2064 bp, Bovine  19866881429625
caaggagacgagcacactggcctcccgcagtgagaacacagcatggcagcctcttcgtggacgaggatggggccagtggtcacttcactggggaagccaggactcatttcagaataagcagcaaaatgaaaagacaggtatgtacatcatcacacagtatgttttcacttctctagatccctacctggacttcccccagtacctcagcagtgcaggagacgtaagagctgggggttcgatccccgggtcaggaagatcccctggaggagggcacggcaacccatcccattattgcctggagaatcctgtggacagaggagcctggcggggaatggttcatagggtcacagagtgtcagacacagctgaagcaacttagcacgcaggccccttaccatcaatgaaaccaaaagacaattgacaaataggtttttaaaaaaactgcaaaatacgacaagaatatagtattaaaaacagtcacatgaaaaagaccaacagtcgaagttacaaaagtagaagcatgaatatagtatgaaagctgttcagtttcagagtaatcaaagaaatagaagtggaacaaggtgccatctccagctccgacgagaaagggaaaggctggtgttccaggtggtaggttaattaatgttctgtgagtactgtggtaatactaaaagtccaaaaatttcagaacggttaaattattctttagctgtacatttctactgctaggaatctgtccgagggagatcccaggcaggtgtgccaagcacagggtgcaacagtgagcagcgagaccacggggcagcactttagcgagtcacagacggactgccagccgcccacactcgtggacatgggaggatacgtgcagagctagctggcgctcagaaaggcgtggtgccagcccctcgcctctgcccgctgtgtccacgctgagcacagatctcaggagacctcctgtctcctgctggaggtgtaaagggttttgtctctcatacttactgtgcacacatccatcttgtggagggcacggcggccttggcttacatggcctcggtttctgggacaggagggcagagtagcagggccttgagcccacgtcctctcatgagcacacccaggccacaactgcctgccgaatagccatcagtaaaaagaccagaacctaaaacagatgctccacaaccaaagtcaaaggaggagcctcaacaaggcaggcagagaggtacactagcaatacaattaaaccatatccctggtggtcaggccacagcttacacactgcagaggttcccccgccaagtgagcgctgagccccaggtcaggctccccagcctggggctccagctttgggaagaggagcccccagagcatctggctttgaaagccagcagggcttagctggaactccactctcacagggtgcacacaaaatctgacatgcaaacagggctataaacgagaattttcatgtttatagacactcaatgcagtgcccatcggtgatggtccagccaggtgctggccccagaaccatcctcaggtaacagaatgactcaggccgggtttcatgttgtcagttgtttattatttgtcattctaaagactcgcacatttatagcatacatggctttgaatgagctaagaatatataaaacagtaactatgtgtttattaatactgtccaaaacaaataaataaaagtaccttaaagcactaaggttggcaaatacaattgtgtagggacaaaactgtattgtataatgtttgtacatgttttaaaggaaaccagaggcagctgagctgcagacgctttgacagaacccatctgagttttcagtacgtcacaacatttctaagtgggggccttatagggaacactggctggaacccctattttacagagacctggaccactgcctgtcttctgccgcgggaaactcaaagctcccgtgtgacctgaggagccgcggctatcgcggtgagcagcatggcccccctcggcgagcatgcccagtgccgctgggagacccacggtcacacaggagccagggagtcacactca

SEQ ID NO: 51688 - DNA, 1419 bp, Bovine  19866880349125
aaaatatacaaaaagccaaatacaaaagcccagagacatgcaaatgcatttggggccatttttacacaggagcagttaatgtggccaagccccattctagctggttccttccctctcagcctataaatttaccaaatattggccaaagctacactctgagtcacattcatgcaagtgtgcacctaagagaagttgtcccaagggtttcccattgctcctgctagcacacgttttctatctctcaatcctctctctcccagaaagacaaagactaagggtagcatggcatggtatgtatgtgtgcatgtgtccatatgaacatgtgtttctttgttctaatgagtcagcttgatgagaacagaagggtgctagccacgtacagactgcaagtcactgcaggctgatgagagaacgttgctttgcctactctgtgttgcagctataggttagactgatattttgggggaattgattgacccacgtgggtattttggcatcttatagacatgactgagagtgctttctttgagcctgagtgaggctgtcagttgtctgggtttgatttttttgagtgaacttaccaatcaattcaaagaataacggtgatggaactgagttggtcaggtggttgactaggcctcacatggccacagagtgattctgagtcaaaaacgatgggcagaatctgacagtttaaaaacgggatccatcaattaaacagaaagaaaccagtggggctgtttggcactcgttcacccaaaccagtcaactgattaaaatgttctcatttcaaccaatttgtgcaagatgcacccacagcacctgagggtcagggaacccaaaaggctttgcatcgaaagctggatgtataccaagatctaaaagaggaaagggctgtgttcgtggccgtacacttggaagaaaaaagttctgatgcaaggctgtgtgtgattgcatgagtgcttgtatctggacctgtgtctgcttataactaataacactggcaagacagtagaagctgtgtatcataactggtgctttcttttcatgtggagtcacagaatgttaggtattgaaggaacctttagagttcatgtagaaactgagacttggagagcttttggtttttgttttttggtttcgttatttattttttggccataccctacagcaggtgggatcttagtgccctgaccagggatcaaacatgcgccacctgcattggaagttcggcgttttaactagtggaccactggggaagtcctaaggtgtggagagttttaaatgacttgtccaaggtcacacagtgagtggacagctgagacacatctagacaccatatttgttaaggctgtcataacaaactacccacagagtaggtggctaaaacaatagaaatttatttttttcacatttctg

SEQ ID NO: 51689 - DNA, 1094 bp, Bovine  19866880406659
ggactctaagtggtaaggctagtcatcatgctgaaagaaaaaatccagactgccaataaagtagaattcagggagatggaaattttgagttatgtgcacttggatctaccactgcagaagccagtatagaagttcctcacagggccgcctctgcacgtccagaggatgtcaaactatttaaaaaaaatttttttttcctttccctggttatgttcttttttttttttaacccaggaggcatgatttggaactatgaaaacctagcagatggggaaacacacagccagggttcaaacctggctaagcgaccttgggcaggtgacttaacctttctgagactacatttcctcatcaaattcagtataaagcacctggcatatagtaatcctctataaatggaagctattatagttatgagtattgagagggcttcaggacactacccatgaattggaactgagtcatggaatgaataattaccatattcggaacaaatcagaagcccagaccctgataattcatgtataatcttctcactgcatggaatccagtctttccccaacttaatttgacctctcaaaaatgggcgataaaagaggaagaatgcattctggactcttctaagcagcctggaaaccttaggtttagggcaaagatgctcttccccagagacaggatgggtggctgtcttcatgatatggttttaagaaaaattgtacaccaccctcacacaaatctgtattatgccacctgccatggatctgaaattccatcatcatagctacttctttccacctgggcaatggctcctgcagacccctacctaaaagcacacaatttcctgggaggatgtacatgtgcacacattggttaaggtttcctaatctggcaatccagcttttaccccatggatactgagctggaactcaggataagtaagctttgataggactggggatatagaaaggccagaggcgtacagtggaaagtatgggcagcagaaagacatgagggccagaaaaagaagaaaagacacccaaagagctaggggacctgctaagaagggccactatgtcacctagggtttaaagagg

SEQ ID NO: 51690 - DNA, 1316 bp, Bovine  19866880518999
ttcaatgacttacccttctactcctttcaagtctgtgagtaggttgtttcaaattccactgagcagtttatttatcatccggaatctcagtcattgaaggatccagaatatatcaaacttcccaggtctccatctgggcacccttcttagttcaggaagcaattagtctgagaaagacagaagagagagtgtaggagcagaatatatatccttttaaaataatttagtaacaaccctaggtaagtgaccaataatttatagagtctattctctttatagagatatttccttgctgctcaaccattgagcttgccgggtttagaggattaatctttgatgtagtaaatatgctcaagctgtaattcagtagcagggataaagggaacttagacttgtcttgtaaggaaaaaatattaaatggatttgtccaggaaccgccattgtagtcctcattgtctcttgtaccttcagttcagttcagttcagtcgctcagtcatgtccgactgttttcgaccccatgaatcgcagcacgccaggcctccctgtacatcaccagctcccggagttcactcagactcacgtccatcgagtcagtgatgccatccagccatctcatcctctgttgtcctcttctccttctgcccccaagccctcccagcatcagagtcttttccaatgagtcaattcttcgcatgaggtggccaaagtactggagtttcagctttagcatcattccttccaaagaaatcccagggctgatcttcagaatggactggttggatctccttgcagtccaagggactctcaagagtcttctccaacaccacagttcaaaagtatcaattcttcagcactcagccttcttcacagtccaactctcacatccatacatgaccacaggaaaaaatgcttgtaccttagcatcctacagtttcagaactgcaaggggccctctgatccaatgtccttattttacagatgagaagactaagagttatggcactacagatggtcacagatttaggactggaaccatgtctcttgcctcctacttcaagacatttaatactacacttcgccatgcctgtcacactcacactctacatttacttgcaaggatcccatatcaacttccttccactcagttcttttctgtccctccctattgtctattagccaaaccaagctgcttcctggactcctgtccataccacacattttctggcttctcaaatgtcccttaaaccacttccatccccaggctcagtcgtatccgacttttctcttccctctgttccctttcttcctctctaac

SEQ ID NO: 51691 - DNA, 4049 bp, Bovine  19866880543271
atccatacatgaccactggaaaaaccatagccttgactagatggacctttgttggcaaagtaatgtctctgcttttcaatatgctctctaggttggtcataacttttcttccaaggagtaagcgtcctttaatttcatggctagcctattaaagtgcagaactttgggccccatcacagattcaccgaatcagaatgagcattttaacaaggtcccaggtggtgtgtatgtttattaaagtttgagaggcactggtgtgttggataaggttctgctacttaacagctgtgtgaccatggacaagttatttaacttcttcacagctcagtttccttgtctgtaaagttgggataataatagtatctcctcaaaggtgttgtgagaccttagttaacacatgaaaagtgcttagaattgcaactgacacctggtaagcatgcagttaatgtcagccagtattactcttctctctgatgcactcctcaaacttcattaaggggaactggctgaacttaacgggacaggataagagaaagtaggggaatacattctatgtgtgtgtggtgggggtgaagagaagggcactgattacaggaggaataacttttttgattaataacaacaaaaaatttgagggagacagcatatggcctagccggggctacccagagccccagaagagtgaatgatggattcattcatattcattcattcatatgatggatttatcagtagatacaacgccaggcctacagagtggtaaacaagacagacaaggctccagcccctaaattagggagattcagaatttctattaaacactaacaagaagtgaaggcctgtggatgctatatactgcagcccatttagacagcccaattatgaggccttggaaatttggtttgactctctgcccagatcttatccgcctagagtctctgttactcttctctcttctgtatcccacacccactgtcaccggaagcagtcatgccgctctcgttggctgtgtcgacggctgagtggaacacgctgagagtaaggactagcctgcccagaagccagttgttcacgttgtcccagttttctggaactgcctttctttcatttttctttcaatcattggttttcttatttttattttatatggtagcagagtccattaacaatgttgtttcggtttcaggtgtgcagcaaagtgattcagttatacatgtatctattttttttttcaagttcttttcctatttaaatgattgttaccactgctattttgatcaccacttttaaggacttcctcctagagtaagcacccccaaagtggatgtttgtcaggcaggagcaggggcgaacttcatagtttggtagcaggagtcgggatgttcctaagaaagtcctgaaagccttggctgtatttcttggttttgtatggcaaagcctggcctctttgtagggaccggaagctaggattgctctcgaaactggttctggaattgtctttctaaaacatagatctgatcttgttactcctctgtttggaaaccccgaatggtacacaaggccattcacactttagccccaaactgttcggcagtttccttacacctctacctagtgcagtgtgcactctacaccttaattacaagagtggttaaagactggggctcttttcagaactaggtttcaaatccaggctttattgcccactattgtgtgaaattgggcgagatactctacccaagccttggattttgcatctgttaaataggaatagcaataatgaaacagtaattttcaaaagagctaatattattctgtgttaagtactattctaagcactttccatctactgagtcacttcatcttcacaacagtcctacctcatagcattgttgtaaagattaagtgtgtatgtaccatgtaatacacatgaagtaatattaactgctattattattgatattaatattacaaagcaaaaaagcttcattgtgctttcatattccctgtccctggaatgaccaactccctattctgtgctgaaaactcttagcattcctccagaaacctcagctttttgagttcctatacacatagtactttaaatatacccccctatagttcacttatcctagtacattgaaaatagtctttgcctgcttttctctaccactagactgtgagcttctcagcagtaaatatcctgtaatatttactttatgtcactagggctgactctaacataagaaacatagcaggtactacatgaatgttagttcaatgaataaatgaaagtctgactgaataactaaatacttataagaaaggacctcgcgtgggaagtccaagaaaggagttggggagtaaaacaatctagatagcttctgcctgtatcccctagcctctgagcagcaaagccattccccagcccaagctgcctcacatgtcaccggatggattggaactccccatcaagaacactccccgatcccctcttgctgtagacacaccactcgcctctggcagtgacagaaataaagaggattacatcatttgttacaacaaaatggttattatagtaataagtataattagcatcagacaattacaataataacatatttccttgctgcagaggtacttttttaaaaaacaggtttattttaataccccccccccccacacacccccaagaagaaaacaactcttttcgggaagagcaaaggcctctttcattctagtgagatgctatcttaattaaggaacattattgacaaagcccataaaatgggagcagattcccttggagcaaaacctcctttgctctctctggtttcttgggggaaaggaaaatcttgtgcctctctttctagggattaggagaactggttgaaggatagaaaagatgaggccggggagaaagaaagaaaggaaaggaaaaaacccttctcaaacaactagagcttaatacccgttgtcgacaatctcccttgttttcttcctggttggatggacctggaagggaagacagtctatttatttatagaggtaaatagtggtatcatttatggatagaggtgaatacgtgctttaggtagttttccaagctccataggagcaagaagtgccgagagcacagggccccaagaggagcctgaaggtgggtaaccaggcataatgccactccgtgcacaggcccgtgtgagatgcttaacgacatcacgtttgttatctcctgcttttttccgaaaagatttgggggagcttacactaatctgtaatgcaaaatgtaaaaactagatagatgataaaattaggatccacataaacatttcaaaaacgtgacgtataggtacttccctgatggtccagtggctaagacttcaagcttctgatacagggggcccgggtctgatccctggtcagggagctagatgctcccacatgctgtgactaaagaacccaagtactacagctaagacctggcatagtcaagtgaataaataaaaataaaaaaaattttaaaaatgacatatacctaagtacatgtacagtttccatacatacctacaaatatatacatagacatgtaccttgtacatagcaggctctcaataaatacttggtgaattactgaaacaaactcaccccaaagacaaagaaatgtaaaaataagtgacttgaatagatatagcctaagatacagagataaatacgaataaatgttcatatataaaatatatatgtgaccccatgccttgtatatataaaacagaccactctctaaatacacatgtcgtgaatacaccattttacacacacacacacataaaaattgaacctcttccttttacaatagacacagccatagttagacatgtgaacacttttcaaactcatatatacacataaaacatggccacatttccacaaatatgtacaagtgcacacttactcatataaacacacattcatacacatagacaggtgcatacagagtactcacacacaaacagaagtcaaacagaaacagctatgaagatgcacgt

SEQ ID NO: 51692 - DNA, 1546 bp, Bovine  19866880556857
aacactgagggaaaaggtgtggagcagaacgggcatttcaggccttaaaggtttggggctgatccagagtcacattttcaagtaatatgatttggttcttttgtggccttgaactgacctcacattgtcacccctgccgtatcaccataggctatcccaagtactcagtaaatattcttgggttaatttcaggcaactcttaatcagttgtcttaataagaatgaagtggacaatgaacattttttattattaaaaattatattaaattatgattaaaaatgttttttctctgtgctgtgcagcttgcaggatattagttgtgggttgaacccgggcccatggcagtgaaaacactgagtcctaaccactgggctgccaggaaactccgcccaaatttttaaatttggtttgcccaaggagttacatcttagcaattatgatttatataagcaatcccatttgaaagagtttgcaatgctgatttgggaatgactgggatagggcagccaagatgtgtgtggacaggaaaggaaaagtcatgttaggttttttaatttctctaaagatagttggcatgccaacgtttaatagttgactctttgtactcacattcttttttttaaattaatttctttttaattggaggataattgttttataatattctgttggtttctgccatatatcaacatgaatcagccataaatatacatatgtcccgttcctcttgaacttcccctcccatctcccatcccaagtacccacattctggactacatgatttatggaaatttctttaatgttcctagctttatttgtcatagtcatcatcagatgtagatatatctcagggttgtttctctcttcttttatataaactggtttatgccttattctggtagagtattaaactgtctataaagctccctaaattaatcacccagtagtttaaacatagtaaacatgtgaattgtctcagttaattggcccaagaaattgtgttcatccacaccaccatatttcttttctctcctcacactttccctgtcactctaagctaatatcagaagcaagaaacatttgttcttgaaaaatgctgaattcatatccagaattagagcaagatcttaaagaggaatttaagagggacttccctggcagtccagtggctaagactccgttctcctaacgccagggcctgggttccatccctggtcagggaactagatcccacatgccgagtttacatgccacaactaaagatctcacatgctgcaactgaaaaagcctgcagaccacaactaagatccagcagagccaaataaatacatattttttttttaaaaataggaatttaagaaatatctcactgacttggaggattaacagatgacttatggatcaatgacttctgaggtgaccaccttgtgttcagggagcagaaggaaaatccagagacaggagaccctcttcctacaggtggagtccagtcccatcagggagacgggatggcactcatgacacagaggccaaggcaaagaaaga

SEQ ID NO: 51693 - DNA, 1086 bp, Bovine  19866880667135
aaatgcttgtgaaatttatttacaaaaaattcaggccccagcataggggaggtgcccaatcccatctccctattgcctcttccaccctaatcttttttatttttttccttaacaacaacaaaaaaaaggaggtaacaaatgcatagactatagctataaattcattgaagtggggcgcggctaggaaaaagattaggaaacctcgatgcaccagttaagaaatttctaaagagggttctacaccttcaaggggagaacagctaggctcgggtggggcctgggcgtagacggaggtaggacacgagtttgcacacctaacaccaggtcaaaggaacagaaatttcacagcaaggcggggtcacatttagctgccccctaccaatggagctaggtggggtagggatggggagcccaggaagtctcccctcgcagacccggtgtcctagcagatcttgtcacttgggcaagggaaggcttttagttcaaggattgttcagttcaggcgcccactactctcgcccctcccccacccaattcgagcagcaagacatggtcgcgaggtgtgttttcttttaaataaagagtcttggcctcggcgccaacggtgtccactcgccgtgggtcagacactttccttcatcccccattccaggccctgtccctgtcccacatggagtcagaccaaggtgaaggaggttgtccagaaagacgtgcgggaaacggcagtgggggccagccctggccacagtccagttttccacccgcggaaagtaggcgagttagaaaataaaaaataaaaataaaataaaataattttcccctttcccccctcccctcaaaagggcccagtctgcggttacagcagaggatttcccgagaaatactgcagccggtctctgcttagttttttttctttcatccttctgttctgaaaccaaattttcacttgtcggtccgtcaggttcagcatccgagacagctgcagccgcttctctttgttgatatacacgttgaagaaaaactctcgctccagttcccggatctggaatttcgaataagggcagcgcttcttgcgggtgcgggggg

SEQ ID NO: 51694 - DNA, 3279 bp, Bovine  19866880713468
ccttgggaggatctagggtgacgaggtcccatccccccatccttccttactcgcattaatgatcacatttctgaaagagcctggaggggagattcccaaactcctggttgcagagtttcaggttgagaatgaacagataaataatgacttgccaaattaattaattattttattagcctgagtaattattaatcaggtcattaatcacccagctgtgcactatgaatagtaattgtgtggtggagggtaggggcgcaagcagcagtgaagcaggttatggctttaagggctgatgatgtctggaccttctcctggtccttggaagatttggggaggtttataggccccatcattccccacccccctggcccccactcatgcttacagattaggagttgaacgggatctacctggactccttttttggcaagggcaggtgccaacttcatccttctcttcctgatttccagagttcagatggatgcaggacatggcagccaggacgtgcacacagagatgaaaggaagatgaagagaacttacacttatgagggtgtgtgagtgtgagtgcgtgtgagtgtgagtgcctgtgagtgcgtgtggacagggtgaaaatgtggagagaccagtagggagatggagagacagagagacagagacaagtcctgaatgtgctgggggtccctgcagtgtcagtctgctgggtcagctgatacagaagagtgatgctgggattgactctgagttttggaatgatgctttggaatggggtggatgctgcgggagaggaggggaaatagaggaggaagagaccagaggagggagaaagggaaggtgagacagtaaggagaatggggcaggaaggaggggaggatgcaaagggctggctctttgaatttggagccctgctgactccagtatttcatatttttttcttgctgaggtatctgaggattccttctgtgccgtctgttccataccacccacccttctcaggtgcttctctctcctgaggtttggagtgggcctcagcttctggatcttccccctcggctatttcctgggattctgcccactgccctgtggggctggagggaggggagatgcgaggatcaacagaaaaggcaaagtggggtagacgacccttgcccttgacaccagcaagccattctgtaagtttcacttccgtctttcttgctccatcaactcacatccgtggtggcgccccatcagttagcagtcagctctcatccctcgtgctgtccctttcccaggcctccttctcccggggccaggtgttcccagggccccttcccttcatggcttacttgggaaggggtcagtgctcatgtttttaactgccccaggtccctctggcatagtctatttcactttctgtttatggtggatttcactctttatttactgtagtcctgctttgtttatgacctgcttagggtcagtttcagctctgtggctccagtttctcccccatgccctgtgtttattcctgctcttgacatcctctttgcaggcccttcctcaagactctactctgaaacgggtggggagggggccctcacaggctcagctccacctgtctggggcccaggctgctctgaggatatggaacccacactcccgaggccccggcctgtgggcatccctgctcagtatatcctcccagcagggctctgggggtgggcagggggtcaggcacaggggcagcttctgacaagacagagcctgtcatgagataaacacaaacacggggcctggaacccagcctcttgtttggaattcttgacagttgggttggtggtgggatagggagggggtagttggtgggaaaggaattgaaagaggggagagcagacctcctggagtgtctggagactcagaaaaagggtactgtgggccccacagcccttgacattgctcgaggactccttgctgatgactttgaaggaaaggtctagcgtccagagtccctggaggttgagttcccttcttaggaaattgcccagtggtgggcatgggccaatgagctagaggaggggggatccataaatgttcagtgcctgggggccaggaagggtaatgctatgctaccttagctgtgattgcaagttcttcctctggcccgacttctgtaagggactgggggagtggacaggaggaagggagagcggagaaggccgggctcctgggtctcccctcctgatctccctgggagttgttcatcttcagccaggttctgagagttatctggaagacactccagacttgcctgcagacagattaacctcttcccatccttggagtgtgcgagagggcgtccttctcccatccctagcatcccctttctgtgtgtctctggaggtatgtggtcccctagccctccctgtctttgtcaggtgggcacgtctctggaaaggacctgtcttacactttcccttgctcccttcccatcaactctccctgcatcactgggaagcccttctagaaagccttccttcatccctcttccattcagtttcatccgcccaaacttttccctagaatacagaggttctagtccttggctcctgctccgagccctctctgggtcctattgcccttggtgtttttctgggttccatagaggttgtccctgtacttcctgcaccgcgaacagcctctccaccttccttcctggtggctctttgctcccaaagcctctgctttctaggccccaggtaggggaggagactgcagttctgcccactgccagcagagggcaacacacccaagcccaggcagaaggtgtggaggctgaacagcctgggatggggcccaacctgctgagccctgggaggtagtagcgcagggactggcttgagagtagaattagtggaattttctaggaccactgaacggggtgggactctctagttcttgcctcatttacaaattctgtaatagctaataatatcggctaccatttggagcagatgctttatttataatatgtcaagttctgaaaataaccgtgaggtaatattattttcactttacataatggtgaactgaggctggggaaggttaaatcatgggaaatcatgtgtccaaggaattggcagagctgggacttggtcctagtggggtggcccaggcccaggagactgcttcctccccacagacatgcagtaaggagcctggaaggagcctggaaggggcccttgtggcgcccacccagccccctccttccggtgcccagcagggttcaaaggaggggttg

SEQ ID NO: 51695 - DNA, 859 bp, Bovine  19866880742592
cagataccagcccggcctgggcagagagggtcagggaatgatgtcccggcccccagcttccaacacagagagaaagaccaggaaaagcctgaggtggtcaagcggcccctgggtgtgggggatagggcccagcagaccccaaaaatggggagcaagggcaagggactgggacgtcaaactccagggacaggcacaccaggcaggaaaataaaggagacgtgaaagaggggggagggaaccccccccaaagccatataattctcaattgctttggtctttaatttcatcgccccataaatgaggaaatatcagttcccatactaaatttttatccttggctgataaatatgacggggaattttcgttgggtcctcgtaaaagcgaacagtttcgatcaaactggtggggaaagacttatgcagataatacaaacagagttgccataaagtctccgcgtttcccgcggggtgggcggtgggacaaatggctccttggattgactgccgccccggcgggccaagtctcatctggggcctaagcaggctaaccttgcccgggccatccccctgtgccgagcccactgcgacccctgcaaatgaaaacacgaaagcatttcaaatctcccttggctggccgggtcagcaagtcacacattacaaacattttcttccagtttttcctggggttcaggaacccctgagccttctctctcgccctctggatgcaagaaatcccggatttctttccgaagtcgtcttctagaagccgccggcttgggcctccctagaagggatccagtctcctcactccacgccagggcgcccagggctcagatccctttcccggcccggctccaaac

SEQ ID NO: 51696 - DNA, 3684 bp, Bovine  19866880775622
ctggggtctcccgcactgcaggtgaattctttaccaactgagctacccggaaacccattgatttcatacttgtggtaaacagcaagaaaagggcaatgtgtggataaggattaagaagttacatggagatttttatgagacaatatcatacgacagcattgtaaaatgcaaatgaaagaaaagggaaaacagctactgagaagactttcttcataaattcacttaaggaaacacagcccacatatagaaaatggctcaaaaacacttacaaagcaatgtataaatactgcaaataaatacaacacagatcgagtcccctggtgctatgtaaacagaataaacaagaagccaatattggatgaggagaactagggagtgcttcctgcaggatggagatctaattattggcaggcctgggataagggtatgttaaatagagttacttgcaaatgaatcaagccacattcggaaaacaggcagggtgagaaaatcatcagagccccccggctcactcccatcgcggctgttttcctgcctgccacattgagcacattactcatttgctactttgaacagtctgttttcgtttcctatgctggcagacacccctgtcagacgccccactcggtttctcacagacaattatgactttcagatttcctgtggctccaggagtaagggggccaggtagccctagaccgcaaagaggcaattatctcggtaatttaggtgtcaaactactttacttgagtatcaagctcatctctccagttttctgctccccacagcctggcagctgactatcctaagaccaacatatgcagcactgagtcttggaaaatctaaaaatatccaataaaatgcagctgtatggacatcaggcaggacctttgggcccctcaaccatcttttccatctgccatgtggtttgacatacacagctatctttaagttgttgttcagtcgctaagtcgtgtccattgatggtagtacgccaggcttccctatccttcactatctcctggggtttgctcaggctcatgtccattgagtcagtgatgctatctaaccatctcatcctctgctgtccccttctccttttgcttcaatctttcccagcatcaggatcttttccaatgagctgggtgtttgcagtaggtggccaaagtactggagcttcagcttcagcatcagtccttccagtgaatattcaaggttgatctcctttaggatggactggttggatttccttgcagtccaagggactctcaagagtcttctccgagagcacaatttgaaagcatcaattcttcgatgctcgtcttctttatggtccaactcgcacatccgtatatgactactggaaaatctttaaaagcctatgttaatttcctgtagatggatgggtgaagatcagcttctggttttgtcaggtttgaaaatcaaggtagtcactgacctagaaaaggactgtgagtctgaaaggactcctcatggtgatctctaaactgaaagactgttagcctagacttttgtcaaaaagtctgctgctctagaggtaggtttgagaagagtttaaaaggaaaggatttggtaatttaaacagttgtggagagggataagaagaggaaggagtcaataaaggtgaccaggcttctggtagaggcaactggatgcccccaactgaaggggggtctacaaaagatagagcagtttagagaaagtagatgagttctacttttgagcacattaaatttgagctacctgggggacttccctggtgttccagtggctaagactgtgcttccaaggcagggggcctgggactgatccatagtgagggaactagattccacatggcgcagctaaggcctggtgcacccaaataaataaataaataaatgggtgttgccgtcgtttagttgctgagtggcgtctgactatttgtgacccccatggactgcagcgtgtcaggcttcctgatccttcactatttcttggagtttgctcaaattcatgccctttgagttggtgatgccatccaaccatctcatcctctgtcactcccttctcctgccctcaatctttcccagcatcagggtcttttctaatgagttggctcttcccattaggtggccaatttgaattttgaaaaatatgagccacttgggagtggacagtggctggatacatcagtctgttctagccttgcctactctgtgtattctgttttatttcatgctaatgtaatggtttggtaatggtttgattgtataaggcaaagattagggggaatttaaaaattagctccacgtttccacaaactggagggagtactcttcctagcagtgaggaaatggggggaagagttactctacccttaacctcctaccatatttcatgtcctcagatgatacatgatgtctaacatttctttagtatccatctgcagagaacctcagatggggtccactcacaattggggctaatatttgttgttgattaatgggctggggaaaaatatttgaaggctcttcaagagaaacctcctccctcacaacttgctaatttattgggggcagcatgtgtctttggacccagtatagaccagtttagacgaatgtagctttgctatttcagtctgctctctttttttccttttttgaaatagtcctggttgtatctattcactaggtttttaagttgtcaaactatattaaactgaagttagggtagatgatttcctaagtctgtcaccatgactgcattactactattttagtctattactttatatcataaaaatggatcgggagacaagcccagcttgtcccacccccatagcaaatgtacacgtatcaaatagtgctaagaggtcacagggagacaatctgacctgagaccagagactttggagccatctatttgtggtagagaccccttatgctcccacatatgaagcagtagagtaactcttccccccatttcctcactgctaggaagagtactccctccagtttgtggaaatgtggagctaatttttaaattccccctaatctttgccttatacaatcaaaccattaccaaacctctcacgttcttccacctttttctctctcaggttctgctcttctcttctgatttcttggctctagacatcagagcctgaagtagaagtttctgtgataacattttattgaggagtacgattccaggaaagcaagagtgaaggatggggaaagcaaagcagaaagaaggagcaaatcaaaaggattgtgttgggacttccagggtggcccagtggcttgggactctgtattcccaatgcagagggcgcgggttcaatctctggtcagggaactagatcccacatgctgcaactaaagatccggcgtgccacaactggggcctgatacagccaatcaatacatttaaaaagtaaacgttaaataaaaggattgcgttatatagcttaccacggcttctggaaaagttgtagcttcacatgggaaagttgtcttcaaatgagccatgtgaagcaactgtatccccagtctatctaggggaaagaaggaaaacatttaactgtagctcacattattaaatttctgtcccttgaggtgtttactatctcatgtatgtgagtgtgtgtgtgtgtgtgtgcgcgcgcgcgctgtgcacaag

SEQ ID NO: 51697 - DNA, 1047 bp, Bovine  19866880791998
aaatgctcctctaagtttcgatcaagttaatattgcccgcgatggtggcgcttttaaaaatttcacagaccgaaggagataacggagaggggggttcacccggcttttccaaagagcccttttccctccctccccaccccttctccatcgtaaaaagtcgagtcgttgggagagagggctttgtaggttataataaaatcctttgaatgcttataaaactccacataaaattggactgacccaaaacacgaggccgtccccgctcccctcgcctcccccctaccctcgctcgccctccctccctagctccctccctcctgcccgcctgcttcccggccgctgctacctactgggggcggctcccttggccggctccttggccgccgagtgggctgaaccggacgagctgggattcgtgttctcctcttcggcctcggcctcggcccccgcctcagcccgggacgccagtcccgaggctgggggcgcctcaggctcccctttggcctcacccttgcccgggcaggggggctcggcgggcgggtcgccgccgccgcagtaggcgttgtcgaagaagcggtcaaaggcttggggcaggacactgttcttgttgactgaggagtagaagccggcgggggcggcgtgcggggcgctggggtggtggtggccgccgtaggagccttcgtttttcatgaggatctcggtgacggtggaaggaggcaggcactcccggtgcatgagctcgtcggccgccgcatagcaggaggagtagctgttccgggggtgccacttgccggagggctccaggccgtaggagacctctcggaccgggggcacttgggccgggtagggataggagatctgacgagagggggcctggggcaggaaggaggagaccgtggagaactcaggcacgtagtaagtgcaactgggcagatagaggttggaagcgcagctccctcgctcgccgaaatcggcgcccctctccttgcgcgacggcgagcagaagttgcccaggttgccgagttaaacatcgttctcttctgccgg

SEQ ID NO: 51698 - DNA, 1059 bp, Bovine  19866880808982
ttggagaaaagtttaggtgtttctagttgttattttgtccagaggcacaggtttagccccataaagatccctatccagccagggtggatgcctgtctgaattttggcaatggcaacaatgggaggaggcggagcagcacgtgggccctgtcatgagagggcacagggcagagtgcagcagctcggcatccccaagggggtgacactcggtggactggaaacttctcctgtttggaaagcttcaagactctgcattcccagcgacttctctctccacaattttcttgcaaccaatgacaaagtaccaagtctttcctcttggtaaggagtttcatgaaatctaaaaggaaagaaagaaggaacctcaggacaggacacttctcccccaaattagggagagggacagaagggaagcacctaattcaaagcaagcctgtttaccagctgccagcccagacacacccccaacaaaatgccatggagaacgatgtcgtgactcatggcttggcaagtaccgggatcatgccccgggctcccagataccacactggctcctccaggtcgctctggctggatctcctcctcctccttttccccagaagcattcctcatcttgccctctcttcccagcccctcctctcctcaaatcattctctgcagtgagaggtggggggtggacaagcagaggtagaactgggattcgagttagggttaatttcaggatcaggattaaggatgggattaggaatggagttaggggcttccttggtggctcagacggtgaaagaatctgcctgcaatgcaggacacctgggttcgatccctcagtcgggaagatcccctgggagaaagggaatggctacccactccagtattcttgcttggagaatcccatagacagaggaacctggtgggctacaggccatggggttgcaaagagtcagacatgactcagtgagtaacactagggatggagctactttgagactgggtttagtcagcggacttttgtcggtagagacaacaaaactctactaacttatatgcattaatgtcttgg

SEQ ID NO: 51699 - DNA, 1209 bp, Bovine  19866880855591
cacacagggggtcagttcccaggtgagcaaccccagagctggtgtcctttccacaggtgaagatgaaatccgggtaacaggaggggcaacaggggactctagggggacttccggataaggatgtggggtgctgggaggccttctgggcccctcctcttcccaagggtgcaggcctctcaccttccaacacttcagtcccagtctccccagggcctagggatttctgcagtgaattcccaagcactatacctgctgacatggccctatgaaagccgttcctcccctggccccaccaggactggacccctgtctcctggtctcctgggtggagggtgctgccctcccacaaagcctcaggtttccacttctgctttgggagcgatttctccgggaggtggaatatagtgctctggccagagtttcagagccctaggccaggttctggttacccctaatccccaccccgcccccaccctccccaggctttggatgcctcttccttccatggctccagcccttctcttctctccatgctctatccccctggacaccccacagtctccctctcccacagctccctgagagctggtccccccactggtttttccaccctcacactgcctctccagtacctggtctccccttccctccaccgtgagccctagttctcttcgtcctcttgcccaagtccctttaactcctggttgctgcctacggtcaccttttccctccctcctggcgtcttgtctcccttgctctccagatgctccttccttccacgacccccagacactacccgtcccctaatgaacctgttgtctctctcccctgccctccaggatccccagcatcccaccctttgtcccattcttgggatgaaccagaacaaacagtaggaaggctaccctctgccccacacctccccttcggggggggggttcccacccccaaccccacttttctttaagtttccaaatcaaccttcctccaataataatgataaagcaggaagctgggccggaggacagtgcagatttttcttcttgacacggagtttccgattaaaggcaaagggacataaatcctcctgcgtaattgctgtgctccagcttggagccactcagagggggaggtgcccacccctctgcccctgcccctgggagccccacccccatcctgagcagggctcattgcccccagagcctgggg

SEQ ID NO: 51700 - DNA, 744 bp, Bovine  19866881064432
gtggaggagatcctctgctggcggagggagaaaatgtcagagccgcgaaactagttaactattcccgcgcagaaaagacagtgaaaatgagggaagaaggttcaggtgaggagtggagagatggtctcccagatgttcccgcctgggacccctccccatcccttccccatttcctgagtggcaatcgggctgggatcttgtggtgggagggggctcaagggagctacagaagacttggaggaggtaagggcgctgctgaccccggaccgtttgtgtgagcctgaaaacctgactgggccccctcatccaagtttcctctcaccccctgctcctccagactgcagagccctggaagacagcacagggggagggaccttccaatcttcttgagtcgcataagggggcctgggagacagggggctctgacccctggctaagctggcgaagcagaagaaagaggagtctgagcccactaccaccacccatcaatcttgtctgaacccgacaatatcttgtcccaagcccaagatgccccaaaaggacgacctagagagagctaagaggtcgggctggggtgcagaccttccccacccgccgcttctcatttcccctctctgggccagcccagctcctgctcacctcccttcgggacccaaggccctgccttatttgcatacgcagcagaaccgctttgtgcaaactaggcagtgaccttgaactgggccgccttggcctctcgactga

SEQ ID NO: 51701 - DNA, 748 bp, Bovine  19866881069214
tgagtttcgttgtttaaccctaaaatgggaataataaggacctctttattgggtgactaggaagattcaattagacttggatatggaagttgtctcacattcaaatattagcttctcttcccttaacagtgattcttatttctatgagaatattacttcagaagcataaagaaagtcatctaaaaattactcaacataaaaatagccacttaacagctttatgagaacatatctggtgtgtagagctatgttaatctatgtaatccttttttacagtagctggttaaccttcctaattctgctttgtcctaaatgacatgaaaaagagtttggtattagtattccctgccttctcattggttagggatgggaggagatagccaagaggcagaccagggagaccatcagaaattgatcaaaaaaaaagaccatgggtaaactccaaaatggataacccccacagaaaaaaaactgagaccgtgacagtggctaaaatgaaccaagtgctgctacatgtgaggctttgtgctaaggctttaccttaatttaatgcgcataacaaacatttgagttaagaactattattgggcccattctacagatgaataaatcaaggcttagagaagtttagtaactaattcattcaaacagatgaaagtgacaaaggattcaaaccctaagtctctgccttcaaagctcagattacttcttctagagaaacatagatgaatcccaggcttgaaacatg

SEQ ID NO: 51702 - DNA, 1438 bp, Bovine  19866881123275
agtagtattaattcagtctctcaattgcactatgaggagtggggaatggatttaaaaaatgcagacacggctctgttgtcaaggatgcacagactaaaacacatcaatgagggtgaaacataagaaagatgaagaccatcagtgccatacagtcatccaaagaagggcatcaggcaagggaaggctctgggcgtgcttggcttgagaaatgggaagaggtggctaatcattcatgttttgagaaactctcctcttattggcccaggagagcttctcaggtatagggaagaaagcacagactgctggaagaatgaggaaaagaccatctaatagtctgagggaaatcaaggccagacccaaaatgtgaaaaaactgccccaaaattatgaacgaggaaggccaaggtaagtggtggtgaaataggaaaaataggcctaatgtgtatggctgagtccttttgctgttcacctgaagttatcacatggcttgttacttggctatactccaatacaaaataaaaagctttttgtaaaaaagaaaagaataaaatagtcctgattcaaaagtgttagttgctcagttgtgtcagactttttgagatcccatggactgtagcccatgaggctcctctgtccatgggattctccaggcaggaatactggagtgggtagccattcccttctctagggaatattcccgacccagggatcaaacccaggtctcttgcattgtaggcagattctttaccatttgagccaccaggaaagccaatgaaagggtctcatgaattcttctgaaagttgtaggtgtgctgtaggtgaacactaggagagattgatgaaggatgtgaactaattaatcaactggaaaactggatgaccagactctagatgatccataatggaatctatactcccaagttgtgtgacatctccccacttaccccacctctgcccaagtggccatttcctctaagaataatctcctccttttcagcatcatgtttgtctcctccaagaagccttccatagctaatggaatggaaatgcccttctccatccacagcaatttggatcttggctgctctacgtactactcattcattcctgaccttttgtcattcactgtctacctctggagactgcagtctgtctcatcttttttagaagggtactcagaagagaaagcatcttatcctcctttgttcattttgcttcccaaaattgttcatggcaggaaagcacagaccacccaaggaagacagccatcagatggctccattccctgcatcacagactctgtgacgggctcttctctcacactggagttatggagcaggagttatagctctccctgtaaaaagtcattataattatgaaaaatgtctacagctccttccaccgtttaggcaaagcctcggctgtcccaatagcagaga

SEQ ID NO: 51703 - DNA, 974 bp, Bovine  19866881265497
cggaggcagccgcaccgcaggggctgataatcccacactcgcctcagcctcaaaaacgaatttctcctcaccgcctggggagggtcggaaggcctgtttcttttcatcctttcattgcgatgagttgagtcctcccaaccgcttctagaaaagtccgtccagatgtctaaccacagtcacacgtgctactgtttcagacatttttccctgtgatttggtaagaacactattcccgaagtgccggtggttgggttttgagggtgtggaagcgggatgaaggattgccgggcacggctagccactgagcaccccctcgcctcccccacaccaccccccgccaggcaagacctagaagggagtctggctggggactgtcatctcccggctgttgccctgttttcttgcctgctcttcccacaacggccacaaggggtcttccttgcgctaagaatgggaaatccttgcgccaggtcagaacgctgggaagctccggcgcctggcgcagtgtcctctctgcggtccccgagcattcagacccgcaggcgtccggctagccccgccctaccttcgtggcttcacccggttgtagatgaccttcagctctcttgactcgagctccggactggagatcggcactctaagatctcctgctccttcctccaagcttaggaagcagcagaaggctaggagtgagtcgaggggaggaactcaggccggacacatagtaggcgctcaataaatatttttgagatgaatgaaagaacgtggcggtgtcctgttcagaagctgggggaggggacctcaaaaaaccgaagggcaccatagaggcagcgcactcaacgccctactgaggaaactgagcccgtctgtggaccctggcgagtgggacttggacatcagcacagcccgggaggtccagtacagagaggggatataggaaggggagaggacaaccaatcagaaaacacttttgg

SEQ ID NO: 51704 - DNA, 830 bp, Bovine  19866881324613
ccaaagagggaagctaagatataggggggcctgtcccccaaggccagcagttccctggggagaggagaaaggcttttcccatcccagcatcaccctgagaattcgcctcagcagggttgaattccaagagcggagatggggcgctggagagggtaatgaggggcttggggactctcagggtcaggaaatagaactgctgaaatttcaggacttggtcgtgggctgggaggatgggagggggcagaggaggagggaagtggggaggagagagacctcgctataaaaataaaaaacaagagagagaagcgtttatgggcctatgaaacggttgggaatttggactttttatgaggatattctcgagttactactcttgaagctgaggaggaccagactgtagaggctttgatagcttcgatttcctatagttttaggtgctggaaactgaggaggggaaagatagggaggggggagaccgcaaaagcagtaaggggggtggaattcctaaagcaaaacgtgtccaaattcaggttcaattattgggtttggggagcctggctgagcctgaggatggggtggcaggggtcctgggctggaaaggggctccactgacccctgcctgtgtttggccctccaggcaaccccgtggccaactggattcacgcccgttccacgaggaagaagcgctgcccgtacaccaagtaccagacgctggaactggagaaggagtttctcttcaatatgtatttaaccagggaccgtcggtacgaggtggcccgggttctcaacctcaccgagcggcaggtcaaaatcggtttcagaatcggagg

SEQ ID NO: 51705 - DNA, 1093 bp, Bovine  19866881374603
cgtttatgattcgttttttattttggatttcttccccaccaaaagactaccacaatgcctatcatgtaagagactcataaatattggagggggtgggggaatgagttaacagctggtggtaggttggatgggaatttttattttcatctcagagaagacagttaaatgacttgcttaagagaacttagagatgaaaccgggactagaattagagtcagttgacacataagcctgtagctcttgccttctgatcaggctttgaaattctagaacattgaaaataaggccttgtcactcttcggtgtatccctggccttgctgtcttcaggatgggtccctaaagattaaaggtaggctcaaccttaagacctgagagagatgccagacttggagcaggcagtctgctaatgttggcactgtatggggagatgcaaaggagggccccggagacaatgagttctccacagcgcccttctcagcctttgtttgagtctagctggcccgggtagccacccggacagatcagttaaagagttctgagagcagtctagggaaggatttcctaagtttagccctgacttcttaaatttttatattatattggagcatagttaggatttttttttctctctctttcccacttttccagggctagggtcagagaacaggttgatggatcaagctgttgtgtcaaccttgtgatcccatctgggggaagaggttactcttgacctgcatatggggttgagagggaggagaaccatgatccctgccctgtgggaggcccagatgtgatggaaacgtgcccagagcctggcaagctctcagaagcaagcagagtgcaaaacgggcagctgggccttgagtcaactcagggtgtagaagtggagaggagtctgtcaggaaaggctctttggtagaacgtagttttgttttcacttatttatattggctgcgccgcgtggcttgcaagatctcagttccctaatcagggattgaacccgttccacagcaggaatcctaaccactaggccaccacggaactcccagaaggtagttttaaacagcattaaaaaagatgagatggacacag

SEQ ID NO: 51706 - DNA, 1374 bp, Bovine  19866881516841
gtacttgctgtgcatgttttactctgttctcatgacatcttgtgagaaatagtctattattcaattcagatttagaaagtgaagttcaaagggttatgtaacttgcccaaggtccaaaagctagaatgatcaaatctaggatttgaacccaggctgaagcccacttcaccatactctttctaatgcttgacagagactgactataatgccggtgtttcccagagagatgtgggtctggaaggatgctcagcattaggccatccaaccgactgctgcttatgcaaatcctgccctcctccctggactccttccctcacctgagaacttccgtgggcagggcctctctggctgaggttggcttctctctccccacccccaccccttcacaagaagaagacatcaaagatcgcagcagggccataaagagagggagggtgttagaagggagccaccctggactcataaactgggcgggggtgggggtggagacccacccatttgtcagggacactgcatctcactttccccaaaaactgagatgtcagcttttgcttgagggcagggcacttaagtgcagatggctgcagcgagaggcggggtgggaataggggtgatgattggagtcattctgacatggaaacggtgccacctctccaccccgaccttgtgaggccaagacacttgggggggtgtcatttgagacctgagttgcagtttcagttccactgccccgtggctgtgaggaacttcttcctgtctcctcagtctctttaccttgttctggggttgatcttccctggcaccctcctttaccttgctgagaagttcactggagaccacacagtggaggcaacctacagagcacagctgagttccctgggccacaaccaggctgcacatgttgaaggacagctagagaccccaagagtatcagtggtctcatagtcaccatctccttctaccatcacagtcaaccagaacctccaaactcttgttgggtggtgtctgaaactgcaagtcatgcaaattcagtaaaaaaaaaaaaaatgcctgtgttcttagagctaagtgcagtctcctccgttagcctaggagcatctcaaggacagaaatcaagtcttgttcccagataattcttccactaaatagagagctctgcacacaacgggggctcttgaaatgcagtcagcaacatccacatggatcaagaagtccatgttctcctaggcaaactggagaatcacaattaaaattctcccttcctcccaatcacattcaccatagaactgcttttttttttctgaatcaccgtaattatcaacaagcttttattaaatatggggctgtgcttgttgcttgacatgacagatatca

SEQ ID NO: 51707 - DNA, 867 bp, Bovine  19866881569561
ttcctgaggtttatttgtgccgattctctccctctctgtctttgactctctctgcctatgtatatgtatctctatccctagtctcttgtatagtctctctctccgggtacatctgtctccctgtctccgcttttttctctggaatgagtgaaataagagtatcctgaccttctgactggctcttcactcaggtgtctctatctcagtagatctatgcgtttctgtgtttctaaacaaaaattaggcagggaggggaaccatgctggtggtattatcttattgcttaagaattctaggagggaattccctgatggtccagtggttatgactcagtgctttcactgttgtggtcccagattcagcccctggtcagggaactaagatcccacaaactgcacggccttgccaaaatttttttaaaacgtctaggaacgtcaccatccctttgacaaccttcctgccgccccacccatcaccccttgctgccaagcaccaccaggttgccattagagcagcctctccacactccaggtcagctgtcaggacagtgatgagtgaagtgactgacaggcaagcagagatccccagggccccgacccatgattccatcttcctggacgggctacataactgtttctgtccctgtaagcccattcacccctgggaacccaaagatagggagtcccgacatggggatatggggagaaactaagtcctgggcaacctgcagtccctgtagctgatcctagaggcacctgaaggccttctctgtctctggtccacgctactcctccccacctggtgagtccctctcaggaaagatggatgtgaggagctctcccaaaggggggtatagaaacagagatc

SEQ ID NO: 51708 - DNA, 860 bp, Bovine  19866881570598
acgaatctctggggctttctactctgggaaaccaacgtataaacatcagggtggccagccccagtctagggtcttgttgtgtctggacgaactggccatttgtgcttgaggggaaggggcccagccccaccttcccaccctcggggaccagcgcagagaggaaaggtgggggctggctttcccccttctcccctccctccctcgaaactgtatataaaaattccaatacagtcttctcatggttgagggggagaaaaaaaggaaaaccgaaaaccctaccctcgaccctacacatttaactgcgacagacggagacatctggcaggagggcggtggagccaagaaaattcctataaatttaaattcgatgatggttacaattaactccacaacaaatgtgtgcttaaacggaaagcggaaagcattgctgggcatttggacgaggcttgagcagcacgtgagaaaggacagctttgagactcactgtggaaagtcctcagcctgaaagctggaggaagctaccgccacactcctgcccctgcccgtggaaaggagggagcaggcccgctagctctggcctacttcaccttcacatgctctgcccgcctgcctcctcctccgcccggacagcaccgagggttttaagaggagaggggctaataaaaggatcaaataaaatcataatattgaacagaatgaagtatctttatttgccacaaaaaaaaaaaaaaaaagtcacagcaatccctctgggacagggagcgagccggatggggattgcacatgtacacacactcacgcacatggagatgggtgattccaatctcattccaggccagtcctacccacaccccctcagg

SEQ ID NO: 51709 - DNA, 1087 bp, Bovine  19866881761031
aatctccactttgagcccttcttttggggctgagttgctgaccctttagttgtcaaaatgtagatatttcatctgtgaatactgggcaaaactgaatcgccagtgtctctgggctgcagggtggcagcactgctcagctccagggaccaacccactcactgcactcctggagcacaactctaggtggtgccattcacatagagtttgatgtgcatggcacctgtgcccccacccacccacaagattgtgtgatggtgggccaccatcatgccctttctgggtcaggacttccctggtggctcagatggtaaagaatctgcctgcattgcaggagacctgggttcagtccctgggtccagaagatcccctggaaaagggaatggctacccacatgggtatacttgcctggagaattccatggacataggagcctgctgggctacagtccatggggtcgcaaatagttggacactgaggacttttctatttaccaacccaagcaagtcaagctgagaaccagtaatatttgtgaggctttgcctggggacagaaaagtggacaaaatgatcttcaaagtcatgtactcatgagacatgggcgccaggaaaccagagtgtctcccagaacaacaggcccatggagcaggatgcagtcttaaattgggtagcagggaaaagaaatgcagattccatccatcaaggaaggaatttctatcttcaattcagatagaaaacaattacctagttgcacttagtaggtctgtagttactgtgaggtgaatcagaatcagtgttgacattcctgtctctaggtttggagttcatgaaagcagaaagacccagccaccatggtgacatttgtgtatgggaatttgctgaaatctgaaatgagattctgacccagatgggggtcaggaatttgtttccttccctttttctccttcttagggaaagcttagtttgctatttaggatgaaaaataaccaccagatgaacaaaacaacgatcatcagaaatgataaataacacactccagatgtgtccagaaagaaacgcaactgaaagcaccactgcctccaagtagtcac

SEQ ID NO: 51710 - DNA, 1241 bp, Bovine  19866880410853
cttttaagatgcttttccctggaatttctaactgatttggtctacctccgctatctcaaactgagtttaatcaccaggaaagttctattgattgtcaatgatgtttgcttgattaattcagttctagctgtgttgcctttttacctatgtctttcagcatgtcctagaaaattaaatgtttcctttgggattttcagtgaatttgaactgaaaagaaggttattttcctctttttttttttttttttttagtagcgaagaatattctcattagttttcttgaatctaattttgaccccagtgtatatatttaaatgaactacactttttgaagacatgttttaactccacggtgttttttaggatttagtctattctctgtctgatacttgaaagtgttaactacctgaatcttttcagaagacattgaggcttagatttaagaaaaatttgaaaactatttgtgctacccttgttttaatgatcttcaataattttctaacttgatcttttatcaggaatttgtaagtgggttttaaagatataaatacataaatgatatgactgtttttgaagcatgcatgtttagtcactcagtgtgtccgactctttgcgacccccatggactgtagactaccaggctcctttgtccatgggattttccaggcaagaatactagagtgggttgccgtttccttctccaaagcatcttcctgactcagggctctaacccacatctcctgtgtcttctgcattggaggcgaattctttacttgctgagccatgggggaagcccatttttgaagagtatatatcaattgatttctttcagtcttgcaataaattatcgttgatttttttgttgttgttgccccaaagtctttccaattgagtttacagatgttgtcttttgcaatttgctaaccagtaataaggatttctgatgacatcagttttgggagaagaaagtatgacattttgagaccaggtaacagtagacttaaaacaaaattattttaaaaagtatttatacatgcaataatgctattttgttttgggcaaaaaaaatgattgactgtaataaagataaatttttagtcttaagaaaaatttataaatgtggctctttcacactgactgctcccttctgtatgaaagaggtcatcatgtgccgagaaaaaaacagatgagtgttgagttttttggaaccttatctcgaggctgctaccacttgtctgtgag

SEQ ID NO: 51711 - DNA, 1817 bp, Bovine  19866880510611
ccctctctccttggggatccctagactccttatcacctgcctaggaaatgactctctcataactctctctctcatatattgcaaatacttttccatttaccttatcttttcattgggtctatgatgattttcaaatgtgcttaagcttttattttttatgtcatcaaatctactcatcttttcatttatgatcattgtcttttgcttagaaaaatccttcccaggccaacgttacagaagatcttaatttttaaaaatgattttgtaggtgtcatcattttaagcaggatacataaaagaagaaagaacaaaagcagcctaaaaaccagtacaagttctcttaatataggtaagggcatatgtgacaattgtgtcaatggctgtggccgctattaggtggttacattgaaagtcaaggaagaggaggaggtaaagcaagaaaggttctttctaaacatcaggtaaaacatttgttctaaagaccttggtgatgaaccatccttctcttcaacttgttgagagggactgggctgtgttttggaggccactccaagtgtaatcttgccagagacaggagggcagagctgcccagcttccctttctttctctagagaagtagaacacacatccagtaaacaacctccatcaagctttaccaaacaattctcttttcaactacaaaatctggatactagagatgtgttccaatgactgttctgaaagccaaaagatgaactgctgtgaaaccctgaacaactgtcagataaaggaatgctgctataattaatgcactgagcaaagcttaggtatcatttttaatttcaaaaagtcaaagaagttgtattaattgtgtagcagatgcagctttcacatctgtgagtactcaaaattagagacaatataaactttaagattccgaccctgatgattgcttttcaacatcagaaagtataacttgtgacaataatgtgattttaatttttatcttcgtgatataatattttaaaatttagtctggaatatttgaaaattcaattctctatatgtgtatatacatacacacacacacacatacacacataagtaataattaatatggagacactggtgagtttgaagctagtactttccctgagtaattgtatctggtcttttgacaggttcttatcttgcccttgtagctaacctattacaagctaccgccactaatagggaacaaagatagatttagacaagggattgtgttgtatcaggacaaagcacacagcaaacataacagacttaagagcaacatgaaaagaaaatagcaatcccaaagctccattaagaacttagaacaccagatcaagatccaaaactgatggcttcggtgggtgtgatatggctgccaggaaatgaccttgcatgccctgctggagaaattaatcccaaaggtaccataggaagaagatgacccaattactgagaagaaagtcaggtttataaaagaccatgatgagaagaacagaccacaaagactcaaatatcagagcaatcaagattgtcagattttgattgtgagagtcaaagccagaaactactcataagtgaaaaggaaaaaatgtcctgttgaaaaatcagtgtcctgatgttgctgggagcaagaccaactcttcaggttttaaatggagtaggaatgtccaggttcataatgttatcaccccattgctagttggaattgatataaaacagagaaagcaggtaaagatgacctagaaaagaaatgtgcagaataacattctgatggcaagaaagttgattttgcttgaacttttaat

SEQ ID NO: 51712 - DNA, 1118 bp, Bovine  19866880861694
cagagctcttaactcctttctctgtgtcagtttctgttatgtcacttcttgaattttaattggagttatgtctgtcttcaaccccctacacagtaaatcccaacaggatagaaattatgcctcaatcaactttgaacctccaggattcatacataacaatttgtggaataaaaaaaaaaaaagagcattggttacacatcccactttcagaaggtatttaggaggaaggtatatcatttattcgagaggaagccatctaacgcagtcacaacaaaatcacagcactgaatagaaactaaggcatggaaatggtgatacacaaaattatagagcatgtgaaaaatacaaaaggtaagagtggtgggggaaaagagtccaagagaagattgcatgcttgaagcaagaaacttctctgaaaggctaaaacacaaagcaaacaatgttgcagctaataagaagtcctggatccacactttgtctttgcacgggaacatctctgcatgattagcagttaagccatttttcagtattaccagcattgagataacacaattcagatcaacatttaacaatcgttagaaaacgttgtttagaaagtcaaaccaaaatcccttacatttcagcttaagcacatttctcctttcctttcatgagaggtgagcagctggctgccatgctaagcagatctctttatatactccaagaccctccaaatatgtactgcttattccagtctctaaaatatgcagctctcttcacacccttccttatgcatcctgttgggaatgtttctttatgtaattcatccttttaaatcatccattttttctttcatgctacattccataacttcacctctccctaagcccttctgttaatgtctctagttcaatttactacattaattccttcccctctcaaattggcattctgctttctacatcttaacagaaggacttattttagtttatttaccttacatttctctcctccttttgaagtggccaatgataaaattaaaacagtcccaatcagaatcatgaaaccaatcttaaaacagtctccatatgtcttgggaggatttgccttcctggagatgtgttgatgaatttttagca

SEQ ID NO: 51713 - DNA, 1187 bp, Bovine  19866880930910
cccaggactgatctcgtttaggatggactggttggatctcctcgcagtccaagtgactctcaagagtcttctccaacaccacagttcaaaagcatgatttctttggtactcagctttctttatagtccaactctcatatccatacatgaccactggaaaaaccatagctttaactagatggacctttgttgacacagtaatgtctctgcttttcagtatgctgtctaggttggtcataactttccttacaaggagtaagcatcttttaatttcatggctgcagtcaccatctgacatatggacccattcaaattcacatgcacatatatacatacacaaatgcagggtaatgcttgtgtgtatctatagttaagctctcattctctttttctccactgctaatgtctaacttttctgtcttcagtttatattctcttgatctttgacttagatgtgggtgactcagaccaattacttcacataattgcatttggagtgagactgatgattttgatatgggctcatttttattatttgcatgtaagtttaagagaaggcacttgatgaacttactgtgatttcacatgcaaaagtgaatattgaggagattatgtaagtagatgagaaaattgcctttcatacatatttcttttttttcatacatatttcttgagtcgacagggtcagatgagaagttggcaaagaatatatcatgaaattcaagaaacaactttttattttgctgtgttgaagggaaatgttctgtgcactttgtgctgctttttattacttttagcgattgtgtaagttgaccaattatgaaatattgtacaaccaaataggaaaaaaaattagtattttgatggaaaactgaatggaaaggtgggcagttgacttgtcattttgacattgagagctttctgtttgtgaatctagaaggacagatatgtgtcattctgctttcaacagagttggaaatgcccactgttcttcacagcgaaggcttcatttttgtgcgtaaaagattggaaagtgccatctgggacacatcatatgttcatgtttctccaagagaatctggaaattatacttctgagattttgttactaatgaagaagagaaaggaaaagaaaatcttccataaattatacctggtccatttcttgtaaaaatggaaatgagagaat

SEQ ID NO: 51714 - DNA, 1428 bp, Bovine  19866880965872
aaaaataactgcataatattcctttaatgggatatgtttaactactccctttaggttgtcttcagttcttcttatcattagtaaggccctgatgaacatttttttttttttttgtggctcattttctccacatttagcattatttcattaaactatagttctagattaaaattaccaaaccaacaggaataatcattttaagagtttgataaatatgacaaaacactgcttgtagaaaaagttgcaccaatgaataagacatccatttcaacatacctttgccatattgctttacctttgtataacctctgaaaaacaagtaatctgatgttatgggatgctgttttaaataaatgtttttaatttttagtgagcatgaacgttgcatatccctgccctttgtccacacaaaaattgtcccttaatttaccaaacttggttattgttggataaacctttgctgtgagctatgacccgtgaattacagattattcagcagcattccaggcctcccaggtggcattagtgataaagaacccactttctgtcaatgcaggagatgcaagagacatgtgtctgatccctgggttgggaacattccctgaaataggaaatgacaatctgtttcagtattcttgtctgggaaattctatggacagaggagcctggcaggctacagtctgttgggctgcaaagagtcagacacgactgagcaactaagcacacactagcagcattcctgtcctctacatactagatgcccgcaaccccctaactcataacaactaaaaatgtctccagacactgtgaatcatacaactgggaaaaaatcaaaccttctgaagaatcttatttttagcaaataaatgttcaataatgtagtaaactgcctatttagttgatctgttttggaagttcagatgtttgtatctaaagtgagaaaccttcactcaaaaatatgaagtaagtgcaatgagttcaggctagagagcaaagtgttaataggctcatggaggtcaatttagaagatttcaaggtagtgctaaagcagaacagatagggaaacagaagcagctcagggaatttgattcaactgcccaagcttgctttccaagtaactgggactttaatagaattcaagtctttttttttttcaagctaaagcatagttgaggtacttgaaagaattcaaatctttccactcctactcataatgtccacgccccaccccccgccccctgaatctgcctgcaatgtgggagacctgggtttgactcctgtgttgggaagatcccctggagaagggaaaggctacccactccagtattctggccaggagacttccatgggctgtacagtccatggggtcacaaagagtccgacacgactgagtgactttcaccttcacttactgaaatgattgagtga

SEQ ID NO: 51715 - DNA, 1550 bp, Bovine  19866881010676
tggaaaatccttgaggagatatgctagcctttttttctcccttttctagggaattgttttatgttctatttctagtgttctattctgtgagaaagaattgtctttttagcctacaattattttttaattaaagattgagttccctttcatctttcttttctacctgaatattcttagcagtgaatagccatgtattgaaattcctttctcactaatatgcatcctcccttttcacattgagcacattatgatttatcttgatattttaaaattaatcatttttcctacgtgtgaccaagatctgtctgtttttaccttttccttataaaagcttattttcttgaaatctagtgggattggtgctttgctgtggcactgtgcccccttctctgaggaaataccatttttatgtccagaagtgatcaatactgtaaaagtgttcctcctgcaccctaaccccagatttgaggaagtaactgtgactcttcttatgcatctgtccctctgaaacttaatccagcactgccctgggacccgagataaaggttgcatgacttcacgttactcccaaacccttccctgatgacgttgcaagattattacctcagttagcacatattcccctttgactctttgctctgaaatggatataaaataattcatcttctttggactgcatttgcaattataatttccctccactttttgtaaatttgaagatgtgatactcctttcaaaaacgttgatctatttcttagttttagcttttcatccgtgcccttgtgcgtttaactcataaccacctgataactggggaagctccctgatgattacaactttttgatttaaagttgaatggtttcacaagtttctcactttaacctatgtcataattttagataaattatgagtgttgaacttactgtgtagaataattttcaaaagccttcagtgtctaaataagccaacacagagcttactgaggaatactgtgtcccatgtactataaatgcattgtctcatttattgtagtaagaattccataagggggaaatattgatgtcattttacagatgggaaaagcaataaaccatacatttgcaatatacacaaggtcacacattggcagagctaaagttctagttcaagttcttcttatctttaaaaagctctttatatgctgcttcttgaagttaatcaaaagtattgattaggactgtaagctccactgggagtagaaatcatatcctccttgctctatagtcctgtataagacctaacatatagttccttacaaagagaagctcaaaatctgtgtgcagagtaaacggtttctcatttctgcttttcactgactacaactgccatctctccatcttctgaagcaattttcagcttaggaaacttaaggcagaaaaattttcaggaaaggaattgagagagctgaggagaaataccctatttcttcccaaattccaaacacatttgtagtctttgagctctcaatatccttcctggtttggacaaccatctgaacctctctaaacaaa

SEQ ID NO: 51716 - DNA, 1566 bp, Bovine  19866881229911
tatctgcacatattttatgcttctttcagctgttgttaggaaatgcagtcctcaaactgttctccaccataagtctttgctctaggtgattaaaaatagacagggagaagagaaggatatccttgcagtttgcaggacataaaaaaggcacatgctgctaaattgcaccaaccgcagggaacacttctcacaggtgttccactctgcagaggttactcatttgcctccaagtgcaatctcaggtgttggcttaaggtttcaaaggccccctcccccttgccctatgcttgaggtccctggagaaaccaatacttatctaggctcagtagaaaccacactgttcccggctctcaagtgcagggcgttggaaactgggtgttttcctcatggaaggcttttgcctctggaatttcctgccagtcccagtttgccagaaccccaccttaccgaccttcagggactcatgaaagactcgttttctatatatccttcacaacaaggagagaccttacaaccatgattttgtaagaatcagtttaaggcattagcatagctcaccgacttctgggttacaatggtttaattttggtgctggcttcctgttgcaatttcaaacagggtaaaattttcagaataaacataccaaataagtgcctgctcttagtaatgaggaagtgagaatgcctacctggacgtgaagatatttagaattctaaaaatagaaaaacttctgtcagatcatgctccttctcgcactggtacctcaggtgcctgcaataacccttaattccgaggcaggaataaaccgctcctttaaagctcgaagatgatgcgcatgtgtgcttgtcaaatcccaaacccaccctggagaatagcactggtttgactggacattcacatatttaccctgtgctgttacgccaaggcattaacagctgctggcttaattattaatggagttagtgtcaatcatctgagaagagaattaaagaataatattttaaaatcatctggtccaaaaaagaaaaaaaaatctgttgtaaaacacaactctcttgtcatttattcctcttgaacttctccagccaaaggattaatctcagaaaaccgctcttctaaaattatttttcctatccccttaaacgttttctgtccgagcgctctccctttcaaaacccagcacttgctatgttcgcattattttcgcaagatgccctacatcaggggaaccgatgatacggtatagttttgataactctagcacggaagagaaatacagaggagcaagagccccccttttaagaaaagagccctttagatccgcggcgagcctgcgatgcctttagcgctgcgggccttctcggctccgccaaaaacgcggaggctgctcggtgtgtcttacagccgagagcaggtcaaagaggaaaaacaaatagttgttctgatgatctccaagaagagtttcactctggtagtatttggaaaggatcccgcccccccactccccccgcgccgctggatgccccggttttgggacctctgcagttgtcaagaaatttttttcag

SEQ ID NO: 51717 - DNA, 1318 bp, Bovine  19866881268586
ggctttctttcgtctccttcctctgctttccttgagtagcatactattagattgtatataaaaagctccagctttatttataacaccctgcgatgcaggaaaggaacattcatcttgtgtgctacaagccttatattctttttgggagttggcagcagcatgccggctgtgttctaacaatgggaacaggcattgccaaaaccaaccaggcttacctctgaggcccagtgccacggcaagctctttccctcctcctgcctctcaccctttcctgtgggctgggcagaggtggaggcttagggattttctcattcctgaatctgcccagatttcttcacagtcttacaaatcctttgtcctcgggcaaggctgcctcctccccattgctggtctttgggtagcctcatgtgtgacacagctaaagaaaatgtgaagtgtactgttttccatggtgaagatttctacagaaagtaggtaccctccacaggattacctgggaggccagaataatcctcctcctaaaagtgggagaaagctccaaattcctctctagcaagtgtttgctttggtcatgaggcttcaacttgaagagaggtgctggggtactgccctttgttgaaatttcacttggtgccgttatatagtgtttgatttcatgaagttatatcatgatccatattgagctccagcaaaaatggcttgtgtgtgtttgctgtaaagtaatcagttttgtatttcgagctaaacctaagtgctgtttacccagtatatgatttaatttcattattttcctcagtcaatatttatcatattgggaaagaacttataggaacttacaggattacacagttattataatgtgctgtgcttagttgctcagtcgtgtctgactctttgtgaccccatggactgtagcccaccaggctcctctgtccatggggattctccaggcaagaatattagagtgggttgccatgccctcctccaggggatcttcccaacccagggatcaaatccaggtctcccatactgcaggtggaacctttaccatctgagccaccagggaagccccttattataattgggaaagattacttttctgttttctatttacttattatgatgataatttttataaatatttgcagatgcattaatgtatctgtatttacgtattaaaaacatagttggtattgttgaagctgaaactccaatactttggccacctgaagcgaagagctgactcattggaaaagaccctgatgctagaaaagattgagggcaggaggagaaggggacaacagaggatgagaaggtt

SEQ ID NO: 51718 - DNA, 1605 bp, Bovine  19866880395432
tgtcagactctttgcaaccccacggactgcagcacaccaggcttcccctgtccatcatcaactcctgaaacttgctcaaactcatgtccaaccatctcatcctctgtcttccccgtctcctcctgccttcaatctttaccagcatcagtatcttttccaatcaggttaggtgttattattaccatagctcatcaaatctaatatgtcagtgactgcaagatgcaccaatatggagtataccactatgaaagaaataaaaacactatcagttcaactataaaattatgatgtggtgcttttttattacttagaatttttattttacatttattgagatagtctttttagatggagacataggtttattataagaacacttatgcatgtataaaaagggagatatgagtttaaaaatgattatttctaagtttcttcacattctgggtctgactccctgaatctttttttgactcataagtgctgatggccatgtttttcccacacagtatcctcagagcatcaaaggtgctcagatgctggatcatttttcaagccactgacactttttctacaagttttcatgctggtgcttcttggatctcactgaatgacaagaagaggaggttttcattcatcagccagaatgaatagttctttctcaaatgacaattgaattgcttgttgactaaaacatcaaggaattgccttcgtgttgtcacaccatcagaaataacaatccagttggtatatatacacagcaatgacacccaaaattggtaaattagaattgattaaatacagaattttctctgttaccttttcccctttctcatatgagtaaaataagatgtgtaaatacctagagtcaaaatgaaatagaaagttagatactttcctatcaaatgtaagtattgattctaacagtgtccacaaagatccaacatttatttgtttattcacttaccaaacattaatggattgtctgttctatggacacatattaagtaaggtatcaggaattcagagagattatcttcatcactaagacaaagtgatggatgcagctcttgggcaatgcgagaaagcaaacaagtaagcacacaatgaacgtggtcatgagagatgcgtgcacgagatataccggaggcacaagggagagcttgatggattctccttggaccagagttggggaaaatacaaatgagtttccagaccagcaaaggaggaaagggcgttgagccaaaaggggctttcctcaaaggaaaggatgtggcttataatttttttcaattttattttctatgtcctgtctgtgttccttgctctaaaaggctgaaggcatccatttctcttttttctccaaggaactgtccatttgtaactttaatccattctcttctcagattatgttcacttttgacctgtaggaactttttacatattatgaaccttaagttattataaattatatatttggcaaacatattcttccattctgtcacttgacttttaattttgttaatagcaacttttatatttcaacagtttaactatttccccagtcagatctgtcaatactttcctttacagtttggggttttcgat

SEQ ID NO: 51719 - DNA, 1031 bp, Bovine  19866880593990
ggtggcaatcagttgcagaacaccattatgctaacatttctagaggaaaaaaagttctaggaacttgctctttaaaatttctcaagagtcagttggagcctacacacaggatttaaagcaaatctagctggtatgtatcttttccttcctttactaactctatcacccaaaatcgagtatcccaagatgttaacaagagaaaaagcttagaaaagacactgacaggctgtaaacaggacttggtggaaagataaatcagatggccttgagactcttgtatgtcttatttctatgacacctttggatctagaagcctgttcctgtgtgtaaaagggaaattttagttttggtggaaaagcaacaaatgctgtccatttccatgggctggagtccagtccaggtccgttctagcaggactctgcctctgaggccaactaaagcactcagtgccagcccagggctggtaggtgctcggaaagctggctacctaagctaccagcctcatagaacacactcctggacacagaacagggacctaactgaaaggagcaaagtgctatcaaacgcttgtagccattaaagccgaaacatgcagtttcttcacaaattgaccacaacttaattttctgaaactaaagattcatgctcattcaactcctgggtcaacagtcactcaatgtgttgaaataatgacattacaaaagcaacccagaaatacccagatttttaaaaaaacatcactttatttctcctcatgagatagaaggtgcatttctattccctttaaactgcatacacgttaaaccaggctccccaaagaatgaaatattaacaggatttactcaagagctacccaaatagagaaacggtgcgcgcaatgatctgtttcatggaacgaaactgaatcaaacatctgttaggttttcctcccctccttctcccctccctgatggttaatgacatctgaagcgcttaagctttgcacattccttcactaattaaattcctgcaaagctgtctcatgaatcagg

SEQ ID NO: 51720 - DNA, 1195 bp, Bovine  19866880668717
tgctcctaagggaagtctggacagagagatacttgcaggcagtttgagatgttaatttcgtatgtataaggatggcaattaggatcaaggactatctctagtttaggaggaaggtttgagtcatcttgtagggatatgaagaaaaaagactcatttcatcactttcctagggtttccttgggccattgggtgattctagcagcattttgaagtcattgtgttggtgtgtatgctcctgaacctacccattaaatacaaatcaaataattataaatttaataacatatctgagagtacaatgagactctagagagtgaaaaaatacatttgtactccttaatttaaccataattaatgattaaattacttgtgcttggtactaggatatttgaaaatttaaaaagcagtccccatgatttctgtctaggatctagctttggatacgaagaatgaacatatggagtaattagagagcaatttgaagcagtgcatggacataagaaggagataaatctctatgctgggcataaatggtctgtagaaataagaaatcatcagagggaaatacattcagttttttaggagacacaaattactgagaagggtgagaatattaaagaatgatataccataaataagagtacagaaatgggaaataagtggtacctaaatgggctgtttgtatgcatgtatgtaggagaaggcaatggcaccccactccagtactcttgcctggaaaatcccatggatggaggagcctggtgggctgccatctatggggtcgcacagagtcggacacgactaaagcgacttaacagcagcagcagcatgcagtcaacactgcaggtctagaatgtcccaggccttggtttttgccctcaaggagctcacagccaagcagggagtagaatatgcaagccacctaatatagcatcagtaggttagaatagatggtaagagtaaaatatcctatgctgctagaggagtctgggcgggcttcttgaaagagaggtaaaatttgaagaacagagcagggacattcaacaagagaaatacaaagatttcgttggatagaagtgatatctctgatgagaaataatcttccatgttctttaattatctagtaacaattatttctaaatttaatgaaagacctactgctttgtgagatcctgttgcacatgcttcgggaatt

SEQ ID NO: 51721 - DNA, 1379 bp, Bovine  19866880699105
ctactgtaaccgttgtttgagtttacccctcctttctaacagatagagatctctacaaggattttattatgcttatagtgcccagaaggccatggctcatctctggactcttgacagttctcaagcagtcctttgggctctcagaacttttgttttataacttaatataataaagagaaaaagttgcaaaattgaaaggaatcctagaaaaactaatttacgttgaaaatgacagcattaaaaggtcacaaactccagtgtctacagaggataggcctacatcataaataataaaactgaccctctgtaatataatagggagtggtaaagacagtagcagattgaaaggacatgtcatatttgaaggaggcagtcactgtttaccacccaccagttataaaatgaaggcaacatttagccaaactttcagatttttcaagggacatcagatatatcagatttttatgtatcgtttctcaatttaccaatgttgacaacaaattaaatttatttttaaaacatgtatcaaattaaatgtatgcataggccaaatttgggctgtgggtcacatatgtgctatttttttactaaaaggtaaaatgaatggatactggaaatcttaaaattggttcctgtgaggaatttaatggaaaggaatgggagaggggtgatgattttaacaagtttttttgttttggggatttgaattggatcccatctgatattttttgagagattccaataaatgttttaattcttttcaatttttcttggttttggacaggtgttttttggtgtgttttaataagcttctaccaaaactggacattgagaggaatgaacttcacatgaggtatggaactctagcatataattttgcctgccaaatgcccgataaaacaagattagaggataaagctatttgggaatttgaaagcttattttttgactaatcttcctagttaagtgacacttgtagcatatgatttaaacatgtgcatggcaaaatccaagctttagcgaaatacaaattgctacatgtcaggaccttaagaattatctttaacactcagtgaactcacaaatgcaatgatttggctgaccatatttgcatgcattgtactttacccactatgaagaggatgggaaatatcagttagaaacataataaatcttccacaaaatacttggaagccaaatccagcaacatacaataaagaattaaacaccttgacaaagtagaatttgtcccagcaatgcaagattgttttcacatttttttttttcagcaaggttacaatctttattaaatttctattctgctttaccttagtaataaaatcaaaaggaaatataaattaacacttaatcattataag

SEQ ID NO: 51722 - DNA, 1120 bp, Bovine  19866880757193
agatggggaaatgcccacaaagccttgttattttgtccttagacaactggtgagtccatgcctgcctcttagctagcaccatggaagcatggccaccggggcagcagcttccagaattctgtgctgctctatgggcacctgcctgtctgcgatgttccccacctgtcagttcactgctttgcctgtggaccaagaaaaagagacggcagaccatcactcccctgctgtgcccagtttcactaatactcatccatccattctgttattcaacaaatatttattgaagcctactgtatgccaagcactatttcaggaacttgggacatcgcagtgagaaaaataagcaaaaattcccatcttcatggagtttacattctaatgaaataacttctaatggagcaagaattctcatttattttatcttattttaatactgctctttacttttcacaagttaccttatcctttactacagcaggtttccatctttagtcattttcttgatctgctttcccatgtcctttagtgcattttaccaatagggatgtggggcaaaaggtaattgaatctactatttgtcaagtctggagtacagaataaccatcagaaagcaaagcacaagtgcttcacagtcttagtttccactaagccctgtactggcagtaaaaacacaaacaaagttccccataacctctccatgggggcccttcttggctgatttcttgtaactctgttgcactggttcagacaaaatcaaccaaggtcatgacagtgaaatgcatattgcacgctgaccccagaatttggatatgagttacaagcatgaactcaaagccagaacacaggatctaccctgtaattattttatttttgactacacaaagtctcaatcaaatggctatcctgggttcaaagcactcttttctgaaaacatctagaaaccaacgtatacttatgtgtaaaatgcacatattaaatataaatgattcagcaacatggatcagattttacatactgtaaaaaaaatctcttctttaaagctgatcaccctagacattaccttcatcatatttacaaatctgttgaagattaatctttttttccccccttacccaaatca

SEQ ID NO: 51723 - DNA, 1834 bp, Bovine  19866880773456
gaactttctgggtacctctttcctcttactgcaacattgtgcatttttctccttctctttccctattaactcttcaggagacccaaagtatccttattccccaggatttatcaatgcctggggaatttgttctgagatttccttcttcatttaacttctttctttattcaaagctgtcctatacaaagtaatttcatctcctctttaatatcttgataatgttaataatgataatagctaatatttgagtgcttagtatatgccaggcttcacactaattattttccacagattagcttgctcagtgatatgaatatatgatcatttccattctacaaacaaggaaataaaggtacattggaagttaagtaatctgttcaagttcatggaacaggtaaataaatgatctgtacccaaaggatctgtacgcaaagattctccacacagtctctatattctcttataacattacagtataggacctatagtattatattcaacaggaaaaaaagttcattacaatggaaatagaaaaacaaggcataagctttcttccaattcaccaaggaaggggatagtggtttagttgctaagtcgtgtctgactctttcatccccacagacagtagcctgccaggctcctctgtccatggtattctccaggcaagaatattggagtgggttgccatttccttctccagggcattttcctgacccaggaattgaccccgggtctcttgcattgcaggcagatcctttagtgactgagctaggagggaagcccgaggagggggaagaattaaatatttatagtgcagtgaaggaggatcacagaagaactaatctgaaaaaaatccacctgtcaagttcttgggggaaaatgagagcattataaagaaggttgggaatattatttattccccaataatggagcagcctccagaggttacctggagggccagctggggactgaacttggggtcaactgctgttccatcactggagggagtggcatattgctggcagctgtggttgggactgcagtcacgtggccacaacaggcacaacaaaccaccccccaacttcaatgtatctgtcccgcaccctgcagtttcccattttcagaagggaaacaggctctgaaaggcccatgactgctccaggttactcaatcagtaacaaagttgagctcaactccagatctcaccccagaggccttcactccagggaaaagaagctgtctttaaaagcctgttagcattttagctgcttctgtgaacttgtatttgctcttgtatttctttttcttgaattttagcctagtcattcaaaaccagactggatatcccttgagacagaatgttatgcttttgtctattggtgtagagtgtaaagtatatcttcattgaatacttgttcactgattaattaaatgaggcccaagaccaaatgctaggcgaagtgggtggacctcttgactatcaggctgctgaagttgttgcatcactctgtggggaaccctgccactctgtctctgattggtctcaaggcattcattaagtttcttgatttctctttgtctccacggcatagttaataaaaatgaagatacagatttgtctgagggtccttctagttccaaatttctagggcgagagtttcaacattgaagagaacagaaattcccccaagaatactgacataactggtaaataatttgaatttgcagtggtttgcagaagaacttgaaagcatgagtactatgtttccagtacatagcttgcccttaaaaataaatgaataaagaaacagacaggctcttttcctaattcata

SEQ ID NO: 51724 - DNA, 1603 bp, Bovine  19866881209382
tctggcttattaagatattaagcttcagtctgttttttcagtctgaaaacagcatgttacttccctgcttaattatttcacgacccataaaagctaattattaataaacaatttttaaaagaccattaactttttattgtaatcacacagctatgtttcaatgttggttgacatttattagatcctggtttctcaaaatatatttatctaggtaaagaaaaatgggcagaaggaaacctcacccaatttatgtagcagtgttaagcaaatttagtttttcagccaaaataaaatcatttgtatcttcaaactttcccttttaacttttcttttagcaatataattttgcattttggccaaggagaactgctttcttttggcagacaaaatcatgctgcaggagaaacagtgacttcaatctatagaatctgtctcctttttaatagagctgtaccaaagtagaggattacattttacctaagctgatctctttcaaaagactgataggatgaaatgattttaaatctgtatttttacccaatatacacaattatgttcaatctgaaacaattttctaaaagaactgttgccaaattttaagaaactccaaaatgtcttatccaaaagctgtcaattaaaaagtaagccacagtgcttaagtgtaatatttttaaaaccaactctttactactgcacattcttgggatatgtggaaacaaatacattttgactcttaagaaaaaacaattgatggcacattgaagaataacttcatgagtttataaacataagagggtatagttattgcaaaatgatggaaaacatcaagtgtgccttcattttgtttgaagagagagtatttccactcaaaagttttgagtccgaaagagctatttactgttaaagtatcaccaaaattagtttcaaacattactcagaaaataaactatttccaacaataacaatcttcactgccttttataaggactgtattgtaacttttcatttttaagcgtcttatatctccttgtaggattatcacaaatcaccttttaaatttcaaatgaagtaattccaacccagtcccaattaaatacatttacaaacaaggaacattattgcacattacacccatattttaggaatgtgtgcttccttcccccatgcccaggaaaaaaaattgacactgcatctatgaatttacatcctcattatctgaattcataacactttctgaaagtgcttctgctcttctacattaataatattatagtctaaaatacttcatgaaccctgaagtgattctctatggaaggagcatcgtttgcaaaatgaatttggctagtcacctgcataccaaaatctccaagtatctgaacaaatttcttgtgctcctttccaatccaagatctcattggatcatgtacttggtaaggtgttacatgggtgtgaacaattatccctgtttgtgcaaattctttcaagacttccggataagtaatccaagtgttgcttcctccagaatgaccaccatccaaccagtacattgtttttatgtttttgataaaagcatcgatgttcttgtctttctggcttctttcaa

SEQ ID NO: 51725 - DNA, 3216 bp, Bovine  19866881309099
ttttatacacagaacatttcattatttgaggggtatctgaccttttctgacttagtacagtacttttgttctcaaagacttcctggttaagctgcctttggttctctaacttgcttaaaatctgcatttattgtagcctccccagtttttatatttctaatgcacttacaatcatcctatgttaacgctcctttataatatatatatatatactaaaagtaaagcaaatattttggttgtggaaaagataagtaaacttcgtatagctaattaatattttacttccactaaaaatttacttctttgttttcaattgagaataaatattttcaaagcataggtgctaaagaaacactaaaccaatactaaacaaagatgagatcctagtcacatccaaaaagtgtttaatcttgtgacagaaaggaagatttataagatgctaaattttagaaataaactccttctaagagtgctctagaaaaaaaaaaagcttaaaatattttgatttacaaaaccaggttccaaacatggttttaatcttaactactccttctttcagaacctttttttccttattcagtgttaacggaaaaaaagctaaccatcctgttaaatttaaatccagagatgggacttctgctcctatttcaaaatatctgcaaacgttcagtattttttctcttttaaagttgtatacagaataaggcagaactgcatcacccttaaccatgctctcaagatataaaacccccaaatttaagtaacggcaatggatttaaaacactgtgctgtgactgttttcagtgaggattgagaagtcaaggtattgaacttttatacacaattatgtaaagttaactaaacaggacaacacaaagattaacaaactatggttctctgtcctcaaggaatttataatctagtcccaaataagatattattattaatacttttaactaaattttatcactcaagaggtattattataaacatattaacatatatgaaaagtaaaactataagccaaatttgttaatgcaccccttaatattttgatttttataattttctggtattcagttttgtataattacagatgttaactgtatcactggttactaacaactaatgcctatatactgttcaaagaaattaagtgacactaattcagactgtagaaaaatagtgcccaatagtgtacatcataggtattgcattataacatttgatatttaataaaatattctgtttggctttgaaatgtatttataatttcttcataattacttaagtgacagttctaaaacatgtaaatattttagaaacaaaatgattttaaaagtaccatgaagtataatttttttgcagatataaagtatcttgcttagtatcctttaataagagaacttaagagtataataatatatttataggttgtctttgaaaaataagacaatactgtaagaacctgtcttagcatactttaaacacacacacatttgtatataaaaattcatcttgtataggataggatacagttaacaaacttttgtattaaaaaaaaaaatcacataatggtcaagtgagtataaatagtataaaaagcaagttactgaagtctagaaatcttaccaggaatgaataacacatctccagctttaagggaacattcataccttctagccttggaaaacagtggatatttagctaagtctgggttatctatgttcagtacttctgatttagaacctgaaaagttacaaaacaggatgatatagattgaacagttagcattttttttaaataaccacaaatataaatttgaaattttgttttttcttaacaactactttactgtatcacactgtgagaacaattactgttctcctgaagacaattttcagtgacctaccctttatttataaccactgacattcatgtaacataatcaagataatctaaaaatttcattcttcatataacctatcatctcatgtatacacgtacacaatgaagaacacaatacaagacacaaatacaacacaagaatcataattaggaagaagccctacaaagtttttctatgagaatgaagacattaaaaaaaaaaacttgagaaatttattctttaaaaaaaaatagtacctgataaatataaatattgggcatctcgaggactgaacagaacaacacgcttttttcctgtcacttgtattaagaagttatccattacctgaaggcaaataagaacttatgaaaaagcataaaattctaatatacagaatcaatggtattccagttaaccataaatcctgtcttttaataaagcttgactcagattacctaaaactcttatagtaatattctaatttaacagtgaaaacagatgtgttacacaactgtgtcactatttctccaacactgccttaaaatgggaaggactggcaggccattagaaaatctgctcagaacactgtttgcctttgcttcatcattatgacaccaagtgcagttacatctatttgaggctccctttggtaagtatgaccaactcccctgggggctcagatggtaaagtgtctgcctacaatgtgggagatctgggttcaatccctgtatcaggaagatcccctggagaagggaatggcaagccactccagtacccttgcctggaaaatcccagggacagaggagcctggtaggctacacagtccatggggtcacaaacagtcagacacaactgagcgacttcactttcacttttcactttcctttgctaagtatgggtttcccagatggtaccagtggtaaagaacctgcctgccagaacaggacatgtaagaaatgctggttctatccatgggtcgggaagatcccctggaggagggcatgaagcccactttagtattcttgcctggagaatcccatagccagaggagcctggagggctacagtccatagggtcgcaaagagctggacccaactgaagcgacttagcacacacacgtgcacgttggtaagtatctattttacttatctatccaggaatactgtaaggccaacattagatgataggatgagagcacttagaaaaccaggtgctgaggaaacacaagggagtgctgcaaccacggacaggctcttacgagatggccaaccagaatttggttacaggaaaatatactatttccaaagtatttcgataggaccgtactt

SEQ ID NO: 51726 - DNA, 1077 bp, Bovine  19866882143437
tggatttgtttgtggattatttgcctgtatcatgtagcttggctttaccaaatctggggtatagtattcccacagagaggaaactgtttgtttatgatagtgaaatgtcattttagcactttgatggtttgaaagacaaatttatgttaccctgtcctgctcacacactatcataatagagaaattaggcaattatccttagcacattacagttcatgtcttaagtttagccaaataactgtcattggttcatttattcattcagcaaatatttattaaatgcctgcaatgtgccagctgctactcgaagaagtagagatttagtcatcaacaagacagacaaagtccctgactatgaagtatttcctactctgaaaaccaatgagcttttttagtctgatacacaactggttgatttattctcatgtttactcatgaagatttttcacttttcacagttttaaaaactcttaaatagagagcacgtgggtgaagagaaacgatcttgggtaaggctcaaataaataaataaaacccaacaataaaaaacatgatcctattggccaactgtagctaggagcctcattcctttcattcaagactgtactctttcaaggggcagttctccagctaatcaaaatttcaaaggacacagaagaccatttaataggattatacctaaacctgttatagattaaattctctgactgtttgacactgtagtaactagcccagatttgtatttacgaaaaaagagatgataaaaattccctcttgatagaacagagagaacagactatcttggcccacccactttcctcaaaaataaaggggtggggaggggaacaagtgctaagaaatagaaatctcaacaccagggtgctgctggcaaagttcaaatgcaccaggaaagcacacagagaaatgtccctcttgatacaaaccgtcttcccccgcccttgtttccagaggcccatggccaagatctaacatatctccttgaagtgcagaaacaataaatatccacctccaggtgacaccagtggttaagcatgacagaatttgaaatagaaagcg

SEQ ID NO: 51727 - DNA, 1447 bp, Bovine  19866880123635
tcagcagatgaaatggataagaaagctgtggtacatatacacaatggagtattactcaggccattaaaaagaatacatttgaatcagttctaatgaggtggataaaaatggagcctattatacagagtgaagtaagccagaaagaaaaacaccaatacagtatactaatgcatatatatggaatttagaaagatggtaacaataaccctgtgtatgagacagcaaaagagacactgatgtatagaacagtcttatggactctgtgggagagggagagggtgggaagatttgggagaatggcattgaaacatgtataatatcatgtatgaaatgagtcaccagtccaggttcgatgcacgatactggatgcttggggctggtgcactgggacgacccagagagatggtatggggagggagaagggaggagggttcaggatggggaacacatgtatacctgtggtggattcattttgatatttggcaaaactaatacaatattgtaaagtttaaaaataaaataaaattttaaaaaaatgaaaattatatggcatgtgtgagcataataaatactagaagacttgttcaattttcctgaaaattagctttaaaggaaaaactgaaagtaattttgtttaggactgaatttagcagttttattaatcctgttctcccttcttgttacagggctatctttgcacaaatctatggggcttttccagataccatagattaactcatttgtgccttagaggcagagataaagtaacaatttttcatatctcaagtgttctaccttacaggaaagaaatgttattcttcatttaatgaacattagcacatgaacaattaagacataattgaatgaagctagtcagcaaaaggcaagagcttgcctctgggaagctgcctgaagttgactgtgctcatatctgtggtattatctattaagctgacagtaccaaagggtagaaatgtactgacagtaattgtacagtttttggtacccccatgttttaaaattgctttctaatagtaaacatttctaggagaaatgatgatgctgataataagaggttgaaactgctgactgacctataactgtcagattactattaaaaaaggcaagttaaaaataaaatctttatctgattattaacaaccgctctgagggttagctttaattactgtaagacaattttacttattccaggtaggggtaagtcatttaataaagtataggttgattagaacttttattaaaaacattaaataaaggctgagttttaaaatacctagctccctaaagtgaaagtgaaagtgttagtcactcagtcatgttcaactcttttgtctctgtgaccccatggactgtggcctaccagaatcttctgtccatggaattctccaggcaacaatactagagtgggagccattcccttctccag

SEQ ID NO: 51728 - DNA, 1542 bp, Bovine  19866880461197
aaacattagtaattaaatgatgctctctgaatgtcagtttactttatatttttagttttcatgtagagttctttttcattctttgaagtcaagatcaatagttttccctaaactactgtatttattgattaaaaaccttttttcaaaattcccaagtccaaatttgtatggtttatataagaataatggcaatgttcctcgatatatggtaattttaattctcttgaataataaaataactagaactgctcactcaccatttccttgaccattatgataacattgttttcattcttcatagtatataaatatggatttctggattttaaattatgctttttctctatttttgtatattaggaaatagactttattttttagagttctttataaaatctactctgtctttattcaatataaaaccatttgaggaacttatcttggaaaaaatagtacaaaatgttttgtattttatttattataagattaattcacattaatctgcaaagtattaatttttactttaataggaaaactaatatgattatgttcttccttcaaggggttttaatttgttcaagaggttaataaaaagaccttaggaatatttgccccttctgttttatatatatacaaatataaattttaagtttctattttgtgtaaattacattttaatatacataaatccctaaaaattaatataataaatatgacattaaatcatgcaaagtttaatagtcaatgttgatacacttccattttaaataaatatcaaaatatgtctatatgggtaacattttttcagaaaatttgtaaacaattgtctttggtaaaatcgttggtaagttgtataggatactgcatttcccattcaaaatcaatattcacatttagactctatgatctattccagacatgttgacctttccatgatatttacctctaaaactcatgacaagtgaatcccagtgtgcttaagtcttagttcatcatcttgagaaggccaaatgccattctgctaaaagctaactcacttgacctacaggagtcaatctagtctcaagtaatgctatgtatctaaactactattgggattttgatatttctgtttggattaaatgaaagatgtataaaatgtgttttctgactatgacagtaaaagtattttccagaagatccaagtaataattggctgaaaacctcttatcagttatgcacacatgtggtagcaatgagagtgcctcatagagctctgactataggaagcacacttaaccaaggttctagttgctgtgctctgctgtatttgttgttgttcagtcactaagttatgtctgactctttgtgaccccatggactgcagcacatcaggctgccctgtccttcactataactgaagtagctcaaattcatgaccactgagtcgaagatgccatctaaccatctcatcctctgttcctcccttctcctcttgcctcaatctttcccagcatcagggtcttgtctattgagtcagcccttcgcatcagaggccaaagt

SEQ ID NO: 51729 - DNA, 1721 bp, Bovine  19866880518166
tataggtgtatgcatgtatatcggcttcctaggtggctcagtggtaaagaaaatatctgtcaataaagagacaagggttcaatccctggtttgggaggaattcctggagaaggaaatagcaacctagtccaatattcttgtgtgagaaatctcatgaatagaggagcctggcaggctatagtccatggggtcacaaaaagtcagacatgacttagtgactaagcagcaacaatacatgtgtatatatgtacattcctggatacatgtatattcagacagtgtgtaaatagttatttgacatttgtgtgagcagaaacataaatgtaacataatacacataaaaatttaatactgaggaactttggaggtacaaggtgaggaattattatgtattgccaattgttataataaatatttgacattcattacttttgtgaattgataataagtctattaagaagtgttattcaatttcttacaatggcaacttttctcccttctctctctaaaataagcttgttagataaaacagagtatgtaatatttgagaaatacatatattaaaatttacttatcattcatttgaaatttaactgcatgtgtgtgtgtgtgtgtgtgtgcattttactgaagtctggcagacccatacaaataccaatttttatacagaattcatgaaacaattgcttctttcacacacctctatttgaaggaaagtggtcccagctggcaggttctcctcaacaacgacagtatatgttgaattggtgaacacaggactattatcatcaatatccaaaaccttgatggccagagtaagagttgaatgacgaggatgtactgctccatcagttgccacaacaacaagttcatagtagtcccggacttctctgttaagcttcacggccgtgtaaatgcttccattggatgtgatgcgaaaaagattgttgaagttacccaagctgtagtgcacttggccatttattccagcatcaggatctactgcctaaacaaaattaaaaacagaggaattcacatagtactctctgttataattttttagaagggacagttaaagacctatggcatatttctaaccaaatattgttttttctttagagagaaaagtaaaaagataatgataatgtggtacaaaagtctagaacatgaaaagaaatttataatagtttaatgctactcttaattctaaatgagcataaaattattttgtatcagtagcaataacaatattatattatgacagaaagttcacattacataaatactgaattttcctgtattatcatttatttaatagatttttaactctaaaatttaaaaaagttttaaacataattgagtgatagcttttgattgtatattttttaattcaagctatatattatatacctataatacatatagaagcaccatatatagatagatatagattactgcatttaattttcctaacgttcttataaataaatatcattggttccattctacaaatgagagaactgtggcttataatttgcttagagttatggaaaatcccatggacagaggagcctggtaggctgcagtccatggggtcgctaggagacggacacgactgagcgacttcactttgacttttcactttcatgcattggaggaggaaatggcaacccactccagtgttcttgcctggagaatcctatggacagaggagcctggtg

SEQ ID NO: 51730 - DNA, 1192 bp, Bovine  19866880518167
ctacaaatgagaaaactgtggcttataatttgcttagagttatggaaaatcccatggacggaggagcctggtaggctgcagtccatggggtcgctaggagacggacacgactgagcgacttcactttgacttttcactttcatgcattggaggaggaaatggcaacccactccagtgttcttgcctggagaatcccatggacagaggagcctggtgggctgccatctatggggtcgcacagagtcggatacgacggaagcgacttagcagcagcagcagcatacaagaaataacaatctgtgcctcaattcttagtataatgcctacataaaattacttaataaatatttgagggattaattcatgttagaataaattaatgcaagcaactgaggtttaaaactagacatactccaaaccccaaacagaagtgaaagtttaataactgtaaagcaactgcaaagggctcttaaatattagaatacaacctctaaatgatagtagaattgttgatgcaataataagccttttgcaattgaaattttaagtcatattaaataactttgcattaaataaaataagtaaattttgagtggctattcttcaaaggagtgttatgagaattaatataatctaaaactcaattaattgaaatagaaattattacatctcattatcaaatactgtgcattttgtactacatagctctatctcattgttcctcacacaaattggaataaatcttggaaaccataaaatgttatataactatgcaccaaatggctggtaaggaaaggaaggaaaacaagagacttggctgcattatgagcgagggacacaaaaatcaattaatattcataaagcctaggatggaatatgatgtattttgaacagaatataagcagatgtacatccacctttacaaacactggggaagcaagtggggtgggtttgctgaacacttttgccttgtttgaaatgataaagcccaggatgtgaaagtcaaatttataactgtgcaccctatgaatgccagactttccagcaggatttgtccctctgattcatcaaaacacaaatgtccctgggagggtattacttctgaagtttgaagcctgagaaaagatgaggaactgcaggaatgtctgaagaggacaaaaatactgtaaaatagtcaaagagcttacataca

SEQ ID NO: 51731 - DNA, 1315 bp, Bovine  19866880752662
ataaagcctatttattcaaatgttcttaggagggtacattttttatctgcatagtcacaactcttctttatgccgtaagtttaataaaatggaccagctgaaaatgattgctgtaagttatagtgccttgtttgtcgaaggaatcattgcaatatgaggggaaaaggggggttttgaattgcatcagtgctgtttgtgttcaacttataaaatatatgaactctttaacaagagtaggagagactagaaatctactctcttattcaccaaatgtctaaaattcagcccactggaagaataataagaaagcaagcattgaaatgtgacattaaaatagtatgttgttctagttgagtactccagacatgccttaaagaagaacagcttctcttgtgtatctgcacattacttttgcctttcacattaagatttatgtttcatggatttgctgtaagataaaagagaaaagaagtagttctcaccatgggagtctctgctacttctttatctttttctttttcttcctttctcttactttcaggatatctttttttcatatcagaagtcttactgagtgaactgaagtatcagcctctgttattataggctttttcttttgttcaggataaaattcagtgataactcctgtgagaagtgatggacagggaggggaacacactgatgctcttaaaaggaaacaagaaatagatggtgaaactcaccaagtgtttgaatctctgccttgcacctcatcttcttaaaatatcatttacaaatagcattacaaaggttttttttttttgcctttttgaaacagagcattctctatatcatgccagataaaagtttgaatatcttctgctttgaaacagatatgcaagtcagccagggcatgagtttatgaaccttgatgaagaatgcatacatgtagaatgtattttcaaataactttctttggtttgcaggtacaattctggtggataacatgctgatcaaagggactgctggaggaccagacccaaccatagaactctctttaaaggacaacgtggattactgggtattgttggatcctgtcaaacaaatgcttttcctgaacagcacaggcagagttttggatagagacgttagtacattgtttttttttctctttgcccctctattacaactctattataatttaaatatttgcatgtgtttgttaatatatcaaattttcattgtataatttgagtttattttcagtgttcgtcaacaaaaatattttttttaaaactcctgaaagaagaataagaaaagaagaaggaccatctgt

SEQ ID NO: 51732 - DNA, 1477 bp, Bovine  19866880804632
tttgctttttgttttcccctcaccatcctaattgtgtatgtgtattagagaaagggggcaaattataaatttgttgcttttcatagcatccagtgtgtccaggatataacataatgactttcagaacaattagaaacaaaataaaggagagagaaaacctcttgttcaaaatggcttgtgtgtatgaactgttctgcttcaatcagataaaggtcattgggttggaaccccatatggatcaattagtctcctacagtgaaaggtgatattttctagccagggactgtaccttttaccctggtcagctgtgtccagaaagcctgctctgagtcacagggggaatttctagaacatccaagtctcagcacaaattaatcacaacagctggatacagaaagaacttatctaggctggtggtgtcaggaacacatatggttctgagagaagaatacaatgttatataaaaggttacacattatttccagtactattgtctttaatgcagagcaggggatcataaacattttatgcccagaagcattctggcaatttgctctcagatgaaaatttaaatccagaaaataaattgcataacattataaaggaaatctaatatattgaaatagttatgaaaatggtaaaaaaacaaagaaaagtattttttcttctaaatctattctttatataagattaacaatgggtttattaattatcataatttcattgttataatcagcataaatgtatttaaatatctaatattaataataatgtgaaatgatttttcctggtgcaaactcactgatactaccaaacatctctgtgatctgtcacctgccctccaatgaataaaactggtaaattacaagaggaaacagagaaaattatcttctagaggctcaatggtgaagataagggagatggtgaggacagggaagcctggcatgtggaagtccatggagttgcaaagaggacatgactgagcgactgaacaaagacaaaaagaggcctgatataaaacagagatatgtatcaaactgcttataaactttcatggccaaatgccactgtattacagaggaaagcactataggatttaaaagaaaagatttaactttaactcttagatggtttcaaaatacaactactgcaaaaatgggggaaacataccaataaaaattataacagaatttgaatctattttgaaatacatatctaacacatctcttggtatatgtatgccactaaattatgtcaatgattacttctaaagtttggagaagattttatagaagtcagttgtgataaaatcttcccttataaaatatctggatagacatatagtaagatggttaaaagcaaaccaaaaaaaaaataggatgttgagagctgatgttaaagggttggtgttcacccatttataacatgtgtggtgattacatagtaaaatttattggaaacaaattgtcatcaattt

SEQ ID NO: 51733 - DNA, 1385 bp, Bovine  19866880936835
tatctttctttttattgcttagatctattaacttcttaagaatggagatgggtttctctcatgaaatgtcatatacaaatctactgttgttgatttatcaaatagaataatatgaaataaatagtaatatttgaaaaataatgtagagactgagggtgccatggcctatgtgataaatcatgctaatgaaagcaagtgatgcagagcaataattattagtgactttagtgagctttactagaccatattgttggaacatcataaacaaattatataatccaattaatgactgcactaaaggcatcataaaatataccttcctccctttatggtaaaatttgaaatatattaatgctaatgtcccattcttgaatcagacttacttacttgcaatgtcctgtggtttactaaattcattttgctttttcagtcatggtctaacttcaattttagacaatacaaattagcgtatggttctactgatattacaaatgtcatggtcaaattctttttctttcagatgagagtcaaaatgtaaaagaagaagtttttgtgttaaaatttcactatgtgtgttttcctgaaaatgaatattctgaggatcaacataaaaaaatgagaatagtccctcctcttctgctgcttgtgacaagcaaattgaaagtaaaatgtttgtacagcatgaaatttcaagagagcacagtactcctttgattgagaggtcaaattgctttgaaataaggaactgattcagagaaagtgtgtgtgtgtgtgtgtgcgtgcacgcacgcacgcacataaaaacaaaagcttctaaataagaaagaccaggtgactgaatatgcaaagtgatattcacaggaatatacagaagggtagaagtttcagaaaatctttaactctttcttgatctttttgcttgatcattttgacaccagtgcatttccagactattgtgaaagcctgagactattgtgaccctaagcacttttctttcttaaacctagagttcaaggattctatttgcctctagtaaattcagttcagtatagtgtatttagattggcatctggaataagagtttcaacattccaacagacattcaatggcaagtcatgtgagtgcttttattcttaacgagaatgcactttacaaccacaaatgtaacaatatcagctctcactgaaaatgtggagatacccaaaggattctctacttggatgcttggggctagtgcactgagacgacccagagggatggtatggggagggaggagggaggagggttcaggatggggaacacatgtatacctgtggcggattcattttgatatttggcaaaactaatacaatttgtaaagtttaaaaataaaataaaattaaaaa

SEQ ID NO: 51734 - DNA, 2600 bp, Bovine  19866881055052
ttctcctgcctcctcactttactcacattttttaaaatacactttctactgatctgtttcataataatctgtactataactagttgaaaacatacacagattcaaattttggcttctcaactcttgaagggaatggttatacaacataagtcataaagtaagcattgggaatgtaggaagagaagttctaggaaataaccctaccagtgagccaactgcttaaaatggccaatagaacaactgtttgacagaagcgatagatattccacagtacagatgttagtatgacagtacagttaaggtattcacttaaaggggtaggaggttgaagttagagatattctgattcaatctgtaagctgttataattatccctgaaaatcatttttttgttaaatgcattcattttgatttttaaataatctaggacttatgcattctaaaccattagccaatcagggcatatgcgtatttcattctctttactgaagagctatatgctaactcatactaaattttcagtaactcattgatagtaccacttacagtgtagttcaccaaatactattggtcagaatacccagtatcttctctgcagaccaagagtcaaattaacacaaaaagccatacaatagtctgacttgtttttaactctaaaagctcaaaagttgtaaaagtgaatattggactgattttttaaaaagtttctaaattagaaacagtgttctagctttagatttatagccttagaaaaaggaatttggggggatgtcacaatatggagtgataataattctagaaaatagaaatttatctttgaaaaggtaaacagtttatctgtgttcacttattggcttaaaacctagaacaaagaagcaacaaacatataagaaaataaatagcaaaacatacttataagttttttttaaataaacagaaataccctagtcttgaaagagtgtaaatcagtcctgcctgtaacataaatatttttccagtaaccttgatgtaacatagcaccataaaacccttacctctgatgtataacctctcctgcaaggcagaaatgaagaaatcagtattaaacaccctggatttacagataaaatagaattatagatgaaggtaatttaagaaaatcatagaaaaattgagaaggtgattttttctcaaaaattgtctcaggagaaatatattttatggcagtatcaaaacaggaagatcaagattttatgcctacattattaaacaccattatcactccagactctcatgccatctgaaaactaaacaatacacaatctgtattgactctgttatgatcagttagattaaaaatattctacatcatgtctgtcctagaccagtcttgatatgtgtgatactcatttgggggaaaagatatgcttgatacatgaaaaacatattggcacaggacaaaaaatattacctccatggctagaacatattcttccaaatgtttgtaaggttttttgttttgtcaaattattctaaaaataataaatgcaaaataatgactagtctttacatgccaattatgttactagacatgacatgaaaaagattttagaaatataatagccaagcattcaatattacatagagatttatgtagttaaatggactataagttgttgaaacatttgactgtacttgagagggaaaaaagtatggaatgttttcaatgtcattaattatgaagatttttatttattattcattaaacacttgacctaaagtattacactaatgctgttgaccatgctatatgaaattaataaacaactgcaatgaaaatttactatgaacactctctaaagtccagcaaaagaatctgtagaaaatttatttaaaatattccaaggactttataagataaatctgcttatttgaatacatcttaagtgattataaggcattgttggtttaataatggttatctagttggtaataatggtaatctaatgcttatacacatatattgctgtcagcaatttattgcaatagttctgtcttatctgtggttatctatctgtggtttcagttacccgtggtcaaccatggtccaaaaacattaaatggaaaattctaaaaagaaatttggtatgttttagactgcattctgagtagcattatgaagtctcactccattcttctgtatccctcccagaacatgagtggtctcttggtccagtatttgagatttcaggcatccattggaggtcttgcaggatgcttatgttgtatggttaaatagggggatgataaccttaaagcatttaaaagttgagacattttcaacttttactcaatttgtatgttttagagatatataaagttgagagctcctacttaggttttaataatgactcgagtcatagccaataaaacctatatttcattttctaggatatttaaattgcctcttttcattggcattacattccataaatgtaggaaataaaatatcagtagatgaactatactatttccattaacctttttcttgccttttatttggctatttgtattgttttgtcttatctcaaaggcaaaacataactcagaaaaagtaaaca

SEQ ID NO: 51735 - DNA, 1127 bp, Bovine  19866881057948
tatttttagtgatttgagctcatgtacacttgttaccttatagccagtaagtctatttgccattgttcaataatgaataggtatggaaagagggaatatttgccagtatcatgagtcagtaaattgcttttccccttttacactgataatcacatcccttgaaataactcagcttctttaaagaaataaagataacaaccattttatgtctttttgaagttgacagataattttaaaaatgtacttccattagtaatgtcattaaggatgcactgcccaacttcttctgacctccctgctcaacaacttttatggctcccacttcaaagtgagagaggagtgcacagactcaaaaattgctgtgaaggacaagcaaaaactagagtgaagctccctctcagttttgcactgggctgataaggtgctacatggcagttcacacctttctcatagctatattttctgtttgtcctcaaagttctttatatagacctgaattttatgaaaataaacagaaatcatttatctaaataatccaaatgggtatgaatataaaacattttgaataagaatgaatcattgaaaatgcataagtaatctacgcagggagttttcaatggaaggagggcaggcctcatgctctcctttaaggtcttgtcccagtatattctacccataaaggcatgcttttacatctctacagaatttgtaattcttggtgtaggtatcccagtaatgggtttccacctttatcaatcagaaagcatatataatagacttctctaaaatataattaggcagcaaaaggcgtagatataatgtgtaagaaatatattttccagcttccttttaaaatgatgtactataaaatagtatagtcaataaaagcccttgtgcatgatgtgttgtccttattaagcaattatttggctgactgcaatgttaactggctgactcaactttgacttcagtgattaaggctattcacaagttttcctagcatacgttcacagttttgtccagtgaaatctttatttgactacagacaatcagccgatgtcccagcaatgtgcatgcacagataagtagccgcaaatcaggtcccataggaaggtgtatattacaaa

SEQ ID NO: 51736 - DNA, 2538 bp, Bovine  19866881162987
atattaaataggaaaataatactctcaaataaatcaatgtttaaattacacaatggtctaaaatgtaaatcaacaaacttaaaaacttaaacggaaatgcacacaatatgattaattaaaacaaaaaagtcttgaaagttatccagcacagtgatcaaagatgaatgcactttattaccatcttgccttatgcccaagtgattttactgacagctttcaaataattctgatgtcaatcatttaacacctggcattagttgaatctcttttccaattaaagtgtaaaaagtttactcacgtataaataatacatttaagatacgtacatactccacttaccctgacttgacccacaaaggcattggcttcttcttctaccactgacagatttctgggcagataaggatcaaagactggtgcgttgtcattgacatctgtcaccaccacgtttaccgtggcagttgaggtcttaaagaaaaaaaaaaaaagtgattaaatgtgagaggaggtatttttattttgatgtcagttaattggttatctgggcatttgtctatctgaaaagcatttcattaccattcctattccttagctttccaaaaaaagacaaggaaaaaaaggaagctcgcaatcttcaaacacctcaaaaataaataaataaataaaagtcagatgggaaaaacaaatgatgacattaaagggcaagcatcttcttgaaaatgtcaagtatttcctggaggcttacgttcagaaagtgcttttacctttatcttgttcacattttatggatggtaagcttttatttatatacacatgcacctcttttttctctgaaaagtaacatttctggagtttttaccatgtacatgttgcactgttcaaaaatataactagtacattataagataacatggtataccaaatgggtattttcagataaggaaatactaccagaaaatactacattagtaattttctagatacacatctaaaccaaaagtttgagtatcatacactgcaaattaaaaaaaaaaaaaaaaaaccttatggttatacagcctaaggaaatggtaagtgggcaaccctaccagtggtatgtacttcctggttaaaaggtgaaatccctggcctgatgcaacctgagactataatttaggtcaatgacttttgcataatcaaggaacatcttcatacctgatgcaaatggaaactgctctttctaatcaaagcctgagtatagtttatgacctccacccatctctgtcacatggtggggaagatcacagaaggctgagaccaaaatcaaacaaagcaaggatgctagtctggaaaatgaaaaacccataacaggcaaataataagtaggaggaaaaagcaggacgaaactatcatgggtgaattatttacatttctttttataaaatacaaaaaattatcctaatctgtttaagtaaggtgagtgaaagactagagaactgaacataaagaaacgacttaaaggaagtgaatctgaagaaattttgcagtggtcatgggactatggatgtcaaaaaactggatttcccagataatgactatggtatgataactcacctaaaaccagatatcttggagtgcaaagtcaagtaggacttgggaagcaaccctatgaaccaagttagtggaggtggtggaattcaagctgaggaatgtcaagtcctaaaagatgatgctgttgaagtgctgcattcaacatgccagcaaatttggaaaactcagcagtggccacaaactagaaaaagtcagttttcattccaatatcaaagaaagacaatgccaaaaaatgtgcaaactaccacacaattgcactcatttcacaccctaacaaagaaataccccaaattgtccaagctagacttcaacagtttgtaaaccgagaacttccagatgttcaacctgccttttagaaaaggcagagaaaccagagatcaaattgccaacatccattggatcatagaaaaagcaagagaattccagaacatctacttctgcttcactgactatgctaaagcctgtgacttgtgtatcacaacaaactgtggaaagttcttgaagagatgggaataccagaccaccttacctgcctcccatgaaacatatatgcagctcaagaagtaagttagaactgtcatggaacaatggactggctcaaaattgggaaaggagtatgttaaggctgtatattatcaccctgcttatttaacttatatgcatagtacatcatgtgaaaagctgggctggatgaagcacaagctggaatcaagattgctgggagaaataacaacaaattcagatatgcagatgacaccactaatggcagaaagtgaagaggaaccaaagagtctcttgatgaagagaggacagtgaaaaaactggcttaaaactcaatattcaaaaacgaagattatggcattcggtcccatcatttcatgccaaagcaatggggaaaaaatggacacagtgacagacctcattttggggagccccaaaatcactgca

SEQ ID NO: 51737 - DNA, 714 bp, Bovine  19866881199458
cacttataataatgaaagtgaatgctctgaattttactaagacattccatgcaagaattaattcattttcatctagaatctaaaatgtgctttcatgtttctattgcatagttgtttttttgctgtataacaacggtgatcacataaccttttatccaaactgggacacttttgaagatgaaagaagtgttatgaataattatacaagaacaatagtcataaatatgaactgtcctgggcaaacccaggactggctatgattcttgttcaaaatgtgtatttcattttaaagtatacttaaattattggagttatgtaaaatttgaaatgggatgttcgttttgaaaagaaacatctttgtctctttgaattagatgggttttaatcttttaatattctatacttggtgaactatccatcttttctttctagtttcacctttccttgttatttaccactatactgaataaaccactggcagaaatagataaaatgaagatgacaaatctcttctttgtgacacttactggctgttaaatgtgcatacagctttttaaagtagaattcttcttcaaagtctagaagaggatacttcattttatttttctttagcctcaaaaacagaaactggggtcaagtccaataaaaaaattatggccaatggaaaatgaagcattattaaaataagaaaacgggaagaaattgaaagactta

SEQ ID NO: 51738 - DNA, 1690 bp, Bovine  19866881263723
aaaaaaaaataaattccattttcaaccaaggaccaagatatcaatctaattcacactttgaccttcaaaattcccccttggctacgcagggtttactgtatctaagcaaccccccatctctagtttttcatctctggcagagatggctctggaatattgggtaaaaattacaccacaggagggtgtccccccaaaaaggaaaagaatcactgagaggttgtgaatttaccaatttaccaaatatcttttacatgtgaaatatctgagattctttttatacctaggctcttttaatactgaacagatgtcatctggtaattcagttctgggccaggtctcatgcacagaacaatgcatatattaacagaagctgtttgttcttcaacaccttttaactgattgtctgtacatataaaaggagcaaaagtgaatgccttccatgtaatgtcaatttcacaagtatgttacttaaaaataaatgtttacactgtatgttatttgaaaccagtggctaaatatatttgtatgacatcatattctaattccattgatttactggaatgtactgagagtatatgtctataaacccctataatataaatctacaaatttattattttaggaaataaatctatattattttcagcaaactatatatcaaaaaatttcatacatgttttaatagtaacaggtattttattttaactcctcatttaacttactttctccaattaagagtagttctatatttctgaaaaataagcaaaagaaagaatcattttccacaagttctatcttctttaaattcagttcagtcactcagtcatgtccaactccttgcaaccccatggactgaagcacgccaggcttccctgtccatcaccaactctcggggcctgctcaaactcatgtccatcaagccagtgatgccatccaaccatctcatcctctgtcatccccttctcctcctgccttcaatctttcccagcatcagagtcttttcaaatgagtcactttttgcatcagctggccgttttattggagtttccacttcagcatcaatctttccaatgaatattcaggactgatttcctttaggatggatttgttggatcctccttgctgtccaagggactctcaagagtcttctccaacaccatagttcaaaagcatccattctttggcactcagctttcttttttttttttttggttttcttttttttaaattttatttttaaactttacaatattgtattagttttgccaaacatcagaatgaatctgccacaggtatacctgtgtcccccatcctgaaccctcctccctcctccctccccatacccgcccctctgggtcgtcccagtgcaccagccccaagcatccagtatcgtgcatggaacctggatcagctttctttatagtccaactcacatccatacgtgactattggaaaaaccatagatttgactagatggatctttgttggcaaaataatgtctctacattttaatatgctgtctaggtttgtcataacttttcttccaaggagcaactctcttttaatttcatggatgcagtcaccattttcagtgattttggagcccaagaaaataaagtctgtcactgtttccattttcctcatctatttgccaggaaatgatgggaccagatgccatgatcttagtttt

SEQ ID NO: 51739 - DNA, 1223 bp, Bovine  19866881634368
cctgggctgggaagataccctgcagaagggactggctacccactccagtactcttgcctggagaattctaaggacagaggagcctggcaggctacacatcatggggtcgcaaagagtcagacatgattgagtgactaacacacacatatgctttattatattctgttaaacaaggagtttttaatctaatgaagacagtacagatattggcttgtgttggagactgagatgcactactcaggttccccttcaagaaaagacattctgacttcttaaagtgatgtaggaagatgtccttcagctgccagacacttcccagaatatttcagtttgcacagagaagggtcacacctttctcactgtagcccactgactgatggccaagtgcaaagaccttctcattttgacccaatctggaataactcaaacatgcagcgccaattccagagctccttctggaattggccaaaactgttgttgatcctgtacagttagatttttctcttaatacaatcctgcttctgtctctgcttttcacatgcatggatctgatcttattcctgtcccactgtctccttcacagggaggccagtttgcaagcaaaacccttatatagcacaatgttttccctcaagccatgaaagaatcaaagataggaggctttttttggtaatttttaatctagatttagtctacaaaataaataaataaaggcaggcaatatttctttggcttgttttctccctattcagtttatgatatctcagaaggattagttcattgggattctgaaacccaggcctggaaatattccctataggtatcataactcatgatgtggatatacagaaaatatagtctctttttcactgtcatattccttctacctcaacatttttatagagagttcttctgagcctacagtcttctctaatggttttacgactcttcggtatcatacttatccaagtcttcacagacagacttttgtcaaaatcaatcagtctttatgaaagtagcaagaataatgcttcctctgggcaaaccaaatcaaagtgttcgcacctgtcatgttggagggtagttttcagtctccaagtctttagattttaagtttgaaaaaagtcaataactttcttctttattatctgcaaagattcttggtagatatagagtttcgatttctcagaataatatgcttcattttaattcctgatttatat

SEQ ID NO: 51740 - DNA, 1352 bp, Bovine  19866881742266
cttcttttgttggggggaaaaaaaatgacgtgatggtgaaaagttgagtccccagagaatttatgttgtgattttcaattccagctcactgcagtcgacgcagacgaagggtcaaacggggagatcacatatgaaatcctggttggggctcagggagacttcatcatcaataaaacaacagggcttatcaccatcgctccgggggtggaattgatggttggacggacttacgcgctcaccgtccaagcagcggataatgctcctccagcagagagaaggtaatttatatcagaaccaatgcagtcttttcatcggtctggtttaaccccataattaaatttaagaagcgcagcgagcattcttttatcttataaacatctaaattggaccagaaaatcagagagactagtttctcaggaactgcatattcttcttttgtcaaattgcggaaaaagtatgataaagtcaagattaagccacaaaataatgaactatgattccaagatgtgaaggatgcaagtctctgttgggagggggagtgggaactgggaaatatcagaagcctgtgtccaatatattaatgaaaagtaaggttgctactgagagctcatagataacgtgcaacacatgatgtctcaaggatttgaagccatccctcagtgtctggataattatttttaaattatataaatatatatatataattttatctagaaaatcattatatataatataatcttatatatatgtatacatatatatatatatatgagaaaacattaagagaaagcaaagtaaaaagactttcaattattacaactacatttatttattcccccacctgagatcttccttttatttcttgtttgttccagatttcaggatgcattttaagaaaatgtaaacttaatattaatacattattgaatctttctaggaactttatgtctcttcatttgcccatgttttcttttgtatcctttagtagattttattttcaaaatttttttttgcaaatgtcctatacatttttttaaatttaatttaattttatttcttaacttaacaatattttattgattttgccatatatcaacatgaatctgccacaggtatacacgtgttccccatcctgaaccctcctccctcctgcctccccataccatccctctgggtcgtcccagtgcaccagccccaagcatccagtaccgtgcacagaacctggactggcgactcttttcatacatgatattatacatgtttcaatgccattctcccaaatcatcccaccctctccctctcccacagagtccaaaagactggtctatacattattggctcttctgctggct

SEQ ID NO: 51741 - DNA, 1038 bp, Bovine  19866881824620
tttgagatgatacttatggatgagcttaatgatacatttggagaagtacaatttaataggagtgagtcagcatggatttaccaaaggcaatcatgtcagaaaaaatttcgttcctttttaagttgaagtaataattggtttatgtaagggagaaccaatgagaaactgtcaggatttttggagatttttggaccttttcataaaatgaattattgtacaaaatgtcatggcatgtgtcagggtacccaactaacaaaaggggatgaaagtaagggggttaaaaatagagggccaaagaattcaggaaagactacattccacaaagcttcatatatcagaacgctaacgtttttaattaatgatgaagaaaaccttttatattaggaaatttgaatatactagtaaatgagagggaatggttaagatacaaaaggttacagctgttttatcttaactgtgatagattaagcaaatggcctcagaggtggcatatgaaatttaatcttcctgagtataaagtgatgcacttggatagaattaaggaatcagttaaaaatagtttaaatggtactgaattgcttaccattaaaaagaaaagggatttggaattttgataacagtcaagcttttacatttttattcttataacttgataagaggaaaatgcaagggaatgcagttaaataatacacatcacaaagaattaaaagctgactgccttactgaagaataaaaaatcctaatttgtgaaaagggtttgatagattcatgggctatcatcttgcacaggcaataatctaatatataatgtaaatgactatatatatataagaactaaaaaaatatatcaatacaaatatgatttaaaaatatgacagcagaaaaactaaggaaccccagaggtgctatgtgctcagtcgctaacctggctgtgtgaccccacagactgtggtcctccaggctcctctgtccatgaattttccaggcaagaacactagagtgggttgccatttcctacttcaggggatttcccaaacc

SEQ ID NO: 51742 - DNA, 1379 bp, Bovine  19866881869818
acaaagtaggaatatatggacagaaaagaaaatatggactgtatttttctatggaattaaattcaccaaaaaataatagatatcaggaaaatacatagtgaatatcattgtagtaacaatccacttagaattgagaggctatgagtcaaaaccttcactctttattctgccaaaataggtcgagtgatagtttcaactgaggaaaaatcccacactaatattaaatataaataactgctaaagggcaaacagaatgacatcctaacactggcttaggggcaaagctagaaatgcaagggagctaaaccctgagttgactacataaaaacaaccttggtataaaaatgtctccttaaatctagttttgaaacacctgtttatgtacttaattttttctaacagaataaaaaatttgataataagaaataaatataatacaataataacaaatctgaataaattctcatatggaaaatatttttcaatgactctgacagccatacttcttcaaaatcttgtctagaaaataccgttagtgaagcacgaattagtaactagtaactcacaatacaaaatcttgatataaaactaaaactttttaaaattttctatttagcatttgtgtttttgttttgtttttaaatttcgacttgaaataagaaatgtgggaagcctaacaggagcaaattaaaatggcattttttcttttgccatgcattctgtaaaactttcttattcactctcaatcttccagaaagtatgtatcatagaaaagattcttgaaagaattatacaactccagcatttgaggagacagtgatctagaattactttaaaagtaatcttcaccataatggaatgctgcaggagggctgaaagtttcacttttagaaaataacaaattgcatggcatttaataggccttgactaaacaggctacagccttggaaagaaaatcactttcagcactggccttcttgctaatgtattgaattcttctataatacttgaccctgccagaggttgcataaggtttagctggagctgtgtcctgagggcctggaatgagttcagaatcataatgtaccttgtttttggtggcagcataaggaattgagaagaaatatcatgaatggtataggagagtcaaataaaactaaggatacagtgaatgtaagcaatttgaactaggctagatcagaagaatagtagtcaaagtcagatgaggtagagacagagaggagatgagaagggacatagtaaaaagaaagcagagtagaaaaaagtagaaagctgcatagcagaaagcagcaatgtggagtaatccctgagtaaatttcaggaatatttgattatattcttatactttccattactgg

SEQ ID NO: 51743 - DNA, 1343 bp, Bovine  19866880140302
tggtttgccttggaaacaacagagatcttctgttgtttttgagattgcatccaagtactgcatttcagactcttttgttgacctgatggctactccatttcttctgagggatccctgcccacagtagtagatataatggtcatctgagttaaattcacccattccagtccattttagttcgctgattcctagaatgtcgacattcactcttgccatctcttgtttgaccacttccgatttgtcttgattcatggacctgacattccaggttcctatgcaatattgctctttacagcatcggaccttgcttctatcaccagtcacatccacagctgggtattttttttgctttggctccatcccttcatcctttctggagttatttctccactaatctccagtagcatattgggcccctactgacctggggagttcctctttcagtatcctatcattttgccttttcatactgttcatggggttctcaaggcaagaatactgaagtggtttgccattcccttctccagtggaaatgtatttagtgatattgtattctctcggctgttggacacccagaaacacttaccttatccacagaccaaaagctctaaaataggccgtgctgccatcttatctatagagatgaatgtatcttcccagaaaggttatttcacttcaaaccccttaatccagaggctgaaaaattcccattgtctccccaaatagtattaaaataggaaaattcaaatcactttgccgtattgctgagcgtataagactcctagacctaacttcctaccttcaccctgctctttgtgcctcattacttaccggttaaaatggtgtctaaaatagctctgaaatacttactacctttggttatcagagatttgggaaagtggaggttggtgctgagaaaccttgtttgtgctaactaggactaacgatctaaatgtcaaatgctaatagaaattcaccaaaggatttgcttaaaaaatggcgaaattcattattttcagaattttaattggttgttgtttgaactttctggcttctctctgcatcaaaaacgcatgcaagatttattttgcacaagtatgtcaagtaatgctttttgaccaaatcaagcagacttaacttaatgactatagtggtgggcctagtcccaattgcattaattggtaaaatatttatgacccacagtatcataatgtatgtgcaaatataagtgggatgttgagtgacccagataacattgagagtgccttgtctaggattggattaattctactaaacattgttctttgatgctctttgggcctaaggacaactgaacagaaact

SEQ ID NO: 51744 - DNA, 920 bp, Bovine  19866880367694
acatgagttttagtaaactccaggagtcgtgatggacagggaggcctggtgtgctgcagtccatggggtcgcaaagagttggacacgactgagtgactgaactgaactgaactgagctcagactctcaccagctctcctctgaatcactgaaataacattaaaaatggtctcctgagtgctaagatttccctttccaaatcattgtctggatttggaacactgctccaaatagctttgtgctttcctgccttctatgtcttctttaagatgttcagattgttctgatgcttagaaacctctttcccactcccatacctgttactcaaagtactgaatcatttcttgctgtctagctcaaattccatgaaccatacccaacttttactccttgcaattagtctcattccttagctgtttttcctctaaaacattgttgtacctctattattgttcttactcagtctgttgcaagttatatatcatctttgattcacccaaaacatctatataagactttattcatagtagaggggcaataaatgctattttaaattttacctcaaatggcacaaagttggatcaaatcagaatatctgataataccaaaagtaagacttataagatgcttactttgcagccattgtaactcgtatatttccataattttattatttttaaatttatgtatcttacagccatttaaaatgggtcttaaacttcaagatcctacttattatttagtttggagagatgctagttcacagacacatttatcttctttggctcagtttggtttcatatgggaaatctctttttctgatatcttgatgaaagaaaattagtctgtccactgaggtgaataatgccttagataaaggacaagtcaatgcccagatagctgtaaaattccactgttgca

SEQ ID NO: 51745 - DNA, 645 bp, Bovine  19866880431242
ttgagttttttctatgctgcatgtaatgaacataggctgtaaaagaataccctaaaataaaaatacatggtggcatttaagatgtttgttgaacttgaagtggttactcatggtctctcttagtgattacaggttttcatcggaccctgtggtttgcattactgtttgcaaagctggggaagacggactggtggaagaaggctgggtgcttttcctctacaaggtgggcaccttgctaactctttgagatgctaagttggtaagaacaggaggtggtaaaagtcccgaaaaggaaatatcagcaatactttctgcttacaaatctctgacctactcaatttatcaagtgaggatattttacattttaggttaactagttcttttttgaggtactcaaacctcaggagacagaaggccatctaacaatatatcttaatgtccatagttttaatccgatcaacaactgggttaggttagtttcaagggagaggcttgaaagcaggaggtataaagaaggagagaaatggggggagagcagaggcccaccaaggtacagggacatctctctcctttgctcttagagtctcacaagtgtatgtcacagactggaaccccagggctgtatacagacccacactgttttga

SEQ ID NO: 51746 - DNA, 1066 bp, Bovine  19866880574101
ggattaggatcagggtctcattcccacagaggaattttgctgggtggtctctggtgtctgtcacttttgattggattgggcacaaaaaataaatgtgtcataaaacctctaaaaattgttcagcagcctaaagtcacagaaattcacccagcttgtttattttggggaggtactatggaaaaaaatgcaactctcaatgttcttgagataaaaaaatgttaatagaattttagaaatgtcttttaattggagaatctcataaattcacatgtaaataaaggatgattaataatagaggcactgatatactgatatgtacaattttttggtctcacacaaacataattatggactgtaaggggtatgctggctttctatggttttagtttattatgtttttgagggtacataaggcataatagaaaaaaacaaacagaaaacaaaatatcaccttcccaacccaattagcaacatctcatactatgtaaaaattaaatcatctttaagcactttaaaaacaaaaacttccactgtccttggtctgtgggcagagcctccctggagaaaacaaccttatactaggtacaatgtaactatctgtgttgcaaatttatgtaaaatacagatgcagcatacagagataccataggccaggaaacaaaaatggacatatgagggtccgttgtctgaaaggaagttaagagctagggtcaatattaactccaaagattaataaatcttgatagtctctatgcaactaaaaaggatagacttacattattatctttggtttgcacagggctttaagtatttagaaggtaggttgactctaggaagcagaatatccattttttcaagcgttgcctttctaaaatgtaatgagcggcagtttttatttatgagaaccaagaaaaactttgtctagttactacatttaaaactgtgtgaatctctttactatgctgaaagcttgtttcctttggtttgttaacttaagaactagcattattgaacaataatgtgttatttctacaatataatatcaacttattagagattttattgg

SEQ ID NO: 51747 - DNA, 935 bp, Bovine  19866880588368
caggtaagaatactggagtgggtagccgttcccttctccaggggatcttcccaacccagggatcaaacccaggtcttccacattgcaggtggattctttaccatctgagccaccagggaagccccaaaacaacaccttaaaataattgaaccaaatatttaatgagcactttccaataaaccagggtgatttcagtgaaatgttgctcagataccaacaacccagcaggttaacaaaacagacagaacaaacccacacactccaatacaggcaaacatgtctttaagcccccaaaagacattttcccctctttagttaaaagcaattaattcacatgtatactcaaaatcataaaaacacagaaaaaagattagcacaaatcttagtcctataattaaaattaactgtgtttatcaatagaagcaatcactccatgcattattcaaggcctcctgctaggaaccaatagcaaaagagagagtctcaataaatttgaaaaaattcaacaggtaagaaatctcaatttatatctgtttccaaacagaacatcaaggtgaataaaccagacagtgaagccactgctgattcttctcccggttgccagagatctccctccaaaaaacagcttcatcacactctcagaaaatacagagatcccttcttatgtagctagaaaaggcattttaaagcaaagtaaatcatttttaaaatgttgactttcaagacttccctggcggtccagtggctgggacaccgtgctcccaatgcagcaggcccagttcagttcctggtcagggtactagattctgcatgcctcaactaagacccagcccagccaaataaatacataagacattttttggttggtggtgactttcaacagggacacttttacactgtctagaagaactggacagaactacctaaactaccat

SEQ ID NO: 51748 - DNA, 1258 bp, Bovine  19866880655374
aattggtttgagggtataatttccattatgataatcttattgtagacttttttaaaaggcggagtgcttgtctctgttttaacgagatactgttttaactggatactggcagcaaccccttttaactctcaataatataaagatatttcttaagcagagaatccagtgttaaaatttggcaacaaacctgtgttcttgtcaaaagtcagaaatcacaaaatcaagctgtcttattacatactttagctttctactttgagatgctcagagaggttcaataacttgtccaaggtcacacaggtagattaatacctcactcaaaaatttttcctaggtctttgaaaccataaggaaaatatgaagatcatctacgtagtcaaataatgctgtgacattaatttcactcatgatagtataattcatggggataaaaacatattattatttcatgtattaagcacattatacaattaactgacaaaagaaaaattcaaatccacgtgactaaatgctacaaccaagtagaaaaaaacagactaaatattatactagtctaatgttatggtaaatttggatcaatagatttttcctccccaaacccaatttcatttattgaaattgttttttattgtattaaataatatatcaaaatgctaatttactaaattttagtttagagttataaaataatagttcaaggaaagattaagattctattaatctttctgtagatgagaaaattgggagtcacagagattaagaggtgttccccatatcactcactagtcagggcagaaagaggcctgagatccaattcttggcctactgactcatattatttcctttggttcctcacaccttccccctcccattttgttattaatcaaacaggaatgtgaatgtatcactcaggattaattggtttttaaagggactattctattttcagaatttaatttaattctatcttcaaagagcccagataagattctcaatctatagtggtctataggcatctccagaagtttaactcaagccaactggattaattcaagctaattaaaagatgaattatgattcatttaatccaacatgtactgttcacccaccatgagcagattctgtgctaagtgtgttaaaaagatgaacaagatacagtcaagagaactcactagaaagcagtgtgagaggatgtgagacagagtctgcacaggtgcaggtaggtgctaggagagcaaagaggagggcatctacctca

SEQ ID NO: 51749 - DNA, 1327 bp, Bovine  19866880681300
agactgcagctgtgggctggatcctgtgagccaagtttggttttcatctttagagaaataagcatcaatgcagcaaatgctcatgtagctggcattccaatgaacagtgcgaatgggaggtaaaaagtttcagccaacaatttcctttaccacaataagagctgagtaaaaccaagctacatacagtttcaggaaactgctagtagattatgagcctttggaagggatttattgtttcctggaagttcagagcctacttaattatggggagaagttcagtaatattgctgaactaaacgacagctataattcagaacagtcactttcaaagttttcagcctgtggtccaactgggagcacctgtgcccctccgggttagagccctgtcttgtctaaggctcctgattccaggagaaagaaaggtcacctgcagctggggaatgagacatggttcacgggaacacacacacacacttcccacccgaccttcagaaacagggtgcaaagccgcttttaaaaacaaacaagagctgagtggggaaggggtggcatttaaacacttgtgtctgtgaattataatctcgactttccaactgatactggcttgaattttaagcacttccttcatttcccacaagtaaccatcagttaccaccagcagcacatagttccttctgtgtcagatctaaagctcagtgattcttataaaaagccagcagtcccttctgatgttacagggaagaattgagggcaaaggactggagttggcttacactcatacggttttttcacacagagaacaaaaccaccagagcataaaccccactttttgttgaaggtaattaaatgcaaacacacttcagcaaaatctctaagatccaagcttgaagcccttttattctattactcttcactacatcctcttagcctgatgactgaaaactggaaacagttgtccctgccattagtgagggttattgagagtccagctgtaattccatccttcttttctgactctaagttatatcccaaagggaaatatgtcatgcttgtagggctcacatgataatgccttatcccatcaagttttaatggttttataatagagaaaagcagtggcaaggattatttgaaataaggtataatcctaagtgacatgtttagaaatcctgatttttttttttttttttttaatagctctgacctccccaatacatttaaaatcagcttgcttccctggcagacagcagggggcagcagatcagagtcggctctctctcagtgagagcagtttcaaagaggaaaatttactgcagaaaaatcctca

SEQ ID NO: 51750 - DNA, 1466 bp, Bovine  19866880719646
ctctctctaattttagctgatctgttttcaaattgctgatggagaaagtaagtacagtatcctataaatatgacaggttccttaggtggttgctattttggagatggtctggggctctctcttgtaaagttgtcaggacaagccattgcttctggtgtccaagggtcagcttacagaaagcacatgagcttcctaaaagtctcattcttggtcagtgttggtctctgtttggtgatgggccaatatgggacactcaggtgatggcactggctcagtgcccactaggaaacatggtatttctttgattccttttatttgttttggctgtaccatacagcttgtagaatcttagtttcctgaccagggattgaacccaggccaaagcagtgaaagcactgagtcttcaccactggaccaccaggggattccctctggttctttttttaaaattaaaaaaaatagaaaacaacatttatttttaattgaaggataactgctttacattgttgatttctgccaaatgtcaacacctggggttcttatttaggctttttggtttcttttaagtgaccgctttattctggaatctgatcttttaaaaaaattatttaaatttgcaaataatacacagacatagagagcagagtataatgaatctccatgtaccatctccaatttggtttcatcaatctcccctcaactcaattttccccctccttcctcattcccttcctcttctttccctgcagaaaatgaacacaaaatctaaacaccatccttttcacctgtaaatattcaatatgcacctgtaactagaatacttttttttttttttaaagcaatatgttgaaagtcaattaaggtgttagaaacacactagcaaaatatatcatccagtatccagccaatatccatattttcccctgcactgtcaaagcgctatcaaccctgaatattcattagaaggactggtgctgaagctgaagctccagtacctgatgtgatgggctgactcattggtaaagactctggggctaggaaagattgaaggcaggaggagaaagggacaacagaggacgagatgggtggatggcatgagtatgagcaagctccaggaggtggtgaaggacagggaagcctggtgtgctgtagtccattgggtcacagagttggacacgcctgagcgactgaacgacatcaaagacagcttcttagagttctcctctttttgcaagactgactgatctgttgaaggagctgaatcatttgccccaggattgcttccttaaggtgttgttcagtttgtgtttcttataagctggaagttagatgtggaagcttaattagattcaggctcaacatttttatagcctgactttctattatatggacataatgtgaacatagtaatagttgatcatgggaattagtgaatttccgccctcagaaatcagaggtagaacagg

SEQ ID NO: 51751 - DNA, 1162 bp, Bovine  19866880826376
acccaaggtgtgaatagtccaagttactgggctacctggtaactctgcaaaatccacccagcccctttatcacccatctgcagctccacacacagaggccctgggagcctgaaatgagtactagaacagctgtcagggaagcaggacagcgtagagactccatcaatactgcacagactcagggccggactccctggtatgaaccccagctctccactccctgacttgtaactgtaggcaaggattctgtgcatccatttctgcatcagggaatacacaggaagggcctgtgccagtcattggtatcactggtagtagaggccctgaaaaaggcattcctgccacatggctctctgtgtggcacacattcctctcgtaacctatcctctgtttcagcccatcttccttcctctctcagagcatttcaggctcctctacaagacaagagacaaacagcggagaccagggacaagaccacctgaccacagggctcctgagaccttaaaaaagaaaggttctcccaaattggttgctctgaaaccaactgccagtgaaaatcttgatgcctcagaaagtaattccctccactgtcaagagcagtggagatcttacaatgaattacttgtctgttcacgtaatagcttgaaactgacacctctggggccacaaagaaaatcatgaggtcaattcaagcttattctgaatgtcaaagggactctaattgatcctggcacctcaggggtgcgggtggtagtgaggggaagaactttataaatcatctagaccaagggtcacacccaaatacccagcgtaccaatcaggtcacaaaccacaaggggactggagccagctggggactgcgtgtcctatgtggtgggagggctgctacttagctccagccaactgctgtcaggggccaaggactgccagaggttctgaatgtttaagagaaactggaaattcagattctgtgggagggcccagcaaaacacacctgcagaacagacatggcccaagggctgccaggttgcacaccctgagccagacagggcaggggttcctgcctgcaagcctcagatccctgaaggtcacgtaactcccacactaatccaaggtgaggaggagacgagggtccccagctttcacagactaaataaagaat

SEQ ID NO: 51752 - DNA, 1957 bp, Bovine  19866880851934
gttgttttgtgaaatttgctcggcattcaatgtactttcatgaatttgtgggagagaaagtggtctcaccatcctattcctccgccatcttaggaccaccacctgtttctttgtttttagattgatggaagtatggaggaaaacatgctaagagtcagtttaaagaaatgaaagtggctacctgtagagaacagaaattgaaaagaggtagtcagagttctgcttttttctgtaataagtcttgtacagcaatttgactctctaaattatgatcatgtgtaactgtgataaaaaaaattagcactaaattaaaaaacaaacattgcccccattattagagcacaattaaataagacacttgctcatgatcagtattattatgtaacaaacatcgttatactttaaaacattaatccctgacaaaatctctgaagatttattttatataaacatatagaagtagaattcatttgtttaaaatgtctatgaactctttaaagtctttttgtatatattcccagattattttgcagaaaaaaatgtatcaaaatattctcatagctgcagtagaggagaataaatctctcaacatactctcatcaactttattattcttcaatccattttgtttggtataaagaaaatagaatttaattgacttatcaaaagataaattagattctgttcatatgaattgttggcctaatagttaaaaattttagtgacttcctgaaggtatttcatagaagtcaattattaatatccatgtttggggtttttgtctttgatcaggatatttggaagaaaatgtgccattacacaagttatgttatacagactttattatgtttgctgtcttaaaaataagctttattctgagctgaaggaaattaatgatcttagactttaaacatgacctttcattttagaagtagttatgtactttatgactatcttaaatttacacagtgcttctttcttgaaaagacttttcaattcatttaacaaacatttactaagtgtatacagtgttctagaatgtaccatgtgctgggacacaacggtaaacaaaacagtttttgtcctaaatactcattgtgtaggatttacataacagcctcagaaagtccagatactttcagcaattgaaggagaaaattatttctgaaaatatacatgtctctatagtatgagaaatagaggtgaataacttgacttcaacttagaaattgctgcacctgagaatttttaaactaatcatgttcaggagtagtatttgtttacagttaaatgtatggtatgcgtatgtgactcaggcatcaagtggtctctatcctgtttataaaaatggatagagaattccatcttcacataaaatatagagaatgtccacaaattctgttttatctttatacattctgtgtaactgaattttttgtcagaagagagatgtgatcctagtttcgaaaacacaaaatactgttacatggtcatttctgtctttgaattgcattctcaatgacactttaaaagaaaactagatatgggacctgacacatactttaaaatgtcaacattcaattatatcaccatggtaagaaggaaaaacctcgcacaattttcacccaccagacacagaccatcctgttgctctgcttctctgccttagtgacagtttcccatttgtacaaaagctatttctgtgacagaaacatgccttctctttattagtcagatcttgagttataactctctctcttaaaaaaaaaaaaaaaaaggaaagcaccacactgcttagaagccataagaagggcagataaaatcatcttcattctgtaccttccactcacagcactcagagaacttggtttcaatttgaaaaaggcttagtgattagaatggagtcaggcacatttgcagaaagattaataattaggtcttattaagacaatagtgg

SEQ ID NO: 51753 - DNA, 1904 bp, Bovine  19866880932392
atgcttaaaattggctctgaaggacagataagacttccttctaattaataagatccatttgctcacaatttaccatttgtttgttctctggagaagattaaacattccccatctcactcccaccttacccccaggcttatttactctgcttagcaagctttcttgacaaaaggtcaaagtcacaacacttagttcccctatcatctataacagttctcaattagtgaagttttattattaggcttactctgattaatgttgctctaaattatttggaacctatttcaccttaatattgagcgtatttttaagcaaaatgactgaaaacataaaatcctaaagattactttgttattttttttcttttcaaatacaagcactccagacttgtatctgatgtgcacaaatggatggatgtccaacacttaagagaaagtaaggtgttatgagaatcatacatcaccagcatggataattgcttaaactctgttgaatcagtgatgttttagggcatagggggaggtgagaaaaggtctattcctggaaggggttagggaagaggtattcaggtctggtttctaagtgtttgtagttagccaaggtgatgtcctatacaagatagtagaatgtggaagactagtgggaaggaaactcggcaggaaccatgtacaaaacactgatttatcatttctgtctttcccatttattcctgattggaaagttttccaaaggaaatataatgaataagaatccctgtaggtaaatatgtggttaagaccatgaaacagttcccttgaactgattacccatgaaactctttttcttttcagtgattagatgcatcccccaacttcttgggctttcctggtggctcaacagtaaagtatatgcctgcagtgaaggagataaaggagatgagagtttgatccctgggtcaggaagatctcctggaagaggaaatggcaacccactccaggattcttgccagggaaatcctatggacagaggaggctggcgagctatagttcatggggtcacaaagagctggacacaattgagcacatacacacatcctaacttcttgcccctagtaagtaaaatctatttattgtggctcagacagtaaagaatctgcctgcaatgcagaagatgtgggtttaatccccgggttgggaagatcccctggtgaagagaatggctacccactcaagtatccttgcctggagaatcgcatggacaaaggagcctggcaggctacagtccatcaggttgcaaagaggtggacaggactgagtgactaacactttcacttcttttttttttttccaagtcaaaagaaggaattccattcctctaccaaattggaagcctttaaatgttgactgctgttatcttagagcatagaaattgaatcccacctcctttaaaaatagatgtaattaccatatggtaatgtattattaccaaagttttgaatttgagaaagcaaatttatgcagatgtcatgaggtagaaattgtactttgtccattttatttctagagaaggacttgtaactagtgaaccttgaattcccctttatgaatatttcaggcaaattctattactaatttatgaataagagctgtggacttggaatccgactattcagtagccttctttgtagctttaatcattttctggcaggtgcaagtgttttactagtttgttctccagtcaccaaatgccccagttttgttgatataacttaggaaaactaaattacagaaactaggttaaattcacaagctactagccaaaaagttctgagctaaggtactccatctacctgacttacctgaaacagctctaagagacaagctgaggctttcaccatttctgttctaatattaggatcagactgt

SEQ ID NO: 51754 - DNA, 990 bp, Bovine  19866880974775
tgaaccctggctgcctccaattttgagaaaagttaaactaatgagaagagctaaactacgtagtttcagagtaaggtcagatgcctcctctgtttatacagatcatatctgcaaaggtattaagtcatcaggccattcctggagcaaggggaaaatcaaatgcattaatgagttagcaatggttctaactgtctcacgtgacatacctaaaacaaagtttactttccttctttctgattcactatgtttaacaatgacttcacaaaggaatagtgagagaatcagaaagctgttcacctcatgatccaaaacaccaaagaggtggttttggacattagaccaagatgataattcatttttatcttacttctaagttggctaactctgaaatctgttgaatttttaaatgtctgtttttttatcctcttagagaagcggtcagcaattttctcactgccctcagtttgcaaagaaagagcaggaatcagcagcaggtccctcatccggcaatctctgggaatatctgggctgcccttagaattgccctttctctcatggaccagccggaactcttccaggcggctaatctcggtgacctggatgtcctcctaagagctttcaacttggatccttgaaggaaaaggggggaaaacccttcacctgtgtaattgtactgagaaatgcaaaactattttattatgaattccaaaaaaaaggataaaaacggatgttcaaaaggccatggtgatataacccaagggaattcccacagacaatgcccagtctctgttcaaatacaaaaagcacaaaacgttgcatagagtcaagtttgggctcgaaagaacggagagacacaagacaaaaccaagataaagtgaccgtgtttgaatacgcttcacaagccatgagcacagtgcacgtatgttccttggggtttttccaagtgtccacttgcagctgatgacacatctaaggaactgcttatgggca

SEQ ID NO: 51755 - DNA, 1160 bp, Bovine  19866880988444
aaatcctggtatcaatcttcttagacagtaagagaatttatattatacaaaatatatttacttggttttatttttaaaggaagaaaaagcagggggaaaagactatcaaggaatatcttttacctgtgctttttaaaaataaaatatgaatttgaagccactacttaaagcctgggtgtgaggaaaagtacataggatagaaacaacatttgaccttttactagaatggggataagttttctggacccagaaaaactagtaaatgataatagctctgttatgaaaagaaaccaagcagaaaacaatgattccattgtgaggagagcttttagttctctttccacacataaatggattgcttcttgatccacactctttaattctaccactccaacagcctcttctatccacaatgaacaacactgcgtgatactagaagagaagagatggactagcttactctcagacataagcgttttctgggcaagtgtttataaaccataaaccatctttactaagtatcagttgctataagttatttattatattttagacatgtcctttataattcacatcgcttcagaacaaaagacattttttaaaaagaacaagaaattatgctgggagcttctaccctatgtgccaatggactccaaaatttggtaactctaaactggatcacacttctgactgccagacacctgattctgcttcaaattcaacatacccaatattaaattcatcatcttttcctcccatccaagcctactctctttatgtttcttatctttacctaacgataaaactgttattatcctattgatctcttgatggaactgttatctttcattttattcaagtataattgataaataataactgtatatatttaaagtaaactaaggacttccctggtggctcagatggtaaagcgtctgcctacaatgtgggagacccggttcgatccctgggtcgggaagatcccctggagaaggaaatggcaacccactccagtattcttgcctggaaaatcctatggacggaggagcctggttggctgctgtccatggggttgcaaagagtcggacacgactgagtgacttcactatctatctaaagtaaacaagtatacattttaatgttttatatatgtatgcatt

SEQ ID NO: 51756 - DNA, 2784 bp, Bovine  19866881141911
caaaaaataaatttataggatgacctttctaaactcttactattcagataatactacttccaaattggaaaggcacttccaaatagcactctctctttataactaaaattgtcagatctcttgtggaagagaaaatataagattctctgtataaatagtcaagggagacattgacctgggataaaatcagtggtcagtagcaccttgctggagcattatcttacatgcctcatttttaaattcaaatcattattgtgtaaactcactttatgtcagaacagatttctatagattttaataaatttaattacttttttaatattatcattttagtaacccaaaagagccaaaagtagtctatcagggagcataagtaagatgtagttgttatgtatttgccttttgtccttcctggaaattttttaggttaaacttatgacattttcatataaaatgtataaaatttcttccaaacagctgcactgtacaattgaacttggataaaagatccaatgcctctggagcttttagatatgaaaatgtttatttttattaaacctttatcataacaaaggcctgtacatacaactttttggtttacataggtttgggcactttatttgaaagaataaaataccaataatataaatttgatcaaataattatagtattttggctctccacagtttggttttaaaacatatggcaggttagagtaggttttttgttttgtttttagtgcagagtctgaagccatggaaattagacagtctcttaaaacctaatatgctccttattcagtagcatataagcatggggcataatacagattgttctaataaaggattaagacacagatgttttctgtgtttcgcatgatagaatagagtacgctaagctccctttggaggccaagttttctgaatcaacttgtttatggagctgctaagacttctggctttatttagaaaagtctcaatagggtatttgaggccaggctctaaatcctcacctgaattgtgtcagtttacatctccactaataacccagaaaggattagatttatatcactcttttctctgtttgaaaacagaaactctttggtctcatctatcatactttcctagcctgtgaaatgaatgatttgtctaaaggtaatatcccctcaagatctaatatgctatgaaaatataagataatttagatctttatgggacattctgcattgtgattgcaattatttcctgatttagcagttgttaacagtacttatcaaattgttctgaaagagaatttattatgtttgccattatctcagtcctttcttgtaaaatgctatacattaggtggtctgtctacaattctagggcagctgaatgttctagttgcactcaaaactgaagtaaatacatttctttttttattgttttatcaccaaaaacatttgtcttggggtataactgattaacaatgttgtggtagtttcaagtaaacagcaaaggggttcagccatgaatatatatgtattcattctcccctaaacccctatttcatccaggctggcacacaatactgagcagagttttatgtggtatacaataggtctttgttggttatccattttaaatatagcagagtgtacatgaccttcccaaaatccctagctctctcttccccctggaaactataagttcattttctaagtctgtgaaggtctgaagtaaatatatttcttgataggaaaattaatagcatgcaccctcaaaagggttacattgatatgaaaatgcaggtttgaaaaatacttgccacacagctgacaaagggtcaatagccatactatgcaaaaagttctcacaaattgccaataaattgaccagccacccaatataaaactggggaaaggatacaagaggtacttcctaggggaaaaactccaaatggtcaacaaatatgaaaatatgttcaaattaacttatagggaaatgaaaggaaagacatcactttatacttatcaaaccaaaaaaaatttaaagcaattaatacttgttgctgccaaggatagaggaaatgtgtaactatataagttgtaaattttttaaacaattttaaaattaaaagtatgtattcttttttattctgtaatcctattgctagaaatctatcccatagaactataacaatcagaacctaaggaaatatgcacaaagatgctagttgcagcattattcagcacaggggggaaaaaggaaatcaccaagcgaatgctcattttaaaaaatagttgaaaaatcatagtacatccatatctagaacaacgtgcaaaccttaaaaaggatgaactagagctatgaagattaattttggtgattgttcatgaagcataattatgagagagaaaaacaagacacagagaagtgtcgtatcatattatttgtaaaatgtaagatagtgatagtcccagctaatctatatatgtatatgattaaatgtatttatctacaaatatgtgtatttgactatggctaaaatagagaacatatatattcaattgttaattatgcatgaattggatagttggtatgaatatattggtaggtaggaaagatatattggcatgaatatattggtagtaggtaagaaaaaaaatagacaaaataaagactagactataaaaacaacacatatcatcccataaaagcatttatgtcaagttccatatatgtttaaaatatttaacttaaaattattaaaacagtgttttcaaatcaaatccacagatca

SEQ ID NO: 51757 - DNA, 1152 bp, Bovine  19866881148768
cttgtaaattaataaaattaagctacactttgccttcttccctaagttttactgatctaaaaatgatagttctgtatgtgctcatttttctacaggggatctcatttttaaattgctccttaatacaggacattgattcataacctcagggccttagtaagtggcttccttgaagatgatactattttggatttattcacaagaagtaatccccttgagtgactcagataattttttttttttttttttagttttcttaagaaattcttcaggaattcttgtgagatagaagtagggaaaatattatcactttgctgatagggatgtcaaggcttagagatttgttcaaggtcaaagagaaagtcattggtaaagccagaaacttgaatcctgacatcctcacttgtattttagttctgctaaaataacttcctgtattccttggatctgcattaatgtaagaattttgcattttgggacccaggcaacattttaaaaatctagactacttacaaaagactatatattctaaaacgcattcacaattatttctttttatcattgcctttcaacatgaaaaagtcataggacttaagtctattattccattcatataagttgcttaaacttcaatataggtctctaagtctgtgtattttatttttttcttttggcaagagaatatcccagtgggtccatacatctgtgtcctcaatgcatatggcaccagagtaaattatatcccaggttatttgtggttctaacaatatttagtcaatttcctttctcagcaaacttaagaatccatgcaaaccagatttatgcaaatcatgtttgtgattcagctgtggtcagcctcaggaagcagaatcctgtgtaactgccatgtaggatgtgatttaaagttgaagatttacaagagcagtgcaatgtgtgtggtggcacacacacgggccacttaaatatacagtgatatttaaagatgcagaggggtatgaaaagatgacaatgtgcaaattcccacaaatatgcataattcatggtcaattagtatatgtctaatcatagcaaagtacacgattttcttgccaatcccttcctttcctttttaaattgataactggcatcttgaaagaagaagggaaagatgtg

SEQ ID NO: 51758 - DNA, 841 bp, Bovine  19866881173826
aactatgggttgccaactcaaatgcctaatgaggacagcgtgataatgtaagtgacagaagtaggctggtatgagaaacacacagctatagctgtcttgtcctttcttgagtattcccattttggatgaagacgtggatcaggaaaacatttccctatcataagaatcagaatagcacacatgtgatgctcaggatcatgggggcaggagggagtggtgaggtctgtggtagacagacatggagggcacattaccttggagtgaaaactgagaatcggccccaggcagatgttatcacatgagcctctgttacagctttttgtttttgttttttcaaaatgaattggaagtctggagttttgaattgaaatttctgaattaaaaattggaatttgttgccaacattttaaaaacatccaacagaaagtgtctacagatgttgtatgggctcccggttttcgacctctggcttccctcatttcttgttgttcagtgtgaaatcctgcatctgtgtttcccccggttctacattaaactctaatcagtcttagtcagttttctggtcccgtgacttactcccaggaactataacacatcccttgtctctgcctagacatgtgtgcatagttagtggtgctagattgaggaggtgattgtggttatttggagagtccagtgagtataatctctctcattttgcagatgtttctgttgatatgccagacctacttgatatcaaccatctccgagccagggggttgcagccaggagaggaggaacttccagacatcagcccccccatagtattcctagactctaaaggtaccgtcttctgccagga

SEQ ID NO: 51759 - DNA, 1787 bp, Bovine  19866881201135
ctgggcactaagaacctgcaggcatttttctttttaaaagttagataatagctcccattgttccttcttttaatttcataaaatagcaaatccctgtagtcctgagtgatttagccaagtaagcaattataggatattgctggatccatctgcttttctccaatagatttgaagatgagttgagtatgttccgttttttcattcttccaaaaagtcaatcaaactcctactgctttgtaaggtcactgaatacctcctgcaggctcctttcagaattccagttgggaagcttcttaaaacagcagcctgttatattagtcaggtttcctttggttgcaaatggaagaagcccctcacattagctaatgcaaaaaaaaaaaaaaaattaaagagtaggcactatttaatagttcatataacaaaaaagtctacaatgtaaaatgtcatcaaatatctctctcattctctcagcaatatgtttctctgtgttagctttattcaccacaggctcaaatgactgcctctaccaagctccaggctcatgtcagcattgcatgtgatctcagaaggaaagaggttctctcctcccagcatgtcataaactctgcaaaaacgttggccctttttaatgcacatacagcctgcgtagttcaggatgaatagatactctaataattgaccaacctagattcgatacatcttaataggaatcaggaacttgtggttgagactcaggtggaaggaatcttcttcctgtatctccaccataatgtagtggcatttgcaaaggttgtctggcaaccctcactgcaatcttcgccacatgttacatcacttttatatatatccagagttatacatttgagcttatcaaaagcaaggggagagagaattttcttgttaaataaaactttaataacttgttactgaaggaatgaggtaatacaatcaaggaaaagaatcaaagagaaatgtaaaggacaacaaaaactaagattcagagcacttccatgactctagaaatttcttcactccttcaaagcattacccattgctacattggatttccttctccaggggattttccgaacccagaggtcgaagccaggtctcctgcatggcaggcagattctttaccagctgagccaccagaaatccagaaatttcgtcactcctacttcaagtcattacccactctcacattcgcaaccactgttcttatttctatccacatcgaactttcttaaactatgtaattggaattacacagtatgtaattttctataatctttgactcaatataagatatatccctatttttgtgtacaatcagaagttcattacttattaatgagtgctataccactgaataatatcttcaagtgattatgccattttacactcccaccagtaaggtcaattattccatttgttatggaacatgacatctttgtcatgatactatcagtttttaattttaactatttaggtggttgtgtagtgatagctcattgtggttttaatttgcatttccctgatgatgattatgttaagcaccttttatatgcttcttgtcctttcagtatgttcttttgtcaagttttttttttaagttcttgagcacttttatcgggttatcatcattattgacttttatctgggcttatgctttgttatacatatgtgtcgcaaatattttctcacaatctgtgccttcatcttcttactaatatctttggatgggggagaatttttaaattttcatgaaaactaagtcaaagattttt

SEQ ID NO: 51760 - DNA, 1892 bp, Bovine  19866881205233
ttaatccattgtatattcttgcctcctttgtcaaagataaggtgtccatatgtgcgtggatttatctctgggctttctattttgtcccattgatctaatatttctgtctttgtgccagtaccatgctgtcttgataacagtggctttgtagtagagcctgaagtcaggtaggttgattcctccagttccattcttctttctcaagattgctttggctatttgaggttttttgtatttccatacaaattgtgaaattatttgttctagctctgtgaagaatactattggtagcttgatagggattgcattgaatctataaattgctttgggtagtatactcattttttttagatgagagaactataattctggaaagcaaatatgttacagcttctcaagattctttgggttagcacaatgaaaatctgcagggctttatgaaaatttaaaactctttatcctaactagttggtcatacacaataactttaaagtttctcatctttattttgcaaaggaaaatgttgagaaatgttaggtttggatgctcattttctgcatttcttctggtcccgtgacctttttttcactccatcctacgaaatcacaagaagccctaaaaatgagatattcctttcattccaatccagcctacccaatcactgttagcatctgcttgataaattttcaccaatcactgagcagcagagttcctttaggaacatttgactaattaaaatgtctctcccataatgtgtaatctgaagaggatgagaaagacagagaaatatttaagtactaataatttttgctggtatcttttgccaaataacaggacagattgtagaaatttggctgctgctgtatctcaaaggtgttcttcagcagagtgggctgctttacaggattcatagagccaaatttggctccctgcttccatcaactgtaaggaacttttttatatgacatttttcatttcacttactgatttcatctctgatgtttattatttttatctttagtttacacatcatttgattatcccaggtattaattgtattttagtcttttgaagtgttgtgtttatgctacctcaaaacattttctaagagaaaaatagtgacacttggcaaatgcttactgtgtattaaaactcgttaagcattttacatgcatcaataaatggaatccttatgaccctacatggcaggttactagtattactctgcattttttagaagaggaaactgaggcacagaaaaggttgagatacacagcctttatataatggagctaggaatcttggccccagacctcatgctctaccattacatcatattgctttgtctagtatattgaaaatctcttcctatattttttaccaaattggctaattgaattctcattaattgtattaatcatagtgcaacctcttttatctgttcaccaaatatttatcctatttgtatgtgttgtatcagctgtatcagagcctatttgtatcagttgctcttaaagttgttagaagtagtgaggtctgagattttttttttagtgggtaaatgggttaaatcttaagggaaagatttactatgaagtcagtgaaacttaagcttcatctgcacaagagctttccaaaaccctgggagtggtcccaagtcaatgttagcattgtcaaatgcttttgtaaattaaaaaaaaattagatatcattaacagcaataggtcaagattgctatctcttactacatccactcactctctgtcacactttcagtattaggcagcattggagtggccagaattattctggggatccagttaaagggaagtggagtcaagaacacattcagcttgagttttgcataatatatatatagaagtttgccgtca

SEQ ID NO: 51761 - DNA, 1309 bp, Bovine  19866881263709
tgggaacctttctccactctgagaaaataaggaatacagcgatactgatggtaccagcatacgtggctccgctgctgtagactatttcaaagttctctttaactgaaacttagctcttttgttctaagaagttcagcaggctgcataactgccttctgctaaagagctttaaataatccctgccccacactatttttggtatccaggacaatagattattataggcaaaaggaaaaattcagggcagtactccaaaaataggccatctcattttaaaatgaattatctgttacttggtcccagggtatcttgcagggacaaaaaaaaattccccaggggagcaaagcaaggaccttgatggcattttgggcagcaagtttcattttcttctattttgttcattatttaagtttgatcaatttcctgtgttcatttacataactttacatcttaccacattcccccaataactggatagtctggcaatttcaacttagcactcttaatatagctcttgtatttttttttagcaaagtccaaaatggtaagaaaattccaagcctcagcttctatgttctctactttgctgtattatttgtgttttaatagaagtatgaatttatatatattattattattattatatcatttgcaaacaaagatacagcagcaacatcataattccacagttgccagttttatgctaaacacttttgttggtgtctctaattattctatttttggcaaattacatttctttcactatttatattctctcagaagaacaaattcaattgaatttacatcgacctgcatttgtggagcaaatacaatgtattaatactatcagacaacatgccagacactggttataaaagtggcatgcacatgttccccttattaaagagctcacaggtaacacaggcaagaaactgatgcaaatatgcaaaagaaacccattccaaaatgtgagaataatgtaactacagatgcaaaaaggacaaataaggagggaatcttttctctttggaaaggggaaggggaagctagaacaaagacatgatctttggtttgggctcaaggcttttgttttgtaggatattttgttttgagggggccaggtttctgttttgtttacagagccaagaatgctataggggaagtacatttcagaagctaacaaatagatcaaagacaatacaaatgcctggtatatttgaggggaaagcatccacattaataggaatacagatatcacctacattgtaagcccttcagaaaaagtgctaaaagtaagctaagcaaagag

SEQ ID NO: 51762 - DNA, 3373 bp, Bovine  19866881356206
gttaaattcatgatctataaatactgtggtaaaaatagttaatacctggcacttcactaactatgtggcactgaggcattatctaagtagtagcatcctttttttttaagtaaatataacatggaatagttttgagggttaaataatacatgcaaagcattaggcagagttcctgggccaaataagcattcaatgaatgctaacattatttattaggtttttacattattatttggaaaataatattttattaatactatttttagtattaataaagttatttacattcctttcaattcctataattccagaaagcattgtctataaacacttaaggatttttggaacagaattttaaaacattctgacttttcagcccacatcaatttcaatctcatggtcactacaaatttatattaattgtataaggtctaaaaagaaatctcaattgacccaggggcactcagatacttcaaccctcctgttggttgattatcaccctggaaacagctcagcctgggttcaggcataatactccacagatgcctcacaaattgaaaaatcaataaaaggatccatagcagctggtggtacaagagccatagtcagagtctatatgtcaaattataatactgccacccttccttattccagaaattgtttttatcattaaaatttaagtatcagagtttaggacttcctccatcttcttgaatgtatcttgtgtatcatagattagagatgatagaagggatcttttatcattgtagaagtcaactctttctaaaaactgaaaaaaatgaatccatccccatgatgttcataacttgctcaggttccacagcaagtcatggatttctttctaatgaagtaaaaatagaagactactatggtagtcaaggctatggtttttccagtagtcatgtatggatgtaagagttggactgtaaagaaagcagagcaccgaagaattgatggcttttgaactgtggtgttggagaagactcttgagagtcccttggactgcaaggagatccaaccagtccattctaaaggagatcagtcctgggtgttcattggaaggactgatgctaaagctgaaactccaatactttggccacctcatgcaaagagttgactcattggaaaagactctgatgctgggagggattgggggcaggaggataaggggatgacagaggatgagatggctggatggcatcactgactcgatggacgtgaatctgagtgaactctgggagttggtgatggacagggaggcctggcgtgctgcaatttgtggggtcgcaaagagtcacgactgagtgactgaactgaactgatggtcaccaaaaatgacaggtagttagtttctgttaaaactttattgaggtctaattaacataaaataaacttcatatgggcttctctgattcctcagatggtaaagaatctgcctgcaatgtaggagacccgggttccatccctgggtcagaaagttcccctggagaaggaaatggtaacccactctggtattcttgcttggagaatcccatggatagaggatcctggcaggctacagtccatggggtcacaaagagttggacgtgactgagtgactaacactttcactttcaaactccatatagttaaacattaagagtttttatatatgtgtagactcatgaaaccatcactgcagtcaaaataatgaacatatctatcacccccagaaagtttttttcatatctctttataattttttcctcctgctcctcctttttccctgctatcccaccattgtcccaaagtaaccactgatctggctttctattattatagtttcattttcactttctagaatttttatgaataaaattacatagtatttgttttgtctgacttctttcacttcataaaattatttttaggtatatccctgtttttgcatgtatcagtagttgtacccttttactgatgagaaatattgcattctatagctatacaaaaattagtttattcatttacctagacagatgtagatgtgtacgtttgggttttccagtttggggctattaaaaataaagtgacaatgagtatagtgtaaaagtctttgagtcaacatctgcttttgtttttcttgggtaaacaccttggaatgagttacacattggagtagtatggtaggtatgtgtttaaatatactgtcaaaacaccttcaaaagtagttaaatcattttacattttacatttccatccacagttgctcagtgtatttgtcacacattttgtgtaaacagtctttattttagctgttcaagtggatgtgtagggataatatcattgcagtttttatttgcatttcagcaatgactcaagatattgagcatatttttgtgtgcttatttgacatctatatatcttctttgacatgtctattaaaatatttttgcccatttttaaattgtgttatcttctttctactggagtgtaataattctttatacattctggccatttccagaaacatttaattgtttattgctttatcatactggtgagaatatccagtacattattaaatagaaatggtgggattagacatcctcaccttgttcctgactttaggagtaagtctttcatcactaaaatgccttttatcaggccaaggaagttaccttacatttgagtaagacttctttttaataggacagaattcccttggtgtcgcaggagagagtttggctgtgaaatttagttgtagttcccatgggcacaaaagccctgtatgcaaaagtaaaagtcagaggcttgttttggaatcaaactgtactggccacacaagaagcaaatttttgcttctaaaaggaactaaaaatactaatatatgtgcctatgttttttctatgctttatgttagaaattaaccattgatcccagcattctttactggaaaacccaaatgcagacactgaaaccaggtcatcatggggtctgggcagccactagacttggcattgtgatgagtattttcatccataatatttatacatgtctactagttgctcagtcatgtccaactctttgcaacccccatggactgtagcccaccaggctcctctgtccatggaattcttcaggcaggaatattggagttgccatttccttctccaggggatcttcctgactcagagatcaaacccaggtctcccacattgcagacagattctttaccatctgagacaccaaggaagcaaagaataaaatattcagttaagcaacactgtggatgtgagtatagtctcacttggtatctgaatattgttaataaacaagtttagagacttatcttacagctttgggagccttttca

SEQ ID NO: 51763 - DNA, 1300 bp, Bovine  19866881377987
caaagttcatggcttattcttttggtgccatttttaccatgcgtattattctattattgtatttgtaatggtgacttatttaaacaattatctcccttattggactgttggtggaaccatgtcttgctcgtattttttttgcataatggggataatttacacagtttcttattccttccccttgactcagtgcaaatgttcctgattttgtaggaccattctttttcctaaatgtgaaggaatcctgaatgtagctcacaaatatctcctgcatgtcatctgtaaagaattgcagggattggcagcaaaagcaaataaagtcagcaatctagggatcagtgttgctgttgcttagtcacagagtagtgtccaactcttttgcgaccccatggactacaattttccaggttctccgtccatgggatttcccaggcaagaatactggagtgggttgcctttcctgttgatcgatcaattaaacaacacagagttgttgtgcatctgttgtatgcttgacactatgctaggcatcccagcagtacaacagcaggtaatctgggcctaaaattgctaactctctattttgtcaccttgataaatgaaggtgtgaaggacttgatgtatataaagcatatttgtggtttaaaattagtaaacagagcaggtaacatttactcctaaaaccttaaaataagaaaaataagcaacctattgtatgatatgttcataggggtcttctccaatcttctggtggatgcctacaattcctccattaaagcctcatcttgttaatataagagtttgatccttgttaaaatgcaaataaattcagggaggaaatcattgtttttaattaattgtgcctccctgttaataaattacataggagtaggtttttaggaagatagaggatgagaggaagagggagtataggaaagaggtgttggcaagtgggtaaaaagttgaggaaccgaatgctgagacaatgtacaaattcacagggctgaaccaaatatgttatgaattattggatgagcaaaattaatgtagattattataaaagaatatacgaatactaacatttggctatttctaataatttgcagaaatttactaatataaaaagtaaatatatactagagtgaacaaatcaaaaggttattgacaataaagacacaatatcagagacaagcacagtatccagtgatatggatagttcagtaaattatgtatttacattaggagtgatgttctagaacagattatcatttcttaagagattataggataggaaagatag

SEQ ID NO: 51764 - DNA, 1504 bp, Bovine  19866881476567
tgcattgcagatggattctttactgctaacccactagagaagccctaacagacatcttcccaagaaaatatacagaaggcaaataagaatatgaaaagatgctccacataatatgtcatcagggaaatgtaaattaaaataacaatgagataccactacatatctatcatgtgaccatgcttggaaaaattgataaatttcaaatgctgacaagaatatgaagcaacaggacctctcattcattgctagtgagaacgcaaaatgtcacgatcacttgggaaggctgtttggcagctttcattatgttctttggtattcacccaaaggaagttaaaacacatctacacaaaaacctgtacatagatatttacagcatctttcttcatgattgctaaaacttggaggcaaccaagaagtccttccggtggtaaaagggttaaactgaggtatgtaagaaaatgaaatattatctgctgctaaaagtgctataaaaacatggatgaaccttaaatgcatattttaagtgaaagaagccagtctaaaaaagctgcatatcacatgattccagtatgacattctagacaaagcgaaagtatggggacagtagaaagataagtggttgccagaggttgggccaggagaagggatgaataggcagagcacaaaacacactcaaagcagtgaaatactctgtctggtactataatggtagataatgtcattataaacttgtcccattccaaggaatatacaacaccaaggtgaaccctgtgtaaactagactttggtgatcataatgtgtcagtgtaggttcatcagttgtaataaacatgccattctggggggatatgttaataatagggaggctacacatgtgtgggcaatctctgtatcttctgcttaattttgctgtgaaactaaaacatttcaaaaaataaagtccattaggaaagtaattaaaaaatactactgcccacattcaaacatttgcatgcctttgtgggggcacctgttcaaaatacatgctaatatagaagaataagtttacagccaaaattcatttttaaagttggtttatctccaaatgtatgagtgttttattactgttattataaatgccctttaatgcaagccttctcattcattagcttagagagttccaaagtgaaatgaaaaacaacagtttcttgacaagcttacagactttaaagcctttagagtgggtggaagaaatgactgttgcaaagctttatagatatttgataggattgctttattctgaaatgatgacataaataagcctctttaaaggcttcactgagtctatcatagaaatttccatgtaaattttcagaatttgataagctttggaacttgggcataaataatgtatttcccagaaaaacttgagacaatacttttatttgcatgttcacaaatttctaaagtgtcacagtggcaatttccaaaagggaaaactttaagctaacattttttgtgtgca

SEQ ID NO: 51765 - DNA, 1151 bp, Bovine  19866881561787
aacaatgctaatactggagtagaacagattttgtattgaaaaataaggaccagtaaatggtagaacaaggaaaaagtgctaagtagtaagttcactgacacattttccagccaaatctatctatctttctacctaccctacctacccacctacctatttatcaatcatctgttattttaagcattgagatagctactgagtaagaaagcaaatgaaatacaaaatacagaaaaaaaaacttcaaattttttggttaaaatttaaataaaatatttatgacataaatgatctattagaaaagataggtgcattgaggaattggatttgttacctgtgttggaggcactaattccagctccgaagctgactcagagttcaaggcgcttttcccaccgctcagttctggctgagatctgtgttctgaagacctatacggggcacatgaaggaagttaatgtatatcgagaagcaaattcagctagaaagtcagccgaaaaacctggctaatttggatcaccaagaaccttggtaacaaagctctcatcagacttttacttggatgtttccattataaggaccacttttggaataccagtggctgcaatgcgctaggtgttattgtctgtgattgatttagacttcagtgatgtgcaaaaggcaaataaatgcaataccatttttgttgcagaaagttctgcctcatcaaaaaagtattggctttttggggggagggagcttctcacaaagtgtattagtaagattgaatctttatatagaatttgaaatgtcatataagtgggagatgtgttgaagggcaacagaccgaaatatgttgcccttcaggaagttttaaagacatggtaagatttaggcagccagtttttgtcatgggcatccatagattattattagttcattttctgacagtgatgattcataaagtcagaacaggctacctgtttaactagaaacacttaatttaactataactcatttaatgggatcttcctgactcagggatacaaccctgggtctcctgcattggcaggcagattctttaccatctgaaccaccagggaagcccccatttaatatacacatatatgaaatatacctgtgtacctattttgaaagatcagttacacattcag

SEQ ID NO: 51766 - DNA, 792 bp, Bovine  19866881676101
attttcttaatgtccttgcaacctttatcaagtcttagtttgcaattattaaaaggtgcagactattgcctttttaatgaggaaattatagtgaatacctcctccaatatctctcttattgattgccttctttctttaacaagtaccagatctccttcagaccctcattacctcttctctgtcctataataagggccacctaattggtctcactgccttctgtttttcactcatgtaatccaacccaactcctgagaaactaatcttgctaaaacaaagcatggatcatgccatcttcttgcagaaaagcttttaataattccctcttacaacctgttctatactcagatgctttgccttgatttgcaaggcagccacagttcagctcattcaatataccttatatctctagtcaaaggtaatcacttttctatgaacattccctacctccacagttaagcccttgctatctggaaagccctctctattatgtctagttgcagaaaccttcataatcttacaaagtctgaccttatcaagttctttcaccctcactttaccttgctttagcacttcacagtccaactaaggataaatgagttctccttcctctgaattcccagattcattctttgaaccaccctcatagaagttaccatactctgacttgcattgtgatgatctgtatgcttatttaagcccctcctatactgtaagatccttgtagaccaagctcacatctctttatcctactgtctcccacagtacccatcccagtggcctgtacattgt

SEQ ID NO: 51767 - DNA, 752 bp, Bovine  19866881945860
aacctttctatttttaattgcagtcttattttccttctcccattatttctcatctccttagctctgtgatgccttggttcaggtcaggctcagctcaacttccactttcttcacttaacctctcaattctcctgacagctcattcttttcctttgtcaaagctgtactttgaagaatgttctcagtctataattggtgttttggttcatgattaggcaaaggtatgtattttatttctgattataaagtactagtttataacgtgaaagaaaatatttatggagcaggtactgctgtaagcttggtgatgaagcactcaacaacattgcccctatcctcagtgcagcttacatcttaaggggaaggtagattataaatgtacatatatacattcaatgttgagttttaaactaactttttcactctcctctttcactttcatcaagaggctgtttagttcttcttcactttctgccataagggtggtgtcatccacatatctggggttattgatatttctcccagcaattttggttccagcttgtgtgtcatccagcccagcatttctcatgatgtactctgcagttaataagcagggtgacaacatacagccttgatgtactcatttcccaatttggaaccagtctgttgttccaagtccaattctactgttgtttcttgacctgcatacagatttatcaaaaggcaggtcaggtggtctgttatccccatctaagaattttccacagttt

SEQ ID NO: 51768 - DNA, 771 bp, Bovine  19866882204222
atggtttaattaaaacatctctaattttttgatctattaatgtgattccaaaaatgagaaaagtaagcagaacttcattctatttcagcattgattaaacaaaacaaaaagtttgaaattataatatcagatatactgttcattttccagacataattttttcatgttctcctgccaaaatatggatgatgcaagtgtttctttgaatgatagcattatagcaaatgtttttaagggagtgttttttaaatgagaaactaataatcatactgataataaattgtaaaacactcttcccactctatctgacattatccttgtcttccttttttaattggagtatcttgcacaaatacatctgcctagagttccaggtacaggtaaatggatgtctccaaaataacatgaaaaataaagctttaccatggtttgacattggctgttgggacaaaaatacaataatatgctgtatttttaatggaatttactggggtcagcttggatattggcatggagactgttgtttttctgactaaaggagtccaagaaaatgaaacctaatatatttgagcaaatcttagatgatcctgtacacaaaaatttaaaaataaaatgccattacacagtactggcacctatgcacataaagaaaaacaacaaaaacaactttgtgcagcttatggtgttttgaggtttttaaaaagcttcattctaattttaacaaatcatcatactgtgtttgctccctggagaaaagctagcaacagaaaa

SEQ ID NO: 51769 - DNA, 1811 bp, Bovine  19866880350659
tccatcctaaaggagatcagtcctgggtgttcattggaaggactgatgttgaagctgaaactctaatactttggccacctgtttgtgaagagctgactcatttgaaaagaccctgatgctgggaaagattgagggcaggaggagaaggggacgacagaagatgagatggttggatggcatcactgattcaatagacatgggtttgggtgaactccgggagtcggtgatggacagggaggcctggcgtgctgcaattcatggggtcgcaaagagtcgcacactactgagcgactgaactgatacagatatgtaattatatatctgtaatatagatatctaatatatttatgtaagatatctttgaaccgtacgagttcagctccttgtcatttggttgttacattaacatgtattcatgaaaagtgaatgtaagtgtaaggtatatacttggagcagacttttaaaatgtaatgcactgttcctaaatggtattcaaacctgtctggaagtctaatagtgctggaatatttatggaacttgtgcagtcatgtcctggaacccatctgctgaaaataaactccagttgcatcgttcctaggcaaaaccacaatgaaatttatttaattcttattcttatttaaagcctgacatgtaatatttaagtaagtgataacagacattcctgtcagtgaacaaaacatgacatagaccttttttccctcaggtgtagaatgagccaaggagactcaaacccagcagccattccacatgcagcagaagatattcaaggagacgacagatggatgtctcaggtaaaggaggtgcacgtgttattattcacagagatgaatctcttcagtttttagagtcttgaccaaagctacgaaagggtgtttttaatggccaacaagaactaattactgtaaataaaaattttatgttagagatgtcattctaatcaccatctgatgttggaactgaggaatattttaaagcatgttcattcccctttgttaattttagtagatagcgaggtttctattttttttaagcttttttaaatttcaaagtaagttcataagtatgcaacaagaattacaaacagttcagaaagaacttcctatatccttcctctagatttgccacttgttaacattttgctgtatctgcataattattctgtctgtatcagtttatactatttaccaacttactgttttttccaaatcatttgaaactatgttgcagtcttcatgatgctcctttacccttaaatatttgagtgttttctaagaaaaagaatattctctcacataactgcagtatagttattaaaatcaggaaattttacactgacagtatactgttacctctggagaaggaaatagcaacccactccagtattcttgcctggagaatcccatggacagatagatgagcctggcgggctatagtccatggggttgtaagagtcgaacccgactcagcagctagcccaccatactgttacctaacgcaaagaccacattcaggtttcttcagttgtctgttgttgctatcagttttcttcccagtcttggatcacacattgtgtttgcttgtcatatatctctttattctcctttaatcagaaacgtttcttagcctttgttttttatgacttgaccatttgtataggctgtttattttgtggtgtgtccctcagtttgagtttgtcgtcttttctcgtaatcagagttcggattatacatttttggcaggaatatcagggaagtaatgtcttccgtgcatcacatagaaggcatttgacg

SEQ ID NO: 51770 - DNA, 856 bp, Bovine  19866880629041
aggtgagcatctgtctgccaccccttgcagggaagtggggccagtttttcctactatgatttgtccagatgctgcagcgatggaactaggtggggtctccctggagtctctgtgcttccctgtgcccttctaccccatcccagcacctgccaccctgtccccggccttaccccgcccgtgggtcttggcctcaatgatctcactgatgcgcccggagcctacgctgttcttggccgccagcttcaccttgtaccacgtgccgcacttgaggctgtccagcctgaaggaccgctcgctcgagctgacgaacacatccttccactcctcactgttgtccaccgagtactgcagcacgaagcctggccgggaggtttgcctggctcaggaggggcagggcggggcctggggtcccccaacagctgtcatgggactgggctccgcagggggtcagcagggggaacttttggccgttaggatggcgtggacgccaattagatgcaaaactggaaggatctggggtgagttgtaggactctctcccatcggctcttgtgttagggtttagaagccagggtggggaggggagcagaaaccggagctgtgagacttcaaaggggtcctattgagaccttgctactccgtgtacagtcccctggccccaaagcatcacttgggagcttgttagacatgcagattctcagctccccgaatcagaatctgtgttcttacaagatcccctggtgattcatatgcatatttaagttcaagtatctagaacatttgttgattttatagatttggaaactaagacccagagaagaaaacagacttcctcaggttcacacagctcaccactg

SEQ ID NO: 51771 - DNA, 1432 bp, Bovine  19866880685095
cgggtgaaaggatggccctcgccctcccctcctgcctctgcccattcagcgccctgcagcgggctctctccctcgcggctcgcctctgcgcctctggccatgctaccgttcttcccggctcacctcaggtgtcagattctcactaaagcctttccaaacagacgggacacccccgaattctgctccccacagcactgcggcttactgcccggacggcctccctccctgcattctactcttgtgttctggttacacgggtctctcttttataagaatataaactcttcgagggcaggaatcgcagctaactgaggcttgtatggctgacagtgaagtgccacacacagaaagagctgataaatggcagttacttgataaatgagtgaatggatgaattcctttccctgcttgtacttccctcaccccaggaaccccatctggacaggaccgggactaaagagttctctttccaaatatatctccctgagaagaaaggcttaggaaggaagggggaacctgccgggctgagacgtctgtctgcaggcgcttcgggctcttacctcatactcaaagtcaccccccagcgccccgatgtccaggtgcaggttcctaagaagctcacttgagctgcggacgctctgaaaatgaaaacgatggcaaggaaactggtcagccccgggtgcaggaccagaagctcctcacaggtccgagagctccactcctgggtcagacccagcagtgatacagactgggcaaacaaggaagctatgggctggaaaaccgctttcactgattttcaaagtagcacagaggttaaaccagaaggttaaagcagctcaagtacccaccaacagatgaacggctgaatggaatgtggtaatttcatacaatgaaataccatccaatcacacatgctacaaaacactatgctatatgaaagaagccagacacacaagaggacaaagacagcatgattccaagtctatgaaatatctagaacaggcaaattcacagagacagagtagatcagggactgcggagaggggaggatgcagagttattgtttaatgggtacacagtgtttctgggattatgaacaagctttggagacaggtgatgatgaagactgtataacactgcgagggtagttaaggccactgaattgtacacttaaaagtggtttaaatgtaactttcaaggtgtatatatttgaccacaatttaaaaaaaaattttcgttgttgttttttttaatggcccagaggattttcaggccaagaaaaggattcattcttaccttggttgtcactctctgcctcatcctcctcgttggtctcctcccctaaagccaagaggctgagagcattcttgtcctcatggatggagcccaggagaccttttgtagcagcagaaggcttgagaccctgtgatgg

SEQ ID NO: 51772 - DNA, 870 bp, Bovine  19866880766513
tcaggaagcatggggcgtggggacctggcaggcagtgttttgtccatcgctgccacccccaagcacctatcagctcatggaaagagtctcatgcttagaagggggctctggctccttcgttctatgcaatttacaatctgtcctttccccaggctcagttcagttccctctggccagtgctcagggaggcattaggtgggggaggggctggagtgcaggctgcaaaggggtggggaggaagaagggacaggggaaggcaacactcagctcacagcttctggctagagtggaggtcacaagaaacctcgcttcactgccctgcggctgcccagacagagagagaaaagggctgatccaactcatgccaggatcccttggtcagaaccctagatgctgagattgggcgaccaagatccagagcaaaggggtggggagactcaggcatggtgtgggctgacacctgttcacagcccctgtggtttggactcttccccagatcaggcctccccaatccacgtgtttttcttgtccccaaatccttcctgaggggtgtgtgtataagactaggagtgaggggaggacagtcaaagcctgtgaggggaagggaagtgggaagcggggctttggggctgaatgctgccactatgatcccagaggacatgtttgggagaggatccctccagcccacaccatgcagcccccattttagcaggagccccccgcatgctgcacccccagcctctcttcctcggctcatgaggagggagggcagggctggaccagcgaccttaccgtctgtggggggctgcccaaggtcatctccacgtagtagccctggcccggatttgcccctcaggttgtccaccatct

SEQ ID NO: 51773 - DNA, 1995 bp, Bovine  19866880869414
actctcattagttatctgttttatacataatagtgtacgtatgtcaatcccagcctcccattcatgccacctctcttccctccttggtatccatacatttgttgtctacatctgtgtctctatttctgatttgcacataagttcatctgtaccattttcctagattccacatataaacagtgttatagtacccctatttttagtgtaaaaattttaaattgttacagacatttcaaagtaaatattttaacttgttacagacaagcataaaaatcataagtgcacagcccagtgaatttttacaaaatgcacacatccatgttcttagaaaccagcttgagaaagagaacatgagaactctagaagttccctagcatccctccagttaccagttaacccataggcaagcacctataggcaaccactatccaaacttctgacagcagaggttccctttatagatttttgaacattatataaatggaagcatgccaagtgtactattttctgtctggcttctttcacacattatgagattcaccaagccaggagctacattttccaggctctcttacagccaggtggggtcatgtgactagtttgggccaatggaatgtgaggaaaagtggatatgtattgcattggaaaagaccctgatgctgggagggattgagggcagaaggagaaggggacgacaaaggatgagatggctgaatggcatcaccgactcgatggacatgagtttgggtaaactccaggaattggtgatggacagggaggcctggtgtgctgcggttcgtggggtcgcaaagagtcagacacgactgagcgactgaactgaactgaactgaactgatccctatcagacatcggtgggtagtgccttctctatattgtcctcaatctttctgtgagactctacagggtaggtactgggagtggcagtgttgaagctcaaaggagcctgaattcctgagatacctctcagatcaggcaagaaaccaaccagaaatatccacatttgactttatgtcaccaagaaacaaacttctattgtagtgagccatgaaggcttggggtatgtttgctttagcagctgccctaccctgattgatatggttgggttcctgggtctctctgtttctcaaaacaaggattgatagggagagatccaatgtggcaaagagtaccttttcctcatttcttttttccctcttaaggaagtgatttctttagtaaaggaagagaaaactgaatcccttgagtggcagtccagggttaggactctgagctttcacttcagggggcacaggtttgatctgtggtcaggaactaagaacccacatgcccaaaaaaattacagaagcccatgcacctgccagccacaaataaagaaatagtgaatgtatgaaagacctgagaagcatgattatattatgatgtaaaaggttcacatcttgcttcctctgcttttaaaaattagaaatctgtcttttctagatctttgtatttagcccattcaaacatggtgtgtgcaaggattattccagatttctcatgggttgatttcctgtttactcctgaaaaatatgcctggaggatccttgtttttctagtggcacagaagacaactgagaagggcatttgagtttttaatctagaacagaggttagcaagctgttttggtcaagggccagataataaatatttcagactatgtgggtcacatacgagctctgtcatatattcatctttgtctctttgtttgttcatttataaacctttaaaaatgtaaagctgtctgagcttaaggactatacaaaaacaggatgcaagctggatttggcctgtggcccatagtttgccaacccttggtctagagcatggatcacttttctctggttccttctcatctggagctgaaacattgcagaaacagtttgcctcctaatccgtaatctggagcaaaacttaacagggtcatttactcaacat

SEQ ID NO: 51774 - DNA, 524 bp, Bovine  19866881102583
ggccccagctcgccaggggccgaacacggcccggagactcggtgggcgcccgccggggatgtgacagccgggaggcagctggttgctgggagcctggagacgccgacggggaaaagggggagcgagggagggaggggaagccggtggccgggccggccgcgaaggggcggagagtctgagggcgaggggcgtgataggaggtagcgatccgacgccgcgcggcgccgccagttctttcgggcgccggccctttaagggcgggcagacgcggcggcttcagcgctcagaactccggggagtgagcgacgccgcggggcggtaaacagcaggactgccggcccgcccgctgacgtcaggggaaactgacacggatttaaagggccagggctcgaattgggtcttaaaggggccgccggtttccagctggaggccctctcccactcctctcctattgccgcctcccctttcattatctttcccgtctctgaaaggtcactttggattagatggatagctccgtgaag

SEQ ID NO: 51775 - DNA, 1732 bp, Bovine  19866881163207
agagggtgctggttcccatactctgaaaggaccctcgccatgttatctggtttagcatactgagcctttattacgtacgtgcttttatttagcaaacaaaattctcaagctaaaatgttcaagaactactaccatcctaccagacatttcttcaatctttcttcttaagacagagtaaatcaaatctgataatcacatttaagaccacaaacagcctctcccttctgatacagcagcagtatgtgaaaacttttcccctcacgttcctcccacagcactctgcaattctagcatgagctgaagttgtggcgtgtgaaagtgaatctcctaatagacactggcttctcccttagcagaaaagggagttaggacattactaagccagtcacgatgtccaaatgttcaagcaaagaatcatcactttttagaactgccaggctgagttgtcccttcatccacccaagaccagagtggtcagatttagaacagaattttctactaagctaggctggcaacaggacactcattcttctgggtggaagactgactccttgacagtaacatgtctttcaagaaggtactcagggtcggctatcacacttgacaagatcactcactgatgaggatctcacctggccaaagcctccctgccaccttaacacacactccatattgttctagtctttaaagtttattctagtatttctgaaactgtggttcttaaattgattgtgggtgataaaatcaacttagtgatttgagactagctttttttgtttgtttttttttaaatgaaacagagtagtcagtgtcaattaatcatgggcaatcctcagttatgtgtgtatgcacgagcctatgcattcaaagttgatggaaaatgtactttgtattctgggttaccatcaaaaatctcgtaaggtcactaacttgcttaattggtttgtttctattcaattttcaaatttactggctcttttgttatctttaatttactgttaaatttactgttaaagccatataaccaattttatttcagatgttatacttttctactctagaacttccctgttaattctttctgtaataaagcttctaattctctgctgctgctgctaagtcgcttatcgtgtccgactctgtgcgaccccatagacggcagcccaccgggctcccccgcccctgggattctccaggcaagaacaccggagtgggttgccatttccttcacaggtcggagatcccaccaaatagcttttcttacctgagtacttgccgccacccgctcatgctctgccagtcgcgcggctaccagctggatcagctcctccatggtcagacctgccatggtcgtacgtgctgtcttgatttgctgaagaatgttggtcatctgagccctaagaaagagagatattgagggggagaaattttgtgctactttcatggggaatatctatgaaacctctcctattttaacccataaatatttctctggaaaacactttttaaattaatccttaaaaacacttacttattgcattgtgggaaccgagtcagcaacttctccagaatcttctccagtttgtctactggttggggccggggagtttcagtagaagccttaacaccacccaagcctgggggaggcgggatggaggcagcagggggcacgtgcggaccatgggggccgacaagggaacccaagctggggctatttctcccatgggagcca

SEQ ID NO: 51776 - DNA, 1885 bp, Bovine  19866881180701
tctggtccttccccacgtggctcccctggcatggcatgccctcttctctctggaaatataaggaataaattcttctttcagtggcatcggcctctcggtgttgtcactcagtcacctctgcaaattaaaattccatggatacaaatgaggcacagagtcactcccccgcgaaacccagagaacaaatccattcctaaggcagctgtaaaggtcaatagcaaggaagttctagagcctgagaagagtccaggaaaggagcagaagacatctcctaagagcaccatgtgaactgaaactgtggggtcaaggagaggccggcccagcggggacagcctcgcagggacgggaggagacacacagagaggagggcttgtcagcctgggtggccaggaggagcctcactgcccaacttctctcccagaagccctgggaaaacgccctctgacccctgacctctgcccagagggtcctgtttctgaagcccggtcacctcctgtcctcatcataagcaccctgatccggctgtccacagccaccaagggtccctcccctacatcactccttcagcaccacacagcgctacaggagagcatgcgttcctgggtccctccagcccttggtgacacttgctgtgagtaattagcgcatgaacctgtctctgctcaacaatcagccccaatcctgaagactcttaatccttctgtactgctcagctcacaagcaggaaaaactgtatcaccctgaaaccctgacaccacgcagggaaaagacacagtggctgcagaccaggagacagaagtcaagggctccagagactagaatctagatctaattctgcaatcaactagcaatgtgaccttgggcaaatccctttgcccctctgaacctcagtttcctcatctgtaaaagaggtgaggggggagaagagctaaaaggtttctaagttttagaagtgtaacaatgtaggtgtgctgtgaacccaggcacaaaagagctatattgtgtactggataattccattcaaatgaagttgggaacaggaaaaatgaatctatgtgacaagccagaagagtggtgacctggggcaggtggactaagaggaaaggagcccaaggaagcttacaggatgggtgggaaatgttctcaaagatctgggaggttatgatacggtgtgtgaaaagtgttagtcactcagtcatgtccggctctttgcaacccatggactgaagcccaccaagctcctctgtccatggaatttacaggcaaggatacgggagtgggtagccgttctcttccccaggggatctgcctgacccaggggtggaacccaggtctcctgcattgtaggcagattatttactgtcttgagccaccagggaagactgtgacatggtgcatatgtatataaacattcattgacttgtacaattcacgtgtacatacaaccaggtacataaataccttaataattttttaaaggaaaacagggcttgacagagcagaaaacgcggttgaccaggtttctgctaagggacccagaaggtactctgccccctcgcttccagcctcataccctaggtgttgacaaggggagccctgggggctgcttaggggtcaaggctgcacacagaaaccaagggtacactcactttccccccactccactccttgagccagggccagagcaccctctccccaccacccaagacgggatggacactaaagcaatccacacaacggaggacagggacagacatggaaactggcccttacacctctggagagcctggcgggggtgggggctgaccgccaccttctccttgggctcttcctgcccagggcccggcccctcggcctggggacgccattcttggcccctctcgtg

SEQ ID NO: 51777 - DNA, 1446 bp, Bovine  19866881202059
cttccaagaagcctcacattatatttgtcctagtcacgactttcagttcttacttgcgttttactatttctttgcttgtatttgcccatttttgtcctagctgtgattctcaattcttactatttgtgttttaccattttaaaatgttatgtatttttggggtgaacttttgaatctgtttaggcattctcccaagggaaatttaaaagaaaagataggtttctttttgtgtttagcactcttgctgctgctgctaagttgcttcagtcgtgtccgactctgtgcgaccccatagatggcagcccaccaggctccccgtccctgggattctccaggcaagaacactggagtgggttgccatttccttctccagttaagcactcttaagttttttcatctcatgtttctacttcccctcatttcttttaagtgatttaataaagggaaagatgaatatattgagttgactgcttaattataaatgttgctacctattaagtgcacaacctctgcgttgtgactcaagtcctgagctgaggcctaatgctgcactgagagctgagttccaaagcgctttcggcagttgggagcataccacttggggtgttaatatttgaatacagaaaaaggaagctgttatttcaaatgcctcacaatacattgcagttgagggattttatttcccaataattttagcttaaataaatgaatttttctctttttagatatggcgagagcttttttctccacttcatgcactgaattttggaattgggggagatacaacaagacatgttttatggagacttaagaatggagaactggagaatattaaacctaaggtgaaatgaagctttttttttaaaaaaaaaaccttaatcttaagtcttttgcagagagttaaattgtcagaaactggtagtttttaagaaaaatttcttctgggacttccctggtggtccagtggctaagatttcatgctcccaatgcagggggcatgagtttgatagtcaaggaactagatcccacatgccacaactaagacctggctcagccaaataagtaaaaaaaagtgtttaaaatttttttttcagttgcttctttaaaccattatttcattgttgttcttggcttcatgcctttttaatatagatgattttatcattgtttaagaacattccaaatacatgcttaattacggatcagtgtattgcttgtgtggctcatacttgaaattgttataattatcttcgtctgctgttggaagagatttgatgctaatgaggtttgctattctatggtcccgaggcagtaaggggaggaaagtcctcagaggtgggccattggagcagggctatgattcacttgaggaagtaattttggattcacttaacacacaaacagattggtattcacggcctgcaagttcttctaaaggaaatttga

SEQ ID NO: 51778 - DNA, 930 bp, Bovine  19866881365840
tcaaacacttgtgctgttattgcaatttcctgtaaaagaagtgatagccctaaaagtcaactgtatctaccagttaaagaacaaacacccaaaagcacttgaagctttgcatctgaacctacgactgcaggacttttctaacgtttttatctctatggtcaaactccaggcaattttgattcccttatgtttgtgaaaatgtatttttttttcataaatcttttgaagtaaaagctaagaactgttagatatataaatctggaatctgatttgaaatgttccttgatttcatttccctttgttcttgagggtagtagtgtctatataggtgtcagtattctctttgatttgttcaaaatggatcagtaataaaattaggtctctagctgtccacttttagtttcattaaaagcaactttttggactactttgggattatggctaaatttctctttttatatggccagtaatttatctttttactgtatttatcaagcaaaaacttcttgtaactacacacataaaagtttatcattctgtgaccatttctgaaaaagtctagtgatcttggggttgtggaagagcaaagccctaggttataagacttctgtgtgccaggctggggcttttctgaggctcaggtttgttgaggaaatgatgaaaaccatacctttgttctgccattttgtttctttatctataaggtcatgattgaagttcctgactctcattatgatgaaattgagattttaaacatttgcttttctttacatccaaaatggatcctaggtaagaggaagaattccagatatgtttcaaccaattattgtcagtctttactttccttcccttgagcccctgggctcatctttgggttattatatatagtaccctcctaggatactaccactgaacgctaatgaggtacca

SEQ ID NO: 51779 - DNA, 1207 bp, Bovine  19866881374815
aaggcgggggcatcccccaggccccttaatggagccaggcccccgagaggaacatggacgggggctaacgaggagcccagggcttgggcaccagaaaaacatcctgtagaaacccaaagtaatcacagggctctaagagtgtggagatggatgtaaaaataaaacatctaaatcctgcccgctcaagtttaaaccacctccgttcagaggctgctaaagaaacacaacatccagaagtcagcattgtgccaaccacgtgagaatcacgggctggtttcccgattctcgtaactctgcggctatctcccagtaagcagctcttccacgtctggaaaagctgcagagggccctgctcttcccttctgaagccacagaggaagctggggagggggtggggagcagagacaaaagcctcatctcccagcatgagaagactcaatacataaagctgaaaactgatgaatcaagaaaaagcagcctaagcatattatttacaaatatggaagcagacaccagaacaaaggaattgccatggtagagatgggaggggtacccacaccgtagaactgctatattttgttttgcaccttttggcttgtcttggcattgtttaatatgggcatgtattactttgattaaaatgaatattcactttgaaacacacccatgagggtaattccctggtggtcaagtggttagggccccatgcttccactgcagggggcatgggttcaattcctgctcaggaaactaaggtcccacatgccacactgcatggccagaaataagttaaaaaaaaaaaaaaaaaaaaaaaaacacatgagaaacagaagaattctctctctgctctcctgaggagcaaagaggctggagagagctcagccagaggattactgcggccgctcctctatctattctcaggatggtgggcttcatgcccatgaggactggggagagacaccagagagatggcagaatttgtgagacttgggccactcataggatcttggattctcggtttactcatctgcaagtcacagatgatatgtgcatgctacttaaggtctgctgagaacttcaaatgagatactgaatgtaagaagcacgtgtgcatggcccaaactaccccagtgcatgtgtgcgtggcccaggctaccccagcgcatgtgtgcgtggcccgggctaccccagcacgtgtgtgcgtgat

SEQ ID NO: 51780 - DNA, 815 bp, Bovine  19866881419954
tgcttatgctcaagtctcagtttcctctttttcaatggagagaaggatagtacggacgcccccacccaagggtattgtgaagactaaatgaggttaatgcgcaaagagctcaggatgcacctggcacacggtacaggctcagtacacctcggctgttataaacaggagagcaaagtgcagcctggcggcggggaggagcagccctcccgcaatgctctagtacaaaggcaaaactgggtttcaccactgctgggggcccgggaaggacgcttcccaccagccctgactcccaaggccctgcggacatccgggaaggaccccaagcagtgggagtgagtttcgtgtgcgcgcgcacacacacgtgcgccaggggctgcggcccagtcacctcggcctcgtactgctgcctggcctcagccaccacctgctggtgctcctccttcatcctgtccatcttccgctcgtgctcccgctccacctcctggcgcttctctctcaggaggccactgagctgccgggcaggaggcagggatgcaacatgcagggctgaggcacttgaaggactcacacacgtgtgcgacacgcgcccacctcccccagcgtccctacatacacacgcggccacacccagctgctccactcacgtacagggcacggggtggagaaggacttggcctccagggaactaaggcataaaaactgagccccagccgagccgtccaaggcaaagcagaggcccttcgggccaggacggctcggccggctgtccaagtcgccgggcccccagggcgaaaggagcagaccggcactcacct

SEQ ID NO: 51781 - DNA, 1030 bp, Bovine  19866881508782
aatattttattacatcagattcaaagatgctgaaatttaaatttcagtttgaagacggggcaaaggtttttttcacccctcactcagaaaaacagaaaaaaatggaaacagtagacgttctctgagaaggcagttaagtctacattttaatggtgcagtcatgtaaagaaaagtctgtggctggatgcttggcaagcaagacaacacagtgtttactattaacaattccaatcactataggactctggaccagccaaggaacaacacatctgcacggactctacgagtcagaggggagctttcctgagtaaaaaactactacagaggccaagtgtctagacttgagaaggtggaaacctgccaaaatcagagagcttccccggatcaaagaatgaacattttcccctctttgagagagaactggagaaaatgctatgaatgagacccaacagtcagaaagctaaccaaagttgggtatgtcctctatacatgaaagagtagagcaacaagtctaaaactcattggccttcagaatacagatttgaatatttcagtgtaacaggacagattattttactaaaacaaatatttaaaagtacattaaaaaaaaaaacaacattatttctctagtttcttcaagaacataggcaaaagcccagtgcactatatccctagaatcaaataggaataatctctttgacaggctcccaattcttaagccttagtttttccttaaggctctctctgattaggttgctattcaatcactcctcccagacccagatatttccaatcacactgtaacagcttccatgtctgtatctccaggcttcacatttccaaccattactccctggatatcactctcatgttctccatcataatgtaaaggttcagtccatccataactgatgacatttttttcttcccctgtcaaacctcctcttctgctctgaattcccttgtcacctaaaagcattgtttggataaagcaataattaatctacttaccaaaagtctcctgcttcac

SEQ ID NO: 51782 - DNA, 1200 bp, Bovine  19866880391923
aaaatggtttgtgttgagatatatatctttatgagaacactattgggtataacaagaggggttttttttgctctgtgtagtgtgatattgatctctgagaaccattaggaatcatttttggccctgttagttctgttttactttgcctatacttcaaagggctaaggccatgatcaagtgccaagaatttcaagtgtattcttggctttggccctaattctgaatagactttgggaaacttactgatactcgttggctttctgattgttagagaagtaggaggcaggcatagttatttcatgtggaaaattccacagctacagaattttaaaatggtttaattaatacttaagctataagaggatttataatgttttgatgtttaaaaagcaactttccttgtattcgaatagtaatgattttgacctttcagactcagagtgatctttttgcaagaagacagaaaatctgctgccactctgaatctctagtacttcacaaagtaccagaggtacatgtttgtttctccttccagcttcttcatcttattggcacttagaattttaaagggtgtaccctttgagctagtactgctacttaagaagagaacacattcttaaaagtggttgatggaaaagctcattaatattctatgtatgtgacccttatactcccctgtactcactctccagaatgctcttagaaaagcattatggggctagtaataagtcagaacgtcagagctgaggtctggactctcagacagcctgcccctccatcctctgcctttatctgttggtagtacttaaacgcagctctgatgctgaatagaaggtacatgaaactctccctcccttatcagccttttgtctctaaagaaaacagagcacacttcaccccagaaccttttgcgatttgtgagatcatagactgaggcagaattacctttatcgagccaccagccccatctgacttgcagatgtctcatcagtgggagccccctgcctcacatgaaagtgggctccctatttggaaaggtatctgccaagagagaaggcaggaaaaatgaacagtcatcagagtcatggacatattaaatgctttatttgctcagtagggagagctaatttaagcaaaggaataatctgagcaaagctttacttctagaaagtaaattggtcattatatagacgataagat

SEQ ID NO: 51783 - DNA, 1759 bp, Bovine  19866880889251
tatgttttttctggtttaatgaatttcccaaaggcacagtttgattagaaattagatgaataaaagaaatgatttgttcatgtaattgattgtaaacacacttgcagagaattagagtgtctgtgtcagctaaaggcatagacaatctttgaagaaatcttcactgagttcagctgacactttctttggataacacaaaccaatttttagaaacatccaaaacaaaactcttcattctcacaccacatctactttgcacacaattcaccaagtaaagaaagcactgatgtctcccctaaggtttaaacctttctagtacattcatctcatagtacttattgctacattcattttatgtctctttttcctaaattaaatttgattcctatttagttatgaaataagtacatgttgtatgacttgtgcaaacttccagcatggacttaagttttgaaaaacaaatccagtagtagctctgacttgctaaagactgtggccctgtttactcactttactcaacacataaaaataatgtcttgatgtgcctgttactggcacagtgttcaaaagctattcaaacacttaaagtcttccagacaccacaaatgactatagctacttgggtgggatttatatcttttatatctatactttcattggctggaaggggaaaaaactataaatgatttaaccttttcatgctactttgtactataagtcccttcacccctaagaaatgctaagaaatatttaatgagattaaacttatatttgaaatgttagtttctgttcagtacacaatttctgttgcaatcaaccttttcatcaacccatcactggcaaaatgttttaatgccaagatttttttttttcacttgatacattttacaccagtatcactgctataattccagtccttgttttcagtccatttagttattcactaagttaagtttgtcattaacatgtctttgcttttctgggcatatttcttgttgtgggtagtttcataatagcttctgaagtcgttgtatatttaatacgttaaaaaaaaatgtaatttagtcactgagtcgtaaattagtctgactcttgcaaccccatggactatagcctgccaggctcctctgtctgtgggcttctccaggcaagaatactggagtgggttgccatttacttctccaggggatcttcctgacccaggaatcgaacctgggtctctagcactgcaggcagattctttactgactgagctacaaacttgaagcagaattaatcatatggaaataatctctaattccacaatggcatatgctcttcaactttctttgaaacacatgactatgtcagtttttcaactttccatttttaacggagaggaaaaaaatatgataaatgtcaactcctggtcaatattagagaaatattacatagtggtgggatttgtaataaacctgagaacacctgagcaggtgttatgaattaggaatagatttgcctgaaagccttaaataaaaatgcatttcttttgataaaagtccaggaaggcagtcctcagaggtgtgctgattctaaggtcatcaggaaactcagcactttcttactgctcttgcaccctctatcagcagcttcccccttgaaatacaacttgatttttctagcattaaatccacattccacccaacaagaaaaaggaaaatgaagaaaatggcatccttaaggacacttctatctttcacacaccacagtcagtaacatc

SEQ ID NO: 51784 - DNA, 1205 bp, Bovine  19866880514394
aaagttgagggaggaaaaagtatactgacagacttactagcagtttggaacaggtcaggcaagtcatttgccaacttctccagggctatatctgctatggggccaaataagacaacaggtctcttgaaaccagctgaaatgagaaaagaaaaagccatgaaattagatgtaaaataagctagaaggatatattttacaaaatgagaaacatggccaatattttatagtaactacaaatgaagtataacctttaaaaactatatacctgtaattttatacataatattatacaacaactatacttcaattaacaaaaaagaaaagccatgaagacacctccaggtctttagctgttaagaaacaaaagtattttacagagtattgataacaaaatagtggactttccaggtgatgctcgtggtaacgagtctacctgccaatgcaggagacacaggagaccccagtttgatccctgggttgggaatatccctggagaaggaaatggcaacccattccagtattcttgcccagagcataccatggacagaggagcctggcaggatacagttcatggggctgcagagtcagacatgactgaacaactgagcacacacattgataacacaactaaataaaagaaactgtgtgttcttccatctccaattcagcccagctcttttctgaagaataaaagctctctcttttattttggttcattcccctcaccattactaaagataaactttgctctatagaatatataaaaacttctgaatggtagtattaaaatagaaaataaccaaggttgtagaaatacaagtttgcacagttcagttttttctaagtcttatttcgtgctgaaaatatgactccaactgtcagctcacttggcctaagtgatatagataaattggaacatgaccattaaagtttaaaaatgaagaaaaactggctctgagcccagtcagatcatttcctggcccacatggatcccttaccttctcgaagcaaaaccctctcgtaggccgggaacttggtgctgactgtcacggcggcagtcaggtcctcccgactcttccgtaggttcttcttcacacctgatctctggccgcgcatcctccagaagtctgccctgtccccggtggtgtctctctgggcattctgaacgctggccatttgttccgctctgagagaagaagccagga

SEQ ID NO: 51785 - DNA, 1321 bp, Bovine  19866880550457
taggcaggccctgatgaaaacagatcaaaagctcagggagcaccttttaagaaacaccttcttattttctcttgctttttttctgtttgcccctcctctatcaggtgaacacacaggatttcagaggactcgttcgggaggatgctgttctctacctgttagaaatccccaaaggtgaaacggtgaccattttagctcagagccgagctgatggtgagcaagtttggttttgagttcagtggacagtaggggaggggaggtagcttgggaacagaataggcaaatctgagtgttaaaaaattgacctaactctaggtcatagatatgtgcaaagaatttgggtagcatttaacttcctacagaaatgctttctctgcacccactgaaagaactttactagttgtgtgattttggaataaaactgcttttctggacagggatcgttccttaattactgtctgaagttatgattgaggttttctgtatgacagatgcagaggccacacctgcaggtcagcccgcatattaacccttatcaatctgacacgttgatttacctgtccaggtcttgtcatctgtaaaatggaagttaatagaatcttcttgtctgcttcagagggttcattggcacctgtgttagtcagggttctccagacaaaatggcacacagagaaagaactgcttattatgaggacttggcacatatgttcatggtacctggcaagtcccaaaatctgcagggtgagctggtgaggtggagaccccaagaaagctgatggtttacttccagtccaagtccagaggcttgagaaccaagagagctgattgtgtagttgttgtccaaaggtggactggctcaagatccaggaagagccagtgtatctgagtctgcaagcaggaaaaaagctcatgtcacaccttgaaagcaaaaagaattcattatctcttactcagagaaggatttaccttgctgttctgttcaaatgttcaacagactagctgaagccactcacatgagggagggcagtctgctttactcagtctatgtgttaatgttagcttatccagaaacacccgcaacagacacagtcagaataatgtttgaccaaatatctgtgcgtcgcatggcctgttgatacagaaaattaacaatcacagcaaaagtcatgaacttagttacttgtccttcttcctgtttgagctatggttaccatggagcctgtgtgctgagttcactaaatgcatggaaggtaaagagggtgatcagagctcagaggacccgataaccgctccaggaaagaccccagccaggctagcaccg

SEQ ID NO: 51786 - DNA, 1246 bp, Bovine  19866880588974
tcgtgtccgactctttgtgacctcatggactgcagcctaccggctcctccatccatgggattttccaggcaagagtgctggagtgggttgccattgccttctcctctggtattagggtgggccctaaatccagtgacaggtgttatcacaagaagagaggacacacagagagtcccagggtggcagtgtgaagactggggaagagattatagagtattgcaagtggaacaatgctcaggaccacttgaccagaagccagaagaagccaggaagcatcctttcctagatccttcacaggtagcagggccctgccaacatcttgaccttggacttctttgacttggagacacatttctgttgtttaagcctcccagtctgtggcactttgtcgtggcagccctgggagcacaggcagagaaaaagggaagctgggcgcttgtctcatccgcatgccatctgtcacgtcagaggggccttattttttactaagtggacagtacgtaggcatcctcccttctactcacttttcccattcttcctcaggtccccagagtgcgaatggtatgagggacagccagctcatgaggtcccacaggtatgatttaaacttactttccctaaagttttcatttccctaaattcttttgaatttgctttttttgtttccagaaggctcagggcctggtagtccccaggttcataccattagaatctgttcttccacaaacacactcttcccaagagttgaaaaggcttattaggagactagcaaacactggtttcctatgatgagggagaagatggaaatcgaaagcagagaagcgacaagaagattctggagggagtggggaaggagagagagcctggtgttgagaggtaaagacaaagaataacaggggcccccaacgagggcctggatgaataggaatcttaggcgagcttgagagcaaaaccagccttgagaaaggtggaaatcaagctggcctgtgaggccacgattcactataaagccaggacaaaaagaaaagaactaccatagctctgcaaatctgtcatccaattaactgtgggcctaatttaactgaaaagccagtatgcctttataactccaattctctaagctaatccttaaacagcagtttaatgctgtttgttaaaaaaaaaaaaatcccacagagacctaatccagactgatgggttgcctcattaatttgaaggtggcgtcactcttgtttgaggatgaatc

SEQ ID NO: 51787 - DNA, 954 bp, Bovine  19866880697666
ttgagcaagtaatattcagtttgaagtgagaacaataagagataggcttaaagagcagggaaaatttaggttaaatgtatggaaaaattttatagagaaggtcttggtaaaatgctacaatgataacctgacaagaagttcattaagggccagttcacaaagatctgtgcagggtgtagtcctgacaggggaaggtagtcagagtctagaatttgggatcatgtactgaggagcccttgagaagatctgtggcttttcatgagggacacagccaacctgaagctgcagagaaggaaccaggagaataattactccaacctcatcctcctctctcccttgggtcttcttccagggcacccactgactgaaccaaaccagacaccagagggcagaggagccccattgatacagtctgcagatcagtctccccgagaggggagaagtatggggagcagagagaggatctggaggggccaataggagacacctcacacacatgtgtcaatggtcagcatggtggagtgagttcctaaagcaggctacagagagaatttatgcaagagttttggaaataatatacctacagattattacaggtggactgtagtaactgactatcctttccagctgccataaattcggggcagggggggcagttatgcatcacaagtgtaagaacaagttgctgctactggaaatcagtgaaacacattttgtgaaattcattttataataaaaagtcttccccacaaaggcaaaatgcccattgttagcagtagtaaaattggttgcctagtattttgcagcatataaaagattttcatgtacaacattttgtgttatttcctcattaatcttgggaagtacctgggatgatagatcttttttttaaaacgtattatattgatgtatagttgatttacagtgttgtgttaatttctggtatagagcaaa

SEQ ID NO: 51788 - DNA, 2639 bp, Bovine  19866880734029
gaactaacacccccacatgctgtaaggtacacccaaaataaacaaacaaacaaaaaattcattttttaggttaaaaagaaaaatacccagcaggtgataaaacatctagggaaaactttttttaattttggtaaaatacacttaacttaaattcaccattttaaggtatacaatagaaaaaacattttcaactaaaagggaattacaatactggcttgtctctatatttatacatgtgggtttcccccaatcagaaaagatggcagatactttttattttaacccctcatcccaagacaatccaagaaaatgctttctggacatttttatgcatcctgcctgtgcctttcaaacagcacaagaggcaagctcctttctgggcggggctggaaacgcagcagcctcatatggggacacatccagtgggaggaggaatgtgcttctctccagtttcgcacatactcctctgtctgctagacaaagtgatattgtggcatctgtgcaaaacactccctacacaatggaacagaaatcagagagtgtccattttatttgtgcaggcaggagacccatttcccttctccaaggaccagcaggaaatgtgggcacaggctaatgcagggacatctggatatcctacaaagcaagcagcaggattagagcccggcccatgtgccgtttctgttattacttcccacaattaataaatgcccagcaaatcaagacggacttgcttatgctttgggccttagcatgaaattttcctatgtgtatcgataccaaagagagttttgcctctttcattgaaatggcttgcttttgaattaagtcagttttctgcattgtgacaacatcctggttttaactatcttttatgatactgcctgaagtttctgacatatataggaacctcaaataacaatcagccatttctgaaatacaaactattgactagtggtagtcgctcagtcacatctgactctttgccacctcatggactgtagcccgccaggctcctctgtccatggaattctccaggcaagaatactggagtggggtgccatttccttctccaacactgactagggctacctttaaattaaggaaaagcttggaagaaaactaaatacacttggtattcaatagtattgacagatatgtaaaatttttgtcaggtaacatgagttagtgctggaaaacctcacaaaattttaaaaggaaaatccataagtggctcagtaatcagatgccaactcatgccatacaccatgtgagatcttagtttcccaaccaggaattgaatcaatgtcccctccgttgagggcatggagtcttaaccactggaccaccagggcagtccctggacgtcaatttttttaagagaaaaaaaattttttctctactttggctattttttaaataatttatttttattgttggttacacacggtcttggttgctgcacacaggctttctccacttgtggccagtggggctactctttgttgtggcgcacgggcctctcactgtgctggcttctcttttgcagggtctgggcacatgggcttcagtagttgcagcttgcgggctctagagcgtgagctcagtagttgtggcacaccaggctttgttgctctgcgacgtgtgaatctttccagaccagggattgaacctatgtcccttgtattggcaggcagattcttctcccactgtaccaccagggaagtcctagagctattttaaaaccaagtaagcaatggcaaaatatttgccagtgtacctatcgtcttggggactggggtcaataaacacatgtgcaagttatccaatctgtgcttcaataaacttgcaacattcagtcaactggttggcagctggttttgacctatcatatgattacagttagtagagtagacgccccagcacagctctgcttgcagaagcaagacaaagtactaaaaggaggaaggagctggtagtgaaagaattccttgaggtcttgaaaactcaatcatgacctgacttccaattatgttctaaacccaaaaggagctgctcataattactatgcagtattacatgtatgttgcagcaattggaatagttctggaaaagaatgaaagggacagaacccttggaagaaatattggccccactatttagtcaaccagctcaagagaaatctccagtcagaatgcttgtcggcagatttacctccgtagaagcacaacttatcacctaccttctaaccactgacatgtctaacagctgcagagagggtaaatttttaggaaggtcagagaactgtgaggtcaagagggaactagtaggatatcatggaacgggcggctctagatgcttgttcctccaagtgtgggtcatggaccatccactgggtgggtatcaccaaaactgacagtatcacctatgctgctaagtcgcttcagtggtgtccgactctgtgcgaccccatatacggcagcccaccaggctcctccgtccctgggattctccaggcaagaacactggagtgggttgccatttccttctccagtgcatgaaagtgaaaagtgaaagtgaagtcactcagtcgtgtccgactcttagcgaccccatggactgcagcctacaaggctcct

SEQ ID NO: 51789 - DNA, 749 bp, Bovine  19866881124562
aaaaggtagtaatgccatttttaacaagtaccttccagaaagacttcagaccacagtgcttttaatagtgtttttccattttctacaacagtatacatgaaatgagcactcagtaaatattttttgatgctgaggtggaaactaacagaatgtatacacttgtattttcccccataatatcatcaaagaggtagcaaatgaagggctttcctctggcatgacagatgaaatgcaacgcacaaattcagacggtttaaagacaactggtggattactttaaggcacagggtttggggtttgctttgtattaactattaataactcagaaagccctattcaccaatttattagtgttaagttgaatttctgatgagatgggattctaaagcatcaccaactattctaaaatcaattctaccttctgaatgaaacaacttgtaagagggttgttttattagttcaaatggataaaagcaagccccccagccctagtggaggctgtgtggtgggttcatcatcaggttgcagggaccaggtggtgaagcaggtcgtttcacggagctggtacaggtgagaaagctgaaggaagaggccagcatctgtaccaaatgctcctgtggcttttttccaacagctttccaagtttctaaaaggatttagaacctggtttcctgccagctccctacttttaaaagcctgctccatttctactacatttgcaaaaatgctagctgcactccatccctcca

SEQ ID NO: 51790 - DNA, 1516 bp, Bovine  19866881154906
gatgtctgatgagccctttgttttcttacatgtggacagaaatgaacattagttgatccttaacaatcaagaattaacagagacacattcaagaagataaaggccaaatctttgggatgtttaagaggtcacacaaaccgtgtgtagagcctggaggcctgaacattgaaataataacacacaagctacctgtccatacagtgtatgtcctgtaagtactctttaccccagggacaacagattgtgatgttaagagcctgggctctccagaattctggattttaaacctggccctactacttgtgacatctgggatgcaaggtaagttacttaacctctcagcttcctccattaataattgaagacaataattcctacctcatagaagtcatttaatgcttaaatgagatactatgtgatttgcctggcctggtgcctgaatgcataaacgctcaagaaatggtaactctcattactgttatcatcactgtggcttttcttcttgccatttgtgctcacctattcatgtgctatgaataaaatataaggggtgcagggccagaagaaaccgtaaccccattactcctgttcccgaggcctgatcaagaccagagaaggacaaaacatatttcaaatctaaattctaatattggtgtcatttctgagactgtctccctgtgtttgtttgctttaatatgaatagattaataaaaaatacttctcccctgcatgaatatttaatggcaaacggatgtgtattcaatgatacatcaagggtaaattttaactaagactcctttttagaagtgatcgccactcaggttaaaatggagatcactttctccactgaatttaactttctttatcagcaaaaaggaaggaaaattagataatcattcattatgtggtttatctctttcatgaacatcccccagtgctgattaggcattatctatatttagagcgagctgagcccacgcataagatgatcgtgcaggtcagtattgacctgatgctacttcatacacaggtgggaggagcagttagccaggagtaaaaggacaatgggtgctgaagaaggcaatgtttccccctcagggaaaaacacctgcccttttctagcctcagaaaccttagtaggagccagcagcatcttctctcttaaatattctctgccagagcagagcatggcctccatcagtagggtgaccataggattggctgttcaaagagacactttacagttgcacttcccagcagcccctagccacacatagttatttaattaaaatgcaataaaatgaaaaattcagtttctcagtgccactggccgcatctccagggctagcaaggcacacacggctggtgtgtgtctaccaaacacgacagtccagaagcagaacattcccggcatcacagggagtcctcttggacagcactgctttagagtgagaaggggtgctcacccggtgtgctgtcttggacaagtataacaagaactaccccagataaacag

SEQ ID NO: 51791 - DNA, 1607 bp, Bovine  19866881166230
tggaaaaacaattcagctacttacctcactaaaagcattcgttatgcaagaaatgcaataatacattgtgtgtgtctcagagaagagcatgtgcatagtcttcagaatgcaaacacccaatattgattaaccaaaaacagtatcattgagtagatgagggaaggtatagtataaaggagataactcctagtcttttatagtagaagccaagaaataatatctgcaattgaaaaatgaaggtgaaagtgttattcattcagttgtgtctgactctttgtgaccccttggactgtagcccaccaggctcctctgtccatggaattctccaggcaagaatacaggagtgggttgccattctcttctgcgggggatcttcctgacccagggatcaaacccaggcctcctgcattgcagacagattctttaccaggagagccctgggaaataatgtaagcagttgaaaatcaaggtgaggcagtgtaaacacaatctttacgcctgtggaagcaaatacagggagaaatgctgaaaggaaaccatggagcgcggaggaatacggaaaaggacttcggtttttgccgtaaaccttatagtaccatttgactttcaaaactgtgtttctgtatttctttgctttatgttttaaaaataagagctggaatcattatgcagacatcagtcactgtataaaaggggttatttccacgttactgtccactttcttgaaaaaaaaaaaataaaggcaaacatttctgtatattatgtgcacaatttgtagaaaatgactgctgtattacctctgttgtatgatgagctaagtgttctgagtttttcattttaatttcctgctgtgtttgtgtatgcactgagcacacacgcttacattttgcttatattacacgcataagagtaaagaggtaaaaagtaggtcaaggagtgggctgtactacttcaggtgaagaaccctaattgggaagtggatttgcatcttgacagtaaaaaccctgatgagttcaggatctgtgggtttgataatgggcttagagtgtggaaactgctgaacacatgtgggaaggatggcagccagaatatgaatagctgcagtgagaatgatgtttgctgaggtcaaagtggatgcattgatttctcctcaggtttatatacttacttaagttaatggtccatacttttaaaatgaaatgttttcaatgtgcctacctttaccagagtacatataacggcccattctgcaacttagggtcagcaataaattgccatatccctgccaatggcaagtaatgctcttaaataacagaacttcgttgtcagtaacaacaacaacaaaaatacacttttctatgaactgtgaggacctgatgcgaccagcgtaatgtttttaaacatgtcatcatcttgctgttacaacttggaaatgaaaagatttgatctggaagtccctatcagagagcaaatatatagtttatttcaatcatgaaaaagcaaaaggagctagaagaatgtgtgcttttgcattctcctcctggatctgaagttttgctgattaatttatctcacctttgagtggtacctgtcagttcagctccagg

SEQ ID NO: 51792 - DNA, 1673 bp, Bovine  19866881202767
ggtgttctgccgtaccccctccccaacctgttcctctcaggaagttctggttggtaaagcccttgatgagaagcctgtccatcttcttccaactcagatttggccagggggtggctcaggactcagacgggcaagtccagagatgcatccagatccttaaagacccacactgataagcatgccatggaggtgcagagaagagaaaggaaagagaggagaagggaaggctggagcgggagatcccacgggtcagcacaacttctaaacccacatgagtcactttccctttctgccactgcaggaaattaaatccgtctgtcgcctccacttaggtcaaccgagcgctcacccacaacctcagagagccaaggaattctccacgaagagggcatttctctccccatcccgtgaaataacaggcacgtcactgtccttcagtgtgccctctgtagacagcctgacactgggctaaggttttagcagatgtgttctatagtacataaagaataggtattttgttgctatgtccctctggcctccgtaattcttggctcgtttccaaaaagactacagaagtcatcctggccccttaagttttgaaatcccagtccaccaggccctgtacaacagggaggctgagctgtcccctgggaccatctggcagccagcagacaccccctccagctttgcagtcatctctgcttccactgaggagggtgagcaggggagggtccgcagcagggtttatttatttattttttttagtatttatttctttttttttctttttttttttaaattttatgcagcagggtttagatttgattctgagggaaaatcaggaaggtaaataaatcatgggaaagaatgtgaacagcatctgagtgggagctgccactagtgacctctgaaaatcacacgtggctgtcctgagcactagcaaatggatttccaaaaaccccaagcctgacaccaaattcgtctgacaactctccacatgtacctcagggttaaaagtagaaattcctggccctctcactagcaatggaaagacactagtctttcttatagaattctacgcttttcttttacaagtttaaatataggtctgctttatcctttacattcagactaagagcatcactttatacaggaggccaaccctaacgagctgactcttccttgaatctcgccacagcccacccatcattccaggttaggtagcctcccctcctgcactcaaaacctccttctgaggactattatgatccttccaacactcagttttaatgacctagactgtgagctccttgttagggggaggaagtcagtgtaactcattttgaatatcaagaacccagtacagtgactagtaagcagtagaggatggatcaaatgtttgttgaatgaataaacgaagtcttttgattttttagaaaggtacaattctacaagtggctaacaatcaaatgaatgcatgtggcattttgttctacagatgatgatcttagagatttaagaaacagacagataaaattttgagctagaatttgaaaaggagcataaacatggtgtcttttttttttcccctagaccaaggagatgtgattaataattaatctttttttaaggctgggaagaatttcagatttcaagacctgctgatggtgtta

SEQ ID NO: 51793 - DNA, 1498 bp, Bovine  19866881240406
ctgacttgttagtttttaataaaataaaaggtgatatgtaaatctggtttatagattgatgggcttccttggtggctcagatgataaagaatccgtctgcagtgcaggagacctgggttcgatccctgggttgggaagatcccctgaagagtctgtccccttttcctccctctgtctaacttctgtcttttgacaagctaagtgaaaagattcaatcttgatcctgttttgtgcctcacgtctcatgctgacagcacatactagtctatcaaaacatttggcaatagtgtctgtcccacttcttatttgcaaaatatgagctgtaaagtgttgctcttgagacgtttaaaaatcttgacttggtttttgcaaaaccctccctgtataatgatgccccatgtggaaagaactgagtttttcttcatttagaatgtgtgtgaatcttctctctcatttaaagaattttgcctgtgaccctgactaattagggacgttactcctgttgctttcaggtgagtagctagaaacagattagccaagtgatttattgatccatattttattttaggcttagatctatagtactgcttctgaagacttgcagagaaatttgacatggtaaggaaagcaaatgttctaagtgccaagataagcatgaacagtaacttcatttcagccactggtttagcagagcgagctggctctgtgcaaaagctcacttaaatttgaatgtgctagaaatacactgacagaatctcctgttttatctcttttttcgcctgacttagtcgacgagggctaacagtggatgtccaaacagtttacagttgctaatacaatgcacaaaagcttgctttgtttggagagtggaaaatagagctgaaggggggcttctttagggcactgacctaatttcactcctactacaaaaatgattggttttaaacacatatgtatttctgatccaggtgtctatatctcagctagtagtgttacagcctgaggaagggtcgctcagtgctgctttgtgtatttttacaaagcagccttatttttatttgacagtgtccttttaaacttaaaacaagaagtcaaattctggcataaaatgataattccacaaaaggcaggcaattaagaaaggcagctggcgttgcatcatcacccctctcagtccttgaaacctcctcacatttgagaactggttagtcaccagctttttaaagataaagttccctgggggccgttcctgtgtaaaatgtggggaaatagagctgagttaaaagtaaacttagttcaggcattgccaaattttctgaatttcttaaatttcatgtttatgatttactttgtatgtatcatgtttatgatttacgttagaaatcacatgtcagcaatgtttttactatctgttatcctagaatatttgcaggcagtatgtgctgccttaaagaatctctttcgcttattaatagaaccgaggagaatacacatgtca

SEQ ID NO: 51794 - DNA, 916 bp, Bovine  19866881364111
tgtgaagtgacaaatatattcattagcttgatacagtaatcatttcactatgtacagcaaattattatgttgtatgccttaaatatatgccatttttattaaagatatatactgtaaaaacagttctaggggagaacaatttgtaatcacccatgcaaaacaggaaatatgtaagttccaaatatatttagcatgataaaactttgatgaattggatgtgtatcatttcctatttaagtcttgggaaactactattttagagaaattggtcatcggcattcaaattaatgtatcagatggtcataaaatactaaaatcccccagaaaagaaaacaaaaaggaaaaaacaaacccaaactggcttaacagaatggtaaggcagtgggaagtacagtccagacgtggtgtggtgcgtgtctgcgaatgactggacaagaatggcccattctgggcagcctagcaaatcatgaggaggatgtaggtcactgctgaagggccttacccacaccttcaaggactgacactggcattgccctgcagctggtattgagagtgcctggaagggttggcatccagctgtgtaggctggacctaattgatgttcaggggctctgaatatgactgactttactgaatcagatatgaggcatttaccacgtgtcacacacaagaaatcctaccttcgagaaagcacacataagtcaactaataaacgattgggcactttgcaaaacatcatagaaaggtaacccattatttcacactgttcatagacctgactctttgttatgtgtaaatgtgctttgcaatctgcaaatgcaaacaataatgtttaaaagctgtcactgaacttacaccctttccaatttattcttcctactggagaagtctatattatccactttaggggtttgat

SEQ ID NO: 51795 - DNA, 1616 bp, Bovine  19866881753251
aatgcagtctgtctcaaaaggcaagagtggccggccctgggagaagcaaacactttggacagagtgtgggccgtctcagaagacaagagatgacccacgctctttttcttttttgcttcttttggtggtaaaatatacatggaacttaccatctttaacatttttaagtgttcggtggcattagtatgttcacatttttgtgtaaccatctctatcattggtctctagaattttgtcatcctccccaactaaaactctgtgtatattaattattcctcattttcccctcctccagcccattaaccactgttctattttctgtctctatgaatttgacagctcaggagcctcacagaagtggaatcatacaatatttgtcttttttgtggctaatttatttcacttagcatagtgtcctaaaagttcaaccatgttgtagcatatggcagactttcattagttttaaacatttttcctatttgacatttaccactaggcatcacatacaactctggaaactagaggtttgcttctgtttttcctcttcttggctaaaatgggattggagaatggaagcagcaggaaatgagcaagctgactggctagtcattcatcccttccctcttattctttttttacccccgtaatctctgcagattgaaattgctcagaagcatcctgatatctatgcagttccaatcaaaacacacaagccggaccctggcccaccccagtacacaaggtaagggctgctctgagggtataggtctaaaaaaggggcttatgtaggactttgatgcttaagaatttttttttcacctacatttcaaagtaataagaaagtttgttttttaattcctcctggtaaactgtttacttattcagtcaaatttaattataaagaccatagagtcaaagttttatggtagtgttgattgcatgctaaaactaacatagtgttattgtttagtcgctcaatcatgtcccaccctttgcgaccccatggactgtagccaactaatcttttctgtccatggagttctccaggcaagaatactggagtgggttgccatttccttctgcaacacagtgtaatcactgacaatccaagtcagtcccattagacccattggagccatgtgtgtgcatgctgagtcgcttcagttgtgtccagctctttgcaaccctatggactgtagcccaccaggctcctctgttcataggattctccatgcaagaatactggagtgggttgccatgccctcctccaggggatctttcccacccagggataaaaccaacatctcctgcagcttctgcattgcaggtggattctttactcctgagccaccggggaaatccaattggagccacagatgcattaaattgtgttaagatagtttgtgagcaaaatacgtggggtttagatgccagttgtttcattgttaatattttctagctgttggccaacaagctcagtaatccttttgtgtcacttagcaaagtcaggctgtgtgtgagctgtggtctgagggaaagggaacatcaattgactggtgttggtaggatgccttctgtttaaagtgctgcataggcagtagtattatcaacagagt

SEQ ID NO: 51796 - DNA, 1248 bp, Bovine  19866882200667
aaaaagaaaaaggctcagaagcactacaattgttgtgacaaatttaaatgaagaaaactccccataaccactggggccaaaatgctccagaaacctttacttaacaaatgttacagtgaaaaataatgttgaagaggccacagattctcttgtcacgctttcctattccagaacccaatataaagttctgaagcacaaagagcagaatcctattcacctgcaatgtcaggttttcttgactggaagaaaaatggatgtgctaatagctggcaatctgaaaatgacacacccataggatgtgcctttgtatcacgcacgtcaacataccctttcatgtttgcagcagtggcaaaaggactgtaaatcactacactgcaatgaaacttctttaaaattcttattgttgacacactaaaatgacccagtgattgaaaacaattacccttgcattctgtgcttcttggagctcttgcattctctgtaactttgccttgtgatccatcttctcaaatatttttactttgcccaggacagatttgggagcattgtgctgctcctcactgccctctcccgtctcctcactctctgggggagggacgggagtggagggcttcagtacaggccgtccaaaagtgggtttcgctgcaataggaggaggacaacctttggtagatgcccctggaatttcgttaccagcagcggctgaggggtttgacttgtattcataagatctggagaagtcaaaagattcttctctgttttgggttttggcctgcagagagcaatgacatagttttaaccttgagctttccgtttattttcaaatctctattagtgatttaatacactccatttcctgatcagtttccaaaggtggtcaacaaattccactccaacaagaaatcaaatacgacaaggtacatggccaagatctggcatccaaagccctacctcactccctacagaaaagtattaagggctcgaggaaaccaagagggtgctgcgaggcctgcaagtgctagaggtggatcagacctaactctgccctagaggagatttgaatcttagagaggacctcagaataagtcaggcttcaggatggaagggtggctcctgagttcacaccatgctgaggggacgtgccttggcccagaggtccacccagaagtgaggagactggggttgggagcggtaagggagaatatcatgctgatggccactttgtcttcatacttccatcctaggccg

SEQ ID NO: 51797 - DNA, 1480 bp, Bovine  19866880399569
ttggatcaggatcctgacagatacatgtccttagcacctctactaaagtcctatgggagacaaagtttctctccatgctagacttctgggagcatatgggggaagaggttcaggtcatctgttaaaaatgaccagaataaattattcttatgatttatagaattataaaatacaaattttctgacccaagataaaattttgagcaatggtagagacactggaaaattactgagataaactgaaactaaggaaaaaataaggggactgctagaagttagattccccagataccacctaatgcacacttagactatttgtacattatccacatacactttgcctaataaatgtaacaattattcctactgaaagagttcctcagttcagttcagttcagtcactcagtcgtgtccgactctttgcaaccctgtgaattgcagcacgccaggcctccctgtccatcaccaactctcagagtttacccagactcatgtccattgattcggtgatgccatccaaccatctcatcctctgtcatccccttctcctcctgccctcaatctttcccagcatcagggtcttttcaaattagtcagctctttgtgtcaggtagccaaagtattggagtttcagcttcaacatcagtccttccaatgaatacctaggactgatctcctttagcatggactggttggatctccttggagtccaagggactctcaagagtcttctccaacactacagttcaaaagcatcaattctttggcactcagcttactttatagtctaattctcacatccatacatgactactggaaaaaccatagccttgcctagatggatctttgttggcaaagtaatgtctctgctttttaatatgctgtctaggttggtcataacttttcttccaaggaataagcgtcttttaatttcatggctgcaatcaccatctgcagtgattttgtagcccccaaaaataaagtcagccactgtttccccatctatttgccatgaagtgatgggaccagatgccatggtcttagtttctgaatgttgagcttaagccaactctttcactctcctctttgactttcatcaagaggctgtttagttcttcttcactttctgccacagagttcctcagagcaatttaatatcaaggtcagggtccagattcaagaaataagatgctacaaggcacaaacctacacagacaaaacaacacagaacctctgagggtttcatcagggatacttgactcagacaattctcaggccttgaaaccagcacccatgtgaagtataaagctatttctacacaggttttcctaatcctccaaagatgtgatgactgagaaaaatagatatttaaataaccccagagaaccagaacagtgagaaggtcattttagagtcaaataacatttagattaggtatgctacactatccccccccccctttttttttttcagtccacaca

SEQ ID NO: 51798 - DNA, 1298 bp, Bovine  19866880407649
aaaaatgaaagacaaggctgctaagataataggttattaatgaatataataaaatgtttgtcacaaatattttttggaacaagataggttatatttaaatgagggattaagctaaattaagaaagtcaatagaaataggagggaacgaggcgtgggggggaaactaacctgcactgtggttgctaactctactactgagtattgagtaataacaatgattactgaattacaattaattttatcactgaattatgtgtaagttcttataccttatatgtagtgaatacaatatttgttaaatgtatgcaccttctttctaggaactagctcatggtgtcagaagttttgtatttcatagtttcattcatgggtatttaatcttaagtaccatcttaagttacaccagctcacccatttggtaaagaaattctatatgcaaaaatcaaggcttttcttttcaattatattttattcacattttaaactttattttttatatccccaattataaaaaaagagatcatgagaagtaaatccatttccacttctagccacatttcaaaatatagaatattaagtctccatggaatgcccaacctgagaaagattttcccgtgggtctctcaggataattttacagcaatttaggagagaaaacgatattttttatggtcctcaggagctttggatgggcagaagaccaccaagaagtgggatacattttcagttctgtgggtgttaccagaagggatttgctaaacctacaaatttcctcctcaggtcactattgagtcaaggtgacatatatagaatatctaaatgtgtcggtgatgtaattgcaacaaactacttctgtcaaaatgaattaaaaatatatttttagtctaaatatttcttaaaaatatgtgaaaataatattttcctatttatgagagatcactttattactttctatagaggctttaaggattatatgagatttaataaagaaaaaaatgctgttttataactataattatttcaccttaacaatatcattttgaacctgtatctcagtgttttcagagagtaaaattcataatgcatacatttgtgaatactgaaagtccttaaaaaaaaacagaaaataaaaagttgaccatcaataaggaaagtgagaaaaaaacaaattaataacaacattattataatagctgactgctgcaaagttttagtttatgcaacatatgtggtaagcaacaattttattctttatataatttaatatttatcaaaatcttattaaaaaagaggaaagt

SEQ ID NO: 51799 - DNA, 1188 bp, Bovine  19866880429704
cacttcgtgtgtatgaattaccctgtcagaaattgataccactcttactaaaggcccagcttaagtatcaccataatagtgcagccctccctggccatccccactgctgctgctcactaggcttagttgtgtccaactctttgcaaccccatggactgcaccctgccaggctcctctgtccatggggatttctcagacaagaatactggagtgggttgccatgccctcttccaggggatcttcccaacccaaggattgaacccaggtctcccacattgcaggcagactgtttaccatctgagccactggggaagcccccaatccccactagttccttattttaatcattcttatggcaattactgacttctatttgtgattgtccgtgaaagtgctttcctctcaaactatattgtcatgtccttaagtataaaggttgaatcaatttagcttagaatacaccacaatacctgacacaatatcctgtatatatagcaagttctcaaatactaagaaacaaatcaagaaatttacagacagcaaactatttaatactttttagtcattgtattcatgtatttcttttagcatatggcttgttgacctactctgtaagattattaaagccttgggaataggtatcatacctatccttttatttataaatgatataaataatataaactttatattattcataaatttattgataaataacagattataaataaagtcttgggaacttattatataataataatattttcttattatgatttgtcaatgattaatccataaagagatactgattattagggtgactattcaggttaaagccatttcttgatccaattaaagctttacagaaaagcttaggtagatgcatatgttcttaaacataggcacaattagatctcccaatggtagatgaatcaggcaactcttttatttggcagatttttcaaggaaaaaaagcataaaatggaccagtcatttccctgagctcctctcttattttaatagctattactctcactccatgctcatctcccctgagatactgtgttggattcttttcctgaataagtctttcaaaaattaaagataaatacaagtctcagaataccaacaacatttctctctgagacatttcttatatgttaaatcaaaacagggtgacattagaac

SEQ ID NO: 51800 - DNA, 2474 bp, Bovine  19866880437623
tctctcctctcccactcctgcgtttgctcccctcttccacctccttctcaccctgcttctccaccctgctaccttcttgcccttctgtttccctgctactcggcctgccctcccttcactgccaacaccattctggaaagaccagtctacacgtattccctctgcatccccccctctacaattggcctccagcccctaccacctttctagatgcccttgccaaggttaccagcagtgcccttgttgccacattcaagcagacacttcagcccatatcctgcttggcctgtcagtctctgacactgttggccaagccctgctttgttgaaagatttcctttcagcaactcctaggtcccaccctcccctgattttcctagccagcctagtatacagggaaaagatagttttgaattgcagttctgccactatatgtacttgggcaagttgcttaactcaccaagctgcctctgtgagtcagggataataatagcctctactcaggttgggctaagatatataaagtgcctagcatggagcctggtacacagcagtgctctgtccctctgtctatcctctctgccaatggtggagtcagcaagctgtccccagatatgtagtctctacagtgatacagcctttggttcttggttgggtatgaggctgcctagaagctgcatttctcagccacctcttgcaactggctctggtcatgtgactaagttatagctaattggatgtttgtagaagtgtcatgtgacaccttctgggaactttcattaaaagaaagctggtagatcttttgcccggttctttatctttgtctccatctcactgcctggaattcatatgtgatggttggaactctagccatcaccttgaatcatgaggacaagagtcaaatccagaggttgctggagcagtgagtggaaagagtcacatctgggaggtctttgtggagcagagctggagcaaaactgttgcccccaaactaggttcatcttgtagtgggtgtccagtgaaagcacacaaccaagccaaagagtgggagaaggaaggatttattacttgtagcaagtaaggagaacactggggatctttctctgtaacagtgtctcttggaacagcaaaactggggaagtttcaagcttaaggcacatgcttattattcatgaagaggcttggggagtttacgtatcatagaactggggcaaaggttgacaggagggtcagaaaagctcagggtcatcccttaggtttcggttgatctagtggttgaagggggtttcaattctgcaaaacaactcaagaaagtgcttcaggctaatctttaccattgaaacagaactgcgggggtctttaccactgatatatcatctttgctgctgctacttctttgcctgacaacagttgtttgatcctgcattcttttgttcctttaaaatcattaattactgggacctgttcattcattattgagacctgttcaaagacaagcattgtggccaggcttggatcacaaaagcggcttagggaacaaatgacttctcttataccaaaatgctacatttggttctttttctctgggcctccttactttatctgcttacaataccaactcaggactgtttaccctgaggcttttacgtggaatttctgttatgtaagtcagaactgattctgcctactacagagattttggggcttccctggtggctcaaatggtaaagaatctgcctgcagtgcaggagacctgggttcaatctctgggttgggaagatcccctggaggaggaaatggcaacccactccagtaatcttgcctggagaattccatggacagagaaacctggtgggctacagtccattgggtcacaaagagtcggacacgactgagtgactaacacaccacacacacacatctctctgaaacggaatcaagtacagcacagacttctctggtgttcactaaaaagccatctaacctttttatagatccctagatacctgtaatccaccaatttccagcttagagaagaagaaaaaaaaaagtatgaccgtttaactttgaatcctgggaggagaactcttagctggataaatttatttttcttatccatcaatgttttagatttatatccactttcctgttctatttgatgccaacatgcattcctctgctgtggtgcaggtatgactaagtactgtctcatttcactgaatcgagtgtcatttgtcttgagttctacaggctgactgcatacatgacagcacacagtgacagtaatttgcactgatctgcccccactgctagtcctgctgctacaaatagcaattgattattatgctgtagtgttattgactgtcactatgaacacaagctttatttcatttttaaagtaacatgctgcagatttgtttagtataaaagcaaaacagggaaatattcatttcttagaattatttgcagtcacaa

SEQ ID NO: 51801 - DNA, 987 bp, Bovine  19866880438234
ctgttttattttcacatcttggtcgatagtgcctagttgttcaggctggctgcctgcatattatttttgatccctttgtctctgaactttgtctccttatttccatgtcgactcgcatcatttgtgctagttgaaactgcatcattttccacctggaataatgaaatattttcctgctaggtctccctatcttgacactttgttctttctaatccattattcactgtgcaggcagaatcatcttctgaaaaagtgcatcttatgatacctcttgctgctcaaaatcctcaatagcctcacagtaaaaatgaaaatcctcaccatagaccataagatctacataatccagcctctgataacctttccagaatttttttccatccccccatctttattactctcctatcacactggttttacttcagttcttcagcatagcctgtactttctttttttccccaaaacatttttattcactcttcttttggtaatttgtaattaccctttaggtttaaagaaggtgtcagttcctctgaaaactttgcctcatcccctagtctgtgaacattagatctcttcacttagaatatctgctgttcttcctccacagcactgatcaccagttgtaattttcctcgtgcttctgtgatttttggcttactgtttattctatcctgaaaatatatatgctacctagggcaagaagctatgccagtttagtacatggtccatagaaggtgcgtaatacattttgttgaatgaattaataaataaaatatttattgagtatcttctgttcagtacagtaattatcttgaaggaggaagaatacacattaattcaaaataagtaaaaactcctaaaccactaaacctttaaataattagaggacagaggaagacagtatgcaattaagtgtgaaaatatgtggtacagcatgaagctgctagaggaatgcaaggaaggaagagagatctggggcttcaa

SEQ ID NO: 51802 - DNA, 1044 bp, Bovine  19866880448393
attaggacttctgaagcattaaatctaaaggtccatcggctcacatcttccagccctgcctgtctgtggacaggaccctgtctgtctgtttcctctattgcactattttgtttgtactactgtaatcattttgctggcccagatctgtgtgggtgtgctggcagctttacaacaaagttacatgggaacagagttaaggttgaatatttattagaagaagccatctggcgtcaggctgtctgtacagggggctggcttctttagtaggctctcctctttctctagagttcttcctccctctctctcttctgctcctgctcaccctgctcctcacttcacagttctgaaaaagttgactctgcctctctcacccatttactttgtcctttgttatttgtgttcttacaaaagaaaaattgcgagatcattctgtttcttttaaaatgtttctcttttcttggaggcagcttttgcttgtttccacaatgacagtgtccacagagggtcaccagtagaaggcagcagggccgccacagcagaacagcggcttgcttcctacgtgggcttgcaagttgccttaaacatccatttcctgtcgctgcctttctttcttacctccagtcagcaaactaatataaaagcacctctctttggagccaggccactctccacataagaaatcagatgcggtaattcccatagccttctgccattctgatccagttcagctgacttaaaatttttgctacactgtgcttgaaatgcttagttttttcacttatcatttcgtgtgatagttgttcattctcttctgtgaatgtccctcttgtcttttacaactcttcccgcttctccattccccctctcgcctaaacacagggcctctgctgagagccttccccagtttatgtagtttgtcctgctgtaagtgtgctgcccaaaattgctattgtcaccaacctgctccagtgatgctcattttaaaacatgcatggtatgtaaccaaggaagccagtgggaaaggaagctcataaccaagatcac

SEQ ID NO: 51803 - DNA, 792 bp, Bovine  19866880496045
ttggaagaaaacaaaaagccagaacatcctatatccagtgtcctcaaagagactttgattaaccccaacgattccattcaaggaaacaagcttcagcctgttcttgtgttctcagtccaccctcttcattcaaggtatggaagatgcaattttctagcatacacccagttgaatcttttctaatggtatccatgttggcgctattttctaggtaggcatggagggatgtcttcatcattcacaggagtctggggttacgccaaaggcaaagacaactccacagacaagggaaatagataatttcagttcccgaatcagtattgagtccactaacacctgagcagtgaaaatcctgtggtgtcttcattcaagagccaggaaattccatgtgtttatggactcaagttctcttctaaatggagtgactatttattgtttcgtatccatgaaaggaaatctgcaaatagcagacagacgtcacacattccttgtgcatctacgccccagtggctccaatgctgagccaactgctcatgagttacaggataactaattcacttggtcctatttctccctgaaactctacgtggagttgtggttcactggtttagtgacgtgaatgaagggaattcactgcacttcaaatctctcattacaccttaattaggaccccagctagaaatatcaatgttttaacaactgtagcagacaaggtttcttttttttgctttaatcatatattgtaaagcagattgaagtactttatcaatgttttcttcttttggttttttt

SEQ ID NO: 51804 - DNA, 1763 bp, Bovine  19866880548647
aatacatgttcaccttatatgattagagaaaagaaaaatgaaggagcaaaagatatttcttgtcttctgaatcttaaaccacacctatcctttatggcgcttctaaagtttgcacactgggaaaatcttgactagcatttagtctttttgtcaagatgaaaaatggcaacttttgccccaaagtagtgaatattccttaactcaaaaaaaactttgttcacataaaatagagtcaaaaaagccctttgtttataaagtgctttcagattctcaatgagagacattctatttttttgattcagtttcctcatgcattcattaatattattatgggaaaacaattatcattttaataaaacaaactagagaatatattctgcctgtcaccttctctctgtgttcagtatacaatggattacctgctagcaataaattccctggcttgtattttaactcagaatataatgtttccaatttttaaataaaatttttgcagatatataatttgcataatctatgattgatggtgcttattaacaaaactccaaatttctgtcttattctctcttatgtacaaataatgctacccccctgccccacactgaacacgcacacacagacacacactctatctcttcagggttcattccaatctaataaggattgttttcacagcattccagacataatgctccaaattattattctatattccttgttctgctgcagataaaaggagaacacatttaaaggaccattgcttagaagtctcttttatttaaatgttaaaacaaaaaaaagaattagctgtgaaatatactggaaggttccatgggattctgaatgacttcttctaacaaagtgtttacatatgttatctgtgactggaataatggaagtggtagagaataccatattttaataaattttcagaattattttgtataggactttagaactaataaaaatgtagcacataaatgtccaatagccaaaatatactatctcatcatttgctttttatggatgtaggggtgaggatagtaaaattattatttcctttaaatatctttgtcaatttcttttaatcttacagtttacagcttccttttcacagtgaatctacctttcaaagaattacttattctttgaaaacttcacaaaggcatcctacatgatgcattttcatgttatttacagcaaatacgtaaatcatatactaatgacagtagcatctttgtagttcattctaaaatatggatgaaatatgagttttcttccaaggtacaaaacgtcattaagggctcaggtggttaaaatcaacatgaaaaatacatgcagcattttctccccttaaatgcaataatgtaatcagatttcaagtcatcttacctacctcacttacagctttatggagattaattagtttttagaccccagtcacatgatcttttctgactgtcatttagctggctgactagaacctgtaagctgtctcctgccccaaaggacagattaaattttagtattgtttgtcttctttctttgatttaaagttgtatttttaaagttatggtttattttattttgttgttaattggaaatttactgtaaccttgtttggggggatgttaaatatttgaaataataaatattaggtaaaacaaaaatgttttccctcttttgctataaagatggttattatacagacacctaaaacataggtttttattatttatgattcagatgttacaagtattcaa

SEQ ID NO: 51805 - DNA, 879 bp, Bovine  19866880606801
gcttcccttgaaacatattaaaaactctcagaagagataatctacagtagggaatagcactgtgctggcccggggtgtacaggatgacctaatgggtcttttccatctctaattcctgtgatactacagatctaagagatggagccagtaattgcgttacaacatagcagattcctctctctccctcctctttccccccttccctggagttcagcagagaatctcttaaaataaacaaaaactgtgagaaactaagagaagtcagggactggcccacttttgagatgcagaatgtggaaagtatgaagcgctgatttgactatgaaggctggaaagcagaggggccagagccatttacactgcaggcagtagttaaaaaaggaaaaaaaaaaaaaacaaaaaaaaaaacttgaaaaaaatgggtgtaaccctgggctttgatacaactggcctttcagcccccacttgagatttgcacatcctcaagggaagctgtggtttggaatacgatcgtgcatttaatttcactcagagaacttattggacttggcaccaaaagaaagaatttgcagtatattttttgtcatgattagtggccccctcgccacaacatttgattattttggaaagggaaaagttaaatccttgtaaagttgtgatttacaattttcgagcatccaggtagggagcatgacttctgccagcttgatcatgggatccacattttattctagctcattgatgtgagaaaacaaaacagttctgtgggggaaaatagacttgaaaatatatcccttgattatcctgggagatttttctctccaaactacatcttccctcagtcacatgattttggtatccacggaactgagcaagaaa

SEQ ID NO: 51806 - DNA, 2288 bp, Bovine  19866880610854
tactcatacccacactcatttacacacaggcacaggcatatacatatattcacacatacttgcaatcacaaacacactgatttttgccccaaaattcacatagaaaacaggaagtttaaaattctcatgagaaatgactagtttttaagaaaagttagtttaggaacataagaaactaataaataattgacaagttgaaagtgcttatataaacaagtttaaagactagaccaaaatgtattgctaaattagtataactaattgctaaattagtaagtataacaattaacctaatgtgtatggtaactactgcctcgttctccacttctgaactcccttgtcttttaccctacccccatggtatcatgtaaagcaattcagataatttttgttatctttactttggagaaatccccagatcatgatcctttctgactacaacttttgaaattttcagttttttctgtcttcctgaagacttctcaacagcaatatttgaacacagagctgttggtcttccaagctgtactctattttttttttgtctctgaatctttccaacattgtcatgctagttcctaaagcttggagttacccaggtggtagttattaactgacgtgtcatggttcattgtgaacaagctaggtcaacaaacttgtttttcatcatgactggttttaatttgaaagggagcttgttacgtatttgataatgcttcactgaggttcacctatttcaggtagattaatagcttgttcagggatgaggagcccaggggccccgttgtaactgtgtgctgttgggttcaaggttcaaacttcagaaagtataaaaatccttgtttttcttctacctgtttggcagtacatgctttagtgaacttttatacttggtaacacttgaacaatcccaggtttgagatcttacagtaatattaggaactggttatataattaagtactactctggtagtactttccaggttagaagaccttcaattttgaaaatattcatacagagtttcctgatcatttaccaggaaaaaatatataaaaatctctttaaaatgaaatattaaatatctttcaagtcctgataccacaggtaggtattagattggagtaaatggatgaaaaaagtctgttcatgtgggaccaattcatgaggcgatggcatatcagtaattccttaaatgaatgtctacataaatacacttataatacattttaaaatttgtagtaaattattaactgaaaaacttttttaaataaatgagaggttcaccacatttgtttttttttagccattcataaaatagatcctttggacacacgaaatatatcagatagctctgtcatgtgagaagaaaaaatttaagaggcagttccttcataacatggtcctagtgaatctcagtgtagctgaagctcctactcagattttgctcctgaagcatttaaattcaacactacttaaagtttaaaccacaatggaaatattaatgatgtctctgtgctgaaaacagcttggcagtctcttaaattgataggtttctaaagaaactctccatttcaaataaggatctgatgttcagatttcccaacctgtctgaaatatagtatacctacatagattggctatctaggagcttgtaaacaaattcataaatttgtcatgctgattatagtgttggcaaacacaatggctgatcatgttataaatgtttatcaacactcacactcacccacctgctaagaggtgctacgctttaatgaaattgtttgaatatcaaggccggttgctaagatacaatgttcttgttactagggatgtgatgcttgcagatttctgttatcaaataatgattagagatgtgctaacctcaaggtgctcagtgcagtggaaggtttaccgagctacaaattagtaaactgcttgagcaggcaccggcagaaggaacatgtgcttcacccatacacgactggcattttaaaagacgacgagaggacagggagcgtggccacgaatgacggggccttgaaagtttgccatggaaggttcacctactctgttgcccagcatgataaatctttagccagctggggaatttgttgaaatccattgcagtaactccctttctcatgcaaggtctgttctttacatttgcttttaattgggttgttatggaattattaacattaaacacatcatatcttttttatgagaaataaaagtaaataaaagtgtaatcctgcagaatgaagcacttgaacatgaacacattttt

SEQ ID NO: 51807 - DNA, 852 bp, Bovine  19866880614163
catgagcacacatcagaagcacatggcgatgaagaagtgctgtggtgggagatctgatcaaagtttctcaaaacggactccaagtatttgatgaagattaacatggagacgatttaccaaacaaatacagcataaagagccaagagaccttctaagggacttcaaggctccagcttgcccacataaagaatatcattcaacagaaagaaaacaaagacaagaataaatatctaagagcactgggtctgtagaacaactgaactgccgattgatgacttttctgttctttttttaatatatacattagaagatgctttcagtttttaaaagcaaacaaagccatgagtttgatctgggtcctaactgtgtaactcttttaagtgttctaaaagatgtctggaccagaattggttaattagcgctttgtgttgcactatgttacatatgacctaaccagagataaaaaggtttaaaggtctcttgtaaccctgcaatgccatttgtaacacaaaaataaccccctttcattactagcatgccactgtagcacgcaggttattttttcccttcactgcaataagggcagctttcgcatcagaagaattcttggcaaattaatgcgctacctcttgggctaattaaattagaaaggatcaaaaatacagagcggcttttgtggtggacacaatgtcgtgcttcatgcgtcttgctcagagaggaatttctgccatttagccccttgcctctagcagtgttctggactctctaacacagtcaagttcctaatttgcctcaatgagagagaattattaactgataataagaaaaggagcattcacagctccaggctgg

SEQ ID NO: 51808 - DNA, 1216 bp, Bovine  19866880627362
ttttaaaaagtagaaaaataaaatttaaaaaagtatatttgaactttataggatacacttaacatatgcactaaattaataggattagagaaaaaattcttacaatcactaggcccaatcctttgttcttagttctgaaaggcaaaataactcacaataagaagctgccataggaactatagctgaggcaccactgatataaggaagaaactccccattcgcaccaatagggtatttccctctggaaattaactgtactttcagttgtggagcagataattgcacttcttaaagctacatttatataaatagtccccatttctgggttgtttttgccctcagttttttcataaatcaaatactaaatagattgtttatgtgtattcttcatatagtgaagcatagtcattcattaaaaataataataataataagtgcctgccattttaaagttccagtaagtacaaagagataatcttccttctggttgcctataaaatcagattgggacaatgtctctcatggtgaacttttaaaaagcaaaaactgtgtctaaataacctttgcatttgtctgtatcagatgtttgcaatattagatactccatgaagatttggcaaatgaataatttgaattaatagggtaagtgatatatgatagaagtagaggtacagaagacaagaaagagttccaaatagattgtgaacagtttttctaaagaaatggcctactagctgaaattaaactgatgaggaatcttgcaggggaactgcatggaaagaatagagcagactatcatcagcaaaaccacccaagggagattgaacctgtcagaacatttagatgatggtagcatggagattcagagaagaaaatggcaccccactccagtgttcttgcctggagaatcccagggacgggggagcctggtgggctgccatctatggggttgcacagagtcggacacgactgacgcgacttagcagcagcagcagcatggagattggtagatggtagatggaagaaagctatggaagaggaacctggtaatgtagagacagagatcaaattgtgcttggtcttgaaaaaaacaggtaaaaagactgggcttttttcttccatcaaaagccatgttttgaagaggatcaaggcctgatctgttcagatgactttcctcagaataatttacagatcttatatagaaaccaggagccaa

SEQ ID NO: 51809 - DNA, 2622 bp, Bovine  19866880629711
ctgcatgtgggtttaaaaagtactaatcaggcttccctggtgggatcttcccagaccagggatcaaatcaatgtccccagaattgcaagggcagttaaccactggaccaccagaactgcctgattagttctttttaaaaaatgtttccttctaatttgaatatcagggtaatggaattttgtaaaacagtttggaaaatgttctgtcttctatattctggaagagattgtgtagaatttgtgttatctctattttgaaaatctggtagaattcaccagaaaagttgtttaggtttagtgatagcttttatggaaagctttaagttataaatacaatttctttcagttcagttcagttcagtcactcagtcgtgtccgactctttgcgaccccatgacttgcagcacgccaggcctccctatccatcacctttttggcaaagtaatgtctctgcttttgaatatgctatctaggttggtcataactttccttccaaggagtaagcatattttaatttcatggctgcaatcaccatctgcagtgactttggagcccccctcccaaaataaagtcaattatttaatagtttaaattattaaatagttaataattaactattattaatagtgctgtcgcagcttggcactctcggctgccgcccatgacctcggacatagggtagctcgtcttggctgccacctctgacctcagacgtgggcagaactattaaatgaatagttaattaagagtttaattatttattaatttctttaatagtcctcaaagcattaagattaccaatttagtagcatgtgagttttggaggatttagttgccttgttctgctgtgtccttttaggatggtgctgacatctggaccaaagaggtaggaagacagagggagataggaaaagagagagcaagcgagagagatattgaaagcatcatacacttgctgcctccttgggagcatacctctcttaagcagagaggaagattcccctcgtctcagctgtggttccactgggcctccactgctcatactgttaccaccactgttggattgcttgggggctcatggacaataaaatggtgcatttttttttaatgggaaaaaaagatacatcaaaatgaacgtgagggttatctacactgtgcccagcattagcattccctttcctaccttccaaaccagaactagaagactttccttggtgctgtctttttgactacagcccagtgtctacttccagttttgggtgcattaaaatcaggttgggagacccagagaaaaaataaaatggcagactcactgccagctcatttgatacttcagttttccctccactaaccttccctagtactctatacatttttagagttactataaaaggagaaggaaatggccacccactccagtattcttgcctggagaatcccatggacagaggagcctggagggctgtagtccatggggtcgcaagagtcggacacgacttaagcgactaaaccactaccgccatcatagcttctgtgcagggtttatatttctgttctgtcatagacagtgtgcttataccaccttaacctggaacagaaacccaaatagattcttccttagtgcaattgtatcactgtacaatccttgaatacttctgagaaacagcagagtgatttttacggacattagtttctgacctagactgccttagttcaaatgctcactctactccttactaactgtagaccatgtccagattctttaaactctttctgtctgttttctcatatttttaaagggaacagtgataataatagtatcttccttacagtaatttacttagttgttataagtaggtgcctagaatagttcttggcaaatcaggcatactatatatactttgccattaataaagctttgaataaaaatgttttctaacttaccatctgtattgtacaatcagaagaatatctaataatcagtagtaaaaatattaggatatatgtgtaaccacttttttcatttcagactttgttaaaatgcagattatctctttctggtttaggtcaccacgttccctcttatcctatgtccttcagtacattagatcagattgtcctgtgaagatgcagtgcaagtgacctggtcttactactgtagcaattaaatcacataatcagaaagctaatttcattgcactttgaaaaggttattaattgtcgttgtatatatttcagagaaagtcaaatatgggcaaagggcatgttgctaatagtcatgcatcagacaagattcaaagggaaacttaaaaccaagcttcctcaggatgaagataactatcagaagactgatgctataaggggggttaggcggaacagaccatcttttactcttccttctctattcagggtaggtcattaaaagtacactttagaggttgaggggaattattacagattttctcccaatatctatacaaatttaagctaaaaataaaaatggaactcatgtttatatttgctgcctaaataaaacaagaacatataattctgtttcaaggatatttgtagtgattaagcctaaatgcaagtatgtatggttttaaaaaagtttatggaggag

SEQ ID NO: 51810 - DNA, 1305 bp, Bovine  19866880706323
gagaaaggcaggtggaaagacaaaaatgagtaggttttcacttagtcaatctccagtacagaaaaaaaggaatgcttacacttgaaacttgaaaactaggaatgaatcaatggcactctggggcaggaagatggaataagggaggatgatggagaaaaattttgctagataaggcatgcatgcctgctaaatcccttcagtcatgtctgactctttgtgatcccatgaactgtaacccaccaggctcctctgtccataggattctccaggcaagaatactggagtgggttgccattcccttctcctagggatcttctgagccagggattgaacctgtgtctcttatgtcttggcaggcaggttctttaccactagcgacacctgggaagcccagataaggcagcccaaattaaatatcaatacccactgaaaaataataataactaatgtttggaaagggtagtaaggaaataaatccaggcaaaagaaaattaggtcaaatcaatatatcaagtttgtgtaatacttttaatttacagaagggttattctgtacttgacataaggaaattggagatgttactattctctgagagcaattgagttatccaccatcacaagaaagtacagtcagcagctgaaagctaccatctttgcagtgatgtttatttacaaagcaaataatggtttgaaatcaccaagccccagtgaaagtgattctcaaaaaagaagcctctcccccgccccttactctatctccatcacatactttttcaagtatcgagacaaaatattcactatcaaaaacagattctttttcaaaaagtacaaaatttcaaagaagtctctagcttcaggagaattctcagtattcatatcagtaaataatccaaagtatatttttttaggaaacatacttctagtaggataagagccttttgtatcctttacatctttaagagagtcacatctttataatacataataacaaaacagaatatattgtaactcatttcttgaccttttaatatttctgtcactgattgtcagagttgagaactactctctatcctgaggtgatggattatttaattaaccattgaccttggtcccaacatttgttgacaatgagcacagttccatgaaagctgcctgctttggatattggtcaattcttcattgtttatcaataggagccttccatttttcataacttaaataactagaattacatttgccatgaatttgtccaaacctattttcaaatgaattcgtgtctgtttccttttgactatctatattagaa

SEQ ID NO: 51811 - DNA, 2520 bp, Bovine  19866880708281
ctttaggatatactggttagatctccttgcagtccaagggattctcaagggtcttatccaacaccacagttcaaaagcatcacaaatctcactcatatatagaatcaaaacatatgataaatatgaacttatttataaaacagaaacagactcacacatattaaagaaaaaataaaaaaccttgtaattaccaaaggggaaaagggagggagggataaattaggatcttaggattgacagatatatgctactatatataaagtagataaacgaggacctattttatatagcacagggaactttaatcaatatcttataatgacccataatggaaaaggaaaaacaaaaatatgtatatatattaggaatatatacatgggaaatatatatgtgaatgtgtgtatctgaattgctttgctgtgcacctgaaactaacacaacattataaatcaaatggactttaatttttttttaatttttaaaaaataaatggagttatggtctaaatggaaaataagtataatcgtggggtggagggaagcaatcagttcagctactttgacataccataaactgggttgtttaagcaacaagcatttatttctcacagtatggaagctggaagtataagaccagagtgacaacacaatcaggttctggtgagtgccctcttcctgatttgtaaatgattgccttctcactatgtcttcacacaatggagagagacattatctcactcatgtctctccttataaggccactaatcccagtcattagggctccaccctcatgacctaattaactctcaaaggccccacctcccaatgtcatcacactggggattgggatctcaacgaatgattttagggggatataaacattcagtctactgcagggaagaagtaaaaatgaggcatttggacctgtaactagatgaattgcaaaatatatctctcccccaaccccagtccccatctgtttctgagatctattcgtacttctgcatataaattgctaggtacaactatattttctatgaaatgaaccatttgaatgagaaatcctaatatatgcattaatgtgtgcatatgttatatatattattctgttatcttaggagatatcttagggttaggagagtgtcacttcagaacaagagcatactgtcccacaaagattaaacacaaaaatgaatgactatgagtgtctctgtgccatcctaagataataagcacctttgaatggatattcattttttcaggcccaaagtcaccatttactgccaagggacaatcatattcctacttatccccaggataccttggataatctgactcattatataaaaatattgttgagagctttagataaaaaggagtcataaacaacaaatctatgaggggagctctctgcaaccttataaacaagaaagtttctgggtcctgaaagagatttttctctttgtattttgataattaaatagttagtgtggtcacaactttgtaataagactgattgtctatggactgaaaatgcttatccataatcagagggtctcagagagacttgatgaagataagcatgaggtatgtaagaaaatttctgtgttgtgaggacagagagtggggagccatttctaacctctagtaaatcatctaattcaaatttttaaaaattctggaccattgtcagagagcctgatgtgataaatcttttcattccccaatttacttttatgagaaatgccatagcatggtagcaaatatatccaataactattgtcagataatgacaaatctctgataccttttgtcacattatagtccattttgctagtttcatatttacaagcaaatggttacctcaaaatatgaaaccctggcatttagagaaatgcagaaattactcacttctctggaattctgcatgacaaattagtactatgctttaactctaataaatgtagctataactgagttttcataaacattcttgagatgttctactagagtagctttattttggcaccctacttttcctgcttaaacaaatgaaaaggttggctgatattgtcaaaatacagcacttctggtgaaccaagagccatttattaaaataatgtattgatgcggtgtcataaaacataaaatcacatttctgcaggaaaaacctattaccctaagccaagattattttattttaaaagaaaaattattgcagttgtggattctgaaagtaatatgatgtggttcagaccctggccttttagaggctaaccaggggcttttaatgcacagtgatatgttatgtaaaagagatatttgtgtaattaacaagtcttcttgtcttcacagaaatgcattaactggaagtagattctggatatcctatgactcctcagaatgactaactgaagaacacaaatatgatttatcccagttgtggaaaggctttagtctaacacataggcaaatgtgacaactaacacacacacacacacacacacacacacacacacac

SEQ ID NO: 51812 - DNA, 1737 bp, Bovine  19866880724372
atggtagcacagagaaggaatgcttaaatttgctctatgaaagtcaggaaaaatttatgtaagaaatagaagttaagtcgtacttgagtaataaatattgcttcagtgaatggatccactagctgtacaagtcagaagtcatcatccttgacccactgtcttcctcttgtctaatttttccttcagtatataataattctgtgtacttttctctagttaagttatccctgtccaagttcaacctactgtcttctcttactggactagagaaatagcctcttaatgagctgacctgcttccactctgcccattctctagttttctatctgcaaccaaaatgaacaagtataaataccatcacctcctcttcctgccttccacaatgttttttcatgtgtattcagataaggcaaaatgtcctcactagaatccacaatacctgggatgcttcagtgctcatcgatgtgtactcttcatttaaacattgcactcttctaacagctagctctgttctggaaaataaaagtacccctctttgtttctattcttctcaaatatgtcaagttctctcccactacaaagtctttgtaatatcatcctctctgcttggtatgatttcctttactcttcccattttagtcaagtggtctcttttttttttttttcatatctcagtttaagcatcactttctgagaagggatttaccttatggatccctccttactaccacctcagatggtaaagaatccatctgcagaatgagagacccggctagataccttggttgggaggatctcttgaagaagggaatggcaatccattacagtattcttgcctggagaatttcatggacagaggagcctggagggttaccagagtgactaacaattttctcaggagaaattcaccttatagacaccgccttactaccaccaccagtgaaagctagattgttttaccaaccattctcaaagatttatattccttttcttcaaaacatttatttttgtgttattacacttgtgaggttgtttaataaatatctttctccatcaggatatcaaatctcatctcacaagagcatgtttttactcactcttgaatctccagcagctagtagattacctgatcccaaatatatgccaaaacaataagtaaactaatagataagatgaattaatagatagacaggtggttgaatgactaaatgcacagataagttagcagatagataaaggacaagaaaagacatccaggcactgcatgaacaaaaacaggagaaaatagcagcttgcgcctttgctttgagtgagcatagagtgcatgggatgtgaaaagatgagtttgggggagcaagttgaagccagactgcaaaattgttgtttgccaagttaagaaactttcatttttcatcctatgggcatttgacagtcagaagaggctattgggaggacaaactataattatatttgattttttaattaagataaccctggcaggaggtgaaggggagacagtactaaatatagggggactatttagttacaaggcagctccagttatgcagaactggcattcaacccagagtgatggagggaagcaaaagtccagaatataaagtatatgggggacatttaggctgacatgtcggattacatgtgggatgagcgaaggtccaaagggtgagggtcaaatgaaggctagggtgtcattacaaaggactggaatagcaagtt

SEQ ID NO: 51813 - DNA, 1337 bp, Bovine  19866880779310
actaccaagaattatagaagtagtggcttaatcttcttcctatccaaagtcctctttcccaccatatcctcctcaggcagctagtctataagttctgctatactttctactcaatctacctaccttggccagaatcacctacttaagatagtttgtgattacttttaatgaaatcattttgcactgacaatacctaagcttctagaaacatgaatagggcaggaaagtgctagatcaagaaatcacatatttaaaaatatgtaataatattctttttttctgattactagtgaacttagggtatattataaactaaactaagtcatgttgcccctggattgtttttacaataaatttaatttaaaatcttctactttttatttccaattttaaatcttaggtgtattcagggatgtattcagtattgttcaataaacaattattaagccctactagtgtcagacactgtgctaaatgctgagtaacaaacatgacggaggcatgatactggctctttaggaggtcatgccctggtagagaacattaatgtgtaataaaacaagaatcacaaaagtccctatgctttagacatctactttgtgccaggcagagatatttttcatccatttaatcctcacaacatgtatgcaaaggatgtatttattttccatgtgtaacagatgagaaaactgagcttcagtgagctctagtcacttgtttcaggtgacagtaaatggtaaattatggtttaatatctgaattcacattacatgacctgtgttcttacaattatgacacattattctctgggatgagaaaatccacacttttagagcaatatgaaatgagttgatgtgctctcattaattagctctcattaatgtgctgtcattaattagaaataaaatttctacagagtatttttattgcattttgttgttttaagaggaaaaaacagaaattaatttgaattgcttcattttctagagaaactaagatgtgaaggtgaaatacttagcaagcatgtaagatttacagggaagtcatattcatccactacatttaattccgtggtatttgccactgttcaaaatgctttgtacctcctttctgaatccattttaggatttatttttattcctcttaaagagtttatttactgataaaaataatttttatcaaaaatgaaggcttgagcattttgtcagtagacctgattctagataaactttggataattgcagaaaccaaatgcccctttttttaaagaggacagttttccgcattgaaattcaaaacaatataaagaggttttgatggcaattccacagtcattt

SEQ ID NO: 51814 - DNA, 1808 bp, Bovine  19866880789372
atgttatgagtatgacatgaaataatccgagaaaacttttgtcagtagtacttgagatgaatattgaaagaggaagtatgaattaaagtgaaagaagtttgatttcctaaggctactagtacacagtcatatgagtagtaatgagatcaaaatgggtaatactagtttagaaagattttctagcactcaaagaaagatgggggggaggcaaggtaacagactcaaagagaacaaatttgttgctcattatgtttggggattgaaacaggaaatttgaaaatgacatttgaatattgtctggatttcagaaaaatcactggtttaacatattgcaaagatcacaaatggttcttgaatttttaaccagtgaactgtagatgaatccaggctacacacaagaaagggatttttttttaattttttattggaggataattgctttatcctattatggatattaggatatcctgcatcctaatattatgttagtaccatacatcaacaagaatcagccataggtatccatatgttccctccctcttgaatgtccctcccacctccaacaccatcccactcctctaggttgtcacagagtactgggttgagctccctgtgtcacaggtcaaactcccactggctatctattttacacatgtatatggaatctcccggcaatcttgattccagcttgtgcttcttccagcccagcgtctctcatgatgtactctgcatataagttaaatgagcagggtgacaatatacagccttgacatactccttttcctatttggaaccagggaggcctggcgtgatgcgattcatggggtcgcaaagagttggacacgactgagcgactgaactgaactaatacggaatctagaaagatggtactgaccaacttgtttgcagggcagcaaggaagacacagacttagagaacagactgtggacccagtgggagaatgagaggatgggaggaattgagagagtagcatggaagggaatttttgaacatagtttaaaaacaattcaccatggaagtattgaagcagatcaagatctgcttttgcatttatatatactatgaaaatcttttaaaaagtcaaagatgcaaaaagaatatccaagcacaatcactaatttctgttacaactgaaggaagctcaagaatgaacaacacacacataccacacaatagcatgatgagactttttcatcttgacaaatggtttgaatcaacaaaaattataaccaagccaaggatttacataagaataagtatggttctggcacaacaggcaacacttctttcaatcattttttttttttttttacaaacacacttaggttccttcttcatatacaaagacatgcactcagtttaacattgttacatatgtaggctagtccaagctctgtgattgtagatgtgtgaaacctggaagacagaaaaattcactaacataagtcatcttcaaaagaacagcagaagaaactctacaaataccaattgaacaaactctggcggttgtgaaatcatatccaggaaagcaacaggctgttagttaagttttggcaagtagaagtgaggtatctgttttgatcaaagcttccgtgatacctgagaaacaaactgacagacttacaaacaaaagactctacaagcagcaacaaaacaccgaggtctaaggaagcacacagtcattcaaggattgattgctgaagcctacggttgccgaatctctctttctgggattaatgcccataaagatagcaacaccgtcatcagtgtcatcttcaaacaaaaga

SEQ ID NO: 51815 - DNA, 1195 bp, Bovine  19866880828463
agctttttaacaactttaaactattgtcataatgatgtggccatgcccttgggcttcaatctgatacagccaccacactctatggttagagcctcttagaatggtcctgaaatgcttcttagagttccaatctgaaaacttctgagaagaaatttgttatttaatatatttctttcatctagcatcagatatttataaataattggagttaggaaaataagcatcagcaccaatataatagcaggcattttatttttttaataaatattctcttaaatccacaccttgagaattgcctaacttagtgagattacatggctttgatatagagtgttataaaatataattgcattaacataatatcactaaactattcccttaatcactaggttaagggaaatagtaaaaaagaagtgtagaaagaagataacttgagaagactataaagaaaacaaggggggaaaatgtagataaatagtactgaaaccaagaagaaaggaatgggaaaaaaaaaaagaaaattatcatatggtaaagattgcagattactatagcactctgctgagctgaaatacagcattataacaccaagatgttagtggactgcagttgtatgattccatttttttaaaaaggtcaaaatcattatgtgagtttcaaaatatgggatataacttgtaggttgtgggtcattttggctgggtgaagggggtctaaccttatcagagactgaaatagcaaaggttataaagcatacaatttcataaaataaattaaaatgtcattgctattttggggattcactgttagattattgttacttttataagtcagtgttggcctctgaatcttctcctatatgactggaagcaaatctataaagtcttggttgattttgttaaagcgtttttggtggtaaagaatgatgttaatgacaaaaattatatttttcataaaatattgggttaacaaaaatactgttacacttcctataaaatagcagatagttttcttaacatcagatttgtgggtgctttcaatctcaattctatgtatgaatcttcacagagtcctaacagtttagcagtgctaataagagttgaacaactacacgaggctcatcaggtcaagcgcttactccccttaatgcagccttaaacaaagttatcattatcatttccagtaagtgacaaac

SEQ ID NO: 51816 - DNA, 1146 bp, Bovine  19866880849953
aactcctgtctctacctgtcatttcagcatttgcatcaaaactttgaaactcgggtgtgcacaagcaggatatattccaacagagctctccaattttcagggacttcattccctttagacttcagaattgttctaaagtgtctgtaaatgttgtcacaaaatctaaggaaaactataaacattaagaagttcatgtgcattatactgactgaaagaaatgacaacatccaattattatctccacaatatcagtaatgaatagaatgaaaactaaaccagcatcatcctcattttctcatgctctgctaggcacacacagaaaccctgctgctatgctttgtctctttccccaccccttcattttctccgcctgtgatagacatatctttatggattaacaagtacgaagatcatgtcatttcctgacataaatgataatatacctttgctcctagatatgtttagacaaaaaataaataccaccccccgccccccaacccccgaaaagcctcagattgagttgttggctaaacagagcttcttaattaaaatatcacagtgaaatgttttctggtgatgtgaaagcttaaaggcagtgcttcacttgcaaaagatgagggaaagagattgcaaaccccttccagccctgcaactttttaaatagattcactacaatgtgaccagttagccttaatgtaactgatagtgaaaacttggcctctgtgcactggtgccaaatccaatctcatgccaagttgagtcagtcatgtccagctccttgcgaacccatggactgtggtccaccaggctcctttgtccatggggattctccaggcaggaatactagagtaggttgctatgccctcctccaggggatcttccccacccagggactgaaggcacatctcctgcagctcctggactgcagacagattctttacctctgagccactggggaagccaaactcagagacaaagatttgggtgaggtaggaaagaataacttctttactttcctagacaaaaaggaaaatatcaggctcatgcctcagaaactttgtgttccaactagggaggatttcagatcagatcagtcgctcagtcgtgtccgactctttgcgaccccatgaatcgaagcacgccagg

SEQ ID NO: 51817 - DNA, 1355 bp, Bovine  19866880888554
ctacttctgctttattgactacactaaagccttttactgtgtgaatcacagcaaactgtggaaaattcttcaagagatgggaataccagacatcttacctgcctcctgtgaaacctatgtgcaggtcaaaaagcaacagttagaactagacatgggacaacaaactggttcaaattgggaaaggagtacatcaaggctatatactgttaccctgctttcttaatttatatgccgagtgcatcataagaaatgctggactggatgaagcaaagctggaatcaagattgccagaactaccaacaacctcagatatgcagatgacaccacctttatggcagaaagcaaaaaggaactaaagagcctctttatgaaagtgaaagaggagggtgaaaaaactggcttaaatctcaacattcaaaaactaagatcctggcatctggtcccatcacttcatggcaaatagatggggaaacaatggaaacagtgacagactttattttcttgggctccaaaatcactgcagatggtgactgcagccatgaaatttaaagatgcttgctccttggaagaaaagctgtgaccaacctgctgctgctgctgctgctgctaagttgcttcagtcgtgtctgactctgtgcgaccccagagacggcagcccaccgtccctgtgattctccaggcaagaacactgggagtgggttgccatttccttctccaatgcatgaaagtgaaaagtgaaagtgaattcgctcagttgtgtctgactcttcgcgaccccatggactgcagcccaccaggctcaacttgaaaactaggcctcatcaatggaatgcagagcactgacaaagcaaagcagctgttcgtggtgaattgaaacagataaagaagcaaagatgaacatagattattctttcacaaatcttggttgtaatgggaagaatgagcacgctttacctaagtgtttgaatgatgatgaaacaggatcactgtttcattcctaactctctgtatagattcaagggtgcaattaccattttttacttccgctgctgaaattgttgccattttcattttacattacttattagaacatgggagtagtgtccaagcagatggttgtcagtaaactgatgactacagttatggattagtgtccaaatacaattctcaaaacttggtacactgtgtagtttcctgaatgtgactgccaaaataaatctggcctgcaaaataattttgaggactttcccctctcaaatttttttcagtattttaagctaaagatagcctttaaaagctgagactttgcacatatagacaaaccacttatcgcgtttgggaactttcttgatgag

SEQ ID NO: 51818 - DNA, 949 bp, Bovine  19866880915677
acccagggatcgaacccggttctcctgcattgcaggcagatgctttaccatctgagccaccagggaagcccttcagagtccttatagttatatcttaaattatttgagtattgttttataagaaatcagacctttggaaagacatccatgtatcacatccatgatacatccatatgtatcacacctagctaaattcaactcacaatatgagcttcaactgtcaattgtgaatacatttattcattatcaatcaatttgccaaagtgccagttcataaaaatcatagaaattggtattttcttggggctgcataaagcttcaaattatatttggcaatggctcattctagaggaaaactttagtaatgttctattattgccacatattcctgtgcccatgttagaaacacctcagtatctttccctttctgccaccacctcatacctacttcctccagaattaaaacactctaggccatgttataaagacctttgctgtatctcactaagacttctttcctatgtggccactaagttttcctgaaaacacaccttccttagagtctccatataaacttctcaagggaagtctacttggcaggaataaggaaacaaacaaaactgtataataaggcaaaggaggccagaggaacactgttctgtctcaacagcagttggcatttctgtgaatcgtccatctcactgagtttataaaccatgttgaataccagacttcctgctggtcctaaagaaataattattactgagaataataatgagactttatcaacactattaagatgtatttggttaagcagttaaattgactttggagatgaaaggaggaaaaaagaattaaagtgtctgacacttttaaaagcaaataacaagaagcacaaaggtaaacttttgactgtcagggaaagaagtttcctaggaatcatctctgt

SEQ ID NO: 51819 - DNA, 764 bp, Bovine  19866880919716
taaacttgtaactgaaaaacatactgtggtaacatggaatgtaccaaaaaaattaaaaaacaataacaacaaataattattcctttcttatatactcaccttcatagacctcttatccctttccatgttataacaaacatacagtgaagctgactgcaagtgaagtgttagttgctcagttgtgtctgactcttggcaaccccatggactgtacatgatcctgccaggcaactagagtggatagccaatctcttctccagaggatcttcccaacacagggataaaacccaggtctcctgcattgcaggcaaattctttactgtctgagccatgagggataaactgaagccatgacttttcaatataaaatcaatcccaatggtttctaaactacgtgttagaaaagaattctccaaagtggaccaagagtctatgataatattgagtaatttttctcagataagtacatcatgcccctatctactcagcatttggtatatataaatttatcttatttgacccttctatcatctaattttttagaatatgtaatttatgatataaactatttggataaacctgtgaaaatgacagctgatcctgttttaagaaacgtgtcactctgtctcacaagaagtcatgcaatactgagacctaatgatggttttacaaccgttttccagcatatttttacattgcatgcattttcacttccagccatgaacccagtacttaacaagacataaaattaataattcagctga

SEQ ID NO: 51820 - DNA, 770 bp, Bovine  19866880944573
ctgttctattttcttttgcagacttttgcaacggaacttttcaagaagatgctgggagaaaatcagaaatagataaaagtctaggaagcaatttttcaaattagctccccctctccctttaatttcaagaagaggtgcagttcttagaagtgttccttctttgacagatcattcagaggcagagacatgggaatcctaggcatcaacaaggtcactgccaagttcattccagtctcctggagtactacaggctgagagcaaaagaatgaaggcccagaaacagtttatgagataagctgccaggactaaagtcagggtcagggcttctggaaacttaaaagcagacacatatcaccagaagtatcaccattagcacagctcactgatgttctcatattggtctccttatgtctggacacattttttctcttgagcacaaggaacaagttgcacattccagcagcttcctgtagccagatttgcctgatttatacagacaccgtttacagaatccctgtcaccttttcagtctcctggcttctagctttgacacccatcttcccctggctctccctgcttcacactcaacaaatcccttatattccagacatcacaataaaaatcatggacattataaatccattttcagtaacacctggtataagaccttccttattgcaaaaagtgtgcaactttccccaagttccttgaaatctattgtatacctggcctcagctctccttataccaagagttttagatatcctccat

SEQ ID NO: 51821 - DNA, 1153 bp, Bovine  19866880947851
ctgtgaatggtctagtcgtggcctggagtaatcggaaaggttaaatttgtttttgatttactctgtcttagcaagacccaacatttatgataaaattttaaaggtgttcgttcaatgaagattacttcaacctcatcattgataatgaggctttatttcttaaagcaatacacctttttccttgtttatgccagataaatcaagtattaatttaatctaaaaaagagaatgaattctgaatgagaaaggggaggtttagaaattcgagtttcaggggtataataacttttgatttatattcaaactttgtgtggaaatgtaaaatttatccttgtcctgggaaatgaagtaaagtgcaatttgggagtaattctgactaaaagtctgagtttataaactccaagtgctgcaaaactgacagaatctgtgagttaatatttatcctgtaccttgctaccttctgatgacaagtaccacacaaatatcaagcacaatgaactctgtggaattttcagttctgagtttgctaacagcaaactgctcagaagcttattataaaaagtgttccttttgtagtaacaatagcactggcttatgctgatgtttgaattcattagtaaaatcacttttcttacctgtcatctttctcagagtcttcctgagttttaatatgatcaatgaaatggactattgtttggtctaaagtattctggcagaaacttatgtctgagtaaccagagtgaaaagtatacttgaagtcctatcaggtgaattctttacagagagtatataccatctaatattgttacacaaaactcaaggttttgccttgacagtggggcctgactccagtggcacctgccccttggaggtgggtctctaaagcatgcagtctacctttatctgtcttccgtgggcagggaaagccagctctaaatggtcttcactagctggggctattgggagtatggtgttatctactttttttttggtttgttttgtttaactggaagataatccactgttttgaaggcaagatactgcacagaaaagctttcttacttctggaacttctggaacccttgcattaagttatggtctattatatatatttagaaatctaacattttaatgatcacaaatctacagagta

SEQ ID NO: 51822 - DNA, 1705 bp, Bovine  19866880987527
tagaattcatatttcaagacacgtttttgggttatgctggcctaatggaataaatacaacttggtttttaggcacgctgctgctactgctaagttgcttcagtcgtgtccgactctgtgtgaccccatggactgcagcttaccaggtcctccatccatgggatttttccaggcaagaggactggagtgggttgccattgccttctttagtcatgattctggtataaaataatagtaagacttttattgtcactccatattttgttcctgtctcgtactttttaaattctctagtctctagattccaagtctagagattctctttggagagtttttcatttttactcatatcagtcttaaagttatttccagaattctttgtgttctttcatagttaaaataattcttcagatttttccactgattcatcaaacatttccatcttattttgcataaagtgtactatatttttggaagtatataaatatactagttacatggagtaagttagtaagcagtatttctttggtcaatttgttgttttctattaaaaaagagaaaatggtgaaacaacccagacaagagatacaattatatgacttttgtcatttcactgtctctagcagagaaaagtgttcattttgttgctttttattttctgtagaggtattattaggcctttgcctcaaaggtgtaatatctgaataataagatctcctttgacttatatctgacctctgcatcctactcattttttactgagagtcagctaactaggctgccagatattgtgtctcttaggaaatttttccccatcctgcagtaaactttcataaggaaaaggcaaataaaatcaaattttcttgtggaatgcttaatacaagtaacatattatagcacttttcccccagaaatttatcagttattgatataaacatattatcctgtcttgatttaaactgttaattgttctcaatagttctatttcttgttgttcagttgctcaattgtgtctgactctgtgcaaccccatggactgcagcacaccaggcttccctgtccttcaccatctcctgaagcttgctcaaactcacgttcattgattcgatgacgccatccaaccatctcatcctctgttgtcctcttctcctgccttcaatctttcccagaatcaagaatcttttccagtgagccagctcttcacatcaggtggccaaaagtatcggagcttcagtgtcagcaacagtccttccagtgaaatgtcagaactgatttcctttaggattgactggtttgatctcctcacagttcaagggactctctagagtcttctccaaaaccacagttcaaaggcaacaattgtttggtcttcagcctttttattgtctagctctcacatccataagtggactggaaaaaccatagctctgactatacggatctttgtaggcaaagtcatgtctctgccttttaatacgctgtctaggtttgtcattgctttatttagtttaggctaactagtttaggctgaaatcattttgaccagacttctttaaagcagaaagagggaatactttcttatcctaaaaagaactacttctcacatagctttaattttttgtcttcaaatgtgaatgatcaaagtaattagtgatcttaaatgcttcagtagttcatcatggatattaaaaagcaataggtcagaa

SEQ ID NO: 51823 - DNA, 666 bp, Bovine  19866881009460
ttttatgaaaaaatagcctgtgatattattgtgtctaataatgagggatttttatcagctttggaagagaccagaaactgatgggtaatgggtagagcacccttaacacagccctgtgagcacagaattaatcatctaccactcacaactcttagccacttccacaactcactctgacaaatattaccacaaaaccacatgctcctccaattgcttgacagaaactcagcttgaaaaagtttccttcagtgtagattttcataatgtttccagctagtgatagaagtaaatgctgtcatagtctgggtgggcttggcactcaaagtctttgatgcaagaaaatgaaggtgtgattggatggccatgccccaggtctctggtgagtgcctgggacaggccaccaagtaagggtccatagttttctgcagggaagaattcaagagtgagacagtaaagtgaaagcgttagttagagagagacacactccatagacagtatgtgggatatctcagaagacaagaggtaggccccaaacatggggtggttaatttggggggctgggtaatctcataggctaagaagtgggaggaatagtctaactatcttggagaaggggtgggggatttctaggaattgggacaccacccactttttggccttttatgg

SEQ ID NO: 51824 - DNA, 711 bp, Bovine  19866881010160
atgatttcctggaaatagctgtacttttttttttttatgatttgtgtgtgtgtgtgtgtgcgccacttttaagctattgctttcagtttacttcaatgcagtcactgaagtagcttagaaagaaatctttgatatgccagatcaaccaaaaattttaaaatatccttttgtgcctccatttataatgcaaatagtaagttggcattttgggttcatttcaccatcgtctctgaagtgggttaacatacacagagttaggaagtgaagggagtcccacaagagagcacatctttgatagttcaataatagtaaaaaaaaatgtatttaggtcttttctaaataccttttacttcctaagatataaaaaacgagaggaagagatctaagaagaataaattgtggttgccctctatgttagctgaatgactaaagatattgttctatgaattacccactacttaaatattcctaagtctcgcctttatgagctcataaaaaagactttgcttatgtgtctaggaaagccagtatctttatatactgtcagaatagaactaacatactgtttcaatataagtttgaaaaccagcaaatattttgttatataaagcaagctgggcaatcaccttaaacccatgtttacattttagttttatcatatataaacattccctcgctgaaatagtttaaaaaagtaggaaccgatatttg

SEQ ID NO: 51825 - DNA, 832 bp, Bovine  19866881016444
atgttgttaaggtcatttaaaaaatccttcaaatttaaattccatttagaatagcatgttagtagatgcaaaataaattacatgagaatactgaacaaatatgaaattcaaaagacagatatttcaaaactttttggaaagcacttgaagggaagaaagaagggaagtcggtaggagaaaggttgattcaaatatttcccccctttggggaaacagctgcaccaccaatgttctctcctcattccagaatcgtgtacttatttcagagtatggaaccacttgtagaattttttccctatgcttaacagtttaagcaagtagattataaccctcactaggtcatcccgtattctttgtttattttataattttctctaagcaccttaaatattgattaatctttctattccattcggagacaactaaactaaattaatacaagttataatcttactctggctaatcatcagaccttaaatctctaatatatttaaacatttctaagctattttctatataacaagacctcttcagatcttttatgcgtaagagtggtatgaataaatagattaaattataactacattatgaaatttcattttcacacagtcttatgaatgggataaagcagatttattattttcagttatagacgataaatctgaaggcacatagaggttaacacacttgcctgagtttcttcagtttattagtggaaagatgagtctagaacccaggtactgtaatacctattcacactttactcccttgatgatggcctgcttaatactctgttttacactctagtcttggggacaccataaaacagaaa

SEQ ID NO: 51826 - DNA, 1057 bp, Bovine  19866881038104
tttcactattcagtgatagagaactgaagaattattcttaacagacctgattcacagtgtaatttctttgttttttctttttatgagtgcaggattgccgataaaaatgcagccaagcaacaggcattttggagtctgttcaggtgtggcacctgtgtgaatgtgtgaactcacagtccggagtcagagacctgcattgcaggatgtgtttagaccatggcagacaaatatatctcagatacattagggagttgatcatatatactatgagttgtgagccagaaaatctggcttctggtcaagtatttaccattacctctacgttctccattagtctctaaaacttgtgtgctacaatttttataattaaaaaagggttgcagtctatggtttctcaagctccttaattctttaatagctatatgatgatactgaatgttatatgtcttcacagtaaatgctaataaaaggagaagataaactatgaaataggggagaagaggcaagaagcaactacttttttattgaaaaaaacatattacatattatgcataatgatagaaaggggaataaaggaaataatagaccaattacttttcttagtgagcaaatgtttgcagtttttaagtttatttctaagttacaggccttccttcataagctttatgtatgacatgaaactcctaacaaatacagtttgcctttcttttgttattatttttataagatcaagaatatttattattaatattaatacattagtggacatttttattcaaaggtttaaaaagtacactaaagtattatctgagctagattcattttaggagaaatcataaacacagagaaaccataatcctggtgtaatgtaggaatctaattaagactaatgaggcaacattaaatttaatgtatgatgcattttatatgtctcaccattagagctgcagcaagctgttcatcagagtcgatctttggtgactagccccctacaggcatccttcagaaacctaggtttaggctggcattgctgcaaagaagtcaacacaaaagcaac

SEQ ID NO: 51827 - DNA, 2645 bp, Bovine  19866881114934
ttcgtgatcctttactgatggtcctaaaatcaacccagaagtccaaaaagtagtgctttctctttggagtcaaccagacaagtttcatcacagtgacagaatcgaagcccttcctgatctgtgtatatggaaagaactaaattcaccaaatttcactgaaatacttgacaatcagtttgaaaggatactcccccaagagcctttttactcatattgaaacactaaatttctatgacagtgatactggtgtcaaaatatcatgaaacacaggtaaaagtattgagtgtgatacgtgtttgtacagtatttctactttccatatatcacttcatattaataggcaaggtcgaaagggactgctgttggttctccatattcaagagagaaattgagaactgaaattgctaaatacccttttatatttcacccagtaaatgacagtggaactgagagaaacaagactggcctttcagattaatgcattccaaacttcctctcatgaaatgggctgtagtccatcacacttaacctacactttccacacctccaggaggagatatccacagatatacctatttactttggcgtgaactcaaagaaattagtttgcaaatctggtcttttctttgtgcattaactaatttctcctttccacacatacacttcaagaacatcaggtagatccatttacttccactccttcatcccactgctcctcctaaagtgacatattaattatggctcatttgaaattttctcttacaaatgtaggctcagatttcaacacctaaacaaattatatatacagcgtgcaagcctgtttgttccaggtttcttaaaaggagaaaatgaatgcagtgtattaatcatcaaactgatgtccctgattgaaaaataaattatttaaatgagtaacactttgggttttttttttaatatactactttctagaaaatctcctcaacatgtaaggtgaaaagaatgaaaaaaatcactactaccacagtggatacatgaacaaaattaaagccatgaataggctacatgatcatgctcagtccaaaatgttgggcattattgccattggttctgtagttaataatcaacttttatggatggtactccaaattagttttaagaagttctaaaaattcagcttgactactacagatttaaatgaattttattcttttcagagcacaaaaaacaaaggcaacccctaatgtagatttattaaaaaacaaaaatgcttatgtttctaaatacatggagtagggaagacattccttttctctcaatgtaatggcaatgaatgtggatcatctaaaacaaagcaacaagcttaaatggaaggcaacccacttaatgattttaagatatatatttgagatataactcaaatgccattctattcatggggaacacatgtatacctgtggcggattcattttgatatttggcaaaactaatacaattttgtaaagtttaaaaaaataaaataaaataaaaaataaataaagtaaacaattgattggtttttagtgtatttacaaatatgtgcaacctcatcacaactttagaacatttccatcacctcacaaagaaacctcattctctttaggtaccattactaactcctccctccctctggctccaagtgaattactactttctgtctctatagattagcctattctgcatatttcataaaaatgagagtatatgcagtctttgtgattgatgtctctcacctagtataatatttttcaaggctacttggaagcatgtatcagtactttatagattcatttttatggttgaataatattccacagcagagttatatcatatgtgtttatccatccagcagctgttaaatgtttgaactgtttctaccttttggctattataaataatggtatcataaatattaatgtacacctttttctgtggacatatgctttcacttcttgtaattagaaatattgggtaatatgtaactctatatttaactatttaaggaacttccagacagttttccaaagtagctgtaccaatttatattgccatgaagagtgcatgagcattccaatttctgcacattttcaccaacaattattatctggctttttgattatagccattctagtgagtgtgaagtggtagttcattgtggttttgattcgtttctctgatgacttaagataccaagcatttttgtatgtttattggctatttgcatatttctttggagaatgtctatttggctcctttgacaatttttcagttgaggtctttttcttattgagttgtaagagtcttatatattccagattgttgttgctgttcagtctctaagtcatgtccaactctttggaacccatggactgcaacacgccaggttcccctgtccttcactgtctcccagagtttgctcaaattcatgttcattgagttggtaatgccatctaaccatttcatcctcttgcaccttttgcttttaatctttcccagcatcagggtcttttccaatgagtcaattcttcgcatcaggtggccaaagtattggagcttcagcttcagcatcattcctttcaatgaatattcagagttgatttcctttaggattgactgggtttgatctc

SEQ ID NO: 51828 - DNA, 689 bp, Bovine  19866881118363
taatactgaagaagctgaaactgagtggttctatgaagacctacaagacctagaattaacacccaaaaaagatttcattataggggactggaatgcaaaagtaggaagtcaagagatacctggagtaacaggcacatttggccttggagtacaaaatgaagcagggaaaaggctaacagagttttgccaagagatcacactggttatagcaaacaccctcttccagcaacacaagagaagactctacacaggaacgttgccaatgtctattatatagtttaagttctcaggactactatgcagaattactttcttctgtataccctgatggcatgataaaatcgcatattcaaaactggcaagtcaattttgctaaggaaatttcaaaactaaactttttgataagttttttctctatcaacctcatacatttattgagcttcagttttggtaatatcagaatctattgattcacaagataaatattgatctgacctcaccttcacctcagtttatatttacttctgaagtcaataaatctagaaactgatctgacagcagtcaatattagtttaaaattcttaaaatagcagctttactgtaaggtaataattcagcattttatagattctgcctcaaagaaataaaaaggcaatgtaacttacaaatttcctagataaaactatttt

SEQ ID NO: 51829 - DNA, 1838 bp, Bovine  19866881129614
tcccttaggaaaaaagattgaagatttatagaaggaagtattttattacttttaaaactgcagttttaaagaaaatcaaagaaaaagaaggaaaattatatcaaactataaatgcctttttatgactaacagttttgtaacactgaaatttatgaaaggagaagggaataaagcagaacatagaaagatttttcaatgagctcacagaaattgcaactcctatatcacaaattgcaaactcctaaaaaattaaacctgttgatgtgactacaaactgaatggtgttaaattcattagatgcttgaggatattatggatttctcctggaaaactttttgggttttttttttgcttaaactctcaagctacttgttccaatttttgacaagttaggattctaaacctttacaacaccaatgacaacaaaattctgtgttcatttaatttctttctcaaactttcagtgatttgttaatgttgaacaggtaactgacaacataattaattcctaatattccactgtcataaaacagagtttcctaaagagtaaaactagagtgtagagtaaaggaagtctctacatacacacaaatttctgacatgttgttgaaaggaagaaaagtgaattgattttcccccagatagtctctttttatgttcatccctagcatttatgtagcataatattaatgacaatcttataaataagatgcaaactataatgacttattaataaccactttttgtaacacttctaactactgaaaaatatcaaagtattacctttattaagatgttcttctacaggaaaaatttgttgctacatttttattacaataacatcatacacaattcttcagattgcaagtcatatagtaataatatttaatatcaaagatgatggatcccagaatggaattccagttcctctaattcctgagtctaccctctaagttttactcaaataactcaagtaattaaactttcttcccagtattttcgaacatttaataagtgaactactaaagttatccagtggagaaggaaatggtgaaccactccagtattcttgcctgaaaaaccccatagacatcattgcctgcaggctcacagtgcatggatagcaagagtcaggcacaatttagtgactaaacaacaacaacaatatcatctggaataatttcagtgatctggacctcagtaccacaatttagcaatgccagatattagaaagtttatttcaattatcttcaaccaaatttcacttctacacattatatcctcttgttctgtcttgtctttacctttttttgttgtcgtcttctgattttcttctccagtacattacactcgcattgtactattatggcttttgtaaagcatctaatttcacactgaacatcctcaactgtagtgcagtccttggaaggatatgttgccaagtcctctcactacctgttttcgtttccttaggtccactgttcttcaatgtccctctttaaaagggtgcctcaattgggcacaaccctccataaggaggtaatcaccaagaatggtaagcctcctgattttcagctccaatctttttcacctcaaagctctcacattatctgaaaagccatggcaattagattatgggattagctagaagatgtatcatttgccagacagtatcaaatagtattcctcaaagggctcctcttttttttctttttggattattattcagccaaagtgtattcagtaatagttttggataggaaagaaatgtatgagggaaattctcagagccaagcgtgagaaagaaaggaggctcttcgtgatcctttactgatggt

SEQ ID NO: 51830 - DNA, 1203 bp, Bovine  19866881136270
ccttttgagctaattcctagagataaaaaatgttttaagagttagaaaaaaagggagaaaagcaaaaactgcagtatgctaagtcacttcagtcgtgtctgattctgtgtgaccccatagacggcagcccaccaggctcccccatccctgggattctccaggcaagaacactggagtgggttgcaatttccttctccaatgcatgaaagtgaaaagtgaaagtgaagtctctcagtcgtatccgaccctcagggaccccatggactgcagccttccaggctcctccatccatgggattttccaggcaagagtactggagtgggggtgccattgccttctccgaaaactgcagtagccatgaaaaactggttaagaagccttgcatcataaaaagaagagataaaatgaataaagacagtctatataaaaggatataaaatatacttgcctattgaaatttcagtgtccttttcaacacaatatgggatttaatgttgaattaagttacaaaacatacctggagcagaaggaagcactagcaatgctttatttctttgataggagttaaaaaatcaaatttctgtactgatcaagcaggaaatatattacagtgtgggtgaaacagactgggttagaggtggaaggcagccagtaaagggcacccttcccatagaaacaggcagcctctccccaggacaagctgactagtgccttgagaggaagagaactcaatctaagatcattctgttcatcaaaggaagctgaaaatctggcttttaattaatatttcccaaaatgttaaagagacttatagtcaaactatacacctttcacacttgggacaggtctaccaatcctgctctggggttttcaatagtccatgtcaaagagaagccagaatctttcattctaagaatcctgaagataagactattcatgcttccagaagctcctacattacacttgaattccttctgtaagatggtattccctctttccatgaagccaattctgagaactattttagaaaaggccactccattttggaaagcgctgaagcttggtatatttcttacacaagatttccaatccctgacaaataattcaatggtgcataatgaaaacagtgctctgatggggcctgtgcttctacaattagacattagtggccatatcaggaagagaaatacctaagatggcaca

SEQ ID NO: 51831 - DNA, 1569 bp, Bovine  19866881137672
tacaattgctatgtgtgcgtttaagccttcctttcatgtagcaatccattcaacaagtaatccattcaaaaagtaaaattgggaccacatccagaaataagggactcagtactatggcttctttgacttcttggtgcattttattatttgaagtaaacacttaatgtgtgccatccactaacctatactgttagatatcacttaatgtggagaaggatttgctttcagcagtcactttgtagttattcagcctcgattcagtttactcctatttctcttgccagttatatgagtttgggtgaatcacttaatttgattgtcagtttcctcaactgcaaaatgggtgggacaatggcacctcctagggctgctatgttgattgaatatgacattcattgtaacatcctgggcatattacagcatagagtattcatcaaaatttagctatcctaggagtatcatgtctatatatcttatttcatgtattcaaaataatgcagatgggcattaaaaactgcaaagcttcttacaagtgtgggtggtcatttttaatagtatctggaatggggactatttctaatacctcattaaattcacaggtctaggggaaaacctgtgtagttggtaggtgatcaataaaggtttgctgttgcatatgataatatgtcaatgagacaccatacaggccccatttagtgctgaacaaactgagtccttaaggtgtgggtcagccagtaaagtgctcaatcacacccttggcaagtgtgcactagcatctcatagagtttgttttcctttgtttatttcttcacagccttttatatgccaataacatcctactctgccactaaagacttttgattcccagcaaagagtttgattcttttccaaaggacaaacacacgcagggttcttttcatggtttggaacacatgctggatattatagcaagttgcaagggttaggcccagatggatgggagggtcatgcactgagttgattcacctctgttaagaagaactgtggagtatgctgggatactaaagacatcattctgtagactcttgttgcatgctgattttagaggtggcagccatggagatgcacagcttagagcttcaaaagagcccattgcctggagcagagctgactggaagtcctagctgtccttccatgagaatgctgaggccatgctcctctggctgctcccacaaaggctggtatggccagtgttgactgatttcctaagactcaagacatcttcctttgacttggctgaaagttcctcagaactgtcctgtggtctgagggccttactactgaaacccttcctttcctctctttcacaggtattagaccagacttgtgatctgaaatctcttcccatctactcctgttcccttcccttttattcacaagaaaagtttaactcctcctccatcaaattttgcatgtcacatcctgtcctagctttctaggaacagtgacatagttggtgatatgctaccgtattggaaatacagccccattctgtatgagtgccatactggcccagtagaagctttccta

SEQ ID NO: 51832 - DNA, 945 bp, Bovine  19866881146245
attgggaggaactgcaccaaaacatttctgtggctatttttgagtggtaagaggtgttttgttttgttttttaatattactttttcagttaaatgtactaatattcattactactttaacaaaatgattatttatattttaaaaaataagctttgtaatatgatccaaagaaagaaaaatatgatgaaagaatgcattccatttaattaaatctaaaattaatacactgtgactttttaatcaaagtttatcattctcttacaccaactgaagaaagtaaacatccttctttatatactcttctttctcatagaagccaaactccagtttttgacctggaattcatagtctattcacctgaacataatgaaaaaggacaatttggacttaagaacaacaaaaaatcaatttgcctatatcagcaaggaaatggttgctgtatagttttacttcgaagattttgaaatgtattagtaatgcagagcttaaattgatatagaccgggacagataacaaattcaactcttctcttccttggaattcacaaagctttaatacagataataaaagtaaaaataacacagaatattttccctaagcataagcatgatagtgcatgaatgtatgctcagtagagtctgactctgcaaacccattggctgtagcccgccaggctcctgtgtccatggaattttccaggcaagaatactggagtggttgccatttcccactcaagatcttccggatgcagggatctaatcagagtcttttgcatctcctgcattggcgggtgaatttttaccaccactgtgccacctgagaatccctaagcaaaatagtacaacccttttattcaattattgctggtatcttgctgctactgctaagtcgcttcagtcgtgtccaactctgtgagacccatagacggcagcccgccaggcttcc

SEQ ID NO: 51833 - DNA, 808 bp, Bovine  19866881159829
tgtttacttaatatttgttatcttgacaaaataatattatgtattaatattaatgtaattttagttaattaagaatgataaaatttatagttttatttaagaattataatataatatagttgaatagaattagagtggtcctgaattatttaaaaatacaaacaggatataagaaagccaatttctcagttaagtttctaccctacgaaacacgcgtcttcacatagtcttgcgtgtcttaaattttttgtaggcttagaatatcacaagcaaagagcttgcaatgatttgctcaaggcctattctggtgacgttaagaaatgggagagagagattttccttagcttacctattccccatatcttatcttctcaaggctgggctctatgtctgccaaggttacaactggctgatcagaatgagttaccatgttgatataaaggacagtcctcaaggcctttcttttctttcagggtaaagtacagtttaatggtgacctccaaaagatgaagatcttggttttctttttctaacctaaatatactaggtcttaagaattttagaatgtgtaagagcaaaccactggagaatgtattttgggtgtgtgactacttttgttagccctgagtcatagcagaggcagtcacatctactaatcacattggggtgagcctgtggttttccctctgatgatatcagagcatttactattgcttggaaacacatcctaattcctacagaaactggagtttttgataactggatcaaaagacatgtgtgatttctgcaaaatgtctagtcctctatt

SEQ ID NO: 51834 - DNA, 1018 bp, Bovine  19866881204182
gaaaaggtttctttcccttacatttatatattgataattatatattagcacatattgctaatactgaaagacctaataataggaagtgggggtacacaggtgcaggagcagaaggaagagggaagaaggtccagaaaagaaaaaaataagcatctttcacaagatcaacagcagaggctgtgaatcataaatgacactgaatggactttaatttctaaggctattctttgatgtgaagaaaaataattacaagctgaaagatactggcaagtattacactcaatataaagataaatacattagccataaataaatctttatataaaagctcacactcagggcgggctagcaaccagcaaccatacattgtgtcagctacagccggccactaaacaaagggaatgaaagtttgctagtaatgttaaaatcttgtaaaatatttcatagttgcctcatgctttttttcctctttactgtacttaaagggggcatgtgagaggtagcgatagttccaaaggtccaggccagaagtgacaaaaattaaactctaagatctgttcttaaaatattggatgtactttactaatttgatttacctaaatttcatcttttacttacactagagttcagagatataaaaaaatgaaagcagacatttattctttcagcccgactataagcttttaccagcagtttcagacatactgtatttatctattctcttagcctaagaaacaaacaaaatatgaaacataattatatcatttatttactgggctgaacaagtacaatttttctataatactcatgacaaggaaagtagatgctatttatttaaacaaagcattaagaacagaagcaattctttaaaaattcatttgtcacttatttatggatattacttgatagataaatatttcagtaattccactataaaggggatgtttcttgcttcttctgagttgtaagtggcagtggagatactgaaggaaaatactaaacagattacaattccagg

SEQ ID NO: 51835 - DNA, 1225 bp, Bovine  19866881206652
ataaatgaacagaaatattaatattgaattaataggaatgatcgagtgaattaaacacagcgggccaaattctgcccctggatatgcatgtacaatttccattgacttcaatgggagttttgttgtgtgtatccaagggcagaatccagcttaatgaattttttttaaccgtttttaaatggtgaatgaaagcacccgagatgattctgtaaatatcgcatatatttctgttttttttcccccatatgcttgaaatcttatgattcaccacaaatgtcaaattttaaagttggagaaaaaaatatagggaataaaatcattgctgttacatcttcttcgtaaaaggctaacacatacatattgctgcaggcttctatttctgtatattaaattataatactttcatgtattaataaaccactgaaagaaatccgaaaaaaataatttattctaattcatgcctttaaaacatatgatttagttagaaagttactacgtcatgtcatgccataagcgttattgaattttaaacaaggttttacatattcattttctctatgttatagttaaaaatctatgtgtttttcttaatctgaggaagtagctggaataggactcagtaagaaggccattgcctttgttacttcttttgtagaattcggaaatttgactaaatcaatgagtctcgtaccttacaaaaagtttttttttttcccccaaagaaaacaacctttctttcaaaaaaaaaaaaaaaaaaacttttacatggaaccatattatataaaatagagacaagtatagagcctgttagctaaaggaacgaccagagaccctgcagctgtgatttctctgttcttccactctgcagtgacccctgtgggaccttctacttttatgggacatagtttggaagctaacagtcatgagagaatccttcttactaaacatctttagaattaaaacttgccggtaccttgttttcttgtgtataattttctcgccattctgtgtttttgttaaatggaaaagtttaaagaaaatcacagatgtgttctccttattaacagtttgatttcaaactacttcctccatttgaactcgatcctcacctagaaatcaaaagaaaggcctcagaagtatatatttagggcaggagcttttaggggagaaatagtaatcttgtgggtcatttctaggactatgcatgattccctaattctctgaa

SEQ ID NO: 51836 - DNA, 1696 bp, Bovine  19866881208365
cttcaaaaatgtatatgtaactgtatatattaacttcatattgtaaaattttataagaattataaaagtgagtagagaacagagggaaaaaaaatgagggtgatacattgatacactttgataggtcttaatgaattaagttaccaggaagggaacagtagattttgttgatgttaatattcttgtctgtctgtctaatataagacttttagattttcattcctgtaaaaatacctaattttgttgtcatacaaaaatgtgttcctcctactagagaagatagactaggctagttgagactctgaagatttcattagacctctgggtataatctgttatttctgctaaactgagattaacattactgattcataaaataacttcaaaaattgcctttaatgacaacatctgactgagtgtacacatcatatgggataatcagtttgaataaaataattcccattagtatcataacatgtttaattttattttaaaatcaaaatggagccaaggtttagagttcatgaattttcaaaaagagttgttttctctcctatcgaaatgtaaatagtttcctaagaaatccttgtcctcagagaactaataggtgtacatacagataatcagcataaccattattctaagaggaagttaaatttcaaaattagagatattttttattaattattcatattaaacatttttctgaatccttgagagaatttgaaagtcagaaaagggtttgattatatggcacatggatttagtggtggcttaataaaatcatgtgtactctagcatgtttaatgtaaggaagactgacaaatggcatcgattttattacaaaatcaatatttgccttgctaagttgggtaaattcatttctgtaaattttatttaatatcaaaagaatgaaattcaaagaatatgcaaaccaagaggcttccaaaattaaatatgaagtgaaacattatcaaaagctgtattaagctggtcctgattagttattatttaaagcagatagtcatattcagcttttaaaaggtaaagttctcatatattttaatgtgagtgacttcaaatttaatattattattatttctttatatttttccagggaaaatttcagattttgagccaagtatagaattatatggttggaggttacataatgcagacctacagagtgttttatattatgtctacgggacagagcattagatttcacagagaaagtcacagagatgccacattgttgaaatttctgatctggttgcaatacttaggtttgaatgaaaaacccaagagccaaattcacagaacaattacatttgcttcttgcatgcttgatgcccccaaaatgctagaatatgcacttttaaactggcaaaataaattctctctttcctacttactaaactttaaacttacaaatgtttcttatctaactttaagtatactccttagggtatctgctggccttaaaaaactgcagggcagctaagaaaggtgttccctgctcagccatcttatttatctatcttctcatctccagttcaatctaaaacacaggcacatgaagaatcctactggggcatctataaaatatgtaacatcacttaaaaagtagtttatgtcattactttttaacacattgtatttatttccaaaagagaattcaacattaccaaccaga

SEQ ID NO: 51837 - DNA, 944 bp, Bovine  19866881228641
acaaagaaatcttttgtcattaatgtcatcaccaagaacaggaactgatgttattcgagctttgatctttgttttctttcccttcccccactgcttaattcaattatgtatccctcctttacataatacaagtaccactcctcctcagctcctcaattacagactattcagcaatcctagctgtcctgagattgagccagtgtattttggcatttttttattctaacctctaacaggtactgcatgttccagacaattttctttttaaggcccccaaatatgaggctacatagataatagctcattcagtaatcagtagattatgaagtggttaaaatgtagatgaaaattaatagatagtttgagacaagaggctacttagattcctttgatgagaagatgcatcagcttacatctaacctaactgtctgctactcccttgtacccaaataactaggcaattgcaacttttgtgaaaacatttcaaaccatatttatattgtatgactggtcaatgcagtttttaaataactgtggtcaaggattgacaacgtaaaaaggaaaattaaaacttctttcatctttatacctcacctttttactgtcacttggattagcatcaattactatgttctttttttggggagggggcagggggagagtagggaaaggtggagattgataattgtttaaaagagatagctggcacaccttgatagatttgtaaacatgtatctgtgctcagcgtagtacagagcaaactaaactcaagaagatttatgtcctctagaagcttatgatctctgtatggaaaaaatagaacaaatgaaaaagcattaaggaatcatttctataagtagttagatgtaaaacaaaatgaaactgatagttgtgaaaaaaaggattaatgggaaaggacacctgaggaattaattgcaatctct

SEQ ID NO: 51838 - DNA, 1204 bp, Bovine  19866881306577
gagagaatatcacatcgttcacatctgaggcagttctgttgtagacacagtgatagtttcagctaagttctctatttttttccttaaaatgtcaagtcctgagctgggcggagcccccgttttctgtagtgcagtcaccctgtgcacctaacattgcctgctggctggtggcagcatctccttgatgagcaggccagggccagtcccaggcagctcccctttcagcctgacagctgcatatcccaggtggtctgacatttgagatggaggctgtggataagattgaaggtgttttaggggagaagtaggctgtgaataacaccaagacttcatccagatggaatcactcatgagacaacctgagatagtctattactgcccatatgtcttctaggtctccaaaggccaggctccattgatttataagaaacctactatttacgcttttggctcatttcacaacagactacagtaaaggatttatcagagatgctgctgtttctggcagttgttgggattttataagttctttaaataaaacagtctccataaatatcctagtaaacatcagacaataaagtaaatatttgggggttagattcagtttatttcctcttaatacacaccatctttttacaggtttccttctgagtacagcaccatggcaaaaccttttatagaacatacctattttaggtaaataaataaatatgtgactccaaagaaataaaaattactagatatagctatgctcacagtattgcttaaacactttctctcttgcagataagtcttggaagaattatttcattattttttccagcacaatcagttattagtgtatcttatttatagatggttctttgaggaactatagtaatatagcaaaatatcagttatttcatcacactagtgaatttaatgaacctgaaggtgtgtgttattttagcacttactgtagctcctgtgaaaacccagtggtgctaaaatctgtaaacctgtcattgcttaagtaataaccttgttaaaagcatcttcatttaacttactttagcttctgcaggatgtaggttttattttatcagtgcagagagtaggtgtttcaaacccaaaccacttattgtaaatataattaattgtagttcattaatttattcacagtgttattgcttttattttcatacttaggttaaattaaatattg

SEQ ID NO: 51839 - DNA, 1079 bp, Bovine  19866881371539
tagcttgcaagggtaacaggagtgtatcccttgttctctggcttttgttgggttgaaccaatgagaaggcatctcaggagaccagagggcaggagaggagtgaagttatgtttgtcttttctgctgcctccctgtaaggtcaccctaaataagccttatccattgaaggaagtttctcccggtcttaaagcagcctgaggtcctgatctctggactcttcctttcaggtccagggatgaatatcacccctgaggctgttagcacagcttcccttgtatctattctttgtggttcccctacactctaaccacatcttggcacatagttctttgcaaattatccctaataggaagctgaaaaggacatttgtcgtctgcctaggtacacattttaaaaaagctaaaaaggacatttgtactctgtttaggtaaagataactactgtgtttccctttagttggcaagttttctttcatttgtaatattcctattttcatcatctttcagatttctgtagcttattgaatggctaccaacacaattggccttcagtgaaaacttgaatttaagccataatgtaagatatttttaaagttactttgacacctcagtttcaccaaagcccaatgtgtttagagatcctctcagatgaatttatcagctcacaatttatcagctaaacaaaatttaaatgcaaatgacaaatacacacacaagctagaatgtcatgtcatggaatggaatgtcatctttgaaaagtgtcagggagtctggataaaagctgatctgtgaagtatccaaaaacatctctcactcacctacccattcattcacagcacaatctctttgactatcttaggggaccctttgtttttgaggttctcaagtctgcatgttttactagttttttcctgcactgggtctgcagtgcagggaatgacagccgttctctgggaaacttgtttccaaggtgcctctaaatttgccctgtgacatggttttcttggtggagcctaaccaaaaagtactggtaaaggttctgggcaatgatttaatttggtgcaactggggatgtttaaa

SEQ ID NO: 51840 - DNA, 1515 bp, Bovine  19866881375904
tttgttcacttagtagctaaatggttttttcaacattttggctagcagtttctttaatgagaaggtacctggaatgaattaaatttgcttattatttaagcttatgaggtaaagtgtttcttcagggagtactcttatgctttgatgcatttcaatgaatattgttcttgaaaatgcctatttcaactacttgcaacttgaaacctgaaaattctcataatagtctggtgtatgaaactaatcacgaatatttgtgggatacacagacacgatgtgcctctcaccctttttttacatagcacctttattaaggtctaattcatatatacaattcacctacctaaggcacacaatttcatttttagtgtattcacagagttgtgcaactagctctacaattaattttaagacattttcatcaccccacaaagaagccttgaacccatcagaactcattccccatcgtctcccaacccaccgcccctaggcaacctctaatctatattgtgtctctatggattttcctattctgaacatttcatataaacacaaacaaacaatactgaggtcttttgtgacaggcttctttcacttggaatactgtttttaaggattatctatgaggtgtcatgcgcttcatttctttttattgctgaataatattccactatatggatatatcacattttatttatctattcaacagttgaaggacatttgggttgtttcctctttttgactatcataagcagtgtcgccatgaacatctgaataacaagtttgtgtggacatcagttttcatttctttggcatatacctaggagtggtatatgaccaatggctggccatgtggtaattctgtttaagcttttgagaaactaccaaaatgtttttccatggtggctgcccattttaccttcttaccagtagtgtatgaggattcctacttctctgtgggtcactcactttgatgtcaatgatcattcctcctaattcatcaaatcaatgcatttcctagatgctggattatgtgccctcctgtgtccttctgatggatgcatgtgagcataaccataacagatgggatgtgagccctgattactgctcttgtatgccttgccacagcatactgtagacccagaaataccagccctccttcaagcacacctttcaagctgccctaagaacactgtctatactgagttttaccaactgtaaaatgagggagcttgttctagagtgaaccagcccacttctaccttgtttgtagaactgtttctgttttaaacccatttggtggcacctccagctccatggggcttcctaggtggtgctagtggtaaagaacccacctgccaatgcagtagacataagaaaggcaggttcagttcctgggtcaggaagattccctggaggagggcatggcaacccactccagtattcttgcctggagaatactgtgggcagaggaaccggcaggccacaaaccatagggtcataaacagccagacacaa

SEQ ID NO: 51841 - DNA, 1920 bp, Bovine  19866881413603
agacctagctcttggcatgtcttcattgcatctgagacctaggcaatttcacttattattcttgggtatgattttcttggaaatctataaaacttatagaataggatagggagcatttttatgcatttgtaggaaattagcacagaagaaattttaacattattttcagctgtcacttaggcaattgcttcagctcagggatgaccaatgccagagcactgattaaggatgttaattttattcatctttgtatctgtttagtgtcaagtgagaggaagagagggtttcaaatgtgccctggtaaattttttttttaaacacagggctttttgaaattagaaaaaagtcagaaatctatgcaaggactaaaggcgactcaagagaaaagaaacattcaccgttgtaggtttgaagcacacagggcatcttccaggccaggagaaggcctggtccacggtgtactgatcagagagcaatctgtttggggctcagcagcaccttcaggcctctgagctcttctgccctagcagggatctactgctgtttattatcagtgccatcactccaggatgggaagagggggtggtcttagggagccaattgtgttgtcaagaactgtgtgttttggggacacattggctaaaatgaatcataaaatcatagttccaagtgttcttctgttcttgggtatacagaattgaagaggaaaactgtgtctgacattttagggtgttcagatttggcacttctcttcactatgtgtgtaaggcaggtcccatcactgtgtggagtctaacttactgacccctggaaatgaggggatggatccaaagatctctaagaactcatttgagcttacatgccattgactctggacttctctatataaatattaagtaagtttacagtaaccatggagaaaggctgtgtccttgctgacaattgtaaatgtccatgatgtcaaaatgcaggatggtaaaaagtgaagttgaaaatgaggaagaggtgtgacagggtttaatctaagtagttttgaagggtgtgcactttttaggttgcctaaggtctggactgaaaaatatgtcttctcctagcatatttcagagttggctaaattacatttaagaacttttttgtccaaaaagaaagaggatggtaattaaagcaaaagtagccccacagctcagatgacccctttctctgatggaggaaatctttggatggttatttttctaccgagtctttaaaagagaactctagtcttaacaagggctaagagctcttgtagaagtaggctgagggaaacaagggaaggaaaaatggcttttctttaagcttttaaacttattattaaattcataaattagatcaaatttattgttgaattttaagtctcaaacatatataaaaatatatgtttttttttccatgttcccatcaagatttccatgttcccatcaaaattcaacaataaattcatggccaatcttgtttcatctgagacttccccagctgtatattgactcctcacttccaatgcagagggggtagatttgatccctcgtgggggaactaagatcccacatgatgtgcagcacagccaaaaaaaaaaaaaaaaaaatcttgtttcatctatgtcatcacttaattttgtttaaataagattcttttgaagcaaacacatagtttcatctgtaacaatttccaaatactgtgtatctctcaaagttaaggactctttatttaaaaaacaattgcaatattattaacacaactaaaattttaaccaaaaattcctgaacatgattaagtatcaagtcagagttcagatatctccaattgtctcatatttttcaaaacaatctatatgaatttggatcctaacaaggtccacagaatatgtggacacagaattgatga

SEQ ID NO: 51842 - DNA, 1918 bp, Bovine  19866881511849
tacttggcataagataagtgccattaggtgtctgccaacgttaacaacaagactttttaaactagaaagctttatttatcttcttgagcataaatcaaaatcctgaggctaatcatctcaccggtgttcagtacggataacttttaaaatggtgttgctattgtttaactacccgcatgcaaggaaattcaaatggctgcctgaaaacaaaccattaactcagtttactgatgagcgctcagccctaccctccctctgcaatgaaaaggggctgggagggaatggatactttgtgcctgagtagaggttgtaaccaagaacctgagtactgccagggacccttgacgagatcttcactcttttctccctcttcacaaacactcctgcaagcctggtaatttaccactaaatccgtgtgcacagaaacaaacttttaaactataatattcaccacatgatatgtacattccttggactagcatatcattgcataatattgttaagttttaataaaactatcctttgaagctctgttgtggaggacagtaattccacagcagctttgaagtatcctcccttaaataaagtcagagaaaaagccattgtttatttcaccactatttaagagttaatgagagatttgcacctgtacagctgttgcggactgaaactagctcatggagtgaatgtgttttctgcttgagacagttgtaaatgccttgagtaaaaacactgaggactgctaatggataggtttattttaaagcatgccatctgctatcaatcatagagaagtataggaagcaagtttggctgggctccctccttgtgagcctgataaagacagggctccaggacttgggaacattgagtcctcaagagaataaaacatcaaacctactcagcagctccactaacaataataaaaatgcctctgcctaaaggtgacattctgaatttacgattatttgtgtctataaagtgtattctttggctcctgactcattctgactgtctcactctgagaacaatacattaagcctgcctggagtaaatggaaatcctatctttttattaaaccagcagccagtacctgagtcgatctaatgccctgtaggatcgagggaagattttcagctctgttccgttccttccttagatttttcatgagaaaattacaaatgaaatctattttaattcactaaaatacataaataatgtaggcaagtttatctttcctagaagacaaagtaaaatgcaagaaaatgaaagactgaattggaactaagcctcctattctatcatgggcccgtgacaatgctggtggaaaattacatattagaaatatgttatggcaaaatttagaatggtggctcagaactgttatgttctttatgccgtatggactaaacatgttttcaagaggacaaacattatttcctcggaaatcttccagctgtggaatcataaccaatattgctttcaaaaatggatcccaaagtattccttgaaaaatgtcaagcctggcttattaaaagtgctgcctgctgaaatcctcagtggatgaaatgagttgtggcattggaaacttctacagcttataatgttagaatctgcctcaaatctgcagcttaacttaattctactgctagcctggaaaacagagttgtgagtgtttagggaaaacccacctggccagaaaactcatgagcctaattaaagttaatagagaaattaaaagagaaaaacattggctcagtagtagtaagaagaaacttataaggcaatagaaattaagggcaggaacttatatttttgtactatgcatttgttagaaacactccttcccaagaacatgaaagaggaattgatattatttgacttgctatgtattattggtgatatgttacagtccaat

SEQ ID NO: 51843 - DNA, 1005 bp, Bovine  19866881513039
atgcctagaattaatctgaatgttagaatgggcacaaaatcaaataaaaatggagtgtttttgtttcaaatctaggaattattatgatataaggaaaattctcttaaagactactgtaaaacataaagatgtaaatatttgatattgaatctttctacatatacacttcatggttgctttataggaatagataaagtgtttataaatagtaacttgaagattgctgaggaaattgctgagtgtttgtaccttttgtcatttatgaatcaaagtaatctgactgtcctcccaggggttctaaaacaaactccagcattatagaggtaaatagtttcaaaaaatagatttcttgtcatatctataatgccagctctaataatagacttttagtatttgtattctaggtaataaaatatattttctatgagtaatttttctttagtgtttattaaagagttcaattctcaaagaacaaattctggtcactgttttaactgaataaattccatagcagatggctcatgtcaaagaaaagaaaaaaatactatgaggtaggtggtgtgtccagtggactaaacattgtaatttcattagaaatctatcctacctcaggatatgcaatatgctgttctcaaggtgagcgtagacatagtggccaatgcagcattttttcttctgttcacccgttactaaaggcgacacttaaatttttttttttttttttttaaagcaaggttttaagctcaatctgatttggaatttttgtttttctttcttccttccctacctccttccctctttcccttctttttctctctctctctctttctttttcacactggaatcacagcatatttttgattttattcctgaaattattttaatcttggactagtaccaacgataacaacaagaaattccaccttctagatattcaatatgcttagtaatgcaaataattatttttaagaatagctttcccttaggggtcctaaatttcaaggt

SEQ ID NO: 51844 - DNA, 768 bp, Bovine  19866881680805
ataatttctttcaagcctaaactctcccttatttgagaaaagctttcagtatgttgttagctcactgttttgtataccataaaaaaatgactgatactgtgggaacattccaatcatgattgctgttaccagattttccatagctattcaatatcttaagcttgagttattcattttccctcagtgtacattttttttggactgaagtaacaagattttatataaatatttactttgctaattaacttagcaatcatctataaaggaaataaagtcagttcatgcctaactttccatttctcacaatgcaactaatatttcacttttctctcttattttagacagttaataatgtcttgtatttatgactttcaaagataatcatctccatcaccttatattctccaactattgtaagcagtacaagaaatatcaccacctcacttctgaaaggaaactgaggaactgtactagaagaaatggtgagcactgccagatgaacagccaacgagccacgtaaattctcatggccaaggtgagcaacctgggaaaatttacgaatctcagtgaatggggtagcaatagcaacttttgatggtaatagcttcaaggatactgggattgctttttgttagtagaccacagagatgacttctcaaggtctgtttcaatttcctttagaattaattgctccccctagtccattctgaaaggagatcagccctgggatttctttgggaaggaatgatgctaaagctgaaactccag

SEQ ID NO: 51845 - DNA, 1675 bp, Bovine  19866881684656
ggttttgttacttaaaatagtctgaaattattcagatcacctcatctactcccaggagtctcaactcaacactgaccacgaagatcacaggagctgacctctgggaaaattctatgttttagaggagagataaataagcattttatcctagcccctttgccagtcagcattatgacacccaccacaaactccatgaacctagtataaagagacacatttgctgcttaatgctgcttagtttgtgttatttaaatctggagcctgagctctgtgaattcgtgatggaacaactttggcaaatagaaaaataaactttgcttcagtggaagattagtccgggagacccagtggacatttcacagcagtaaaatccatgcaaaatgaatttgggcaagaatagtctatctaagatatcaatttgcccaaataatatatttatagactattattacatctagggaaaaaaagcactagattgaaactgtaaaatttcactggtagaaatgatccattctcaaatgttaaccgagattaaaagggagaatttgacacttttaaataaaaaatgatgcgtaaattacacaagaagtctatggagacccctttcagttcttattttctcctctatcctgctctaaaacatgcagtaaacctttttcaattggagagggtttaatctgtgtttaaggatacttagaggcagtaccatctcttcctggaggcctatgtacagggcttttttttcagatattgattgtgaaagtgatatcacaccagaaggtacattgataccgtgtcaagtaaaagaaaatggccaagaatccttacagtctaatcaaagctctgttcaagccccacactcatgaaatccaatcaatagagacgattaaatgacacgtacagagtcaccaatattaaatacactccatttcctgtgcaagagcttgatgacacaaagtggatgagacaaaacttgactctgtaggtttgtttacaggatctgtgctatatatatagagagagagtatgaaagtttgactcagtcaccatttgccccacaaactaaggtgccaactataggcatctacaaaccatcttgtgctgaatcaactgtgaaagggagccagtcagagagtatgatttgacaacaatcacatggaggagaccagtatttattttaacatatggtatttggctttatgatggaagacacacaggaaaacaaggaaataaaaagagtaacaataaaaataggtatgatttattgagagcttgctatctgtcagccaatgtgctaattgctttacaattattagctcatctataaataacatctcactatattttcagggttgaagaagctaagattaagatgcattcagtggtacagaagtaggagagttggaaactgaactcagcgttacctgacttcaaaaggtaagctctccaacagtatgattcaaatccaatcctaactgactatgatcttggaaagcctatctgtctgtttcactgtagtttcctcctttactgtaaagtgagaggcttgaactaaataatctaaagtgtctctcgtgatctaaatgtctaaatgtctaagagttggtggttgtaccatgtctgactgctaggcatttaaaaagtgtgaataatatcacctcatcaaaattgctca

SEQ ID NO: 51846 - DNA, 1086 bp, Bovine  19866881728199
gatagaatagatttgatgttggccagaaaatttggtggtttcctcttttattggtggtggtgattagtggggaccagcagggcgcatgcagagcagacaactagtacattccaaaaaccactccattattaaggaagtgggttgttccctattttttcagccttatcttgcttcgaagttcgcttttaaatttggtagtgaatggagtaccagtgttgagaaaaaaatatcctgaatgagagctcatgcaacctctattctcacgtgagcaatgatagacgttctttctatgaaaattgctgtaattaaaagacaacccaaagtggagaggagaaaaaggttacactggaccccttgtaaactactctaatggaaatggtggaggtgaattctcttcctttcatttgtttcctgattccccaaatattcatcagggcttcaaagcatccctcaacaaattttttgatttaagtatatttaaggatttggctaatacaaaagttagtgtgtcaggacaattatataaaaaataagctgatttacaaattactagtctttcttctctgtttacatatgatatttatcagtcttaactgtgatgtatattttgtaccatgcacattgttagcaaggatctggttaagatagagatgtattgacttaacttggtctcatgaataattccatttgtttatttgctggatatatccagtttgctgttgatgctgtaaatatttgaattggattcaacttgtccatcagagactttccgctgtctctcttggacatcatatatgtaatttgatgacactatctcctggaaagtaagaaaaatgtgtactttggtttctgcttggtaaagtcattcaaagtgatacaaaatgtcaagagcaaagaagataaccactccaatgatgtgaggaagcaattgacagttttcttggtatttggaacatgggagtacttagagatttgtggcattaattacacataaacaactaagtatcagatatctgacctgataggatttttctcttgtttcaaagtatataatattagaccctttactaaatatttacaaaagtt

SEQ ID NO: 51847 - DNA, 830 bp, Bovine  19866881767076
ttggagaaaaaatataggaaataaaatcattgctgttacattttctttgtaaaaggctaacacttacacattgctgcaggcttctatttccatatattaaattataatactttcatgtattaataaaccactgaaagaaatctgaaattttggtgatcaggaattcattcatgtcctgtcaagtgtcctttatctgaatgccacagaccaaggtgcttcatccatctcaccactcatcactttactagagtcagaaaatcttttgcctgtgatcatcaatgcctgtacttattatataatcttgggcaattgtcatatcagtttacattttaacatttagatatgaaattttagtactaaaacctttctagattaagacttcatgatagaatctaaaatatgtttgatcctttgatagattcagtcatttaaatagaccaattctcttttacatcatcacacccactgggctgacacaaagaaagccaatgccttagacctaaaattaatcacaatccactacaagacatttgccttaatacattatctcccaggtaatgacaaataatctttgtgggagataagcagataagtgctaaacaggcataggaaaagtgtgtgtgtgttcatttgggggataaatgtcagaagaattcaccctgtgttaggaaaacaaaacaaaaaccagaatactatacattccttgactgactatataagttaaattcattacattctttttggttttgtttttatttttaaattaatacggtggagcctgatgggctgctgtctattggggtcgcacagagtcagacacgactgaagcg

SEQ ID NO: 51848 - DNA, 908 bp, Bovine  19866881885973
gcaaactctattccttccaatctgcactttgttcctttgcgctttatgtgacagtgagttcctaaactgaaaacaaatctcccattagtcagacaaagggctgcctcctcatttctgattgaatactattaaaaatcctacctagctgctacatttcggtagtagaatttaccatttccctctgatagtcatgggatttcccaggcaagaatactggagtgggttgccatttccgtctccagaggatattcccaacccagggatcaaacccacatctcctgcactgcaggcagtctcctgcattacaagtggatttgtgagtattacaaacattgtttataataaacaatgttatttgtttaaccaactgagccaccaaggaagtcaaaaaataaagagagagagcagtcatattacttttaacaaacacacaaccagcgctaactggaacacaaattaggtacaaagtagacgtatgtgttttgtgtgtgtgtgagttcacaaagaaaataaatttttaagtttcagagattttaaaaataatttctctttctgagagagcattctcatttctcattaattataaataggataagaggaataaattttaatttttacattaacactgcaaaagaattcaatgagaaagaaacagctaactgaaaagcactgcactgagatttgaaagactatgaaaagatttgggctgaattctgttttcttttcttttttgtagtcattccttttcaataatcactcctatgaatctatgtgcatcaaaaagtgaaatgctatatattttcaaagcactcaaaatagctccagtggttcaaaatatgcatgatgatcaaaatagacacaaataactgtagatctatcatgtgataaatacacattatcaaatattt

SEQ ID NO: 51849 - DNA, 1333 bp, Bovine  19866881978381
acagcagctaaaaggaaaggtttattattctgcctcttcttccttctcactggagtctcacaaatatgaaataggtcaattggggcaacataataacagcaattaataagatattaattgacctatattgaaaattcaatgctctttgaaacatcttcagagataaatcacataggtatctatagtaatattaattaagaattggaatttttctctataggttggttgccactttataagagttagttgaagctacatattactgcaggacatcaattaagtttagctttattataatgattactagtgtctgaacttgcattttaaaagatttcaagacacaagacaagtgtaaaagaaattagaaaattgtcccagtgtccaagaactgtatcaccttatcacaaattttctttccctcccaccccaaaataatgatgattataacagtgatataatgatgggagaggttgatattggtaagtgctcctcaccaacatattctacttttgacaagcccttcccaagccaaatgcgtatttgtctcagtagaactaacaaagaatttattttgtaggcatctgttactggttgggcttcccaggtggctcatatggtaaagaatctacccgcaatgcaggacctgggctcaattcctggattgggaagattccctgaagaagggaatggcaacccactccagtattcttgcctagagaattccatgggacggaggagcctggcaggatacagttcttggggtcacaatgagtcagacatgcctgagtaactttcagtttcacttttctaaactatagaagtaccctccctgctccctatactaccagcagctggtcaagaaaatccaactgagtcaatgatgggtaataaagaagaaacacacggaatcaaagacaagaaaaagaatacgtaacatcaattactaacaaaaattgtcactgcaaaaaggaggccacagggcaactgaaaattgcaatcagatattttaccatagactttatttttaaaaagcaatagctctgttcaggaagaccatacaaaatgaaatagaaaacctaaagaaagaaatagttgatcaacaagaagagatgcagtatgagctggttagttcaggggaaaagtactaaaactatcacagaaatgaagacaaatttggaaagaacacaggaaacactaaatgttgcagaaatctcagtggggaacatgtcagatagaaataataaagctgaaataaatgaaatgaaaaagagataaaaataattagatatatagagcaagcggatatagcatctgtataatttggagtctctta

SEQ ID NO: 51850 - DNA, 1197 bp, Bovine  19866880353914
tatatagaagttataacttctgatgtatcgggatacatcagaagttataagctttaggcatttccaactgaactgaagacctttgccatttgtcttttctttatcacattgcagtgagcatgtgatgagaatgtgataaatcacatctacaatggaaagtcacattccttttaaagctaaatgagaaaagatgcaatcaataagaaattcttgatccccaaaggctgttcagtagtgtaataagtgctatgtctacttgtttattctcctttttactatggcccttttcccatgaagtttttttatagatccataaagatcccaataggcaatgagaccatatagtacattagataagataaactctaagctaggggacttgagtacaattcttcaagtcagtacttcttgtgtaactttaaggaaatactcaaaccgagtgtctatgcttctttcctgcagatatcaaagagaacaaatgcagtaatccattgactgcattcaaaaatgtggttatgttttatctgctcttattattctccttattatggcaatttcacataggagctctgcatgctcttgatgcccaagaacaaaacaaaatatgcctacccataaaatactcaacctctgatgagaattagaatgggaaacatcacaattcttagcagcttattacaatattaaagacaactatatatcttgaacttattagtagattcaggcccagaaattgaagagttatagtttgactgtaaagttaattcataggcctctgcaagagaaaaaaaaaaaatgtctctttcaccactctgtggcctataattgattgtaattaccagtttgcataggactgtattggtaggagggtcaaagattacaaagaactttcccattgctcagtggctaatgggacacagctgcaagggaaataaaacagtataattacactttagtctcttttgttcctttctttaagcaacatagttacaattttcacgtcactaagaaatccatcttcatatgctataggtagtctttatgatgtaatcttattgatcttgggtgctgactagtttcccccatctttttattgattaaaatctgactttagctaactgttacctgattgggagatgttctttaagtacattaaaattaaagagattacaaaaaagataaaggaaaattttagca

SEQ ID NO: 51851 - DNA, 1079 bp, Bovine  19866880359949
attttttactgaccagctgagcatcaataatgttacatattttccttagtaaatagatgccactttgataagaaaatatgttcaaaaatcacattaaggtcacactctgaagaatattattgtatgcttcatgcagaatttaaatgttatttaaattaagcagtttaattaataacataaattaaatatttatgttagtaccctgagggtagtggttagtctttgaggctcattagcaggagaacacacaaaactggaaagatataaaggaaggtttattttctttgttgagctgcaactaattgcattaaaataaaccacgtactttgccagctttaattctcatagaagagtaagcaatccaaactccagtcttttgatgtggtcatatatctattgccaagtttctttttaaagtcccccagataaacatgtatgccaattaagcaatataaaatagagaggaacttgtggtgcctgcgtgccattttctcattaattctaggaaatgactctggcacttattcccactattatccagtagattaaatgacatctttcccccagttgactgcggtaaaagcgccaggtttgctttcatcttggactctctactctttgaaagaagaccagaccaaacagtgcccttttgaggttgaagatgcctttcttcataatgtcatccattggagaaagctttgaggaaaggtcagttttatcccagtgtaaaagaaaatgccagcaattcaagtaaagccatttattgctacttagaagtatcttcaagttctgttgcaataatttacccattaaatagatccaaaacaccaaataatagcatatgcaacacacctatatatgtatcatacttcaaaataaaatacatttcacttaagacaatgtagttttaaagtatgaagaaagaaatcattaaacagggtagagatgacactctattccatttgaactttgggcataaaaacacttgaaatattgagtggatgtaaagaaaactatttaccatggtgtagccaagaacagaataatcaatagataatataaaaacaggacaaaaagga

SEQ ID NO: 51852 - DNA, 1327 bp, Bovine  19866880509630
ttaaataagcagggtgacaatatacagccttgacgtactccttttcctatttggaccagtctgttgttccatgtccagttctaactgttgcctcctgacctacatataggtgtctcaagaggcaggtcaggtggtctggtattcccatctctttcagaattttccacagtttattgtgatccacacagtcaaaggctttggcttagttagtaaagcagaaatagatgtttttctggaactcttgcttttttgatgatccagcagatgttggcaatttgatctctggttcctctgccttttctaaaaccagcttgaacatctggaagttcacagttcacgtattgctgaagcctgacttggagaaatttgagcattactttactagcgcgcgagatgagtgcaattgtgcagtagtttgagcattctttagcattgcctttctgtgggattggaattttccttaggtgtcttttccttaggtggtctcagtctttctgtttcatataggaaaggaatcatgagttaatctctaggagttcactgacatgctaactggcatttggttttaaccactgctcaattctttctccaacttcccttccctctttcttatcttctacacaggaacgataagttactatactaacacatttcttcctacttttctcaactctcagataacagagagatgatattttggaagaaaaatttccatttaagttgatttatgattaccacatatgtgacatatgtacataaataatacttatcagttttttaaaggcttttacattttaatatggtgaccctaaaaatgtgtataaagaaaaataactgaaccaaatggtgcctcaagattcttatttacagatgaaaataaatcatctaataactaacactgatgccaagcaactaacaagaggcaatttaacagatgaggaaatgctaactgtagcaaggaggataaatctaaaagttgggagacaaattaggtgaatgtcagcatgtgcacacagctaaagtgatttttttccacaacaatgatatgatgtctcaaagtactgcagtgcaaatgactaaaacaacacctatcagaatcagtgaatcattacctccaaattgaaaaagcaaaatggcaagtatatgaactcttgcctttaaaacagctctttgtatcttaaagtattactagcttaaacagcttaaatgcataattactagcttaaatgcataattttatgttcaacttattgaatagtgtttgacgaggaacattactttcaacttagttctaatctgctagaaatatgtctggctccattattct

SEQ ID NO: 51853 - DNA, 1251 bp, Bovine  19866880553452
ccagtaaaggtcaaggagagcagcttcactcggtctcttttatccctatcatcaacaccactgcggcgtgctgaatcagtttcaatttggtctccttttaaaagtcactgacatagcaaggaaactgatgctttgacaaccacagcccaccaaagctatcaaacaggggaaaagacacaactaacaccatttctatagaatgaagaaatcttaaaagaattttgcctcattgcccaagaggaatctgtcaatcacttgcttaaccaatgccatatgcaaatataaaggccgtacttttcaagctaatcagtactcagacattcaatattcactcaacaaatacttagtaatgcctgccatgggtcaaacattccgctggacaatatttccctcagctgtctttgagctgaagagaatttctcaagtcaaggatatctaggtggttagggggaaaaaaaattcagatttgaatacaggaactgaagaaatgcacctgaaaacttcactctattaccttcagtcaaatattttttcttgtgatttttgcatgcatactcttctttaggcaaacacttaaacctcacatccaaagatgaatgagcaggcaagttgacatttgccagcttcagtatgacagatgcaaagacaccatggtacttcttaagcactttaacattttgctgttttcttcttcagcatatatatgttccaggaaaagtgcttaatgacttgtctgccttttgatttgcttgctttttagaagggaagtgatagcagagaacacgtcaggtgttttgcttcagggatgtgatggctgggtaacagctgttcttagagcttgcttctactcaaaccctgtgtattgcaggcagaaagccggaccaagcataattctattgcagcaatttttagcaaattgttctgctaaatagaaatatattgcttgaaggctagaaaagtgatgataaacctggcccttcagctctacttttaaaggtcattttggttaaatgtaagcaaattgtggtacaaagtaccttttacttgctgtttctcacttatatctccccctcatacctcattatgctaatgtaatgacttatttgacagagtagtttcatccataatcttggaaatgtataatggatttaattttcaaggttatattttcagaaaactattaatgtccctttcaaagtcattgagactgaattatgtttcaacaaaatattaagtacattaaaggtccct

SEQ ID NO: 51854 - DNA, 1897 bp, Bovine  19866880623350
accacttatttaactataagttgagcaagttagattctttgttctttcattttctcatctgagtatattcctgtcttctaagcagtgtcattctgaatgttaaatatggtaatatgtgtaaaatgcttagaacagtgactggcatagaaactgttataatgttgccatgtgagctcagtataatgccataaagtcacttctcaatgtcattgtagactagatttatatttttcatgtcatcgtatgtaagaacttcatgattacttgaaagtgaaagtgaaagatttttagttgtgtccgactctttgcaaccccatggactgtagtccatggaattctctaggccagaatactggagtggttaggctttcccttctccaagggctcttcccaacccagggattgaacctgtgtctcccgattgcaggcagacgctttgccatctgatccaccagggaagcccaagactgacagaggcaagtgcaaataaggatgaagatggataagtcctggcctgttctgacagcaagattgctcccacaggttctggaaggagacacaaatgagtcagaagtgaggatgctctttccgtagcaaagtggtgagtaggctcctgattctgtcttccatggcaataattgtcaaagcagtgataggagattccagttggcaataaggaggaattagcttttactgccttttgatggttcataagaatagtcacaaaattactatggaaatactggtattggtttagctttgaaattttagtctgtaagattatttaggtatattcttataaggacaaattctttgccttgtaggaaatttgatttttcatcaaaattaatgatggaatcacaacatggatcattaaatgtgataataccactacaaaagtaagcataactatgaagtaatggtactagagttctgtagttcataaaataatattgttggcatttcttttaaaaagtttttttttaagtatgtatgagcagaaattccaaacttgatctctttaaaagttagcatttgctttaaaatatagatatgatgatattacagtaatttcattaaggtaaaatttgcatttataattatattagatttgttcatcagttgtacatttagtaactaaattgtgatttactgaataatactaaagggactaactgtcttggtttggtataattaatcctcatacaagtctaacaagtcagtatatatactgtgtatacatgttctgtagtcatataggctttattggagggaaaatcatatagtagaaagagaagcacatggttattaggtatttagtatctttgactaggtcatctgcaatgttcttgttgttcattttgtaactaggtccctaggccagctacgaacacatgttggcactgacatggatcttttactgttggttctccctagatctctaaataggacagtgataaggaaaaacagcaaaaggaagtaaaaaaacaaaaatctgatcggtagtccactgtgatgctcaataaggacccctgtgaacactctaggcaagacaaaagtatccagctgttctcattcctagtttcagggactaaccagggccaggtctatgctgctgaaactggacttgcttggagcttagagccctagtgagagggactcttacttcctcccattctattttcttgtcatatgtgttagaaatgcctagtaagtgtgatttaaacagagcaaggtgtagataccaggtatgtgtacagtgtgagtatgaaggctaagtggacatgaagatgtaggggcttggatgaagttgagtttagatatgatgaccttcagtgaagttgcaatcaggtttgtaagcaaagacccctttcccacttggtacacactactcagt

SEQ ID NO: 51855 - DNA, 953 bp, Bovine  19866880849514
attgaactaaccctgtgtgacgccaacgctggatggtaataacgcagtggctgtggggtctggaggaggggggcaatggaatccatagagtgactttgagcatattaataagtcatttatgaaaagaacattcagcatcttcaaatttatccattccagcatttgataaaagcagagacagttttacttaattagtcatgatgtggatcatgtacaaagtgatggtaaagtctatgaatttgaatttaaccagacattttttttcatgaattcatggatgactgaatttaaatagctgaaggatcattaagcacacaggattgattactaaagcagcttgctgacttgttttctttggctctctttgaggatgtgggaaaatgaatgatcatcttttccaagttaagtacatgagagagagaagtcattttcctcagcttcaacacatagctcctctgagaaatctaccttaatgaattaccttaacaattgaatcttctatcctgtgcttcttcaaacacttaatgtaccataatgctttgtatagtaatttatatctggtcactacaagttctgtaaatgtatttggagtattatgtatagtatggctcagtgaactggctaatgagcttcttcaggatagtgctcagctctttaaattgtttgtattgggtgcattcaggggagggataatggggaagaagggcaaggaggccaatattttagcaaaaaaaaaggagcaataaataatactgagaattagaggactttgcatgtaagaagaaagccaaagagaatgatatcatgagttaagaaaagaagactgtagaatgagatgaatgagagatgaatcaaatacacagagaggttgaacaggattggattgacaggagactactggttttcaaggaaatgactgatcacagttttattagtgataagagaataaggca

SEQ ID NO: 51856 - DNA, 1578 bp, Bovine  19866881117971
gaattgattaacttttttttgctactgttattcctaatgggtagaacaccagatgaaaggactcaacattcattctgaatataaaatcaaacaaagaatatacaccattctcagtgcaaaattgcatcagatttttcttgttgcttcaattaaaatccgagtgtgtttaaatactcatgacatatctagagcaaatatgtgcaacagaagtactgtattttgaggtatctattccttataagtgacaccccactccagtactcctgcctggaaaatcccatggatggaggagcctggtgggctgcagtccatggggttgctaagagtcggacacaactgagcgacttcactttcacttttcactttcatgcattggagaagaaaatggcaacccactccagtgttcttgcctggagaatcccagggccgggggagcctggtgggctgccatctatggggtcgcacagagtaggacacgactgatgcgacttagcagcagcagcattccctgtaagatctcaagccaattagtgtgccagaaagaccagcccccatgctcataaaataacatgcggctgaccaactgttttgatgtggctactattttttttatccctactacttttgaaactactgtctaccacatcagttcagttcagttactcagtcatgtctggctctttgagaccccctagactgcagcatgccaggcttccatgtccatcaccaactcctggagcttgttcaaacccatgtccttcaagtcggtgatgccatccaaccatctctaccatatgtggtagtaatatgtctaccacatattactactcagttacttttggattatttagatttgcatcaccccgatcttaaaaaggaagacaaaaaaatcaaggattactagctgctggatagagttcctttaaacagaagagaaagataaaaatgatttcttcttaagaaggaattcttcatgccccctttgacatcagttacacatctaccagccatctcaaagtattgccgatcccagtctcctcaacatttgccctttactagaggttgtactacagccaacttgccaacctgaggaagtgagtgcccagctaccgacaaggaagagagtggacctcaactttcaaacagctggttcagtatctgataggcatatagtccatcccggtcagactcaagatagaaattattccaagagctgaagagaggtccagaaagcacatgttttgtttataagagtcactgactctccccaggtgttcaacatgttgagaattgtggttgactgctcagtccctggttggttggctgtttggctggttttgagaagggaggttgtcagaatatgaccttcaggggaaatgaagtctctacaaaaccaaatgtttgttactaaaacttctgcaccatgactaacattcaaactgcattttaaaaagaaatcattcaaaacacactgcttcagaatcaatagcttctttgaagccacagtaagtagcatgaactaaatgcccatttttggtggcggaaagcaaattacttccaactgctcaaacagaattt

SEQ ID NO: 51857 - DNA, 1367 bp, Bovine  19866881179107
ttccccaccaacagtgtgtgagggtgtcagctccctttacaaccccccacccaacacttggtatggtcaatcttttaaattttagtcattctaatggtatatatggatatctcattgttgtttcaatgtgtttccgccctgacttggatgtttaattttgtttgaatttctagttcatgcttccattagtctatgctatttagtgactccatagcttctctcacacagaattttgtattgatgtgtttatgctaataattttaggggtttcacaattactttagctgtttttaacctcttctattcctttctatactgatagtttccttaatgacgaaaattatttccacttatatagcaccaacatacaatatgagataagcaaattatatagttggctattattcattattttaattttactttctgaacataattgttattcaagaaagtaagatttttacactgtttgtaactcctagcacaattcttgagtgaaaattgtttaactgataaccttcaaaggctaaatgaatctttaacaaaattcaaaaaagtaataacatcaatcattagattttcctattccttaaaaaacaagttgtaagtagtactagttagtagtattactaatagtactagtatttaatcactatacaattaaaaaaaatccctccctataaaatctttaccacatttgattaaaaatataaagtgaaataaaatgcattgtgtttatactggatcagtgaaaacccttgaggatctctcttttggtccttaatgattctttaaactagtatgtctgtctgttataaaagaagataaaaatataaatgttttgcactgttggctcataattctgggcacatttgttgtgttgctaaatatggtggcctagtttacagaaaaacagaagctgtttgtaagttgtcaaattaacacatttaaattaagcattccaaagacactaataacagctgtgtttttaaatatttctttgagccattgcactctctgcatagaaacatgtggcacagtagctactgctactgcaatgagttctgtatggagtgactttagaaagagaagagaaaaaaaaaaggcggcggggttgttatgtttttagcttgaaactaagtatctaggaaggtgttatatgagacggggtgctgagatatatttaggaagtatcatgacccttacatttaataagtaagagatgtgtttatatcagttttatttttgtattatatcaatttgtatagcagattatggataattgtggtgcaacccactgaaaacattcaagaggaaattttcattctgaatttctacattgccagtggtaaagtaatccaaactaa

SEQ ID NO: 51858 - DNA, 1925 bp, Bovine  19866881197665
atagtctacttgtggctggcaggaaatatacaatttcttatgtatgcttattgataaatgagcaaaaattccccagagatagacacttcagttttcataagctttcacttgtattccatagcatggttttgttgtatgtattctcattgactgtgaaatggaccttaaattaattaatttctaaacttttctaagacttggcaagatagtctcttgaaaataagcctttcattaactctacagaaaatgacagccggggtctataattcttttaagtagatcagaagtgttttgcaatgcaacaaaaggtcaaagacaggaagctcacttttaatagactgttcctttaacaatgtttctctcaaaaagttatattaaaatgcagtatacctatctcatccactccagatattaattattttgacaagcaatggggaaatgccagaatatgtgaactgatgaaaacaaaagcaatgatgtttccaaggatgcacctgacagctcttaggggatctagagaaatgagagcagaattacaaagatttcaagtatcttagtaatacactcagacaatttaaagttacaaaaatttgtcagatttctactgaacttaaattctttctgaatgcatagtaactcttttataccttttttaatgctgttcatttatatcagaatgattttattatgataaagtatatttaatatggatttacataatgaaacttagttttatatgttgtagtagctgtgctctgatctctagtctaaaatatgcttgtctggattactaaatcttaggtttggagagttcttttaacagcagatttcctttgtaaccctgttaatttttagaagaaatgtttattattcggtgtatattttctatatttgttcttttacttaaaacagtactagaactaactgaaatttcctttcagaaagttggacattcaaggttaatttatctgattaatcaaaatatgtaaatagacaatactaagaagtttggaagatactgaaaaagtcatgagaatccctggggactctttcctggggaaattatagtgggattttccacctatattttaaaacattgaaaaatcactgtcctgggatttaagcagtatcctagaaattcaccatcattttatcaacattgtggcacagacttctaaattatactgaaatgttaaggatagcccattttaatccttcctaagccattcagattttttaactagttaaagcacactctatattttgcctttgagaaaggaaaaaaggtaaatttgttagcacaatgcacatggaaggaagtgtccttagcaatctacccatcctattttcccagggtaagatgttctcaggttctaggaactcttcccctagagatgtattggactggccataagagagactggcaacagaggaaaaggtttgagcctgcagaggcatctaaccacgttaggtggtgttgaccagtatcaacaattccacttcataatagtctttccatcatattctcttattcctgtccattagggcaaggtcagcttcccactggtccttctcctctaggctgagacaccagaagctaaagcttatttctcatattccctggatcttttaaagtgtaggtgtaattatttgtgaattaaatcactttcttgcttaggggtacaaagtttaactaatacatttagcattttgtgttcctttcacccataccagaataagattgcctttaatgagttttccaagaaaagtaggttccaaaccaaagtgtaattagcatggttcctagttttccttttcccaaagtgaggtaaagtcacttttttgggggggtagaaaatcattacttctcactatgactttttctgtatacaaacaacatcaatttcaaaaacaaaaatatccta

SEQ ID NO: 51859 - DNA, 757 bp, Bovine  19866881366391
gagatggataggtctcttaaaaattaattctgtactccagaatgaatgtgacttattgctagcataaaataagcttcaatggaaattaacagcaaatgaagagagaggagatggtctaccaataaatttagggcttacaaaacaagcattaataattgttaaggacattgtttacaacagaattctcaacatattccaagtagattaacataaaacaaataagtacatgaaatgcataaataattaggcatattattagttgcctagtgatagctgttaagcatccaagtaaaaataatgcataagaatttttcagtgtccaataattattgcaaaatttaatgcaaatggtcttcttataagctgcaataattgtttaacctaaacttatctctgatatacatttatggaatcaacgatataactttgatacaacaaaagatgacttccatttgaaagcatgcaaaataagcagctgaggcagttctttgattatagagactataaagaaaagattattttgaattagtcttttaaaatatttgttttttgaaaccttatttcctttttactttaatttttccatctctttcttttatatttattttttaaacacttcagatttttttaccagggcttccctggtagctcagacagtaaagaatctgcctgcaatgcaaaagacccagggttagatccctgggtcaggggagatcccctggagaaggggaatggtgacccactccagtattcttgt

SEQ ID NO: 51860 - DNA, 1490 bp, Bovine  19866881445401
cctgtgcagcaattaagaccctacacagccaaaatataaattaatagaccttaatatattgttttctatacctttctcatatcatcactattcattcatgtacatttcaagttatcattactctccagaggaaatcacaaattatgtttaatatattttttcataggaaaggaaaaaactgtccattttgcattaagtagtaaaaacaaaaagagtcagattaaagactgactgctaatggggtcaggagccagggactaagctgagtaacactgctgcttttccagcttttatctaaagtacatgctgggaggctttatccacccatttaatctcttaaacttttaaatctaatttcttcttttaaatcctcttttcttcttttgttttgtctcctaacccttgaaatactcttagataagctcttagattcagttgaaataatccctattgattctggtatttctcataaagtttgagagcatgaaaacaaacttagatcacaagctgaaataaatgtcactgatctaataaaaacaataaatgcatttaatatttaagccaacaatagatattttcagcagaaagtatacattcactaacagcaaatctccataacgtttactaaatgtgtagctaatccttatatacccctacatggcaggtgccaccatgcccattttataggtaagggaattgacaagagattgattaaacagtttgttcaaagtcacatagctagtgaggaatgtagctgcaattctaattctagcagtctgctgcagtcaatgctggaagctctaaagtgcatctcctaagaggaaactcttaagtctgatcaccctcttccataagcaacttcctaatctttattgtctgcttgctcatacgcagctgctcgtactccttattagcagtttaatgttaccaaataaagcatttaacatttacacaaaggagaacatttttgttagacatcacacaggactgggttctgatagatttttatagatggaaatgggagaagggcactgctaatggaagcaacagaaacatcactttgccaacaaaggtacataagtcaaagctacagtttcttcagtagtcatgtatagatgtgagagttggaccaaaaagaaggctgagcactgaagaactgatgctttcaaactgtggtgctggagaagactcttgaaagtcccttagacagcaaagagatcaaaccaatcaattctaaaggaaattaacccttactattcattggaagaactgatgctgaagctctaatactttggccacctgatgcaaagagccaactcattggaaaagaccttgatgctgggaaagattgagggcaggaggagggggtgacagaggatgagatggttggatggcatcatcaattcaatggacatgagtctgagaaaactccagatgatggtgaaggacaaggaggtctggcgcactacagtccatagcgtcacaaagag

SEQ ID NO: 51861 - DNA, 1447 bp, Bovine  19866881501902
aatatgagactggaatagtaatactactggttgaatcctgtgctgagtttgattaaaaggttctgtcagagactaaccttcacatattaagctggggacagcctttcaaagaaatgatagcgataaggctttgagagagagagacaacactagaataaaagttcaacatgccccaaaggatttttcagtgcatgatgactggaggcctaaaagctaataaaagataaactttcaacaaaagtactgtcaaaaaaaaaaaagtgactaagaaatagccccaagaaagaaaacttggacaagctatttttacagcaataccaaaagaaagattaaaatgaagatacatttaactatcattcaatttcctgcttttttaaatgcatttcctagaactgacctttacaaagtttatttctagtttttggcaaaaacagaagaatgaaagatcactgatagagctatcttaatcctgcagtcttttgtgaagggggaaataacgaggaaagtttttttataccatatttggaaaacaaatatttatgaagccatggagaagagtaggagggctgatttttctctctctcagtacacccaggacaggtcaggcctgagactaggaaggaaggggctgctgggctgtctcatccctgtacacctgatagaaaaatcaacatctagctcagcgtgcaggaggcctgaatggattggaaaacatttctctgattctgagtctgggaaataacgagttccactggtagctcagacagtaaagaatctgcctgcaatgcaggagacctgggctcactccctgggttgggaaaatcccctggagatgggcgtggcaacccactccagaattcttgcctggagaattctatggatagaagagcctggcaggctaggtctatagtccatggggtcacaagagtcagacacaactgagtgactttgtttcactttcactggagaaggacgtgtactgtgctgttagaatggaggaacagacaggagataggaaaagtgtttgaggaagactggtctgccgttctcagatgagtaagaatcaacactagaaatgggagggagtcagctcaggttcatgggtgtgtgaccagtgcagtcatacaaagccccgtgcttagaggatcccatgattggtttaatgttctacttgctctatcttgaaattcttaaaactctgaataaaaggctctgagtttttattttgcacttggctctacaagttgtgaggcagttcctgtgaggggaggggttgtaaactttgggtagtttatcgtatcttaagcatctctaacagtttaagaagcctttccttcctcctctcaagatacatgctgctctgaaccccaggaaattgaaagactatcaccttaatcacctactcatgtctcttcctccatacttcactcaaaagctccagcacata

SEQ ID NO: 51862 - DNA, 1781 bp, Bovine  19866881508730
tgctgtagactttgcttcactggaaagtggagaagaaaatttaaaacaatgagctctatgaaattttaaaatatttacatttgaaattaaaaacacaggtcatgaaagaacaagagcttattttgagttcaaaatgaaaaaaaggttgaaattgtaaatcgttaatgaataacaactgaaatatacaaaacctatcttgcagtgaagttaaattcattctcttcaagaacagaggatcaataaagaaattaagccattctaagttggagtgggaaattaagttactgagggcagcaaatgagagtaggtaatggattacgaatttcagcacctttgggaaaagggatattaaagacatatcgttgatgggagttttgtacttttggtggctaagatcactcacaagaatgtctaatgaggtaaaagtatgtttgccaaagtatgttatgtcatatatgaataagctatcataacacatgaaatatttttctaaaatatcaagctgttcaacaatttagtgggaaaaatatggaaaagaatgagaaggaattgtttgtgaagaagttaaaatttgaaatattttaatttcagcaagcataatacagaatttaaaatgttaaaaatctaataaccatcttatctcaagattttgttgtaacaaatgatatagaaagcctcagagataaacctatgcaccttatctttgttttgacaaaggaggcaaaatatacaatggggaaaagacagtgtcttcaataaatggtgctgggaaaactggacagctatctgtaaaagaatgaaattagaacacttcctaataccatgcacaaagaaaaactcaaaatgggttaaaggataaatgtaagaccagaaactataagactcatagaggaaaacacaggcagaatattcagacataaatcacaccaagatcctctatgacccacgtcttaaataaacacaaaaatgaacaagtgaaacctaattaaacttaaaggctttggcacaacattctgtcatctgatggggcttagtatttaatctgctgcacaaaatatagcccaacatacctgggataagtgtattaggtactcacatactcatgatattatggccttgttgccaaactgtgaagaatgctacttatagggtagagtcatttggttatcactagaaaattgaatttggccctgacaattacttttacgaactccttaaccctcagtgctagaaccaaacttagttatcttttttctcaaatcaggatgctgcatactaccaataatccctttttcatcacaattcttatagatgatgaatatctatcaaagctggctaatcaaatgagatgctaggatttttaaacaattatgcaaataatgtacttagatccccaaaaagtgtactttccaaatattacagcaaataatataaacaagaatgagaccaagttaaggcttcaccagaatttactctctgagtttataaaaccaagaaactgaataacaagcatcatggaatcacttcttgaatagtaatgactagtgctaacgaatttcatgtagttccttaaggacaccatcctgtctcatgactcttcgtgtttctatatgctttttcttctgcctggaatgcattctctcaccagttcaccagccaaatcactttgtcctccctcaattcttagttaaagctctatctacaattctaaaacttttttactcttctaacaaataccagtgctctattgaccagactgacatatgcaaattcactggtaa

SEQ ID NO: 51863 - DNA, 888 bp, Bovine  19866880469987
tagctgtgtcctctgcatgactttcagtcttgcctgcaaccaataatgagaatgcagcccattttaaagtaaaatcacttttgcagaaaggtttgtttccccttcttttgttaccttgatatactactagtttcaaatgcctcatttaaactttaaagaaaattcctgatgtccttgctttacatttcgagagatccaatagtgtaccaggtcttgagataataatctattcataggtttatagaaagagtgaataacttagttggataaacttaagctaaatcaggagctttaaaaaaagtcctgagaattctgaccacataaataagcttctcttgcttttatatgtggtgaataactaagcatttaataaaagtaagttcttatttttgaatgtactatgttctgaatcccataggataccatgttattattgccttccattgttctgagatggaaaactgatgctcatagttggtacttaaacagatttgtaaaattaaaaattagaatttgaattgagttattttagatcttaacactattatgaaacagtatccttgtgtttagactgagcaaaatttagaatataagggggggaaaaagtgtctagcatgtcagtaaaggcaagaacaagctaaaagtttaagaagaatttcacatcagcagtggaatgttttgataaatcagtttataaaaaaaaataggggaaggtaacagagacttggaacagggaatttcaaaactgtttccagctttattgagatatatttgacatataaacttatttaaggtatacagtggtgatgtttcaatatatatatgcattgagaaaggattaccacagtaaggtgaacaatgtgggggaatatgccactttcaaatatg

SEQ ID NO: 51864 - DNA, 1568 bp, Bovine  19866880598881
atgtatagatgttttatacatctaaaattactccaaaataaaaaagtttattttaaaatgcccccccacactaccaaatggggcttccctggtagctcagctggtaaagaatccacctgtaatacaggagatcccagttcagttcctgggttaggaagatcccctggagaaaggataggctacccactccagtactgtggtcttccctggtggctcagctggtaaagaatttgctgcagtgtgggagagctaggttcaatccctgggttggaaagatcccctggagaagggaatggccacccactccagtattctggcctggagaattccatggactgtatagtccatggggtggcaaagagtcaaacacaactgagtgactttcaccttcaaacactaccaaacattccctctgagcaatagcaccctgaatggagaaaactattagactaacctttttaaaatgcacatccaatcatgtcactttctggaaaaatttttaaataagcaccccacccttatttatcacgtaagatccacactgtattgcttttgatgacctttctgaacacatctctttctactccatctctgatacccatcttttcctttaccactcctggattttcacattctcctgactgtgtctattgtttcatgcttatatacctccacactaccttgtagcatggtagtagacatgatttagaaatagattataatgaatatttgtctgagtttaagaaagattaaatgggccaaggagaatggctgttagtgttcactttagtcattccctgctacctacaatagtcattctctctgacagaatcttttgatcaaagatctagtcatgtagattattgtctgcttgaaaaatggcctgttgtgccccaagaatgaactagaggtgatgaagcccatagcatgtgcagtatcagacctcacaattctatagctcagatacgttcacagcaaaactttgacagatggctctcagaaatgattcacttaatttaagcatttgattattgtgataatgagaggatggtaaatattaacacagatttaacctctcagtagatggaagttaaatcataactcacatgaaaaaaaaagaacagaagtgttctgtgtttaagtgaaagtgaaagttgctcaatcatgtccgactctttgtgaccccatggacaacacagtccatggaattctccaggcgggaatactgaaatgggtagccatttccttttccaggccagaatactggagtagatcaccattcccttctccaggggattttccaaacccagggattgaacccagctctcccacattgtaggcagattctttacaagctgagccaccaggtaagtccaagaatactggagtgggtagcctatcccttctccagggaattttctctacccaggaatcaaaccagggtctgctgctttgtaggaggattctttgtaggagctcccagggaagtctatgtttgttttaagggcattatttattaatagtaagatatattggtttattatctttgcatcttctgtgacccatta

SEQ ID NO: 51865 - DNA, 1177 bp, Bovine  19866880749889
agtgcacaagctcgctaagtcacttcagtcctatcagactctttgtgagcctatggacttagcctgccaggctcctctgaccatgggattctccaggcaagaattctggagtgagttgccatgcccttctccaggtcatcttcccgaccccggggatagaatcacttttaagtctcctgcattggcaggcgaattcttttcccctagcaccacctgggaagcccatataaagagtatataacagatctaagaaaagggacttgtgggtggggagggaagctggcattctattttaataacatggttatggatctggaagaaagcaggttatctgtaactataaaacttcagcttttacaaatgggaatcccaaatgtttggatattttcctttttcttttcttaaagggggtcctgtcctaaaatctagacttgtttattttcttttttacagagagttaacacggagacaacctactccatttcaaattcgggtaactgtgaggctttttaaaaaattatttttaatattcgtcatctggcttttgatgttaaaatatgtatgattatggagcctcaagtaagaattaactcgaaagccataagtaattaattcattcagtaaccagcctagagtaactcttcaaattttaatatttcattcctaataaaccacattgacagaaaactcagagttcctttggcaaaagcaaatgtgtggctggagataacttgttttatctagttatgtttaaaaagctaaataataaaggtcttcttaataacatttacccaaacagcagttgaagattcaaattcacaaatccatggtaccatgtcataatctattctcctagattaatatcttgaaaactacaaacttgatccttagtaggatgtattcaactgagtagcatacagggcatgaaatacctataaaatacgatgataatgcttaagaagccacattataatccatgatacaggaccaggagtttgcctcaagttatattagaatgactttagtggagtttggcttaaagttttttagggggtgatttatgaaatgaatggagtataaataatactgagtagaaataaatcaatattaaacttgtgtgtcatttaacatattgatactgatcctccagtaacacaaagtctgccacttcaggcca

SEQ ID NO: 51866 - DNA, 1485 bp, Bovine  19866881053472
tggttagctagatcatgaagatcttttttgtatagttattctatgtattcttgccacctcttcttaatatcttctgcttctgttacgtccatatcatttctgttctttcttgtccccatctttgcatggaatgttctcttggtatctctaattttcttgaagagatctctagtttttcccattctattgttttcctctatttctttgcattgatcgctgaggaaggctctcttgtctcttcttgctattctttggaactctgcattcaaatgggtatatctttccttttctcctttgcctttagcttctcttattttgtcagctatttgtaagttcttctcggacaaccattttgcctttttgcatttctttttctttgggatatacttgatcactgcctcctgtacaatgtcacggatctctgtccatagttcttcaggcactctatcagacatggttctccatctcccaggaatattcctccttaccgtaattctgcctcttatccaaatttcccttcttatagaaattatctgtaaccatgattgtcctccccaatagactaagtttcttgaaatcaaggacatatcaggatatatacttaaggtgcattctaaataaaccaacgctatacccaggtcacagaactgtagctcaagcttgcaactttttagttttgttttaatagatatagcagaatgaccttgatatcgaattcttacactgacttattcctttccaaataatgttttctctccactaaaagggacttactgttaggagaagaaagagtctctggcctcataataattctccacatgctggaggagtttgtgataaggtcctggatcgcatgtaatattactgacctttactgcctctattctgaacatccacaggaactgtctacagattgagagcaactcaaaatagaattctattcatttagttccaatgtacactttagaggattagttcctaatagcatttaatttgtcattttctggctttctttcctaaataatgatcacttactcatgttagtgcataaataaacagaatgattaaagattaaaatgacatatctttctttttcttatctaagcactaacgaattctaaaccatggctttacatttaatctactgttttgatattattgagagacagaaattgagattattggaaaattcgcaagtattccccttccagtactgatttcttgatatttaggttaatcaggtgacatatgaccagggtagacttgacccaagatgtactaataactccctgctaatctacagaggttggttcaaactactggcatgaaactctagccaggtcaattatgtcctcttctccctggatagaaaaaggtaatttgtacttgggcaaaatgtttctctggatacgtttgctttggagagagagtcgaggtaaagactaggaaagagggagaggggaaaaacaagagagaaaccagaaa

SEQ ID NO: 51867 - DNA, 1246 bp, Bovine  19866881107257
tattcttatttttaatgtctctctctctctctttttttaaactgcccaggtccttaaggcagtaagaacccaaacttcctcatcaacaagagcattaagctgtccctttattaactccctcccagaaaaaggctgttattaaccagtggtatccctcaggctgctctattgtctgtagagaaacagggacatgattcgggcattgggcaaagctgaagcagttactaactgctccccacttgaaacttgagaagggattggattgtaaaggttaaactggtcttcccagaccatcctttccataaaaaattattttaaattatgtgcagaaggaagagagttaaaatttcacaagactctaccctggctaggaatttgctagaagtgattaaaatgattaaagctgccctttaggatagcagggtgtattcccattttatagatgaggaggttgaggctctgaaaaatgtaacaatatgagagtgaagctgggaaaacaggatctagccctttaattccaaacacttgtgtaatgggaacagtacaagctatacaaagcaaggatgattaacctaactggatcatgggtggagtaaccaaggatgatagccttcaagaatttgcttaacatcactcctcttgaggaagagttggaattattaggatgagattaatgatgcttccaaacagaaggaatgttttaagtttgggcccagaggcaagaataagaagatttattatgcacaggagctgctaaaaattttttactcatcagccctgggttttctttggaaggaatgatgctaaagctgaaactccagtactttggccacctcatgcaaagagttgactcattggaaaagactctgatgctgggagggattgggggcaggagaaaaaggggatgacagaggatgagatggctggatggcatcaccgacttgatggacgtgagtttgagtgaactctgggagttggtgatgaacagggaggcctggcgtgctgcaattcatggggttgcaaagagtcggacacaactgagtgactgaactgaactgaactgtactaattcctagaaagacttttcagatacaatatcccgttagaaatctctgtaaattatcaccctaacatttccccactctttccctcccacacacaaaaaaagtaacaattgtttggttatgcaggttattaaggaagcataattaggaaaaaagatagttcatttaggacttatgtcagc

SEQ ID NO: 51868 - DNA, 941 bp, Bovine  19866881125648
atttagactgcagtgaaggaaaccaaaggttgtcacctattttatgccttgtttcagatgtctacaaaacttgtttctatccttggactcactgtaacttcattactcttttcaagtcaaatcacatcccaacctcaacaattcaaattggtctaggatccctcactaacaaaatgttaatatttatgagtaatgcattttggtttcagagatagggagagaaaacttcagggagacagaatgagttattgacctgctatagaatgtgtcatttggacagagctgctttgtaggaagagatgattcaaatgcacaatttcaaggggcaatgcaatctagtttgctaatctctcattatgctaaggtgaggcttttgtgaatgctgactgctcattagcatctctaacccacagaagaatccagataatgggtgccagttttattatcattattgagcattctgtttacattcctttctttttttgaaaaaaaaaaaaaaagttttattggaatatagttgctttacaatattgtgttatttttctgctttcataaagctatgatttaaaaaattaagtgcagtaaaaggtaaagacagaccattttctctatgatcatggacagcacatattaggcaatatttatttgtttttgacttgaaagaattcaagtgagcacctcataacctctgaagtcacttatctcccttcctgagccacatctaccttgaccaccactgagcacgtttcttcacataccagttttgctcccacatcaggcaagctggtgtctcctttttgagaaaacgcagtttcaagactgcacctaaaatcattttttatctaatgtatgtgaagtgtttttgcccattagctggctagaaggaaatagtttttttgtgtgtttggttggttttttaaaataattaaatttacttattt

SEQ ID NO: 51869 - DNA, 1952 bp, Bovine  19866881127257
atgggtgggaagaaagaatacaatcacacatattaacagaagtacccaaagaggatttctgctttattacaacaaggaaaagaaatgcagatttaaagaacttagacccctgcaaatggtgattcattcttaactccaatgagcttaattttgtcattaagcaccagatgcatataaaaagctacaggggacttgcatatttggcgagagttgtagggaactgtacaataaggagagaaaagtgagaatgaataggaacacacaagaaaagctgttggaaaggaaaaaaaaaaaaggtgttgagatgccaaaacactagaggatagaatactcattcattaatttggcaagttcctttcattctaacttctaaagagatctggccacagcacacttctcaacactccagtgcaactgagcattgtctctggtccacacacagattctagtttcttttcttccacttctcccaccaaagaaagtatactttacagacagaaatcttttaaaacatgaacaaataatatcaactccattgttcaaaactcatcagtctcccttcacactttaataaaaagtcttttctactctgtaaagctgtcaaaaacctggagctcaccacctgtctgacctcaatttcctcctcattttcactcactggttgctgtgctccacatatacttttgtttctaaatgttacatctgctcctactctaggagtttgtcactagcttttccctgttcctaaaatacattttccctcatatccctagttaatcatcttcttttaagtcactcttagaaaaataccccatcatccttctttctcttacattactatgatttatttttattatggcctgtatcactacttataattctttctatatacatttttttctctctgctccactacaatgtaaaccccttaaggccaaattctgattttcttggttcacagcaaaattgcctaccacctagaatattccataagacagcatacgatctagataaatgttttttaatgattactgttttcattatcaacttaacaaatatttacaacaaatttagtatgtgccacatcctatagcaggttttgtggtgcaatgatgtgagcaaagagagtttccttcatggggtttttagtctagtatgtgaggtagatcatagcctattattataccaattttcaacaatatggctgtggtgaggacagggaaggaaaggtctaagaatgttagaagtccaagaaatcttaagaaaagaatgttttagcagagaccgaaaaggataaatatgaattaaactgataaagttaattaaagggacacggagcatcccaggcagagaaaagtgtgtgaaaaaaagaacagggaagacaaaaagatctggatgagcagtgtggacaaaacacagacagcaggggtaaaacaaggtgccccagagtgatctggttatctatggcagtgtgacaaatcaccatgaagcttagtagcttaaaataataataatatttatttttatgatgaatttacaacttgggcagggttcagtaaggagtgacactgaagctgaagctccagcactttggtcatctgatgtgaacggccaactcattggaaaagtccctgatgctgggaaagatcaagagcggaaagagaagagggtgtcagaggatgagatgactggatggcatcaccgaggcaatggacatgaacttgggcaaacttttggagatggcaagagacagggaggcttggcatgcccgcagtccatgggggttgcaaagagtcagacacgactgggtgactgagcaacaacggtaagtacagttttctctgttccctccatgtagctggagtaggggtggctttaaaggtgtgaatgaatccatatctaactagcatctttggctgtcagcttaaaaggtcagctagggcattgactgg

SEQ ID NO: 51870 - DNA, 780 bp, Bovine  19866881225356
atttgttacataggccaccacaataggagagttacctcagtctaacaacctcccttgtttaacaggagagatacactctgtgtgtctatgaattaactactatacacatgcacacacagaaagaagtacaaacaatccatttctatcttcaaatagaaataaaatggggctgactttttcaaaagaaaatcaaatgcttaacaaagttaagttgatatgtaaatagaacacaaagtcttttttttggcagtcatcagctgtaattaatttaatgccatgtatttagcacaaaattgtgtaacatttttataggatagatcttcaaatagtagattctttccttctatattccaatggcttggttagtcacataatcatttaaacaaagggcatttatcctgctctgcctaggaaagcatccacatttggcaatccaaaatcaaatgttgtgaagattacccttccacatacagcgagatgtgacaatttagaaagacaatgggcatgttaatctattcaacggagtttcaaagttagtagcatttgaaagaataaataaaatcataaaatctacagctgttgagacagatgagccaacaaggggaccagttatccattcacttctctttagcaaagaacaattcctttgccagtgggttagatcttccttattgtcttatttatgttgactgtaaagaaggcagaacgccaaagaattgatgctgttgaactgtggtgcggaagagactcctaaaagtccctggacttcaagaatcaaac

SEQ ID NO: 51871 - DNA, 952 bp, Bovine  19866881254510
atgaagaacttttttaaatgcaagccagtctaggtctctcgggtgacacaggaagtttaagtattgcaaagtgcaactcactgagctaaggggcataaggataaacttctactttaagaatatggactctaatgctaaattgcctggaatttaatcctagctgcttgatttactagctgtaaattgaccttggccatagtcttcaacctctctgttacagattttttcacctgtaaaacaggacagtaatgcttttcaattcacaaactagttgaaaaaaataaataagtgaatacatgaaaaataatgtgaagagtctgacatagactgcatataatgtacaatcatgaaaagccaacacacttattttgttccattatttttattttcaagactgctggcaactcgaagtcattgtaagttccaaaggctttctgtataaaagacatataaggagatctttttgtatttagttaatgccttgggcttgatttattactccttctgccactgaccatcctgtgagatggtacagtctccccattgtactcagcttcgttgtcacgtgtatgactcaaactctaaatcttgagtcttaactgggctgctctagcaatttccatcagtttaacttcatgtatttgagacttttggtaaccaggtcctgtagccactttttaatttaatctccagggaattcttggcttttatattccaaacaacttggagcaggggtgttcttatgataagaagtaagtatttctaatgtgaagaatactttccatgggttctcacattgtgggcagtatcctcccaccccaccttctgatatagttatcagggtctgaatgcagctttcaaatcaattccgtatttaactactcttaattctatgctgttagtaccagaatagtgatttatcactgagcagaaatccatttaatgatgtcaa

SEQ ID NO: 51872 - DNA, 1427 bp, Bovine  19866881268317
tatttatgcttatctggatacttttctgataagaatcccagggcttggtgtgacatttaaagtcagaaggacattcctgatatttatgaactgtgtaaccttgagcaactgaacagtcctcaaagagccttatatatggacaagaatcatatctacttaaagaggtgttatgagggtaaatgagaaagtactcaaaaaggcattataaacagatattacactttgaggtcttaccattactaaaaaaggaccacaatctctagtctaagctcttggtgtcaaacagttcagaattcaaaacttagagtttagaaatataatattgagcccatattccatattatatagcactgacatgaatagttcaatatttttttaatattaagacatagttttaaaatagtgcagttgatttacatcctctcagttcatgtcctgccacacagtgagtaggtcagatcagatttcacactaacaagttacaataatgtattattgaaagacttgggattttagaatggaagtttactatgtatattataggagatggtatatattaaatgcctagcaaacatctggctgtctccttggtgcatattaaatgcttatcccttcttgagctttctcttttgtgtcccctaatccacagcccgtctctcgtttccccagtgacacggctgggcttccatccctcagcctccttatagcaaaactgtactgttcagtcctagttcaaacagagcattggactttcaaacagcttttcctctatgagattttctccttttcctaaatactctcatctttctccccccatctcccatttccctttctatgaatgtttttacttctcgacatgttgttatttaaaatgtctctggcaattatgagggcttccgtggtgactcagagagtaaagagtctgcctgcaacacgggagacctggattcaatccctgggtcgtgaaaatcccatggagaaggaaatagcaacccactccagtatttttgcctggagaattccatggacagaggagtctggagggctacagtccatggggtggaaagagtgacactgccaaagcgacaacatattaaacacccaggccaggttcccttacatttctttcctttcttaaaacaacgaagtcctggtgaacccagttttgtaggcatgtccacttcttcttccaattctgaaaggtttttggatgcacctcatggcttgcaggatcttagttccctggaatccaaccccagccccctgaagtgcaagtgcagaatcctaacccctgcaccgccaggaaattccctgagagaggttgttttcgagaagcttttgtgtccttctgtttccacatggttctgtctctcccaagggcatccatactgggtatgagcaggaccccagaacccatttcttcctca

SEQ ID NO: 51873 - DNA, 1025 bp, Bovine  19866881315747
atcacaagaatagcctttttaggatgtccctgttggtgcagtggataggaatctgcttgccagtgcagaggacacgggttctatccccagcctgggaagttccatatgccacagagcaactaagtctgtgcaccacaactcctgagcctgtgctctagagtccgtgttctgcaacaagagaagccactgcagtgagaagcccctgaccacaacaaagaatagcccttactctttgcacctacagaaagcccacgcacagctgccaggacccagggcaaccaaaaacaaagcaaggatttgcaaaaagaaaaaaatagttttttaaaataaaagaatgcctaacacatattagctgttattaccatttgtacatgtattatttcatgaaatctttgcaaaaacttaactgaataataattgttattctccctgagtcttatcctgttatttaacctctctatatattgcagaggtgagatttgaactgaattgaaatccagcctagggtcttaaccactaagcccaacttttgaagttaacattgtatgggagagaacagggtggagcagaagatgctctatctcttgctttgtaaagctattcctttgctgtttagagaatccttttgaattcacgtttctctcagcttaactgtggcacacatcattaggcttaaataggtaaactattttttatatgctttttttggcaaaatcagatgttgtattagataccttcaaaggcatttgtgagcagtgcacatttgatatctctgtatctgtattgatgggctctttgactacttaatgttttaaggtaattaaaccacaaaaactcattgaaataatgtttggggctgacttaaactcttaaaagccattagctgttaactgccaagttgctctgagtctctgtctgcatgaaattgaatcatatttgagagggtttgtaggctagtggcaagattcataaaaccctgacagttttacatctttcatcacaaaccaggaaatcagaggaaggga

SEQ ID NO: 51874 - DNA, 805 bp, Bovine  19866881450651
ctaggaactgcaggacacacggaatgtattcaatgtatatatcttaaagaggatatagtaaaatactctcaaaataaaaaggaaaattaactgttatgcattctgcttctttctttgttcatttgtgaattttccaccattcattattaacttcaatatatgaagattttcagtcatgtaggagtcaccaaattggcattttccatgacaatctgctttacttagcacctaactgtgtctaaggagggcatatattcttcttttcaatatttatataagtccaatgcaaacaccaaaccaactcacttttatttagtattcaaggctaagtgaaatgtttctcaaattcctttttaatggtttcatttttattcagttatctctacgtgatttagttatatgtctttttagaacagtattccaagggtaatattttataagtccaaggatatctaaaagaaaagcatccatgaattcttaactttaagatctgtgacatatttaactatgaaaacattctaggtggcattgaaaaacctaatgcatctaaagaatctctgttgatttcagcacagcgttactttaatgactaatttcataaatagcacttgtgtcactgaaccatgaaactgtaaatctctttccttccattagtctctttgataaaaatggttgaatagccttataagtttacaaattatatcaacaacattcagaatttattttatcttgatggaatcaattcaataaataaagtataattctagtcaatgacattttgtatcagcattttaaattcttcagt

SEQ ID NO: 51875 - DNA, 785 bp, Bovine  19866880531200
tttatctttcccttgcaaagtctgacagacttatattccaagagtatttgtattctaaatcttgggttttacttaatgtatatgcctcagaagagcaggtgttttcaaccacgtgcggaaaagctgaccctgaaattgtgtgtgctatctcataatttttatggatggttatcataggatttttgtactggacaaagatcagtttaaaacaagtagaggtaaatgcaattaaatacagcttgttattaagtggtatccactttatgtcaaatcttgtcctccaaaatatttaaagtacataactataaaaacttgataagctgttcacctgaagagaaagcaatcatattatatacggattaataaatgcaagaaacaagaaagtgtgaagtagaatgaaaggtcaggaatcagggagagagaagaaagacagcaatggtaggcaggaagcaaaatattatgcaaaacagataaagaataaaagaatttcaacaaaatgatgcattgttactccttagttgtctggtctcttttccccagttttaaaaacattaatatttgtgatcacattaaaattttaaaattctacatcactgttcttacatatatattaataagaccctttctctccttatttcttccttaccaccagttttgccagccaggaaatactcttagaaaactacatctgtgtggatagatggagcaaaggaagagagagaaggaggaatagtatatatatatatatatatatatacacacatacatgtatatataaccaggca

SEQ ID NO: 51876 - DNA, 2949 bp, Bovine  19866880555447
cccactccagtattcttgcctgagaatccccatggacagaggagcctagccagctacagttcatgaggttgcaaagagtcagacacaactgagcaactatccacaacacaagataaggtgttgatagaaatggatctggatggctttaggagatagaaataacctattcatgccagctggggctgtcagcacatgtgagatgaggtacaacaggacatgagaagaggaacagaactgagtcctctagaatctgaatagctaagccaggagttgaacagtggaaatagatcctgtgattggtatcagagattcattcttacatcagtcataggagacagaatggacccacaacccctggtagatatgacacatcattgaacaagagggagataatgtcacataagtggtcttagaagatgttcagttataaatggtaatggatagaaaatatgaattacctttcattgtaaaatgggacaagattgataaaaacaggtctggttcttctatggacaacagaagacttagcagtttgaaggagtagtgatattgtcaatggatatctactttgataaactaaagtgaatcagggaatatgtcatagtactgatggaggaagaaaagggggactggaaaagacagaaggaaagggaggtcttctgagcattgtttgcttaaagttcatagaaaagctcattttaaaaatatactttaatgaataaaataatacttctttccacatatcagactcagaaaaaataataagtcttaggtgaggcagccatttaaaatacaagacctttgcatgttatcaatacctttgcatgtttatacagaagacattaaatttcagttgtttttttggtctggaaaacattcctatcatgttggaagtcaattttacatgagtcaagtttctgcatatttaagtactgacagtttttctcccttcaaagcaaatagtggataatttactcaaagtctattataaaaggttgagtttcccaaaacttggcatttcttcattgtgacacaaacctcctgcatggacagtatccacctaggtcacttgatatcactcacctatatgggacttggaggtcaaatgaaaactgaaggaaacatgaagctcatatttcttgctatgccatgagtaagacctttgtctcagacacagtagtcatgaaactggcaggctaacctgtaaacttggaagtaggataaaatctcagacctttcctggttcttgacaattctagcattatgtatctgaaaatctaatctgagttcagtaaacactttgtttttgttgctgttgatcagttgctaaatcttgtccaactctttacaactgtagctgccaggctcctctgtcctccactatctccctggtgttgctcaatttcatgatccattaagtcggtgatactctctaatcatctcatcctctactgccccccttctccatttgtcttcaatctttcccagcatcagggtcttttctaataagctggttcttcacatacagggccaaaaaggggcttcagcaacagtccgtccaatgaatattcaggctcgatttcctttagaattaactggtttgatcaacttgcagttcaagggactctcaagacttacacttcacttacctgtaaaatgtattgttagcaggctcttgacatggtaggatgtaaccaccacggacatgtaggtttatttcatataaaggagctgcaaatgtatgaaatgtttctctgacaccaatatctttgccctggaaatgggacagttgcaagaaaagaacagaagcaataaaagaatcatcagcaatactggtacttgagggggcacatttatataatcaaataatatactttttaattaaaaaaataaaaccacacacatttattcaggaagttatgttggttaaaggataaaccactttattccttagtttatttatagctttgaaattaacttaccactattttttgtagtatgcacatgcagaaaatacatgggtgtttgatgggtcgcaaaagctattcttgacttgtcacatatattattcttggaaggaatgcattactgttaacaatcttcttgcatacttaatgaaaggcaatgacctttttgtgcacaatgtacaattttgaaatttatttagtaaaataaatccatgactatataacaatctatggcacaaaaaattaactctctcactgtttgttaatttgattcagatataattagtaagaaacaatcttactctttttaaatggaaaggaaaataaatatgtcattattaaaaaggctataatcaagatgttactcatttatattttgtcagtcccccagaattctttaattacttactgtatggtaatcaaaccaccgagcattagggacatagccttctacagtgtcaacgtactggaatttaaaaatatagtcattaaaaacatatataccaaagaatattattttgtgaacaaaaatatgtgatgggacttacaggttccaatacaggagtaaccataaatgctggaccccacagaaactgtttgaatatatcccaggttggtttttcatttaaaaacctggataaaatatatacaaagttaaatcaaagacatttagctcttctaaatacaataaaataattattaaaatcatattttgaactatggacttttgtggattgaaatgcaaatcaaactataaaagatcaaaaacaatttcatcacttggaattcaatatgtgaaagtcattcagtcatgtccaactctttgtgaccttatggactatacagtccatggaattctccaggccagaatactggagtgggtagctattcccttttccaggggatcttcccaacccagggattgaacccaggtctccggcattgcaggcagattcttcaccagctgagccaccaaggaagt

SEQ ID NO: 51877 - DNA, 4133 bp, Bovine  19866880619378
catttaatgtttgggataatgctctgcatatgaatacttgtatgcctaaaggacaatgatgataggtgtcctctgaaatttacatataaaatcatgagtatatgaaatcatactcaaagtgattcttttttaaaagattcagctgccatttttttgtttttgattgtggctgggcaagagtggaaaggcaagaagtgacaactaataaagagtttagataaagctaaaccagggaaactcatttttaaaacttagaaataagaataaggaggcctggaaaagcccctcttgtagttaccttgtgaagcatgcagcaccctgctctggattctctgcagaaggaaatagtcagaagagcacaggtgatgtaggtcatttgtctgaattacttgctaaggcagactttgataataactttctaatatttaaatgacacatattaaaagaaccatgtgattctagtgatattctaagtctctactaagatcaagcaaaaggatgtgggcctgtgtagcagcaagagagatttcagaaagagtttaggtaagaatttcacaacaatgcaagtagctatacatggtgatgaataagcaagggaagttatagcatagtttctttgaaagtgttttgatattgaagagattctgatatcatcctgaaaatcacttcttaagcttttctttagccctctaagattttaagattatatgttaagggccaattcaaaaacacaactatagagaactggttattttaaaccagaaaaagtctattggtaaactaagaatatcacttcttatgagtcaaatatctagccttcattcaggtttttatttggtaatataccaataaaattgcttggaacaactgaaaatttttctttagctgaaggtacaacaaagaatttaatactttcaataacaatttttaaagaaactgtcaggcagcttactaattcctgagggaaaaaaccacaattttaaagaacactggtgttacatataacatcaatacacaaaatagaaaaaaacaaatgtcctaaaatctttggtatcatttcaaagagttagtaatatatgtgtcccataaaaatatgttttaaaagttaaaaaatatttcaatctggtattaaagataatgacaatatgggtttaaaagtaactcattcaagaactttttcttacaaaccctcattgaatgaatcgagaaccctgtcttccaggagctcctcatgtagctgctgctaagtcacttcagtcgagtacgactctgtgcgaccccatagacggcagcccaccaggctccctcgtccctgggattctccaggagaaaacattggatagggttgccatttccttctccaatgcatgaaagtaaaaagtgaaaagtgcagtcgctcagtcgtgtccgactcttagcgaccccatggactgcagcctaccaggctcctccgtccatgggcttttgcaggcaagagtactggagtggggtgccattgccttttcccctcatgtggcaggcaagaccaattttatcaattactactcaatatgaaaggctggaaaaactccaatggatatgcagagaaggtaaaacctaatcttaaaataccacattttctataagtcaaatcaaaaaaatcaaattagatttttcagtttaggtagtgtatgtctgattatgatacatagacatcaaagatccaatgcatttactttaaaaatcaacattctttaaagcatatcccaccaacttcaataaaactttactgtctaccatttctgttagtcaactgagttttatttttgcttttgatttcaggctcctttactgtgttttgtatttcaaatgacctacctaggaaaatgaggccttcaagccctgagctggttttatatcctgacagtttccagacatgctatgctctccctgggggctggaagatctcaggagaaggctccatctattttcaactaatatctgacaactgtcaaatttctgtgtctcattttaaacttttcatcctcccttcagcctcatttttctagttgcctatatctctgcttgccacttaataaaatatcatcaaaatcaccaagggaacttgttaaaaacaaaaacagtgacccataacagactgaatctcctggattcatgcgtgggaatttggattaacaagccttttgccagcccctcaattcccaggggattaccaagttctatcagtgtgaaagagtactttatgacatatcagtctcattgctaacactgagcctcaggacatatattttaagatctcagttccatataattttcaaactaatcatcacaataattctatgcagtgagaatcattgcttctatgttacacaaaatgaaacagaggctcaaagaaattaagtattatgtggagctatgaacactgccagcatgctgtgtagactgtatggtaggatgaaaaagataaagggccgaaaagtgagccttatatttgaatcctggcaatgatactacccagagggcttcccaggtggcactagtggtaaagaacccgcttgccagtgcaggaaactaaagagacatgggttcaatccctgggtggggaaaatctcctggagaggagcatggcaacccatttcagtatccttgcctggaaaacaccatggacagagaagaatggagagctacagttcacggggccgccaagagtcggacgtgactgagcgacttagcacgcacacgcgtaatgatactacagcagcctgatcttgtcattcgaccttgttgagcccaggtaaatcacaggaaagtggtgattacaatactgacctttataacttatagcataccaagatcactttagaaacgttaatccatttccatctacaattccatttttttcctttttcaatctccttaagcatgagcccattttaaaagtcttcttttagcttctttacttatgagtagaaatgcattaccactttttaacaaccttatgttaatgagtcatctaaatatgattatttgggaggtacatctgttatgtaaaccaccataacaagcctgtttaaataggctaaaattggaaacaatagaatttccaaaattaggagactatcaaagaaagagaaattattaattaaaattataaggtgagccacacagtttaataatatacaagcactaaatattataatttttagagaactgctgtcaaaataataggcataaaataagatgtgaattatattacattatttcatttgaaactgtatgtacacatgcatgtgtatacataaacatatatattggcacttttctcaaaagataggaaatatatcaatgtagtaatagtagttatctttgggtttagtaattatgtattacttttgttttcttctttgtagctttttctgattttacacattttctataaaatatgtgtacattttacagagagaaaaagtaaacattattaaaataaaatttataagtaagttcagttcagtcactcagtcatgtctgattctttgtgaccccacagactgaagcatgctgggcttccctgtccatcaacaactttatttatttataaataaaacaaaaaatgcttcaaaatattagaataggccatgcagtcacttgcttctttttatcctggcatccacaacaaaaatacatttcttacaagggtttctttagtttctgttatacccaatactgtaaaatacttaataaaagataaagatcttctctcagattacacacattaattttcctctgaccatatttggcttccatgagaattctacaaataaaatatctgcaacagaaggctctgaaatcagggaacaaactgttcttaactgtgtgggataatttttcatttacatgagaatcagccttcccaaaataaaatggcagtattcgctctcttctgggcactgttcttttccttttttttttttttttttaaattatcctctctgtgaccttaggcaagtaatttaacctttctgtgtctctatttcttatatagaatagaatgataatagtatcaacttgataagccttttcatttgaggattaaatcagttaatgtttagaaagcccagaagaaaatgatcata

SEQ ID NO: 51878 - DNA, 1222 bp, Bovine  19866880666111
aattactgagggacagagagattaagctacttacctctatctcttgggtagttattaaagaaaatggaactttggtcccctcttcaagaaattttgtactaaaacttattatcgaattctggatgaaagatgtttggcaaatatatcatttttagaatcatgactttcccttcattttcaattattttagcatatcttctgagaaaactgggcagactgttctaatagcaagacagtggtaattggagtccacatttagttggatgtcacagaactggacttacattggcaaatatttaatcatctgtcagcctcttgttggtgactttgagctaatcaatatccagtcatgcatttatgccagctgtattcagttcagtttcaaccatgggcctgattctatttagattggctttgagtctgttctactctgcccacttattatcactattgagtattgcttattactttagttttctgaattttctttgtccccttattaggctctcttattcaatgctaagtcaaaatacttaaaaataaataaataaataaaaatctggtcatacctacaaagcagcaaaagcccaatttcaaagatgtaactcacaaattaagatttaggattatagaatttaaaataactgtggaggtctactcagaaccaccatgcatgcttgctcagtcctttctgactttttgcaacctcatggactgtagcctgccagttccttctatacatgagatttcccaggcaagatcaccagagtgggttgtcatttccttctccaagggaccttcctgacccaggggtcaaacccatgtcaaaccccatatctcctgcattacaggtggattctttgctgctttgccatggggcttccctgatggcttagcagtaaagagtctgcttaccaatgtaggagatgtgggttcaatccctggatcagtaagatcccctggaggagggtgtagcaactcattccagtattcttgcctgggaaatcctgtgagcagaggagcctggtgggccacaatctgcaatctagacagacctgaggttcttttagggatgcttcaagatcaaaaccaatttttttaaaataatttaaggttttatttcctttatactttcattctcacttgaatatgtagtgaaatttaacagaagctatctgactgaatgccacagatatgctccactgccttctattaagccaat

SEQ ID NO: 51879 - DNA, 1163 bp, Bovine  19866880714830
cctaggttccttcattcttttgattaatttgggtttctcatatttcctatcagtaaatctctttggcctgattcaatgcagcattatccttcattagggagtcggatttcatgctatcagagaacactgtggtagaaagagaccttagagatcatttgcccagtcctttcattttagagattaaaaagggattttagaaagatgctgctttttgaaaaacctcttttgttctgattaaagtttatccttttctggtacacttaaataattttcttatatcttctttacataaacaatcttactattatataaggccagctaactggtgttgtacttcaatcaggcattacaaggttgagaaaagaaagaaaataacattttttgttgttttaagtttcacacactataatacataaattacacctacatgttatagctttaccctaaagttctcaattatgaccaaataattcctatcacatcttatctcttctttgtccattttatattttatgttatgtagaggggagaaagatacctgggaaaagtcattttagtggcattgctgagaataaaaggacatttcagcattttttctgatcattaaaaataatgcaaaatatcaggaataaaagaatataacaaaataatagtgactcattatgtcaccatccagaggttgaatatcttgaagcatttctgttttgtctttttgctgtacatttttctccacatgcatagatgtatgtatgtatgtattttaatttgggagcctggatgctctcttaaaagacaatttaccattttttttgttcggatgtaacacaccaaggataagctggcaactaaaatctcaataatttctacttctgtgtctatcattaattcatagctcaactcaagcagaagggaagttacttagaaaaagtaaaagaaaactacaccccattttgatcctggaaaaactgtagaaattaggagaaatgctttgctgaagaaagcagcaacagtaggaatttctcccctgactacttattcaatcactggtaaagggtaatgcaaggcgtgttgtaaataatctagagttaaatgtgatagaaaggagagaacctttgaaatttagctttctaaattttgactttaaaaatttactttaagttttt

SEQ ID NO: 51880 - DNA, 3005 bp, Bovine  19866880719579
attatgctagtcaggatgcaaaagtagactaatgtgccaaaatacactatattcactagtgcatttcttgtatcatgaaaatgaatattcattgtggaaaatgtgccaaatataggaaagaatacaattttacaaattaaattatccagaatgctaacatcttgagaaaactaccatcagtggtttagatgcattttgtagtttagttatagtttaaaacattgacctttttgtcttatttcctatatatgaaaatttaaaaaaacactttgaaaaatgtatacattaacatactacaattgtctagaattctacaagtcataaataacactcaatgtttttagtatatttattttatattatagtattatatgagcatatgtatttgtatactgaatattagttactgaaagaacatcattggtccgagattcaaaagagtatgaaaagggggctatatgtcagataatatcacatcttaagtgatttactattatttctcaattaaaatagaagcaacacagtggatcatgtaattcaatatgagttttaattatcaagaaaatcattagttaagtttattgtctattaagatggcttttatttattttcctaaggaaaccaataactgagagagacaaaacaaaaacttttggtttaataatgcactgagcctagtagctcaactgtatagtttccatattattagcaagtgcctaaagaataaagcactgtttcatttttaagcttctatcaattcagggaaaaacatttcatctgtactcttgacaaaaggagtaagcttaagagatattcgctgatataggggaaggaaaaacaaagaaacagataaaggtagtaccatagcattaagcttcacattttaagctgtaggatttatttttgtctttagactctaaacagaataagcagttagttttgttaatctatcaataccatattttttcattttaaattgtaaattgttatctacttcctgattttttgttggagttacactcaaaacatttttatgtttaagatttattattaaaatcactgtggatggtgactgcagccacaaaataaaatgatgctttctccttggaagaaaagctactacaaagctagacattaagctatttcaaagctagatattaaaaagcagagatacagctttgctgacaaaggtccatgtagtcaaagctatagtttttccagtagtcatatatgcatgtgagagttggaccataaagaaggctgagggccaaagaattgatgcttttgaactgtggtactggaacagactcttgagagttccttatacagccaggagataaaactagtcaatcctaaagaaaatcaactttgaatattcattggaaggactgatgctgaaactgaagctacagtaccttggccacctaatgcaaagagccgactcactggaaaagaccctcatcctgggaaagattgagggcaagaggcgaagggggtgacacatgatgagatggttagataacatcattgactcaatggacatgagtttgaacaaactctgagagagagtgaaagaaagagaagcctggtgtgctccagtccatggcatcccaaagagtcagaaacaacttagtggctgaataacaattagtgccatttgtttctgagcccatacatatctggggtaagtcttttaattttctgcatgaatgggaaatgaaagagcataatatttcttattcttaacattttattttaaaatcctatcatattactccatattttctgccgagaagtgttctgaaacaagttatttacttctttttctttatgaatgactctcagatttatttctttataaattaaaaatttgctaggggcttcccaggtggcattagtgggtaaagaaccctcatgcaaatgcaggaggcttaatagacatgggtttggtccctgggtcagaaagatcccatggaggtggaaatagcaatctactccagtattcttgcctggggaatcccatggacaaaggagcctagtgggctttgtaggatctatggggttgccaagagttggacacaactgaagtgactgagcacagcacaagctatattaggttaaagtcttctattctttatttttctttagaaggttgtaatggtttggatctgcattctcagttctctttaatctaaagtacttttatggttaatttatgatatagtttattgtttctgccttagtttatttcatttccttcttggaaacatcttccatgttctctcttgattttccttgctctagggcatgggagatgcaagttcttgtgtgatctccttactacttaatttctcaggtcatagaatctgggcttctctgatggctcagaggtaaagaatctgcctgcaatgcaggagtcacagagacacaggttcagtcgttgggtggtgaagttcccctagaggagagcatggcaactcacttcagtattcttgcctggaaaatcccatggacagaggagcctggtgggctacagtccatagggttgcaaagagtcggacacgactgaagtgacttagcacacatagaatctactttctctttctctggctgcttagacttggtttctgactacagggattgatttagacctcttgagacatttttacattctttctgttacctggaacatgtgtcttattttatactcttctaattctcactggtgttatttctaaacttgttacttccctctcactctccattcttaaaaggaaaccaaacagtttttaaacattcttcaatatgtattttgaacagattttgaagctacaccaataataattataaaataacctgagcctttcccaacaaaatgaggatatcaaatatattttgttccttaactttagtaatgctaattagaggtttcataatgtcttttgctccctctactgtttgttacattatgtattggactttggaaagtgttagataccattttg

SEQ ID NO: 51881 - DNA, 3054 bp, Bovine  19866880758730
atatttattgtgcaccaattacgtatcaagttgcaagtgaggctctaaagaagagatggtcccaaatttaagcctaggcaaaatgtttaaggtctttatttccagataattattagtttgatatgatttatactatttaaactagttcatatgccagctgttgcaactagtagctgccattacatctaatgtataaagtaaaataataaattctccttaatattatgatctatatggaaagattacatgaagggaaagaaaaattatatatgtttatagtaaaatttgagttacatggtgatgatgtgtgttaacattggtataataaaaaatctatttaatatttaagtttaatagtgtaacatattttcgtaatttgaatacttgtgagacatttttcttggctatttgccttgaaaaaaattttttaaaatctccatgtttaccagttaacggtacacatgttaaattctctcccatttttaacatcaaaagtggcatcaggtacacatatacacaggggcttcccaggtggctcaatggtaaagaatctgcctgtaaatgcaggaaccacaggtgatgcaggttcaatcttgggttgggaagatcccctagaggaggaaatggcagcccactccatattcttgcctggagaatcccatgggtagaggagcctagcaggctacagtccatggagtcgcaaagactcagacatgactgagctacagagcacacatacatacacacatacatacgtgtacacacccatacacatgcatatatgttataaaaatgatagttcaacaggaactgagcattttggagtgtcattacctaacagaatctgaagtatgtgtgacttttgatataaacatcacaaaatgggaatacacacatatacaccttcactcattgaccttttaatcccatacaagttataatgactaaggaagagtcatttagggttaagtgaatccatttatttacacttaatttgctccagttgaattccttctccccaaataataaaaaaataaatggtttttaaaattaagaaaaatagttacaagaatcaatattactttattttccacagattcttcttgttcatgtcattatcacaaacaatttaatagagtgtagatattctttcttaaaagttatatatttatcaaaggtcacacttttaagcagtagtttgagaggatagaatttcataaagaattataaatttaacaatagatttttaagtatgtaaaatattaactggctattttgaattgaagtacagaaaagcaggctcagtaatttccattatctctcatctgtgcatacataaataaaaataaatgtggcctaataaatggctatacttttaaaatatgaatatatccaatattgaataattgtcttaatataattatcatactatatatctattcatagatatataaaatactttggctgcagacctgtgtgggagatcgttctggaatgcagtttattctgtggttgataggatcgttcagtacacttgggcatgtgcctcgggttgaatcactgatttctgagacagaaacaggtcaataaaacaaaacatggttttaaatttacttttcaaattttcaagtaacaaatacatttaaagtaaatacaaatatatatatatataatgaaaattaaacttaacttaaaaaaaaccctacaaattgaattcctaattaccgaaaggaaatgatccaaaagccctttgactgttccttaagagaatcaaagtatattcacagaaggtcttaaaagacagactcaaaaggaaacaaaatgttttctgcaccatactcataaactgtgttttagagatgaagaaagaagatggagaaatatgtatgggaaatatatatggagagaggatgcagagaaggagacaagaattagagaagaaaaaaagtttaggaggaagaagatacttaaacagaagagaaagaagagaatagcaaagaaaagcaaaacctcaactctatataataaagagggactttctaacaaccagagatgaggaagataaatttgattgcttcataatagagcaagctttcagtttactagaagaatatgaaacaagaggcagcagaaaacactaactactgttagactagaaaataatttgcagtacattttccacttctgatttaattaggcgagaatgacgaagaaagaacaagtagatcaggtggatgaaagtagcatgcgttaactctaaattaggatataaatattcaggaaaaaatggtaaacacttcaagcctgtttcacctactctctgtttctctcatatgacctcactccttaaaaaaaaaaaaagtctatgacaaagatgttatccccttaaatttcctaaccccgcttgcaagtgctgaaagctagagtaaaacccgactaatgagatttcccactagttagaagaacctcactggtaactacagaagattactgtgctgtttattaatattttgtttcttttgcctattttctagttctaaaaaaaggccattaatatcaaagcatatgaatttcttaattgcaatgacacttcattgaaatatctgtaatataatggctagaaaaagttggagtaactgtaacttacctgagatctttctttaagtatttcatctcatatagatctcatatagattataaactacttttcaagatccataattattatagagtaaactttatctcaacctcactataatgtataagtattttcaatattatttaccttcaacagcaggtgtcttagttgctaaaacaacaattagggcaatagctattattgtaactatagcaaagaggacaatcagagtaatttctaatccagaaaatttctgctttgccatctaaagaaagaaaaagaatatacatttgaaatgtagaatatataataaatgaccataattatcataaaattatatattttttctactaagcataatgcaagcagagctgcagacagctctaacagtttataatctaaaataatgcacattt

SEQ ID NO: 51882 - DNA, 1205 bp, Bovine  19866880778884
aaattttggataaagtgctatattgaagagactacattttcctgtatgattaaaactgttttctactcttcattgcatttctttctttatgagaaacatctgtttgaaaatatggcataacagaaactttcttgttgaattgaatcactaggtaaatatatagctacagaagaagaaagtagaaaagagacaaaatataaagaatgttgtggagttaatttcccatagaattctttatcggttgaagattgtcagcctaaaagatgtactaactttcctaatgctatggttcaagggttttattccaatatgcctttaaaaactttccttggagcatttatagtactttccgtcttcaaaatagtttaaaactgtcaactagctagtcctcacaacatccttttgaggcaggtaaccattattattcccattttacacttgggaaaaaagggtaaaacgattaaaaaagaatagtgactcagccagaactttgtagctgaattctagcctattacacagtcctatccttcaccaaggttttcttttaatagctacccttgtaatcatgttggtttaattaagtcaaatattcagtaagtagtagctgagcaggaactcaatacaacatttagtttctagatgaatttgatcttacatccacaaaaatatgataaactaatatacacatgtgcatttgtgcacacatacagagacacacctatgtgagtatatgtgtgtacgctgtgtgtgtgagatggcagtgatgcaaaatttaaatgaatatatttgattatccatagcaatatattttaacctgcatgaggaagatgcagtgattcaagagagagatatcctctacttaaatattatcaatgaaaggggccatttactaggtgtcattcagatcacctctaaaagcatattgcaaacatcttcctctttatctccagtcttacaactctagatgccaattattactctgctgccaaaggcaacatctcttaaatcttcctatatgtatctgccaaaattattttccaacatccaaacttgactatatagttttccttgtttaaaattcttcaaagtctcattaaaagtctctatgacagatggacccttcttcagtagccctggtgatttttgttatcaaacttagaaaaaatggatctcgaagaataagatctaacttgcattcactgaaa

SEQ ID NO: 51883 - DNA, 3085 bp, Bovine  19866880919936
taattttatgtattttatttaatgtgaagatttttgttttttatacgagcccatatatgtacacatgcatgtgtttataacataatacatactgagtcatcatcacttaaacaaatgtgaataatgattagaaaaactagctttataagccatatcattgtgtctttagtgaaataaaagagatctaagttcagttcagttcatttcagttcagtcactcagtcatgtccaactctttgtgaccccatgaatcgtagcacgccaggcctccttatccatcaccatctcccagagttcactcaaactcacgtccatctaggtggtgatgccatccagccatctcatcctctgtcatccccttttcctcctgcccccttttcctcctgcccccaatccctcccagcatgagtcttttccaatgagtcaactctttgcgtgaggtggccaaaatactggagtttcagctttagcatcattccttccaaagaacacccagggctgatctcttttagaatggactggttggatcttcttgcagtccaagggactctcaagagtcttctccaacaccacagttcaaaagcatcaattcttcggtactcagctttcttccttttaatcattaaatttataatagaaattctttggactttagggttgatgtgattaaaggattctttcagtactgtttattgaaatatactctgataatttttaggatacacaaatcactgatattgactatatggaagacaagaaaatctttacttatgatcaagttacctttaacggcctcccagaatttgttcaagatttgcatgctcatgggcagaaatacgtcatcatcttggtaataactgaacatatatattaatttttagtatttacacatttgaaaattaattgattttctagtttcttctctctattaattaggatcctgcagtttccatagagaaacgtgcgaatggggcagcatatgaatcctatgataggggaactgcccaaaaggtgtgggtaaatgagtcagatgggactacagcaattattggagaggtaaattatgatattcattaaatttgtgttgcttggattttctattgtacaacaagtgtttctgagtgtgtgttgtgtatgtatgtgcatgtctcagagaatttgcttgctttcaaatctggatttgctattttaattgcatagagaagttttagggtaaatattccaattatctctaaaacagttcttgtaagaaggcagataatgtttaatgataagcaatgaaattatttatacaaatatgataaataccttgattacagcaattctcatatttgatgtaaaataattgcatgtataaatttagtacttacatgttggataataagatttatggtgtacatttatggtataatgattttacaataaaatcattagatatctataattaaagttatttttaatactttacatttgaaaaaaagccaatatgagatggctttaatgtttaaatttccttttccaattttaactttcctcatatcatggaactaataaagagcagtgtgaagaaaatgcccggttcccaaaggcataatttttaatcaagataaatattcttctagagacagcttaataagacatatcaaaacccataatgtgtagattgttgacctgataattccaatgctgtaatttagtcaagggaaatgaaacagcagaaaatatcaacttatagaaacatatttattatagctttatttacaacaataaagactatactaaccatcactttttatttaatcacattcaccaaagttaaaatttctgataaaaatgttcttaattatgagctccatcagggaaaaaaaaaaccaatattcctcccctaatatcattaatatcttaaaaaatacattttgttaagacctataccagggcttccctggtagctaagttggtaaagaatctgcctgcaaaacaggagtcccaggttcaatccctgggtcaggaagatcctctggagaaggaaatggtaacccactccagtattcttgcctggagcatcccatggacagaggaacctggtaggctacagtccatggggttacaagagtcagacacaacttagcatctaaaccactaccaagacctgttctattgaatatggacagatctgatcgctaatatgcataatttgaatataaaacaatattatatgtctcaatacatctgaaattgaatttatcttactaaatgtcgttattttacatggtaagtaaaataatatgaaggagcataaatcataaagaggcatctagtgtttaacagcatggaactggatatgagactgcttggatatgtgattggatataaggttccttctgtactacttattagcaagtgattttgaaaagctcctctgtttatcacttctttcatcagcaaaatgggtttaattatactacttacctcatctgtaaagtgatgataaaaatagtacctagttcctaaagttctagtgaagatttaatgaagtaataattaaaagcagttggagtagtcctaagaacatcataattgagtgactaagcacacacacacaaaaataaataaacacacaaagaaccttttagcttaaatttcttgggaacatatgcctttggaaatgcactaatataattcctcttatcacacagtgaatatgtctgtgctttcaagcagacctaagattattgtaaatgtaggtggtccagggatcacatatacctaaagaagtacaatgtcataactttaagaatttttactcttcctcttcactcagtctgaatttccattatttatgttttcttttacatttgtatatatgggaataatctgtttttctaggtatggccaggattaacagtataccctgatttcacaaatccaagctgcatagaatggtgggcaaatgaatgctacctttttcatcaacaagtaaattatgatggactttggattgtaagtagttattttagacttgtgattttggacaatgaacatagaattatttttccataaattaaatataagttcaatagatgta

SEQ ID NO: 51884 - DNA, 1430 bp, Bovine  19866880960260
aatatcaattaaggagaatccaaattgttttaggaaaataaaataagaggattttcctggcttccctgctggctcagatagtgaagaatctgcctgtaatgcagaagatctaggttcaatccctggcctggaaagatcctctggaaaagggaatggctacctattccagtatccttgcctgaagcattccctggagagaggagcctggtgggatatagtccatgggatcacagagagtcagatacaactgagtgactaacaagaatggaaagtatataaaccacaaatccttcatatttaatagaaaatatcatgcatatctttgatatcaaggattcacctactatagaaaatcagaagtgacctcatttataattaaaactatgttaaggttattaatgtatttatttatactttccatgataattctgcgattgaccattaaacataaagctatttcagtagcatgttttaatccttatgacttaagttatcttcatatttccatatataaataatttaattatcattggcagttgttaataagaatgtaaagagtagctagtagaaaattgcaaatcttctccttggattgagcaatacttaccatcttctgcctacaatatgcttatttctgaattaagtatctgcttccatgttcagtatacaaatcacttggtttaacagccttatactgccatggaaggattaattatgtttagctatctgccttttctgaacacaaatgttaaaggctgtactactatggaagtctcctaaaatatccaaaatatctaaagttcaaatctccatagcaactttatactttccgtgtaaagattttagcatgtcttagcaagtatgtatatatgtatttcagttcactgtcactgaattaaaatataagtagatcttattagcaacatgaaagtacggtttaacataatttcccaacatacttaaatgagattaagagaagcttcacaactttcattctaccctgtatatagagtttacccttgaacaacatatatccaagtaagcacagttcctctgcatccacagattcagccaagcacggactgagtggtactgtactatttactattgaaaaatatccacatataagtggactcatgtaatttaaacccatgttgttcaaaggttaactgtatacctaaatatcttatttactttacccatttacacacgcatacccacacacacacacacacacacacacacacacagaatggcctctctagtcctctttaataacaaggattcttcaaggcacaacttataactggtatccttcacgagactctcacttctcaggtgcaattatttttctcctctttaattgatatcaatataaagtattggaggagtactggagcagagcatggcaacccactccagtattcttg

SEQ ID NO: 51885 - DNA, 1217 bp, Bovine  19866881035745
gccttgaatgttccttaatctaatatcttgagtagtagaacaaagctgaaggcattaggtttcctgatttcagatatattccaaagctacagtagtgaaaagcatggtcttggcataaaaataaacatataggccaaccgcagagttaaagagcccagaaattgatccacacatgtatagttaactgatctttgataagagtgcaagaatatgcaatgaggaatgtagagtctctttagctaatggtgctggagaaactggatattcacatgcagaacagtgaaatctctaattattaaatctaagtgctgaatttcttttagttctacaattaatcaatatgaaacttacattagcagcttcatcttcagttagactttgatctattgtcacattaggcaaatctggccaaacctacaaaaagagaagaaatgagaaaccagttcaaaataaattcagtgtggtatgacttttgtaaataaagttttataagcaaataataaaaaataattccttcaattatttgcttagtttgtgttttggcatatgtatcatttggaaactgtttccattttccatattaatctttttaatatgacaaataaaaaaaatccaaccttggtgtaggtagtgattttgaaaacaatgcgtgtaaccaaattgtctagtcaacaattaatttgaaacacgtacaccaaatttaatttaatgtgatatattaaaattatttctacacttgctccaggataacacttgaaaaacaaaaatatatatagttttatatgaaaggaattgaatatctgagttgaatgatgccatactgaggcaaataatcctcttggttttcacagtagtactaaaatcctctcaccaccatattcctactccagtcactgcttcttagtctaccaatgtttcttctactccaatcacaaacacaaaacaggactcagattcaatcatgccaaaagctctgggatttaaatctatgttgtagaaagtagaatccacagaagggtaattacatataagagattagttgctgatagagaatagtgcttaaaaggtagtaaaatgaaaaaatgtacaaaaatatagaattagaagaaagtaggagggaaataatcccttttaataatcaatattctatacttgcacgtttcttaaacattggatttttcacctttaccacagaattttttctattttacctttat

SEQ ID NO: 51886 - DNA, 2272 bp, Bovine  19866881040249
atgtattaaagaaaagcttgtcatagatagagaacatattgtgaaaatgtatatttattgaattccaagatatctatatagaatcatagttatatccatagaatcagtgttatatttttaaacctcattcctggaagcactgcagatgtcagatcaatttggaatgctgaatagttcctctgggaatgacatggcagcaaccaaaatagtatttggccaaattaaaaatgtatgccagtgatgccaaaagtcacagtaacctggcaggtatgtagctattatttaactgcatgataattgttggtttttccactgaaaaactattggctgtttatgcagaaatggagcccatgacttaggcagtctctcttttgatgtcattggtaactggttggggattgtatccagttacaggacacaatctctcaagcaaactatttgggaagaagttttaataaattatatagtatctcacctacaaatggaaatgggagaatatctaattaaggactaattttcattatacatttttaataatcagaatgatgtccatattctgaaatgataacaaaaattttttattacaaattagcctgatcttagtgtttactgaagattctttcagttttaaatgtttattcataagaccactaataaaataaatattattgtaagtgattttctttgtatgttcatgggttgtagaactctcctctctcacctgcatgcttgtcttgtggtttatgttgctatttggaaagaattttgtgttcatagttcttaaaattccaaattggccaaagtggcccaagtgcctgaaaatgcagcatgtgttcttaagtttaggagaattagtaatatttataaatagtctcctctggatctacattattgtcgttttattggatagtactcaatgggcaatattataaagtgggacagtctgctgttttaaaagtgctggactttttccttttatcattcatggaagaatttcacactaaagacattacttcaaccttataaatacactatccaggaaaaagttgtatgaggatactttcatatttataaagtttggagtagtcaaatagtctcattaattatatatacagcgaatataatattaaatttgatctgtatttgtgacttgcctcttccaggtagagtgttagatcatgtcatttatcttcaatttaactctttaattgataactgtaatgatacttagcaatgaaatagtattattttaaataaatgcaaataattattacatcatcatcactgtcacctttatcatcaccaatttacatcatgattatcatcaaatttaatgttattgtggaagattccagaaccctcacactacaaacatatatatgaatttgaatccactgttcattgagttaaaaagtagaattcagaattaatatattatcaagaagcaaatacaattttggctattttctacctattctatgcttggacatgccaaaatttataaataactaacttggaaaaatgaaataagatacagaaagtatagattttggaggtgaaaatgtttaattcaaataaagtagattatcaggtgcttctaggctatttcatggccaagttgaaaacacagaaaaggctttgggcaatcacaaataaatgaatgctctatgctgaattttaactcctcaaaatatcttttaagtaatgttgttatatcagttatagaatctgacagagaaattacatttgctagagttattataataaatgaataatgatagaaaataaattataatataaaaattagttttgaaataaaatatactttatgccatttgtgctgaacaatgataatctaagataaaactagatcattaaagaattcagaaattctctaatatacaaatgaaagtatttttgatagattcaataatcagcattgtttacagcaaaacaaaaagttacacacatctggcaaataaaactgaatcctttatcatttgttataagtttaatgtttgccttgcatgttttctgactcttacattggttttgtgtggttttgcataaccatacatgacatattatgtactaaaatataaaatattaagcttgaatagttggtgaatagtccagttgctcattcattcatttaggaaacaaagatatcttagtatcctatggttcagttagcattgtacatagaaaactaatgtcacatcctttggtgtctcacagtctagataatggagggaagatttaaaaataatga

SEQ ID NO: 51887 - DNA, 1690 bp, Bovine  19866881086778
tgttttattaatattatctaatcttatttattatattttcatggtatattcactcatttgctttttggaagtagatggaatataaataagccaataccttgatttataaaagattacctcaatttataaattgccttgatttataaaaaaataagtcaattatatggaagcactctctgcagtatcatagacaaccaaaagtagagaaaaacttcctgacaatggaattttttattagtctttaagtgacttggtgtcattttaccactaattgattcggttcttgtgactgagcaaaccttcttttatttgcaaagaacagagttatatttatggtggcacattcatgtggcagatttggaagaatgtattattattccattttacttgggaaggcactaaaattcaggtgtttagttggtatcagtacctgcagcctctaagtaataaaatcagtgattgggacaagatactttgatgctaaatccatgtactttccacatcatgagtgcagataaattactcagctatgtttatactctaaaggctgataaagcacaggagaaatttcaagcagggaacccagaaaggtccaggagataaatattagagcagaatctacacatgacaagtataaatgaaccacatgcagcattgtagactggtaaattatatcgatggagctaaaacaaagtgtaatgattccagtcacccctgctgaatgggtgacctacatgataaacaaatagcaatggtaatacatctggataatgacaattcatttcaaagagttaaaatcaacaaatgcaatacttccctactctcagacactcagtatttgagaattcttagtttggagaattaccaacgtgtatttagtgagatgatagctattgcagtcatgaccaaaactaggaactttgttttatttcttactctcttacttactctctttgatcttactctcctcaaaaactccttcctcttctttacatgaaatatcataaacaaaacaataagagattcacacatgtaatacagttagggtattatatcttccctgaatatggtccagattaactttttatagttttatgtacatctgttatgtagctgtctcacattgcccaaccattcacatgtaactttctcatgcatacctgctctctaaactcaagggtgagacaataagtgaaatcaggtgaagtcatcattaaaattgtttggtctgtatttgagagttcagaaactttctgcctcactgaaatatttgttaagaaagtattgataagtaagtaaagtattgaataaagtattcaataagaaagtaatgatgtttagtcccatgatgtttagtttcccatgaggaaaaagtcattttctcttggggaaagtctcagtaattcatttggattttattttagtgggaacatggtactcagattggtaaattactcagactggtaatcttggaatcagaacagattaaataaactaaatttgtaatggaatcagtaaaaaatttcctgaaatatgaatttccactttaaaaataattgaagtcatttcagtgacactgggattcttttgggattgtgggtttagtcactaagccatgtctgactcttgtgaccccatgaactgtagccctccaaactcctctgtctataggattctctaagcaagaata

SEQ ID NO: 51888 - DNA, 1500 bp, Bovine  19866881180038
atagctttctttaaataattcaaaacaacctcttgaaattcaagccagaagttcaaatataaatatccgaaatgggatgctgtaaatactttcatttgcattcttggtttgaacaattcatgaatgacttggaaagtctatggcatggtaatttgcaactttgctgaaacaaattccagtcatacacctgctggaagtcttaaatgtggaaaagagacattcatctgggaactgagcctggtttaccacacagtatcaagaattcaatgcagtttccctcttttccacttgtgtctgctctcaaataaacaatagggggctgaaggttgttacttcaacttttcattgtcaatttgtatgtataaattttgaagatttgaattctgagggagatgggcttagagatttttatttcgtactaaaaattagaattaagtaaatgtctctctgaaaacaacacacatacatacacatacaacctgttgtgctggagctttatgctcatccaagggcaggttaaagcgtctgcctccaataagggagacccgggttcgatccctgggtcgggaagatcccttggagaagcaaacagtaacccactccagtatttttgcctggagaatcccatggacagagaagcctcataggctatagtccacagggttgcaagagtcggacactactgagcgacttaacctaacaagggcaaaatcaaaattaaaggggaaagtgatttttgttcccttgtcctagaagtaaagtaataaaatcttaaccttctttaacactttcttaatgataatctgagcaaaacattttaaaatgacaatttcaaataaaactgtagtgtggtaactactgtaattacaagtctatatatttttctaagatagtactacttataaaatcctaaaggacagaaagaatataaaagctaatgaagtttttatgctttgacactaacaacaaaattgaagtattcagtaagaaacagtttttggtgtctttctgtaatataaatattgagatctctagaatagtggtcatcaaatataaataatgctatttcttggtggtgtgattttgggtggttaaaatttcttagtatttttctgctttgctcaattaaaaaaaataatgcactatattttcttaaataatatacaattgaaaataaaaatcctttgtaatacttttaaatattatattggcattctaaagatttgttttattgtgaacttttatcattcactaaatttatagaaaacccaagtttcaaatcaattaagtttagtatgcaatcatttttggctggagtgagaatagggagaaagtgttcttaatgaataatctcttctaacatacattttcaagataaagctagacttaaaagatgcttactccttggaaggaaagttatgaccaacctagacagcatattaaaagcagagacattattttgtcaacaaaggtccatctagtcaaagcttggtttttcca

SEQ ID NO: 51889 - DNA, 1043 bp, Bovine  19866881218413
tatactgaggtgcttttttaaaattaccttttatatgatctataatgttctttctagaattttatttacatatactctattatatatagagagaagtgaacactatgaagatagcatatacaattttgatatcctggtatgctttgggaccaaatatgctttagaattaaaacttgatcacagttgtttaattatgataaaatttaaaatttattgatccagaattttttttgacttactattgaattataggtccttatacaatgcttgaaaaagtaagcaatccatatatgattatctcctttctctgctttgtatcatgctactttttcacacacaagcaaacacattttatagagaattacttgtgaaatactacatagaaaaccacattttaaatgaaatactctttaaaaaaaaatagtgacttgtccaaatagcaccattgtcttaagccagttatgagattcatgtttagaatacatgttcagacacaccaagctgaatcaaaatttagaaggataatttcagttcatgaattaaaaaaggatcacagttaagtacatatatcatgtaattcttaataattaagttttaaatatgtgaatatttaataaaagaggtgatgcttttatgtcctaatttttcacaatgaaaatagtatctttctttcctttcctacagttgttattatccactctatgtaaattaccaattacatttctagacaataaatattagagagtattctgaatgaaactgcacttacttctctgtagctatagacatactatatccatagaggctgtgtacatcatactgttttccccagtattgcatagcatccatgcaaattgttttggaatacatgagtttgtcaagaatatcttagaaaaaaaaaagaaagaaataattaggtaagaaatattttgccattttaagcttcataattcttaagtgatgtgctatgtaatactatatgtaatgaaaatataatgagagacatcactttatgctaagttccagtgggtctctacccttta

SEQ ID NO: 51890 - DNA, 1358 bp, Bovine  19866881423804
agttggacaggatttagcaactgaacaacaacaacagtaataatcatagatttctctcaatacatgtttcttactttaaaaaaaaatgttctgtatttgggtcaaagtacattatggatgaaactttgctatatagggcttccctggttgctcaggggtaaagaatccacctgccaatgcctgcaatgcaggagacatgggttcgattcctgtgttgggaagataccatggagaagaaaatggcaactcattccagtactctggcctgggaaatctcatgggcagaggagcctgggcaaagtataacccttggggtcacagagtcagacacgacttagcaactaaacaacaacaaattgctatataattacaaatattcaaatatataaaagaatctgtatgcacacacgtctctgtacatgtttctgtttcaatatccattggtccaaaacttagaaatgtaaataatatactaaattaaagatccttcaacactgaatcttaagaatttgtaaattttgagcataggtcagtagctactgcaacctctgctcccaaaatagtcattcatactataaagatgatctgaggaaaaattactctcatattttttctttgcagattgaagtcatttctatcaggaaaatataggagatcctcaatttattcttcctattcaactcatctcaggttcagaaatagtactatgggtatctatccacaatcagtgatttagaagaaattttaaaatataccaaagtcttgggagccttgtattataagagattctagtgatctaagagaattgatggtttcctaggtgagcaattttctgccaaaaagtatcttaagcataaaaagaaataaattccattggttataataataaatcacccacacaattttaaagtacttatctctctaaaaaaatatatacttgtttttttgccaactatttggaaatataaactacaaatgtctctggacttgggttcattttcttaaaacagaatttggcatcaatttttacattttctggtaaagcaatgtaggtttaaattagcatttccaactctaataatatgaatacattatattgatagtgctattagaatacagacaggaaaatggtagtctcattataactattcataaagataatgcatatcattttctagtatttgaggggagtatcttttgatatatgcatttgaattcaaggagatttatgtctgtataaggattatatcacaaccttttttatggttttggtctattgtatgaattttattgaagatattattttatggattataattcttttcataatgcattaacatttcaaataagaaacacat

SEQ ID NO: 51891 - DNA, 1298 bp, Bovine  19866881663262
tatattagtgcttgcaaaaggcaactggcaaaagaggaattattatttctcgttccacatatccctctgctggacgatggtcaggacactggcttggagacaactatgcaacatgggacaatttggaaaaatctatcattggtatgtgagagtcaccatctttctcattattcttttgaagtttgtattagctattcactgttgctagttcatatactttataagtcctttgaatatgcttttggcaccatgttctctgacaaatagcataatgaaaaagcagtgggccagaaagcaggatttagcttattttgagaaaataattttgtctcttttggtctcagtttccttttgtgaaagggcagaaatggaaagataacatatagaactaagaaaagaaatggatagaaattctagagtctagggaataagaatatcttgtagatgctaaagtatgaaacatctcaaacaaacttttaaagttttctgactatctttgaataaaaagtaaataaaatattattttgttaaaggcattatttttcagtttcagatacagacttaaatattctttatatttatattaggattcaaggaaaacatttaatcaatgtttagaaatattcctttaaaagaagagctggaaattcacatacattctatttcatgaaaatgatcactcctcaggggattttgtctaataaggataattcagtttgtttcagatgataagatctatggcaaaataattacagaaacagccttttattttaataataaaaccaaagaagccattaacatattcttatactataatttgttcataacagttttgtgatctaaatgtgtcatcttgaaagaatcagagtcttatttttataaatgtcattaacactataaagtaaaaaaatgcatacattttataggaagaaaaaataaaaagtgtattaatctgaaaagctgttttattgaattagaggtcagttttagaaaaaataaatagaaaaaagcaaatatcaaaatattgatttctacaattttcttttctaatttttaggtatgatggaatttagtctctttggaatgtcatatgtaagtagctccattcctcttatcttcatcacttgtgaatattaaaaaacatactattaacattcattaaatataactgtattttagactggagcagatatctgtggtttcttcaacaattcagaatatcagctttgtgcccgctggatgcaacttggagcattttatccatatgcaagaaatcacaacagtgcatttactagagt

SEQ ID NO: 51892 - DNA, 2379 bp, Bovine  19866880513386
attgtttgatctggactgtcttaagaaatcaaggttgctgggagaaataacctcagatatgcagatgataccactctaatggtaaaaaggtgaagaggaactaaagagcctcttaatgagggttagagagagtgacaaagctgacttcaaactcaaacgttaaaaaaactaagatcatggcatctagtctcatcatttcatggcaaatagaaggggaaaaagtggaagcagtgacaaattttattttcttgggctccaaaatcactgtggatgttgactgcagccccaaaattaaaatatatttgctccgtggaagaaaatcaatgacaaacctagagagtgtattcaaaagcagagacatcactttgccaacaaaggtccatatagtcaaaactatggttttcccagtggtcatgtacagacatgagaggtggaccatgaagaaggctaagcactgaagaactgatgcttttgaactgtggtgcaggagtagactcttgagagtcccttggactacaaagaggtcaaaccagtcaatcccaaagaaaatcaactctgaatagtaactgaaaggactgatgctaaagctctaataattttggccacctgatgcaaagtgtcgactcactggaaaagaccctgatgctgggaaaaactgaggcaaaagaagggggcagcagaggatcagatggttagacagcatcaatgaatttcagcaaaactccaggacatgaatttggccaaactccaggagacagtggaggacagaggagcctggcatgctgcacgccatggggttgcaaagagttggccatgactgagcgactgaacaacataaacaacaaagctttcttacgttcttttacaatgcaaattagatccaaagaaaaaaaaaaacaccacctggtgacacccagagtttaagaaagacttgttataaattacatgagtgagaaactaattcttgcaaaaataaaaacatgctgatggtgtaaatgttcttgcatgtctgactactgtcatgtgggaaaaagtttgaatagtgaactgacatgcattcaaacccaaaggattgaattcccaattttaaatacattccagaaaatggtgtgaacaagccttccaacagcagttattattaaatgaatactgaccaaaatatgctaacactatcagaaaatccagaacccccagcaggcttattacagaaatgaagagcaggggtaggggctgggacctcatctgagaggaccagcaaaagcttcaagaagtgtggtaggtcaaattcagcaaacagaagcaagggtgacatcctgtgaaaacaatgaggcagaatgggagagaaacttggggagcaaagcggagacaagatcaaaatgtaggtaaggatctttttttgggtagacaatcacttcattttctgtaatatgctaaaatcagaggcaatgtagaaaacaaaaaatcactggctcttcaagttcaaatttttcaagaagtgagagcacctgagatttgaagtatttttatgtctaggaaaataatggtacatccaaatttagggttcactttgtcaggtaactttccaacaataattttagggcagtaaatgagctaattcttactctgcagcaaaaactcatctacatatcccagatgaagggtttcaaactgggggaattccaactctgccatctttagggcggaaaagacgccatctttggttagggaaggctggatccgaacttcatgtaacctacgaatgagagacacataaaggaataaaatgaaagccatcaaaataaaaggttcttcctaatgtaacgctctgaaagaagtttatcgtactgaagtgtcaaatgcaaaaacactgcctcctccacaaaaaaatatcagagatgcttcctttaaaagagcattttataaaagtgtgggcacatctaatgtgtacactaaagtcacagtaagaacaaattataataatcttatatcctttttggtactttcctgaacctgattaagtcaaggcaagaatctggtatttcttcaataccttttagaggttaatattaagtcctgtttttaacagagtatagtcctatatagtaggtaacaatatctattcacttaaatacagttttatttatactcttcatattctatgatggaaaggaagtttccttttttaaaattcaatttaaatattataaaagtaaaagcagaggtagacttttgatatgtaggaaatagtaaatgtggcataaagtgatgtgaagataggttaaaaatttaagggttaaaggtcaggatgctgaaaaagctgacttaaaacagtgatttctaaatagcaagtatcaccaactaaaacaattcagaaaactg

SEQ ID NO: 51893 - DNA, 803 bp, Bovine  19866880647434
ctgctgatggacatctaggttgtttccatgttctggctattataaacagtgctgcgatgaacattggggtacacgtgtctcttttccttctggtttcctcagtgtgtatgcccagcagtgggattgctggatcataaggcagttctatttccagttttttaaggaatctccacactgttctccatagtggctgtatactgacttctttttaaaaactatcacatttctatcttcattcctctatccattcagcaattaatttttttcgatgatttcaaagtaagctgttgtttctaattctcatttttatcactgggaaactgagaccaagacaggtgacgtgacttacctgaagtcattcaggaggaggcagtcgattgtcactggagctctgactcccccaagccattttcttaaccaccaagcagtattgtatttcctggaagggcagaaagaaagactcactcaagattgcttagtggcagggcaatgactagcaccaggtcatctgattctcaagctcccaaaatttccattgcattgaaccgtgataaacagcctactttccatgtagaagcagggtttcttctgctccacaaatatctgcagatttggtgctctacaaaatctctggaaaatctgatttttgacacagatgattttgcagaactaatacactttttattccttctcaacatttaaaaataatttgtggaaacaacaggctgggaaattatcattttagataactttttacagtgttcagaggactttcacatatgttatcttatttgaacttcatg

SEQ ID NO: 51894 - DNA, 1370 bp, Bovine  19866880717400
cctctgtgcaccaagttaaacacccaagtacttatagtagaagccttaagagaacttgttgggtagagagtttgacctgtgagttttgttttaggacatttcgtgcagttattatcaaaagaagactgtacaacagaaacacacatgttccataagagtcagcccaatatgtgcctctaataatgttacatattctaactcctgcgtgtactgctttgctaaaatgtaagtgaaaacaccaacccccaaacagaaccctcttttgaaaatctattgtgtagctaactgataacacttctacatattttggaaaatgtgtgtgaactccttaagatgtgattctctaaactaaaaacaatgttactggaatttctgttgtacttattgaacccaaggcgtgtggggtaactgagattaactgagatttttgagtcccacctccaactctagcagagaacctttcctttatcagcgttgaatattggatttcaatatggttttatggggaaaaggttttgttcctaaaatgtttgaaaaccatagttgtaagacaaatcactctttttaagataacaaatcaacaagtctgaggaccttggattgagtcccgcccctgtggttaagtgatactgagaaatctcataactactccaaaccttgagctcctgtttaaaatctgagattgtatttatgatatttactgcttcacttgctaaatatcatttgactacagtgaccttctttcctgatattttcaaatgtacaaagctctttcttgcttcaagaccctaggacaaactatcctctcctataagaatgtttgccccttgattttcatagaactagttctccctcatgatttaagcttcagcttaagtatttctttcttacagatgccttccctgaccatcctacctaacatagatttatctctgacattttccatattaatatgcctctgtctataattcttctaacacccagattttctatttatttcctaattttaagttccattaagtcagaaggcaggtttttttatttattcataatacttagcacagtgtctagcaccacataagcactgtaagtatatacttattgaatgaatgagttcttgaggagaatgaacataatgggtataaaaagcatttttaaacttaaccctttacaggttatgtatttttaagttttatcacttgttgtattggctcaatctttcagacttgagcatgtgggttaagagtaaagactaatccttatagccttgaattggaatttcacctcttctatttaaactatgatctaggacagataattaacctcagtattacctgagaggctggtcatgagaattaaaaggcataatg

SEQ ID NO: 51895 - DNA, 1151 bp, Bovine  19866880761318
aagtttgggaaatgctagcatagcagtttaaagcagaaattggcagctttttgtttgtttgtttgcttgttttgttttctgtaaagggccatttagcaaagattttaggcttcttcaagcatatggtcatcatcacaactactcaactctggtgctacaatgcaaaatctgccacagacaatacataaataaatgagcataactgctttccagtaaaatttatttatggacactgaatttgaacctttaacaattttcatgtgtcacaaaattatccttctttagaattttttcaacaattacaaaatgtaaaaaaacattctgaacttgtaggccagtcaaaaaacaggcagccagtcacatagtttgcaagcccctgactcaaggcatcaattaccactacatctttgaattgcttactttccttagcttcagtggcttcatctgtataataggggcaagggtaaaaccaatgtcacaaagttactgcaaaaaacaagtaaagatgaatacttaaaaagcaggtgcccagagatttcacaatataatgttagccagctactccagtttggcagtgcctcagtcattggagtctgaatgtttcatactctgcttctccacaaaggcagctaagcatctgggggctgatcttccctactttgggatatggttacataaattattcctcttctctataaaataggcccctgaaatctgagcctggaaatgcccaaaaggttttgtcaccactgatttcagaggcctggaattgggagcaggtcaagctaaaatttgcattccatcaaaattaagcttccaaattagtgttttagatcttgcagtattatgtcgctgatggttgctgctgctaagtcgcttcagtcatgtccggctctgtgccaccccatagatggcagcccactaggctcctctgtccctgggattctccaggcaagagtcctggagtgggttgccatttccttctccaatgcatgaaagtgaaaagtgaaagtgaagtcgctcagtcgtgcccgagtcttagcgaccacatgcactgggagcctaccaggctcctccatccattgggattttctaggcaagagtacctggagtgggggtgccattgccttcttcctggttctcaaacatta

SEQ ID NO: 51896 - DNA, 967 bp, Bovine  19866881007884
atgctgaactgatgaggtttaactctgtggggaaaaaaaaaaaaacaactagtaacctttttacaccagcttaattttaaaactacttcatttagaattatgtaaccttgactctgcaaccctcttcttcccttcctgtcatttctgtcattagacctcaccgtttcttttctaaagtgattggcgtcatcaccaaacacctttcttgactacggctgtcctacctccaattcatttagcagttccagacgggccatcttctatagcttaagtttgatcatgcctatcccctgtcttttgtaaacttcctattcacacttcaaattgaaactcctcttctacagacccacaagccttcccaccctgccctctatgctcccagagctctgtatgtgaattgctgttatcaattgtttttaattgtcagagttgattgtagttatttgtttaataggtctgcctcctttgctggatttcatgttcttgttgttctttagtcactaagtcatatctgactcttttgcctccccttggactgtagcctgccaggctcctctgtccatgggatttctccaggcaagaatatgggttggattgctatttccttcaccagggatcttcctgacccagggctcgaacctgtgtctcctgcattggcaggtgaattctttaccactgaaccacctgggaagcctggatttcatatagccagcatttagtacattgtctagcatattatagtgttggaggtaaaaatttagctgaaattgagaaagtctttatgtttcaccttacaactctttagacaagatctcatcatcactgaaggcctatcttagacaggtttgcacccagtagatattaacaatctctacccgcccaccccctaaacactgaatttcacttgcagttatggattctgaagctagagatttgagaggagataggaggaggacagaaaccaatt

SEQ ID NO: 51897 - DNA, 1140 bp, Bovine  19866881032148
ttactggagtttcagctttagcatcagtccttccatgaacacccaggactgatctcctttagaatggactggttggatctccttgcagtccaagggactctcaagagtcttctccaataccacagttcaaaagcatcaattcttcagcactcagctttcttcacagtccaactctcacatccatacatgactactggaaaatccatagtcatggcatcaccgacttgatagacgtgagtttgggtgaactccgggagttggtgatggacagggaggcctggcgtgctgcgattcatggggttgcaaagagttagacacgactgagtgactgaactgaactgaactgaactgatagactgatcctaaaggaaaccagtcctgaatattcattggaaggactgatgttaaagctgaaactccaatactttggccacctgatgtgaagagctgactcatttgaaaagaccctgatgctgggaaagattgaaggtgggagaagaaggggacaacagaggatgagatggttggatggcgtcaccgactcaataggcatgagtttgagtaagctctgggagttggtgatggacaaggaggcctggcgtgctgcaatccatggagttgcaaagagtcagacacaactgagtgactgaactgaactgaactgagggtgccctttcatgataggctctcagtaaatgtcagctaactttgttattatcatcatcagcagcagcagcagtattatagttttcaaagctctttcacatacaacatctcattaaaatcttccaacagcccagtggttggtgctgtgatcttactctaataaatgagaaatgaaagcgcaaagaaatgaaaggagagacactgagccagaaagaggcaaaatatggaatcacgttagattttgtgttctggaccagtgcatcctctttcctcaccatgttgcctttccatcaaaacatctgagggtctgttgtttattagttttctgcaaatgatatactttgagtcttgggagcctgacaaggcaggcaaacatgactgtgttcttccctggcagggctcagcagacaggaagctgggataattggattccagcctttcaatcttagggctgcatttgtaaccagccaaccg

SEQ ID NO: 51898 - DNA, 1331 bp, Bovine  19866881033860
aatgctagctaataacccttgtatgatactatttgggtaaaagaaattatgtttgcatagaaaaaaaaatatcttggttattatttctgccaggtggaatttctggagatctcaatcttttatgtatttgcttgtcttcagttttgaaattttctacagtgaatagaagttatttcttatgtcaaagcttctggatagtaaatatatggggaaatatgttattttatagcattaatccatttatggacaatgagaaatgagaaattctattgattttctgagattaggttgatattattgttttttaaaaaataggagtcatagccatagcagttcgtgaagatttaggggatggcattcattgccagcattatctttgactaactgtgtaatcttgagtacatcatcgtctttttgggtttatgttctttcacttgcacagtgactgagttggggtagatgaatgatttttaaatttggctctgtatagcctctgtgtttctggcaaaggataaaaggattacatgtgccaagggctgcagtgccctatgctttaaattaaacgagaaaagattgacatgcatttgtcttgtatgttgaatttcaaagttttttttttaaagtttcctgacttgtaacagatttgagaaactatggacctaaattatctctaaggtcactttttgtcctgatattctatgatttattacttttcccactgaatttcctttattataatactaggtaactttacacacacacacacataacactaaagtacagaatgctgaaagaacctcacatttttactctaatagtttctgatcatatctaagaagaagttcccttttaagagttcacttgtcttaagaaaagcatttatctgtttatgaagaatctatcattatatttgccattgacagtatatttatagaacataaaatacattattattattatatattatgctatgactagaatatgaacaaatgaacataattccaccagaattacctaaaaagtagactattgttgctgactacaacaatttaatatcctttcactgttaagcataatgaagaataacagtctcattgtcaggaaagatatgacaaaaattcatgctgagaagcttgcacctggactttatggatcagttcattgattttttagtatattcaaaatactatattctggggaactgaagtagattaaaaatttaggatggttgaggcattggtcatttggaggcattgagaagaaatttgtttaagagatgaaagcttaaaagagagttcagattatccatggccttgaatttcatcttagat

SEQ ID NO: 51899 - DNA, 1640 bp, Bovine  19866881051000
cctattcacatgtcttttctcttcctatgtttctgttgctaaactctgcttcaggtgtaagtagaataacgggacattcacctcctcggggaatcatgcttccatgtgcccaagaataatatgaaagcaccttttaaaaatgcagatttctgctctcccctcctcacctctgccctctccctactcccacactgtcattagaggtctggtgtgtgggtcctaagaatctggatttgttatgggtattcaagataactctgatgcacgtagtctctggacagttttgtaaaagatgacttagtgatctttctcctcttttcctctttttccttctcttcctccttctcccccttcttctggaacaaatgtaattttaactctgtctcatcaactgattatattaaacttcatcacaaaactcttcccaccgtacaatgatttccatgtttcccagtggacagaattcctaatttggaaggcaggccacctgatttatagcactagatccactattacctatcagtcaatccatgcccctacattgtacctacctgccttccttacagagttacattgaaggttatatgtggaatgatataagaatgtttcatgaattgtagaggattttactaaaactattaaaacaagaaattgcattttaaaaattcatctgttaaaatatcagagattcttttttaatggtgttttgcaccaggggttttgagtggctctgccaatgtttctgattaagcatatgtttgaggaatgacagttgtgatctcactgcattttaagttgcagcatctccgcccctccctgtcctatcctagccagatacatttaacagctttgcaatgtgacttcacagattcaaaaattgaggtatttcagattcttgaatacaaatcccaaaattatcttcctgtgtttccagagaaacctcctccctccacacagaatataaagtatcagatactaacaatagaatattaaaagccaaattcaaatacccacagctttggagaacagtcccacacacagctggtgcccagtcagaaggtctgtatctgtcacccaccatctctgctactcatagaaccagaatgtcaaagctgcaaaggatctcatagattatctttctggtttaacgcatgaggaaaatgaggtacaggaaagggactcagtcatcagaggcatgccatgatcgaaggctaaaaagacatcagagtccaggttcctgtctcctggtttactgtttgcattgcttagttaatagggtggccttgcagttgaaagcaaaaggtactcactgaatgataaagtcatgttcccattgtatgaggctttccagtggctcagtggtaaagaattcacctgcctatgcagaagatgcaggagatgtgggttcaatccctggattggcaagatcccctggagtaggaaatgacaacccacctcaatattcttgcttggaaaattctatggacagatgtgggaacaatatctcttggggcacagcacactgcaccatgattctgtatcttgaacgaagacctaaaaagaagacattaaactgttaattgtgattcatacaatagtgtcaactgagacgacaggccaaccaggatgcaagatcaccc

SEQ ID NO: 51900 - DNA, 2123 bp, Bovine  19866881081952
actaaccctgctttgctagtgccacttgggtctagtctctggagtttataccctgattctctatataataatactaaataaggtttttatatagcattttatggtttacctatgtgatattcttggactctcccaccaaatgtgtaaatgtggaactttacccattcttgggtgggaggcaatgtgtaatacacaacaaaagaggatggccattggcaaaggtaatttcattttttatattttttaatggggtgataaacttttttattgggttgtgagagtagatatgtgaaatgattaacacattgaatggcttaatcagtagagttactatacagaacaataatgaggactattgttataattagagagaccaggtaatctctgaggtctcttcttaatcttcattatttgtgaatttggagtttacacaacatcttgactagccctgtacaactagaacaacttttgaaaactgtagtaagacttaatggtttggaacttttattcttgaaaattattatttttattattagtgaataaacagttgccttactgatggcctccattaaaaacagaaattaagatacttatctctttacttaccaggcactagcagctcatactatggaagtgtttctctcttcccagtctggtggattcccacaatggcgcacaactggcctttgagataaatagttttctgtcagctcagcatcctcatagtttggatcgcttatgttctcttagctaatttgcatctgtcttgttcaaaagaatgaattgtctaaaatatcctgggaatgatgttaaacacaggatagagcaattgtcgtgacatgggtacctaagagaacccagttcgagaggggatttcggttagaactgtgagcttcctgaaaatggggatcctgtctgtcttattttttggttgtgtgctctgtagagcataaaggttttatggaccagaaagtgcctttggggaaggagagtggtggtcaggtaggttgtccttcgtcaccaccaggtccaagtcatctgtgttgaaagtatggtgttcctagttgaagatgtctgttctttaaaagcagcagcagcaacaacaacaagaaaataaaaagcctcaactgtgaagtatcaactcaaaataggtggtgtttctaatatattttctgttcctaagggaaatattttctgtttaactgtttgttcaactgtaatgttagccttatgaaaatttaaaaaggaaatctttttgttgttgttaacatttgataaaaattacaagtggcgataaacttggctctaaatagttgtgaacttcttaggcttcacagattccagttttctgacactactaaagaagatgccagatgtcgaacagctatatggccttcaccctcgataccttgagaggcgaagggtacggggccatgaggcttttagcattccaggagttctggaagctttgcaggcatgcccaaacttagtggtgagtgcacttggttgaacatttgacatcaactgatgaatgaagcactaaattaaaagaatggtagaacatgttcatgcaaatttcattcataacgaacttttaagttccactccatacttaggatcttatgatatagaaatagaagctttggatgctaaataaaagcctttcttatgcttgctttggcattattttgtagggtgtggaaacttctcacttggaattagtagaatccatttggacatacatgccacatgttcatattttggggaaatttcgtaaccgtaatggagcatttccaattcctcctgaaaataaactgaaaattcctataggagccaaaattcaaactttacatttagttggtgagtacatgtttcttgggttgcttgtgactcctttaaatgccatacagctgaatattagtggaaagggaataatggggattttagaaatagcttggtgattgctgatggcaaccgagaggggtaggatggggtgggtggtgggaaggggaggttcaagagggaggggacatatgtatacctatggctgattcatgttgatgtgtggcagaaacaatattgtaaagcagttatcctccaattaaatttttctttaattttta

SEQ ID NO: 51901 - DNA, 964 bp, Bovine  19866881131025
ttgggcagatcccttcccattgtgcatgtcatcatctgtaaattaagactaataactttgtcttgcttgaggtgttatgggccttaaatgaggttctttatgaataggtgaaagtatttcttaaagtgctatataagtattctatgtaaagatgaaatgaaggaatattaaaactctagtgtttaattctaacccaaattaataaacatgtggttttgtcttgcttcagggctgtgctcgggttggtctgagtgcaggcacgggaattggggtttcctcggcccttgttagcaatcagaactccaacaatgacaatgataataatgcccagaataatgccaacatccacgacaacaatcaccatcacccagatgactcagatgaagagaatgacttccggcaagacttgcagccaggagagcagcagtttgcagccgacggtaacccagatcttttgtgagctccagatagagatgatttttactttgggtcatgtttctctgactttcctgtttccttctcctccatttcagtttgtcactttatacattgaggaaccttgctaacaaagcagctgatgggtggatggagtttgcctgtctacttgcttgttttaaagttgtctttgcgacgtctcttgtccatagaatctattggaggtacttacagaaagggaaggactcagatgccatgagaattagggtgcagtgagccttagaagcctggcttaatggagatttagctgtcaggatttgggtgaagaagcatctttcggtatcttgctaaacagtagatattctctctcaccattgaacttgagtgtggagatcatttttggatgtaccaagaattggaaaaatgaataccagatatgtgtagagattgtgttggatacccttcacacacctctcgccattaagtcttcaaagccaccgagaaaattaagcacataagctaataagga

SEQ ID NO: 51902 - DNA, 664 bp, Bovine  19866881266697
gccattcattcccattcatgtctgcatgaacaggacaccctggcatttctcctgatcctcatcaccacctgtgaggcatggggccatggggccgagggcccagggaaggcatgtgggtgaccgggttggatgggacccaagggccgagcatggaggacctcagagctgagaagaggcttcaggtgccatcagatgcaggctcccagccaacacagaagcggcatcctccattgcatcctggaggctggtcaggctctgcttgtaaacctccagggacaggagctcactccctcctaacacagctccttctattgcggagaagatttagttataaggaagctctttcctttgttgggacacaaatttgtctctgttgtagcttgcatctgggaccaagcaattggcccccttcttccactgagagctcttaaatattggaagaccatgatctgccaccttttaaagtcttctctctgaactcaacaattccattctggccgtcttcttctggatgtgcattggtgggtgaattaatcaaggctctcacaaaggaagtaggttgatgttggtgccaagatgtctgtccagaagcactgaattttcttaagtgaagcatcagtgtttattggttcatagacatgaacatttttctttcttttttttt

SEQ ID NO: 51903 - DNA, 920 bp, Bovine  19866881300663
gttatatctttacatattacttgtactcctttgggcaagtcactgaggctacgtgtaatttggcttaaatgaaaaatagagataatcttatttcatggggttgttgtgcagattatatagagtggagagagtttattatggtacctgctatataccaaccagtcaacacaagtcaacaataaattaatataattcaaaggaaagcatcagtataaatcttgagaaaccacccaccaagttggttgtcaacatatgatgccaagtaacttgtgtgtgtttattgaatggacttgacactggctgtgagaatgagaggtaatagtccttctaaactgtagaaatgtcaaaaagaatcactgccagatgctgtaaactggattactgatgacaagacccacttgtgattgagactgatttaaatgcaattaacatattgagtgcaagtgtgtgatactgcagaaaaataataaacacttgtaaaatagtaaagttcactctgatgcttgcagtcaacttgctgttggatccatctaattgagttactgtccccaatgtcaccagaagaaatccaattaaaaagtatagctacattgtctttcaggctctgagtggtttatgaatctcagttcagaacttgggtattgctgaacccagaaccacccctgctaagctgtttgtaatagacactgcttgaagtggcacatagggtccattttgatgagtaacacgagaactctaggttttgttgcagggaaagaaatctgagtaccaatgccagttctaccctcactctatataaccctggatctgtcctttcctctgggacttcagttaaaaggagcagttcagatgctcttccctcttgctgaagtgccagcccttgcccagcccctcgccaagctctcaaaagcgtgcaggga

SEQ ID NO: 51904 - DNA, 611 bp, Bovine  19866881391478
cgtatcttcacttctattttgattgtgggctggatattcccaaagaagataattatccaacagaaaacaaccaaacacaagtgcagactattctgctagtatgggcacattagtcagtataagctgagtgaccaaagccctcgaaaaatgtcttgcaaaaatgtattatttcactggctacccaactgcttgtttaacaataaaatgtcatgtatgtcaaagggctgtgaagataggaccaagtataggaaatctactattctaaaccactgaggccagattggcttgtttttaattcaacctggaaaagtaaaattccattttttcaaaaagattttaagaggaaaaaaggtcagagtctcagagtgctgccattaactggctctcctcagtgtgagtcttggattgtagactaagtcctctacattaagtctcaaagaagattaaaaaaaaaaaaaaaaagtaactttcagttttgagcatgtgaatctttcataaacctgaagataagcatgaagatatttcatcagcaaaaatgtactgatcatttggttatatactattttgcagacactgtgtgaggggctaaaggtatacagagaaaagaaagc

SEQ ID NO: 51905 - DNA, 1180 bp, Bovine  19866881457155
tcaggcacagaagtgtaaacaacccaataacttactacctctcacacccatcaatcattttgtttttcactatcactacagcattcgtcgggggagtgtgcaatttcctcggttctgtctcgctgcagcaaaaatctgaagtgacagacgggacccagtgttacagctcagttttatttggcaggcaaaggaaaatacatcctcaaggcgtgagggcaggccaacacaaaagacgtgaagagaagagagccagaggctcaattttgtttcctctttttataagtttttttttcctccttcccgagcctgccctatgtaaactgggctagccaggaggctgtttgtgtcacctgaggtcctcactctggtcctcggaccttcctttgttctattttcatgggcttttcctttctttgtcttttagccaccaccattctggactcctttttcctattctaactacctaacacattcgatacattacctgagatattattagctttattataaaataggcttcgtgttagatgattcttcccaatataggctaatataagcgttctgaacacatttaaggtaggctgggctaagctatgttcagtaagtagtgtattaaatgcattttcaacgtagaatgttttgaacttacaatgggcttactgggatgtaaccctatcgtaagtcaaggaagatctgtactgtgcaactgaccagggaagagaagggccaccatgtgaaggataaagggatggagtgtgtatgttcccatgattaccagccagacttgtctttcctagactttctgatttcacaaaccggtaaaattacatacacacacacacacacacacacactgccaactcaactgtcaattatatacatgtgtatgcgtgctaagtcacttcagtcgtgtccgactctgtgaccccatggactgtagcccacccacaaggctcctctgtctatggaattctccaggcaagaatactggagtgggttgccatgcccttctccagggggtcttcccaacccagggatcaaccctgtatctccagcattggcaggtgggttctttaccactaacaccacctgggaagccccccaccaattacctatatttccaaataaatataatttgaggccatgactatcactaggtgttactaccattatctaatta

SEQ ID NO: 51906 - DNA, 1463 bp, Bovine  19866880428869
taacttctaatgtgattgaatatttttaatggggtaaaactatataccttttaattcctgtgatttttcccgtgacttctttttaatttttatgtgtaaaaagttgctatgaccaaattttttttaaaaaaagactgaaggttaccaacaggtgaaatatagccaatatttcataataactataattgggatataacctttaaaaattgtgaatcactatgttatgcacctgaaacatacgatattgtacatcagttatgccttagttaaatttgttaaaataaaaataatttttaaaaattaaacctgaaagaaaaattagaagtaattacacttgtcttttgaaaaagagtaaaacagagtatttagataataccaaatctgttacataaatcaaagaacaagggcaacatgagaattccaacatggttggaagttaattctctttttcatattcaaagtgtcagaatcattgaacagttcaagatgatactctacaattaaagaccaaagcagccgtcctctagttagggctttcccataggccagtattgcttcaataaacatgagcatgattttaaaccatttagaggtgcgatttaaatcaacgtcctttttctctccataaaggaaaagctgttccagacctagactcgccctgtaacaatgctttctgtgacaatttgatgaacattaatttattagcccaattcttccatacataaaggaagggagccaagatagcacaaatacattaaataaccactgtgttctactatgatttctttgtagacataagcccatgaaactgactttaaaataaaggggaagggacacccttaatttcacagtagtgttcaggaggaatacaggtggacaaacacacagacacacgacggaaaagcctaaatgtatagcaaggtttttaactagttctagactattctttcggagaaggcaatggcaccccactccagtactcttgcctggaaaatcccatggatggaggagcctggaaggctgcagtccatagggttgctgagggtcgaacatgactgagagacttcactttcacttttcactttcatgcattggagaaggaaatggcaacccactccagtattcttgcctggagaatcccagggatggggaagcctggtgggctgctgtctatggggtcacacagagtcggacacgactgaagtgacttagctatagcaatagactattctttacataggaaatttggggttttaaggtgatgtttctaatgtgtataatatttaaccaaagtgctcgagtaaaagctaaaataacatgaattttaatctcatcacttgatgttcatctcctctgtgaaagtgaagtcgttcagtcgtgtctgactctttgagagcccatggactatatagtctaccacgctcctccatccatgggattttccaggcaagagtactggagtg

SEQ ID NO: 51907 - DNA, 1483 bp, Bovine  19866880560353
tgaagaatggcgtaagtcatgacagaatctctatgaaatgacctagtgtgctctctttgggtgaaagagggttcggtttcttatcttcttcttcctgctcaagctgcctacgtggaatttgtggcttacaagatacccgttggactggctttaggctgataatatcacttccttcatgttttcttccacatctttttttaaaaagaatatatttatttttggctgcgctacacaacatgtgggatcttaatttcccgaccagagatcgaacttgctttccctgaattggaagtgcggagttttaaccactggatcaccagagaagtccttccatgtcttattttttagaactttttggtaactcctttcagtgagatcctaaaactttcctgttatggtttagttgtttctccaagtatttatttcttctggcaggaatcaataagagaggtacttctcatgactcttggctgcaagttgtgatgtgtcattattgacagcaaccttttgagcagcatggatgatccgttatttttgtgatgaagaaatgaggggtaaactttgtatttatggatttaatgtaaatttcggctgatttcatctgagtcttttgagagccttttatattctcctccactgtcttgctggttgggacttggaactttcaagtgagtgacggtcaaagctgacaacaaaggggaaatcctgtggatgtggggtcctgtgattctgtgcaattgttgctactggatttgagaagtaactgactccaaggggtatttaagttcatctgttcttgaatacctgcatttctttagtcatgtgaagtacatactgattcttattcctatacttggaaccatctaattataattatttgttgcaaattaccttttgaggtttccttgtaagttgatcaactgacttggttatttaaattgtttgctttatcctctgacctagtacttacactaaagtttatcctaaaaaaaaaaaaaaacaccaaaaaaacaaaacaacaacaaacctatggaaagatctcttacaagaagtctcatcacagtcttgtttttaatagtgaaaaatttggacacaacgtaaaggcccaacaccaaacctctcagctatattaacattcaactatttaaaatcatttgtatagtgattaaaagttcaggttctggatctagactgtataaattctaattttagtgttgttacttagagctgtgtgaccttgggcaagcttcttttttttattttttgaattgtaaaatatacatagcataaaatttaccattttaattcccttcaggcatacatttaagtgattagtgcattcatattgtcatgtagttaatgaaattcatcattgtaacagttaacagctttctttgggttattttggatatcaaagaagttaaaagagtagactgtgcctgaagtcaagtgaagtgaaagtcgtcatgtttgactctctgcg

SEQ ID NO: 51908 - DNA, 1188 bp, Bovine  19866880741395
taacaaaacatggatatggagaacagatacagacacagagaacaaacgagcggttaccaaaggggagatgggatggggacgagaaatacaggaatggaaggttaaaaggtaccaagtattaggtgtaaaataagctacacggatatacggtacgacacaggatatactgtacaatacaggatatacagccaatatttacaagtaactcaatggagcatggcctttaaaaactgtgaatcattacactatatacctgaacttacagaattattgtacatcaagtatacttcaattaaaaaaaagaaagaaataagaatcaccgtttgcaaagcttataaatacacttgtaaaatcttaagccaatcagcctttatcctcaaaggaggagagacagaataggtctccttttgggaggaaatgctttcttttctcaggcaaatactacctgtacacggcatcaccatatcaggaacctaccttgcttgtctgatttggtttgatcccaggccctcgaaccaatagtggaacttttatatcaaactcatacagctgtcttttgtctattggcaaagaaaactgtcctggaaaaaaaaaatgcatagggtaaagatggagccaagatagaaatgtctctcacgcatgcattcattcaatcaacagtaaaaataaaaaatagccttgttttactaattatggtgtcttagcgaagagcttaaatcccccagggtctctaattattacaaggcaggaaacagtgagctcatcttctttaaataaatgtccagaggaactccctggccttaaataggcaaatacaacaaaaggaatgactagaaagtattgaagcacaaatatacattatttatgtatgatactccacctgatcacaactgaatgaagttagtcttaaagctgttaaataaaggaacaaaaccatttatccagcctttcctgaataaactgtacctcaagatagccaaacagttgatgaggcaaatttcctgaggaattccagctagtaaattcaaaaggaaggacagagttatgaagtcagatttttcagtttctgagggaactgatttacgcacaatcatcaatggacgttttaggcacaagaggttcacaggaggagctcaggttggtccacatgagccatcaatcagaaacaacatctctaaagtgaggcaa

SEQ ID NO: 51909 - DNA, 2311 bp, Bovine  19866880862210
tgtgtgaggaccatgtcagaacggtggaacttacaatactgcgagtttgatgaccaggaggtaagagggcctgctgccccaccaccccttgtgtctattgccagggctttgttagctggacttggtggccgaagagaaattccaggactgttcccggggaaaacgggtttattttctcactgaggtaaagttgcagcagcagcagcagcatagttgctttacgacattgtgttagtttctgctgtgccgtgaagtgcatagctgtgtgtggatacatatatcaccttcctcttgaacctccctccccttccctcatcccaccctcagggtcatcacagagcaccaggctgagctctctgtgctgtagagcagcttcccactagctatctgtttatacatggtagcatacgtgtgtcagtcacaatctcccaattcttatctatactcacacttatgtctccattggttaaggaaatagaattccacaaggccatacttgacttctctaactgaccttgctgggtggggctttctctacttccaccacctcccacacatacacttgaaatacacacggttcacttttccagaatgctacatgcctggtctggggtgagggtaagaacttctttggagatgaaaggagtcgggggcctttcctagaaagcttcctggccagcagctggctcagacccccctgttcctagcacagcatagaccagtgctgctcacatggatcagcaggttaaaggcagcatccttggaggaaggtggctttcagccagcccggatcagtgtggattatctggaggagcacacgcactccagtcccttgttcttactcttcatcagcgggtgcacacctgccccatctggcagcctacatttttgccgtatggagccagcactcatcatgtttctcagaaattgacttgctcactatttatttgtgggtcataagcacttcagagaacaagcaagagagcttccctcaaactcagtcccttccgctttataagtgatcgtgtgagggcagctccttgaagcctttataagcaaaattgatgtacatcttctgagcctatcacttaactccaatctggagaacaaagtactgatggaggggaaaatagtgttattagatgcctctcattttagaaataacgtctctttcttcaagtggtgttatgtatctaaaataggaaaacttaacatttttataagatgggttcctttcatatctgttctcatttgaatcttcacaactgtaaggcaaagatgaacttcagatatcaagtctcacgcagtaaccttattacttggtctcgtttctgagcccttgccatttgacagtcctgccttctgttctctgctttaattatagaaggaaggcttttccctcctgactttccctgaaggcacaggagtgctggaggcctgtttccagcacgtgggccatagactcagagtaattcaaccctcagaacagatggtccactgtctgctccgtaccctcgggctctttgagcatcttgagaccggatgctattctcccaggccttggtttttaatccacctcctctctttccatttagaaatatctcacatgaggcgtatttcttcagatgtgataacccttgctcttctttttcctccatattttcatttcctgtaggtgtttgtagaagtctataacctgactgcagacccacaccaactcaataacattgctaaaagcatagatccagagctgctgggaaagatgaactatcggctgatgatgttacagtcctgctctggaccaacctgccgcactccagggggtctttgaccccgggtaagtttcccatcgtcctcaatgactttgcccagttgtcttcagcagtcctgccgttcctggaggcagagggagcccagtgggtccttcctgctctgagctgagctgtttctcactgctctgctttatacggggaatgctgggtcttagtgcagcagccagttgtgctgagaaaatgagctgcttgaaagtcttgctctccacaggcagtgtgtgctctagctggaggcacagccctggtccccaccacacagggctctcgctccccttcctgcctgtggttcttgtcatgttaccacttgattgctctggtaacacctggggctgctttaatgtaagctgaccaagggccaccctggtcctagcgcttctcagagccttgcctgcctttcatttctcagaagccccaattatagaaacttgaatacttgccagtaaatttaatataataaatacacaaaatgtaagtatgaa

SEQ ID NO: 51910 - DNA, 1323 bp, Bovine  19866881045117
ctattactgtttttaaaaaaagggactggattttgttatgggctaaaaggatggcgttcttctaggctacttgcaagcagttgtgtgaggcagccggagttaaatcagtgctagctgtgttgttgtgggcaagtcactgcacctctttaagcctcagtttcttcatctgtgtatgacgtgcgtgcctggcacataataagcagtaacaaatattagtcattgttatttgtagaaggttctatatatgatcatgtactttgcgtatgctaggttgaatagagaactgacaataattgagaggtttgaagtgaacctaataatctagctgaagaataaaagacagcaggaaattaggttgtctctctttggctatatggaccaaagtaaattgggaatctcaatgtaattgatcagaaaggcgctccattcattcccagaggcttaattttcttttcttcttcgttttcctccttctgtatcactgtggtgtctttcttttttgctaaaagggctgattcctcctgaccaagcctgaggccacccatcaaagtcttcacccgcttcttcctcctttagcaagccattccatcggaaagagaaagaacaggcataggagaatgggggttcttttgcccaagcctttgtgtaaaagttaacgtacgtgcgaaagcgtttttcttttcatcttcgtctgttctccctgttttatctgcctcagagtacaggttttagttgcagttttgctggaggttgctggcttgacccggtgacaggttacatttctttctggggctatccttctgcctccagaagctctaaatcgccttgtgctcggcgttagggacttagtcactgtcttctttctggttttcctaaggtcaggcggaatgaggtaattcatatgaactttgtaatatgctgccgggggaagctgtggttagagtcctggttccgtgcgctgtggctggcctcccacccacagagggtctgtctcctctctaaggcatttctgtgttgctgaacacatccgcagtttggaaacaagcttgcttttgcagaatttaaatgtaggcatgaaagaaactcgatgagtcatgtgatccatttggctaactcttcaggggtcacttatgctctctgaaagtggtatgagttttagagtccggtggggaacctcttctttgggccacttgagcctgttggggttttgctgttcccttctctgccctcaaccatccctccctttggaggagggatgattgagggcaaccaataattagttggttgtctgaaactggctttatattaattctgaataccatt

SEQ ID NO: 51911 - DNA, 1168 bp, Bovine  19866881095273
tccttccttaaagacttatgtaggtagtgagtgaagttgctcaattgtgtctgactctttgagaccccatggattgtagcctaccaggctcttgcatccatgggattttccaggcaagagtactggagtgggttgccatttccttctccaggagatcttcccgatccagggattgaacccaggtctcctgcattgtaggcagatagacactttactgtctgagccactagggaagtctaaaaaaaaaaaaaaatgtataacaggaggggaaaatgtgcaaagcacatgaacagaccattcacatgaacataattgatcagtatgcatgtggagaatgtttcatcctcaccagtatttaagaatgccaattccaatttgaaaggccagagacatgtgaattatttcaaagggatgatacgtaattctggcaagggtgtgctcaaatgagcaaaatgagcattcctgccctgctggtgtgagtataagctactattacccttctgtaaaatggataggtaatgagtgttaggacctagacagatattactaggtcaaatagggtaattctgttgatgataggagctagtggatacataattagagtagggaaaaaaaaaaatctgtgtccagtgtattaaagtgatgcaggtaatctacaaaactccagatcagcctgaaaatgactccctacttctcagctgccctagattggaggagtattcttcatgtttgttcaggacctcgctcccagcatgctgtgttccttgtacgtaaaattaatttagccaatgagattagaacaacttcaggttatcctgtaaaaagaaactagcggaaaaagaggtgtgttctcttgattgttctgtttcctgtctccactagagaacttaaagcagctctgaagtgtgtcatgtataaagaaaatcccaattccacgggaaactagagatttgaagttaggggaattgagcagctttctttattctgattagaaatgatgcgaaatccatctgtcttgtgtaactcggtctctgttgcttctcttccctttgtagtatgtgccaagtgctctctgctgcccaagccgagccagcatcctgacaggggaagtacccacacaatcatcacgtggttaacaacactctggagggaaactgcagtagtaagt

SEQ ID NO: 51912 - DNA, 1405 bp, Bovine  19866881103511
tgtagcttttttagaaagtgctggctttgaagataacaagtgataaaaacttagcagtaacttgaaattatatcagtaattgaatctgtcattctttctgtgacacatggtggaaacttttggttttaaaatataattttaactgctagacaaaagtcaattttcacacttaaggtgagccctcctggaacagattcttcacaaagagccctttttaaaggagccaatagagttctttattcacagtattttttttttcactagttttagctaatcttaacatattaagcagttgtgtagctagaatatttatttatcttacagaggaagcagctagaagaaaaatcattgaatttgctttcttagaaaaggttatagaaactactaaaactctgcccatgaaactttaatactttggtaattctcaagcatattcgctgcacagctgttgtagatcacggtgcagtttagtgggattttgcctgttaatgataagtagaacactgtttgagtcttttccatttgtatttaattttatgcactgtatctctgtttgtcagatgctgaatccccaaccagagaagaccttcatacgaaataaagctgcccaagtcttcgccttgctttttgttacagagtatctcactaaatggcccaagtttttttttgacattctctcagtagtggacctaaatccaaggggagtagatctgtacctccgaattctcatggctattgattcagagttggtggatcgtgatgtggttcacacctcagaggcaagtaacatcttattaataagtttttaatttagatactgcaagagataatgggtacataataaaaggaacaagaaggaatttttgtttttgataaaactttattaggaatacttacaaatttgctcaacattttgaattttgttttacaaaggaacttaaattggggttttttccccaggtatagagtgaaattagagcatttagcttttttttttttttaaccagagagaaacttcctctagtgaaataaacaaatcagtttttttcctatgaatttgtagagaaatgtggcctgtatttattactttatagttgctgactgaggaaaaagccttgctatgtaccagtgctgggttcttctgtattctcagttagtcacataggccatgaccttagtctttctctatttctttattacccaatttaactttctcctttttcttaaagaacacaatggaaatagcttaattcaaatgtgtctgacaatttaaggttattgtgtgttaaatatgacatttataaagaatattgtttacattatttctgttctcttaaatagtttgtttgtataatactgagaaataacttttatctcaggttaaaatttctaagcaggttttttt

SEQ ID NO: 51913 - DNA, 1160 bp, Bovine  19866881139031
tcagttaaagaaagatgtggtggtggctcttgtatcatatcatcatattatgctggattacctaccagacaaagggtaaacgttaagcttttatataacatgcagagccacatgggtgtcaaaaagctctaagttttgagtccgctgcaagatgagacactgaaggaagagcgtctgctcacctcgttcccagcggcactcccaagacctccccccaggtgcaggctaggaaagtgagagctgggctctgcagaaggggccaggtatcctcttccctccaccccgtcctaggactcctcatattccagccaggcaggaccagatggaaatgcagcggtacacagaaggtgctttaaaatcttaccttaatgcttgactaaaatatgctgtataaactgacccaaagaaataaaatggtccattgactttttaaattttctgtgagaaggggaatgtatttgattattctttttttgcttattctaaggtattttaattccacaagcaaattgagattcactgataagagctccttttttttttttttaaaaaagctaagcattctccatctctctttagaaaacgtctccaaacccaaatgcctatagagcaaaactggattataaaatgttcatggcttttaatatctcatcttcagattgctttctcttaattttctctcagaaaaccatgttaagtaactttttaaaggttttaagagcttttttttttcctccctacttgagagaggctccattttactaacagaagaaaatgtattcaaatgaagcattagcctcagatatcttacctcgcccctggctccagagcaacttggatttccgattctttgagcaggttagtgacttggggaaccagtaaaagagccgggctattcttctgaatgtcttgttaaagtcacttttgatggccatagccagtactattgagtgcttcagaacagccctccacgagagcgtggatgaggaaaacacagtaacacccgcatgtgacactttagctgtgaactctctctcagccaatatgtctggggaccacctgtcagccctaaatccccttcctctgtcattccttcggtctgtcctttggaccttagccctcataactagaaactgtattaatagatgttctttctaaag

SEQ ID NO: 51914 - DNA, 1534 bp, Bovine  19866881150871
tatttctgagatactgatggtcgacttttctgagtaaggccagctaagtcatgtatctccgactgcctgctgaaaacattttttaagtggaaccaaaattggcatccttacaatcagtaaaggctgattgttgacacgtttgtaagtgacagaatggtgagatagcttctgtgagtggagagctgagccgaaccactgttgtactaagatctcagtttttttgagaaggataaagtggcattatcccagttatcctcctgtctgtttaatttcaggtaaattactgagcaaaatttttgaagtgatgaattattaaaaactgttcattttttattttggccataaatgtataattgtcataaaaattttaggatcatttcaactgttttaggctgtacatttcttctttactttaattctgcttactatttcatgaagaaatatcaataaatttctcgattttaatgtaacagtttgtatttttctgtgtacaacagtttgagaaacaaaagttatcttttgaaaaatactgtggatggtaatggtcaattagccttagaaattggatgagggacaattctgtgtctcttctaaaccattgattccaaatttagtagaagttcttacataaacatacgctgtacaaatccaaaagagagccttctctttgaaaaatgtacccaaggttctagacaaaagaattgtgctcaatacgaaattattttatcccagaaggattaggttttggttttggtttctcatttcttagatgattgaagtatgatcgtgtacaacctgtatatcatgaagagaccatgttttaaagagtaaataaattttggctactatggacactggaaaactgaaaacggattaggatgttatttgaaatctcaaattgatactttattgtggtagggaattttaagtgtcacatgtacacattatagaaataaatacatgggtaaatgacattactttgattgtgacagttatcaccatcaaaaattgtttagtcagagaatgtgtggggcaagggggtgtttaatctcttataattttaattttccatttgaccatctaacatgaatgtctttaattgtgtagtttaaaagtttatgtcactgaatactacgtaataattttacctaagttatatggtcagttaatatattggaaaatttcatttttattcaagcacctctagaaaagaacatcaataaacaaacccttgctgtggggactgtatttgtataacttgtgtaagttgtcctggtaagatcagttcttatccacgctaataattggttaagacttactgttctgttcctcattacagcagcatgtaaatcaagcacacttgctttcaatagactactctcaagaatgcatcttcattcaaaacaccttatgtcaataaatgcatagtgactgctctgctaaccaaattttcagagttactatgtaagtaaaattagctttaaaataagttacatctctagtttagtagcttttttttttttttttccagtat

SEQ ID NO: 51915 - DNA, 3157 bp, Bovine  19866881180583
ccttgtggtttggccgcatctgtgccaggggatgggaggctcacccgtgggccccgacctttcacatgcagcttcgcaggctttggtccccacatctgccctgcagaccttgcctgagaagcactttcctggagtgtgttaacctttccgaggtcatctcctgaggggccctcttgaatgagcctctgccacaaagccataaaagaagcgaacaagagagggagtgtttcaccttccttttctgttgttgttttgatacgctccttccctaaaatgcccagctcatgtgtgtgttcctcttcctgcctcagaattcaaatgggatttacactggcttcattaaagtacagatggaactctgcaaaccttcacagactgctggaaaacccgctcccagtagcaatagctgtatgaacacccttcacatcagcagcacaaacacagttggcgaagtgattgaggccctgcttaagaagtttcttgtgaccgagagccctaccaagtttgcactttataagcggtgtcacagggaagatcaaggtaccatgcttaaaatgaaaatgattcctgcttttgtttctgtcttttgacttcatttgtggaagactggtggatgtacctgtatcagttatgtcagagcccagggacatattctggaataaatggtgaatgcatcctggttgtccgagtttttcaggtggacagctctcagtctgagagcccagaggtatctgtatgtgaagtatgtgatgggtatttacggaggatttatgggatagcctccctcctctttgcccccactgccccacccagcacaaagaatgcctttgggcttaagttttcagtagcacattgatgttggatgtgattggtgaacttgcaggcttctgtcaatggcacagtcctaggccctccttttcccttagcctgtctcatgctaggtgtgaccctgggatgggggcaccctgcccaccccacctctacccctccaggggcatgtgcagtggatgaacaacattttgatctgaggtctacctgtctgaacttaatacccactatcagtggattaaacagaatcttaaattactgcatgaaactgaataagatattccagatcaggtcatcgctgaacagaaatggataccgatggtggacagcagggatttagtgattcactaagtactgatttgaaaatggtgtatatatgtgaacatttgtgctttccctagtttttctgagttgagcctatagcagctgtggcagaaaatccactcaccttggcatgatgggaaagtcccttggttgcctagggataaaaccccagtagatgctgagtatgctcacgcttcttcaacacatactgtgggctgagcctgcagaatacagggatgaataggccaaggttcccatccttcagaggccacaggcactcagcagtggggggaagtttacatctccaggggagatgtatgtataatgtataacgcagtggtatctggaagtttgtcttgccatcgtctttgcctgccccacctgatctttagctgcataatctaacagtaatagcatcctactgatgtattacccacatggcaaatctttcaaccctacaaggcagagagagagagagagagagagagagaatgcagagcttgcgttcagacagactgctttgtttgtgcctgctgattctaaattaatctgtaggaagatttgcttctagagttctgatttcatgttcttgggaaggtatatttttattgttgcagggattacagatccttttttaagtttatttgctttctaaaaggaggaacgggattaattataagcccattttgagagtgctactcatttaaatccattctcaagaattatttcctttttaaaatcaagggccagtttacattatgcaggtagaatggaaatagtatagaactcattccactgtgggctatttattggtgacaagatgaggggtggtgcccaggtggctgaggtaatcacactgttgcgttgatctggggatggggagggcaatgatgtcgtgctgtgtttgtgacatgcctctcgttctcaccagtctacgcctgcaagctctcggaccgggaacatccactctacctgcgtttggtagcaggtcccagaacagacacactcagttttgttctgcgcgaacatgaaattggagaggtaagtgattgttcattcttgctttaaactctgcagaccagctggtcctgttttatcgctctggtctagtgactctaccactgactgcggaggaggaggggtggggaggagagagggaatgtgtgtgtctgtgtgtgtctgcctgtcatgggaggagaggtggtcctgtggaggcagggtgtttttgaattgtcagaaatgaacccagagttagtctacaatataattttcttgtaacactcattattttggtctgtaattttcagaggtggaaggatatacacttttttaaaaattgatcaccacccagtctcgttttcaccctttctacctccaaattactctaatccagctgagctttgaaagtcgacactctccatatgtttgctggtaatcaaagtctccaggctcctttgctctaaagggaaacacagtctctttactgtgaaagccatttaactttctagacactctctttcctctttgcccagatgatttaagaattcatgtctatatgtgcattatttgccattttctctccaagaaggcttgtatttagatcagttcagttgagggaaaaggcactttagactgtccttctagatcaagtgtcagttgagtaaacctctcaagctctgggtctcagccttttgtctagaatcagaaatggcatgaattgtctgtgtagaacgttttgtgatgcagtgagaatagttctaggttaaaagttaaaaaaccaagactctgcttcctgccattccttttaccagattaggagcacaaccttggggtaagtctactcttttcagtcctcagttttaaaatctgtaaagtgggacttgaaaaggtggttttgagtcgcaaattagaaatgtatgtaaacatgcttggtaaagagtatgtttatatgtcactgtaaattggaactttatttaggggagttttaggaagacagtgatttggg

SEQ ID NO: 51916 - DNA, 967 bp, Bovine  19866881403505
tcacagagtcggacaagactgagcgactaacccagtcaaagattattcttagtttaattggcattaattgattgctaaatgattatagtgattttccttcttgaagaagtatgctacaaaaggcatatgaattcagcataaaaaattaggtgttggagtgacatgttaaaaggacattaatgaccctgaagttaaaccattatcctcatgaccacagggttccagtcaactgatctcacctggatagccatgtatatacaatgttaggatgtttggaaaagtgaggaaactagggaaggagagaatcaaagaaaataacatgtaaaagccaacataaaaataccataacccctggttcattgacaagtaatattaaatcaaggttacctggctttccaaaaagttggtagattttttacaattttaaattaatcttatctgataatagtaataacagttcctttgatttgttggtaaatattatgattttgtacttagattcttcatgtaattcttttcaatactattttaggggtcttcaagttctgcttactcctgttcttgcaaacatccttgaggcagatcaagaaaagtgttggggttttgaccagttttttgcagaaactagtgatatacttcaccggatgatagttcatgtcttttcactacaacaaatgacagctcataaagtttatattcatggctataatacgtaagtacctctttatattttttcctatatcatgatgttatataatagttacgtatcttcacaaatcaggtgaagaaaagatgtacccatttctgggtagaaagtgttagaaaatgttttggtgcttagtaaattacttttcacttatctttaaagtaaaaagattaattttctaaaatttacaagtaagctaacttgttcttaaactacaaattttacaagactattttcctttatgtgccttctttcaaatta

SEQ ID NO: 51917 - DNA, 1424 bp, Bovine  19866881437830
atgttgacaattaattttttttaatgttagcaatatatagaccaaataaaaaaatttgtgggttatatctacccatgggtcacaaatttgtaacatctgctttaaactcgtaggctttttgaagtaataatctcagaaaacagttgcatgtgattttatgattctacatttataaaagtaatatatatttttatttttaggactagcttataatgaagaacaaatccacaaatttgataagtaagtgtccagattatggttttttaattatatttatttgttttaattgatgattgctttacagtattggtttgatttctgccatacatcagcatgaattagccataggtgtacatatgtctcctccctcttaaacctccctcccacctcccgtctcccaccttttcccacccctctaggttgtgacagcctcagtttgagttccctgaatcatagcaaatttccattggctatctgttttatgtgttagtttatatgcttccatgctactctctccattcatttcaccctctccttcctctcagattatgtttaataattatttttggttatattgttaatgagattcttcttaaagttgtgattaatcacaataaaaaatacatcttgatattggctttatatagaactgttactgaatgtgcacatatttgaggcctactcacctggctccctggttcagaggttacagagataggagagtaagggggacagtcttcttccgcttcctgtgctctgattacagaaggacagataatagagaacatagggtgagggcacacctaaccacctctaaccttaacctcattcagtaaatagattttgactgttctcccctatgaaccttctttttcttttgctgctaaaatgtctgtcttagaaaccttaggcgctttctactgtaaatatcctaaacccacaacagtcgttacaggaaataaatttcatatattttaagactctttaatattggaaatagagacagtgacattgctttaagcccctaatcatttctaaattacaggcaaaaactgtattatcatgcaacaaaagctatgacccactttacggatgaatgtgttaaaaagtatgaggctttcttggataagtcagaagaatggatgaggtaagtaaactttttggggggcgattagtggttggctgcacaatatacaatctaatctatattacacattttaagtaagggtaatatttccttagactgcttattaatcgattctttttggttttcagaaagatgcttcaccttaggaaacagttattatccctaactaatcagtgttttgatattgaagaagaagtatcaaagtatcaagaatatactaatgaggtatagcttcaaaattatctagaaaaaaagcctttttcctattagggaaaat

SEQ ID NO: 51918 - DNA, 680 bp, Bovine  19866880447016
cgccctgctctccccctgaagactgctgctttgcatctttttctgcttcccatttgctctgtttctctaacttcttaactcttcttactccctcagtgtaacggttgagggtaaagcgcctgcctgaaatgcaggagattgggtttcaattcctgggtcgggaagatcccctggagaaggaaatggcaatcccctccagtactcttgcctggaaaatcccatggacggaggaacctggtaggctacagtccctggggtcacaaagagtcagagaggactgagagacttcactttcactttcttcctttcctaggttaggtggatgttctgtctcctatctttctttggcatctgctgaactaaaatgttctttttaattccaccttttaaaaaaccagaggaagttactccccggaatatctgcttctctctcactcccagggaacaagtgtgacctgtgggaaaaacgccacgttctctttgaggatgcctgcatcctggctgagaaatacggcctcctggctgttctggagacatctgccaaggagtccaagaacatcgacgaggtcttcgtgctgatggctagggagctgatggcccgccacagcctgcccttgtacgggggagggcgccccgggcagcctcccgctggagtccacttccagtcctcatggccccgg

SEQ ID NO: 51919 - DNA, 2618 bp, Bovine  19866880591504
ctattattcctttagttttatggaccgtattttgcttcctttctcttttgttttgattatcacagtgatcatgtggattttgttttattcattgtgctaccagtcattatttattttgatgctctggttttctcaaatttggccagtaagaatccttttcagctagctcctatatcttttgaatacttctttgttttctggcacaatttgatgccctaggctctctttccctgcctgagatttgggattggccatttgttcaagggacagaaaacatggccatcctcctcaattacctataagatgtcactttccttaccacttaaaataagcttaatactagctaattgtttattattactgtgtgccaggtactctgcaagtgttttccatgcattcagttcagttcagttcagtcgtgtccgactctttgcgaccccatgaatctcagcatgccaggcctccctgtccatcaccaactcccggagtttacccaagctcatgtccgtcgagttggtgatgccatccagccatctcatcctctgtcgtctccttctcctcctgccaccaatccctcccagcatcagggtcttttccaatgagtccactcttcgcatttaattcatgtacaaattctttgcggtaaatacttttacatatccccattttacagatgagaaaatcagggtgtgaagtaaagcaaattgcacagagccattcagctagcaagtggaggagttaaaatcagaactcagatcattctgactccaaaatcaagcttggaacccccatgatatatcaccaattttgctacaaaaagagaaactgctttaaaagagctgaacttcataatatagataataacacaaaacaaaagccccatgctttaaaatggtacctattacacaaaatgtaaagaaagaaatccttgagaaatttggtaacgttctcattcattccaaaatgccaataatcaccatttaagataacctgggtgaggactggaatgtgattggcagctcaacaagaagccttatcatggagtgaattggagcagggactctggaccaagtcattgttaaagccttccaagcatctcccagctgcaacatttttctgtttctggggtgatctgtttagtgcttcagctgtccaggtaaaagagagggatagctaggggctggagggagatctgttgtgattatgtaactgtgtcctggttctcaatgtcctagggtgccaggaaagataggggggacttgcccagtcaagggctgtgacgcctggaagaaggggcccctttttctaatctgcacaaaggtgccctgtgggctatagaggctctacccgagtaaagtcctcccagcttgagattgactgttttgggttcaagggcaagagactccccattatctcgtaatgagagaaaactttctgctcccaacaggaatttccagttagagttattagcttaggtataacccgaaatttaaatgtaattacatttctcttagagctgaggttgctcctagcaacctgccagttctcttcccaggaggaagggcgtcagcctcttactcttttccttcttttccaccttgacctccgcgtccagttaggcctgtgtttagtgaggagccttaacccagacaccaagtctccagccagtctgtccccatgccctccctccctgggtctttgcccgagggcagggagaggtactcgagtaccgagggcagtggtgtgggatattgcagggagcgataggtggggggcccattaagataaagaggaagaataaacagaagcagatgtacctttcgcccaggtccccagctgactgataagagctaggctccggagctgggcctggcctcctgggagctgggagctgggacaggcccctccattctcatttctccactggatcctgtttcccttcctgggggaacgggccagaggggctttccctccattggaatgcaagccagatatattcacaatctattaccaatgccagtgactcctttagattgaaaagatgtgtccagacaccattctcctgtgaactatgaaagtggagactgtgcacaaacatgtacacacacacacctcacacacacccacactcatacccatctaggctaagattaagaagcctcaagctgtccccaatccccagaacgatggttccccaaagctatggggccctctccatgggatgtgttgtctaagcttcagtacaggactctgggcccgggggagaatgagtgaaaggggaaacctctagaaaccctcctggccctaaaatttctctggccttaaaatttctctggccctcagagctgtttaaggctgcccacccccaatccagaaaggatcaagccaatcgaaactctgcacctttaagggtgtgggctggcactggggttggggatagccatggtctgcacacttcctccccaggacacccccttccacccggccaccagcatagtgttctacagcactgtttccctgtgaaaaagaaaaaaaattgtcatggaccctgaacagatttaaaactttgaattggtaatattaccccaatatgtgcacattttcaacctcagtataaa

SEQ ID NO: 51920 - DNA, 1707 bp, Bovine  19866880634145
ttttgatgtgggcccttttacagtctttattgaatttgttacaatattgcttctggtttacgttttggctttttagcctgcttatggggtcttagctccctgaacaaggatcgaatcctcaccctctgcattggaaggcaaagtcttaaccctggactaccagggagatccccaaattttctttcctataataacctatctgagaaaaccatttagtacaactccttgattgggagatcccaatgagctatgagtttgtatttatagagacttactgtttcagaaattaaaaccaagaaattaaaaaaatacattggttttaagttatttaaaaatgaactaagtaacccataacatgttaataacataaataacattttacgagaaatgactttttcaaaacaacaaaaagaatcacttgctaaggagagtgacactgacttatatttttgcaaatctcttcatgtctgacttaatagaagacaatggattttcatgtctgcttctgaattcaatctcttgtagcaggatcctttgaaggctataaagagagtttggctttcagagatacatagtggaaaggggagaagtattttaatagcctttttagttaattgtggatatttatctttgatactataccagaatttgacaagaggcaatttcttaaaggttagtgacaatgtggaatctgaaactatattaattaacttttttatcctcttacattaagatccatttgtctgtcttgtcctttgaatgggtcttggaagtgacaggctcatttcattctttttggaggaaatatctgccagaaacccaaatctgaataactagcctttgtctgtcagtcactctttcaaggaaaaatgacattccagcctgcaactcatagttttctcaaaacagatgtctttctttggtgtgctgggtgccagatgcatattttctacttaatggcacagattatttaaaaaacaggggagtggggacttgggccagatttaataagattaataatttttaatgcttgacagatatttactgagcgtctagtatgtgccgaggaccttcttcagtgaagttgcccctttttgggaactgtgaggcagtaaaagatacagggcttaatagtatagtttggtgtaactgcctccatccatactcaggcacaggagttttatccaccactgcttttgcactatcagtggaacagttaaaagggaagaagcagatagcattttagtgttactatgcaaatcgttgtggcctcatggacctgtttgcgtatgggtttcctcaggtacagagtgctgatttgctcttctcaacctcctcaggtttccgtgagggtgggcggaggtggttccagaaggtgctttggcccaatgagtcttaacaggttcttgttgttgtgtgaccgcagatttggagcagcaaccatttgtttcccagtgcagaggaagccactcttttcctcggaatgctggataccattttcctcttctcctatgctgtggtaagttttagaatgctaggcttttctgtggaggaaagacgtaaatgactccccttcttctcaagttggtgagggattttgaatgtgcttactgaggagagctcagtttccctggagtttatatttttgtgtccttcccgtccatccatgtatccatccatctatccatccgtccatccatgtgacag

SEQ ID NO: 51921 - DNA, 2147 bp, Bovine  19866880660866
ctgctttgtcttctaagccttttattaatacaaatgttttttgatgacctcttaagttaggtcatcatgtaataattcctattttagggaactatattgggaatggtttttgctgtccagaagtcaaggttaaactgaagaagtgacactaaggttcataattaacttccagtgtgtaacataaactagaaaaggaaaaaaattcaagagtgatcagccagaagtagctaaaataattgatttgtatagagatggagtacaatggtatactcaagaaagtaaagaaggtaaacagtagctttgcacgagaagtacataaagtaatgattagtccttaagcgttatttaactcaaagctgaacttttagaaatttaggtaaagacttcacattgaaatatgcaagtatattcttattttttctataccttcaaatgggtcaagtggattgattatctgttaaataaatgaaaataagacttttacagaagtgtcataaggaaaaaaccaatgagaataactctatactttggtactagttaaatattttatgccagcagagaagatgacaaggcttttctgatctgtaattcatgaaaagtctgttacttatactaactgtgataaatgaaacatggcacttatttctgatctatattataaatctatattaaaaatatacacaaaaagattaaaattaactcaatttattgagagagggagtgggagagaggggagagagagagacacagacagacactaacttcgagagagagagaaaacttaatttacaaaacagctgacagaaccagattccccagtctgtgatccaaaaaaacagcagaaaaataaacacacttgaattttctacattcgaacactgctggatacttacatcaatattgacgggttctattgtgtttatatgcacatttggagctgatgaggaccggtctcgttgtccaaactgatttcgatgatcttcatctgctggtcggaaaggctgtggaattggaatggattttgaaggagatggactggtgagaattgggggcctggaaaagtcaagtgattggaagataagatttagagcaactttctagaaagaataacatagaaaaatgaataaagattttgttttcataatcttaaataaaaccttaaaataaaggcaatggcagtaatggcttttaaaagaagtagtttaaaaaactgatacatgcttacaactaataccaacaaagctgctttgctcaagcagaccctccacgaagtatcaatgataagaatactgattttattcagataactccagagaaatcttcaaatggctagaaattacctgtggttaatcagctgaagaaactcttgttctttaacattatacaaaaatgttctaagtacacactgactgaataatgtctgctaattatttctatctttgccatttcttgatgaagttactaagatgaaatttttatgggaagtattaggaaatcataaatcttttaaaaccacacatgtgtatttcaggtatctgttgctttatacaagatgtatctattgctttatacaagaggtaaattaaaatcttgaacaaaaatggcaaaaataatttccaaattcaaaagatgattctcagagtgtcaatctctcatagtttgaaatgtttactatgcccaataattgatacaagacgcacagaagaataatatattaaaccttaaagcaaattttctaaaaactgctttttgatgaaactgacagactgacctattttggtagtgtagataaataacaaagtctatgatctctcactgcccccaaaatgaagctggcattcacagagcacattaaagttttgagaatagattgtaaacacccatgagaagtctatgttcttcagaaagaatatccaagggagctgagaagtgagtaccacttgattgatgaggtgcgactcagtgagctccgtcaggaccaatgaatgattcaatgctaacagcttctcttcagagattggttattgttgcaccccatcttatgcaaactctgaaacttatcagcagtatcaagtggttaataagacagccagaaagacagctgaggggaataaaaagacatttttgagagagagttttaagaagaa

SEQ ID NO: 51922 - DNA, 1814 bp, Bovine  19866880662130
atgatgagttttccctgaatctataaaaaggtgagcctcactccctcaaacatttgcagctgtgccaggcaaggctgtggcgtcgacaggacacaaaacagcaagactgctcttttaatttactgaaaggagcccacagttctcctagggagaaagatcttgggctgttccagcctcgggtttctctttgcccgtgttagcaagacgatctgagtagaaaagcagcttctctcaccgatttcttccggtgacaccaggagtccaaagaagatgatgatcccaccagcaaactgcacggccgccgtcaccaggaaggcatactggggggtgggaaggggagaggtgctcctgacacatcggggatgctcgttaaccacacagtcgttagagacacacgtggaggacggcacgaccgggaaggaagtgagcgccgggcacccggccgctgccaggcactaagctaagtgttttacttgttttctcacaagtttttcccagggactctgtgcagctcagagaggataattaaggtctcctggacaccgagtggtactattacaactgggaagtcagaattagctccaagaatagcgctcttgccaccactcagcctcacgtaacagacagtatctgccctcaaagacagtttccagttgaggggggttacacactacacacaacattaattaataggaacctccctggtggtccagcagttaagaatctgccttgcaatgcagaggatgtgggttcgatccctggttgggtaactaacatcccacatgtcgtggagcaactgagccggtccaactgctttgtcgcctgacgcgacaaagactcttgagtgctgcatcgaagaacccacacagccaaaacactaaataaagataaattttaaaaagagataccacacattaatataggcagcacggaggtgggtaaatgagaaggctgagtccccataggaaacatacagaggaactgaatctggaagaaaaaagccaaggaggttgaaggagggagacagtgctttagggaagagctgaaaatcctggcgagtgaccacctttcccagcacaactgaagctaccaggcgggagggagatgggaagccctctgcacagggggagcctgagggttgtgctggggggtcacagggaagaacagtgtccttccgacggtccaggtgagacactcgagagccagacggcatcagtgaattttatttaagagagaatggagcctgaggtgtcaatgagtgtttccagaattcaaatctgggaggagcccatagggtgacctgaaattcccatttgagccaattagtacagtccaggtgtgaagctaagaaacctgggaaaaggtgactatgaacacaggaaggacttcccactggccctaactagaccaaaattcttcaaggaccaaacacttggcaagctgtttaaaaactgttacctactttctaaaagagcaacttactttcagttattaggtttggggttttgttttgttttggctgcactgcatggcttgagggatcttagttccccaatcggggactgaacccacaccctcagcagtgaaagtttggagttctaaccactggactaccagggagtttccaattattaggtctttgaacaggcgatccgttgacatgagccattcgatttttttatttgttgaacatataagcactgttatttagcttgtactttccaaagtttgttttggaaacacacaagccaatacaatagatactctttaattcttcctccatttcacataaatggcaatactcaacacacggg

SEQ ID NO: 51923 - DNA, 702 bp, Bovine  19866880670802
ctgccgcccgccatgatcgacatcgtgtgctcgccaacgcccttcctcatcgggctgctcaccagctcgctgccgctgctcagggagctgccgctggaggaggtgagctccctgtcggggccggggtagggggaaggggctgcctgtggctttgctgcagcaggcagggtcaggggagcagcgggaccccacggctttgtgagtcagcaccctcctgccaagtcaccttcagcagaacctcttgactgcagactcagtctcccctctaaatgtacctacagccgtggacacccattgagaaaggctgcagtcaacaatttgttgctgttgttgagtcgtgtcccactctttgcgaccccacagaccactgtccatgggatttcccaggcaaggatactggagtgggctgccatttccttctccaggggatcttccatctttccgtggatagaaagctgtgtctcctgcattggcaggtggattctttacctctgagccaccagggaagcccaaccaacgatttactcgattttaatacacctagtcagtaaagagccatctgccctacccttcccccatccacccctctgtcatgggaagaaagcacacaaagagctaatggtaactggaaatcatctttgggccaataacaaagtcttgagaaggactgtgttcctataagtaggtcattttttgtatcag

SEQ ID NO: 51924 - DNA, 859 bp, Bovine  19866880679542
ttgtcattcactagaagtctgtcgtttagcttctggtgtgaacgcactacggacagataagtaactttctcgaatattaaaaaccgtcgtcctgcctaaaacttttacacaaattgtttatgtgcagctctgactctcttattcagcctagtgtgtagatttggccaaaaccttgggaactgaaattaataaacgaaaaaacaaaatgtttatcatcagagaaatgaagaaaggggtatagggaaatatttatttaggttgttatgacaacagaacaagtgatcacaacaacattctttctttcccatctgctaaactttggcttgacagagccttaaggaacactcaacgtccaccgtaaagatgaaacggagcaagaatgttattctaaatttgatagatttttggctccacttaaaacccttttctaactcatacaatatttgccacaactcccagctatttcctctcgcagtgggcaaacacacttgcaacgatgaggaaatgaattgtgtggcgggggagggtgctggtggcagtgaccacaggcctccggcaggccaatgttcaccccgggatgtcatggggccactcactgagtctgcagtgggccctgttctcatgccctgctccatggccttgagaagatggggggctacagaagggaacctggagcagcctacttctacttccagctgagcagggctagaaatcagggcatgtgcagcccatagagagcaagtggtgcccactgatgaggatgaaagcatgggctgaacttaggctgaaggctttcttcagaggcttttccaggtcagacgacttgcagccagccactggtttgtcatggcctagctga

SEQ ID NO: 51925 - DNA, 891 bp, Bovine  19866880847448
ctttgataaataaaagctactttaagttttgtttgtttagtttaaacaaacacgtcctcagagctgtcaacaccatgatgcagacgtagaactttttattctacctaggtttattaaagtcaaaaaagcttatgttatcaccgttccagagcttgtcagcaaaaaagataagaagacggttagctgtttaatgtcttgtgaaattttcaagagtaatctaaacataattgcttaaagatagtttccgaaacattttcatcagcttgaaatcttatagttatactgtgctgtgctgtgctcagtcactccaatcgtgtctgactctttgtgaccccatggactcatggaccccatggacaggctcctctgtccatgggattctccaggcaagaatactggagtgggttgctgtgccctcctctaggggatcttccccacccaggaatcaaacccatatctctggtatctcctgtattgcagacagattctttctccactgagccacctgggaagcccatagttacactgagctaagttaaatgatggatagtcattgaatatctagatcctttccaaataaaacactgacatgttaaaaactgatatatttatctactttgagattcttactatagaagaattaaagatgtttgggtctaatagtaaacacatctgccacaccgaaaagtttactgaaaagactccatttctagaaattattaacagtatttataagttttccagtgcacagaatgctgatgtaacaaccagtcgattattgtttacctttcagttttcactagaaagtaaggtttctaagggttaagaatgctaattgatacatttaattaaaaataccagaagtaataatagtgaaagaaaacaactgtg

SEQ ID NO: 51926 - DNA, 1654 bp, Bovine  19866880853232
tataattatgtgcacccgtgtctacgtcccccacaagaaggtaagttacccaggggtaaagggtgcgccttagtcatctatgttccccagcacccagcctaggacttggaacagaaactcaataaatgttccatgaaaactgcttttcatgatttttcctctcattgttctccagtcacgtcatagtaaaccttgtgctgcctgaagattttcatatggtaaccctcagtcctttaaaaaccctttttacatcattaaatttgccaatttacagtcatgattcaaaaacatttccattagtttacaaacaatctctgagcctatgtttcactgggataactatttctgccgcttctcccttgaatacagacctttcccacaacataacatatccattgctgatgaaaagccaacttacagagcaaatatttgggggcagtagtggtagacggtataataaaaggaattattgtatctatttatttatattaagcctgtcttgatgccaatatttccttacaggtatctaactgatattactaaactggttgtgagtgaaaggcaaaaaataataataataataacacacaacagtaaagagaagaaagtaaagtagaagataagtagtgatccaacccacaataattaatagctgtgttcttaagacaaacacactagaaaacacacaggtaattatggggcacttacagagttggcacaacctctcaggttaacaatgaactcttgagaaactgtttacagtcatgtaccagcctgcatgaggtaacccacagccagagatgtttacaggtaatatacaagagtataagaggcatttacactgctcgtgctggtcatcgatgcaaagccataagcagaacgtggtccataagactcacccaaatggccccaaaattggtctcagtcgttgttcacatatattctgaatatatagccctgacagtggtaatcaagagatattgtgtggggaagcttttgctttctaaagaggcctttgcaatatttatcaagaggttaaatatgaatatcctttgactcgggatttccatgtgactgtagcataggaataaagatacaaatgcacaaaaatgttcactctggtttttgtagaaaagtacttgttcatcaatagcaaagttattaactaagctgtactacacatccataccttggatattaaacaagttcttaaaaagagatatgtgtatattttctgacatgggaaaatgtcagtgatacgctttaaaaactcaagtagcagaatattctattatactatgaacctacttaaaaataatgtgtaagaacacatacacagacacagacacatctatttatatatgcatagcagatgtttgtaagcctacccaccaaactgcttactgtgattatatctgaggaaaaggatcaaaaaaaagagtaagaaatcactttcccttttatagcatatacatttcttactgttgttgtttggtctctaacttgtgtccgactctttgtgaccccatggacaaggctgctctgtccatgggattctccaggcaagaataccggagtgggttgccatgccctcctccaggggatcttcctgatccagggatcgaacctgtgtttcctgcattagaaggcagat

SEQ ID NO: 51927 - DNA, 1001 bp, Bovine  19866880886664
ggcgcttctctctcagggtctgcttggcgcacctgagagttttgcgctcagaaaggaagtcggccttctgagacactctgggggctgtcgcaaggctagactctgttggcttctgcttggcactttgcccaaactcgtctccacctgtgaggacattggcgagggggctccggagagcgtacgtcggcagaccaccagttggagtgacctggctaaaaatgggccgctggaaagagtccctccggaggggcggctgggctggctcctcctgcacgtgcgcatctggctcagagcaggggctctcttggtaaaattcttccctctcctcctactctatcccctcacctacctggctcccagtgtctccagtctgtggctccacctgcttctgaaagccaccgagacttcgggccccacctacatcaaactgggccagtgggccagcacccggcgggatctcttctcagaggcgttctgcgcccagttctccaggctgcacgtccaggtgtcgccccatccttggactcacaccgaacacatcctgcgccaggcctttggggaggactgggggagggtcctctgctttgagaagcaagagccagtgggttccggctgcgtggcccaagtgtacaaagcgcgtgccaatcctgccttcctggagaacgacagcatccagagactggccacggcctccatactgcagttctctgaaactggggcagctggggggctgggcgagctctctggacgcctggagaaggccgggaggcctcaagagagtcttgccgaccagtcatttgtagaaaggctgctcttccctaaaccggacctggttggatccaatgcatccttgtctcacgcttcagggaccgcccatgaacaggagccagatcaccttgtcccggtggctgtgaaagtaagtgttctaatgtttgcagccaggccctcccatctctaaaacctcaccaactccaccgagctacccaggtcaggatacaacc

SEQ ID NO: 51928 - DNA, 1175 bp, Bovine  19866881000578
gttttagtaacttggctttttttctaatcagtgccaaactcccccagtttttttaactttaaatatgaggtaataaatcttttacccttccttgatcttttgacttataataccttggtcagttgtttcttaaaaggaatccttaaatggaaagagacaatatcactgtctgcagttctgattagtagttttattcagaatggaaaaacagattattcatttttgaaaattgttcaggggtatgttcattgttaggaccttggactttggagtcagtgcctagctatgcattccaggtctgccattttctggctgtgaaattttggacaagttacttaaccactttaaaccccagctttaagaagtaaattaaccccagtaaattaagaagtaatagcagccacttcgtagagttgttatgaggctcagatgcagtgcaaatgtgtataaagtattcagggagtcacctggtatactataatagacactagaatagttgccaatattatcagcatacaatctgaggattctgtcagccaatcattagcaatctgttgtttgttgggacatgccagtgttctccagttgaaatcagtagcaatctaaaaatggatagattattcctcatttaaatagtgtgttcatataagtgattgcttggatccttatcagaagttgctgttactgaaaaatgataaggctgactaaattgtgatagttgtcagttactaaccaactcccagaaatgaataagaggaacctatctctagttcctagtagaaggtatggacaaaatagtaggtgaaaaataatgtcttgaacccccaaattaagtaagctttaaagagtacaatacctcaaagggtctttgcggtttaaaatttgtatgctgagaatgatgttcattgacatgtgcctatatgtaattttttgatagtttaaaaggtgaaatgaactacagatgggagaggtctgaattttcttgccttcagtcaaatgtgtaatgtggacatattatttgacctgtgaattttatcttttaaaaaagattaattcctgcttcttccttcctaatagttgcattataataatgaaaatgagttgataatttggggggaaagtattctacaaatcaaccttattattttaccatggtttctgagaaatttgttcat

SEQ ID NO: 51929 - DNA, 668 bp, Bovine  19866881106790
gccagataacagtaactggaatgaaaacaacaacactttcaacttaccactaatgcagaagagcacatgccgaaagacagaacccatcgcaaattcagccgatccccgacgataccgctgatgaaaaggccctaagaagaaagcatttcattttacagctctgggtaacaacacagcctggaaaaagtacgatacattctaaagcaaatgacgcaaacaaaacacaaaaattaaacctcactctcgtgcttagcctaacctctttatcagtttcaccagtgtttcaagaaatgacaactgcttctgcacactgtaaacatttcatgcaccaagacagtgtaattcagggcaaattttccttctatttgaccccccataactgcctgagacacctaggggaaaaaaagaataattataataaaacaagcacacaaatatactgcatcttctagaacagatgaactccaacatcagtatctgctttcccaaagggattcgtcttagctatttgcattctgaatgaagatgttacaacatgtcctacggaacagaagcgacggggccacgtgccctgcctgtttcatctaacccttgggcttcatcacaccacgaggcaaggagtacagggaggcacagacggtaattagctgaagataagtacaagtgtt

SEQ ID NO: 51930 - DNA, 1547 bp, Bovine  19866881180775
cacctgcagcttggcttactgtctcgttgggtccagtcctctgggtctctccccttttatcccattaagagaaatgacaagactaagtgggtaactgggaggtagaagggggaggcctggcgggggtggcagaatccagtgaaatgggaacaagctggggctctagcctctctgactcagtgacccacatgctaaaaaacagtcggagcagctctgccttagccagtccaggaacagggcaggaagtccagcttttggcccactcgtatcctagcttgcggttacagtgttgaaagcatgcatgtctggaaagctttttccccgcctcccccttcatcatctgtggcttcagtggcaatgtcaggaaaccacaattggcctactccacccccacccagctgcctccctgggtgccaagaaagaaagaaggttaacagtccgtttcgatatgctggaagccctcgctgctaacagtaacagtcccttttcctcacctcataggtcctggtggtcgacctcgtcaacaatcggttcctcaggcaggtgagtaagaagcaacccagcttcaaccactgcttgctctgtttgcacctctttgatgtttagagctcgcctttccagctctgtggtgggcctggaatcccaaagcaggccagcaggcggggggcagtccccggccagggcttgactgaggacaggacagaaggcaggggccaaagaagaggggtttggacaaaggattgattcccatgggctctgtcacaaaatggtttgctgatagaatctttatataggttataactgtagacacttaacctttttcaacatgcctttaaatatttgacaacaaatttcatgatataatacaaagtggaaaaatcaggataaaaattatatacactactttgctgatcttgctttttaaaggatagaaatgagggggaaaatacacatatatagaaagatagaaaggaaaactcatcaaaacatcaattctggttgtcttagagtgggagactgaaaaagagacagattatgagaaattttagattgttttgatattttcatacattttttataatgatcataaactactttcattatcagagaatgagggttgggtgcagttcagtccctggtgggggaacccacgtgctccgtggcatggccaaataaataaacttggagtggctactgaaaagttatgcatgatatttgctgttttttattattagctccatctactttcactttccaagggccctctgggtaggcccatccccactgccctccggctctgagacccagatcataaagccagctttcaatcatactggtcatctgccctgaccaaagccccttgataagaattagccaccttgcagggtggagcattgggaaactactgagtagccacttaggtgcagggaactttctcaagttaattgtgttgcatttaattcctcccagcccttactgagctattatttacgtataacatatttaaatttaagacgtacaacatgatgagttgatatacgttgaga

SEQ ID NO: 51931 - DNA, 1477 bp, Bovine  19866881332464
agagacaacagttctgactacctacagtaggccactcttaacctggaggatccaaactttatagagtgcacaggactcgccaggatggcttgctgaaatacagatccccaggccctcactcagtgagtccacagtaagctaagtgttctgtactttaatgagttcccagattgattctgatgtaagacatttatgaactgtcttttgaaacacagttgtaggaagcagaggcagcatctcagggcagctgcagcgtccatggcaatttctggtgggggtcagtggcaagaatgtgtgtatgtctgcgtttggagggtgggagagctggggcctgcgtgtcaagtgcgcggtaatgagaagcatgtgtctcctggcctccctgaagtgccaagttcaggctggaagaggacgcggtgggcagcagggactgaaggatctgtctgaccaagtgttcacttctttctagacaggaagaatctgaaggtaaaagtggagaggacgaactgataaatgtcgaggggccttccatgttaggtcactaagaacccaaggcttttagtacagtgcactatagcacaagagcgccacctaccgtggccctgcaggcgggggcaggcccttccaccgctaaacactccctgtccagcccaccccgccctctcacctggcccaccgcagctccaatgctcccggttccatcaacgatcccagtgacggtcgccagagcctcactgctcccctggatcagctcctgacgacccaggtccgcagaaatagcagagctaatcatattagaaggtccaccaataaagaaccctaaagtcagaaacagaacaggttcttattaagacactactcgtaacaacgcgctaggaacctactgagaattacataaactctaatcccagtactctaactggtatgttggagagaaacagaaagaagggggcaaagttacctgtaaaaatggaaactcccccggatgtaacatcttagttagcatccactttcctttagaaaacagacctttctaatccggtgaagtgtgcattccctgacaactgtctgcaccagtttatcaaattctattatggcagagatgagtcagagtatctaactacccaaattcaaccaaacagtgagaaagagagagagaggagaaaaagcgatttaaacggtgcaaggggttccatctgccactgttctcggtgaggctgccacaggactgagcacggtcagggccaagagtctcacagagcagcagcagcttcaactatcccatgagctcaaatttaagaacaggagtttttctataacagggtcccgtgtggcattcaactgattcatctggggttcaagggaagaaatactgaccaattccaacataggaggaaaaaccagctatactggactttttgaaagttggtgaactggtttccaacatggcattcttcctacaccacttccgggagtgata

SEQ ID NO: 51932 - DNA, 1210 bp, Bovine  19866881336525
tgaaatacatacagtaaaagtgatttcatgtacatcttctttaaaataatgccatcaaaatctccattgaacgactttaacctgaatattacctttaagagttcagatgttactgtggctctttcccacatgtaacacatacactatcaaaaataatagaaaaaaaccctcatctggaataaatatagattcagttcagttcagttcagtcactcagttgtgtctgactctttgcaaccctaggcttccgtgtccatcaccaactcctggagcttgctcaaagtcatgtccatcgagttggtgatgccatctaaccatctcatcctctgtcatccccttctcctcctgccctcaatctttcccagcatcagggtcttttcaataagtaagatctttgcatcaggtagccaaagtattggagcttcagcatcagtccttccaatgaatattcagtactgatttcctttaggattgcctggtttgatgtccttgaagtccaagggactctcaagaatacagattagtgagatggtttctctaaaacttttccaaataaatagctaaaaaagaaagtgccagtccaggttcaatgcacgatactggatgcttggggctagtgcactgggacgacccagagggatggtatggggaggaaggagggttcaggatggggagcacgtgtatacctgtgatggattcattttgatatttggcaaaactaatacaattatgtaaagtttaaaaataaaataaaattaaaaaaaaaagaaagtgtatcttaagtctgcgttagctttcccattccctggactccctggatgaggtaatagtaggtggtctcttttggactctttttcttttgtctttacttcttccttactaccagcgggggcatgtcacccacctgtccttctgttggaatgggtgtgttgaaggtcagtacttagagcaaggcttttgctaagttcatgttctcgtcttcttattaccttctccttgggcaggtgtcacaggactggcatctgttccaccaacttactcagttgggatgcttccactccagaactggaaattgtggaattactgcttctgccctcaattcaagctaacagttctgcttcaccagcaacaaagtggatactatgttttaagttccatgccctgtttctaattgattcagaatgaagagggaacttacaggcaatgtgtt

SEQ ID NO: 51933 - DNA, 1029 bp, Bovine  19866881486311
gtcctcttttctatggacttttttttttaggagtttggcttttaccgtaggacagtttaggaaaaagggctgtggaataagtgataaaactttaaatgatgccagatttcataacccaataaaatctgactagtgacaccctcttgctagaggaaaagacgcttcattagccgtacctataattcctccgacgtcgtaccagatggacagctggtcagcttcggcctccttccatccaaagttgttactcagataaaagggcaaccagaagaagaaggagtaattcactaacttcaagcacgcgtaggccagtgaatactacaaggaaaacaccccactgtcagtaaggaacgaacagcacagcgtaactaccattctaatacaattaaacagcaaaacaaaacagaagagctggagctgcatagtacctgattttaaaattaaatgttcctataaattcccattgcctgacttgtcctagccttcctcctctcttcccccaacttagcatctagaaaggcagtataataagccttgggattaaaaacacagaggactactccctaattgtccccacttcttctccttttggctctctggtagaagcaaactggtgttctgaaccataaggcagggcatggactcacatttctttatttagataaagataaaaggtattcgtgccactgaggagcactaaccaaaagcaaacgaacccagtaaacatcacagcttttactgcaagtagccaaccctttcaggttcgacttccttcgaagctaacatgatgaccagtgcagagcaacgtgcctggacgctagttccaaaggtccaagaaaagcatcagcatgaaaactactttcatagggtagtttcggaaagctctgagtcaaaaatgaaagcagaggatcgtcacgggccttgtggctctaggttgaggagtaagagctcccatacatggcagtggggctgagaaacctatattcaacacattattaccaggaaatcctgacattcagcatcaaagga

SEQ ID NO: 51934 - DNA, 1078 bp, Bovine  19866881894322
ctttctctctctctctctcatagttcgtggttggcactttaaagctggaacgcccactttccttatgttacagatgaggaagctgaggcctggagaagagctttacctgagatcacacagagtgtagcaaacccagttttgttgaggtccagcctgggttcttttttaactcagtgacacatttctgcagggtctgaaagtacagtaatggaagcatggcagccacctcccactaggtctcagcaggcaccagaccacatcagagtcaccgctggctctggttcctgggaatcacactcaaagggagacatgctttgcctggaatcctaaaggatgctgatggactcaccctgcaaactcctggggtctctccaactctggaaactcatccttcacttttctggtagcatcttagagaaagctctgcgcttgactctttctggttgctaggtgaattgggaggctgctgagcatagtaataactaactgcaaattgggctaggaccctgttgctgggaaagattgagggcatgaggagaaggggacgacagaggatgagatggttggatggcatcactgactcaatggacgtgagcttgagcaaactccggagatggtgaaggacaggaaaccctggcctgctgtagtccatggaattgaaagtcagacacgactgagcgattaaacagcaacacatacgacacagggctttgtagcagccagaatggaagcgtcttctccaggagaatctgagtgctcacaagtgtatcctggtgtctctggactaatgcttcaaccctcaggaaccaccaccaagtagcaaagcattctgggatctgacccttctcccctgtgcccatcttttaaccttgtggcccagccaacctcccactggggcatctcctccctccctcgcttttgtgcaaattgatcacagctgtggggggccagcattcctttcctccacccccactgtaatgcgagccagctgccagggctccctgctagaacttccttcaaaaacactgcctctcctccaaccagcagatgctcagaaggctccacattaagggcaagc

SEQ ID NO: 51935 - DNA, 1798 bp, Bovine  19866880871433
aatgggcaccaatcagcatgagtctcagcttcctttccacaatcaaaaagatctgaggaatatttaaaagtctgagcttattagagactccaagagaaagtgaaggcttccaggttttatccagcccttctgtagctctccatgtatcacatttcattttatctctaagtcaatttaatttataaggaacgtatcaaataaatagctcttgattctatatttctttatggaagagaaaaagaacaaatttgttgataataaaaaaagaatcaaacctcccagaaattacttaaagagggatgacaaatctgtaaagaaacagaatttttttgtcagctgaaattaacaagagaccaaaaggagatgatatagaattatagctctttctgtttcctatgtaagaaataaatgatgattcatctcactttaaaaaagcagagacattactttgccaacaaaggtctgtctagttaaggctatggtttttccagcggtcatgtatggatgtgagagttggactataaagaaagctgagcactgaagaactgatgcttttgaactgtcatgttggagaagactcttgagagtcccttgaactgcaaggagatccaagcagtctatccttggagatcagtcctgggtgttcattggtaggactgtcattgaagctgaaactccaatactttggccacctgatgtgaagagatgactcatttgaaaagaccctgatgctgggaaagattgagggcaggaggagaaggggacgacagaggtggttggatggcatcactgactcaatggacatgggtttgggtggactctgggtgttggtgagggacagggaggcctgacgtgctgcagttcatggggtcgcaaagagtcggacacgactgagcgactgaactgaacatctcactgtttttcaacctctgccttaaacttgtaactagatgtccacaaggaattagaaactataaaatatgagatgattgtgtggtgggatcctaggcaatgcctcatgcggcccctcaatcccagtatagtactctgtaggttcctcccctctctcccttttcccattagacactgttgcctgaggacatgggctgctcacctctcagtgcactcgtcaatgttgttctcacagtggactccatcaaatcccgccgggcacttgcaggtgtaactgttgacatagtcagagcaggttcctccgttcttacagggctcactcagacactcattcatgtctgtctgacatttatccccagtgaagcccggaaggcacaggcaggagaaagtattcactccatctacacaggaacctccattctggcaaggatctaagccattgtacacaagaattagaactctgaacagcagcatccatttaaccttagactcataaaggtgagtaccctgaactgagccacactaacaacaggtaacaattctgacttttctttacatctatttttccctgactcctccaattacataaatgaatatagtaacacttaactgagattcttagtaagaatctgtttaatagctggaaagaactttacatgtatcactgtcttgcaaaattaatactcataaaactagggatgggatagatattaattagtccccttgtgctgatcaaccttttcttttccctccctctcttcctttcttccttttcttgtttttgtttgttgttttttagatttacatacaactaggaaacgagcatttttaaattttaaacatcatgtagttgatcttagagaacactttacagtcatagcagtta

SEQ ID NO: 51936 - DNA, 3432 bp, Bovine  19866880944136
aggtgtgggttaaattctagcctgttactcctctcccagggccttagacaagttatttagcctgtctcagccccagtttcctcatctaaaaaactgaggatgatggctatgagtctgttgattggaagaaagtatgtgaaagtgttagtcgttcagtcgtatctgactgtttgcgaccccacagtctatagcccaccaggctcctctgtccaaggaattgtccaggcaagaatactgaagtgggttgccatttcctcctccaagggatcttcctgacccagggatcgaaccagggtctcccaagttgtaggcagattatttactctccaatccaccaggaatctctgttggtggtgatgagcaaaaatgcttggtgtccacccaacaggtgttcaccaggcgccccctcccttatcctggcctcccttatcactggcccacctccctccagctccacccaggatcctgtacctttcacattgacgttcatgatggtctctcgcgggacagcattcctgacgtcaatgacagaggcggtgtggatgaccactgaggtgccctggcaggcccccttcaggcactgctcatccagaatgtctccttccagcagggtcagcttgatcttgctctggagctctgtgtgaacaggaggcaggtcactggaaagctctctgcatctgaaagtttcctgataaaggtggcattttacctaggtcttcaaggataggtagactgaggggaaggagagatcgggaggagaggtgaacagcccatggaaggagcaagtcaacaagggcatagcaatcagaatgtgcagcatttcttgagaaacagcaaatatctctttccatcccatctccttccaaaaacataaaaaaagagagtttgagctatgaggagtcatgagtacctggaacacgaaattgtgaaagagactcatgcggcatgtataaaattcattaaggaaagaatttgcatttaattcaaattaaatgcaatggggaatcaggtatggatttggaattaaaggagaaatgtaagcaagaattgtggtgtaggaagcaaacccctgctgcagtattataaagcggatcaaggtggggggtggctaagaaaaagcaaggtgactgagggattaatcgggccatggcaccacagtttacatgacgaggattggaaccagggatccagcagagggagttgagaagagaagaagtacagaaggtttgactttcagaccttaccttccaggtcctggttcttactggagacgggctgagaggaagagtcaaaggcagcccgagttttttcctcttgagtgattaagagcatggtggtgctttttaacaggaatttagaatgagccccaatgctgaatttaactgcaagagctcttattagatatcatcaaaagcagatatcagtgctgaaaatgagctagccaccaagggactaacattctgactatcttagccaaggatcacagagatgtcatcagggtctccggctcctctgaagcccagggaggtggcacaacatcatcacctcagattagtgtggttgctcagctgagtcctactctgtgcgaccccacagactgtagctggccaggctcctctgtccatgggattctccaggcaagaatactcgagtgggtagcctttcctttctccaaggaatcttcccaacccggtggtcgaacccgggtctcctgcattgcagccaggttctttactgtctgaactaccagggaaggcccaccttagattagcccatgaaataaatgccacacaaagagcttagataagtaccctgcacttattttgtgctatttatttcacacatgactttcagctttctaatttccttccccagccatctcatgagacagggattccaatttccactttacaggcaaggccatccaggctcagaggaatagtcttaagtcacacttctaatgaaggctccagcctgcccacctgccttcaagccttgcttgctatcccatcacccacttgcaggacagcagatcagttcaggatcagtcaatttaaatgaaatgggcaatggaggccagagaacagcgagagagaaatccagagtgaaaagtctcctgcattgcaggtagattttttttaccacggagccaccagaggagccagccagacagcctgggttcaaatccagtttttccattttccaggtgtgggaccttgaacaagttaattaacctctgctacatctggtctgtatgtttgtgtcccctcagatccattgttgaaatcctaatgtgatggtgttaggagttaggggcctttgggaggttattagatcgtgaaggtagagacctcatagatggaatttccttcttcggttacaacttggtaaaaccatctgctctcctttaagcctgtttgagattagctccgccccagccccttccactcccaaaaggccacagagtgggacaaaggcagaggagttaactggagagcagaattttctgattgtgtctccacctctgccctgcctgtcccttccccttcctctctttcaaggctgacttcagcagactggctcaaaggccaagcgaggaaagaccgctcacccattagtctgcagggatgcagagtgacaagcagagggcgctgtagatgcctcagctggaacccctagctccctcctcctccaagcctctgtgggcttggccagtgttttgcatagactgaatatgcagtgtaagcttacctgttgtgagcggggttggagggagccccagagagaagctactagacagactagcagttgagagcacagatactgcagccagaccgtgcgtgactctttgcaaccctatggactgttgcctccaggctcctatatccatggaattctccaggcaagaatactggactgggttgccatgacctcctccaggggggcctccctgacccagggatcgaactggtgtctcctgaggtggaaccttgaacaaattagttaacctctgctatgtctgcatgtttctgtcccctcagagccatcgttgaaatcctaatttgatggtgttatgagttaggggcatgtgggaggttattagatcatgaaggtagagcacagataggattaatgttcttatagaaaagaccccagagagatccctcatgccttccactgagagagggcacagcaagatggtgcagctatgaaccagcaagagacctctgaccagaacttgaccctgcctgaattttggacttctagacttcagatggctcagtggataaataattcacctgcaatgccggacacacagggagtgcaggttcgatccccgggttggaaagatcccctggaggaggaaatggcaacccactccagtattcttgccggaaaatcccatggacagagaagcctagcggtgctaca

SEQ ID NO: 51937 - DNA, 1172 bp, Bovine  19866881112137
tcccaggtgggcagtggtaaagaatacaagtgccaatgcaggagatgcagatttgatccctggatcgggaagatcccctggagttggaaatgacatccaaactccagtactcttgtctggactattccatggacagaggagcctggtgggctgcagtccatagtgtcgaaaagagttggacacaactgatccactgagcatgcatgccctcgagtcttatcctcaagaagctcactctagttaacatcacacagacaattaccacagggtatttaaagaagatgtctgtgttccccaaaagtggtgctctttccataaactttttgttccagtgagaataggagtaggacaggagtggccagaagagggaatgggagacaagaaaatgcagatagtacattgggatgcttagtgtgtgaaatgtagttttgtagggggtgtggggagctgggaaggaagtaggatccaaggaggattctctgcttgtaagagttttatttggtttttaagatgagagctccttggggatgtttaaatgctgatgggaaaggactaggagacagagagggtgaagacagagaagagagaaagggtaagggattaggcattcaacaaatacttgttgaattaactaatttctgttacggatcattgctgaagatattgaggttgcaattaataaactgcacattcccagcaaaaatatgcagagtctgagaccagacagaaatgacattcctttctccctcgtcatcagccctcacccacactccttgtcctcaggggaaggtaatagataatccgataaagggggggaaagaagggctccccagctgttagaggatggatgtcaagttctccaattcaatgacaagttccaaaagcatctcagcaacttgagaaaagtctaagcttttaagactgtgggtttggatattattttattagtaaagtaagcaaatattttacccttgcttttttttttttttgactttactttgacatagactagataactgttttcatcctcacctttcaaaatgggaaattgcacctacattttttaagctttcaagtataaggtggaccactattgtttttcttacccttgagaggatccatctcccttttttgataacagcaactttgggaaaataattcccttcccaacc

SEQ ID NO: 51938 - DNA, 1919 bp, Bovine  19866881181224
cgtccggtctgtctgtgcttggaggctggcaccctggtagactaggtccgtgatgatgttggcagaagagtcctctgcatcttcatcttcatcactcatgtctgagctgcctcctcggagagaagccagcatcagtggggtgcacccatctggaggaaagggaaattccaaatagtatttaaggaggggaaggacattcatgttcacttaaccctattgctggaagagctcaatttgaagaaaattattcttttcggaaaaaaccctgtgcttcttgtgataagtggcaattgatttttccttgatagtatcctttctgtaaagaggagctagtctctaagttaaacaagcttttctgttcaagtttctaagtgctatgctttttttaaattggacaacattttaaaatatccagtattaataaactatatacactaaggtatgaattaaacaaattctctattcctctgttttgggatattatttttttaccccactaaaatctatcccaaataatcagcccttttgttgctgaacatgcattatgtgatggcttccctggtggttcaatggtaaagaatctgcctgcaatgcaggagaggtgggtttgatccctcggtcaggaagatcccctggaggagggcatggcaacttactccagtattcttgcctggagaattccatggacagaggagcctggcagctcaggcggtcgcaaagagttggacatgactgagcaactaacactttcacttttttcatcttaaattttataataataattttctttatttctatagatttgctgcataaatatgtagacataaacaaaaattaatgttgctaatacctaatttttattaatggattaatagtgtgcatatttttctgaggatttccattttgcttgacatatttttgatattcattctttctatctcatgtagcagtagtcatttatttccaatactattaatatataatattctgttgattgtgtacattgtcattaattattttaacccttatgaagatttgggttgtttttgctattgcttctgtgatgaatctgctcctataggtcccctgatgcatttgaaataattcctttagggtcatttcataggtagaagttgaatttctgaaaactggtgatacacatgaatcctaaattgtctccagtatggttaccaatctgcacattcaccagcagcacatgaaatccaatttataaagtcaagtttttctgaaactccaatagcatctatgatgaaactcctcttcctgtgtatgatagggacttctgtgtattccatgaatggcttcaagatcagtccattattcacatctatctttgatacatttatactttcttctcttgagtttaagttgctgagtaaatctatccattgagtttctattgttaataccatgatgtatatatatgaatatatttaactcttgaagatctatttgggtctatttgaaatttgccttcttttacttttcactatcaatatacctcaattttattattaaaggctatctcctggctgttttgtatgctttgattgactctctttttgctttaaattgattcttaattccaaataatgtgcttcattttctcttatttgtcttttttgtttttaatatgatcccatgcaagtaatttcacactattttctctatgctaataatattccttaattgcctcaagatattttgtcaagtacttctgtttctacattttctcattaaaatttcctcgtattaatatttagtgttctattaaatttgctcagtatattcactctgaaattttaaatacttttaaaaagtcttagtctcatttaagctatcggtttcattttggttaacataaaaataatcaggtatctatctatctttatatcatt

SEQ ID NO: 51939 - DNA, 892 bp, Bovine  19866881221298
ttacatacagatctgcaaggacagtgacagaggtaagccccaggagaatcggcctggctggggaatctagagagagctttttggatgaattaacactcgagcttaaccttgaagaacagttttaagagttaaagaaagaaatggcagggacagatatccaggcagcagaaacagcatttgtgaggcttcgagatctgagaaggcttcatgtgtgtgtggacacctaccactgtgaccggcgcaggggatgtgtgtggagagttggaagtgagtaaggagaaagagaagatcacccacgtatttattttctcaatgggcctgctcccaggtaatgaacgtgagaaccaggataatgagtgaccagtcaaggcctgacagccttgaaggtttttagcagcctgcacatcaccaggctgaagtgtttctaagcttctctgggtcagtttgcttagggagtcataataaccgacagaccgcagagaggaactctcctcagaggttagggactcacttacctggcgagacacatgatcattccacaggtgagctccgcagcactgaggctgttcccattgggggtactgtgcatggaaaaagaggggggtcgtctgttagccagaccaggattcccacttctgtccctgtggaaagcctccagtgcaccccgagcttgctctcctgctccatgagcttaccagttctttatttctcttgtttagctttatgggtcatttctttagatttttaaaaattgaagtatagctgatacacaatattatataagttaaacgtgtacaatatagtgatttacaatttgtaaagtttacactccatttatacctattataaaatactgttgctattctccatgttgtacaatatatgcttgtag

SEQ ID NO: 51940 - DNA, 1381 bp, Bovine  19866880408495
tccattcatcttgtgatcatagtaatctcaaagattattcttgagcataaaaaaggcacaattagatttgacctgattatttacccaagtgcaacaagagtgttgctgctgctgctgctaagtcgcttcagtcgtgtccgactctgtgcgaccccattgacggcagcccaccaggctcccctgtccctgggattctccaggcaagaacactggagtgggttgccatttccttctccaatgcatgaaagtgaaaagtcaaagtgaagtcgctcagtcatgtccgactcctagcgaccccatggactgcagcctaccaggctcctccgtccatgggattttccaggcaagagtgctggagtggggtgccatcgccttctccacaacaagagtgttaatgtatcataaaggctctttgagtttgctttgcattttctgagtcatacatacagcactgaacagctacaaaggccataaattaacctctgcctagatattttcataaggaatctcagattttgtgtttttaaaggcctctattcttctatcccaaggccaggaagccaagcccaagaatctcactccactagattttactggcaatacctaaacatctaagtgaattcctatcttctggaagtctcccaaatttttaaagattcctagtctgccaagaacttacttactaaactttagaataaggctgggaccctgtaagccaggtattggaccagttttcttaggagaagtttggaggcattggctctatacttttctttcccctgaaaggcagcctgtcacacctgattttttaagagtttcagtctctaatacaataccctaggcaaaaatcttggagaacagattcttgttgtggctatgcaaatattttcatgaaaggtacgggatcatactaagtttctgaattcttgaaagaggagggtaagtgggttgaattgcatctgcctgctcctgctgctgctaagtcacttcagtcatgtccaactctgtgtgaccccacagacagcagcccaccaggctcccccgtccctgggattctccaggcaagaacactggagtgggttgccatttccttctccaattcatgaaagtgaaaagtgaaagtgaagtcactctgttgtgtccgacactcagcgaccccatggactgcagcccaccaggctcctccatccatgggatttaccaggcaagagtactggagtggggtgccattgccttctccctgcctgccccaccccacccctaaatacctcagagttctaacacttgcgaatgtgtattgtttggaaagaggctctttgcagattaattaagttttcttattcagtcccaggaaatgaattcttattctactgtatcttgg

SEQ ID NO: 51941 - DNA, 1329 bp, Bovine  19866880555170
aaattgttacctcgaatgaacataatgattgtaaataggatgtcccctcagtattgaatatcaagatcatgaacatgatgaacaaggcttcttccctaataattagaaaaacctccccaagctctcctttcttgaagacttattgtaaaactgagaagtacaatatccagaatgccgtcgtaagcaacagtcttaggttatctctctgttgttatttttgttttgtctttggcctgcattgatgagaacttatttccaagtaaaatgcgtgaatccaaacaaaacaaactaagcaggctagattttttagtgcatgttttcctttcatttttcaagtcacagaaataagtatttcattctgcgagagggctgtatttcttgtaagaatgatgtacctaatgacttgtaagaacttcctgtcattgaactcgagtttacttttaaatgtcttttaatatattcctatcatgattatcgatcatttttactttcatgatttagtgttcactacacaacagtgtctgttgctcttctcattgaacgtgtgtataagccagacagacattttctcccctgcaactattattcctctctgctagtattttaattatttatagctgtcaggcacttatttgtcttttaaaggtcttccaatcccaatcagaatgaataaacaattaaaaggaagaaaggttttgtagattttcttttccttttgattgtgtgtgttctatataacacttaaattattctttatgaaattagtacatcccaggaaaccagagatttatgccttaggctgggtgaatggaaaatatgtcagtgcttcctttgtgaggtttccagggtgccacaggagatttttaaatgcgctgcttatttgtgttctccccagatctttttcagtttattataatgctggagaaataattaaaatgttgcctagcctttcctatgctctacacctcactgaaaacatgtcggcagagcaagcaaacgttcatcatgtctcaataaaaaacagatcctgccagggatcatgccaaaaccaaccaagcatgacagtcaaatcaatgtatgttttggtttcaatttttatttttgcctttgctttagcaacgtgactctggtatatgttgttccctatggcttatcattttatggcatgacagttcctgaaatggacaaggcttcctgctaacctttgccatgtgtatatgtgtgacaacataaactataagagaaagtgacatttgactcagtaaatatttgtgttatgtcccctacatctgttttacagaacttcctttatacctccatctgtattca

SEQ ID NO: 51942 - DNA, 680 bp, Bovine  19866880559665
atgtaggaggatgtatccagagtattattagactataaggagagagaagtcctaggttagcaggactaccttctctgctttccaacttcttatagtatcactgactaacctcaggactgcttctatgcccaggaaatgcaataacatgcacatgcttcttaagtgatcttagctacatagagaatggaactatccaaaaatcagacagatcattacaataaacagagacaacaggaaagaaaagaagaagaaaaatatgatttggagaaacacccatggggcttttcttcctttcttaaatttctgaatgactaatttgtccctggacaccacaaacatcaattactcattttaaaactgctcagaacatttttttgagttttttaaaaacatttttcaatcattagtccaagtttatataagcagagcttagatacagtccctctgagcattcttatttatgatatatgggatgctgttcttttgaattgggtaaatttccattcaccttatatttaggcctcccaagaccttgttctataatatagaagaaaagcaacttggttccaccagaggctacatgcaaattatggcatgctagaagcaaaaagagattctccatggtcagcagtagtgaatgagaaacctctagttagatccaagaaggagagtgtggcacg

SEQ ID NO: 51943 - DNA, 979 bp, Bovine  19866880669919
gaccaaggaagtggaaatatggcttggaaggaaagctgtcttaggagactgtgtaaaaggctctccatttatatctccttgtgacttttccctttttccctgtttgtcttccccattaacaatgtagagatatacaaacacacgggaataacagttgtaaaatgtgcagaaaatttgagattcctgtggaagatcctgtgtactcagagccactcaaatgggcagtgaatctgatcacttccttacagcccttgaagcatcacctctgaaggaagaacctcaaaggaagcatgacctctgaaggagaatgacatctgtattctcaggaggggtggaaagcaagggtatgctttcctcgccatcgtgctcttttcatgatcaatcctgacatgtaaaatcctgcccttactcagaactgaggtgaagaaatgtaaccagcccagaagtcagatgaagtgagaaatgtgccttgcccaggatttacatgaagtaggaaatacgacaagggcgaaagagaaaaccatacagttattgtagttagcatgtgtatgtttgtgtaagtgtatggatattctttggggcttccctggtggctcagctggtaaagaatccgcctgcaatgtgggagacctgggttcgatgcctgggttgggaagatcccctggagaaggaaaaggctacctactccagtactctggactagagaattccatggactgtatagtctatggggtcgcaaagagttggacacgactgagcgactttcactatagatattctaggcaacatcagattttgaggtgatgaaatagaaagcaatcaagtataatagggtagaaagatctggaaatcccctggaatatcatttcggaaggggaaaagattttccaactccctaggctggaaggaatactcttaatttttatgacatttagatttaagggacatatttaaatggattatgcaaattagagtgtgt

SEQ ID NO: 51944 - DNA, 748 bp, Bovine  19866880719215
tgccttctgcgcacagtaggtgctcactgttttttaatcacaacatgaatctccaaattatattttacaccagaaaggagtacacagattttttccatttcatgaattttttcagttaacaaaaattgaaagtggttgtatatcagaaacaggtgtgtttcatctgtatatagtaaaacactaagtttcaaagagtggaaaattttggtcgttcatagcagaaggaactgttgaaccaacaacaggttcattgagccaatagccatgttaaaagaatatagacagtgccatataactagcaaaatgctcattcaaatgctttaagggtgcctttgatcatgtttaattaaagaaattttaaaatgtacttttcacttaaagttatcttgacacaaccacaacttagcattgttttttcaagcataaaagccagaaaaagataaaacatggcggccttctactctaaaccccataaataatgtataccccacccaaataaaacagttaacaataagacgtttctgagtgaaaggaagagaatttgtaagagccattcataccgtaacagatgtgctgtcttgcttcagccttattttatatttttcctttaccctttcctctcattgacgaccctgtggcataaagtttcatttcaaagatttaaaataggacatggaatccttaagagcaattgcacagagcaatctatcatgaattttgtgactcttatacagcatgcctagtttcc

SEQ ID NO: 51945 - DNA, 873 bp, Bovine  19866880758135
tgatgggaccggatgccatgatcttcgttttctgaatgttgagctttaagccaagtttttcactctccactttcactttcatcaagaggctttgaattcctcttcactttctgccacaagggtggtgtcatctgcatatctgaggttattgatatttttcccggcaatcttgatgccagcttgtgtttcttccagcccagcatttctcatgatgtactctgcatagaagttaaataagcagggtgacagtatccagccttgacgtactccttttcctatttggaaccagtctgttgttccatgtccagttctaactgttgcttcctgacctgcatacagatttctcaaaaaatcctgggtaatttcatactaaataggggcatgtgatcgcttccttcttttgagctaatcatcccagagagggaatcactcctactttgtatcattccccagaggtgaacttcaacttctccaggaaaagtgagcacattttattaacctgcaccacatgaagtttgggaggttttttggttaatagaccaacaagctgtcattgtagagaacaacttctagcctgtgggcctggataaaattatagaaatggagctatcagggaaaatctaaaaagtgtggctccacgtaagaattgtacgtatggttctctctctctctttttaacatcatatgtgtttatactttcactaaatttccaaatgtgttaattcaaattagtctcctaagtattcccttctgtcggtagcatttggctgtacagtaaaatgagcagctgccacaaagcattcgctaatgctcccttcctcagagggagattagtacaaatttaaggtttgtggtaatccccacctgcagcac

SEQ ID NO: 51946 - DNA, 1463 bp, Bovine  19866880834762
gctattgccaatagtgctgttatgaacactggggtacacaagactttattattttaacttgttataaatttttcaacctgaagctttgactgataaattcatgatataataaaaactatttgggcatttagtcatattatcccatacccaaaagaatcaatcatacttattagttgcaagaagtaaattataattttaatgtcaagctaaataaatctatgatattataagaaatatctatttttcaaaatagtatttattctgatagcttccatgggaaatgactatattaataagattgttttctgatattttgtcatttttaatgttatacaaaactttgctttgttattcaaatcctaataccatcttgacatagtccaaaataaatgcaaaccaacaaaaaactaaataacctaactctagtcacacctttttcaagatgcttataaatgatgccttttgcaatcctatattctaagaaccacagactctgacagtagaattcaattacaacctacccttggcagtatatagtcttctaatagaatgtcaaaatggaaacctttctgtttcagttctggctgagatttcaaattccaagaagaaaacaataacgagcaagtgcttccacattccacactgaggtgaaatactgcctacatcagactggcaaagaaaacaaaaatgaaaactgttttacaagccctagttaaatactctcaaacatttcaaggggttaagaagccaagaaagggacttccctgggtggtcgcactccactgcagggggcatgagtttgatccctgctcagagacctaagattccgcatgccacttaccttagccaaaaaataaataagtaaaaattttttaaaaaagaagaagctaagagaaaataaccttttttccttggatatagttgtcaaactcctatggcatttttttttttcctgccttccactcaaagtgtcagaaaagtaaggatggtattctattcttaactgaattctgtaagagggggattaatctaaccatttggagaccttgatatatgtgctctggagtgaaggaagagcactcaaagtgcctgagaattataggaggatggagagacagaggtggaaggaagtgaggtagctatcacacacatccctgcaataaaatgggctgtgtcctatacctagagttgtgccaaatgagaaagagctggtgaccagtaatgagtttaaaagggaccatctgcaggtttgatactacccaaccaaatgagtgtatcttcagaaggctgagagaagaatcctgagctgagggcaagagacacacaaaaagatacactacctgagtaaccagaagtgctggagaacactccataaggtaaacagttaaatgcttgttaaaacgagatcttgacagtactaggtattgcctttgggggcaggaggagaaggggcacgacagagg

SEQ ID NO: 51947 - DNA, 1228 bp, Bovine  19866880869680
aaaaaactaattttaaaggttattgtaggttatttgtggtccttctggtgtgcacacaccatgatgtcatcctgaactcttctctatttatatttcagtcttagaagtcttttgtctaagacttgatctcagctactagagacatctaaaatacttattattcaatactcataaaaatctagaccaaaaaaagttagaatagatggaaaaaagtcccagccaagtccaggcaagaaataattcaggcagatctgtcttctgaaatcatacctacgccatagacatctcaggacacagttgctggagaacttctcaagtgactggaaagtagccacatgtccaaatggctctcctggaaagtgattgcctgttgagtggaggtagatggacccctgccagagacatatcttctgaggaaggggaacaggggattccttgggcagtccaatttcttactcctcctgggtggaccactcgcctgtaattcccagatatgtttcactttgtttacatgacctcctgtggcaatttcacttcttcactgtagcagagttgattttttgtgtgtgtgggaatttttttgcttggaaaaccccttttgttgaggtagtcctcagtaaactaggaaatgtcaaataaacactggatgaagacagactagaaggccagtgagaacagttgaaaatgggggaagctaataaatctcttaagaaaaaagaaaaaacatttggcaattggaaagaacatatagttccactgatatggtggaaaactgacactttcaaggttattaggataccaagctgacattctttgcatcatcttcaaattcattcaagtatttaaaaaaaggcctttgagcatcttgatgtgtcagacacattgatgttagaaaacaaaggagataagtacattatagatactaaatacagtgtgtgtgtgttagctgcttcagtgtctgatctttgcaaccctatggactgtagcccaccaggctcctctatccatggaattctcctggtagtacaactggagtgggttgccattcccttcttcaggggatcttcctgacccaagggtctgacctgtctcctatgtctccagcattggcagggaggttctttaccactagtgacacctggaaagcccattcaatacagtacaacagggaagaagcctgtggagctgctgggatgaaggaactgtaattttaaattcagtgatctgg

SEQ ID NO: 51948 - DNA, 2073 bp, Bovine  19866880889105
atttggtgggccctaagtccaatgactgatgtttttataagagaaagaagaggaagatttggcacgcagacaaattgaggggaaggcggtgtgaggacagaggcagaattgaactgataggtctacaaaccaaggaacatcaaggattgattgccagctgctctcagaaactaaaagacctgggacatcttcctcccctcaggaccttcagaaggaatgatttttaaacttcccaccctcagaactgtggagaataaatttttgtcattttaagtcacccaattttgtggtcatttggtatggaaatcttaggaaactaacacaggtagtcagtaagaactaaatattatttataaatgccatatttctgctttaaatgcagattttactaaattgtatgcattataggtagcttaagacgaaaaagaaagggcttatttatatgtccagaaaatagaaacttaaaactgtaccaactgtattccaaacaaataatcacaagaaaattaccttcaccacttttcatattcagctctaggaaataaatgcttattccagtgaatcttgggttagtgtctgacttcatgaagccgtctagcagtgtggtgtgaaagttgtctgtgtgatgtcagtttcaaagcctgcacttgaatttattctttgaaatgtcaatcatttaaagtctcagagaccttttgtgtccatgatacaactttgccttgcagcttacagtagggactttaggtgagaattagagtaaaataaaactgtttagagacttaatgacctttgttattttatcaccatagtcgataatattatcatcataatcaataatatcaaacaaaagaaagtaaaattcgctatgggggtatagcatataactactttatagaaattttgatcaattttcccccttagggtaaaactgtattatggagaaaaagggcactgacaaatttccagggacttcccatgtttctgaaatatttacattaacagcatttcacccccacatacattatctagaaaaagctgagtgtctcttccgaactgataacttttctatgcgactcttccaatagcaatagatcaaataaacgtaaagttgtctcatatttctttttattaggtgatagaacaaagctttgtgatttctcaggagacctctgggaaatctcaaaaatagttctagatgtaaaatatatcctgaaaatattttcattctttcctcaattcagggacagttttcagaagacaaaagcaaaagagtggtcacaggctatttggacactttaagaaaatagaataataggtatctgagaaacgatttctagttacctagttaatcaaagtgacagtaaaagatataaaaaaaacaaatctagaagataatatctgtagtggatagccagtcccttttgcaaaggatcttcccaacccagggattaaaacggggcctcctgcattgcaggcagattctttaccactgagacatcatggaagtcccatttaatcaaagtgacagtaaaagattttaactgcaaatttagaagataatatcagtctaagaactttagttctttaatagctgaggaatcgttattcttttttgtttgtttctgcttaattaaataatcaaagacataagaaagtaaacataaagcacagaaaattgttctgaagaggcagtatgtcctgtgtaagcaagataacagagaaagtaaaaaaaaaatcctttcataacgtagatgaaggcatgaatcagttaaccaaggaatttagcccatcaaaagtgagcaaatgtgactaaaattttaacatgcttcatattaaaagcttcttttcagatttagtattacatataaaccagggataattaattccaccatgccaaattttgttctatattatactctttcaatattctggaacatgctgacctttggttggaggacaacctatgttctgaggacccctagggaattcttcggaagtctttgaggtcaaaactattttcacaatagcattaagattttctttttcaattttcatgctctcacaagtgtgcgt

SEQ ID NO: 51949 - DNA, 998 bp, Bovine  19866880910796
acatgcctgctgtatctggaagtatattttatccttgacctcacaagaagatatttagaagaagtataaatatagattttgtttttaaagattctttcaacatagttcactggcattaaaaagtgatgtaactttcttatgccaggataaccttaatatacttggcaaatttgttttatattctttaggaacactatatttctaattaatgcttgcatttaatatggatattaacttttcatttgtgtcttttattaataatagaaaaggaaagctcattagaaacattaaagtttccatttctaaagatgaaaaaactttcttttagtattttatgctagaaactagttatgacttggtaattttgaaatagtagttagctatctatccctcttttctgtttagtatttgcttttcataggtgaaattactgtcacacacaagttaaagcagctctggttagtcagttgtttctattacaacacgcatatgtgctcagtcgctcagttgtgtccgactctgtgaccccaacgactgtagcctgccaggctcctctgtccatggaacttttcaggcaaaaatactggagtgggttgacatttcctcctccaggggaatcttcttgacccagagaatgaacctatgtctcctgcactggcaggcagattctttaccactgagccaccagggaagcccagctattacaacagcagcacataaatcttggattaacaatcaaactcttttatcactggatgctgacctagtctgttgacttcataatctgaaatgcctaattgactacttcattgctctaggttttgtttacatcattttttttttctttaattagattgaaatttcttggagaggtaaactaagttttttaccaacggcctgccaatgcaggagacataagagaagcaataaggaaacacggattctatccctgggtcaggaagatcccttgaaggacagcatggcaacccacttcaata

SEQ ID NO: 51950 - DNA, 664 bp, Bovine  19866880935947
ttattttgggtgggggataggaagacagccttatctttgttatgtatacatgaaaaagaacatttagaaatggcatcctcactggttaatattgttcttactataatttaaatgtggtaagtaagtgaatggttcaagaagagaccaaagaatatttccttggtggaagtttaagcacatttgcagaactcaacctagataaaatgtttctgtatttcagtggatacaagcctgtccaaactgtaagtttgttttatgaaggcaaaacatttatatttctccagttatcatgaccatttttcagccttatactgcagttgtagaaatctgccctatttttaaaattaaaagtgattgcattgcaacaactgaatgtttttctagacctcagaagtagctggtgtattttagaattcaaaattagtagcagagtgttatgtatatgcttaaattttatgttattggtgttaggaagtgtatctgctggagattatcttctggttttcatgatgccatcaggttttctcatgtggtgaaagagagttttgagatgcatcctatttctttgtgctcaaattttgtcaacctgaaaatcactgctgatgctgactgcagccatgaaattaaaagtgcctgattctttggaagaaaagctgtgccaaaa

SEQ ID NO: 51951 - DNA, 1673 bp, Bovine  19866880936742
ttggttttgttaagattgaaaaaatgcccaatggcaaaagaggaatgggcaattttcagtggatataactaaatgtgaacccaaacctcaaatgagcaaatgtccaagcagcgtgaaaaccagtgcttttatgattctaagctagccaaggaattctagatcctgttaaagaaatagcaatttagagaaacagtaatctagaaatttttctttaaagatattgaaagcagaccatttgaaataaagtttaaaacagttgactttacactcagggatttttttttttaaatcatcctttcattttgagatgattctagatgttgagacaagagttccaaaagctacaagtcatttctgaaaatcagttttaaaacacagttagatgaacacattttttaattctgtcaattgttgacaaattcacttgaacttttcgagttctaaaaatgtttaaattatctgccaagtattaattcaactttctacatttgagtaaatgttaattttttttaaagtagtgtctctggtaagggtggggcaggtatgtgtctgtgtgagtgtgtgtgtagggaggaaaaaggggaatgagattttaatcagtgtcatgcttttctcctcacttgatcagatttttgttgttgttttaaagatcagtaggaaatagctcacatttttagacattgtagtgctgaagtgttgtttcattattattataaactagactgttgtttagaatgtgaagtggtatgtttgaacccatcatccatttgacagatatttaatgagcacctgtgttatgccaggcagttttgcaaccacggtttcagcagtggcaaggaaaactcttgtggcttagatggtgtcaccagtccaggttcgatgcacgatgctggatacttggggctggtgcactgggacgacccggagggatggtacaggcagggaggagggaggagggttcaggatggggagcacatgtatacctgtggcggattcatgttgatgtatggcaaaaccaatataatactgtaaaatttaaaaaaaaaatgttagctataaaaaaaaaaaaaaaaaagaatctccagcctacagtgctggagacccggattggatccctccatcaggaagagctcctggggaagggaatggcaagccactccagaatttttgcctggagaattccatggatagaagagcctggcaggctacagtccatggggtcgcaaagagtcagacaccactgagtgactaacatacatagacacaaggaagtctgagtacatcattcttcagacggcttctcagaaaaactagaatcatagtcctgattatctaaggaaaacaacctgggacgagaaacagagtatttttctcattgacatactcaatatattttgtaaacatgacatcagtttcctcataattgatgtaaaacatttttcatctgagtatgtataactgctatcctgtagcttagaaaaaaatctctttgattcaagtgatttcttgccttgagaatactattatccacaggatgatgacaccagaaggaatggattggattaattttttcaagcgaaaataaggaactcaatctaaactatgtaaaactcacctcactatgatttattgcttttttcaaaccattgaagctgcaaataaaatttatgacg

SEQ ID NO: 51952 - DNA, 1268 bp, Bovine  19866881067677
caggaatactggggtaggtagcctgtcctttctccaggggatcttcccgacccaggaatcaaaccccagggtctccttcattgcaggcagattctttaccaacagagctatcagggagtcccatatttgaaatagaagcaataaataggatgttagtatctgatggctgtaattcagtggggaggttcaggaaacactctattcaacgtatgtgtttaatgacgctaaattccttttttagaaacacacccttaaccattattgtcttaggataataagaaagcttcagggaaaaactttatatcctccatttctaagaaaaactaaaaattctacaatactttggccagacttattttttttcccttttccttaaagtaatctcaagtttccttgtaaattaaaaaaaaaatagtaaatgtccaacgcttccttaggctgacaaagataggataaatcctttcaaaaacagtaagtggaactgggagtttcaggaagtaacagacttcctgtcattagaagtagggtagtctacttcatacctaactctgatggattgtggaacgcataaatgtcctttgttttcaaccatagtacaaatcaccacgttatgtcatgtccttgtggtataaaaagcagtataaaattatgtaaaaaaaaaatgaactgtgcgttgagtgctgcatttaaataaatttcacttttgatacttaacatggctttcttgattcagataaaggaatttactaaattcagtatattcctaaaataaatattcttgccatgatactttattttccaataggatattgtcactatcaaatctggaaataataatattttcagtaagactttttgtaaaaactgaattttcttaaaattttttcttatctaatgtaaatgataaatagttacatttactttgctggtataactgctttcactttctggaagatgaaacagtatgatcatttaaaatggtatcaaagcttggtagcactctgttcagtttgtacctaggtaaagtaggtcccgatagggcaggaacagcgaaagtaaatctggaaacaccaattcgagtttgtagtttattttttataattcacgttcgtaagtgctagaaaagaaatagcacaaggatatacatactgatactgttgttagcacactggagccaacttaggagaaagggcaccatcaaagtaatgaggagccacagaactttaaaattagaccgattgggtttcattctggttctcacagtcatt

SEQ ID NO: 51953 - DNA, 1849 bp, Bovine  19866881116943
tctggcaattctatgtgggctactccgtatgagatatttgccaattttcattttttccccccaatcaaaacactcattttgatttttaatttttccttagagtcaagagtttctacctgcttcagaatatgaatagataataattttccagcccaaaatttcattaatatttctttgctttaaaaaaaatcaggttcccaccaaaaaaaaaaaaaaactgtagtctacagaacatacaatcttaccaatatttttacctacctgtgggaaatatatgagaaggccagataataaaatatttctttttttcgcttccttggcaaactctctaatctgcattaccttttccattttctgacctaatggtactgattcataatcaagaaaatgcacctgaaaaataatataaaaggtaacaattagaataccattcacttttccttgattaacatgatattaaagaagctcaaaacacatacagagagaacaagatggcagaggagtaggtggacgtggagtacatctctctccacgaatacatcaggaatacaccttcagactcagaattgcatcagcagaacatcagctgagagcagacaggaggacaataccagtggaaaagaatatatagagccatgcaaaactcggtaggatgaaggaactagggggaaaaacaagagtgtttgtaggactggacctgccctcagcaggtgggggaactgaagcaggggtcccatccccacactggggcaattgtctgagtcagaggacaaacgtttaaaggctgggagtgaagaagctgatccatggcagcctaaatggaatgagaatcagatagtccttgctgcagccatacataccctggacagggacacaggtcccctggaaggtgcagcagctaggagctggagtttagggattgtggagcaatcccagggcaaggactgctgttgactttggagagatggatcaaggggatgtgaggcaggaaactgtggtgggaaatgcctatggaggaaagctgggcagtcatggaagcaaggcagtactgttgagtcatgcaaagcaggtggagccatcaccataccctctctctccccacacgccagcatcggcagctattgttcaatagagaggctggcacatcaaacacctgatgcattgaactacaaggcaggaccccacccagggtgctgctttaagtgactgatatgctgatctacagactaggaccccacgcaggggggcccctctatgtgactgacatgctaaacaacaaagaaggaccccaggcaagggagccctctaagggcctgaatgggcagagctacagagaaacactggccaaagaggccttctgattgccagctacaagaggctcgaaaaaagactctgatagggccataactcctgccatggaggcagtccctgtccccacacatttggagctgtcaggtcccagcaagccaagcagctgcagcccctcacactcagccctcactggggcagagctgccacaggccaaaaaaaaaaaaccaaagtcttgcatctatgtgcacaaggtctcttcggtcctgtctgactctttgcaactctgtagactggcctgccaggcttctctatcagggcaggggctctccaggcgagaacactggagcgtgttggccaatactgttgccataccctctagagcactgtatttcctgctgccctagcctcaaacccaaatcctccagggcagcctcacgagctaaaccccagtgcacaacccacacatagaggtggaaataaaaccacagttgaaaccctgggtcagtgggctaaggaagaagacccaaagccttcccat

SEQ ID NO: 51954 - DNA, 1208 bp, Bovine  19866881181256
gaagtagagtaaaaatgcaaagattaaaatatatttttttagctgaaaaaaatggtaaatcatctgtggtactactgaacactctttccttatattcttgctgatgcagaatttcagcacagtacagtgattagaaacatgcaaaatataaacaatggccagagcctaataatcatcatgaatgatgtctttgtaaaacatctgtgttttttctgtccattaaaatgcagattccaaagagtgattgtagatatgtttgttattaaaccaactcatctaatagcattactatataattgccattatgcactcagtaagagaaagttgaagcttaattaaaatatatttccttaccagttgtcaaaggtgaataatgagatggatggaaaactaataaacttcactgttttccatacacaaatctttatgccaaacattactcatatcttcctgtcaatggagaaggtctctctgtatttccttagtgatcataataaataaggttgataggattctcagagacaataaacacacgtttatttacaaactattgtaaatttacaaactgttatctttgctaaatcctgatggtttagggcagaaaataaggaatttacataaaactaactctcattcctggaacactgtccttgggtagttccagattttggaactgttacccttaatctaaatggcatgcaatatctaatagtcaataagcccctaatatttctaagtattccgatttattgccattggcttagaattttaaatcttaattatcttgactttccatttcttctttctcgtttcccttcccaccctgcttgatgtttccaagacccctagcatgcacatcgtgttctctacttgattcagttaaacatttcaattttagagttctttgcacagctgcttctgcagtttggataattagtgttccataaaatgaaaataaacagagaaagatacctccctccctctaatgttctttaaagaaattctacataaaaactgctgtgatatatatatatatatatatatatatacacacacatacatacgtgtatcagtgaccactatctactggtttccatgccctgtgttgtcacctcatctgcctgtgggcaaaatcttgtcatttgcttccaatgaacagaatacaagaaaactggcaggatgtctcttggcgataatgttacagaaga

SEQ ID NO: 51955 - DNA, 765 bp, Bovine  19866881339388
gtaattgatggccccgtctggcataagtgattccacatggtggctgatgaacgactcttgggttagcccctcctcttgttcaagaaacagacaaattagcagacttttctctcttctccatagaactatcattcgcacatcagtttatctatcttagatgaaattttaaatattttataagctggtgaaccctcttgttcttggttttgggggaaagtggagtctcataaatagaattgtcttaccttctcggtcatggggttgatggatggtcggagggaaagcagcatcccgggtttttcagaggcatgtctctgcttagatcagattatatggtgacttgcagtgtaactatgctagtatctctttacacaagaaaaatttcttttaaataacaggatcaatttggggttgctcaagggagttagtagaaaggcttagaacatggcagtagtaatatatactcacaaggtcaaaaattctcagcttgagaatggttcagtgtgctcattcatcactttccacttttgctcatgtacaagacacccaaccaggtgtaaattaaaactactgtactagcatgatcaggctttaaaaaaaagtatcaaatcccaatttactgctgtcaattcacataaaatataatctttatgttgtagatatttctgattgtgttgttcccaaaactcaaggacagaaacaaactgaatgataagcagggtcaatcttgcatatatataacaaatatcacctaaaaattataat

SEQ ID NO: 51956 - DNA, 646 bp, Bovine  19866881367936
tgtttttgaggttacgaaaaccgaaaacatcaacaggactcaaatagctttaaaatctttaacacactctgccatgttggaaactacctgtcaaaacacattctctcaaagcaacctattcctctttcatattttatttgtaaaattattccattatccattagcctagcaccaaatccatttactgtatctggggatactttttaaagtaacattgtaaattgacatatcctgtgtatttattgctccttcccattttcaagctctgacgaagcccagggccaaggcctttgaagacagtctagaatcctgcaaccaaagggaacatgtcaggaaatgggcttcccgaggaggcaaagttgctagctgctctgtagctaggccacaggctggctaatgggcagcaggcaagtgaccacttagaaaaagtactgtaacaggtggctaaaaaggtgactggaactaggatttactttgttcttattccatgagcactcataggtcaatccatttttttcttacaggtggaatgatagagatttcacctaaatccttaaacccatttcataccatgctgctgctgctaagtcacttcagtcatgtctgactctgtgcgaacccacagacggcagcccaccaggctcct

SEQ ID NO: 51957 - DNA, 1340 bp, Bovine  19866881535869
ctcctctgtccatgggatttcccaggcaaggagtcggttgccattttcttctccaacactagagggagtataacatcataaatatttcctttcgattgttgccttctggtaaaccatcagcaaagcaagattcaagtgcaaatatctagaatctgtttcatacttttaaaaatgtttttctcattaaaatattatgggatattttgatatgcaaggaaagttgtcttcataaataattagtttagtatctaacagtaatatttttatttgtgtaggtaaagaattcacaattttaaatgactggtgaaaatagaacccagatcacttatttgtggttatcagtgtaaaacatcttggttctacatggagtacaacattttgttaggcctgttattgttgttttatttgccatggatataattccatattttccttgtaatttaccactttgtgttatagctttcctagacatttaaggtaaaaatgttttgctggacaactgacatgattacacagtatcaaaatcaaatgtttcatccttaaagaatgaagcctgcctgtcttagaaaaattaaaaatgtctgtttttcagtgataaaagcatgttcattctcattctagtatagatggctttgcatttacctctttttttcatatttctgtttaaattttttcaagtttctgtaaataacttaaaatattaaatttttacattagtctccaagttctgttttggattggactttacatgtttgaatatttgaagataaaaagtttaaaaatatttattttgaaacattaaccattaaaatatcaaaagttccaaagtaaaatatgtatgaaaaattgagatattagccttttattggtaaaatatattctaaactagaatttacataatcttcttcaagaagaaagaagcacacatatatttcatatatattttagtttcttagcgtcttgaaatgcatttctaacagattttttaaaaaatcaccttacagtcagcatcactggtcacaaaatttagttttcctaacttctctagttcattgaaaaatgttacttctgtttaaaatgagagtcttctttttcttttccattgcaattaaaaaacaaacaaatgctggcaggtgatatgtcagtgtggaaacagtcactttgattctggattgccttctaacaagtgacttggggtaggggtgacttcttgatatgctcttttgcttctttcttccgtctacttctgcttgcctggatgaggctgtgccaggtcagctcctctatcactctatatatggataaaaccgatatccaaccttcctcaaaagccagcctta

SEQ ID NO: 51958 - DNA, 759 bp, Bovine  19866881577053
gttaggtttttattctcttactaacaccgtttttgttggaaacaaatcagaaagtcaggaaaactacaaatggaaaagatatgacatgtcaaccagtataacttcctacaaacgagattactacttataatttactttgtttgttttatcataccttacaccatcacaagagcaccgttatcctttaatcataaagtgagaacatttttcttgtttaatgcttagtgtaatactcagttttatgttttctcccttcccagagttgaaggaaaaaatgaagagaaatattttggccgcatgattctcctcccatccctgcccatgccaagtcttttcctttgagccctgaactgttaactctcagtgtactcagagccattactaagctaaaggggattctccccaccaggaaagaaagctatttatcatttactggagaagggataaagaaaaagtatccaaatctattctctggttaaaaatggctagcaccacgatcctcttaattgctatctccctcttccaaacttccttatctatgactctcaacactcttacccaattattcaggcaacattcaagtagttcataccatatggcaagcattttcctaagcatagggtttaaaaaattgaaattctgtaattctaaccctaaaagtgatgggaaaagagatggcaaaccacaattacatactatatgtaaagtgatttaatggaggaatgcacaagaagtggtgaagatataaaaagacattac

SEQ ID NO: 51959 - DNA, 691 bp, Bovine  19866881759085
ggtggaaattcttacaaattggcctccacgtggaatctcaaatcatgtttccactcaggtcaaaaagatcactagaattgtcttgtggtagctttggcctctggcttaactgcaattgtgcaaaatggaaaatgagggaatgcatccaggtagaattctggatgtagatttccactggattcttttaaaacctcaagtatggaacagtccctcctagttgtaatccagttccctgaaaagtgtccaaaacagaatcagaaattctgaattttcaaactgtgtttggcttctagtgtgctgggtgatcaggaacccttaatctctgtatctatatttttggaattgtcatatcacaaggttgatacaaaccaccttacagagaccctacaaggattaattaaggttaaacaaagaaaaaaatgcattagacaattcagccttcatctatgcttctaaacagacccagatgttttattaataacaactattcagattatttggtagcatcttcgctaagtagagagtaacttgcataatgcatttcagctgtaaagacttttaaaaaaaatatccaactacttttattttaattctatattactttcattagcaacagaaaacctattttttttttcttcatacacactaatgtgttaaagtcagatcttgtggttttgtgtggttcaaattt

SEQ ID NO: 51960 - DNA, 721 bp, Bovine  19866882211022
agtttactgatgagatttttaggtcgttaactagtacttcctgcgaacctgtcttgatattttatcaggtcttacccaaaaacacatgcttgttttgagtccatgtgctgacaactatttaaatgcatcattccttatttattgcaacctttgcctgtgctttcatcttttcaaagattttgcatgatcctttggagtaggttatttagaaaaatggatgaatggatgaggtctaaccttctggggaaaaaatataagtgtcccataaaaaagagcaaatataaaccaaacagaggagaattggtcaaaaaaaaaaatagtttactgctatgtagaaaactactgcattttatttatttaagcattcattcaactgtggctagaattacatatttgcattataatatgagctctgaatgaagtgggaataccaaagaaagtcatttcagtttatgaaattacccttagcacgtttatttgttctctctcaacttgaaacccacaagtttttattaagagcatggttcgtatttcaaatagcaagaaatcttcacgtctccctttccttccccctcaaaaataaatctacaaagcacctggatttagaagaacaacccagatctattgccattaactcggaaaactagcaagcacttccataataaaaataaacagtgcatactgtaatcgatgaggaggcaacatcccacactggtttatt

SEQ ID NO: 51961 - DNA, 3295 bp, Bovine  19866880358204
ctcttgcctggaaaatccctggatggaggagcctggtgggctgcagtccatggggtcgctaagagtcggacacgactgagcgacttcactttcacttttcacttttgtgcattggagaaggaaatggcaacccactccagtgttcttgcctggagaatcccagggatgggggagcctggtgggctgccatctatggggtcgcacagagtcggacacgactgaagtgatgcagcagcagcagcattagtttttctgagcctcaacttcttcatttgcaaaatgataaatggctttggtattgtctgtctagcaggaatgctgtgagaattcagtgaaaaatgcagattcatagctcaaaaccctcacttgtggcagacacagccagccttcaacctgtagaagttattattacttcttagtttcttattcatgagatatttatatatgagatggagactaaactttgattcccacaagctttccaattttaaggaaatttatatgcaaggaggagaaggggtcggaacttcaattatacattcataagtcgtctttgtaggtttaggaagacaaaaatgagaaaccaaaaagaaaaatgaagacaggaatgagttacacttagttttttcttatttttccaagataatttaatttggcttttatttatcattgttactaggttttccctttcagtactaatgttcttagctattcattcttctatcaagaattttttatatattgagtactaaccctttgaggcacagcagaatttttttatccctccctccccacccccaatacctagcttgagaaacaagaaaatactgtcagaatggccaaattagaaatctcatttgagataaaaacacaaggcagcatttgatggcacattagaccatctgaaggtgagctttgtttttcaagaatccatactgtttggaaggtatgaaatatatctcaatgttaaaatggcagcataaatgttttaattaagccagtgcccagggtgggtgtgcaatgtctaattagaccctgtaggtatcggtaatatctacagttttaggcgtggtttctacccatgaaagaatagctttgctgaaaattggctgtggacttgcctacaaatggccagtcaccgcagaggtttctttctctccctgataatgtttggaaatggagaagtattttattgagtccatatctcattacaacatccatctcactgtcagttgctaatgaaaatgagaaagggagaaagaatgaggagaggggtcaattgggctcaggcaggggttgaagctttgcacagggtctgcctcttacagggcccctctcatagctctcgcaggcacatcctctgggcgatttgaattccagataaattgaggatctgtgtctccatgggaacagcatggagagaacaaaatggggaataaagttaatatttatagcccatgactgttgattttaagtgctggctttatccattatctcagggctgccacggatagaggaaggtaaggctcataggtgccttagtccccaaatctattcttttccatcccttttccaacccatccctaaaatgtcaagccgaaatagtgagcattaactgtaatgtttatttgcataactttccctgggatgtgtttggtagatgaaacacagactttggtgtcaagatgacctgagttcaaatctcagctctgccactaacctatttcttcatctttaaaataggaataaggatacttacctttgccaggtggtgggaggattcaaaataatgcaatttaagtccctgactctgatgcaggcagtcagcccttcacaaatagttattattcatattattgactctctgctcacttaaatgactcttgtcatattttgatttatattaaaaaaaatagggataaggaacagaagggcaaatcatattatttagcagagttcaaagttacccaggagaggttatatctagaattagaagggaacattttataattaaacatctggattctttgggcttaagaagcttaaataattacctcttttcaaagccctattttcttgatgtatgtgtaaaaaatacttgtcacattacctgtgacatctgtattttactgttatttccaggctgttggaggggcccatttcatcaatactgagagtcagacacagaagttacacaaactcacatacaaaagcttctgccagcaaaacctatttgttttgtcatggcaaccctagtcatttctagctggagagtgagtgaggacgtcattatcaagagaggtcgggctgagaacccagcctgagctgcaaggctacagagaattgtatttcagagtcaaatgatcatgatacaaagacaagccttctgtgtgaggcacttaggttttatataaacatagacatactgcccctggcaaggaaagtattgggctggaaaatgtgacttgatgagcaatatctgcatatgattttaagagcatgtatgaagctctgaagaatctatactggtgtttggtgaaactgtaaatgattcccatgatctgctgctgctgctgctaagtcgcttcagtcgtgtccaattctgtgcgaccccacaaagggcagcccaccaggctcccccatccctgggattctccaggcaagaacactggagtgggttgccatttccttctccaatgcatgaaagtgaaaaatgaaagtgaagtcgctcagtcgtgtccgactcctcacgagcccatggactgcagcccaccaggctcctacatccatgggattttccaggcaagagtactggagtggggtgccattgccttttccctcccatgatctagtggtcccttaaagccttggggacaaaagtgcgacctggtctggtcagaggtccactggctagatatggggactgactgggtgtacaggagacagactgtgtatgggaggttctgacacccagacctagaaggagggctctaaccataagacctgtgcccgcagacccatggaagaggaaaaaggggagctatcagtatcccaggaccaggatgcatggtcactgcatgtaagtcatggacatgatctggttccctcacagagagcagctccaatgtttttgctctctaagcgtgccatgcagcaaaggttggccgagagggggatactggtcacctacacacaggtcaagagaaaatactgtgagatgaggatccagatgtcatctcaaatgagctttggccaaggcatctcacatatgacaccagcaagcctgagtctgagt

SEQ ID NO: 51962 - DNA, 2090 bp, Bovine  19866880503196
cgcccctggggagcctgaaaatgagctttacactgtcaagctagaccatatagggatgtatctcataatcttgcgtctcactttgctcaagtcaattgagaaatggggaccagcacatgaaattaaccgagaacaaaagaattagttcaatgccctttattaaaaagagagtataatcacaactcacaaaaatatgaaatgaatatgtcaatgattttatttaattaaattagttacagattcagtaaaatgctacagctagttcaaaggaaaattcaaagagtcatatatatgtaagcagtaagaaaggctgaaatgaatttgtcaatagctgggaaactgggaggggaaaatcaattgtatttccctctaatttcattttcatttacacagacaagaattgtctgcgatgatattggttatctaaaattttgattcttgtgaaatagctcaaagataatgaaagctataaaaacacagagaatgagataccctaaatgagtgtgcttaagcaacgcattgttttccatttaagataccagtccttttcttagtccatttcagtctttcataaaacctgctgctgctaagtcacttcagtcgtgtccgactctgtgtgaccccatagacggcagcccaccaggttcccctgtccctgggattctccaggcaagaacactggagtgggttgccatttccttctccagtgcatgaaagtgaaaagtgaaagtgaagtcgcttagtcgtgtccgactcttagcgaccccatggactgcagcccaccaggctcctccatccatgggattttccaggcaagagtactggagtgggatgccattgccttctccgtcataaaccctacaatgcttttaaaactcaaagtccttattctctagtgaacaatatttcttgaatgcttagttattgtaggttcagttttgcacctctgctgacttgagttacaaagtatctcatggtcaaatctcatcttgagtgattttccaaaggaagaataggcaatatggtggcttagatacccctatatgtaaaaatcatttgaaaccaacctaagacacattttcagtggccattaaactgcgcatttttttaaatacccatacaaacacatacacacacacacacacacacacatgcacacatgtgtgtatgtacccctggtactgctataggcagattccttttaactcttaatgttttcattgcctgtggtattggggaaatgtctgagttaatttttcttgtgcaataagagaaaacctgggaccagatcatcataataatatcctttgtacttggataatttcatatctaaagaggaaaagaaatgatcctatcagagaactttcattacagaaattttggatcctattgtctgtcttgatattttaatagtaatgaaaatgaattaaagcagctgactgttttcctataggaaacagcctggtaacattgctgtgccaccttttcaacacccatggactcattcaccacttcaagttagatatggtgaccttacacagatttttaggtaagtccttttttccacatttctactccatttctcatgaataatggcagtctacaatactgtttaatgtaaagtggtaagagccacagcatggtagatgaagacctcatattagtcttaaattatccatcttcattttaaaatacagtttatctatttaaattgttgaaaaaatattagttatgcttaggcttaaaatataaaggctatgtgaagacagggactttgctgatggttcaacagtaaagaatctgcctgcaatgccaaagacacagattcaatccctgtgtcaggaagattccctggagaaggagatggcaatccactccagtatccttgcctgggaaatcccatgaacagaggagcctggcgggcttacagtccatggggtcacaaaagagtcggacatgacctagtaactaaacaaccacaatgtaaagacaaccatcaagagcagataactgtcagagaagttactgatctgctcatatattaacaaaacccaagcaaagtactcctcaaataatgccactctggacat

SEQ ID NO: 51963 - DNA, 1407 bp, Bovine  19866880546726
ggactcccctggcagtccgtggttaagactttgcttttaatgtatgggtgtgggttcgatccctggtcagaagttaagatcccacatgccttgtggccaaaaaaccaaatcataaaacagaagtagtgttataacaaattccataaagactttaaaaatggtccacatcaaaaaaaattcttagagaaataaaccctgcaattatttgttataacaagataaaatgaaagagaaagatgttgccctcttcaatatcccctctttctcattctgacctatgaacagagaatgggtggtaaagaaaagacctaaggaattgcagatataattctgatacatagaaatgacagggctgtatttccctggtggtacagtggttaagaatctgcctgtcaatgcaggggacacgggttcgatccctggtctgggaagatgccacatcgcttggggcaactaagcctgtgcacagcaataaagacccagtgcagcataaataaataaaataactcaactgagaaaaaaggtcattgccttctttaaaaaaaaaatgacagggcacctttctagttggcatgggaaggtactttttcccccagaacctggcccaggcttcctgcagtttgggtggtgattccctgtgccaatgggaataacagctggcttctcaatagtcttccaaagcagctgccccatacaccttggtgctgtttgcatacagctttagttgctgacattcagactgttgctgaacatctctaataacaatactttacattttacactttttctcctgagtaaaatgtcttcaatccttagtcaaagaagatgcagtgaaaaatcaccctaggataaaaggcatgctcatagtcagggtggtgttaaggtttctgtaaattattgtggtcaggaaaaaagaaaatggctttttatatatactaatgttgtgacgtgtgctttttggaaacatttcaatttgaggtcaaagtagcataaaagaagaagggtagggggatgggatgaattggatggattttatgtatatatataaatatattgtgtatgtatgtgtgttcatgcttagttgctcagttgtgtctaactcttttcgaccccatggactgttgcccacgggggtcttctatccatgggattcttcaggcaagattactggagtgggtagccacttccttctccaggggattcttcccaacccaggaatcctgggtctcctgcattgcaagtggatactttattgtctgagccaccagggaagccgtgtgtgtgtgtgtgtgcgagcatgttttgtatactatcatgtataaaatagataactaatgagaacctactgtatagcacagggaactcaatattctgtacctcaagggaaggaaatctaaaagagaggta

SEQ ID NO: 51964 - DNA, 1819 bp, Bovine  19866880613452
attgaaggcagtgttttgggtatgttatttctaacagtttcagtaactctgcaagttgggtgctgtcaatatttgacccatggataaggagaagtacaaagaagttttgttacttgctcaaggtcaacaaattgtaattggcagagcctccatccagggccaggtctgttggatttgaaagcccaccatctttccacccaactgcaccatcactcttcatcaaaaagcagtcccagctctcatctgactttatgtatatgcttatgtatcttccagtgaattatccagggcacattgtttatatttttatttatttatttattttggctgtgagggtctttgttgctgctcaggctttgctctagttagagtgccaggccttctcttgttgcagagcatgggctccagggcccataggcttcagcagttgctgcacgtgggttcagtagttgtggcccgcagcctccagagcaccggctcagtggttgtggctcaccggcctcgctgctctgctgcatgtggaatcttcacagaccagaggtcaaacccacatctcctgcattgacagctgactctttatcactgagccatccttggcacatttttaatcaccaaataactgccctctgcctcttagtgtgttcctgacttctttgacttgccacgtggcagtgttttgaatttgaaagctgacttgatacatcaagaagaaaataatggtgatgatgataacaacagcagcagcagccaccaggcttctatggtgtttacacatgctgggaactcttctaagaacttgcatatattaacccgtttaatccttacagtatgcctttgagatcaaagctattattatccctactatatagaggaggaaataaaggaaacttggttaagtaactttcccaatatacataagtaatagagccaggatttacatataatagtaagataaacctgctgaataaaaggtacatgtggcacaacaggattattggaaaccagccagagcaaggctcattccagaaacacaaataacctcaagctaattgtgttccgagagattgagtgaagtaatccccatgaatggagccaaataatttcaatttgcctaaagagggagaatgcagatactttgagcatgtgtgcacaccagagtatgtgtgaaaaagctagagtcagtgacagaaataacaccagaatctacagccaaagtcataggctgggctgagagaatatggccacactcgaaaatcaggacgttctatacacactgaatatattgcatcttaggcattgccttggttaacagctgaaaccggcaagtggcttctgtaaattgcaaacaaaattgcattatgtctgtggtatcaagagcactctggtccttagattggaagggcatgaaagataatcatttgatctgaataagatagaaataaatctaaggattcctcagttggatcagtgaatttccacctgaagaatcccaaggtttgctctggtctgtatttgttatttaagtgataaagctatctttggatgagagcagggcttttcaaaaggaagcttcttttatggcatattattcataaatggcagcaaacttaattaaactataatgtgaaataaagttgtccttttcccacatgtttattttgcctgtgaatgagagccttcatgaatgccaaaaagaggtgatttatgaaggtgggtgaggaatcccaagggcctcacaaatccttctagcctttcttccctcctccctctccctcttctccgctaacaacctagtagaactgccaagctggcaaactac

SEQ ID NO: 51965 - DNA, 1397 bp, Bovine  19866880714697
actgactgcgtgtgctgtcaaaaggaaaagcaggctttgtccatcagggctggcagtgatatctattctctcttttgattttaactttacctgaaccctttgattcccttcttctcaagcattgaaggaattaaacttgggaagtcagcaagtgacgatccagggactcagagaaaaaaaaaatgtgaagataaagtccccagatgatccaacagctgtgtcttaattagtacgcggactccttctattgaaagattgcaagacagccaccagtaggcaggaaaaaagaaaacaaatgttttcacaattaaaaaaaaaaaatggatctaggaacctatatggttgaaggaaggagacaaatgtaactagtttatgcctcacatctcattttgcttcagatttttattgtactagtagctgcttcataggcttaactgttaaatatttggtagttttctctgtgagttcttctttaagacctaaaatacttgtgtcctataaatttgaaactacgaaaaatgcctccagtcttatttatttaaattatgatataaatattgtttaaacaaggttcgttttctaaactcaaaggagaggttccattagctaaaacagtgtcttcttccttatctttcctgtatcttccccagtaattgctttctttgatttgatctcatgaaaattagagtactcaaaagtcctctgcatcaccaaaccaaaataagcgagtttggaagcagaaatacattcaatgcgttctcttttgaggactcaccaagctaagagcttcagagtattaaagccataaagaatcctgtcagtttatagttattacaagaaaaaaaaaaaccccaaaaaacaaacccaaagttagtgttaatttttcacaacttcccttcttacccatatcaataatttcaacttattatccacccatttcatgaggttttcacactttctttaggaccttctgaccatccctcctactttaatgaaactacaaccaactttccaattcaccctaaaccttaattctgcaagcctcggcctttctgcaggaacttaatacaatccagtcaagtttctcacatttcatttgtatgttaggagggaaaaaaaagagctgcacttaggaaatgagagttagctgaggttctatcagcttgcgaaacagcttgatagtagcagaaacaatcatattatcattctccccactaccacactgttgaagataaaaagaaagggggcattgccaattttcatctaacattagttatgcaggaacttctaaagaaaaggttcaatgcacggagtttagctgactagagaagaatgctgtaacaaactgactttccagccaagtatctgcagaaaaaaggcaacaaaattccaaggga

SEQ ID NO: 51966 - DNA, 1773 bp, Bovine  19866880715637
caagcctctccaggccggaaagaaaggtggcgattccagccaaatgagaaacgaacacaagttgcacctcggaccgccagaggagccgtaggcggagaagggagagaagaggaagcgcgcgtgcgccggggagagctttcagtcggccacgcgcagaggtccggactgaggaaaatgggggaagggttgaaaacgcagatctgcgcaggcgcacggaaggccgcgcggtctgtgggtctcgagccaggctcgcaggcgcgcgcgcgcgcacggttctcgctgctcaccccaccccccaccttttcggcccgtagtgcctcgaaagcctgagggaaactggctgggaaacgcataaataacggcacaacgtttcctgggctctcctgtcaccgccaacccgccactaccaacaaaagattcagtaatattcattcctcctcgatattcactgccttttgagttatctagacgcaacgcaaggcctacctgacacgccgaaggacggttcccgggacttatctcaccggtaactacacagcggccatttccccactcaagaacgggaggaaaaccatagaggtatcttcgacgcgctagctcctctccgtcacttccgatttggggcgtggcctccggtgccgctaaatatctgaccaagtcccaccccactccaccgccctaaacccgctctccggccgcggtaaagatgttgcctgaggctttctgggaagtcgcgtggctggtctcgcgcgatgatctggcggctccgccttccggtcttcatcagccgcctccgccagggtggcggtagaaagtgggtggggtgttttggtgatgtgaggtcgtggttccacaccggggtattcgctggtctctctggtttgcattgagcgaaccctccggacctcgcttgcccccacttttgctcgtctggtctattttttctgtgggaccaactctgaccaggccggaaacaaaaggataatttcacactgaggaaaagacacggactctattagcacattgcgtctctctgccaggaagcgccgagttttttctcagacgccaactgtaagctaggaagtgtagctttttgtttgatagaaaatatgccagacgcacttagaagtagaaaaatggccacgatctgcgtccgtttcttgagtggcgtcacaccaactctcccacccgtagcggagttcacgctgcagtactccgaagtggcttaggctatcctggcggtttgcgtcagaggttgcttcttgtcctcggacgtggttaaagcattaccacttagacgcctcgagacgttggtttgagcataaaaataaagcaaaacacgaagcttaacgatcagttgtgctggtccagaaacaacctaatctgccaaaaatataaaccagattatgaataagggaagccacattttttcatttggataaaatttcaagtaagagtcgtagcacattttctattaagacttagctgcgcgtaattccttagggcctaaaatcgttattactttgttgttaagggacctgaactgcctgaaaggatttaaaagttctaattagtaaccagtcttctgtcagtaaatgcagtccagtgttgggccctagccgtggatttaatactgtgcttagggcattctctcatcacgtccaatttacgagctcaactagaaaaaatacctcatttttatgggatgtattctcggttatttcttgtacagcctgcccctcaacccctcaccactgtcagaatgtggaagca

SEQ ID NO: 51967 - DNA, 1847 bp, Bovine  19866880755618
tcagacattgcagctccaggtcttgtgtttttcctggcagcatactggtagcatctgtctataaattcagcagcagtgttctttttaacgtggaaagcagtgagtgccctagcactaacagtctcataactggcacataaaaagaaaccctatgcttactctcctggtattttttaagttgtaaaatgtaagctgagccatcatgcctctcatacatacattcctccagtgtcagatgaaactgtcttacaccaagaaatgaaaatctccctaatcttgggctggacttcattgtgggtaaaaatttggttctatgtttatatcacattctaaattctatctcccaatccatcagcaaaactcataaaggcatgcaagagagcatggctattacagaaatgtctgtttgctcaatgttaagtatccattatcctaggggggaaaaagtaacatttcaacaacagtgtctttgaaagggacatacctagctgcttctcccgctcctcacgccgctccctcgcgagcctctgccggtcatcaacacgcagcacaggtggcgggtctgaaaaggagatgggagacataagaggagcagatttttaaaaatgatatacactgataaatatctgtctggtacatctgatgaatgaattgttactacatcttacctatagtaacattacaacaattatgaccatacttgtagtgatgtactttattataattttcctgagaatttcccagtattttctgcaatttaaaaatattatatatgaggttagattctatgagttctcatcacaagggaaaaaatcatttttcttttttttctttttatatctatataagatgctggatgttaactaaaaatattggaataaatatgtcataatacaagtcaagtcattatgctgtacaccttaaacttacagtttaattgatgctgtatgttaattacatctcaataagactcaaaaaataagtaaaagaaaaagacacacagacaaaacaaattatgtaaaaacataactgtgcctttggcttattttcatcaaacactattcatgaggttttatgttcctaaactactgaactcttattatttttatgttttaaaaagtcccctggggcttccctggtgacttagtggtaaagaatccgtctgccaacgcaggagacacaggtttgacccctggtttgagagatcccacatgctatggaataaccaagccatgcgccacaactactgagcctgtgctctagagttcgggagccacaattaccaagcccacatgccccagctactgaagggctgtgtgccctgaagtctgtgctctgcaactagagaggagtccctgctcgccacaactagagaaaagtcagagcacagccaaaataaaaaataaaaaaataaaattaaaaaaagtctgctccttaacaacaaatagaatcctaagtgaatttattctactaaatagatggtcagtcaccagttggacatgaagagcccagctttgaaatcagacaggcatgaaatcacttctggttctgtttctctcacttgctatgagacttggccaagttactcaccgagctctctaagtcttaagctgtgacatcggtttcatgggtttttactggttgtctatgaggataaaatagaccttatctaacattaccatatggattaaataaaatgatgcttacaacagcattagcacaatgtctgcttctgctaataagtcacttcagtcgtgttcgactctgtgcaaccccagaggcggcagcccaccaggctccctggtccctgggattctccaggcaagaacactggagtgggttgccat

SEQ ID NO: 51968 - DNA, 882 bp, Bovine  19866880757073
tttgcttttttgcatttcttttcctggggatggtcttgatccctgtctcctgtacaatgtcacaaacctcattccatagttcatcaggcactctgtctatcagatctaggcccttaaatctatttctcacttattagtacaataattatcagattatgtaatttattaataatgttattttaaatattcagtagaattagtgctctgaaagtattgatgttaaatttatgaagtcaagtctccatgtttgctagaagcaagttcccacttaaacataaagcattctttgttctcacaaccacctgagctacctctgtaccaattactaattattcaaattctggaaatattgggttggccaaaaaagccgttcaagtttttctgtaagatggtgtggaaaacccaaatgggctttttaaacctaatagtggatacagacattgttggaggaactatgtatatagttgacagaaacaccctcatcatataggtgaacttatagcttttctttaaccccagatattatttctaggtttaagatttctcctagtaccaaaatgtatcagcccctgtaaagagaagatgccatagagaaggtactcaaaatgaaaataatttttattaacattttttgcacttaagccaatcccagcttgtgaaatttgaaaattaccatatgagcagtgccaatataaacttcataaccctaaaattagtgtctaaatagtgcagaaatgtgttaatatgtacaatttgtgaaatttgtaagagaacaagcaagcagaaaacgactttcacagtcagagtcaacgcgtacatagattaggcagtgaggccttctggagcaatgttttgtaacttccaaatgagaatatggggacc

SEQ ID NO: 51969 - DNA, 1326 bp, Bovine  19866880767475
tacatgggtgttaaagttaggtttgattgcttattatgtgctgaaaattgttttaagaatattacatgtatcaactcatttaatcctctctacatctctgaggaaggtactgtctttatatcttaactcacttggaattaagagtgagagaagatgaagctggtgtttgtctctttgaagacagttgtgttttattttagaataaatatttgtttgaaacccattgaatttgtcatttatgtggcttttttggtgaggaagtatgcagacatcattgcctcctctagtttatctcaatacttttcaaaaactttcatactactgagcaaagtctaattaggtcaaaatggtttaaatacatggcaattgcaggctattaggaaagtttagtgagttgatttttgggggaaaaaatacttaattttgtgtaaattagtgaaaatttaaaatagttgtagcaggaataaacttgggagatgtgtaggtttaattttgtaaagagtagatcttataaatcagtcctgttactaatttcatgaggtctgattattgcattagatactagctagtatttagaaaagttagaatattggtgtacaggttctctttttcttgccgtcccaatctcttcttgcagcaatctctttagtttcttttatcctttttcatcttttcaccagaaagctatagggtgaactaggcattgtcacgtaagtccatttttatttctacagtcatgactgttgaaagcagagctttgagctccagctgttaagagacttaatgacctttattctactgggagacttatccgtcaccattccaagcagtattgcatacatggagtggtcagtttagtcccatttcaaagccataaagcacttatgatgacagctgggtaggtttactctgttttttaatattatgtcatttgtattttcttttcaggtttgttatctgtaatactctgatattatttatcttttttacaggagaggtaggcatttgtattgggcatggaataacatctaacgtactgctgcagtctgatgtcattgctctttctgacttctgcagctgctgcctttttttggattgaggcacataagtggaaaagtccatagaaatcttctgttgtttctttacaatacctgccatgcaggtgcaaatacagttttagttagggataattgacttagtacttacttgaataatgatgggtaatatcctttgggaaacttaatgttttataaatttaatttgtatctgaagataagttaaataatagaaactacttctcttgcattgtgattttaaccttttttg

SEQ ID NO: 51970 - DNA, 3025 bp, Bovine  19866880822806
actgacagagaagcccaagagtggagggttttgatgacttttaagactcaagagttagagtagagaggagatggcaggtagttcaatctttccaccagagacggctacagccaatcttccctctctgcctcaaattacctaggtgaacatacaactgcctctgcaaatactaatctttctccattatccagatttctatttcatatttctattagcatgacttttatcctgtgaaattgtgctcagtcactcagtcatgtctgactctttgcaacccacttggctcctcagtccatgagaatttcccaggcaagaatcctggtgtcgggtgccatttcctactccaggcgatctgtgaaataatagcctatcatgtaaagcagcatttgattctttcttgatcttatttacaatataaggataatttaatcaaccaggaatgggtctattacagtagttctcaaactcgagtgtatattacagtcacctggaaggtttgttaaaccacagcttgctggacctcatcccagaatttctaatccagtggttctgtggaaagaacagaatttgcatgtctaataagtccctgggtgaggctgctgctgtttccagaatcatttgctctgttatagtcacctgggatgaatgatgattccagctgttcccccatcatcatgcttctctttgataaaaggaaaaggaaagagcatctcagttcacattgataaaaaaaaagttacattcaaaatgttgtacaactgattgcaactcaccagggtgctgacaccaggcttgagaacaactttaaactattgaccaaaggaagggtctggattacttacaaaggcaaaatgctgtcagttgggcagaatgtcaggattagtatctttctaagagtcagctagatccttttgaagaggacttcttgaaaattagatgtttctttaaatagaactatgacaagcactccctcattcctgtatttttttctgatcgatgcaatggcaaagcctgttttaatgagatatgattttataagttatttggcatcaagttacttgtgtttgatgagataattcatttcttatccttgtcatatgcataatactcaatttcttcacccaaggaacaactgatcaataaatatttgttgaatgaatattcaacatcataaaactgagtataattcttgtgttgtcctgttggctgcataaggataatagacatggtgctaaaaactcaagttgttaaggtgagggtcacaaagggagaaatcttcagaaaaaagatgtagtggggagacgtgttgttttaccgaggaactttcatgcaagagcctctgccacgacagtagattatgtagattactgtctgcaccagaatatgcagctgggggtgacatgggactgggacccagcctgcattctgttcatctactcatcaagccacgtacctgagcatggggctgccaccatccaaggaaagaataggtttgcctaattaatctcaaagatgcatgctcagttgctcagccatgtctgaattgctgtgacactttggacgatagcccatcaggctcctctgtccatgggattttccaggcaagaatactggagtggattgccatttcctcttccaggagatcttcccgacccagggattgaatctgagtcgcctgtgtcttcagcattgtaggcagattctttacccattgagccatcagggaagcccccaataccgattaactcttggcagcctagtttccctgtgtctggatttttctccattaattggtcattggccatcttgaaaatgttggtgggtacatagcactactaattgtttcacctgaacacttcatgcatggaaccccatggtggacctccaagaattctttgttgccatgcccccatcagcagaggattggactcttttctatgaatactgatggacagctttactttgtggatttagggattctgggaaggcctgataaatgatccccagaggaatcttaccctatttaacaactagagcttgacattccaatttaatttgatcatcttagctcaaggcatgttgaaatgaaacaagtaattaagaattattctgctgtcagtgtactgcttttagcactctgtggttatgtatgtcacagtactgagcagaagacattatggatttacttggctgagccatttcccttatcctaggctctctgggtcttgtctcagttttagtcctctcattttccccagtacttcctacaatctctgttacatagtaggccctcagcagatgtttattgactaaatgaatcaccaacaatcctatcacatccttgtttagtttattcagaaaaattaagattctatgttcataaccttaaaattttatttttaaggtaggctaaagattttgatttcttattttctgatctagatggtaaacccaaattagttcttcgcatctttagatttacagatgtcttatcatttggaataaaaatcacttcacagaaaatggtttgttattaccatctgcttctttcatttgactctgttcaattttcaaatgagctttaacattctactctagtacatattattttcattgcttttcttcatattttgggcatttgttctggcactatccattagaccatatcctcctcttacatggagcaatggctagcaaatggccgttcaccaagaactacatttcccagccctcattgggtcaagttgtggtcatgtgactagtccacaccaataaaatgtgatcagaaatgatgtcttcttctaggccaatataaaaaagtatacttcctctgtaccccttttttcttttgctggttgtcatagagcaataatgagccttgtaatctttactgtattatggattcctttggcacatattaaaagcctctgaatccctttgcagaatgtttgttaaatgtatacaaatctagaattataaaggaaacaaactatattaaataaaattattagactatttagaaaat

SEQ ID NO: 51971 - DNA, 790 bp, Bovine  19866880837313
cgagaatcctagcactgttgcagttcagaatcaatcctatgagcttatgtattctgatcctaaagtatatgcaacacaaaggctctgcaagaggaagtgcagatttctgaagctagaaatagtagtgaatgtccacgtgattccttgtacttaaattgactaaaaatcctaaaatttggacttagtgaaaggccttatttttgtactgtaaattcaatacaccttgaattttatgtagtgtgtcagtttcatatgtgtgagtctaataagctttttttttttttttttttttaatttactttggaaaatcattgtcttacattctgtccccaggtggttttgttgaatcatcattcacctttctcgatttagcaggcctggaccaccacttcacaacttttggtggtactagaaaacctggtactgacctccttgtgatttgctgatcgcctgacctgtagctagcacctcagactagggccagttcatcactagctgaaccattgccgccttagtcataatgcatgcttaatatcctactgcatagacctagatctgggacatggcacagtgtttctcaagtattgatagtataactcgggtgacttaaaggtattgaaataaagtaattaccggtgatatgcttactttctctttaaatgatcattttggataaaaccttaaagaaaatgttttttcactgataaatcacctgaggtcaaagtacatccagtttggctttatttcactctgcctccatcagtacagctattgaactttcagttttcat

SEQ ID NO: 51972 - DNA, 3144 bp, Bovine  19866880943377
tgagctgtattatgtgaatatgcacaaaggcacattctttgttttgaaaaggtgcttagttatgtattattttttaaaagtttagtgactttgggacagttggtcagtatcagtactccataagttaggcagctatgtttgtattatacctgttgtctcataaaggggcatcattcccattttttgtaggtacaaacttaaaaagtttgtttgagatgggcagcagttacattacaggagaacttctcattttttgttttgttctttgggatgtaatactcatctacttgtacacaaagccaagtacttttcactttttcagattgttttggttaatgggataatttgtaatttggggaacaatctatttggatgcagttaataaaaaattaaagttgggatgtaatagctgcagaattttaggttagtgaacaagaaataagttgcggtattaccctagggatcatgccatcctgatttggcttgtgcccttgccaagaagattaatatgtaatacacattaatttagatttatctcagtaggatttttaaaagtctgtatctgtatgtaaaagatacttcttaccacctattttatttactaaatgttattgataatgttgtaatgacatttttatactttgttacgtatttgtgacgggtaatttttttgggaaaatatcagttacattatctcatttatgcatagtagattgaaataatggaaagcagaacaataaaaattttgataattggcagtaatttagcagttgagattcttcagtaaactgtctgggcagctctcaaatgcttgggttactaagcatgtaattatttactttcatgatgcagcatgtttttgttgaaaagttcagttttattggttttgtgtattttagaacagtacccacctcatatacccaattttcagaagatttatacaataacactattggggatgtaattatattccttacaagaaagacatttctttctttgtttaacctttctgtagcatgatgacagagatgatggtgtggattattgggccaaaagaggaagaggtcgtggtactttccaacgtggcagagggcgctttaacttcaaaaagtcaggtagcagtccaaagtggactcatgacaaataccaaggggacgggattgttgaagatgaagaagagaccatggaaaataatgaagaaaagaaggacagacgcaaagaagaaaaggtagagattttcaacttgttagtggttctgatatgttcttttgtgtgagtttcttgggccagttagttatttgatttttagatacagtgattattttgaattatttcactcttcatatctttgctaatctttattttatttctctctttttttttttttaggaataggaaatctgaagtaagattgcaacagagaacagaacttgcacccaccatttttttttacatgatttttgttttcaaataagaatgtaagcattttacttaaaattttactgtttgcaagtagtctagagaaattttgttttgaatcttcaaatatcttgaaaaatagtagactgtatgttgaaaattgtactgaaataaagtagaaaattgttacgtaccatatttgtaactatcaacttttaaaaaaatatatacttttactgtttttgttacatgcattgtaattctgctttgtctataagatatggtcaagtacagctctggtgaaagttctgattctctcccctccctgtttgtgttaatgtttattctgaagtaaacgttagctctacatacagatccctgaagagcaattgtctatagagaccacactaattattttaactgtatacatctgtttaacattctccttaattcaaacacactacattgtagggtgactaatttttgaagtataccatggaaaaagttgttattttggtaaactaagctaatttaacatctcatcaaatgtttaagatggtaaaagaagctttgccaatagctcaaaagtactagctgttaaaagttaaattgaaaagtatgaaaaaaattttttcttaaactgaaagcaagcagtgggctataaaaaacatttttaggagcctttaccatttgcattcaaaattcagtgttctctgttttctttgaaagtttgagtcatggtcttagatatcagttctttgagagaggaatctggtttgtaataatacaaacaaaacccccattcctacggaacgtcttacttaaaaaagaaaaacagaacaaagcctgtaattctgatattggtatggttattctgcagaataacttgataatgttaaaaagatgtgtacctgacgtcatatctcacatacttatttgagcttttagacagctgaatcactagttcatagtctaactataaggaataataggcaaacagaatatactgctcattagtagtattttaagaaacttgttttccaaatgtcaccaataaaaagatttgacaggaagtttgtcacagcattgatctaccttgttttttttccccactatttctgtttcagtttgtaaaatgggtttttctttttctttccaagggttctgttcttcaggaagataatctttcaaatgtgaattgcctttaatttatgtttatgatgatatctcttagaaggaatgaatatcggaaatagtaaaatttcagtgctaagtctgctctgtgagcataatataaaagtagtcaaattcattttgttaattcagcaactgaattagttgtatttgtttgcattaaaagataatgattattgtgttagtgtaaacaagcattttaagtgtatggctcgttcatgctcactgatgatttaggatgcttctggcaccttgattgcagtcagaggcatttacctaacagctatatgaggggaaaaatagaaaaacaaaactcaacaaatgtgatgttcatggccctaagatccttaagcattgcatgatttatcttactttgtttttccgaaattgagcagaaaggaaacactgtaaaaacaaatatatgttgcattaatcaggacataactaatattctcctagtcagcatagcacgtaattacctgctaaagcaacatggatcgatctccaacacaggaaaatttcacctccatt

SEQ ID NO: 51973 - DNA, 1544 bp, Bovine  19866880992122
accagaagctccggaatctcatagaaacctggaccccaggaggtttctagttagatttccaaccagagaggtttggaaaagattgcattgaaccttcgacccactcacggcttacccatctgtatttcagattcaagcgctcacctaggagtactaacccctttcactatagctgcagagttactgtgccatttgcactgtaaggaacttggctggggacagtcaacatggttcagtttaacaaccaataaatatattgaaaataaccaatgaaaacaaaattacagaggctgttttgtagctgagtggccatggtctctgcagccaacctccaccttcacctcagcatttctctaactttagaatcactacagcgtcagaaagcttggacaagagaaaaagtaagctgggggagggttggaaggcacacatccacatatagaataaagctgaattccaaagtgttgggaattttattttcaaagtgctacagaggggaccagagagcttgtttgttccactttaattacagaaacacgagaaaatgatacctctctggacctcagttttctcatcaggaaaatggtgttcagaatacattgttttaacattttaagattaaatgagataaatttatgacagtgccttataagatgtacaactcagtaagaactaaatagatatcagcttctttccttgatttccactgacatttttcattaattttcagtcacccaacaaatatttcttgaacatcagttatgcagcaagttctgaatggacattggcgagcacagtaaatacagttcctgtccttgtggaagccacatctgttgaggaaaacaaaataagtaaggaagcaggagggtgggagagagagagagagggagacagactgatcaaagctgtcatcagtgctatgaagggattgaagaaggttcagagataggaaacagcaggggagaaggggacctgattagatagctcgaagcataaactgatgtttgaatttcatttctctatttttctattgatcttaagaaagaaaaattgtcttccaataactgtgttgtaccttacccagttttagcataagtttcacagtgtcacattactctttggaaagactgtgatcaactggcagggcagaatcgttcagagagaggcttgaccatggaagactcttctggacatggatagtccagttagctttcattttgtcattacatttccttttctgagaaaggtcacaggagaggttttgacagagcgatgcagttgatatttggaatcttgactttcttgatccttttcagttgagctgtagagcagcgtgtgcagtggaaactggcctggttgccatggtggataatgtcttgacaacagacatgggtcaggtgtccgtcttggatcttcgggcttgtcagcagctcttgacaaagctggtcatgtggtttttattggctcacctgtgcattctgatgggaacagctaagagcaactctgctcaccctccgttttttttagaagccccagggagaagt

SEQ ID NO: 51974 - DNA, 735 bp, Bovine  19866881085823
cttataaatgaaagccttagtaatagtttctagtaataaagtgccaatgttatcataacagcccagttattcaactctgcaaaacagatgtattctcatttttcttatcagaaaaccaacatccaaaaagctaatcacgttcctattatcaagatagtatcagtaatggccacgattggaaccaagtaatacccgttccaagtccctaactttctcattacaagacagttgctctcttttaaccctgctccacatttcaactagaattttatggcctgtcatatagactaatctacctaggaaatatcaaattgtcaattaaacagagtccccttaatgactgaattccattcttaaaagtcccccgaccccaatgccagtcattcagactcctttctgaagtttaaaagcattcttcccccaaatctacaaatattccaatggtaacacagtttttattccaagtgttcatttgtaaaccagttcttagaatgcttatttcttagtccagatcaaaaacccagtagcatggcgattacttctcgttctctctttgaagaacctaaagatattaatttaggcacacataaatcaaggaatatttattctggatcacccatttcacctctaacagaaaactttatataatgtgtatctttcctattataattttcctgtctactcactgattctttgccttttgcttagaaatacttttttttcattagcatttaa

SEQ ID NO: 51975 - DNA, 1950 bp, Bovine  19866881153200
ttgtagacttttgatgatggccgttttgacagagtgaagtgatacttcattgtggtttgaatttgcattggtctgataattactgatactaaacatttttaaaatctgcctattggttatctctatatgtcttcttttggagaaggcaatggcaccccactccaggactcttgcctggaaaatttcatggatggaggagcctggtaggctgtagtccatggggtcgctaagagttggacacgactgagtgacttccctttcacttttcgctttcatgcattggagaagaaaatggcaacccactccagtgttcttgcctggagaatcccagggacgggggagcctggtgggctgccgtctatggggtcgcacagagttggacacgacttagcgacttagcagcagcagcagcaatgtcttctttggagaaatgtcttttagattttttgcccattttttgattaggttgtttgtttctgtgcctctgagctatgtgagctcaacaaaacagtatattgttaaaagacattaaacaaaagaacattaaaatcacttaactgtatagaattaaatgtcaaatggcagtatcatgtatgcacatcccctgatgccaaacttaggcttccttctcagaattaatgaaaattaattttgcttattctcatttcatatcgataaaataaaagtcacataaggaaataagatttatttttttcactgctgtatcctaatgtcctgaacagtgctttacacttggtaaaggcttgacaaatatttgttgaatgaataaacaaattatttatggtgtttattcaaaaagacttgttgctatggatggtgtattctatttttactatagttaatttgtacgtaatatgctgacaacagtggctgacgatttgccttgttacaagaagtctttcaaataagagttcagtaaagaatattttcataaagactagcaacattatgtggtacaggtatcatataacatatattccattctgaagtattcatatttgtgacaaagcgctaacacttgaaatacaatatttaggatatattttagcaaaaagaacatacgttttttcctaagaaataaagaaaattaacatatacgactaaaatcatcctttacccttaaattgtgttttccaagcctatagcctttgttagtatatatcacttataacacaatttcccaaagtacaatgtacatatcaaaggatacgtaagatcttactgttataggaataagcttttttcttttcctttaatagtaacatttattttaatgtactaaggaaaatgtaactagtgcatgaaatctattttttattgataccaaattgatttaagtacatttaagtaaaaatgaattcatttgatttaaagaaagatactaagtaaatagttgtgtaagaggatatagtaaagaccataataatgccccttggatgagtgaaaatggggggctctgaccttcattcttgcttggaacaagacacatcctgcatccttacgaggaccttcttacaggactggagtctgttgctttaccaccttcaccagttaggctttcacatggtagaatggcttctaaccttctcagactcaaggcttctattttatagcacataatttataatgtcctcctgtactattttgataggaagtccatagcctacttgttcacataaattaaaaaaaaaaaaaaatcaatccaaggtcctggcagtattataaagcaaaaagacaagacaagccacattgaatgaaaacattacataatgttttcatatgtaaatgcccagggataaccctccttagaaggcaccatgatgtagtcagatactgcacccacgtgccgaatcgctgtgaatgattctgtgaatgtagctactactagagactgcaacaagtgtgttatatcagtaacacaacccatta

SEQ ID NO: 51976 - DNA, 2785 bp, Bovine  19866881203245
ctatgaaaaacagtatagcagttacttaaaaattaaaaatagaattaccataagatccaacaatcaggtccatattcaaaagaaccgaagacaggatctcaaagagatatgtgcatacccatgttcacagccatgctattcacaatatctaaaagggaagaagcaactcaaatgtccatcaacagatgaacagattaacaagatgtggtgtgtcaatacatgtgtgtatatgcattcttaaaaagaatggaaatcttgtcacatgctacaatacggaaggacagacttaatatgctaagtgcgagtagtcagtcacaaaagacaaatgcagtatggtttcattcatgtgaggtatctagtgtgatcaaattcataggaacagaaagtaaaatggtgcttgccaggagctgagggataaggaaatggaaagttattgcttagtgggtacagtttcagttttgcaagatttaaaaagttctggagattggttgcataacaatgcaaatatacttaacatttttgaactgtgcacttaaaaatggctgagaaggtaaattttgtttttttgtcacaattgaaaaatgtttaaaagataaatttcaaatttgatctgtcagtctcagttacattttcaagtgcttggtttcaattctgcagtgcagctctggaatataaattatgtgagtcgttttctgacagtaagtatttgcctacatatttaattgtaaagaaatgaaaaggtagccaatagatcaaacacagaaagaaagaggcacggaaaagataaaacaaaactggtgagaaaatacaggtagtggattaagtgatgacaaatccctcttatttaatctgttggaggattggctctcacgctttcctcctggtgtgttaattttccttttaatctctaaaaagatatttttcctttggtaaacacttttccctacccaataagtatccagtgttcagggccaaagctgtcctaattgactattactatttggccacagctaggctttctgaagcatcaaggtgctaatgatggtaaacttcccagacttcaaaggtagttttacttctggcttcaagggttggaggtctgactcaatcgtgaattaaacgttgattcttgaaagcttgaggggcttgaaagaaaactgcctataggcaaagccatcaaactctcacaactcttgaattatcctcaaaggtctaagcaaaatccttttaagtgtccatcagctttatacattgaactgctctgggaagttaagattgaaaaaagcattgttccagcctttcatgggtcatgctattaccatgagagaggggcaatgagatctcctggttgactggggggtcctttaacactaaaatacaaatgtctacatctttcaacagatgccaaataatacacggcttaaagacgaagaaatattcctggagacatacaagtgacctcattgcatttacagcatggtgaatactgagggttagttcagccaccctgccagtaacaacaagtacaaattatattcttcacttgcaaaatgtgattctgtaacagagcccaacagcctttcaagaattacttagcaggtaattagtgttttcaaaatactttgtcactatattttaagatctgggccttgacacgcattagctaaacagacaaaaagtatttatcttgctttttggtgaaccacatttagactgcagccagcttctggatatggttggaataaaatgcaaaggcagcagtccaggcccacttccccttcaaagcttttcttactttcacacataaagtatgccagtattgcactgatttgttttgaagcactcagatggcagtccagccactcagacatgcttgaacaaagaatggttttcctcttcaaatttagattttctgtgggagtagaatccccaagtggggaggaagtgtaggggcaggaccactcagcctggcagactcaagactggtgggtggacgtgatgatggatgtcggcatggcccgctctgacatctgcattgcacctcagggcggtgtccactctgcacaacaacagcagacttgtgctcaccagactcaccaggcttgcgtcccaagagctactcaccgctgtgccgtgaacagtcctcctccgcgcggagccctcgggtggtgttacaaagaattttggtcgctccagtggatttctagagtgtgcacctctgtagggcgtgatgttgatggggctgcaagatgctgaacgaggacaaatggggataactagggtgcaggtgattgttttacacacaagagtgccagaggagcagttgaaggaaagccaaaagcgggatcaggacaaggagcaaagcagagatagagagaaaagtagggagaagtgttattacctaaaggcctccagaaccatcacgctcaattctcctcatggtcctatttacagtgtgtccaaaaggagggcacgtccaagtgaaaaatcaggaatatataaactatttggctatttaaatactttaattaaagatacagacgtcagccatacagaaagcaatggtcttatattcctataaacagatggttctggtaaaatgctatattagtgacagataattttaagataaggattgtttataatcagatttgtcctaattagctttcagatggaacaaaaggtggaaagacagcaagtgagcaagcaggcaagcaagatatattgcagctattttgggagtaaaattcaacagccagtggggaaaaaagcaactgaattttta

SEQ ID NO: 51977 - DNA, 1044 bp, Bovine  19866881397953
gaatataaatggactgtgttattccagctttcagcctaaatgaaaaacaacccaaagcttccacgattacatcagggtaatactggctgcttcgaatcatgtggtatgcaaatatgtgtatttttcaaagaccagatctgtactattcagaggacccataagactctaaaataagtatcatttcattctagtcattaacaggaccccagggaaccaaagcctgttcaacatgggctctaatatcaatatttctcagcaattctatgaggaagcttgtcacttgaaatatgtattgctttctgagaggcattccagatgaagagtctgtgtctttcctttattcctacaaccatatcattaacttttcttctcctccttctcttcttcctcctttttctcccctccctcagattttatcaaactccttgatatcatgtggggttccctcatagctcagtcagtaaagaatctgcaggagatccgggatcgatccctgggtctggaagatcccctgaagaaggaaatgacaatccactccagtatccttgcctggaaaatcccatggacagagaagcctgatgggctgcagtccatggggtcacaaagagttgggcactactgagcaactaacactaacaaatatgtagttaatattcactgattgtaatttataccattgttctatttacacactatttatccctccattcttacaccttcttataaatgaatatcttgttaagacttggcaggctgactaaaaaaaaatctttctaactaatataaatgttaaaccttatttcagggagaaaatttttgtgatgtctagcacaactctaaatattttcagagttcactgcaaaagcagttttaacaaatccaccaagaaagtgagccttattatggagtcattaagatataatctatttcacctcaaaagaaaatccaagcttttgctcactcaggacttaaaactaaggctcacatattttaagtggtttgttctgaacggccagggaggatcttattaggacagaaaagcct

SEQ ID NO: 51978 - DNA, 1446 bp, Bovine  19866880355056
cggttcttcctctgctgagggtggaaaggcacagttacgctggagaaccacacaaccttcccccccaccagcccctcccagcggacccaagaggagcctgccccctccactcctccagccctggaattaggaccactagactactcttctgcttcctcctattatgttatttccatcttgggtttctagaaagcatttcaagtaaatctgctgttatgtctttactggccctggaaacgactagaaggaagaaccctgacccttcttggaatccccctccggcatggagtaaacacgccagggctggctgcacaaagattgctgccttgaagtgaagtgaagtcgctcagtcgtgcccgactctttgcgaccacatggatagtagcctgcaccaagctcctccgtccatgggattttcaaggcaagaagtactggaatgggttgccatttccttctctagggaatcttcccaacccagggatcgaacgcaggtctctcacattgtagacagacgctttaccgtctgagccaccagggaagtcggattgctgccttgggactcaccaaaacacgcagtcacctcccccttcagcgctttatatgctttcccaagtgcttccctctccttgtttctatttgctcttgtcacatctgagcttcgcagcaactcagtgaggctggtcaagagatacgaactccctgtctgatggatgaagccactgttaggcacgaaagggtgacaggacttgccccgggggcacagagtaaacctacggcagaacccggacaagggctccaatctaatcccgatttagggaaggcactttgatctccctagcctcagcctcccacggccaggagagccagtgagaacggccccttctcgggagcaggagagagctccggatgctactgccagcccagcgcgatgccaggccactgcctgcccagactgtgcccgcattctgcccgcctgccctccgcccccgcacgtgatgaggacactgcaggaaggagagcgctcttgaatccaaagaacacccacagcttgctgccctcgggggtgagcctgcctcgctgccttccctcgggggactgggattactggggcaaggaaagggaaggagattgtaatctctgtcccctgtcccggcctgccccagccccgccagaggctgccccatgggcagctcttccagagcggggagaacccagactcctgcaggggagtctcctacactcactgccagatggggtggtgaggagactcctaagggaccttcactgcctattcacaagttaccccgaagttcccccgaacctgtactcgtctccaggagcacagacatgactcattcccagcggccagactgagccctgggaagactcccaggatgtgatgaacgtgaaacttaccccctctcccccgtccccggccccacttct

SEQ ID NO: 51979 - DNA, 1286 bp, Bovine  19866880515390
ccataggctccatttgctgccctccccatggcctgccttcctgcaccctcccaaaggtgtctctgagccaggctggatcccctgtggtttttatctcatacttggccccctccagggttcccctgtgactcagtggtaaaagaatcatcctgcaaggcaggagatttgggttcgatccctgggttgggaagatcccctggagaaggaagtggcaacggactctagtgttcttgcctggagaagcccatggatagaggagcctggtgggctctagtccatgtggtcacaaaagagtcagacacgactgagagattaacattttgggcttcccaggtggcgctagtggtaaagaacactcctgccagtgcaggagacacaggagactagggtttgatccctgggtcgggaagatcccctggaggagggcatggcaacccactccagtactcttgcttggagaaccccatggccagaggagcctggtgggctacagtccatgggatcgcaaagagtcggaagactgaagtgacttagcatgcatacaacccctccatgcctttggagccccaccccttacaggctccacccagctgtccccttgcaggggtctcttcccctgtgatttgactccccaattgtgcccgaaccctcagtggctctgggatgggctccctgcctgtctccagggtgaggacagggtgggcatgctgttcccctgatggaggccaagtctgatgagggctggggacgtggctctcccttccacctaagtgttttctcttctcttctctcagagaggctgcaggccccaggaggccccaaccggacagggcttccctgcccagaatactcctgcccggatggcctctgcatcggtttccagcaggtgaggctggggagcgggtggtgcggcaggccagagcccccagtgccatcaaagcacgagtcgccctgaccctgctgttctgaccccaggtgtgcgatgggcagcccgactgtgagctggcggggacagcagggccctccccagaggagcagggctgtggggcctgggggccctggagcccctgggagctgtgcagccggacatgtgggcccggggtgcagggccggagtcgccgctgctcgcccccgagcctcccggtgctgtggcactgccccggcccagagcgccagactcgggcctgcttcgcggccgcctgcccaggtaaggggtcgcttgggtgccaggagcccagtgtggcgggtggggcctgtggagagcaggggggaagaggaggagggcc

SEQ ID NO: 51980 - DNA, 1304 bp, Bovine  19866880761074
gggatgacagagtatgagatggttggatggcatcaccaactcgatggacatgagtttgagtaagcttcaggagttggtgatggacagggaggcctggcgtgcttcagtccatggggtcgcaagagtcggacaggactgagtgactaaactgaacagaactgaaagaagcttatgtcaaagtagccacaaagttgtttaataggagacagatgaatgtaactccatatatactgctagaaaccaaagctttgcatgaaatcttgaatttacggggagggcagggggttagaaaagcaaatacccatctgttcttcccctcatcccttcttctcattcatgaatttcaggagatacagccccttaggctttggtggccccatgtgggcagtatttatttgatggctgattttgctgtgccagttatttcctttaccatttactgtcattttgtaaaacacactctgacccttttcccttccctttctttttcttggcaatacacaatgaataaaaacatattggtagtgaaaaaaaaaatgaggtctgagtttcaaacaaagctaaggaaatggtaatgaatgtaggtttaatgtagttgtggttcaaatttgatgagaataagcaaggaaattgatgtatctgtaaaacatcacttcttttgttcagtgtgattttgcggcagtcaactcaacatgttttataagttcttctaagatgtacatttttatttttttatgcttctgaaattgggatgcattttaaagcaggccacttgagttactttaattggcatctttttttaatggcataaaatagcagtgcctgttaaaactagcagtatattagagttaatgaattatgctaataaatgtatggtgaataagcgtttaaattgcacagaaagagaaacccttacaattcattttaaggtttccaagtttcagtcagtagttctcgaactttgatgtgcatcagaatcatttggagagctcattataacaaaattactacctcttcccaccaattttggattcagtacatttacatttaatgctgatactgctagtgtgagagcaactgccataggtaatttgaaaaaaaattaattttttaacctcagtgtttagtaccattaatttaaaaatttcagttagacttttatgatgtcacacctagaaaattagcattgccttctacattttctcattacttccattctcttctcattcagaaccatctttcctataaaaaatagtattatctgttagtactatcttctcaaaatatacacacacacaccttca

SEQ ID NO: 51981 - DNA, 1463 bp, Bovine  19866880891319
cctcagagatgaccctcggtctccctgcttcttgctctgtcttctgtcttccttccctttgcccagtgaattttggatcccggagaccactccacggtgggtggctgcaaatgcagctgtgtgcagtgtcgttctccaacatgactcctctacgatggagaaacagtgggtgatggagaagggagataggtgaagggaaagattgataatgtaagttggatgtggtcgaggttggcttccccaagaggtgacacttagagtttttcttttccatctagcaattcttacccaagtagatctcagcctccttgtgttcaggtggcatcaagaaggccagagggaaagaggttggcaccaggagctctttctctggccttggccttggccaggccagatggagggtgctgcttccatccatcctgacctgacatcctcttccattgcagagtgatcatcactatgctggtggccactgctgtctgctgttacctcttgtaagtactgctctcccagctcctagtccgcgggggcccttgtcctcccttctttcctcctctcccagccctgctctcgcctctgtcctggtaccgacacattcagctcttgaaaggctgagtctgtaaaccacagaagaagaggggtttggagtagcaaagagagcgacgggctgggagttatgaactctgggttctggttctgagtgtatcatctggacaagctctgccatgtccatgggctgcagttgtctaatctgtgacacgagtgagtggggcccactcggtgcctgttgtccccgatgggcatcagaatcccctggagagattgtaaaacacaggtttcagggttccaccttggactcactacatcatagttctcacagtctgcacgtgggaatctgtatttttatttaaaatttatttatttgtctgcatcaggtcttagttgcagcacacagggtcttttgttgtggcatgaggggattagttgccccacatgtgggatcttagttccccaaccagggattgaactcacatccctagcactggaaggcagattcttaaccagtggaccaccggggaagtccctccaggaatctgtacttttaatgcatgcccctgagtgcttatgatgctgactatttagaaccactgggtgaacagtggtcttcaaacttggcaaagtcagtacatatagaatactgtcctatattccaagtcctgggatacagaacacataccaagagatgggagtgcctggaccatgtgaggggtcaatttccacatcagtagggtctaggtgttctctttctgtaagtgcctttcatggtagcccctccccttttacaaaagagacactccaccattgctccccagttctgtcagcctgctccatgtttaaatctccctggctgccaaactgacgaataagtccaagctctggttttgagggaggcctctctcatg

SEQ ID NO: 51982 - DNA, 1308 bp, Bovine  19866880933232
tgcccgggagcgccggagtgcctcggggcgcgcaggccaagggctcggggcccgcggggtctacaggggcgcccagcgcgcactcgtcgcacccgaaagggcgctcctcgccgctgtgcaggcgctggtgcgtggtgaggttcttcttccagccgaagctcaggccgcagtgggagcaggagaaaggcttgggtccgggaggggaggcggtgggggacgaggcagaggacgtgggcgaggccggcgcgccgggagagggcggggtgcggccggccgccgcgtgcaccctctggtgccgcaccaagtgctgcttgtgcgtgaagctgcgggcgcactgcgcgcactggtagggcctctcgcccgtgtggatgcgctggtggcggatcaggtgcgtctttttgcgaaagcgcttctcgcactcggggcaggggaagggccgctcgcccgtgtgcgtcttctggtgcgagcccaggtggatcttctggctgaagcgcttgccgcactcggcgcacgggtagggccgctcgcccgtgtgcgtgcgcaggtggcgggtcaggtgcgccttcttgctgaagcgcttgtcgcactcggagcaggggaagggccgctcgccgcggtggctgcgttggtgcagcagcaggtgcgcgcgctgcgtgaagctgcggccgcagtcggggcaggcgcacgggccctcgccgcggtgcagccgctggtgtagccgcagggtcagctggtcccggaaccggcgctcgcactccccgcagccgtagggcttctccgaggcggtcgggacccacccggccagcgcgagcccacccagtgtccctggggcccccgactccagcttatacgcggcggccagagaccccaggtcaggcgggggaaaggggctggggcgtaatgccagatgctggggccattccgcctccttgtgggcctcccgatcctcctcctcctcctctaccttcaccttccgaatcatccactcgtcccctgaaaggacaaaacaaggcgagtctgttaaaccccacgtttgtggctcagctggtaaagaatgcgcccgtcctcaatgcaggacacctgggttcaattcctgggttgggaagattccctgaagaaggggaaaggctacccactccagtattctatcctggagaattccatggaccgtatagttatgggcgtcgcaaagaatggactgactgactttcacctgatctgtttgtttgccaataggaccaccacttcctgaagtccctaagcctagctcctgctccttccactgaaaagttcctggaaatgtccaaa

SEQ ID NO: 51983 - DNA, 2710 bp, Bovine  19866880991133
ctggattctctatatcttcttccctggtgaggagaatgatcatgtactcgatgaatttgtccccaaaaatgcgttggatggtgctcagcaccatgtcatctttctcattgaaggagcccaggggggtcaccagcaggaaagcatgaggacctgggtaggtgttgttcacaaggtcttgttcaatgtcctttgaagatgagaagtctggagtatcaatgatcaaaacttgcctctctctccagattctgctctcagacatgcacctctgggttactggcttttcactgtatcgagtctcaaagacccgcttccccagaaggctgtttccaactgcacttttccccacaccacgcttccccaccagcaggaccttcagggctggcggccaggggctcggttcccatcctgtcatctgctgatgctgctcccctgaccctgggacaaaaggacagattcagagttgattctcacagtagaatacagagatgtggacagcttttaggatagctcataaacctcttttgcgtttttgaaaatctcttgttgccagtttttgtagagaacggccatgatgctctgaaccaggagacctgtagtcccagccagaagctacccatcaaagtgaaagccatgaaaagggccatgaccaacttaagagaggtgtaaagggcttgagatttctcaggaacgtgaaaacgttaaacgtggccttcactggtcttgagccttggaattcctcttattttgctaccaaagttaagtactggggcatgaagttcatggcctaaggcagaaccatggagagtgagtttaaaatgcatcttagtggtatattcataaaatagaacacaactcaggaatttaacaaaaagtgatggactgatatgcagcctagatgggtctccaaaacacgctaagtgaagaaagccaaacacaaagccacatgctatgtaatgtcattatctgaagttcaagaacacacaaaattaactcatatcaatggaagtctagagagaggctcctttcaagaaaggagagtaagaactcctaaggtgatggaaatgccccgtatttttagctgctgctgctaagtcacttcagtcgtgtctgattctgcacgaccccatggactgtagcccaccaggctcctccgtctatgggatttcccagacaagaatactagagtgggttgtcattcccttttccagggaatcttcctgactcagggatcaaacctgggtctcctgcattgcaggcaaattatttaccatttgaggcactcgggaagccccaatcctgagggtatgtgtgtatatgtgaatgttcttagttgctcagttgtgtccagctctttgcaaccctatggactgtagcctgccaggctcctctatccatgggggttctccaggcaagaatactggagtgtgttgtcatgccctcctccgggggatcttcccaacggagggatcaaacccaggtctcccacaatacaagcagattctttaccttctgagccaccagggaagcacaatcacaaggggaaacaaacctaaatctacttaccaccattccctacccatacgcccgttctttcactgtcagtgcagaattcaataaattacatgaaacattcaacaaacaggcactatgttagatgattttgcttcactgtaggctaatgtaagtactctgagcatatttaaggcaggctgggctaagctatgatgcttgggacatcaggtgtattaaatgcattttgacatgcatattttcaattcataatgtgtttataaggacataaccccagtgtaagttgaggaagatctgtatttctttttaagatttattaatatatatgagaatgctcaggaaggaaacctattatttttaacagtgggggtaattacaaagtaaataattacaaagtaaattttgaacactggcattgttcaaaataaaattgttaaaatgaggttaaaataagactaaaaatggcagagagcatacatgataatgtgatgtcattttcaaacacaggatatttaacttccagaatccactttaaagagaaatcattaacagtcttcaaaattcacttttacatagtgttacattattatacatgtaactttaatacttctttttcatattaatatatgttacatggtgctcttccactgatcactaaaagatataaacagagtgacatcaaaagacaaagtcataaaagttgttattgattatgctaactgcatatgtgtccctgtggcagtagcaattgtgttttagaaattatttattagaaactaatgtaaaccatagagcaaccaagactctccccaagtgttcctctgactcattctctagcctgaaattgcctaaacccagcacctgatgcaaagagctgactcatttgaagactgtgatgctgggaaagattgaaggcgggaggagaaggggatgacagaggatgagatggttggatggtgtcactgactcaatggacatgagtttgagtaggctccgggagttggtgatggacaggaatgcctggcgtgctgcaggccatggggtcacgaagagtcggacacaagtgaatgactggactgaactgagcacaaattttgttattgtcataatcaaatacttttcagttttatattcttgacattttttattattaaggcagacttttaaaaacaattttatt

SEQ ID NO: 51984 - DNA, 2752 bp, Bovine  19866881095410
aggaatgtgttatagctactggggctttccagccattgctagtggtaaagaacctgtctgccagtgcaggagacataagagatgtgggtttgaaccctgggtcgggaagatcccctgagaagggcatggcgacccactccagtattcctgcctggagaatcccatggacagaagagcctggcaggcaacggtccacagggttgcaaagagtcggacacaactgtagtgacttagcacacacacacaaacgttttaactcattaaagaatccataaatccatgttactgaggtttttaaaacttttttaggtagagaaaggaaagctttacaaaaacctttaccaacaagtcaattaataaaggtaaaaagcaggatcgaaatacaaaatcatcaatttatgaccatcattgtaaaaacttagataagaatcattaacggatgcttaatttgttagatgaagaatatcagggaacaggatacagaaaaatctgctaaacactacttcaattcattatccaaattcaacttcatcaataatgtaacaaagtaacatcatttcccttttttttaattaaaaaaatttttttcatcatttcctttagatgtgaggcacaaaagacataatatcacttgtgtggtcattttgctaagatactgaactttaaataatgaggggacttccttgggggtccggtagttaagaagccaccggccaatgcaggggacacaggttcaatccctggtccgggaagatcccacacgcctcggagcaactaagccagtgctccatgtctactgagcttgcgcacgtaaaacccgtgctctgcaacaagagaagccactgcaacgggaagcccgtgcaccaccctgaagcgtagaccccacttgccgcaactagagaaagcctgggcccagcaatgaagacccagtgcggccaaaaagaaattaaacattttaagtccatctaaggatgacttgaggtgtaacacacaaattttacatctgttctatgtttatcagcattcgtttcaaagtattcatttctgtgagttcttgagaagagtgtcataatctaccattccccatgcttcagactttctgttcctgtctggaatgttccttgccccccacctactgaccctgtatgctctaagaaaccgccctgcgctcgcaggaaggacctagcacacctcctgcgcgagacggaatgtctccacgtccatcgtgaagcttcagccggagcagtgtcagtggagcaaacctccttcgtgcttattttctggaacaatcatcatttcagatgttctcctttatgcaaatgaatccgtttattgtcccaggtttttctactttgagggtccaaattacattacccagatgatctcttagcaccagaaagtgacataaaaattctttgttatactgaaaacctgggagttttgtttacaaaatgtggtcatcttgactatatactctccaggctgacgaccttcaggtactcagtatgggcttgttgactaagtgctactaaggtttgccccttgccaagctagaaaggactcggtgtccctataaaacactcctaatttcatctgactagcctttgatgtgacaggcttcaccttgaaagccagaggcggcattattctcattacacggtcatcaaaaatggctgactcaaaggtcagccttataaaacttcaacgtcgcttgtaaatatgagtcataatctgaggaataagcttgtttctcttataactaataatgtcattgctggggtaggccatgatctgcacaggaagtgctccttaatgtacatggtgagaaatgtttgttttttgttttttaactgaaacactattcccaaaagctgtggggaatttagttatggggaaattcaataaccttagccattctttaaaataaacctgaaaacaaactttgatgcttgtatgaaaatatgtctggatttctccacatctggggtttgcttaaagtaaaacccacctaagggttgtccttgacagctcagtggtaaagaatccatgtgcgagatgcaggagatgagggttcgatccctgggttggaaggatctcctggaggagggcatggcaacccgctccaagattcttgcctggagaatcccatgcacagaggagcctggtgggctgcagtccatggcgtctcaaaagagttggacacgactgagcacacacacaagaccccctgaaatccttttgctgttcttttcacctttactggctcaaggtgacctcacctctgctcagggggtgatccaggcctagaggctttgcctctgctgagggagcctggaatcccctgggattcgatccttcattcttgaggctcatagctctgatcccagggaagatgcaggaaccctgggatgagtcagtgtctaagctgttgtcaggtactgacatcctcagtgtaggcaagctgacacctgcgtatagaaataactgaggccatggaaggttctagaaagcacgaggggcagtcatggatgccagggcactgaagcattcccaaacattggccgcatgcccaccttgcccccggctctctaaagccacaccagggactccctccaggttggctgagggtgatgccatcaccggggaaactgagcctccctggagctgtgctgctcagactaaggcaaggagggaggcccagactgaaggtggggaggagcgaaggaggctacaggaagcactgaatcaccaa

SEQ ID NO: 51985 - DNA, 814 bp, Bovine  19866881113094
aagctcctcgcaggctgtcccttccccactctcctcccctggaggagaaactccagtggaaacgcggcttaaactgtgtttagaaaagacagctatgacctggagcatcgcacttcctcccctctgcacccctctccgccgcgcccccctccccacccccgcagcctccttcttcacttcatcgtggctcccggcgcccccttccattccgcagcagtccccttgcgcccccggctttccactgacctgggccctcccttcctgtcccccagcactgcgtttggcactgccagcccggctgttactgccccccaggccaggtgctgagtgccgacggcaccgtctgcgtgcagcccggtcactgcagctgcctggacctgctgactggggagcggcaccgtccaggggcccagctggccaagcctgacggctgcaactactggtgagggccggtgggggcgaggggcggcgtgcgggcaggatgccacgggtgagggcagggctagtccactccgtatctcacacacctgagctctcccggtctcagctgatgcacactaggctcccacaagctctgagaagatgcagcaggtaccctaatccctggtctgacaggtggggaatctgaggcagccagctctggggatctgggagactttgaagagctgggcttgtgctttgaggggacagggggtgggcgctgtggtgtttcctcctgctgtctggcttcctttagccgcagacgacctgtggtcacttccccataggactgagtccgcaggatccctgggcatgcctggagtgggtcagggag

SEQ ID NO: 51986 - DNA, 1076 bp, Bovine  19866881128120
cgtggtggggatggtgcgggagggtccctcctgggcctctcctgttttactggacacccatagcccacaccccggacagctcccacagaactgtgctgaccgcttgccagccagccacattctatgaggtgaggggcttaaccctcaccaagggctgggatgtgtgactgtggcatgtgtgactcgcacgtgcacatgtggaagtgtgtgactgtgtgtgtaagcacgtgcacatgtggaagtgtgtgtgtgcgcgcgtgcgcgcgcgcatgcacaggttccggcaacatgcctcctccccctccctccctgtggggacatatgctcacgtctctgagtgccctcaagggtgcacacatatgagagcgtcgcaggagcccctgtttgtgtccacgtgtgtaagaaggtgccgggtcggaacctgggaagtcacctcactttaccgggggaggagggctggggacgaaggcggacccttctttatttgcgcccctcgcccgcccccggggtcgttttgcaggaaggagcgtgtgtgacaagcccagccgtcccatctgtgagaaaagggctgtgcgggtgggttctgcgtggcgcccccggcctgcggcggcgccgacagagagacttccacgggaacctgaggcggcggcgagaacccggagggcaggctcgagggtgtgcacggctgccatcttcccgccggagccgggccgtctcagagtctccccggacggctgtctcgtttattcagcggtttccttacagtcactgctctcccccacccccaccagcacccctacgagggcccctaggactctggcacgaccccccgcttccgctcccgccgtctgcccgcgcggcacacctgcaccaggatgaagcggcaaccggcgcggccgcggaaggagaagctccgcccatcgaaggtgacgtaatgcccgtccccgcctaccgcgcactcggcggcgcacggcgcctgcgcgcagagccagcggccgtccctgcactcgctgcgggcgcaggggcggagagaccgcgctcagggtccgcgccgccggggttcgggagtgggggtg

SEQ ID NO: 51987 - DNA, 973 bp, Bovine  19866881140312
ctgccaatgtcactttatttggaatatgctagaactagaataggggatgggggacggggcatgggaggaggggtcatgatggccagtgcaggcatcatcagggaagccgtcagcgctctgagaaatcacctcctggaggacaaataagagggagatgcgctatcaaaaaaggcagggtaatcgggctgggaagggatggggctggagagagggagggtgctgagcaaactggcaggagaggaagggagagccgccaggaggaagaccgcagtcacggtaagcttctgccccaggcgttctcagcgcccttccatctctttctcaccccccacactgtgtggtggcctcgggttaacgtgtaccaggtgtttatagagaacctggcacttcgcatacagcctctcaccaagtcctcccaacaagcctgtgcagatcgtcacctgggtgtaaagacgaggtcatggaacctcaacaaggaaggaaatggatgagctgggattcgaacctgatgtgcctgaccccgaacatctaggcttaagtgtgattagagaacaaaccaacaagaatgctaagaaggggaatggagcagagcagaaggactcggaggaggaaattcccgcgaggggctgtcgggtaacgcgcccggcctggccagctcctggcctcaggtgaccccagaccccggcctaagccccggccccgcccccgccccacccaagaccccgcccacaaagaaccccgcccctccgggaaccccgcccacacccaccctggcaggcgctgcactggcagctgtgaatgaccggcagcaccaccagctctgtgcggccgccagggcagcgcaggttcaggatgcgcaccgggttctcagggtctaggcggtagctacagcagtcacactgactctgcaggtacggctcctgggcgagagggagcggatggctgagctggggaggggcaaagagtttgccca

SEQ ID NO: 51988 - DNA, 1411 bp, Bovine  19866881183121
atttgacctggaaaacctgtggatatgattcaaagttattttcataatctttgtcttctaggaaatttgtagtgacgcatctggatgtctgtgtgcattatgctagagaagcagcatttagaagttgattggatttagaattttcttctgtattttctacacaccttattaaggatataaattgttattaactgaaagtgtaactgtttgaatggcccatcagcttatgtgcatgcatgtttttgtttttttaaatttttggccactcctcatgcaggatctgagcagaggttgcacccatgcagtagaagacctgagtcttaaccacaggaccagcaggaaagtccccatgcagatgttttgaatgaagaactgtttgatttgaaggattcagacatttacaacttagttaagaaatttataagttttaggtctagaactgtatgctgttttttgaaattatataaggagattgctgtgggttttacctaaacgatttgaaatttccctttgtatatgtggattaaagtttaacaggtccttatgccagtgttaaaagtaagctagttcatagtagtgcaaacaggatatgaaaaaatttttaaaaaatatttccccatgcaatttacctacttttattactggttttcaattttttctttctgattgtccatcaagcctatgttgacttggtggaattacagttttactcagatcaaaatagagcttacatagtttttacaaacaaaactgaaacattcccacagcagtacttctcttttgggggctttttatatttgaggccttgtttctgggtggaagttgagatttcattgtattaaaggaattttgtcattttttttattaatgacctttttgctttaatttagcaatttaaatatactagatcatgttctatgtaataatactttattatgaaaaatacaagtgaaaaatttgtctcacttgaaaaaaataaaattttttacatacataaataacttctattttaaaggtattgctattaaagagtcagcaaaagtgggagatcaagctcaaaggagggtgatgaaaggtgttgacgacctagacttcttcattggtgatgaagcaatagaaaaacctacatatgcaacaaaggtatatttttatgatttttataaaaataaataacattttatttcaaaaaattagttcgtttagtaattttgccacttaattacaggactaatactctcagcctcttcacagtagaaatttcttctttctctgtgacttcttccagccttgctttaactgtattattttttcctccccaccaagaggaatattttagctccttcacgtaactggtatttactttttcaatctcagagtcatcaatgtgattgactttctcttgcctccacat

SEQ ID NO: 51989 - DNA, 907 bp, Bovine  19866881278855
aagatgttaaatgtaaaatattgcaagtgcaaaatgcaaaatactaggtccactcttgtctgaaacataagcctctagtatgtttcaatcctgactgggattggacacaaggggtaaaatctagctgagccccttttgatgcacataaaacagactattgatgtgtgtgtctgtgtatgattgttgagcgtgagttggttgcatcagagaaataagccgtatgtccatttaccatcttcagaagataaaaccatagcatggagttaaagacatgtgatctcaggaactttacagctcacttgttaatttactataccttgtagaaattttattgccatttttgttatattcagaagaaatagtgatagtataaagaagaaaaggcgttttcaggagcataaaactgactttagatagagacttgcaaatgagaagaattttatgtttataactttcagaaggttttggtattatatttcaaaacaaacaggaaattttaaaatcatttgattcattaacaaataggatgaggttgagatctaaacagttcacagaatctcaaacatttagcggacactgactgtccggggcaggctgctgctgctaagtcacttcagtcgtgtccgactctgtgtgaccccatagatggcagcccaccaggctcccccgtccctgggattctccaagcaagaacactggagtgggttgccatttccttctccaatgcatgaaagtgaaaagtgaaagtgaagtctctcagtcatgtccaactcgtagcgaccccatggactgcagcctaccaagctcctccgtccatgggattttccaggcaagagtactggagtggggtgccattgccttgtaacttactcaggatagacaagaataagaggcagggtcagaacta

SEQ ID NO: 51990 - DNA, 1653 bp, Bovine  19866881311095
gagagttctgagatgcaagatctaatcgctctctgcctacatgcagggagagggcagaaaggggacgacaaggacaagtggagccaccctcgcgggtccccatatccagtgatggcacagatagagaggcttctcggatctttacccagggacgccaacagctcatagttcatctgcatcacgtctctgtacagttccttctgccacttgtctagcgcgccccactcctcccgggtgaaatacaccgccacatcctcaaacaccaccgggagctcctccaacagcccctcctcagaaggatcctgcaacaaagagtagcaggtactcagtactcctctcacatcagacacccagcatgatgctccagggatcctgctcatggcctgtttctcctgggaagcctgccaagaggcccagacgctctctgaagaattcagctgtccaccaaagtcaaaagagcaaacgtgtggcccagagtcggtaggtaacaactacacaaacctcaccgtgatcctagaagaaagggaagacccttcctcttctctctgggaaggaaaggacagggcactgaggaagagggtctcgcagagcctcgtggctgcacccgtcctcgagagcaccttctgctcatctaccattgcaaaggtggccgctgtctctgagccactgctgagtttccccatcaggatggaaagagcagtaaaacaacaagtaaagatgatcctgttcagtgactaggttaacacacactttactgctaaaggaatttaggctataaaaggttagacctgtttatcatcttctaatcctaaacactgaggcaacatgaagggaaatgagctttgtcccttttctggattccataaaaatccgaacttactaactttacctacaatgttaggaataaggaacgtctgagctcttctcaacagaatactaaaaggggctgctcaaaatgacttgtagtaaaaccccgcttatatggtggggggcgggagttgagaaaggggggatggatctggctactcagagacctcaattaacacagcttccttgcagggcaattttccaaagaatcagaaactaaacctgttgcatttgataaacaggcctgaggtgagaagtggagtctggaggtctcatcagtgcagcagggctgggaggagagccctgggctggcggccaggggctcagcaggagggcagcaccaggagcccttgttctctggctacatcttagctcttgcccaacaaggtgagtttaactacgcttgctccacccccttctgtgcagcattaaaaacacattacacaaagtctgaagaaacatgagtccaaagttaaagctgaaacatatcttttacattgattatttaagagctctgcagctgtttttatggttgtgggttatttctggagttctgtggtcattttagattctggataaagatggcttttctgaatgtagctgttctcttaatgtcagaagttagagtatttggccccactaatatgttttgttatctgccaaaaggagataatagtagtagggctgttgtggtcagtaaaggagctgatacatgtaaagcacttaaaataagacctggcacagctgaagcaggcagcttatggtaacgtataatgttagcagcag

SEQ ID NO: 51991 - DNA, 993 bp, Bovine  19866881326761
tcaagacaaataatcccaggattctgattcatgcaacaataagcatttattttcatgttcatagggcagcagcacagatgccaaacaatgatggatctcagctggactttacctggtggccccgcttcaagctgtgggtccatctgtgctccgtttctgtgaactgggctcgggtttattccctgtctgttcattccagagtcccagttggaggaatagcagctagcaggggaagctttctcttggaaatggcaaaaatgcaaaaagtcaagtctgacgacgcaagcagatcacaagcctctgtttgtatcacatatgctaacatcccatcagtcaaaacaagtcacaggaccaagccctaaagcaagtgcagggaaacatacctccttctaatgggaggatctgaaaagctttgtggcaaagggcacaagacagaaaaagtgaacaaggcgggggaaaagtttaatctaccatgatctgccctctcggtcataattacttacagctctaccacatgcaaaatatactcagctttatcccaagtcctcaaagtctcattcaatcagacaaagttcaggatctacgttaggtccgggtgaggcacctggaaacctatgacaagttatccacccctcacacagcccgaatccagtgacaggacactgcagacgcacagtagtggatcacttgcagtagacttactgcaataaacattattttcacaggctggacaagacaggaagcaggtatgagtatgcagaagaaaccaccacgtgcccttctacctttgggtacagccacagcctcctccgagacaccgatttcagtactggctggtcttattcacaaaaatgctgcataacaagccgcccccaaccagtaacacacaacaataagcatttactgtcgcctccatgggtttgcaggaatcagctggtctaggctgggctgggctgggtgagtgggcttcaagctctgggccagctggccttg

SEQ ID NO: 51992 - DNA, 1389 bp, Bovine  19866881408235
aggggtcggggggcacggcgggcagcggcggcaggggctgtccccgggccggcttggcgcccgccgcgtggttacgctggtgcttgcggaggtggtccttgcggatgaagctcttgccgcacacggtgcaggtgaagggccgcacgcccgtgtgcgtgcggtagtggtcgatgagcttggagcgctcagtgaagcgcttctcgcactccgtgcaggggaagggccgctcgcctgtgtgcagcatgcggtgccggatgaggtgggccggccgcgtgaagcagcggccgcactcgccacaccgcaggccgctgccgtcccgtgcgctgcccgccgccccgggcaccccatcgggctggcccccacagctgcgctggtgtgcgctcaggctgacctgcagctggaagctcttcccgcacgtggcacatgtgaacggccgcccccccggggggggctgccgggtgcttcttcagacccggcttgtggccgaagcctttggtccggccggggtatttacaggggtcgttgaagggtctcggggcctggccggggtccagcacagcctctccgttgtcggaggaggagaagggcagcccctcgggcccagtcctcgggttgaggcccgcaggaggcttacacctgaaattccagccccaccggaccccccccgaagagccagtcccctggagaggtctcgtcctgggtcactgtgggggtgggatcccccaggtcacgctcgggccgggcgggctctctcagccccagcacggggtcctggctggggaacgagctgccctggctctcccaggctccttcctggacaggactggggaagaaccttgtggcctggcctggtccaaacagtgtcccgtgggcttctaggtcagtagggtgcactggtgtggccaccacttcttcttcttggacttctgtttttatcacaatttttacatctgctgagaaagacagaaaagaccaggtatcattctgtcccccttcctgcttagaaagggaagatctgatactttattctggatattcagccccaccaaggccactctgagccctagtctccaaggctcaggatctagttcagcagaggtgcccaaggtggtcaggcaactgcctcaaactgtgggtgaggacatcgtgttccagaactttctctacaggtaaagcaaccatcatatctgctcaccttgttctagagccttcaccacaggtaaggaaccattgcatctccccatcacttcccattttcactttggctggtaaggctaatcatgaagctattccaaggaaggaactcagaccactggtggcaatgcacagagctgggctcaggcacatctgagactggacccggctccccacagatcagctgcaacttca

SEQ ID NO: 51993 - DNA, 1249 bp, Bovine  19866881700529
aacaggaaaagtggagggacttggtgtgtggacaaaggtgaagcctttggtgatgattagaatgcttgagatgaagaaaacgtagaaagacaaaattggtatagaagaggcatataccagtcgtgtcaataattaagaagcgaagggtaggaagtataatagagagtggataagctgagcagctaggtagaggacagcagggccaggcctcggatgaggcagggagaccctttcttacgagatgtgaggaccatctcattctaggcaccttctttgcctcaactctagaccctgctgggccctgtgggacactgacttaaaatgtagagaaaagagcatgcataaataaaaatacaaagaacaatgaataccaaaaaaataggggggaaatggaggaagcacccaaagagagctccacagagagaggatgagtaaagagcaatgtggaccaagcagagaggaaggagagaaagggagacactgtcccgtttgaggaggcagtcatcagaatgcaggcacaggggctgttcctaacaccactgagaaagataaggtgttctcagtgatccaaatggccctgtaacccctcagataaaaataagattctccccaggaaaggaaagacaaacgccaaaagcccagagctgagggaggaacaaaggaaaacacggaatcagtttggggaagaggttttgtggattccctgtcccttcctttgttcctctagagtcacttctaaagtctaaagtcactttcaaagtggtcttaaacttcagggactcttttgtatatgagtgctagttcagatttaagcttgagtcatcccatgtcatcccaggaatgtagacaatagaaggaatacctttcttgtagtttcagctctagactgaaaagctgggggaagaaacttcattttctttttttgcacaaatcagaaaaacagctactgtgtagactttcctttttgatctcagcagatgaactggactgatagtgtttattcagatttaagacattatctgaatcttggtttgagtagatttgggatctatctgtaatattaactagatcagatagcttttatattttcatatgtacacagaggatcacctcacccttgtcaatgtccatcagtttttgaactttgtgaactggccttgaaacattacaacaatgttttgttgcaccaattttataaactttttcagttcaatatgtgctatttttcagagacaaagtaaagtttaat

SEQ ID NO: 51994 - DNA, 1054 bp, Bovine  19866881760342
actaaggaggaacttggtgcttacctggtgtcattttcccttccaggctcctgtgacgtttgacgacatcacgggtgtacttgcttcaggaggagtgggtgctgctgagtcagcagcagaaggacatctgtggttctgacaagctggtggcacccctgggtatggctcctgttcacttcccccacagcattcccaaccatgtctgactgtgacatgcttgcgaattgtctggaatctgaccatttatcccccagcatcttgatgctgtttatccactcagtcctctatctgtcttaactgcctgtggattcacacatcatgctttctcttttccacttaaactggccaagagaagtggggaaatttggtgtgccagggctagacctggatgcctcggcatatcccagggcaccgggggcagggggagccccacctgtggactgtgctgctggaaggtgggttttgtttcagtgcccagaggacactggaggtggtgggcagcggtggaagaagcctcagatctgcagcgtggaaatctggtctcagtgccggctctgccacaaggcctggccaagcccattagcctttttgagacttggtgtctttcttcacaagctttcctttttcacaggcttgttgtagtggtttaatgaaatgaaacaacttaaaaatttgtgcccaagtagatagttttcatcttttttattttctgaatgtcctttctctcctctgtggatagacttccagtaccatggacagaggtgattgtagttcattgtgtctatgtgcatatatattcttctgatttcaatttgatgatcatcaccatgcatttccttacttcttttcatcttggcccttgtctaaggtttatggggccaacagtctcagctctctttggatggaggggttgcgttctttgtgtctactaaaaagtttaaaaactgatgattcttttaaacgagaagttgcaaagtagcactgggccagatttggcttacaccttttttctcttttttttttggttgacttctttaaaagcttaaataagggg

SEQ ID NO: 51995 - DNA, 987 bp, Bovine  19866881874772
accttgaggaacttgtcatcaaagggtgagggcccatcactgctgaagagaccatgaagcaaaaacccgtgagtggtgcaacaggtatagaaacctgctgggagcccccaagaaatattgacactggctaaaaattattccatacagcatgtgccatgcacaactaacagttttatatacattattttgtgtaatcctcagagcagccttaaaaggcaggagtcatcatcacccccagtgacccaagaagaaagtgaggcttgaagggatgagggacgctcaaggtcacagctgggcaggaatggacaagctgcatcagtggctcaccagactttatcttcccaggcgcgggggcatggggctggcgcgggcttggctgtctcctcctttcgacagcacgaccttctctgccctttggacccgacagcccgcctgttcccggttgtacgcggcccagcgcggacccgggaggaggactgggggcgccgcgcgccgggaccagtgcccgctgccccgctgccgcctcgcgccggaggaggggtgggcccaggcgcagaggggtccccagggaggctgggccgcgcgcgatccttacccgcggttgggtcctttgggtacgaaccagggcccagcgatgccgatgaggccccagaacgtggtgaagatgacgaccgggagggcgaaggagtgcgccgtcatggccaggcgcgggatgcgggtcagagctgcggatgctccgctgggtacctgtcacggccgggcaggggactccgagcatgcgcagcaggaccctgccgccgcgaaagagcgcgttctgccgccccgctcgcgcatgcgcggcagctagacactcgggacggaggggacctttgatccgcccagccggtttcctataggatttacgggatagaggcacatatggggaaaagctatgctttattcggatagcacaaaggttagaatcgaacaggttttcttaaaccgtgt

SEQ ID NO: 51996 - DNA, 2305 bp, Bovine  19866880722558
gcagcacagctgagtctttgttatggaagcatttcatcttattactgtactcgatcacatattgtacatttttttcacacaactcgtaaatagtgagtaattgttatatatcttcaaacttatgttttctcaaaacacttactttattaaattgttcatggcatctgggtcatatgctgtcacctgtccaatgatgctgccttcctttacatcttcatctacttctatcaaataaaagactttactgaacacaggaggctcatctatatcttccacagatattttaaccacagctgtgtctttgaaaggccccaggtgtaagaatcgtggatcagggtgagtgttacttgcatccacttttaaagtgtacagcatcttgttttcaaaatctaaattctaaagtgaaatgaagtaagaaaaattagtataacatagcagacataacaagcagagaaaatatcaaaatgtaataaacatccctccagtagttccagtaattttggttaaataagtttcccaattattgcttcatgggtatatcaaataagttagtacatttttaattttgccttacatgtttataaagagtagttgatgtaacagtataacattaatacttatttgcacttattaataaattttatattttggtggtcacaggtaaatgaaatatctaataaataaataggctatttatttattactatattatgtattattattttaaagttataaaaatttgaaatcagcagaaatataaagttgagatttagcaggctattcatataagttgcgtacgtttggaaatgtacatgaaataatagtgttgtcgttgttgtttagtcgctaagtcctgtgtgactttttgcgaccccatggaatgcaacacaccaggcttctctgtccttcactatctcccagagttcactcaaaatcatgcccattgagtcagtgatactatctaaccatctcctcctctgctgcccccttctccttttgccttcaatcttctccagcatcaaagtctttcccaatgagtccgcttttcatgtgaggtggccagagtatcaccatggcaaaataatgtcacggagaaatataaaaatgacttttgaggttacttgatcctagttgtacttgttgtttactctaagcaagagctgttgaagttttatagcaattttaagtgtcagtgataaagatgcttaactcacttgaagaaaactcacaactattcccatttatgtgaaggacagaagcatataaaagatggaagaaataatcctaggctttcttacctaaaaagcaagaataaaccataaaatgctcaatgaaaaaatgaagacagcaagaagaaacctgtttgacagttataatcccttcctgtgtatccttgtcagtgatgacatcgaacatgtctgctccatctccttccgcaatgctgtattccacctcagcattttcccccacgtcagggtcattggcttttatccttccaagaggagttccaagaggtacagactcaggagaatgaaactgatacgtacctgaaaattaaatcaaagctgtttcatctttagataacaaaaactttcatttcctctgctctttttattaaattaattttaatttaggagaatttttcatcatatcgaattgtaagctgtcaaaaatttacagatttattaagtagggaaaataatttataaaggcagaactctctcattttgtaaatgagaaatctgttccagaaagaataaatggatatctcaaggttatttagataatagatggtagttctgatattagaatccagaactttttgacttaagaggggaggaaagcaattgtttactgcttatttgaagtgttcagtattatcattacacattattcatttgctaaattatttagaacatacatttattcttatattctaactcaaggacagaaaaaaataaattctttcatgacaggttcacaaggagatccaaccagtccattctaaaggagatcagtcctgggtgttcactggaaggactgatgctaaagctgaaactccaataatttggccgcctcatgagaagagttgactcactgaaaaagattctgatgctgggagggattgggggcaggagaagaaggggatgacagaggatgagatggctggatggcatcaccgactcgatgggcatgagtttgaataaactccggggagttggggatggacagggaggcctggcgtgctgcaattcatgggggttgcaaagagttggacatgactgagcactgaactgaactgaaa

SEQ ID NO: 51997 - DNA, 1497 bp, Bovine  19866880829872
ttgccttaggaaaagaatcataaagcaatttcaagtcctcagacacaaacatttgtcagttgaacttgtaatatcctgatgttagttattaaatatagtgtgagaagtgatgttaaatgagggatgttggaaggtgccatgtgactaacctaaggcaaaataaaagggaaaaaagagtcaggaagtgaaatgcatggagcaaaatgagtatgacatggaaccagaggagagagatatcaaaagaaaaggaaataataggttaaaataagttgcatttgaaaaaaatatctactgtcacatacagagagtaaagaattaaccaagattttgtctatttcaccaatatttctgatctaatagcaataagcataacttttgtgatactgggtacttttcatgttttcctttttgtctgattctatccgatttgcctaagttgccagtgagtcaaacaatgtttatatcattagagtcacttctagtgtcttgtgccaaaaataaaaaataaataaatacatgactagtgggaaattttagtattaataattatttattttgttttctgttcagaatttgaaactatctcagcactgggcacaaactgggggataattcacagtgaaaaaaaggaattagtgtatgtgtggaatagaatgaatgtgattggtaagaggacaatagataattagaaaattctggatggcagaaagaatatgtcagctatttcaagatacagcagaaagaggagtgaggcaataactctatttcatcaaaactggatacaagaagggagttatgtattccctgctgccatttgatcgtgattgttaatgagcaagttttcacttgctgcaactggaatggaattaagtctgtctaagggtactgtcttttttctagttcttttttttttttttcttttcttttcttcttccctctgctttaaatcctttggtctggattataggcaagatatagttcattttgactgattaggagacagaagcatctagaagtattcaaattacttgtttttcatatacagcatactattcttaattacaacaaattattcatcagcagagactaatatattttagtaacaattgtatattacacttttatttgctctgccttatataatacatcaaattatttttactcatgacttaatttttgaagaaatttttaaaaaatcttttagatacatgcacatgaaattatatcatatctagctgattaatagtgaagtaagtccacaaatagtttattctttgaggcttactatgaatactgacctaatccaactacctaaataaatcacattccccacattatcctactgaatgaattgacaacatgatacctctgcatattgccattagtcaaatactttaaaataattattagtgacatgtaaaattgatgtaaaaaaataactatcactttcaacttctagacttatcatataaaaactcttaccttgcctacatactg

SEQ ID NO: 51998 - DNA, 707 bp, Bovine  19866880894541
tttttttgttaattaattttgtaactgtaagacggaggatggaacactatacatgagcagtatcatacgcagtagctccttgggctaaaatgtggatttttaaaaagatatatattttaattagcataaataaacaaaaataggaaaattggttatctgatttcatttattcctaatctaatcgttatttttcttttcttttttccccttcttagaacatgccattctcttttattatagtgtattctcccgtaaagtgctagcttttcagttaaaataatttctttgggtcttggtagtgtttgcaaatgcagttatcacctttacccttccactcctaaatcttcattgcttgatcccatcttaatccaatcttcgttttcccttctctcctggatcagataacataaatggatttcttagaacaccctttacattttatgataccttgtttcccaagattgcagtaatcagaaggtggaatgaacagcaaaatcagtgagaaaaaaaaatacatcaatctcttttttagtcaaaaagaatgtgacagtgagactacagagcagcactagtcaaagttgtattcgcatctatgcagcagcagcagcatcttctggacaaaaagaaaaaatgtgaaattatagcaataagactgtaattagtgaaaaagcagtcacctgctaaccaaactcgaattcttttcaggt

SEQ ID NO: 51999 - DNA, 1206 bp, Bovine  19866880896653
cacacacacacaatatacatgacatatgtggtttccatgcctgtaaatgatttttccatattgtattgcttggatatttatgactaagcttcattgttcaagttatactgtatttacttggcttgttagcctaaaataaacagaaaataactaaatcattgcaataactccaaagcagtatgacagaataatcgagtacactttgaagctttttcattagtaatcttcattttatgcattcactgaatttttccatatatttacatagactaagccttatttacttcagaaaaaaactcacttttgcaaatttgaccttgtcttgtatacctgtatacatataaataagatgatttttctcataaatgttgcaagttctacagtaattcaaatgtctactgtgaatataataagaatggtcctgggctcttcacatataattcaaattgaataccaacataaactttcgtttcctctaaattttctgatccatagcgaggaaaagaatgttaccaagtaaaaacctcaaaaaatgcttctgacatagaagaggccattcttatcacaattcacacatttcagctaccttttattctatgaaattccttgtgacataaatgcaaactctgcttcttttcaggtttacgcaaagctaaaaagagagtctctgtttctagccttgaccggaaagtcagaaaagagaatgtgtactctatgattccagcattattcaccataaaaatggccaagatgaagcacataaccaggagtgaaatgacatgagagaaaattaggattcattcatcagtcatattatatctcatagaatacaagtgaaggttatagccttgaacacatcattttaaagaagcgatttttatactcgggggagtgttaactacagcaatgcattatcactctcactattttattccaactttagagaaatacttgtttagtaggaacaacttgaaacagtattatccattgtgctctcagtgcataaaattcattaaatataaaaacccgtgcgtcaaaaagaaaggagtttagattgaatcattgtcttatatcatattatttgtatatgttgctaaattcaaccacacacttaaaatgcactaaccacagaattcactttagattatttgcttacaaagtttaatatatttacaaagaaagctgttctatttctctaacacatgt

SEQ ID NO: 52000 - DNA, 1791 bp, Bovine  19866881190692
cccagcactcacacttattttggatgggatcaaaaaatgagacaaattcatggctcatgaatcccatgttgtgggatggcctttgatccttcagttcagattctatcatagaatttgcactaaaattatatacattgtatatttttttcaaaaatagctaactttgttcattcctgtggatgccagatttcaggaagaggcccagtgaactttacctcctggtattcacatactatacagccctctctgagctgtataatcaacacaacatggaaatgacagcataaggtattcaaagctaggttataataaacattgtgattccaccttctttttcctttaatatcttgtaccagatgcctactgccttgtgaggacactcaagtagctggagagattcatatggtcaggaactttggcttctgtcaagagccaggaccaactgattagacgtgaatgaggaaccatcctggaaatagttcctccaatcagagtttagctttttgatgactgaatggcagtttgaaccaacttcataactacaacttcatgaaaggtcccgaaccaggacaatccagctcctatgcactgggttttctgacccacagaatctatgtgagatcaaataactgtgagataaagtaaatggattgtgttaagccagcatactctgaagtgatttattatggaacaagagattactaagagacctctttccttatgtttctttttttttctattttttactttacttttttctttgaatcctaaccttccagaataaaatatgttcttatcattattgatctgggtcatggcacccatatcacataacccttatatttaaatgtgacatacttagtgaaatatccatatttcagtctccattaggaattttttcttttgtagttacagtagggtttcgacagaaaaaaaaaaaatagctgaatattggatcctgagattaacagatgttagtcaaacaaattatctttttggttcagttaggtgctatcctttctttttattttctgtttgaggctatgactcaataatttgcttttctgcttatagtatcaaaactgtttgttttaaaataacagctataaaatatcaagtacataattttacaaatacctattgacttttttctttgacttttacattaagcactgacatttcaattttgacagtttatttaccacataattagaatgagtaaatttctcattaggacaaagtgaaaagaaaaatgttgccagaaatttctcatggaaaaaggaatatcatataagataaacatgtatataacataaaatatagtacattaaatattattcacacctgatgtgaaatgttgagatctttttaaaaatgtgttcacactgctcaaattcagttttaaattattctaaatctgtggtccgtttcttccttaactctcagctctgttctaaattcccgattgacatcatgatataaattttcttagtaaatatttttataagcttagttttattgcatgtctatgttttcaattcatgcttggcattgttttcttaacattattactattttattattaattgtagtgctctgtcttcctcaattgcttggctgctcacacttgataagaaaggaattatctctacacctggttgcatttccatttctcttcctatagtggaacagaatttcaacaaattgaatcaaaaattaaatcataaaactgttttttcacttttaagtgtttcctaaattttaactacttgtttatatcttctttttctg

SEQ ID NO: 52001 - DNA, 1172 bp, Bovine  19866880462214
aatgcaaaaaatcagacgtgtgtccttaatatatgtaagggcttgcctcagacgcgtggacatgtgtatttataagtgcgcagacagaagtttaaatattcagacacattttatgattgtcctctgcccgtcttctggctaatggctcctcctgtgcccaccaatacatcaatacggtcgtgtgtattgaatcgcgggcaggaatgaggaggaagcgagtgctcagcctagccggtcggagtacaggaccgtaaatcggggaccctaggcagtcagcgcttcccgcgcgcccgccatgttggggagccctccctgccccccgcgccgggctgggtggccggggctcgccggcagccgggggagggcctttcataacccggagaattttcaaagtgcgaggaagatgataagaatagatttctacaagtcccgaccacgtgattggcgaaataattaattcagcacgtcccttaagaaacacggagtcgtcattaatctgccacgcaaagggctctctcctacttgtgcagggatcccaagaatatcacccaccgaggggggctgcgcggcgcccccagccctccaccctcggcccccggtggcggcggcggccgcggcgggcgcgggagtgcagccggcaggtaaatattttgtcgacttttatttcttcggatttaaatccttaatgaacttagctgtcagggccgctgacaaatagttccctttgcttcctgatttggaagcgtgcgccgtcaagaagttgttagtggcttggatggtgacctttggttcagcaaagctttgcacttatgaaaaattactgagagcggccgagtgtgtgtgtgtgtgagagacagagagagagagagtgtgtgtgtgtgtgagggtgtgcggggggcgaggggcgagggtgcgcgcgggctgctcagaggcgacaggagtagtaaaaacccgcccggctgggggacgcgcctggcgcacgcgggccgaggttgcccggtcgcctgtgtctaccgggaacaatggtcgctgtcacggcatctgccgcctattcttaaaccggtgagaaaaggccccggccctcttttcaagcaagggtcgtaaatttttctttgcgtcataatggaaggctataaaatcgagttaaattttaccccaggcagattttaacc

SEQ ID NO: 52002 - DNA, 1939 bp, Bovine  19866880656938
ttgcattgattgctgaggaaggctttcttatctctccttgctattctttggaactctgcattcaaatgggtatgtttccttttctcctttgcttttttttttctcttcttttcacagctatttgtaaggcctcctcagacagccattttgcttttttgcatttctttttctttttcttactgaattattccttggctactcagaaaaatgcacttcccccatcttgtcaggtactacttgggtccctctcaggctttttcttgagtaccatcaccttctgatgtgaatactttatgtttatttctgtgttttgtttttctgtctcatctgctggcatataaactccatgaaggtggaagtgggtgtgttttgttcactgctgtatcttcagcacttaagtcaatgcctggaaatagcctaggaagtcaatcagttgttcaatatcaaatttattttttattgtacagtatttgtaaagtttgcattattttaaaaaacagagtagagcatgatcaaggaggaataaaaaaattatggattaattacctcctaaactattgaattttaataatttttattgaggttttaaactctttcatggaatatttagctaaaaagcagatccactaaaaataggtgcaattgctcagttgtaagaatatgagttcacaccttaggcaactcttaggttatgacatcagtttatttgagtgcaggctcagacaaaacatcttctgaagtatcaccgttggtagagtctgtttggatatttaatcaaaacacaatgtcagtaaatacagccctagtctagagtttatagtcttcggtgagtagcttacaagatggtcaccatttgtttttctgtttccttaagcagctatcttgatatccaaaatgtcctgtttataaactgtcatcccgggggccagggagcaaagtgagccctgtgatggatcaccctcagcaggctgactccgcctgtcgttcttgctgctctaattaaaagacggtgaagtcaggggtctaaggcagggatgacaatagggcagcagtccccaaaatagcagccaaggaaaatggatgcctttgagtgattgcatgatgtctgaattaatggccaggaaatgagcgattattgcatgcttaaagctgggctgttttataaagcttgtggtgtgctcaacgccttgtacttgaacttggggaaacgtaagagaggaatttgtttggttattgtttggctggagataatgcatatccaagcagtgcttaaactaaggagaaaaacagttactgttgttttagtattgacgtttctaaaataagcatgatctgatgaaactcattttgtagatgcatgtagtagctagccagttgttgacttagagagaccacatttattgccactgcctttgttcctgacttaagataatatttaaatagatgttttactgtggaagcaaagcttctaagatcacctttctttttttaaaaaatattttctcatagcacttctgtttggcaagtcagtgataagcatccttatttctctgtggctgattagttcagtaggttaagacatcacacaaaagaggccaaggtccggtgtttgattcctctgtgagggtgcgctcccctaggctgcactcctaaccccagacgccatcttgtaatggtgtccattcatcatgggcggaaacaggagagggtgagggtggatcacagcaaatccatcaccactgctggaaacccaactgatcatgctggcctcacagattgggggctgggaggggtcagggcagttgttttatgcaaacaacaatgaagcatgccaatgaggaaattgaggtacggctacgttatattgctacatttttaaaaattaatcactttaataaacttcaaatccacaatattttttgctactcttcagtcagtt

SEQ ID NO: 52003 - DNA, 1325 bp, Bovine  19866880674590
tgaactcatttcatttctcctgcagtcttcccttcccactccactgttcattttggtggataactgactatctgcttaggctgtcaaaatcaaaacctagggattagcatccacaactcctctttcactaatccaattgatcaccaagtcctctgaattcttcctcctaaatgcctctcctcttcatccttattaagtttctccctctctaggctggattatggcagcagcctccttctttgttcttcccacttcctctctctcctttctcccatcagacacagtaccccctagagtcagctttccaaatatagataacaaatgtccgcatgtcccagcttaagacctttagtggctctcccttgcctacatgttaagtccagatgcccttccatggcccttacacagcctctctgtccagccagatgcctcactccgagctcctctccttgttataggtccataccttgctctttcttccctccctgctttagtatgtgttgctctctccacctggtagatcactccttcttgggcctaaaaaattcctatacttcaggaacccaaattcacctcttctgagaagccttttttgacactatgatcctttattccaggaacattttggccacacctctgttatagcatctgtcatactaatcttaggattctttttctaccccagcagactgaagggcatacaccattagtgactcaatttttatatcccagagctcagcacagtacacgtaggaactgttcagtaggcactgctgaagagagaagactctgaaccaagaacaagaggttcagtattttaactgctggaggagttcaggacactgtggaggccttaaggcttcagcttacatccatctgaggaaaatgatagtagaacatttctccagaaacaagctatttccacccaagaggagagagagagaagaggactgaggggagagggcaagagctgggactttctgtcctccaggggctctttactgtgggctgagacaacacgctaacttgagaaacttcccatctcatatcactgagaacagaaattaaaaagagagggtagcccagaactctcagaatttatgaccgaaaggacagcgggtgccactcaagaggggtataagagtgcttccccaccccctcacccaggccttcctgctgtgaacagctctgcctgaagcctgcccctcgcccccagctgtagtctgctccttcacggtgtttctaaaatgaacccccaacagctaacgtacaactactccaagccttccctcatatcacaaaaaagagaagaggcatatcattgt

SEQ ID NO: 52004 - DNA, 867 bp, Bovine  19866880680291
tatgtttgaaattgggaatacaaacaactctataacatctatgtgcaaagtcgtggctccatggattatctaagacaaatttttaattcaaaactgacttcctctaccaaccactattactgatttgtgctcaggacagccaaactaattttaacattttccttttaaaatatatttaggaaagataaatccactaccagaaatatcctgtaaagttttacaaaaccaaacagcaaagctttctgaattatctgctgttctagattctctgttcagaattttaatacgcttggtcagaagtcattgctaaactttcagagtaaaaagcaagtataatgtaattttgagaataagtcatacattataaaagaacagagctaaaatatgtctaagcatttaaagtttggatttttttccccacgaatctgcattttcattctaatccacagtcaagagttaactaactatatttaaatttttgatagcactttttcttaatgatctttgaaaatttcacggacatgacctggtgccaaatatagtgcatctcagatgcagagcacttggggtgatttgccataagcatagtatagggagagctgtggtgctgggtgtcacaagtccaagaaggcaccccaccaaacctggtgcccattcctctaccccacgtggccctagccatcagctgtgtcatccaatttcttaggtgttcaactgcaaagtgaacaccataaaatggtagatggtttctcaaaatcattatccaagttccaaaatgcctgatccatggctctgatttaatatacagcatcatttagaaaagcttcttcaagcgaatccattcaaggcaggaacaaaaaatccaga

SEQ ID NO: 52005 - DNA, 821 bp, Bovine  19866880716519
aagtcctggtacaacttacttattcagcttttagaatctttagaatgatgaaatagtaaagtccaatgtctgaaaatgcaaacacccccccagccgtagggagttaagaatctctctgagctggatcacacagccacttccgctgtctggctcgatgtgagactgggtgtttccatctcacctccaacaggtcacaataggtacaaagtcttctttcccctagtccaagttcactacttgacttttgttaaatgtttcacaacagtggagtttgcatgtctggagttctttttattggattttgatgtctgattctgtctccataggcattgaaaccactcacacaaagattcagtttgaaacttgttttaaggaacccccttacctccttacatctggatatgcaggaccaccagcaatggtactgttctcctgtgttaccccagtgtaatgagtttataatcctgaatctttagatctactacaagcttaactgaaagaagcatttcaaccctaagagctatcatccagtgaattgaaggggaaataagaaaataacattgatgtgtgtctagggtccacaaatacagcagatgaactaatatattggctcaaaatttatttttaaaaaggtcttataatacctttttgttgagtaatgaaagatggttgatagatacctatgactagtgctaccatttttagcaaactatccccttttctaaataagggtccatatcaccagtggccagtctaattataggagaaacagaagagacagagttctgggaaagcatcgaaggtaattactattatcaaat

SEQ ID NO: 52006 - DNA, 824 bp, Bovine  19866880729714
caggaggtgagggttctattcctggtcagggaactaagagcctacctgtcacacgatgcaaaaaaaaaaaaaaaaaaagcaaaaaactacacagaggatctggaacacctaagtatgtcatcatgtgaagaatataaagtaaatatgtaaagtaatacagccatacttaaatagcagtaataaactgttaggcttagcaggaaatggaaaatagctaacggaataatgcagagtttgtttatttgtggagtggacggccatcatccatcatgttcccaggtcccctaccaatggcagcagctaataggcttgcttggggtgatgaggtgagcccaggaaaccactctttctgaattctaagggaagtgcagttgtcagccacacaagggaactttgtagcaagaacctgtgatgcggtagaatacggtggtggttagggtcatggcatttggaggtggtcagtgttatatctgtgaatatggatttttggagcaggagagggcacctgacccaaagcagagattagtccaaaagctagcacccaatctattgtatatgtagccttgaaagtttatctagcctggctaaatctcaattttctctctcataaaatgaaaaaataatacctaactcaaaaagctactgcaagtaccacatgagatctgggaaagtgatatgcctcagacttagaacacactcaacaatccttagtcaccgttaacctttagccaaagcagtggccacagagcccagaggccaagattccatatctttaaggccaaactaggagggcaagttttcccaggcttctcttcaccctcaga

SEQ ID NO: 52007 - DNA, 741 bp, Bovine  19866880741333
ctccctgcattgttctgggagctagctccacgtactcacgctttttatcctcttactgttggcttaatttttttttcctctgtgaggttaacatgctatttaagcttctccctcaaattcaagagaacccccaagttacccaaaagaatttggggggcacctccatagtcctcctcactaacctggtttttgactgcaatagtggcagagaaaaggtttagggcttctgggtccttcttaaagaaactgaaatgacagctaaataatattttggttcctgcatcccatccatcattttgtgtattgtgtcctggatgtgggagcacaggacagttcatcatgggtctttccccaggaccaaagcctgagaaagcggccccgtgagtgagtggctcctagctcctggaaaactgctatagggctaggccagactgggcctctgtgggaaagggacccagaaagcaaggagcactcccttaaccttagttgggacaggtctcagccagagagggacagactcccagggtcctggccatcaaaggagagcagtaaacttgtttggtcaatcgctgatgcttcgctccatcagaagttaaagtcactggacatttttcttctcttgctgccttggagctgcacgcctgccagcttagtcagctgaatccaattactgcgaacagcatttcatttggccccggtggagcagtcagttataacttccccgaaaatttcaataatctg

SEQ ID NO: 52008 - DNA, 1353 bp, Bovine  19866880831986
taagaatgacgaaagcagtatttaaaccgaaaaaaaaagtgatttttataatatgctgctttaaatgcttgtgttacaaaattaatgataaaattaaatattataaacatacattacctattttgttttcatgtataaaattgtataatttaggtgaacaatgtttaaactatcttcttaatggagagatgaaatttttcttgttttttattgccatatatttgtacatggcaattttcaaccaaaaatcaatagccatctaaattaatatttaatgaagagaaaaacaaagatagctttgaacatgaagtgacagagaaattttgtcattaccaaccactaaggattatcaaaggatttactacagcaaattgagaactgtactaaggaaggcaatgacatgggaaaaatttaagtggtgaaaaaagagagacagtaccacatatacaagatgattgctatgttattttcaactgcaaataaaataggaagtaatcaacatgccccccaaaataaggaaatcggctaagttattgtacttccacttaagagaatatcatgcagccattaaaaattgtaagtaccaagattttttacagctacatagaaatacttatgttttatgtttaataaaaataaaatgcagaattttattcaaattatgcttatcagggcttccctggtagctcagacggtaaagtgtctgccgtaatgtgggagaccctggggtttgatcccgtggggtcagaaagatcccctggagaaaggaaatggcaacccactccagtactcttgcctgggaaatccatgcacagaggagcctggtaggctacagtccacggggttgcaaaagagacatgactgatcaactaaacaacagaaataggtttgatgagcatgctaaacatttattcttttatatattttaactattttccctagtggctcagatggtaaagagtctgcctgcaatgcaggagacccagatttgattcctgggtcgggtaaaatcctctgaagaaggaaatagcaacccactccagtattcttgcctggaaaattccatggacagaggaacctcatgggccacagtccctgggatcacaaagagttggacacgactgagcgactaacacacttgtatcaaactaaagagctgggcattcaaccacaatatttgatattttcattgattttcacttaattgtccataactttatatcagttgtctgtattaaaaagcaccatcaggaacagtccaataaaattaccactatacctaccataggcatatttctattacattattcaatactttatgagaagtgatgagagaaaaacctcagatttcta

SEQ ID NO: 52009 - DNA, 1568 bp, Bovine  19866880883588
tttatataaaatattgatattagctatctgggaatgaatgcgaatcaccaccagtgactgtgtattgcatacttattgtgtagaggatgaccatgtgcccagcaagcaggaaatagaaatgagtgtgatgtccttacctcaaggaaatcacaatctagtgggaataaagtttaaacacagaaacaggcgagaccctggcagcatagcataatggttgagacggcgggctctagccagttgtttaacaattggtgatgtggaacaaaatgagggctgtgctagtttgtagactgtgcctgtttctgcagtgtaggtacatgcactgtagcttctttttaagctgtcaatatgacatctctgaaaggcagagttggaaagagaggctaacagtaggctctctctagctggtgtgggtacaagcccgcaccagcacagcaccgactcaagagaggatctgcctgggcttgagtctcagctctgccgcacgctagctgtggttgtggtttagaaactaactcccttaggcttcagcatcttcatctggaaagtgggattatggtagcacttgttgcagttacttgaacgttccttaaggtgagccacgtgaagaattaagacagtgtctggtgcacgaccccaagaggtgtgacctgcaattcctatgattgatcaaattcaaagaagatggagagatggcttccaggtgaaggattccaggatttaaggacgtaaatttttttttttcctggtgggtgtggtggggattgtggaagaggacagcatggcaaaaccaggtaggtaagaagagaccagttatatgctgaaaattccatggagttctgtttagttggaatattgtgtttacctataaaggggcaggaagtttccaagcttaggggttaggctgggctgtgttgtgaggctcttgaatgccaggagatcagacttccctttgggacagtggaaacttaaatgcagtgactatttagatgcagaagatgacatgaggccaggcattcctgagagaactactcaaaaccaagtgacatgaatgtctgcatgaagtgaggcgattgctccaagtcaccgcttgggaatacatgcttattctatcattagaaacaagtattgactggctctagtcaagtctgcacacaacacgaagcccagctctcggtatttcttgactggtactccatctggaaacacagttgagccaatgaaagttttcagatgggtatatcttctataatcctgagctcaccccaatccaatttcatatctggtaacatatctggaggacgttacagagatatatgatttcaccgagtggggtctgcagttcacagaatcactaatacaaaataaatggttgccctttagaaatgacttgcaaatagaacttcctcaaatattatagcaggaagaacagtattactttctacagagccgattgagggaaaaaaattgctcggttggtattgttttccagaatgtcacctctttagaaaacactttattttaaaatggttcatttgctctggatctaatttctattatttcgggtg

SEQ ID NO: 52010 - DNA, 1664 bp, Bovine  19866880951900
aaatatttgagtagcatacccaaatagatttggaaatctatggctggtattcctaacctagtgaatcatgcacattataaaacacactaaaaaagaaaacagttgaaaaaagttgaaacctaaattccaatatttcttttccatacttgaaaggattatctagtacaaaacccctgtatatacacctaaccccactttagaaaacacggttcaaattaaataactacttatttgaagtttcatcagggaactcagccattcacatatccttgatcaaagacaagtcctcctctattctactgaaatcatctctttgaccacaaaaaaagcttggaaagaacacactcaaattaatgtggggtgggggggatacctgactacccaaccatctaataataggacccttgcattctaccagagtatttaaaatttcccccatacactttatactttctcacctcagagactttgcttaaactgttaccctctacccagaatatttcttcccactgcatgcccaaatcctacacctttttcaagaccaagcttaaaatgctacctccatcaagaaggcttctgtaactaaacaaatctaatttctcctttatctatactgctcatagcagtttgcacttgtcttatatcatatattgctttctactctattctattattatgtcaatatcttatcttcctttctaggcagtaagttcctagaatgtgaaaattcccatgatccttagagtatttattaaagactcagcttctcaactgccccaaactgaatacaatattaataacaatatatacaatatatggaaaaacatgaaattcaaattaagcaatatttaaattattttggtctaagtatcatttaaaaactaatctttatcacatgagttccaaagtaaaattacccacctttcagaaattaattcttttacaatcagaaactactatctcattttcatatcaaagaaataacttacactaagacattcttagtgacctatattaattcatttttaaacattacaatgatgtcccattccctagcaaaagatccatgaaaatgtttatcatttttataaagaagaaatatactattttataggcataaatttaaaacatctagaaataaagcaaatattggagcacctcagcacttcctattccaataacactattagaagtcttttaacccctttgtcctttactgtctttccaattttatctaggtaaaattatcttgagaattttacactaatgtctctttcactaggagcaaagctgattcctcttaaagttgcaacctttagtgagatacagggcttttttatggaaataaatttcaaagcttttcatagatagtttctatctcctataagtatttaggttggaggagaagcaagtttagaaagagagagaatacacactcttggacttgtgaaaaccttaacttaaaataaataacgtctaaacaaacaaatttatgctagaaatgcatacacggtaaaacaattctcatagccccccaaaatacacatttgattctcattctctttaaggtacctactacttttaagttttatcaacccccgggtggctcagaggttaaagcatctgcctggaatgatggagacccaggttcgatccctgagtca

SEQ ID NO: 52011 - DNA, 1083 bp, Bovine  19866880983650
tttaatagtataagagcatatcatttgcatacaacatatgacaagaaaaagttcatggatactgcccttccttaaaagaagcctttctattgtaaaaagttcctctcctttgccgatgcttgttcttctggggaccccaatgacattattaatacaaagattccccccaggctagagactgactggagccaacctaaaggcatgaaggcatacatgtagaaacttgtgcattccttgtatgcctgttgactgtattttagtgtatacacactgaaggactacttctgttaattaaccagcttttaaattattaaaataaaatcaagtttatgacaaaaactcaaataacatagaatctggggtaaaggtaaaaagtaaaattctttctctcaacatccaatctcactcccagaggtgtggaaccacataattacatattcttgaatgtccttccagaaatattcaatccatagtcaagtgtgtgtgtgtttagaaaagttatttttaaaggatatttgatgaagcaaaagaataatctgacttttggttaattttattataaaaattattagtgagtatataatacatctttattttgcagcaacactttaatattcataaagctgtatatcatacagcttaatcattgccctcttgtcacaaatgatttcccatatcattctaatatagttatttatattttatagatcatttgaaaataaagctgaattcttcatcctaatataaaacaacatacattaaaatgaaaacaaattaatggcttatttatcattgtttttttaaacccttcaagttgaaaatgttagatggattttcctttgaggctattatggtgctgactctcatcaataaagttacacaaaattttagtgcatgaaaagaacaagattgcttattcttaaatcaccttgctgaattagaagtaaaaatgattgttatagagagatgcaatgaatttttcaaaatatattaaaattgtgagagtatctctttaatactaccactttataatttaaaacattagttcctaaaagttgtaagatttgcagcaataaacaacat

SEQ ID NO: 52012 - DNA, 1601 bp, Bovine  19866881128974
agagggagtgacttgcctgaaacttgtgcatagctactacctgaggccaagaatctaaataaatcttttgattcctagcctggagcaatttccattaccttctgtgtaggatcagtgcaagttgcctcaatgttgaaatttctgaagtgcactcaagaccttttataatctagtctaaatttacatttattacttcatctttcatgactatcccatagaaatcttctgatccaaccacatttatttacctattgtccgtgaacttgctgggtacttttgactaatactgtgaccttctaatgagagtttccactcattcaaagtctagcataatttagttgactttatccatgaatctttctacaaccaacccattaataacttttcacgtttaagctgtgtcatttttaaatacttaactatatataaccatgtcccttcttaaattgttgcttttttgtactctcatttaacttcacacatctttgtgtgatctacccatatagattacaatcttcttgatagcagaagctatgtctacctttgtatctccttaagaacttaataaatgcaatattaaaatgttcaaatatttttaactgaattcattttgattgagttttgttagtagatggtttttaaatttggaatttccattctggcattaaaataggtctccatattcagatatcctaacaaccctctcttaaatgctgtcgacttgacatattcttttacattttattttaaatactatatatattattaatcatcattaaatggaggagtttaaaataaagtaacttatttcttggtctcttttagaaaccaaattttcttgtgacattatgttctaattaggttttacacagagatagtgttcactgactcctgttagaaaaccacttgtaacaacttctataggggaaatgtgtcactaatcaatagtaattattaaatatattataaagttttgatggtacaccaaatgaagaggacataagcctgcatttttatctctttgcatatttttaatcattttaggatcatttttaacacaagcataaagttcagcatttcaatttactattcaggataattttcttctcctattgtttagaaatacaaataacaaaattttcaaggctttctctacttattaaaatgcatcttctgaaaagttaatcatatttatcctgcttatttgcaccgattcagtccttagcaccttttcaaagctctgccatcaattgtcaacctaaaataacacttattttacataacattctctcatctaccttcttgtatatagggagtatagggatatgtttataataactataacatccttgtgcactaatactgtcatctgtgtcatttctgggtctatttctactgactaatatttctcacatttctttgcatgcctggtaattttttttttttcttgcatgcctgacattgtgaattttacattattgggtggtggagatatttatgttcctttaatattttaaggttttgttctgggatgcagttatttgaaattcagttccttttgaggctgtttgaagttatattaggcaggtccacttccagca

SEQ ID NO: 52013 - DNA, 1012 bp, Bovine  19866881131020
cccgcgcccggggagtaaggggagtatataaagtggcctctgcgggcctcctggagcagctctgttcggcggccggacgcgggacgcgatgggcgcagcctggccagggactggagacctgccgcccgccacagccttggaggccaggccggaggctcgccggacgcacggaggccggccccgcgcgcgttcgcccgccgccctcagtggccgcgcaaaggctgagggggctggggagggaggcggctgcagtcgcccggtggtgactagagctgcgatcgtggtaaaatcaaggacgggtcggattagtctgtgcaacttgaaagagaaggggtaggcgttggggtgggtgcaggttgcttctattcctttcattttattattattatttcctctgaggttcgaagtggtctgggcttctctgctttaccagaatcagggccttcgaaacccacagatctctttttggcagacaccaatcttgctgggcatccccattaattcactggaaccgggcatcgattcttccttccctgctggctttactactttgggattggaaacgactatttttccgatttgctaagaaggggctctatttaccgtagagctggagcagctttctgcccacgttctcccgatctctcagcctgagctcttctgccttatgggaagacctggacgcgccttctaaatcactcttatttagcccagataactcaatgtaatacaccctgcatttaaggcactgggctcaccctattaaggcaccataaatttgaagaccgatgatcggttatcatgtaaccggcggcagttcacactgaggtgatccacttcaaagccgccctttgttttatgttttgatgtatgaatcctgagatggctaatttgagttgcaggacaaatggaaatgtagtggaaattacttttaaaaatcacaccactcaccacaatttgtgtgtgtgtgtgttctcaaaatttgtctctaactctttgtaggctcttcgag

SEQ ID NO: 52014 - DNA, 1417 bp, Bovine  19866881206419
accaaattagcatctttttcctggtctgggtataagagtttgggtgtgtgtaactgctgaatcttttatcttaaagtgacaaggattagccactaggtgctccttttaatattcatcaatgtctcacacaggcagaatattgtttaatgttcaggacaatataattgtgccttttcttgaattttggcttttgattaagtggcgctggtattcaagcaatagaaacaatgatccatgaaaaaaacatatatataagataggtatcgattccatttgagagtaatagcaacccacaacactgctgtgaaattatcaaatttgggttggaaagccttaaagaatgaaggctggggaatttattgtgctatcacatattgcatctttgcaatagcagagaaaaagcatgtagcaattgcagctgaaaacatcgatgtaaatgttattatgccttcccagctctcagtcatattggctgctgacatctctcagtgccggttgattgtcagtggcaaagcaggtctgctgttgattggctggccagtgtcacatgataccacagcctgcacccatgtaaatcacccagtgaactgttgtgtgaaattgttcgtacaccctttggtgaacttgcaatgtgacagctcacatcagaaatagatcagatgtcttcagaccacatttgctctttggacaatccatccaggaacctgaggttcctgcagacccaagactcacattcttattgtctctaattcacatgccgggtcgtataggctttgctccctcacgggcacatcgcttgcatctttatttgctgagtctccctttacctttgtgttatgtctcctcacgaaccttcatgatgaacattctgcagtggctcagacagcctttcgcagttgatgtgatttccccagatctgataaagagcttagcaacgcgcttcggtctttgtgtttggataatttatgtggtgacgatgtcgcaaaatcagaattagacggacgttgagacatcttcttacccaggagaaaaagatactatggactgcatcctcaaatctcagtgtggacacattttgcttcacagatctcttattttctgaatacataataacattttcatatgctgatagtgagggtgaaaaatataacctttctggaggacaatttggcactagcttagaagaaaaatttgtaatgtgtacaaaaatgcagttataacaatgctgaaacagagttgtttataatagcaaagtagctatttataattatatgtatttataatagttatagatatttatgtattttaatacaattataacattaaaataaatgagaaaagaatagttagaccaaaaaaaaaaaaaaaaacccccaagatggtctgttcaaacatgaaatactctagttattggaaa

SEQ ID NO: 52015 - DNA, 1104 bp, Bovine  19866881350004
ttctagcatattttctttctcatagttgaattcatcatctatacacaacttcatatcctgtctttttatttaacattacatcatatccataagttttaatggtagcataatatagtattacactgatattgcatcattccgtattccatagctaactattctactaatgtagatgtagatgctgccagtttttctctattacaaaaagcaccacaataaacctccttatacataaatcatgcttagcaagaaaatcaattaggagacaaataattgtaataaaggtaatggggattcttaagacttttgttacattttgccaaatttctttccaggagggttgtatcaatttacatcaatagtgattgagaatgtttgcctttcaacctttatcatagctattgttacagttaatctttgctaatagataggtggaaaattagtcatactgtatcattcctgcttgaatttacagatggaagttgcttttttgcatgttttttaatgtaatattcttcttcagaagttatgctaattcacctgaattattacagttttagacatgtcatgaagccatcataagcccttgagctttctgttgcctcctaaaataaagtgcacctgccatctttatttcatttattcaccccatctagtcatgcaatccttagacaatctttatagaaaacactttgacaaaagtatcaagtctttaaaatatttatatcatttaaccccacagattttctttcagtaaaatgccttctgaggaccagtcacatttgatttgttttctaaagaaatgaggaaagtaatccccaaggaaatagcccccatcttttgcttatctttctctcacttcatttcaaaaaaggaaaacgtattaccaagaacagctgtcttgaaaatgctggaagctaagcaggtggtaccacctgtagctatgaaatcacaagctctgtacaaggctatccagttgagctgatatccagcctttctcaattttgttgggaacagtgtcaagcctggacaaattccagttcagaattctccagatagacagatagatgatagataaatgatagatagccactggaatagcaa

SEQ ID NO: 52016 - DNA, 919 bp, Bovine  19866881384496
taattatatggagaaacagaagagacagagttctgggaaagcatctgaaggtgaattactacttactcaaatggcctacaacactgtcgcgtgagggcaattagaaaataacaggttgagcatgggagtacctccttttgaaagtgttgtcttttccctattatataagaaattcacgtaattctcttaagaaattacttggctgtagtagggtgatcctgatgttggctggtaacctttattaagttgtaagggtagtttatacagttgttgcacttacctagcctatgagaaattttgcccagaagaaacttctcttgttcttctatattatccaagaaaaagtctttccagagttttcagacttaggtgtccctgtatagtgaatcagcatctgttttttgttttgttttgtttttttacattttaaaaaataattaatttattttttaattgaaggataattgctttacagaattttgttgtgttctgtcaaacctcaacatgaatcagccataggtatacatatatcccctcccttttgaacttccctcctatctcccttcccatcccgcccctctaggttgatacagagcccatgtttgagtttcctgagccatacagtaaattcctgttggctagatagcatctgtttttgattgatttgtgatgtttcctctgtcgtttgttgaaggtgtcagcaagcagtgaaatgaccaaaaaacaagggactacatttgactcagactaatgaagatcttttccttgttccagaccttcagcgtttgggatttgggctgtgaaacagttgtgtttatgattctagttagttgagctcttacttagaacatattcatttattacaaactattgaaatctaagtatgtttttgaagcacctacataccataatcattaag

SEQ ID NO: 52017 - DNA, 1880 bp, Bovine  19866881426408
caggacagttattcttagagtggctgaccttcctattgtggatttcttttatcttgactaacgtcagctcttctgtttttttcctcatttatttattttccctctaactggtggtgcttctgagaagcccatctgctcttagccctgcagaccgtgctgtcagatgttctcaagtgccctgggcagctgtggtcccccctcacacatactaagaccagaattcaagactccagtgagatgagaaaaatctgggctgtgttccgtattccattctatcccatgtcaccttttcctctcaactggacttttttgagtgctcacagagttgaatgggcacagaagccaggttctctgaatgctatttatacacttctctgatgagaatggtttggctttattttccattgtgcttcatccacagagatttggagttgtcttcttcttagttcagacagactttaacctccacctttgacttattttctgtttacaagtggcctccagccctggcatcacctctcctttccttggccaccagtgttatctattccatgtatgtctggtcaggaaaacatgattttcagtgtctaaagctccagtccccagccctcctttcctgactccacactgtagcttctgaccctctgggtggctgggaaggcagcttctggatttatcctgagcagttcccacacacactctattccttctgatagaaaaaaatagctcattagagatcccaggaattaggcagagaggagcttcctagctcaggatgaaggaggctgcacgtgtgtgcgtgcatactcagttgtgtccaagtctttatgaccccatggactggggtcatagtctgccagggctcctctgtccatggaattttccaggtgagaatactggagtacaggttgccatttcctactcgaggttatcttcttgacccagggatcaaaaccccatctctcctgtgtcttctgccttagcaggcagactctttaccaccatgctacctgggaagctcaaaggaggtcgcatagcatcataattaacagcccagattctggaggcagactgcttggatcaaatctgtctctttgtagctgtgtgactttagacaaataatttaatttacctggcctccatcttttaatgcatataacagtatctgtctcacagattaatagtattcgtaaagcatttagacctcagttcagtgcagttcagttgctcagtcgagtctgagcagcacgccagacttccctgtctatcacaaactcctggagcttgctcaaactcatgtccatcgagttggtgatgctatccagccatctcatcctctgtcatcctcttctcctcctgccttcaatctttcccagcatcagggtcttttcaaatggagtcagttcttcacatcagggggccaaagtattggagtttcagcttcaacattagtccttccaatgaatgttcaggactgatttcctttagggttgactggttggatctcttttgcagtccaagggactctcaggagtcttctccaacaccacagttcaaaagcatcaattcttcatcactcagctttctttatgatccaactctcacatccatacatgactagtggaaaaaccacagctttgactagatggacccttgtaggcagagcagacctggcaaagagtaaatgctggcggaagtgttactcaaatcatgaggatttttttcctcctcagactttctgctaactaccttgcctataactttgttcttctgggtggcaggcagacaagtctgtgtgtttggagaccaggaagcagatactacctgtctgcaggcccatttcctggcaaaggtgtggctgcagggttagtgcatcttct

SEQ ID NO: 52018 - DNA, 885 bp, Bovine  19866881654399
gaacaaaccctctctcttatgtctcctgcattggcaggagcaccaatatcactccctgggaagcttggactaggggtagcgctcaccaaaaatacttaagaatcagttttgaaaataattttctttttttttttaatgcaaggagtggtgaccaaaagtgaacatagatatgagactaaaatgacaacaacagaaaagagcagctcaattagccaagtccatcagaaattataaatatgccctttcaatcacatggatagagcatgattgggatgagccattcctttaagctaccttcaatgccaggaccaacgctgcagacagaacgaacagatgtctttcacttagtgactggaggcatgtactagaccaaaatattcacaaaagtctcagaggttagaccatattaatgaccctctctttgctttgaactgagtgcattgtgaaaagatcaaggctgtttgtgcagtgtgatatatatagttctgctggaaccactttcacagtgtctcttcagcggccgtcttgggagctgaatcagtgcaccattaaagatggcagcaccaactcctgctgccagctccagctcagacagtgggaaaacaacgctcccaagctaaaactgatcaccttcattgatttttctttagttctgctctttgtaagaaacaattaatgtatagccaaactcactatccctatattttatatttctgggactgttagtgagatatctcaacagataatataaatttgatttgtgtgtgtgtgtgtgtgtgtgtgtcttttttaaagtagccaaataagcaagtgcatgggaagtaattaaaatagtgtcatttcaaatcttgttgaaggttataatgaggactgttatttcagagt

SEQ ID NO: 52019 - DNA, 1180 bp, Bovine  19866880438873
agacatgtatactggtattattagactctaggtcctgttagttaatgttgatgcttttgtcttattaggtaaccagccttcagatataatttctttttcaacttacgtgagtagtggttctaatgtcagttcaattttcagagacctttaggtgtatcccatttgtctgttactccagggttagtctagtgcttggacagtggtttatattatagttcagttctcaaagccttttctgtgctgctttgggtctgctttgtgtatgcatagctcaagggtggcccagggcttgtgccaattcatgtacagaatcaggtgattctcttctttagctcatcccctccagtatttctcccatactcattggccctcacagtccactttttcctttcctctggaaaaaaagatgagatttctttaggagttttagcttcctgcactgctaatgtaacaattcaaaaccaaatggaaaagagaagggggggaaaaaaaaacaggaaacagccttgagtgggttgtttctttgactcctctccacagtctacttgcttttgtttactttttagagacctcggttgctttttttgtattttgtctggagtttttaattctttttttttttttttttaagttttttttttagagtttttaattctaatcggtgagaaagagagaagctaatatgggcttattgcatcttggccagcatttgcagtttattcaatttctttacccttttgataatacttaatactttggcaactgcacagaagtttagtcttcaaacttctaccagttttactaaaatgtcatgtttaatgcaacttcattcatctgattcagggaaaatgttggggtagggaatccgatggggattctatgtagcaagagagacaagaaaatagatgtgtcaagatgttaacaattagttaatctaagtaaagaatatatgggtgctcactctttcaactattttgtgagtttaaaaagtcataataaaaagttgatgggaaactctgatcttaatatattctataatcttaatctaagacactgatctaatcccgaggtcaacctgctggtgctcttcagagtatttttgattggtcgaatttggacatacaaatttggaccttctcgatttcaaggggctttcttgtttctagagaataaacacttt

SEQ ID NO: 52020 - DNA, 2093 bp, Bovine  19866880460842
cataagcatttacattttatctctagctcctgttagagggattcctgacttacacagtgggggagttttatggttgtaattcatcatcgttcccacccaccttcctgagggtcctttccaggcactctaaaatcaccccaggcaagaggttgtcttctcttcctggttataaggagaccccagggtcctctgacaccgcccacactgtcctcaacccacctgcctcgttctcctcctccgaggacttggagacatcagtatttattaaagtgaattgtggtgtgaaagagatattttggcagtgttggcatctttcttaaacccaacgaggagctcaggcttgagagacaagcaccagatgtctgaacatagataactgtcactgtcagataactgtttctgaaaacccttccctttaatttatgcatgctctatgaataaatacgtttcaagtgtgcccgaagccgtttttaagtgagtaccagcgttctcactgtatggtatgtctgccgtcaatatgatgtgctgtcaagatacttgccttaatgaacaccgattttaaggtttcaaacattctctattttcctgacatgtatttcaactttccaggatctgcttctttccaggtaaaaaggataaaatataaaaacaagtatctgcctctaaatcagagcctttggtatcagaatttagagttaggagttttgaggcatatgtacacagatcaaaaaaaaaaaaaaaaaatgctgatttagaaccaagtgagtgttgtcagtgtcttcaaatgagtcaaaatgtctgaagtattgggatccaaaatgactgaaataatcctctgcctttgactttaggcatcaaagctgtgggtactagtaaatgtttcagtttccaaaaatctggtcccacactcttgcttgcccttgtagttcacattcgtcagagttgaataaatggcacatgcctgcgtttccatagcagacccccaccaccttggttttgctgctgctgctgctgctaagtcgcttcagtcgtgtctgactctgtgcgaccccatagacggcagcccaccaggctcccccatccctgggattctccaggcaagaacactggagtggggtgccattgccttctccgaccttggctttaagatggctttaatgctgtttgaagtgtcataggcagtggtggtgagacctgggtgctgatgcatgctgtgagtcaggaattctgatgcacacatccatcactatgattagtctcttttcctgtcacttcctgttcctggtagatcaatgggctaaaaacacctcccctcatcagtaattgtttacaaaaccatctgcatgtacagatcatgctgttgaggtttacaagtgcataccccaaatgaaaacatttgtcttgatgccacgttatatgtagcaatcccaccagaatccatgctccgcagattcattaaggagggcactggtgctgttagtatgtggatttcccattgaccaatgggggctctctttccactgaaatatgatactctcttcagtgagtcctgatgcacaggattcaagttcacatttgcaagttctaacagaataatcaagcttctggaaagagttgtttatacctgttgtctccatttcccaacttactatttatttccaacccctagcccccatcactccatagaaacatcttccgccaaaataaaaaatgacctatgacccactagatccagtgggcatcttcaggctccattttttacttcctaggaacattcaaccctggggaaccacactctctttcctatagcctcctttagctttctggacaacgtcctctctgggtgtctctcctcactgtctgaccctactgctctggctgtcttgtggactcattttccttcagctgttgcatgttgaggctcttcaaggtctttcctggacccctttctttcttcctttctcccccaaccttgcattcatgcttcaagtgctatgtatgtcaatgagctcacacacagatctctaagccctctaaggttagaggtctccccctctaagttgcaaactagttacctgtccagccgctaatta

SEQ ID NO: 52021 - DNA, 807 bp, Bovine  19866880480956
gggctgggacacatctctacttgcactgtctctgcatgacccacccgacgtgaagactggtcagagaagggaagaaggagtgggaattcttgccggtgctgcctgggccacatccccccagatggggacatatgtgactcagcttccatgcctcccccaaatggggaccaccacattcatgtccccatcccttcttgggaaggtaccttccgtacagaatctgagctgatggccgtcggcatggaggggctccggcccaagccccctccaggtgacccttctgctccctggttccgtgctctggtgggcttctcacttacgatccgcttggcctggaggaggtgaggatgggcagtgtggcacaggcagggaagaagaggaggcttcctggctcataggcttcccctacccaccctgctcacctcagctttgttttccatggtcacagccagatccacccgctcccctaagcagaaggtgccagtgtgggcctctgcctgctcatcctcaagcatctcactggctgttccaggtccacgggcactccttgcccagttccggctgaccacccgcttcccctgcagaatgaggtgccatgccgtgagaccacatgggcagcactgggcagaagttggggggttgggtcctttgggtgcttccccaggctgggttcaagccctggccctccctggaatgcccactgaggagctgcctctgtgaggcgttcacataccagtggcattaggttatccaggcctggggccacccaggggcccaagacgccacagtggcccatctctgagctgg

SEQ ID NO: 52022 - DNA, 1304 bp, Bovine  19866880541063
atctttatatgaccagcctcttgttatccaggttacagcttcataatgtaactgacttagatgatctccccctgatcactggtttagtagctcctgacctcccattccctacccaataacacattttcacatcacctaatttttatttttagcactgattatcttgttaatttctgtgtgtttgtctctgccaaattgaacattagcatcacatgaccaaggactttgtattatgtgccactaaaacctaaataccttgttgtgcttggcatgtaatagatttctatttcttattgactgaataaataatagagaccgagacctcaagttgaggactttgctccatttgtgtcattcttatctgtaatattgactgtcccaaagacaatctttgacaggataaattgctatgaggagtaatgcctcagccaactttactgtttctagctgagctactgaccagtgcagagaagagagcagaaatgcagaaacagattgaagagatggagaagaagctaaaagaaatccaaactactcagcaagaaagagcgaatgaacaggtcattttctcttttcagtacataacaactaatgcttattgaaacaaatttaaaaatatgaaaatatagaaggtaaaagtcctgccagtgcccactcagtttttggtagtttcttagctactagtatcagcaaagttgagcagaaaagtaattttaacaggtgacttcaaatggaatttgtggcatataagtgatataatttattgacatcttagttatactctaaatcactattctgttacttctgactttaattttttattctagttatgttcaattaaaatgagattagctaaagaaatttagtgtgtatttgcttgccactacttagttaagtacagcagtatcagtttatactggtaacataaatttaagaacttctgtgggacagacattctatatggttagtaaatatcttgggaaagtgtatagtaaagctaattttggcactaaaacttgaaaataggtagcattttctagataagagggacatactaattttgtttatttaatgcaaatagcaagaagaaaagatgcctacaaaggagacagctgaactgccaattgcttcagagtctcaggaaatatcaggaatggctctgtccaattttgtttgcccagtaaactcttgtgccaggtaggaccacattggtggaagaaatgatacttataggaaggagggcatttagaaccagcctttgactctctagacttgaagtctccttaacttttatagtattgaga

SEQ ID NO: 52023 - DNA, 1696 bp, Bovine  19866880582921
ctcttgcctggaaaatcccacggacggaggagcctggtacgctccagtccatggggtcgctaagagtcagacacgactgaagcgacttagcagcagcagcagcagaaattttgccttgtccaaaaggatgggaaccaatcaggttatatgaatatttttgtcataatttcctgatttattttcccttttttttttttttttgccattgactactggtgttaactttattcctactgccttttattagtaggatgtctttgataaagtgagtgaccctctgtttcccaaacacttggaggaagccagacactgacaatcatctggtcctggactaaaattgcaaaggattctgcctggttcaggtgccagccctcactcttcctaaagagccatctgatggctttcagatgaatggatatgtttaaaaaggaaaggaaaaaaaaaagatttccttctccttgcatgataaacaaaattatttttcctcagtaacaacaatttaagaagaaaagcagtgaggtctgaaatattctcccaaagagcagctgctcatcgatggttagagaatgcttctgaaccagaaaacagcattactctcattcaggcaggattccaactttgccttttccctttctcctattttcgacctaagtaacaggaatcttagtgtgaataaagatggagttgatttagaggagctgagaaggaactgtagggctgaaaggtggttagcccagggtgaaaactgggggctggggtgaggggaaggcctggatctctggctgctctttcacttcactcttagcagagacaggcttccacagaagggagtccagtggtttgtaaccactggagtccagtggtttcttaattggtttagagctgacaacttaagtgatttgtctaaaaacaaggtgaaactatttaccccccccaaaaaatttggtattagtttccaaagctagctttttaatataaatttaacttaggcaatggatgtatcagtcctaaatttgaaaccaagagtcttgggtgctatctttatccatgctgtggcttactgtgtgatcgttaagttagtcaaatgacctcttagtattctagtcccgtttcagaaatgagactaaccataggaaaaattctattggtcaaaaatgctgatctgtttcctttgaccctgggaactcccaaggaactccagttaagacttcctcaaatcagtaaaatttatgagttgagagagcctttcttatcacccttaactttcttccttcctcttgtccttaatgaaacagaaagagcacatggagcaatatttactgctaaaccttagcggcagagaagggcaattcccagcagggcaaaaaggtcatgactgggtatatccagagaaggttgggttggagccagggagataaggtaagtgactgccactgtctctcctggctccgggcttggcaagatcagtgctggaatggcacaggcttgcgtccagtacctgctccagaaataggctctggatggagcacagcaagtaaacaaacatcctaccagctcttgctgaggtgtgtccctgtcaggcaggcctgcccaccaggactgttgtgggaagaggaaaaatgtcctggagctactccctggccttgcttggaatgagtcctccaaagctaggaacagctccagccacataaagcag

SEQ ID NO: 52024 - DNA, 1610 bp, Bovine  19866880623162
acttgggattttcagggttaaatcctggccctgcagcgactgctcccagctcctcttgtggagtgagagtgaataacaatagcagtagggaaattaagctgaaaagccggagtggggtcgcagaatgctggcgagggcagagcccagtctgacaccttacttggcatcaccttgctttgttggagtataggtagagagtgaacagaccaccacctggggaagggccggggaggcacccgcccaccccgcccctcagttcttcagtggctatgccatgccagcttcctgcacacagcctactttttcatttaggaggagactcaggggggcccaggtatgtgggaggtggggggtgtctgccatgcacatttagggggtgatgcctggtcatgggcattgtcctggggctctaggtttccagtgattctctcctccatcctgcccctttctggcatcttgcctacctggagggagtcctgataaaaagggctggactaacatggctgagcagctttgtcccctgagtcagttcttccctttggtactttcttttcccagctcttggtggctggtgggcttttaaggttgtaccacaggtctagagtgtggtccgtgggtctcctacctgggaaccctggccccaaccttactgccatccctcccccaggtactgggctgtttggaatctgaactaaggtggggctggctccaggggctgggtgacaggccttcatccttcagggggctttgcagcaatacccaggttatggccatccactgtacttgccaggcaggtgtcctcacagactagacctggcgttctccacagcccagcaggcaggttcctcatctcagcttctcactgtccatctccttatcctccttggacaatctccgaggccccaggaagggggagggattgatagtatctttgagggactagatggactcccaccacccaagctcctatcctgcttcagtgtctcagagtctcttcctgtcctgtgatgaatatccagtgggagaaaaacaggtggaaacagctgcatattttgtccccagccttttctgtcttctgactctgggtttgcatcgcgccataggctccccaggtgcttggttcagaggaaagtggggtagccagtccatgcacagctgctggtagcctgaccccactagacttttgcactctggaagaggggtcctaagaaaatccaggctggaaatgcagtgagggtaggccagagttattgcagcggatgctggaagggcttcagtggggaagaaggcagaccaggacaggcttctctcattgcctgtttctgtcctgcaggttggagatactccatgacacacactcggaggaagtctcttcccatgctgagttcaggccctacaggccgccaggagcccctgcaaatggaaggcagcagtgtggagcagcgggcagagggcgtggagccaggtcctcctgagagctcggagcatcttacagggcgccgcaagaactacccactgcggaagcgcccgttagttcccgagaagcccaagacctgcaaagtgctgctgacccgcctggagaatgtggctggtccacggagcgcagatga

SEQ ID NO: 52025 - DNA, 749 bp, Bovine  19866880626699
aggaccaacctgtttctaagaatcaggctccttggactcaagtcaccatggactatttctgctttgtgtagtttctccaccattgtcaaaaggttataaataatcaataccgtcatttcatgggtaataaattcactgtgttgaagaagatcctggaaatagaaggacagaaaagtatttaaattggggtgacatattcaataccttgcttactgctgctctgtactcttcctggttctctgttagaatgtgggttcctttgcagattggttgttgtcccatttttaacaatgctgctctccagtaagatcgttcatacagggtgaggctggcccatagtaggatctctatataaatggtagtttaaaattatcctcatgccaacaattttggagaattcatattaccatcaaaattgcagcaaaaccatcattatgttgtatacctgaaactaatataacattgtatatcaactatacttcaatttaaaaaaagaaatgagaaatgaaataatctcagaaacattaaaaaaaaataaaaatgataggagaaataatctcaaaaaaaaaaaaaaaaaaaaaagccataaaattgtcttaagaatagtccaaagaataaaatcacatattataaggagttctctggtggcctagtggttaggattccaggctttcactcccaagggtcctggttcaatccctggctggggaactgagattcccacaagccctgcagcatggtcaaaaaaa

SEQ ID NO: 52026 - DNA, 1632 bp, Bovine  19866880651086
ttggaaggactgatgctgaagctgaagctccaatactctggccacctgatgcaaggaactgactcattagaaaagaccctgatgctgggaaagattgaaggcgggagaaggggatgacagaggatgagatggttggatggcatcaccgactcaatggatacaagtttgagcaagctctaggagatattgaaggacagggataacaagaacaaaagaaattagaaactccttctggcaggaaatcttgagaactggaactgagcatttcctgcctgagaggatacaaagctcggtctgctgcctactgcaactggatttttggagttttcagcaagcttaggcccacaggagaaccacatttctcggaaattcaagccagtgtccaagtgaacagtctccttccgccaggaataactccggttccgcttcatttgtaacaacctctttaaagtttttttcagctttgtgctttgaccccataggttgaagaaatagccaaactcccttgtgcatttcaactccaccctcaaccccaagttgtgtatttgaaaaagatttaatggtgatgattaaccaggtttgagaaccacagccttagacagtattgaggtgtaagaggacttcagagagattgagggccctcttggcaaacgagggtaatcctctgccgattcaccaaaacatcccctcatgctcccccgactcctgtctcccaggagattttctgtcctcgactcctcgcctaacttccgtaaccaggccttgatgcctccacaacgggatgctcgggcccgcggccgcccctgcgctggcgagctcagagtcctcagatcattcattgctactgtgtgagcgccaggcagaaaagcgcccgggtgaccacagaccaccgataagaggcaggagggtgagcctccctacctgcttctgctcctcgttcagcccattgactgcatcgtccacaggcaacagcgagttggtccgctgggtaatcaggccagcaagagactgcagcggcggtcgcatcctccagctcgccacgcgccgacccagtaaccaagccgcagtcgccatttctgccttgcccctggagctgaagcccaggcagctgagagccagccctgcgagctccaccaatccccggctttgctgcctccacccaatcggcgagggggtgggtctccagcagccaatcatcctcagctgaccgccgaaggacaagctatccaggcaccagccaatcaggcacaaacccggcgaggtgggtgtgcttggcgagtaagctggatctgccagggacttgtccgggttgcgtttttgtttttgtttttgtttttaaagtggaagagcagaaagtctttttgagtagaggatgcagtatctccgcggcgttaaaaatagcagtacctaattgcagacatctgtgggaaaacaactgttaaaaccataatcaggaaattcgcttgaacgtccctcaacgcttccactcaccgaggaaggttcgattcctggtgggagaaataggatctcacccgccagagacccgggtttgatccctgggtggggaaggttccctggagaaggaaatggcaacactctccagtattcttgcctggagaattccacggacag

SEQ ID NO: 52027 - DNA, 3419 bp, Bovine  19866880657228
caaggtgctgcaggcttggccataaacagcagctggggacccgctatagtgggcagtgttcagaggaaatggctgggtttggggcggaaggtcaggctggaagggaaacatcctggggcctcgttgtggctctgactctcctctgagacccctgggctttcggttccccctgggggatgtgggctgccggctatggagcaggtgacatgaggtggggtgggttgggagtgggacctgccaagtgctgtgtttctgcaggtgggaaatgaaggaagacaggcaggagccagagagccaggaggtgggtactcggacctaggatggggtgggctagggacatgagccctaaattcaccaaccagtagagccaacctcttgttttcagggaagccaaagcaccagaaagactccgaatgagaaggaacatgagcagattcagagcaggatggagcctggaggacccaccagtgccccgggtggcggaaccacccccaccccagcatcggaatcaccagaggggctgaaagaggagttgggagatttggcagccagtccagccagtccagccagtccgggctctccaccaaactcagacttggttcccctcgatctctccctaggaggtgccagtagctctgggcctcaggagagcacgtgtatgctcagttcaaagcctggggcccaggagagcgctgtgtcccggctggagggccaggagcagcccctagggtcgaccgagccccaggccgggccagaagcccagacttgttccaggcctcccaaaggggcagagcccctggagcccagagaagacaggcctggcaaggctggggcccagcagggcctgacacctcggagcagggcccctagaggaggcagccaaagggcgaggggtgcaggaggtgtgaggagcaggacagggggtcctggccctgcaggaagatgctgagaaaagctcatgggagcaggggaccaggctggggagaggaggggaggcgctgtccagagtctgcgccatgggtgtgtggtggctggtggctgtggcggcctggctgagcagtttggcaaactctccaggggagtgagaccgtgaaggccaggagccagcccccgccctcacaggtgccccctgtgcacgcatgtgctctcacctgcaggtacagcccctggtgcacgcccacgccacgcctggtctgtgaggctggtgaactctgtcccaagcctgctgctgcccaggccacaggctccctgccatgacaagaggacgaggcttggaagcactcagcagctggctcacctagcacccgtcacccccagggcctggccaccctctccagctgctggctcctggctcgtcaggtactgccagcttgtcaactgatgccagccgcagcagctggcatggctagcccaggcctggggccctttcctacactttcccctgccttgcacccatgtgactctcagtcccagaatcactggatgaccattgggggaacctcacaatcacctggctgcctactacctttcgggaaaaggaggctgaggcccagaggaagggaggccacagccggcagggacggagctggggacagaagagcagagctcaggtctcctctgtgaaaggaaggatctcgagaaagtctctgaagcagggtggggtgaagaggggacagatggctgtctctccccacagcagggttggggagctcatcttcagggatctcctcctccacccccaggttagacctgagtgcatcctgaatgggggagggggagcctgccacctggggtcgttttctgccatctccaacttcctcttcccaccacttccctgcactgtgtcatgccaaagcaaggtctcaggaagggactcaagaggcagagaaacagcaactctagctaagtacgacatcaggactcgtctttcctacttagtccctgttccccgccccccaccccaaccactgagacccacgtctggtgaattatccagactccgcacaagctgtggcttcctctcaattcaacaaacatttcctgagcacccactaccagcaatgcagccggtgggcgatggtaactttgccagcaagagggagggaagaagcctcgtcatccggcagatccaggctgcacagcaggagctgttcttggctgtaggtgcccgacaggggctgaagatggtggcaggagcccagagggaaccaccccaccgctgtgtgcaaaggtgggcacgcctttctttctcatcgggtgtcccctttgcccccaaacccctgcttggatctccccacatagcccggccgtggctgttcctctctgctgatggtcccaggcttcactggcttctcagggttctctctggagtgtccagatcatccccagcatttctctccactgtgaaaaagaggtctgaattgtggctcaactgtgaggccaggcttcctcactggctcttgctccacgagccaccccctctattgaggaggagggtggaggggatgacttttcagcagatcagattgtttcgagtagtgcttcttacacattaaggtgcagatgaatgcagactctaactctgggctgggcctgggaacctgcatttctcataggctccaggtgctgcctttactgcgggttcctggaccacactttgagaggaaggatttagattagaatatatggagggctgaggacagagacagactctagactcttaagggctggctgctggctctacatggggcggtggcaggctgcccctgccaggtgggagcttcctggtctcagagtcgggtgggaagctgaggctttgggttagaggcttgagagctggtggtgccaacttcctgtagtggggagtgagaaagttgattgggaatggggtgaggtgaaggtggttggaagaggtgaggattaatcagaggaattccagaaaggcttaggaacattctgtgcatgtagggagaagacccctgtgagatatgaaaaggcaagggtgaaaaattccaagcttaagttttcctcttgccatttggtcacacatttgtgacttcagagcatgaaactggccctggaacccatgactcccaaggacggagctggagtagagcaggttcaagcagagcccttgaattcagatgtctcccaaattgtgaaccagaatttggattctaagaattacaaacttcccccaactgccaatgctaccaactatacagatgtgccttcattaaagggtatgtgctaagtcatgttttactgtgggctggagatgtagtttgggcagaggtctgcttgaggcctcatgacaagacctaagtgggagaggaagctgggctaaagggctaaggaaaaatgggcttctctctttccgggtgttaggagaaagggatgtcatgggagtgagtcaggag

SEQ ID NO: 52028 - DNA, 1430 bp, Bovine  19866880769003
tctataaacttaattccttgaaagtatccctcccaccaagaaaggaaaggaaatattatagaaagatacccagtagagacagaggcgagtatattttcaaaatgagaagcaagtgatttacgaaaatcatacggggagaagaaaggtaataaaggaaataaaatagtaacacagtccaaagattctccatttacttctaacatttactcttggaggactttagtgattcacaccatttgtttggacattcaggtaactaatctttattattaatataagtgtattcatttgacctaagtttgattttacctttctgataagagggtttgctgtttatatattctaatcattatcttccatagagatggtagctgtggtttctttaaagtacttattttgtgaatagatagggttgccacgacaacaacaaaagaaagacacccagtagatactcaatattttgagattgagttcactgacattcggcataaaaaattcaagctttccagaatattgcatcatccccacttaattttatgagagcaaggtttttgttttgttatagctaaactgatcttaggaatttagcatggagtagtgagcttctcctcacttaaccttctggttttatagaccattgccaaaactctcaagatagtgtgtgaagtgttatcatcggaccatgacagtggccctccccggatcccattcagcacccttccagtttctctacacgtatatcgctgaagtggatggggagatctcagcatcacacgtcagtcgaatgctgaactacattgaacaggaagtgtaagcaaacatttagcaattggaggggaaagagtatatggaaagcaaatccagcagaccaaggcatagtgaggttactgtattatgcagctctgggaacagaggaatgttgtgaagaacagtaactagggatcagaaagagaaggggaaatggaagagagagaatggtataggacagtgactcagagtgccacacagaccagcagcagcagcacctgggaacgtgttagaaatgcaatttttcaggctgtaccctaagcccatcaaatcagaaactctgggggtgagaccaggtacctgtgcttcagcaagccctccaagtgactctggctcacattcaggtttgaccagtggtggaggtggggtggaggaggaacagacagacaagaggtcagagaaagagagggtgatgagggcaggagccacagcagaattaagttggagggagagagttgttcatatattgtctttcttaagattacatattaaataaactaacaccccaatttttttccccaaacagtattggtcctgatggtttaatcaaggtgaatgactttacccaaaaccccagggttcggcggaataaaagcacactttggcaattttaaaggaagata

SEQ ID NO: 52029 - DNA, 1235 bp, Bovine  19866880828335
atacatcacacacacactccatttttggaggcagtttgggcaatgttagacaaagaaaatactctaatggtaggatttcaggtgctgtggctttggggagactcaaagcgattcccagtaccccacagatgacacccccatgggcatcttgccacatgctcctggaaggtcagaagtatgcagaattgggtaatgtcactcatgaaatacatgtgcgctttaacagagttatcccctcttgttgatgctttccttccttgctgaaccttaggaaggggaggccaccacaccccaggttgtatgaggggaaactgagacccagaaaagcgggtgtggttatagttcaaatcatcccaggcaggctggaggtctggggtatggagaaccctgtgttcttcctgccttcctcctccccctacttttaagagtttagtgagtgggacaagaagccccttcattcatgacgattagggatcctaaatttttaaacttcctgccgggaagtgaaggacaggaaattatgtagccagagtttctgcaaattacccaggtgtcctaagtccccagagtagcagatgctcttcatctcttgtcttccatcatcattcatccttgattgtccagggaagccgactccagcgctctgagagaccagcagatgcagatttattggcaaaacctagacaggcacaacgaactgaccccttgccagatcagagccaggtcctggtaataacatcactaaaccaccaacttagtgagtcacaacatgaagctgttaagaggcctccaagatcgttctagtccaacgcttacccttctggttgctcaaagataagaaacctgagtgaggcccagatagggaaagtgacttgcccaagatcatgaagctcatcatggcagaggagaggctggagacccggagccccagccccatgcactttccactgccttccacacccctctgaatgtcccatataggtggtagggaggcatgggccctcttgcttagccaagggcagatcaggctgtctcctagcaggtgggctcaatgtcaagttcagccctcccttggggacagaagagcctggggcccacccttacatcccaagcgccaggcactgggttaaaggctataggagacggcttcctgcttggccctcatccaaggccatttcacaatgtggggggaaaagcgctgggcttgaaagtctgggcttagtgcttccctccac

SEQ ID NO: 52030 - DNA, 1195 bp, Bovine  19866880836653
cctgagttgacctcattgtcagttcccggatacagagtctggcacttccttccagttctttggggacggatggctgctcccaggatcccagactgagatgcctttccagcctcatgcctgtgggggatgggaggctgatgtggaaaagttgcctcagctgtatgaccctcaggccactgagacggctgggggagaggggagaaagacggtcttttgtgctctctcccacccaaaggccgatcgccccttttctgagacctgggggcatttcccagcatgtgcccccgactcagactgtctgacaaggtcagcacctgtatgaagtttatttatttttctctaactcctactaaagaaccctgtcccaagattttctgcctaagcctggcctctgttctctggctgagaaatggggggcaggcagcagagtagagtgcccctcaactgaagtgtgctgggggaaaagcccttaagagttgaactgggcgcgaggtcccttccagagcacagtggaaaagccctgcctctgggtttgaagaggattcacttccccttctgccagccctgatgccataaccactggaaaatgacatcacccttctgctccactccccatccaaatgtggcctccttgcctctgccctcagggttggggcaaaagagcaaaggtgtcccccaccctcttggggaatcagaatatttcaggccaactgggccccttgagacagatttagagtggtcagatttttatatgcctgtggcagttagggttgaccccaccatgtactgtaggaggctttgtgcttgcatctgccaagttgctcagttgtctccggctctttgcgaccctatggactgtagctcgccaggctcctctgtccgtggggattcatggggattctccacgcaagaatactggagtgagttgccatgcccttctccagaggatcttccacacccagggattgaacctgagtctctgcggctcctgaggctcttgtattgcaggcagattctttactgctgagccactggggaagcctaacacctatggacacagtctcaaatcccacatgaagacaggccctggcttgggaaaggaagggggggtggtgtagattctgggaagaaggttgttttcttattagagaattatagcaaatgccattagctatgagcacctgtgcctttggta

SEQ ID NO: 52031 - DNA, 2119 bp, Bovine  19866880856737
gctcgttttagatagtggccctctcccactccaggacagcggggggttgagcgtttggctgggaaacagctgatccaactcatttcttggcccagcgcctcttgaacaccagattcaaaaactgagaggctctgagcttggaaagcacaggtccccagcgcttctggtggcaggtttccttgatagcaactgattgtactctggcctcagctggaaatttctgagatgttcatgccagtcccaaggagactaatgtactgatgtaactttgcccaggaaagaggatgcatggtgggaggagtagagtaaaagccagagtattttgattggatttcttcattccttggcaggataaagccaacttcttttccatgggctgagcaggctgagtgctggactgggcaagaggcgagaacacttcctgagggtcatgcttatagtttttctgtaaatttgtctccataagcttagtaaattctgtcatgtgccagacctggaagagggtagtctgagggtatcaagatgctgatggcatcagctgtgcctcttagggggcggctctgctggtgagaagaaacatgtaagccaagacaatatagatagggcattcatgggaagatcttccactgcagcttttttccccactcttcaaacacaggactatttctattttctaaatgtggagaggcacattcattcactcattcagcaaatattttttgagtattccccaaaacagaactgtgtactgactgtcataacgcatgtgatcccaaacttcacctaatcttttaggttccgtttggctttcccatggtagcctcagtctctgcatttccctttacatccaggtcttggaattcctaaatattttctctttagcaacgcttttttgatttgaaccccactctccagtgattggtaaggagagagttcagtgactagggaatcaagtctctcctcttgcttactcaattagaagaagccactctgtcagctctggtaggttctcctccctccccaaccccttgcccctcctctgtgccacgtgcacacatacacacgcatacacacacacacacacaaacacctctctgcaactcagaagagactattgctttgcacacagatggaataatgcacagagagataaattcactctgttagagcaagtccaccaaggaaggacaccacgccttccaggttcctggcctttcttgcacacacgatccctcccagagggagttaagaggcaagagagtcaagcagtatgggcttctccaccaagacccccaccttacacataaatcagtttccaatctaacccctccctaggggttgagttacaaacctcagtaaccccagggcggcctgcctggtaattcctattattcagctgtcagctggtgttttttaaaaacctcccttcccagtgatccagttactagagttttagagcccattccttgtctcagagagaaaccctatagccaggtgaaacaatggagagagctcggcagctttctacggggagctgggttttctcttctgctgaaagcagcctccccttaactctttgcattccctccccagtcttctgtgcctccctctcaggcgcccagctgatgcctttcggagtaacttggccttttttggggcaaaattttgcttcccagagctagcatcagttagcagaggaaaaaataagaaacaaaaaactggggcaaagaatggtttcaacagagaaagagggaaaagagattctgctgcggatgcaagatgcatgtgctctgaaccacaagtccaggattcttctgttcccagggtactgctgttggtaggagacttggagccaagacctccagcccagcaggtcctgacgctttgggctgcagagtctatcctgtgctggaagggagaaagggcatggggaagggtctgctttgacagtgatgagaagggggagtgaggcttctgacctccctgacccctttatccctgacagtctttttttggttcctctagctcataaggctgggcccctgctgcttaccttagaggctgagagcaaaggaggccaagttatgggtgtccttcacagggagcccaagggggcaag

SEQ ID NO: 52032 - DNA, 689 bp, Bovine  19866880891194
tcctgccccatccctagctgcctgggccaactgagacagtgcatctcctaagggcagagtaaaggcctgggaccacctcttccctcagagagagagtgtttgggaagaacatagctctcacacacctgcttgatcacctgcaccacctcctggatgtgggagttgttaatctctctcttcaacctgttggggtgatcagagtttcaggtggggtaagagggcgctgagaagagctgggtgggacaaagtctccacagggtgtaggcaaaatgagaacttcattgtagaatcatctgtggctggcacatctatgtctggtctgggaaccagccagaggaataagcagacggacccatggaggacctgaggagcctttgggagccctgcgggccttctgagggaaggggcctcctcactaaaatgcactgttcctcaaggcatgcatgggcaagtgtaggtggaaatcagatgtcccaaggtttcgcgtccctcttggcatgtttaattttcccttaaattctcctctctgctcaaatagtagtggcatctgtgttttgcctaaggaggacattctctgattcagaggtgacagaagtggaatcacctttcaggaaccagcagactctgggaagcaagtcaggatccccttgtagggaggccccttcccactggagggttcctgctcagca

SEQ ID NO: 52033 - DNA, 1871 bp, Bovine  19866880915256
ctccattgaagacaaagatcagcttttatttttcttcatatccttcaaaattcttagcactatgctttacacagaaaaagtgcctggtgcatattttctgcattgaactggtaataaatatatgaagtccataatcttagactgtcaccacccctttgttcattaccttgctttttcacttcatgaaaaaaaatagaagccagaatttctaaacttcctgctacaaaacaaaccaaacttttatatatctgtatccattctttcatccttcctttcttttccctaagatcaatctctccacctaaactttgaattgcagcctctcttgtcttctcaggaatcttatcacactgactttcccttatctcttgtatttacaacctctctgcctcctccactgaatatattcacttcttacctttaaaagtaccaacaatcacactctttctctagttgccactgaatggctctctatttctgtcttctttcttcattattccttgagcaaattacgaagtacctatcatgtgctttgtatagtgcttggtgctaagactactgtagtgattaaaaacaaaactttatgcccttgtggagtatttttttttttttgtcaactctcccattactatcttttaattcaaacattcatatattaagaaaggcttccatactttaagtttttacattactatacagagctccaatgctattttagtttcatattacaggagatcacattcaaatatgtttggatttgacaatttgcttttacaatattgaggaaagattataagcattaaatagtggaagagtggttccagggtgccgtaagttcctgaagtagaaatctgtcaggtcaggagaggcttccctttgaggaagtggcatttaagccaaggtctgaagaataagttggggctaaagtgagaagggagggaaaagcagactgctcaatatgaataacacaggcagaagcctttctatggaaaagaatataccaagtaaaaggatctgaaataaggcaaatgtggctagaatagagagaacaaaagggaacatagtctaagataaagctggagatgccagctttagggaccaggtcaaggagggcctcttaaggaattttgactttttctgagaacagtgaatagccatttgaagggtgttaagcattggctgtaaattaagaagttaagcagttattggatggtatggttaataaaggacaatagtttatataaagggaacttagtagtggtgaaggaaaaaagtagattcacaaaatatttctgaggtaaaagtctaaagttgatttggatgtggggagagagaaggcttttagggatgattccaaagtatcagaaataaatttaaatatgtgtgtgtgcatttatatatgtgtatgtgttcctgcttagtccatggggttgcctaacaataattttgatgtatgcaaattatatatgaacaatttccatctgccactagaagcaagtcttatgaaattattattttatctcaatgcttttttgtcaaggaagaggtgggttagcataaatgcttgtgaaatattcttaacacgacattttgggaccatctcttcttttcatctctggttgtttagttatttttgactgagttattttaatccatggtctactttagaaactaagagtttggaggatgaacagaaagacagtcctgtggaagaactgaattctgaagtgagagctgcagagaaaggtaactgatttaattagggaggtaaatggggaaaaaatcctctgttctgagttttttatttaaatgagattaatgagatagacttttcaataaaacagatgatttgtataccagtattttaatgt

SEQ ID NO: 52034 - DNA, 760 bp, Bovine  19866880915996
ggcccctccagcctggtggccaaggcccagtccttgccctcagaccagcctgtggggcctttcagccctcttaccgcctcggataccagcagcccccaaaagtccctccgcgcggccccagccgccggcgctcctccaggccggtcttccccggcggggtcgccccgcacccggcatgcccagatcagcaccagcaacctgtacctgccccaagaccccgcggtggccaagggcgccctggctggcgaggacacgggcgtcgtgacacacgagcagttcaaggctgcgctcaggatggtggtggaccagggtgatccgcggctgctgctggacagctacctgaagattggcgagggctccacgggcatcgtctgcctggcccgggagaagcactcgggccgccaggtggccgtcaagatgatggacctcaggaagcagcagcgcagggagctgctctttaacgaggtgggaggagagggtgtggcgggcatgtggcgggtcagtgatggacctccaggagcacggacgcgcggggagagtgctggcactcaggcatcccctcctgcccccaggtggtgatcatgcgggactaccagcacctcaacgtggtgggagatgtacaagagctacctggtgggcgaggagctgtgggtgcttatggagttcctgcagggcggggccctcacagacatcgtctcccaagtcaggtgggcagctggaagggcggggccccggcactggctgccccactgctccctgg

SEQ ID NO: 52035 - DNA, 967 bp, Bovine  19866880970532
aacttttatttctagccagctttagtatgatgctgaaaaatgtcagctttagaggttaatttttttatttccaaaagtccactgttgaaatagatatttcttaagttgtttgttggcccttaccacctggaaagatgatgttttgctcacttttcagcagtgacagcaggctgggggaacttccttacctaggacaggtaggagcctgcatggggaataaaggggcaaaggtgccccccagctcctggctgacagacctgcatcttgctgaccctgagggagagacattgaatggagaggttgataagtctggtgtttcccacttttgcttgagaccagtatgatgctgctcaggctcccttggttcactgggggtgagcatcagcacggagttggccctctgccagctaaaagggcagcccacagggacctcaagggagccacagacttagcactgtctgagacaatagcagtgatcaaaggtgccagacgtggtttcttgcaatcaacttgggaaataggacaagtaatcacaaaggtgtgattttcctcagctccaataaaatgaaaatgcctgtccttgttatagagaatcagaagaatcaataaggagtttgaggagacatcgacatgtcctatgggcatattgtgaaaccactgctttcacgctgatgtgaacctgagggctgaggctcttcagcctggacaagtacagacaaaactgccctcctcccacatcgcctgtgggcctgttgcttcaggctggagtaactagaatggaagcagaagttcaaacgttggaaagaatgactgctcaccaacttcagcaagcacttactgcctaaggctttacacatgtcatgtgcactttataaggaccctttgagataggttctatttaacccactccagtattcttgggcttgcttggggctcagagggtaaagaatccaccgcaagcaggaga

SEQ ID NO: 52036 - DNA, 1590 bp, Bovine  19866881074795
tagactctctcccagtcttaaaaaccttgctcgcctgtcgcatttaaaattttcaaacagcaaattaccaagagaggcagtatatgttatctctaaagatcttttgaaacttaagagataagaacttgtctctggctccttaggtgctgaccttcctaaagatgggaagcttgagcagataaacacaaaggctcatttcagatctagaactcagtgacaccctttcgatgaagagcatttgtgagtccagaagtggcctgcaagaagcaaactcagtttggctcacctgccggtcccgaacctgttcatgaattctctctgagacggctgctgtcttggcaaacatgaggaccccagaggtaaggcgatcaagccgatgcaatgggtgtagctcctttagttggtgctccttgcccaggatgaagatgaccgtgttgtgtcggaatcggccacaggggtggacaggaatggaagaaggcttgtctacaaccaccacatcttcgttctctgctagcaggcggatgggctctgcggtaactggtggctcatgcctgtgcactgtgttccgtaagaagtcattgtcctgccaatgacacaggcaactggtcagcccagggtccagccacctatgatcagtcaacttcacacacaacttccccccatcttccttactggatgaaagaatgggcatagtacatccttaagcagaaaaagcagtatacaccatgtattcttattttgtaaacacacagacacacaggtagaagcaggaattgaaaaagagctagaaggatatacccaaaatgttatctatctctggatggtgtgattatggtttttgctgttctgattatttgtattttctctacaataaagttatatttaacaatatatttttctaaaatgaaggggaaaatcctccataaaccatcacttattgtgaccttgaacaaacaccaagctgtaagtccagagatgtgggctctagacctggatttgctacaggcttactgcatgctcttagggaagtcacttaacttctctaggcctcagttcccttatctgtaaaatgtgagcgtcagtccagatctgtgcttcaaaactgtgactgattcaaaccactcattttccaaatgccttaccatcccctcacaaatatggtgagacactgttaatgacaatgtctggtacctcttagctgtgatggaaatttaaagaagggtcaaagcactgggctacacaattctggtctcaatctctgtcatttcacagttctatcctatcaggctctaggataaataattcaagtggaagttataagaacacgggcttcccttgtggctcagctggtaaagaatccccctgcaatgtgggagacctgggttcaatccctgggttgggaagatcccctggagaagggaaaggctatccactccagtattatggcctggagaattccatggattgtatagtagatggggttgcaaagaattggacacgacggactgactttcacttcacttacaagaacacaggtgttggaggtggcactgtgccttacttctgtgagggtgatcttggtttcctcaa

SEQ ID NO: 52037 - DNA, 1228 bp, Bovine  19866881075751
gcgtccatgaggtcgcaaagagtcgaacacaacccgagcgactgaactgaattgatgatatatatgtatataaaatcatcctgtcagctgtggggaggatgaacggtaaaaaccagggatagtgagggagaaaccagttaggagaacatgaagtcatccaggtaagagatgactgtcctacaactaccacagtgggaagtgaagcaaagaagtgggtagattggggatgcattgtgcaggtataagcaacagtatttgctgatgggttatctgcagagagtgaaagaaagagaaaagtgaaaagtgattctgaggtttcttacctgaacaactaactagataatgatgccattaactgaagtgaggaacagtctgttctccacaaatatttgggatttaaggttattgttcagttagcttatcctcttcttgaacaacattcacaatttggatgtcagttgttgccctgcacatttagagctgccaaagttctacacaggtgacgttactttcaagaaaagcaataaagaaaacataagcctgaaacaaccagaagcaaggaagtactgctgagtcagaaacccttgcttccaccgtttcttcaagaattggaatatcaagagtaagagaaagcaggactttgttgcttactctgaatttgtaaatcaactatttcaggtgagttgtctactgaaaaaaattttcccactcaaactgatgttctagttgaggggttttcttcccaatgcttcatacaattaaagataattggagggcctaacccaaaaaaacagatgaccatacagcatcacagaacttatctcctctgaggtacaagttgagggcccagcactttaacaaatgccaggttcactcttcttctaaggcagtgctggattctcagccataaacatcaactcttattttccttaggaacacaagtcagtgggctgcagcctctggttgtcatagcaactgaaatttcacacatgaaatgttttgctcagaacatagacttagcgtagcacttttttttttgagcatatattttattttagcacatggaggattttgtgccattttcagtcatttcttccatctcaaatatattcttttctaaaatgccacagtgactaaagactaagaccaaaaaaggattgccagatttctctcttaattagacttttgattgtaattgctcccttggttgctatctacccttgaacaa

SEQ ID NO: 52038 - DNA, 1182 bp, Bovine  19866881108238
tcagaagagtcagatttggaaattccctgaatagtaattagactttatggaaaatgagatctgagaaaaatttcagccactcagtggaaaccatctttagttgtaaggtcagagaaaggatcctggaattagacgcaaagtctggttcaaatcccagctctgtcccttatgagtcctgtgttcataggcaaatcatgtaactgacttatctgagcctcagtttctcatacacaccttgcagagttgatgtgaaagccctttggaaattgtaatatgtttaactattaattccctggtggctcagtagtaaagaatctttccacaatgcagaagacccgggttcgatccctgggtcgggaaggtcctctggagaagggaatggcaacccactccagtattcttgcctggagaatcccatggacagaggagcttggtgagctacagtccagggggtcgcaaagagtcagccacgactgagcgactaacacacaataactattaatgcctagacaatttaacactttcgaaaatgggttttaggattttgtttcgacctggttttggagttcttggggagctcttttggaagttgtacctgagctggtgttttcttggtttattaactagtggcttctctgccagcagcctggatcttttgttcagggagcccctcactgcttcctgaccctttaggatgctgtccttgttggtgagtagttttctggagttcagactatgcctgataaagttgttcaggctctagatggggaagcccggggcaggagccccagagattctctctagggtaagaagggtccctaggagccagccccagagtgggaggtgcccctcggacagtgcctggggaagagtgagcctgggggaggagctgtggagagtgctgtgcgtgagagccagtgctggggcttgggggccctgtgtttgctctgtggctggctctgtttatatcgctcgctatatttagcttctgagtcatcagcgtggctgactagagccgagttccccacacaactctgcacctgactactctctcttccaggagaagggccttgtagttccggacagtccattccctccccaccaaggcaagccatggggatggggttggctttgggtttttttttttttcttcccgccctggggcagggagggtgatgagag

SEQ ID NO: 52039 - DNA, 1836 bp, Bovine  19866881140945
ccacagagaaaatacttcaagagtgccctgcatttggaatagcaaaaagaaaaaccttgggtgtttcttttccacaagatggtaattctattcaagaagtcactaaaaaacaagcactggctgtagaaaacaaaatcattcttcacagtgagcaaaagcataatgtgataccctttgttcctactaatacattgtctgggggtcaaggtgagacagatgtcaaattccatagcacttctgtggaggaagaagtcatgaaagttgtaggccaggcctatacattggaaaaagccaaaattgaaagctgtcagttaaatagtacagatagaagaaatgtggattttacaggtagtcctgcaactgctatttgtggatgtggtgataattattcctgtttacctaatgttacttccttttttggtaatttggaaaagaatgtcttgtccttacatgataaagatgaagatttaaaagccagtcattgcccagtgcaaaatgatcttccttatgcaaacaattcagccagtgatgatgatttgaaatctgagggactgtctcattctgttccttgcttgttagagaaggaaaaagtcgttcaaaccaatacccaaggacagttacattgtgccccaaaagtgctaaaagatcaagatctaattaaggagcccccaagtctaatatcaaatgaaactttagtatatggtgaagattcagggaagatggctaaacttaactcaaagccagtgtcttttaagcttccaagggatcaagtggagccctctgttgataaggcagaacacagtttaaagaagacctttgttgatgatgtttctcagcatcatctgttaacccaactacctccattacctcaacaaggacagaatagtgtcaataaagatgaagcaatattgtctaaagctggaaataatttaaatattgttggaggaaattcctctgaacccacatgtgaaaacaattccacaatgctctataatgggaaacagtttactatggcctataaaaaagaaccaaagaaaaatattcaaacagctaaatgtaatacagctatagatttccacaataactcagccttgactaagcaagttattcaaactcttatcaatcctcgagaagcgtcagatcctgtgattgcatccagtgttgcaacttgtagtagtgtcaaaccaaatctgaataacttaaatggaaaaactgaagaatttttagatttccaaccagttcatttaccaccttctccagaacagttgcttgaattagtaaataaggcacaccgtgatatgagtatagtgcaagctacagaagcacataatgttaacacagtgtctagcagtgctaaagatgataaagatgaagaaaataacattccacataatggagctgaagccacctctgtaccattaatgacaactgtaaaagataaaatgaggagatgttctttgggaatatttttgcccagattgccaaacaaaagaaattgtagtgtcactggtattgatgatctgaagcaggttccagcagacacaactgatttaaatcacttagaaactcagccggtttccaataaggattcaggcattggaattgttagagctaaactgaacttaagtccatctcaatatataaatgaggaaaatctccctatatatcctggtgagattaattcctcagactctatcagcatagatactgaggaaaaggctttgactgagacataccaaaaagagactttcaccctctgaaaataaaatggaagaaacctgcaatagccaaaaaagaaccctgggtacaagatgatgatgatattcagaatgagaa

SEQ ID NO: 52040 - DNA, 948 bp, Bovine  19866881170199
gagtttgaattctttctgtgtttaactcaatggtatatttatgcaccaacatgggttaaggtaatacctaactctagggttagagatcactcaagcagtgtcctttgaaaccgcaaggtgaaactacaaaaaaaaaaaaaaaaaaaaagactaccacagtgggaaaagttataatacgatgaacgcacctaaagggaaagatctttcatttgaatctataaatttcctccatgtactgagatgcagcacttctcttctacgactagaagaaaaacaaaatttgtctcctctcctctaactttcctaacgtctaggtcattagaaagatgacagcttcctctctccccttgcccagtattttattatctttacaaccttctcagaatcttaagctcgactgaagtaactactgcttaagtctatgatgtttgtattaaattttttttttttaaaaatcagataagcttctattattgtataaggcaaggttgttagaaaatcccacctgcccctacctgcttctgcttatgtaagactcatctaggaccataaccaactggagatacctaactctatcctatattatgccttaattatatttcaaacccattttgaaagtatatgttagagacaaataagactggccaaattctgagtaaagaaaaacaacaattcaattgttgggaggggaaaatggaagtaaagtggtgttaaagtatcaatactgattcttcttttaactaaagaatctattagtaggtgatagattgttatacttattctgggaagttaacagctatgataaggtaagatggaagatgggatatttagtagtatgagcaggcttgagggaatactaaggttctgagaccaagcaactcttattaagagagcatttacttcctcaccaaggagattcaattctctgctttggttttatccattcat

SEQ ID NO: 52041 - DNA, 1488 bp, Bovine  19866881186874
cccctgccaacttagtatttccccacaaaatatctggaaatcaaactcacataactggctgttgtgcagtctcttcccatatggagtaaaacttggaagcatagagggtacagctgtcatagacgctgtattgcctcgaggctggcgatgaagaagaaaactaaaattaccatggttttacattctgatgcaccatatgcagaccatgcctaattattcaagaggaattaaaagagatgctaaaaatactcctctatttgaactttgttatgttaacaaataaactggattagagtccttaccctgtattccaaaggcctgcctgtgttccaagggccggcttgcagctcattctctttgcccctggacacaggaggtgctatccatggctggactgtaggcttagatggctctgctctagaagcctcatcagtattttcatcaaaaacaataattctagtattactttgcatctgttgaggaactggattttggagacctctgttctggcttggagctaagagaaaaatattaaactttcaaaatctaaatttaaaaatcttcaccaatttagatgcccaataaggtacacctgaacctttcccaaatcaagattacttctactaccatagaatcagagatttttttaaataataatttttaaaaaccttaatgcatcaaataattaatttttaagtctattctgcatttgttacttataccctccccttttccctcacctgtaatcttttacatatagatatccaaaaaacaaattctgtatcttccttcagtcatcattctaacattgtttaattttatcaggattaactgaaatcttaatattcatttttctggtaaaatttttctctcagctgaaatgtactgaatctaaaaaaaaaccaagttagctcacttattattggtattctgtttagtggggctgcttattagactcaagcttcatcatgatctggataaaatattttttaggactatattctctgtactctaattctcagatctccaaggaacattctgagtattacaaagttgatatatcaggatagggataagagatctaaatatctggtctacgtgtctaactgctataaatgtggttaataaaagcttactgctctctgtatcttctggtcaattttgctgggaacctaaaatttacctaaaaaaatagtagatttaaaaaacagctattgctgatcatctttaagtatacaaagagagcccaatttctcaccctccaaaactgaagatcaaattaatacattctttgtgaatttggtacatgtaagctttactttgataatacttgctatattactgcatatctttcaactaataactgaaactcagaaactctagttgcttattactctagataaatattagattaagttattcttttttcttttccttctgtctgtctttccctctttctttgcattataagagtcccagagtaggtgt

SEQ ID NO: 52042 - DNA, 1431 bp, Bovine  19866881209697
tgagattcccaggacacaatgggtatggaagtgttctgcaaaccaaaataggcgggatgtaaaggattcttactggtgttaacaggggagaggacacttccaatgccagagcatcttcccatgagggaccgttagcaattcagggatgctctgggactcaccatctctccaccacctactttactcccagaagccatctttgcttggctggcaccaatttcttgacagattgggtaatgtgaggggggtagaccattcaggacagagaccccagcccaattatgactccaagaggctctcccaaagaaaaggaagtgtcctgataaaaaaaagcctctgaaaagtgagagaggcccaggaggctgctgaggtttcccagggctcttggttgatgaaggggcccataggatcccaaggactgggtcccttagtcccactgaccttcatgccccttggcatgggggccaagtcagcctcccctgatacatggagctgcacacatgacctttgcccttctagagggtgggtcctggttggcactgtgggagcagatgagcccttcgcaggtcacaaggagagcttggcatttcactccagagaccaccccccttatcagtcctccaggtgtggggagtaagcagcagcccagaccggggctagaacacctggcagggtttaaagtccacaactggagagcgagacctccccacgctgatgtggggaaacactatcaggctctagcctggtgctgctctggcctcatcatccctgacaggctctgtgccccattcgggcctccctgggcctccctcagctactgtagcctgaagtgtgggtactgggcctgcggacccaaacatctggcagatctggttggctgttgggcagcaccacagggctgccatcccccggccccccacggcctttccaggacaagctactctggtgtgaggtgggcagagaagggtcgtaaacagtctccttgagcgccagccacagtgtgtcccgcttctcattgagctggccccgttcaggtactgtctgctcagcttcatccaggtcctctggggaggcacccacggaatctggcacacgggcactgggctcagaggtgcttaagcaggtctcatcagagacgctgagcccctccagggtgctggctgaggagcagaggcaatcagagggctctacgacctggggcttgggcctgggagggtgggccggggcttctagtgaggcctgcaccagctcagccttcttccctggggagttctgcctggcccgggttttggggctgggtccagcttgcttgtagggagaggaagtctgcagggccgggcactgactgaaaactgcctggtggtccaggaacagctctcttggggatgcagggcctggcgggggccgggagcagtaggggccatcatgcag

SEQ ID NO: 52043 - DNA, 1117 bp, Bovine  19866881351466
ctggcaggtagtaggtgctgaacaaatgctggatgaatttaactgaatttgggaatcatttcatataaacataattgttaaggcagatgaaagtattaggggagaaaatatagaaatgaatagatgaatgttacacaaggggttagttagaaaagggacaagagaggagctaaaaggaagagtcaggagaaaagaacagtatcaagatagagcaatatcatagagttcagggagaagaacgttacaggaagaaaagaataatcagcagtgtcaaatactgaaagaggtctagatggctaaggactgagagagaccaaatttgatgattatgtgaaattttgcgatctttgaaaaagcagtttcaagacaaaactaacaagttgggatactgagagaccaaactgaaaggataaataagttcatttattaaaaaaaaaaacacaagattacggtctaggttatgaagagttttccaaagagacttattattttgggtatttcttgattatgttatgaatgaccacagtaaaggagttgctccaatttaatgtctcaagctgctaaccaggcttcagcatagtgctactagcaaagtagggaaggatttagatacaattaaattatcttttggaaaagtattcaagatattttacctatttccacctcggtaagatagttatcaatcttcttaagtgtgttgtccatctcatttatccttttatgaagtttctctctctcactctaaacacacaatatcatagactgtcaagttaaacctcaaaacaaaacattataacattataaacagttcaaactgctaacataactgctacatctaatttatgatcaagcaaatctttttgtttgcttgttgttatttttgttttggccccgtgcagtggaagtgcagagtcttaaccactggatcaccagggaagtcccatgaacaggcaaatctaaaagatcaaaacttctagtcttgtcttaaaaaaagttttttaagcatacataacagattaatattaattcatattttatactttattttagatttctattaatatatataacttagagtttataaaaatgatctatggtcaaataaatttgggaaaca

SEQ ID NO: 52044 - DNA, 985 bp, Bovine  19866881383740
ctctgggaaggcagctatgtcttcacctctctgacttatagataactaccaagtttcaagtgctgtcaacatctttttttaacgttgagtacttttcttgaagcacctgcagccttctggggactgaaagagaaccctgaacactgagtctcacggtagcttttgaagtaaaatctgatttttcatagtaacgacaggtatgaaaaacgctggggttagagtccacaataaccgaagttcctcaatcaggagctcggttaattactactgagcagaccaccactagaacatatgtaaatagcgataatcgtgggattctatgcactgttttttgctacattagaaatacactaaacgcattatttaactctgattcccagaaaatgtctctttccctttttctttatacgtgagatcagaatgctccaaaagctgtctttcaagagtcaaaccggaggtttcgaagtcgactagtaaatcatacttgcaatgaataagcaactctttccattccgcaaggaaatttaccgtcatcggttcaaatcagtggcgaaaaaataaaacctatgttcgacgaggatgggattcgaacccacgcgtgcagagcacaatggatttatgcagtccatcgccttaaccactcggccacctcgtcccagaagcctactccttcctggtagctatagggagtaaaactaggggggatgtgacgcaatggaatgggagccgccattttgtacggaagcaaagctccgatcttttttacagcaagaaataaaaagaagatggccgctcccatgcagtgaggaatctgcagtggggaggaataaaggaaaattccgtagaaaatgagataaccttgaaagaaataaaattggcatacaaactgggaaaaaattttcattgaagtaatcttaaggagggtctgccgcctaaggggcggggctgacgcgttgagcggctttgcgcctgcgcttccgctagg

SEQ ID NO: 52045 - DNA, 1790 bp, Bovine  19866881390049
tcatgtccctccaattgggtcagcatgagctcagctctgtaagggatcttgtctgaagtaggaggcagtggtcaggaacccatattctcctgtctttgagtcttaaagaggagacaaaacaaacccgggggggaaaaaaaccacaaaacgaggcagtgtgaagttggggcccacacactcatagtgcatactggacagtccagtacggccagtgaggggtgagggggacaggggagtcactgtgggccaggcccaggggaccccgctggggagaatttggctcagcaggaatgatgaaaaaggtcttctactggggaaggggagacaaggcaggagggagcatgcgtattctcaggacagattctctttgcacagaatgagactggaagtgtgcctggccccaggcctcttccttcctctgagctctcactccttgaacttggtcttcctctgaatccatgggatgtcagtggcctagggagggaggtagccacgtggagagctaggcagggggcgagggggtgccagggagttcaccccctcagccggggagcatctgacaacaggaagcagctgcagcagctccagggctgtgtgctggtgtctgtcgctctccctctctcccggcagcagcccccgcagaacaaactgttcttcgagaagctctggggacagagggcccacacctgctccccaggtcggtttggacaagtcagcagaggcgtgccatggcccagcagccccctcaccccctctcttgcatgatgcaatgtaacacaaaacaagagctttggggagggaaacgagcgctgtctcttcacaaaggcctcacccttgaatttctaaggatgtctctaaaaataggacctaagctccaggtcccaaactccaaactgagtggagatgctgagtggcgtggcttttcagaaagagcacaaaatcaaaatgcaggattcttctatcttaaccctgccagggaaaagctgtgtgaccctggacaagtcacttcccctaggcagacttcagtctccttctttgtaacacgaagagttgggatgggtgaggtctgggtgacttccagtttaaaatgtgagagacccatgctcagaggacactttggggctgctgtgaaaactagagcttgagtaacagagagaaattaggatgagactctgattgagggctagataaaatagaatggaactcgggatttctctggaggtccagtggttgagatcaatgcaaagaaggtgggtttgatccctggtctgggaactaagatcccacatgctagacggcatggccaagaaaattaattttaaaaagaaaaggaatgggatttaatttaggacctgagatggtagagttttgtttcccccagatccccacgataaagagaagtggatctgttggactgagaacacctcaagagaagctcatttcatagaaggctcccaacacttggtgaagagctagactccttctggatagtttaaggtcgtccatcagtcacagctgcccacccccaatttacaatgagctgggaggaggaacacacctgagagcagagcaaggggtgcagtaacacaaagaaggaaaaagcccagccttcctaatgctcttcttcatggaagctgctccttaaaattccttcaactggggatcgagcctttcagaccacagtcaagctaaaaataaatggctaacattctgcctttctaggacccaagggtatccttggagagactttcagcagagtgggggctggaaaagggagagaagcgggcagt

SEQ ID NO: 52046 - DNA, 1614 bp, Bovine  19866881426455
accttcctgaagaaaaaggtcatgaccccagtatctccatttggatttctgatgctacagtttgagaaactgttatatttaatagaatgattgttgggatgggagtatattgacataatgggcttccctggtggctcagtggtaaagaatccacctaccaatgcaggagacttgggtttgatccctggattgggaacataccctggagaaggaaatgacaacactctagtattctggcctgggaaatccatggacagaggagcctggtgagatacagtccatggggttgcaagagttggatacaacttcccaactaaacaacaacatattgacatacagttcattcttcctcttgttagccatttcacttttaaaatatttcctggacacatcttcacttatctttatggccttaagtatttagagagactcctaactcaggaaagagacgcagatcgtcccttgataggggaaagacaaatatcagtcttggacaggattgccaaactttaaaattgtgttatcctgttttgttaaacatccatgagacccatcaacatgtcacaaagccaaacctgggaataattatttgaaaaaggaaagacaattctggaagaagcttttgaggaaggacagaaagaagagtcagaatagggtttacatattgctaagaaatgtcttggaaaaacaaaagcatttggttaatgatgtgcaagaaaaaatatgagaaaaacacatgtggaatgatggctaatgaaaaagatgagggtgtaatgtgaaatttgttgggaagccatcagaaataggatagtcatccatgcagtaatggccaaggaggttaacagttctgttgtggcagtcagaatctgtcttcagtgatggtaaggagaagaagcaacagtctgaggaagctggagaaccagatcctctggcttgttggtgctctgtgtcctgggaaaagaagaatctttcatggaatcagtcatgtctttgattggtgaagactggttcaggaagttaaaatttccactcatcttttctaaaatcagttaacatgatgattaaaatgtccttccctgaagaaagcaagaggcatttctgttgcctatggcagagtctgggtgacaatggcaggcaggtttggaggatgcaagggtgcctgtttctgcctgatcacaccgaactagggactcagcacacagagaggggaagacttcttccagccccaaagactacttccaccttgacaaggtctaacaatataaagattgtttttattgccaaataaacttatgtcagagaatccactaagagcaacaattaaaaacttttaaccaattcaacgtgagatgtacataatccttttcacatcctcctggagagaaaaaactcctcaaatatttaacatttatcaactgtaggtttgttctttttttttttacatggtgagcttttggtggtaacttgtagcaacaaaggtgtttgttttgataagtgggttcaagttgatgtggcttgcttagaaatgaaaaccagattgcgaatcataaagcttctgttggtcctgggcttgatgtccacttatcccctccaaaaggcatcatttacccattt

SEQ ID NO: 52047 - DNA, 1332 bp, Bovine  19866881433192
aagcagaggctgcgtgaagagatgaccaacctagatggcatattaaaaagcagagacattgatgcttttgaactgtggtgttggagaagactcttgagagtcccttagactgcaaggagatccaaccagtccattctaaaggaaatcagtcctgggtgttcattggaaggactgatgctaaagctgaaactccagtactttggccacctcatgcgaagagttgactcattggaaaagaccctgatgctgggagggattgggggcaggaggagaaggggacgacagaggatgagatggctggatggcatcaccgactcgatggacgtgagtttgagtaaactctgggagttggtgatggacagggagacctggcctgtggtttgatccctgggttgggaagatcccttggagaaggaattggcaactcattccagtactcttacctggagaattccatggacagagaagcctggcaggctacagttcatgggatcacaaagagtcagacactaatgagcaactaaatttcacttcttgtaactcaataaagctgtcatatatgtaattaagcacacacacccgaggaaaaatatttttacatttgtccttctccttaacagcatgaggactagagatctcccacttgccttccatatgctcctgtcctgagattaaaactccaagtggatcagaagatgtatttgtcagaattcttaaatgcaaaatactgaaaccaactccagttaacttcataagagacagaattattgaaaggatattagtgcctcataggattcataagagagctggagaacaggctcagaaacagccaaaatcaagataagccaagacttctgagaacctgccacatgacaaaagggtgaattttatggagtgtgaattgtatttcaataaagttttttgtgtttttttgtttgtttgtttcagaatgtgtctgaaatacagacaaggagaaagctataagagaggtctagagagggagtccttgtggaattgtataaagccttgctgctcaaaatgtggtctgtgaattagcaacatgggaaacatctagcaacttgttggaactgcagaatcttttccctcttcccttcaggccccctgagtgagaatctctgttttaacaagatcctcagatgatctgaccgcatatttaagtttggaaagcactgacataaaccatgcaaagtagactgttctcatacctttggacatccagcatcttctcaacactcttctttgtgtgggggaatttcccacattaagtactgtttccaagaggtaggatctagaaacggcttctcagactcc

SEQ ID NO: 52048 - DNA, 1077 bp, Bovine  19866881487736
tgctccttatagtactactctgagtaaggaccgataagctaatatttttttctaacaagtgtttgacttctaccgccttcattttaattttgctcttgggctttctactaccaaggtaataaaagaagatcttgatttcaaaacagctggggaactacacactaggctttatttagtaacttacaaagaaaaaaaaacccacaaaacctggtacagatataacccatcctcagttaagttcaagtctttaaactccaaaacaggagtattaggaatccaacttaccacagtgctgatcttctttttcccatcagtagctcttaacagacatttgttgtctgagggctcaaagccctccacagaacccttccttggaatgggtttagttcggccatcatctgcatgaaaaatatatcctggtgaacacagtcacagacttaacaggttgacaaaaagttaataaatcgggaagggatacaaagaggatacctgatccacctccactgatctagttctgttagccacattatctgctatcatagatggcttggccacatcttgggaacctacctcctactcccaagatggtaacattgtaatatcaaagcacattaaatctcactaatcatggcgcggcttggaatccttgacaacaaggacagccctgacatgactggggcccactagaaccggaactgacttaggtggctaagtgctgggggccgcaccagccccaatccctaatactctggcccctcagctctgaatgggcccagtataaagtggaggaaggtaggggaagcagaggatgcgcagcagtaagattttgcctgaggctcccagtctctgggcacccgggcccggggtctcgctcggcctcccagcccccttccgaaggccttgccgcgtccacagctgcttacacttcttcagggtgatgaacacgctgcccgacaaccggcacttctggaagagcctagtcagctccgtcaggaactggaacacaacaagcccggccccgttaggcaaccacaaacccccttccggcctcgtcaagtccctgtccctcccgaagaa

SEQ ID NO: 52049 - DNA, 1545 bp, Bovine  19866881544557
ctatagtcctggaagcatctttatgtttataatacacacccatcacttgaatctgtttcacgtagttactgttgggttataactggtctcgatttctgtgcttatttttctctctcttctacaaatttaaggtttttttttttttcttcctagagaaaggagcaggaggatctctcccagaaaggcagctcctcagctgacctgagttcaggctgcctacacttgggctccctgtgctggatgaaacaggcccactgacactcccaccctcaggccaaggggctcggtcgggccctgtttcaatccaggagaacaatgatcatgtgaaatctagaacacacaggaggaagcagagaggttaaagcagctgcggtctccaggttggcctggaaaaagcctgacctgaactgcattaaattcattttaaaaaagtaacctaggactcccctggtggtccaggggttaagtatccacctttcaatgcaggggacacgggtttgatccctggtcaggacactaagatctcacatgtcatagtgaaagattccatatgacccaagtatccagagtactgcagctgagacctgatgcagccaaaaaaatatttaaaaaaagtaagaagggaaaaactgggcctcactaaagtttatacttgaatgttcatagtaactttgtttggaataattaaaatggcaggacttctcaaacatccatcagtacatgaatgaataaatggataatgatacatgaacgccgtggaacaccagagtaaaaaggaatgaactacacaagagaacagggcggaaccgcaaaatcactgctggtgaagaaggtaagacataaagaatccacactatataattgtctataaaattctagaatggtgtaaaattccagaaaacgtgaactaattgataatgacggcagatcagtggttgctcagggaaatggaggtgggaaggggaggggctggagggagccattaggaagggacacaaggaaagttttgggtttcatggatgtgttcattatcttgattgtggtgatgttttcatggcgtaaacttattaaactgtacaatttgtgccatttctggtatatcattttggcttccatcagagccataaaaacagaagcaacataaccacatcagaaaacaatttgaaaaatagagaggcggaaaatagtgattctcctttatttccatggtgggcaggcatggaaagtattttgtgtgtcagcttcttttaaaataccaattatctcacatcaggtcttggggatatgtgttattatcttcttttctagattagaaaaagccaggattcagagaagttaagacacttgcctgaggtcacctagcccgtgtgtagttggtcccggttggggaccatctgagtctagagcctggacccctttcccacattatgttgtctctcttttcaggaatgctcttctgaaaaattccagcctgctttggtaacactgtggccaaagggctttggtttatggctgggtggggagttattatccatcatgcacaca

SEQ ID NO: 52050 - DNA, 1670 bp, Bovine  19866881569774
ctcatccagctcttttgactctttctgcctctgttagtggcagcatatatataaatacatgtatatttataaatataaaatagcaacatcttttatatttgaagggcaaaacatcactatgttcacccattcagcaagtgcatgttaagcattcacagtgtggaagggattgaatttagggccatgagggatccaggggacatataagccacaggtcctgctgtcaaggatcctataatctggtggagaacagaagacattcatgcatgattatgagctagaaaatgctcaatgccatgagagtcctacaagaaaattctttgaggattcctcaacctgagagattactacagaggtagaagggaagtcttcagagtggaggtgcagttaatgctgaaccccaatggatgggcaggatactaaacaaacaggctttttaagcaaaggaataacaacggtaatggcagttctttcagtaggtggtcccaaagatggaggcagcccagctgagaactattccgatattatcccaaatagtccatttggagtgaagcagaattgtgcagaggggcacttgagcaggagaatatggttctagctggatcgtagagagccaaaatgcccaaccagggaattcagacttgatttagcagctagtaggaagccggtggatgtttttggacagtagggaacatcagagtatataagaaaaattaacctgcaaggagatgtaacatggaagggagtgagggataactgaagctggggacggctgagggcagcgtatcagactaccccaagccaatgcagggcactggccatgggagtgaagatgaacagacgggcgccataaaagtgggatgacaggactggggtttggaaaggagggggaggagttgtagaaatcttggtgactgacccaaggatgtttaagggggaaaacatgtaaagaatcaaatgaaatgggagctggtttgtcttggccttttttttttttttttaattctgtttataataagctgtttgaatctggacagggtttctcagcagccacattttgacatttttggccagatgcttctttgtggggctgttgtcctgtccgttgtaggatgttgagctgcatccctagcatctacccaccagatgccagcagcaccccccataactgtcacaaccacagatgtctctaattattgccagatgctctgtggggagcaaaatcacccctggttaagagccaccaacctaaactgttgactgaagagtcttactatggtactcttcagcctgttggcttcagaaataatgggtctgtttcattctttttaaggtaaagtcttttgagaaggacaggcaaacagagaaacgtgtgccggagtctgatctcgtggaccacgttgtacagaaactgaggactaaagtcagtgatgagaggactaccaggtaacgtagtaaacaaaagaccagaaaaccagctgcagctgcctacatagaattttcattcatttactctaagtgtcagtttgatcctttggggagataaagacaggtcaggataacttttttttcccccaaggtaacttttaatgaaccatagtacagcttctgaataactcaattatataactccgtgtaaaactagtcataacttactctcagcatttgtc

SEQ ID NO: 52051 - DNA, 1416 bp, Bovine  19866881599142
tagtacatcttccaattcccttgttgtgaaaaatcaggaaaaactaaataatgtgttaatgccaatacttaaaacagctcagaaaagcaaaattgcacatgcaggattattggcctgtgactcagcagccatcctgtgttgcggttcggggcgtggacttggggactgacaccagccgccctgcctccacccttgatggtgcgggagtgtgggcaagttctcttacctctctgtgcttctgttttctccttgctaggatgaaatgataacagcccccagggggtggggagtggcaaggatgaatgagagtgatggtgactaagatgtggaatgagagaaatagtctcccgagatagctgggcaggttgggagagagaaggatggtagtggaagaaggttgtgctgtgtaacatgagagaattcctaaagtagcccattgaactgtggattacactgaagaggcatggtggactcctggggatgagggagagctttgaggtcagagtttcttgtcctgggctccaagtggtgccatcagtctagggtagaaatgttatatgaagggaagcaggtgggcagctagatcttcatttgttcagcaagctcttaataagccctatggatgagatttactggtaaggaaggcagaccctgcctgtcctggtagagcttgcataatgggagtggcactaaacacttagttaattagtgagatattcaggttaggtgcctgtaactctagtaggggctgcctgtggttctgttggtgttggcggaatgttgggaaggcctggtcttgggtcttgttccccatggctgtttcattcaggaggtcagcacttcgctgggaagcccgagggccgaactcccatgttggcctggttggccagtttcttcattcaagatactagatagcacctctggtcttggcaagccatcttagacatctaagttattggttcctggagtgtcctggtggttgaaccagccacatatcctttgccattcctgggcaagtgcctggagcaagctaatgagctgttgtgttttatggagaacagggcatcagttcttgaggcttcctcctggtgggcctgttgctgagccttgaggctctgtggccctgttcctgctgtatctcttcagcactttcaccgccaggaacaaataggtcctgccccagcgggagatttgcttctggcaggggactgagtctgagagggggagggtctgcaggagacttagcccagagctccactgtccctcagcctggaataatcctgtatggagccagtggtgggcagtctggggaaagttgcctttgtctcctgccctttgcaaatgtttgtgaagcaaattttctagactgctacccatttcccactgggcttggtacaccggcataagagcccctca

SEQ ID NO: 52052 - DNA, 1674 bp, Bovine  19866881909228
aatgttattagtattcactgttgttgttgttgtttagctgctaagttgtgttcaactctttgtgaccccatggactgtagcctgccaggctcctctgtccatgggattctccaggcaaggatactggagtaggttgccatttccttctccgggggatcttcctgacctagggatcaaatcctcatctcttgggtctcctgcattcgcaggccgatactttaccattgaatcagcagggtagcccctattagcattcacagatagtctttagtccttttattatttcttcaaccagctacagctggtacagtttttcacttgaccttcagatcctagccctgcttctggttaccatctcagactccctctggccaaagcagggactatctaaagcagtgatctcagtgtagatggtcagagaactgtttgctactggtgggataaggaaatgtgaccaaaacataaatctgtatacttttttttacttcatcaagaaaagctcgcttagtgacatggctgattgaaattctggtgtatctctttctcccctagcaggacgttaacaatgagtttgaggcctggcattgccagcagaccattctcggaggaacagtgactgcagggccattcttgacctcttctggtgaggccagagggacccacgtgaggttggggacagaaccatgttcattctgtgcagctggggctagagcagaaccagttgggccatgtggaagacagccatggaaggacgctgaaaaagctgaagcaaagtgagaaatattgactggaatcatataaagttttaaccttagaaacaggggaaaacaatagctttgcagtcagtcagtccctgtgccaggtctccaagtaggtggatcttgacttctggttatagggcagactagagtttagagaacatctgctcagtagggaaaacctaagtatgctggataagatgtgttgtttgaaaagtaaatttaaaagcattgctgagctggcagaaacgtaaggaactgtcttggaggacagagatgaaagggcggtatgaatcagcagggggaagtagccactggagcccacttttgtccttgaggtctctaatgatctccagtgacccaaagcctgcgttttagcaggccatgtgtagggggctcaggacgtagagcctgaggctgaggaactggcaaccttatgattaaaacctcgtgaaggaggaaaaacttgctctggagggggagtggtagagaccttgcattctcatgtatgtatgtgtatgtgtgtgtgtatgtatgtatctgcccttctctatctatctatctatctgtctatatctatctctgctttggttgtgggtggaatggagaaaaagtcttccatgagtttccaactactagcctgcatgaaggtaggttttgggtttgagttcacactacttgtagggcctgagaaagcccaagttgaatgttcagttgaaagtggtcttaggttggcagtactcctgagtcctgatagaaggaaagggaaatctcatctagaagaatacagtttaaattcttgccgaatttccatgaattcacaataaagacccccttctcccctcaaaaaaccataaggaaataagccaccataaggataattaatagaaaaaacatactaagaatcagttccaca

SEQ ID NO: 52053 - DNA, 1291 bp, Bovine  19866881921267
tctagtctgtaggtgacagagtgccagagttctatacaggtttgtacaacaatcttggcaaacaattcatgaaaatgacttcttggatgcttgtggaaatgtcattctatccaagacatactaatgtccctttataagtgctacataaaaatctgttctacctgtgtcaaggaaacagagaatttcccacccttccttgaacagacttgctaataattactgatctcaaaagcaagtctaatcttggacccactgtttacagttagccaaaaaaatggaaataattaaactaaaaaagattgctttttatacagccttattcagggcgttgatttatttccaccatttctaacacagtaggaatttgttagatatttcctagtggaatactctgacagcttcaaactatgttgcctaatggaagcccagttgcaaaaataatctcaattgctttaaggaattataatcttaaaaagaaatcattaccagaaactgcattcaagaaaacatttagttcaccttaacagtaggtggttaaatgttaatatcaaaatgatttctgagctgatttttttcaaagcagataattagggaaagaagtgaaatgactcctccttataaacaaactgtaatccaaaagattatataagcttttagtttggtaactaaaatgctggttttaagtggtgcttagattatcacaaaagatagcttaaatacatatagaacctgaatgataatacctgtgctatttaatcacccacctaatcacagaaaggaattctgtactaaaattcctttctggtcaacagtggcagtcacagcaaacatacaaagtccccttcatacaaacaagttccattctgacagtgttcataagtccagtttgttcataagtcctataaaattagcctgggtatccaactaacaaaactggctatacagtgctgtactataataggtttataataccttttccacaagtaatatataaaaaacaaatacaaaaaaaacccatttttaatcttatagtacagtaccttgaaaagcaagtacaacagctggcatacaggggctggcactgaatgaacagtcaagagccgtcactgactggaggaaggagtagagacgggaggtgggagagctgaaggaccgtcagcactaggagagggagggcaagctgcagtttcgctcacacctgacagtgatggagtgcacgtctgcatctttcaaagttcgaaacttgtaggtttgtatgtaggggacctacttcacgggggaagtctcaatt

SEQ ID NO: 52054 - DNA, 1152 bp, Bovine  19866881934266
ggaagtccttctaggtagagcctgggtgggggcagcctcccggatgcctgcattgcaccctcacaggggagatggagccaccccagtgtgtggaggagctggaggatgatcgattccagcccgaggatggggagccggggacccagcccaggagcttgctctctgctgacctgtttgcccagagccagctggactgccccctcagccgtctgcagctcttccctctcacgcactgctgtggccctgggcttcgacccaccagccaggaagacaaggctacccagactctcagcccagcttccccgagccagggtgtcatgctgccttgtggggtgactgaggagccccagcgactcttttatggtgagtgctcttagcctcaggactcctcccttagagatgggggaaaagaggggactttccctccccaaacctgctctttgctatttccttccccaaattgagcagcaggggctattgatccctcaactcttcacctgctgtctttctgctcatatactgctgcttgcctgtgctcctcaggccacaagcaggacagattttggccttgccattcttttctgctcatttgtccctttctggagggatccttgggtccatggtgtctccttgggttggaagaagggtacctgggtcttggcttttacatattatggcctgttgagtggcccagccttttgtgtcgtaatagtgatgtaccttccgtaaagtggctagtgttgccctggagaaggctgggggatctgtgactcgctgttgacactgaaggggaaaacccagcttgttctgggagagaagtttcctggaggcagaaggtcccccagcccagttgtcacttgggactttctgtgtttggaaggggaactggagaaagaggttgggcctgcctaggctcattgccagcaaaggggctgtttccaaggctcagtcagataagaccctttcatttgtgggcttcagtggttggttttattagcagtttgccctccttggcaaaagggcagggttagatagccagtgttcttcatttaacacaaagcttatggagggaagggtggttcagaggctatcttgctgggtctgatggagcggattgaggagacgctgcagttattcccagaaggagctgca

SEQ ID NO: 52055 - DNA, 672 bp, Bovine  19866882252716
atcctagggttggtaaaaaaaggcaataattgcttatgccaaactttccctggcttttaaggtgggaacagaagtgcagcaggtgcttaatcagcgtctgacgagaatgaagagacgattgcagcagacagagctgggctcaaggcccagctcttcagggctcactgaacctcagttctcaaatctataaaaggaaagtacttcccctgtacgttttttaaaggtgcaaattaagatcatatgtgtttgggggtgcagagaccgatgagggaatgagacaatgaaccccaagaagtaggctggaggtgtagacccagagcccccatcctcgtcgcctcctgccagaaccagtaacagaaaaacccaagccccatccgtctcagctcactgaacactgctggggcatggtatggaccaccactatcccacccccattttccctgcctcctcctcccccaggtcccagagcaaggctgtggccccggaggccagcccagagaggagctgctccctccacagctgcccccttgaggacccttccagttcttctggaccaccaccagcaacttccaccctccagcctgtgggcccgtccagccccttggcccctgctcactttacctatccccgagtacagcaggagtaccgggggggggaagctccctgccaggg

SEQ ID NO: 52056 - DNA, 1135 bp, Bovine  19866880385874
cctgcccgtgatgaaagttttagtatctgactccggcagaagtgatactgtgccaggtcatcacttatgctctaatgtttataaatagatgtggtgaggccaaatactttataaaaaagctagattataagtaaaagaagcttgtttatacaaagccagctaaataagctattgcagtgtactttcagttcgtaataatgggagacttgtttatttcctttgaaaggtaaacatttttttgtttgtttccaggccttgggcttccatgtgtcttgtgttttcacatgttttccattgtgtttttgtgtgcttatagggttcaaatttaaactgttaggtacataatattcagcgtgggcaatattatatttctatcttatatggtttctacttttaaataaagattacagaattgtaatttccttaagggcttaaattcttggtcctaaacaaaacttaaaaagctaaaccttgggaaaagggtctttgaataagagaatatagaggtcttcgcattctttctttgaattttcgtattttctagatgccattgtgggtctaagcaaacacatatatatttttttaattcacgtataatcctcattgttttatactgtatgatattagagttcatgaaaatataaaatgtcccagcataactgtaaactgtttttaaaaaacagattacatgagataactactctctgtatctctagagtaaggcaaaccattagcattcatgaaaataaagatagtgattcatcactataaactttcttttccattttctagaactgaattctcttagagttatggtattagaccatagttaattcttacattgtgtttatttgtttgttttgagttttcttcttcacaatgttaaagagcttgaatgctttgttcagaaaagtcataggcatgttttactgattagctagctacgttggctgtcctgaaaccttgcaagtctgaccaaaataaaacacaggcagcataaatgaaatctcagttgaaagactaggtacttcaattttggcttaacaagcaaaacattgtacaatatttatatagttaaagtggctacacaaatgaggaaaaactaaaaaatattaataaattctgcatatttcat

SEQ ID NO: 52057 - DNA, 1815 bp, Bovine  19866880490824
accactggaaaaaccatagccttgactaggcggacctttgttggcaatgtaacatccctgctttttaatatgctgtctaggttgatcataacttttcttccaaggagcaaacgtcttttaatttcatggttgcagtcaccatctgcagtgattttgacattcccccaaaaagtgtgtcactgtttccattactcccccatttatttgcaatgaagtgatgggaccagatgccatgatctcagttttctgaatgttgagttttaagccaactttttcactctcctcttttcccttcatcaagaggctctttagcccttcttcactctatgccataagggtggtgtcatctgcatatctgagtttattgatatttctcctgacagtctagattccagcttttgcttcatccagcccagcgtttctcatgatgtactctgcatataagttaaataagcaatgtgacaatatacagccttgaatgtactctttttcctgtttggagccagtctgttgttccatgtccagttctaactgttgcttcctgacctgcatacagatttctcaggaggcaggtcaaggtggtctggtattcctatttctttaagaattttccagtttgttgtgatccacatagtcaaagtctttcgcctatgcatgttatgttatgttatgttatgttatgttacctttagggtctccaatatctgctcctggcttgacctacaacttcaaagatagattctcttcctgtgggccacagtcaaaagtctaatattctaagtactgtatttagctgcactctgctgggcgtgaagctgattaaagtaattcacattaacttgtgaatgaaacataaccttcttaaaaggtatatttgcgtttaataggagtcccttaacacaaagagggggaacaccttaattttctaaatttaagacagttactattcttagagcctggattctcacttcccagtcactcctcagcagaatgcagttttgcttctcttgctgaggctaatcactgtgaaaagcttttagggtgaagtcaatggacagggtcaccttttgaataacttttatatttggggaaattcccacattatcctttttccatgtagatatcagttccctagcctcctttgcagctaggatgcaggcatgctgattagatgctacatgcaagattaagcttgcaattgagcagtgtgaataaacagtgcttggggcttctgcatggggcttccattttcctgatgtcattgttggcagggctttcagacacaggaggttcaagatcaggtgcagaagtggcattggtggcagtagcagttgcactgaaacctagttgctggcattttgggcccagaggtagcaatagcagtaattggtactgttgcagaagggggacctcttccaggacctgagagtgggctctggtctaaatctcagaaatgaatttttcgaggagacacatgtgctgacaaagcaagagactttattgggagaggacaccctggtggaaagcaggaggtaacggaacccggaagaactgctctgccacgtggctcgccttctggggttttatgataatccagttagtttctgagttgtctctggccaatcactctgactcaaggtccttcctggtgacacatgcatcatacagtcaagatggattccagtgagaaggattctggaaggttggtaggacatgtacactggagtctcctctctctttttgacgtttcccgaattcttctagtgggtgaaagcctgttagttctgcattccttactgaaaggttgttgttgag

SEQ ID NO: 52058 - DNA, 1637 bp, Bovine  19866880554657
aacaagaaagtctgtactgctacagttcacatataccttcatgataacgtgtaacagttcatgtcgactgctacctaaccaatatatgccctacaataaattgcatacaaaccaaatataatgtaagctctagccagcaggaattgtgtatcacagtcaaaggacaaaagccattaaagatgattttaaatagtaattatataacaagcctgtcacaaaaggccacacgctatatgattctatttatattaaatctcgtccagaacagacaaatccagagacagaaaatagattagtggttatcagggctgtaggagaggaaatgcgaaatgactgctaatgggtcatttaggacttctgggggtgatgaaaacattctggaattagacagtggtggtgtttgtaccactttgtgagtacgccaaaaccactgaactgtgtactttaaaccggtgaattttatagtattatctctcaataattttcaaagagaaaggaaagagaaaggaaagagaatgcttagaagacctttgaggaggtaaattacatgcaccatatagaaactaatactaacactttcactgcagatgaaagatataagttcaggattacttctccatttttccatgttatcttaaatatctccagaaagggggttagagtaaagaagagacctagagaacaacctttatctacaagagctaaaaggaaaaaaaaaaatcaaatatatacatattttatataatcttgattatacatatttcgtaaaaatgaccctaataaatctataataaatgagcgatatgaaggagcttttctttctcagagaaaagttgtctaaaaggaaaagtgaaaacaaagtattcagactagtcacaagcaacagatacctgcacttgaatcctgtaacaacgggtgcagccgtggtgccgagactgtgtatgagatttccaagttcttgtaaagcacacaccagcatatgctggctggcagctacatctgcagagccaagccgggtttccaaattaccatcactcattacagcatctgatagaaacaggaaaattaactaggcatcactgttttattaaaatgtattacaggcaataggtatcaggagtaaaaacatataaaggtaaagaatacctccacttgatatatatgaaatccttgaggcagtaactaaaatactaaaataagacttgcatctacagagaaagaactgaactaatataaccaatttagttcaagcaagctgagtatagatgccttatcactcttctagcaagtggccctgaaagggagaactccataagcagagtggactttggacagtagaagaactaagatgaactacctgttttaaagagaatgtatcttaacttgtatagaaagactatgaattctaaggaactattaaccaccaccctctaagatcaggacatctatgtaacagttcttatcaagttagataatttatgtctcatctatcatagactgctctactctgaaaaaactgacctgtattataaaagtagcttcttttgtattaacataattatataccagtccagcttttcaaagggacaatttctttagcactgttttaaaagagactgtcttagaagatccatacc

SEQ ID NO: 52059 - DNA, 1044 bp, Bovine  19866880575340
aacaggggaactggaacagaattatggtcactgtaaatcaggcactcaatgtattttcaatattgaacgataaatatgtggagaaagttgtgattgaagaaggtaagtagatgcttttttccccggacaaaatgtttaagtctgaattctaaaactttaaagcagagtctatactaataagaggtattcctttcagatcatcttcattttgcttcatctctcctacacaatatgaagccaaaatttagtgttttcattgtatatatgtcaccatcttttatgtcttccaaacaatatttagacataattagtgttttggttgtattaacatctctctcagcttcttttgcttcatctcccacaaatagtagtcagtcagaatttagcatcataattccattcatatttcttctcttacctccctgaaactcttgagtacctctcagcatcctatctcccttatataacgtctctagtcacttcttttttgtgctctatcccatacaacttagcttgctttttctcctactgatctcactttatcttctaaaataccattctgttgctaataaactttcctctatttctaacttttccctaacaatattaaaaaaaattttttttcttttttgctataatggaaacctgacgtcctcctgaccatgaacttccctgtaagtgacagtgattctcaagaccaggagatggacttgacatttccctggctctctcgtggttttcaaactataattcttctttgctccttctctgacatcctcttgatacatcattctcttcccatccacatctctgccttttactgatcttcatatcacattttcacagtgattaaagatttgggctcagggtcatgggtattttttgctgttctgagtcttatcattctgctgctgctgctgctgctgctgctaagtcacttcagtcgtgtccgactccatgcgaccccatagacagcagcctaccaggctcctcagtccatgggattttccaggcaagagtacggagtcggttgccatgccttct

SEQ ID NO: 52060 - DNA, 1381 bp, Bovine  19866880769631
agtgttctctattttgccttggtaacccgttgcccataggtatctgagtttcactgggaagatccaaagccataaagtccctgccctgagattgtctcccatctttagggatcgcaactgaatttattccatttcccaggaattagtgcaatattagaactttctaaaagcattaatacctactccgtaagcctgcatctctaaggtgctgtgttcacttttagctaaaaaatcaaattttaagtctctccaacacttaacgactacgattttcaggccttccctgtgtagtatttctaaggtatttaaatgtttattaaatgaataaaattaaccagtatttattctaaaagcattcacatatatgcatcaagcagatcacttcaaattctgcaagtttgaatttttttccaagtaattccatttatgaacactagtttaatgaaacagtaacttttaaaaacgaaagacagataatgtgacatacactcttggtaaaaaactgagaaacagaatattaacccagaatattaaacaaaacaacttttagtcccccattccctgttcctatatcaactaaagattcttaaaataatttaaagcacttggatatccttggaaagtaatattaaaatgtacagtatttctgcattacattttcatagtattagaaggaatagtaaattgcatattctttcattcaaaatatggaaatatgaaatattaaaacattttacaaaattgtaattggtttgtgctgggttttacctagttttaacacagttatttttattacatactacatacatttgagggcataagaaatatatttttcttgattgtacaaaatgattcattgcaaaatgcttaaatacagctctctaggaacatttccatgttcttatcagtgaccataaagtgaagagaaggaatttttgagtgtcagtgtagaggaaagtgggatggaaggtgactgagatccagagtttaggtgactggcaagctcatccaattaggaggctgcagagttatggatgggacccaggattttcttaactaaaaatgcttcagattagtgtgctcaagaagaaggggctagggaatctaattacgactgtagaaacttcaaaactcagttaggtgtgtgtacagtaacgcctgcctgttgccgtaagtgccatgtccgccacaaccccagcttcagcacacttgctattagcagctgattctttttacagagattcacaaatgggaatcaagttctaacccctcttcttttccagagttacagtgatgctgcatgcttcttcctttctctctcccaccagcggtggcttgaggagataagaatgttgccaggtagatccagtatagagacgtg

SEQ ID NO: 52061 - DNA, 1330 bp, Bovine  19866880785623
aattgaggcttaaagagttacagcagtagtagaagagcagacaccaggagcctagactttgctgtcagttccttgattttcctctctctactccagtgccttcagatagtcactgatccagtagtacatttgttggaactagaggaatgaagtaatccagcagtagtggagtcaaatatgtttcttttaaaagggaagggttttaaagagtacccacttcgggttcttgtacaagtgacaagttgaataaattacaggtcctgcatttgtcagtcatcaccttgctcgagtactgctcttgtggaagtgtgtcttcccagtgtctcctaaagatctagaaacagaaaagagccgaggagactccttcacatggcaggtaaccttggaaggacgtgctggtgctctctgtggtaggttgagtttggtctttccctttcctctggctttttccatcttttaacttcacatatacttgtatgttttaacttgagggggagaatctgcttctggtgatttttgttattgaaataattgatatgttggcaattataatagaagtatcatgtaaaaaaacaaatttaagcattcttctctttgggatattttattataatatgatctacttgagaaatgtcaagattgctttgtgttaagtgggcattcatttcccttttcagaaaaactagggttgaagttaattaatatcaactaagtatggtttctatttagctttttatatatgtgaaagttgtacccttctacaacacacagaccattaaaaatagtatccacattgaaaatttaagctaaggaaaagacatggaagcacagactttttttgaagcacattttcttagaaaagcatcttttttaagagtaaaaatgacacgaataaacaaaaccaaaatcaatgcttccttgaatctgagtctaaattttaaatatttacttttttctatatatgtgataactccttatagaacttgtatgtttcaggtaacatctgtgaaacctaacatgctgacttaaaaggcaaccgggttcctcagaactagtgtagaattggtagacttgaaggtccactttgagtttaagggctgaataaagccccaagaaagcaacattttgttgatttggttttccgtctcttttagtaattctaggaagtttgatttgtttttttgtttttttcactttcactggaagtagaagccactagtttcctttttttactagagtttcaagaatttttttggttttcacacatttctttattcttaaaaaaatgtgaatgctgtaccaaaatgaatgctttttttcagcttcatta

SEQ ID NO: 52062 - DNA, 883 bp, Bovine  19866881217109
aagcagagggccaccatatctccagggaccacagcgggcttgctcagtgaggatgaccaggatagccaagataagctaaatgtcagttcccgcctctgtttatttttgaggatcacacattgccaataatgtcttagtgaatttccccctggcctggcaaggtggagattgggagtcagaatgaaattgattaaaacaaatgaaagaaatgtgtatttcttgcaagtccaagatttcatatccactgagcttataattctttttgcatctcagaaatgaagatgacatttccccttgtcacatggaggagatatagttactctgaaggtggaagtggaaatgataaggactgtaagttctgtgagggcagggatctaatctgtaagtcttcagtaagcaggtattgaatatgtgataagtgaataaataaaccaaatataaacagttatttttgcttgacaggtgtaggtagaaaaactgggagagagaccctccctgagcgtagagggctggcctgtgcggcacgaggccggaacccgtgggatatccacgcagcttgagctatggctgacagtggcagaacgcctcaggcccgggctctcctgcagcagtgcctgcacgcccggctgcaagtacgcccggccgagggggacgtcgaggccgaatgggtggaggttcaaagaggattagcgatctacgtgtgctttttcaagggagctgataaagaacttcttcccaaaatggttaatacactgttaaatgtgaaattaagtgaaacagaaaatggcaagcacgtctctatattggatctacctggcaacattcttatcatccctcaagccacccttgggggtagagtaaaaggaagaagcatgcagtatca

SEQ ID NO: 52063 - DNA, 782 bp, Bovine  19866880504100
tttaagcacagggccactttctaaatcaattcaatttctaccaaaatttctcatcataaaatttctgcctgaaagagtccagcaaaaaatgcattccctgccaggttcctctgacacagctcaggtttacagctctccttcagaatttcagcaaccttggctaaatcaccagatgggtctgaaagaatgtcattacaatgcccttatgggagttggcaaatagatgtcaacaaaagctttgtgctttatccagaacagtccatgctgagaagtccaaaatctaaatctcactgctgaaaaatctgcaactagaaaataattcccccctgaactctgcagccatgctccctctttgctcactctctgtctcctcatttttctttttaaggaagaagcccatgttatttaaacttcaggctttataagaacaaaatattttaaatgagttacagtttcaaaagttataaaacaggctaaatcaaagacactgaacaatagcagcattttggggggactgaagtctctgggtacttaaaacgattcatttgtgtgtggggggtacacctccacaattttacccttttgtgtactatctcctttgtcttatatttgttccatgaaacagacggtgggtccttctctgagaaaagataaatccacatgaccagttactggcactgttggaaagttctgtcttctggattacaacggtatccccccagccccaaaactggctttgcagaaagcagggcacaagcatttccaggaggaaacctgttagg

SEQ ID NO: 52064 - DNA, 799 bp, Bovine  19866881136699
atctctacattctgtttttcacttttagaaatgattctgccctcttgacctgttttgaccttcataatactatgaggtacaatcatcagctggccctatttctcatcttaatggtttttattaatttatagggatggtggattcatttcgatatttggcaaaatcatacaatattgtaaagtttaaaaataaaaaaacaaacaaaaaatttatagggaaaagagtgaaataatgggacaattcaaacacagcattccaaacactcacagctatacgagcagtgtgctttcattaagggaatttattagctgtaaaaactctgaacttggctccttaagcccaagattgcatcaggtatgcaaaacagaaagaacataagatctgtaataccctcgaggctggtagggtatcaaggtactccttggacatgccatcactgtaatgaattttgaatcagtaacactgtctccccagcacatactgggcagagtttttcaaatctctggggaaatacaaggtagaaaatggccatataaaagtgaaactaaaataatacattttagttgtgaaagagccagcttgttggtgtagcagttttgttcatatatgcattaaacaaaggacaaaattttgagcatcaattctatttgggggatttaattagaccaaacatattcctactaagatttacccttattaatactgaaccttagtccaatatatagcatcatttagcactgtaactgagggaaaaatatggtcttaaagagacccccattggatggtatagagatataga

SEQ ID NO: 52065 - DNA, 1161 bp, Bovine  19866881187397
atgcagagacttttctagttgctttcaaatgaggagtgatttccaagtgaggattgaatgtaagcagacatcatccagaggccaaaaatataccatttcagctacttgcatccgtttgtgcgatgtttttttccccttttaatttttcacagggctgcaaatacagcccagagaactgtacattgaggccatgcgcatatggttttatttactattgcatgcaggattttgttgggctataaaagaaatagatttcagctgaagcaattagaacagtaccttctaagaccactgtgcacatgagcacgtacccctggctgctcccctggaagagcgtgcgatgcactgaaaggagatgaggggaagcgtgggaagctcttcctctgtttctctaaccctcggaacatgctgtttgtgagcctaaacatgggcggtgtgatcggcaaggacaggctgacacgcttgggtccacacttacgggtaagggaaattgaactgaatttgtttgtggatgcggattggagagagaaacagaagactgtatagaaaattaatttgctgcattttgagtccctttctctctcttttaacctgtcaaggcaaattttccaatgtgtttccacccacagtttagcataagtaaaaatgtctagaaggcactctggcaatgtttttgaagtctcctcagctcccacaagcatcaccatgtaaagcccaaatagccctgaaaaagtgacttcgctgtattgctcttggctcagttcagttgtgtaaccagtgactttagagtgtgacatacacgcttctgtgtgtgtcaagaaagcggccaagtcagagataggaactgtctttccttgcctgcagtcacaggccaaaggaaatgaatgaatctgttcaatgacttttgaagctctcagctgcattgagaattaaaacaaagagtttccagagatctgaggaggttaggagagagatttctaggaagagagatactgtttatttctgctttttaaaaatacacttaatgggagtataattgctttacgatgttgtgttagttgctactccacagcaaaaatgaagcagctgtgtgtgcacatatgtcccccctatttttggatttcttttccacgcaggtcaccacagagtctagtgagggtg

SEQ ID NO: 52066 - DNA, 791 bp, Bovine  19866881743997
atatccttgtaaccattgactttgaaattttctttctaaacccctttgataatttactttgtaaaaaggcagatgagaaagaagaggacaaaaatttgagtaaagttgcattgactttccttgggatggcatttctattgggacttatgaatgcttgtggaggaatcattttagagctagaaaggagtttgcagagatcatcagatacaagttcgttattttataaaagcgcgttcacactgtatgtcagtcagactgaaattcaaaacacaatgtctcatatgaacattacctacagaggagagtgacagacacacggttttctgttttaagaattatttggtctgcagtataaaggatatatcaagagatgagtcactgtcctttgatcattgatgctgaaggtaaatgtctttaagatcattttctccaggtatgtctgaggttgtccttgcctgggttgctggtgtgtgcacggccccttggtttcttgtcccaaattgttctcaagtgtttatatttgcagcagttattgaagactgggttttaagctctaagattaacttggttcgatcaggaattgcctatgatttctttggagtcctgttaaaatttctctgcctattgtttttacaaagtgagttttgctaaatcagtactcagagtatttaaaaattccagcagactgagtggacttcaatgcaactgcctacttgcatttatgactctgaaataaagataaatttggcctttgacacattttgtaactagtgtataggtcaagcaactct

SEQ ID NO: 52067 - DNA, 1872 bp, Bovine  19866880381128
tgcttattcctgtcctattttgatgatcacagctttatgttatataggttttaaaatatcttaaggcatattccccattttcctatgtttaatcttggctggaaaatgtttttaggtgtcttttttcctagaagaataaatgagtggtatattttatgagccatgtgtatgtaaaatatatttccattgctttcacatatgaacacacacacaaaatcaaaactttgactgggcatagcattcttgagtctacatatttttattttgatgacctataattattcttcccctaaaatgtagtattgcagagatgattgaatttgatgcttaattttagataatttatatataatgtgtagcctttctgaattttatataatggctgaataggatattcagtggaatattcttccacttctttcttctaatcaaacgtttttttcagtttgccttcaggatttggattcagtgattctatcttgagtacagtgaatttttcaatgtgtaaatatgcttatagggctaatgaaaaatattttaattatatttttgaatttctcttctaattattctgtactcctcagacacaactccaattctaaaatttagttttgaccctgtccagttttgtgtattaatttttcaatcaccttttctctccttggtctggtgtctttgctttttgcctctgtttcaaatctaggagagtttcggaacttattcaacgtcactaattcagtattccgtagattgatctttctatttaatgcctttaatttgaatataaacactgtaaatcccacaataatatgctcaataataatgtgaattttcatataacaatggactcttcttcagtataagcaaattgccaatcaggagcagttaaagatattatcttcttgggatgacaggaagacggggccaataaagaaacactgggtttcttgggaagcatggaagaagaaatggtaccttgttttcaggattatttcagtttaattttgctgaattgggcagttaaaaagtatcatcctcctaggaaactcctggaactgctgccactcttcttgaaaacagccaactgcagagccaagaataatctctattgacatctggtggagtaggtaggcttcactaggtggtaccaatcagtagcgaacagcagcatcaatttgggttgtgcagtttaatcttgccataacataattctgcattgtatgcagttaaatttgacgggtattaaacccactccggtattctcacctggaaaatctcacaggtagaggagtctggtaggtgatagtctatgggagtggaaaagagttggacactgcttagcgactaaacaacaacaataacagcaacaactttatccctactcatcatttagtttcaaggagcccttccttagctcacccttctttgtttacatcatgatctccccccctttttaggggcttttaggttcttttatattcctgcatttctctaaaatctggacagaagaaatctaggcaaacccacaccatattggatattcttctcacagagttcctcctagttctttattcctctgccactttccccgttcatatactttaagatctaaataacctaacccacagtaactcataatttactcccctccatgacccccacttactctgttgtttctcagagtagctgaatgacttagagagatggtcatgattgggttggaagtaagcctcaatctgaaatctgaagttcacaccatacagttgataaatagctactcttttattgatacttgttgatcacaattaaaacacttgaataggaataataatagtctccgaagataaaatgtaccaaaaaccaatattttaa

SEQ ID NO: 52068 - DNA, 1661 bp, Bovine  19866880442895
agtttgcaacttggttatctttcattatttacaaccacagtggttaaggactcctgtgcgtctgaacatctgttttgcagcggcagagcctggggtgggcaggaagcacgtgcctggggttctgtgatagggatccagtgatccaactcagtgtcaagggggcaggaccgcatggaggctctcccaaggtgggaggggaaggatatatttactcactttagcagctggtgctcaggctgtgggcagagtgtaagtggggctatacacaggcgtttggcacccaggacaggatgtcaacgcggtgcctgtttaaaaccactttgtaaatcagcattcgaattgtaccggcctacacttctttttagccggtctgctcttcttccagaacctactttgttctcatttctcctctagtcagaataccaagggcatgctgctttttttttttttctttttacagacagggaccaaggttcagttgaaatccgaggctcctggacccagatccaaggtggaggacacttgtcaagctgggcttccttgtgctttgtcacctccaggacagagctggctcattgtcggggggctggtgaaagagtcagtcaccccagagagtctgtggatccagataccagtcaccctcttgcaattcgggcagcagaacagctccaagacttcctgtcttggcagagctgtgtcctcctctgggatcccagggtccagccttggtgggaactggatcctgtgatccttcctgttcaggtcttgcctcagagaggatgccagctgcacccaggggctccatgcaattaagtggcacctctctgattcatagtaaagccttttgtcctgggatgggctggctttggagaggaagggcatgaaatatgttctgttagcaggtaagcactttgcctttgtaagagataaaaggtggttctgggagtttccagcatctaagttccaaaattttgtgaatatgttgaagagatgactcagaactcaaacttggcacccgcttttgacatcagccgtgttattttctccagcatccatctggcgcctcggggctccaaggctccttgtggccgtgatgtctctgagatcttcaggggacttgaggtcaccttcatctttgtgtccccagaacttagtgcgtacctgacacagagtaggtgctgtagaaatcatcatcatggataaatgcgttgattgcgtgacctgtatttaatacaactctttggaaatattggagctttttatttttaagataaaggcagacataaagcaaatttgactctgttgcctaggtaatgtacatttttatctcatggcgtctgtgacattgctcttgattcccttgtacttctctgtgacttctctctaaagaaagagttctcctcccctgtgcacagtggcttggtggttccagggttctctccttggttctgttcttgtcccactctgcacattctccccggggagcaccatccatccctgtggcttcacggccaagtgcatgatgatggctccaaagccgcattcctgtgcagacctttcttgcactaccagacacctgggtgtgttgcgatggatggtccacgtgcatctcaggttcagctctggcaaagccaatcttgggttgcccactcctgccccat

SEQ ID NO: 52069 - DNA, 2202 bp, Bovine  19866880518965
ttcttggactgtgtagcacttaaagacctttgctgcaaaaaatgctcagtaatatagtatcagtggccaggaataaagttagagacacaactcttgaatagaaatgttgggtttggaaaaatcatcggtaagcaaaaccaactagaataatagtgttcaatgaaaacgttaaccactagagggagagttactgtaaatatacaagtttaaatgaatttatgtgattatcagaacaaaagagagagaaaataaagggaagagaattaagagggagctaagacctgagataaatacctctggttgggaacgtgggcgagggtagtgttgatggataagtcataggcaagtgtgtgttttcccaaaaaatgagttgaaagataggggttgagagacttcttgagttagactaacatatttagaatgaatgttaagtggtaaaatcatagaaagaaatgaaatataggctttaatgccccaagtcacaggaaaagcagactgaattctcccatccatcaaaaagccacacaaaagaaagcaaagactgttaaagagaatctgagtcatttttccaagcctggatctgagccaggtgagcacgcagggtgttgttcccttggtttttgacacagttgaaagcatattatacaagacagtttatatcttatgggaattaaggtgctattttggagtctccagaaaattgccatggtagaagtcatttaaaaaatatacattttagtttactcactaaaaatttagaataaagtttgagaggattttttcaagtttgaattcagacctaatttcagaagaggagtcttcctcctttggattcatctctctatatcagggattggcagacttttcctgtcaagggccaggtagtaagtaagttaggctctggcagccactgacctctgcatctcagtgtataagcagcgattgaccataggccgatgaaggagcaaggctgagtgctaataaaattgtatcctcagtggcagcgagcagggtgggtttggcctgaaggtttgctgacccctgcatctgtttggttcagagtgaggtcgttgcagtctctttgcagtcaagcccctgacatatgaatgactttctttccaagagcatcttaaatccaacagagttagtctaggtacccaactaacacacttggctatataatactggactataataaatggcaacccactccagtagtcttgcctggagaatcccatggacagaggagcctggcaggctacagttcatagggccgcagagtctgacacgactaaagtgaaatagcatgcagtctactataataggcttataatacctttcacccaaatcatgcataaaaaaacaaacacaaaaagtaaagcatttttaatcttacaggacagtaccttgaaaagttcagcaatacagtacaatggctggtcaacaggggctggcaccgagtgaacaggcaaggagagttactgactgccggagggagaggatgtgggagatggtagagccgaaggagcgtcagcaataggagacggagggccggctgcagtgtcactcacaggggacgccgatggcacaggctctggttccttggccggaaatagatgcatgttcgcctctttgaatgtcttagctgggaggttcgtatgtaggagactttaccatctttgcactcagaagttaaggaaaatttctggcttccatgcatcttccttgatggacaagtttaactatgtatcaagaagtaagccttatctctctgggtgagaaatggaaatgagagaatgcagtacttggcatataatctattggataggatgaaccgtttttttttttttttttggtaaattactgggtgggccaaaaagtctgtttaggctttccaaaattttttggccaacccaatacgtaagcgatattgaaacacccaatattttatgtgaaagaagtgcttggttgtgtcgaaatgctgccctggcccttgaagcatccttggctgagacagcgtgcatctttttcgtttctgaattcagatcaaactccagttttaaataaggaaaccaagcagaaggcaggcagccggcctgtttcacaaaggctctggatcagcagctccctccccgaggggggtgactctggcctgggagccccatagccacacgcggggcgcttccccacctccgggcgggg

SEQ ID NO: 52070 - DNA, 3148 bp, Bovine  19866880540720
ttttttctgcttttccctttcttccaaataaaaataaattgctttctcttcatccaaatttatctgataccaatatttttcaaatattttggggtctgttcatataaacttgccattttcatgataccatataaagatggaatgagctagaaagtgttttcccaatggtgaaaaaagtgttttggtgaacaaagccataccccccctttcttttgactttatttcctctgtcttttacattcagtaaccttccaaggcactcttcattcatggacagtttattgggtacctgctatgtgccagctccttggaacacacagaagtgtttcttgcccataaacccccctcagagcagttggagaagcgatttgggggtgcctccacagctgcccttgagtctctcactgctccacaccaggctccttcagagtggctggctctgcccgtctcccccttccaactggctcttctcagtgaccatcttcagttttctgccctgcccagccagccacagacaacagggatgacccacctaactgcctgccgcaaaccttctctatgtttcccagtgttaaactgttactctcactaaaagatttctctgcttctgttttccctgataccaggcccacctattcttcctttcaccttgttttgagctttctctgactttgctggtggttatttttccacccacatcttaaatcttgtttctcctaccatgacttcacttatcacataaatattatacacaattttcatgtccagcctgtatccccctttgtgggcatctgacagattctctggtgtcccacaagaactttgacctcatgtccaaggctaaatgatcttttccctcaaaccagttctttttcacgttttcctaagccaaaacctggggaatttaactgaatactaattaggtggggttttttccctttaattcaaagctgattgtgagcaaacattgcttctgaagaataaacagactgaaaaatactcagccgttatctttttgtatgcttttgtttgatgctattaatagccagtttgattttactcttaactaaaattgtattcataatacatttatgaaataatcataccaagttttttcttatgccaaccagatcctccaaatgtacatattattggaaatctgccttttagtgtatcaactccactgattatcaaatggcttgaaaatgtttctcaaagaaatggaccatttgcatatggtagaacccggatgatgttgacttttcaaaaggaagtggcagaggtaagttttaactttttatggttgttttatcacaagatcaaattaccagaacaaaataaaaagaatattatcagtttggagttgagaaaggtaagggggtttggtgtctcattattcagtatatagactttggctcacataagcctgctaggcattctcatgattggagtgttccaagtttgtctctaaaaagtaaaccctcagagcagtgaaagcagtttttgaagcaaagaggtttaaggagggaatctgcaggctataagcagttcttttttatgacatatgaatatagaagagtgtgtcatgtatattcacggctttgtgtgtgtatggcttaatcaaaagagcagccgaatccccaccacccaagtcaaactgttgttgttcaattgcatctgactctttgcaaccccatggactggagctcaccaggcttccctgtccttcacaatctcctggagtctgctcagactcgtgtccattgaatcggtgatgccatccaaccatctcgccctccgtggtcctcttcactgtggtattgaccatctagcgatgtccatgtatagcgtcgtctcttatgttgttgaaagacggtatttgctgtgaccagtgtgttctcttggcaaaattgttaacttttgccctgcttcattttgtactccaaggccaaacttgcctgttattccaggtgtctcttgacttcctacttttgcattctagtccccctgtgataaaaatgacatctttttttggtgttagttctagaagatcttgtaggtcttcatagaacccttcagcttctttggcattagtagttggggcatagacttgattactataatattgaattgtttgccttagaaatgaaggattatttctgattcttctgatgaaggaaatgaaagatcattctgtcatatttgagatcgcattcaggtactgcatttcagattctttcattgactgtgagggctactcccatttcttttaaggggttcttgcccacagtgatagatacaatggtcatctgaattaaatttacccgttcacatccattttagttcactgattcctaaaatgttgatgttccctcttgccatctcctgtttgaccatatctggtttaccttgattcatggacctagcgttccaggttcctatggagtactctcgtttacagcatcggacattactttcaccaccagccacatccacagctgggcgtcgtttcccctttggctcagcctcttcattccttctggagttatttctctgctcttctctagtagcatattggacacctactgacctaaggggttcttctttcagtgccatacctttttgccttttcatattcttcatggggttctcaaggtgagaatgccaaggtggtttgctgtttccttctccagtggaccactttttgtcagaactctccaccatgacctgtccatctgggtggccccctacacagagtggctcaaagtttcagtaagttgcacaaagctgtggtccatgtgatcattttgataagttttctgtgattgtggttttcattctgtctgccctctgatggatgagggcaagaggctcgtggaagcttcccaatgggaggtactagctatggtttggaaaacgggtcttgctctggtgggcatggtcatgctcagtaaatctttaatccaactaaagtctttaatcccattaaatctttaaatccaattaaagttaagttaataattagattactaacatctctgacaccctcttgtatgcctctttctgattgcatctcctgttttccatctattaccaggataatctataccatgcatttgcaatttattattccctacatagtttatca

SEQ ID NO: 52071 - DNA, 1305 bp, Bovine  19866880645752
cttctaaaattttatcaggcaacagtctaggcgagaaattaaaagttaattgattttggtcaaaggtcactttgtcatggtaaattacagtagaaacggttatctgggaagatgcttaaagtaaatgtggaccagagtgagtttaaatggaataaacccttttccatccctaggggctttctaattacttgtccgtcttctggatgtgacacgtcttgccaaatctttttgcttccgaggataaaggtcagaggtggtgagtggtttgctctggacactctctactctattcctcaacaaagacaagttacattaaattaacgatgcttaagcttcagggctccttctaaaatcctgggacaggccccaacacatgtttaccagtactcttgtacaagttttggaagaaagatcttttcatcttcttttttaaggagaataccaaattgtatgagcttcatatccaacaaaacctggattctcccagacctacaacccctctcctcttcagccttcacctctttatccaacagcttctgcaaatgttagacacacacacacacaaagcagcacactactcaggactccactatggctgtcaggacttcaccttccagacggggcccaggctgacctcaagaacagccttatttctcagatagggaggagggcagagaaaagagggagacttgattattgctaaagtggatgaaaacgaaattctggtgatctcaactttctcatagaactgacctgaacattattcttaaattgaaaactcagtatatgtcagtttaactccccatggtaaacagcgtacgggggacatggcttttttttccaatgaattttttaaatggtggtaaatcatacacaacataaaatttgccattttaaccattattaaaatatagcttaatggcattaagcacatgtactctgttgagcaatcgtcaccaccaactgccagaactcacttcaccttacaaacttttggggccaacccaatactttctgtctctatgaatctgacaactcaaggtacctcatggggcctcccaggtggctcagtggtaaagaatccaacagccaaggcaggagacacaggtttgatccctggttgggatcaaactccagtattcttgcctggagaatgccatggacagaggagctgagctggctacagtccatggggttgcaaagagttgaacacgactgtgcaacttaacacacacacagcacaggcatgcaagtgtgtgaaattaaacagtatctgtcttgtgactggcttaatttactgagcat

SEQ ID NO: 52072 - DNA, 1214 bp, Bovine  19866880713196
actatattttacattgtggcaaatccgtggtttcacccactgcatgctaaatacgatctaattatcttcctcccaattctctccttcttcacttgttttacgtgttaggtaagaatccacttgtcagtggtgggtcgggatctgagatctctccatccgcaactgtgcagtaaggacaaaactcagaaaggtcccttggctttgccccactggataagcaaagcgaaggccatctgccatcctgtgcttcagtatgaatgggtatgtcgcagaaggtctccaggggggctatgtttgtgtgtgcatgcgtttcatcccaaattcctccagtccgctgcagaggagagcgaggggcctactgttatgggggtactttagccataaatgaccattatatttctgagcagcccctcaattccccttgctttcctcctggttacagcaccataattctcggccggaaagggagtgtaaatagctctcccgccgctgatgccacttagcgggctgcaaattgatgtggatggctctttagctttggagactgtgtgtttcaccttcacagcgcgcatgctttcgttggcctggggcttcagcgcctgagataaatccttaactagagcgtggctctctgcactgcaacacatcagaaccggtggatggaaatctcaaacattttggaaatttacaccttgtcactctccgagggcaatgattttaagaaattatgccttctctacctacctttgcatagtataagtctaaaaacccggcaccatctctaactccagctgaagcgctgaaggtcagagaggttaagacaagcccaagctttgtgcccgtttcttattattatgctaatcatatgcatggtctttctgcactcacacagtcattttcatgaccccccaaaatacatcagtgtttcaggtaatgttaatatttaaaacagtggcaaatgactgaaaatttcaagtaaagactcacattttgcccttagcttgtgatgtttgggagaatggaggaaagataggacctaaaatgtggtttttgctttctattaactctttcttggtttggttgtttttccccctggctttggagttcatactgtaaaattcctaatgacctgctttctcatgattttgctggatgggtgaaaattaattttaggacatatattaatatattttctatgaaattatcttgggatt

SEQ ID NO: 52073 - DNA, 3167 bp, Bovine  19866880716753
cacaggaaaattgattcttccctttgcctaaatctgtttttgtttttttttaattactgtacatattctagtattttaatcctatggtgtaggggaatcttggagaagggcatggcaacccacttcagtattcttacctggagaatcccatggacagaggagcctggtgggctgtagtccatggggttgtgaagagtcggacacgactgaagcgacttagtacataggggaatcttgtgtgtgtatgtgcgtgtgttttaaatgcatgaaattcaaagtaaaaaacctgtcattgacaactctcatgtatgataggtggggtatacgtgatgtattgatgatgaatctgtgtgtaacattttctggtgtgtgaggtgttttcacatatatgatttcttttcacaaaatttgtattattgattggtgaacttaagcaattgtgttgtattaataacatccctgtttacaaaataggaggtgaggttgaacacaggaaatgccctgctctactgcttcttaagtggtgtgacttgaacctcagtcttttgatttcaaatcctcaagtcttgtctttactaccagactaatatgagagcctaaccagaagggaacatttctgagttgcttaatatttaatgttaactatttttatttatgaatcatagaagaacatattagcatgaggtcatggagttactgtgagggtgaagtttaggaaacaaagcttccttgggaaaaccttctgaaacatggtatgtttggggatgatttctgaatgagtgtctagctgaagatggaaaaacacttagtccaggattagggggtaatttttaaaaacaagtagaaagaagagaaacatgcttggattaagtgcagttcatggttagtatgcaggcaggcgtcagaggccatggccgagtgtatctgaaattcactgggatcgtggcttagacatagacttcatggagttcctgatcatctggacaattctagagcagtaagagtgggtactgagcagcccttctttgactgcattgtgctaacttgggctaagaggcaaagtggctagaacacaggaggaggagttgatggactccagtcagcctcccaaggtgtcagttgcgtgtgggttaaacaaatgaggaaactccaggcttgtctgccccagagggtcatgagaagccctagatgtgaggagcgcaaaagtgctaactctaaactcaggggcattttcccacggcctccctcatttgctcgtcaagcccaccctttcttttgggacctcaaaacaggtggatgacctgctacacttatacgggtcagcagtggatggcgttccccgagacggcacgtgggagagccaggttgacgttcactttcaggatcgtcaagccgtgactgtgatggtcaagccggaaaccagggtagaagatgttctgactctggcctgcaaggtagtggattttgctgtagaaatacacttctgaatgggataatcattaatgttgccctcctttgcctgcttaatttgggtggtgtttaagacctcactttctacaggaaggaacaaatttgttaattaacatattcattatagcattctctttctccatgttttagaggagtaagttgagtcatggcccaatgccttcatgaagaacttcagctattttactgaaattctgtatatactcctttgtatctgggataattatgaagtctctttcgttatttaaggtacttatagatggtattctgtgagaaagtggcatgaacttttgcggtggtttgatttgatgctagttttatcaagtttctccggattaaatgagtcactcaataccactcacagttgcttcatggagattgttatgagatggtgtttcattcattattcaaactgggttttatttctgagaagaaagtttatgatatattttcaagagagccctctgagatccatgaaaccgactcagcagcatcagataatatgctttcagaccaccagatgggcgcagtagagctgaaatattttttaagttttcagagaaaatgcaaacatatgaaatggttaaaaaactgtcgagtttggtagctctttaccacaaatgcttattagataatctttcattttagtcctcctttttcactttgacttacgccctaggattccagatatttgtatatgcagcttatactgttaatgaatttaattttcttttgctccattatgtcaggtgattattcaggcagtcaataatattattcagtaccaataatatcaagttggtaaatattctgatagaggaggtcagatgtagtgggtgagttagatccagttagaacataggcttgagataatttctcattgttgaaaatgtgtctgagacagaatgtgtgggtgtatatatatatttatgtgtgtgtatatatatttatatataccttttccttgtgaaaaatggttggaacaggaaatcgtaattctgaagtctgcagagtatgagatggttgacatttcacaaattagtaacaggaaacaatttaaatttaggtacctgtctattaaaagagagcagttctgaccaccatcactgcttcaaaatacatctcttgcttttagtgataagtggtatcatttagagaaaatcttcttaaaaataatttcccttttttcttttttgcacactgaaacttgagctcttgtatatacttaaactcagcatattatagaagatatttttaaaagaaatttccacttttatttttagtgaacaatggtgcatttagaaagaacatttaacatctgaatagctgtctttttctccctagatgaggcagttggaacccagccattatggcctacaacttcggaagttagtggacgagaacgttgagtactgtattcctgcaccctacgaatatatgcaggaccaggtgagtgttcttcggctttggtaagggaccgatccatgggccaaggaaacccatccatggccccttaatttaaaaaaatagtgtcattcgggggaaaaaattctgtttaaattgtcatttagcttggaaacaatcaaaataaatttgcaagatactgtgacttcagatcctctgattttgcgggtcttcccttttgtaggtttatgatagatagaagtctttccactaag

SEQ ID NO: 52074 - DNA, 957 bp, Bovine  19866880719353
gagcagccgctgctcagctcctgaaggaatgtgggccaacactgtcacatcacttcaagttttgaagaaaactcagatttctagaattttacctaaaatctcattttaaaatttggaaacaaatcgaagtgaaaacaaaaccaagactgacatcacagtatgagtgcaagaaatgagtctgttgcctggggatggcccatggatgcttggtttacaagagtcactgtaatagatgatcagccccatagaagtgtgaaacacagcgagcagggtacaggccccaggtggcttcacgagaagacaatcttggtgtcagagtggaggatggatcagagggactgagtctcaaagccagaaggcaaagtaggaggtcattgcagtaggccaggagaggctaccggagaaggcaatggcaccccactccagtactcttgcctggaaaatcccatggatggaggagcctggtgggctgcagtccatggggtcactaggagttggacacaactgagcgactttactttcacttttcactttcatgcattggagaaggaaatggcaacccactccagtgttcttgcctggagaatcccagggacaagggagcctagtgggctgctgtctattttgtcacacagagttggacacgactgaagcgacttagcagcagtagcagcagcaggagaggctacattcagttaactcaaggattggcagtctaaatgcaccactgaggctctatgaacacttattgaatgatccagaaattagctggcacttaaaataactaggatgtatgaaatagtaaaacccaaggagacaaaaatgttttcctatagagttaaaatatcaaagaactcttttttctcttttttaagaactagatctatcgacaaccattctgctttcattttcaaatgaaaaatataaccgcatacacaactaattaaattaatatag

SEQ ID NO: 52075 - DNA, 1416 bp, Bovine  19866880722953
gttttattttttttggcctgaggctccctgactagggattgaaccctcaccccctgcattgggaggtgaagtgtccaccctgggccaccagaaaagtcccctgtgagctcttagtatcctttcaataattctcttttgctcagcatatccagagctggtcaaactgcccttgtcttgtatgtcgtgttcccccttctttaaaatgattctgaaggctattcagtgttatataaagagcactagactggaagttaggagatccagactctagccctgactttccatttaattagctacagataaggctgtttctagggtgggggaaccacccaaaacattaaaaattaggctaaaataccttctcagtttcttacaggctgagataatcaggctgttgggagcactaaaagcaaggaaaagaaattctgctaaattaaacccaacaaacatttatttaagaccaatttaaaaaacatttagaaagaggagataggaagagagaaagactttggaaaaaaacaggatacgctgcttggtaagaggtttagctctgaaacaaaagcgggacttctgaccctggggtttgcaaaatgggtgctaaacaataggattaacgtggcaagtcttctcagtggtccttcataacaatttccagggagacaatttctgagtacttgtctatttctaaatagacactttctatttatattaaaatcgatgcaagtttcataatataaaatttgaatatatttgaagataaaatatgtttcaaagataatttattattgtgactacatcttagaatgttactgtaggtgtcctggctgtctcttactgaacacaccagtgggagagtttgaaaattactgaaaatggaaaacaaaggagaaagttaattatcaaatgttgtgggcatggcttaggcaacattggctatctgcccagtttaagaaggaaggagaatgcattagtagaagaaaagaataaatggttaaatacagttctgattttcaggaaagagtagacatacatgccataaatatatgcaaatcatcttagcaccagggtcatcaaagtgtttttctgctgctttggacttcttacctttcatttttgacatcattgaatgtttcatttttgcctaaaaaatttagtttccttttgtattagtaagaaatgcatactcagggagcaactccatcaatacgaattgttgaaagaagttatttctcctccacttttccaattttgccctcagggagaagatggccattatttggctgtgtggaatttcggttatctttgtttctgaactctttattctaattgtttgacagttgattttataagatttttatatcattgtcaaatgtgatatttgtcaattgtcatatttatcaatttgtcaattgggat

SEQ ID NO: 52076 - DNA, 1130 bp, Bovine  19866880733723
agaataagaatgacagaaacagcagaattcagtttggaaatctgtagcagattataaattcactaaaattggggaggcattttttaaacagaagcaatagtcatgattggattctggaatgaaaccacaaaagcttattgactcaaaatacaatatataaattatagtatgatatgataccatgtgataaaatatggtatggttaacataatgacacgatgtaatataatgaacacaatacaacttaaatgaacaattgtagttattatggccctaagccagcactcccattttcctccccactgtctctctcatttgtaagactcatgagcatactggttttagatagtctacaattataggatttcaggcacaatattatgtgtatacatttcaaaacacaatataacagtctgtaatgataatttaatattttgttttacactaccacttgatttaacataactgtttcctaaacctttttgcctaattagaaccactcacccttctttgccttcacctcccccaaaagaacaacagagtactgaataggctaaaaggaataccttttttgaactgggtaacagtaagatcaaatgacacatttgttttcaggtgtaacacttgtaattccagccttaagacaatcctctgatggtaacactgtcaatgtctctaaataatgaagtgacagaataaaaagtcaatatgcaacagccaagcccaataaaaatctgcagaagggaaagtcatctttcatgaagcaccatagaataataaatgggcaagtgatcctctgagcttactttgtcatatgttacaacaataataagggaactacattctaatggtgtttttgacttcagtaccacaaggagcttcccaggtggcactagtggtaacaaacccaccagccaatgcaggagatttaagagacgagggttcaatccctggatcaggaagatcccctggagaagaaaatggcaacctactccagtattcttgccaggattcttcaatcccatggacagaagagcctggcaggctatggtccatagggtcactaagagccaggcatgactgaagtgacttcacaggcacacaccataagagtattaacaacgtgtatg

SEQ ID NO: 52077 - DNA, 810 bp, Bovine  19866880735292
catgcatgctcagtcattcagtagtgtctaattctttgagaccccatggactataaagcccgccaggttcctctgtccacgggattttctaggcaagaatactgaagtgagttgccacttccttctccaggggatcttcctaaaccagggattgaacccgtgtctcacgtgtctcttgcattggcaggcagattctttacctcctgagccacctggaagcctgagaccaccaatatttatcacaaataagtacaggatgttggaaatatcagatgacccggtagtttgaaaggagtgagatcctgagctttgggaaggaattttgatccttttaaatgtaaaccatttgtctagcctagggctcagtgctggagagtaatagtaatgtgcttcaggttctggaataaacctccatttcaactttgaaagaactgcttatgttatttgtttggggagatgactcaacacttctggcataagctgtaaatcagctcagctgaattgcgtttacacctggaaagtaagaagcttaccatgagcattctcccctgattactcatatattcaagggaagaaagtcttgactgtatctctaccctctaatctaggaattctagattcctagaaatctcttcattctgtggatggagatacccattagttcagcaggactctgactgataagaagttaaaggtctcccaggaaggaagcatcctgtggttacctttgccagcatggcactaaaatacaccagtatgtctccctgtccttcccaattcaaaaccctctcctcaccttttttgttcctc

SEQ ID NO: 52078 - DNA, 1576 bp, Bovine  19866880769566
caaccagggaattccccccaaatcctaagttttgaaactaaatagaatactttgtaccaactaacaggtaatattttatataaatgacaaaatgtgtattaaaaatcatgctaccaatggaaataaaactacaaaatgagtttcagataaggtattattaaaataaaaaattttagtagaaaaaaatcattattaataggaactatgcttgtaaaatcctgtcttataaatactaatcactagacacatctgtttacaacatttttgaagggttatgttggaagttaagaaaatacaagtaatctgcccagaactcaatgtaattaaaaagtgttaaattctgcctctcactccactcacaatattttcttttcgtggactaaagtgaaactgttttagctgaaaggttcctaatcagtttaactcagaataattgaatctgagtttttgaagagaccctgcgggtcatccatctatcaagcctggtcctggtcccgcttccaatttgagaaccgtctccaggatcctgatagatggacccctcccttctccctaaatacacggagggatgggaagttcccagctctattagaaagcacattccactgttaagtcaccaattgatagatgagaactccttccccggacttcagatgagtcatcctaaaacttccactaattaagttcagcctttccatcattatccgcacacacattctacaccccccttctacccagtcaccctacaaacagcagcagtcaggttcacggttcttcccggctctcccctccttttagaccatcttcacaatgaagccagagccaccgtgtaaaacagaacagatggacaccaccagattatgtttttcgctaaaaatcaaatgcacatggaagacagtcctaaaggcttcagtctgcgtcaccccgctcagagtaaaagaggccacaggccctctctggtgccacgaagtctgggaaacgttggggccccaggggcgaaggcaggatggaacctacttcccgagtccccacgcgtgtatagacggttcccagtccaccagccaggaggcccaagaactgagctcaaggaaggtgagggagaatttgctgccgaaagaaaggacctaaaatgaagcaaaagaatggtgtctgaatgcagaaggaaattttttaccgtccagaggacggatcagtctcctaacagggctgtttgaaacgtatgagtgaagcaggactgggagctacattcttaagaaacagaaaccatttgtcagcaaatgaaatgtgtacaagtatccttcagcacacacacacaaatgctctgttctattttccttaaaataagaagctctaggaacttccctggccatccagtggttaagactttgcttccaactcagagggcacgggtttgatctctggttggggaactaagatcccacatgttgcaaggtgtggccaaaaaaaaaaggaactctccagaaacatcttctatttttccattacagatacagaagtagattgcacttttttcactttgctcccagttctactagaaataaaactacttaagtca

SEQ ID NO: 52079 - DNA, 2101 bp, Bovine  19866880833955
cagtagcttttttgctgctgcatactaaaatctaagttccctgtagacatagcagagttcacagtgcataaaaatagcattgccaaatttctaaacattagacatgtttttaccccttttcctaaaagcaaaagtgaaaagagatgaaaaaagtaaattaaaaactatagacacatatagtatcagatatttatatagttattttgaggagcatttgttgtaaaaattatgaaactctgttagataaatcatatgttgaatgaattcattttttaaagaaaaagtagaacaaaagaaaagagttcagaaaggccatgcattgaaatatacctgatttttaaaataaaattaaattaaatatatcaccaacatcttgccgtttgctgaattaagtatattgtatttttgttttaggaaaggttgtgctctctgaatattgtataaaaatagcttatttcacaaacttatattggcattagtcggttcaaaccttttttccccacttaggcataatttattcatccaagtctcccagtttcaaatgaaggctaactgagaccacagcactcatcacatgatgctcggctcagagggtgttagagtttgggttccactatttagaagcttacagggtagcagggaagtggcaggacatgtgtggcagtaaaataatcatttaaaggtgagtacattctggagtggccgagattgtccacctgggggccactgaagcacaaagagatcttgctaaaggatttactgtagggagaatgctctctacatggggatcaaactgacttttgtcaaaaattacatggcatgaagaagaaaaggaggaaaataagtttgaatttctgtgtctctcaaagggtcaattgaatcagctcccaaaacatcaaacagcaaggaaaaacgactcctgcttccaatcttcttcctgcagtcacttctgatgcggtctgctaagcccagagggctttgtgctttgtttggtgtccattttcctgccttcatctttctcattgctcacgtaagtttgcagcacgtttcatctttacatttatgaagtcacctaaaatctttttgagagttatttagaaagctacttcttacagggcactgatgctgatagcctcaggaccacagttcaaaagtgagcagagagactaactcatcatttcttatccccaaaccaagtggcacagttcaaagtctcctgttttgccaattttaactttttggttttaggaatctggtgaaagtcagaattatcatgctttttatattttatatcatgcccagcatacacagaaatgtaataaatattaaataacaaacacagaaatacattcatttctctgcttcttaaaacataagacagttctatacaaatccatacacagatacatttgcaggattttcgagcagtgttttcccttaaagtttaaaactgagaggaaagttttcctgtctaggtcgtgaattatttaacttctgagtttaggaaaatttaaagtttaagaaggctagtctggaaatcccttctttgcatatccaagctgttcatctctcaaaagtcaaagtggatgccagaattccatagatttcatttttcaagatgaacattcatatttgaacatatttcaaagcagatggtttacagttcatgtatttgttgctgttttcctgccacaacaactaaatattgaagacacatatttgtgatgaggagagcacttccaaaccgtctctcccgctgctctctcacactgcgtgctctaatcccctgtgtgctgcagggaaaggcgctgaggaatgaagcagtgaattacatccatttgatttaatagacagcagaggggtgcaataacataaaacaagcttcctaaaaataaatacttttttttttgtagcagtcatgaattttctggtagcaaataagaaatcaaatgaacacgtattgaaatattctgttttcatgatccatttagatgaactggaaagttttaagccctctactatcttataaggcagtttgccaaactgtgggactgtttgatcacagttaagaaagaagaggaaaatcaaatgaaggtttagt

SEQ ID NO: 52080 - DNA, 975 bp, Bovine  19866880836139
agtttgataccctggctcaggaagatcccctggaagaaggaaatattcttccttcgtattcttgcctgggaaatcccacagacagaggaacctaatgggctatagtctatggagtcgaaagagagtcggacatgacttagtgaccgaacaacaacaactgccctgaccccactctattattaaacattaagaattcatagatggtgtttccagaaatccctcaagtctgagaagaggtgaaaattatgttgcatgggattttttagagatttgaggattaaaataagattttgatgactttctggctaatcctgacgatacatgaaaatcaattttagtggcactattataacttttcttatattatacagtttgttgtatcctacaaacaacttaggcaaataaaatgagctaacattgtggagatatataaggcttatggagatggtgggtgttatttgaatctaaatatatattccctaaaaattgatgttcctagttacagccatacctttaaaacattcataacaccagttaccagatgcattcatatctgttgaccaagcactggaatattgactctgtcaactcaagataaagaagcagagataagaattatctgtctccaattattgtaactattgcatctttatttcctttccttgactattctaaaactttaagtaaccagattggtgataattggtcttcgataagtaacaacccatatgaatgctccatgaatcacagaaacaggtaaattcagacaatatatggatattgagatatgaggcaagctatcaaggaagattcaaagtcctagccaaaagtaagttcacatcaggaaaaagcaacaacaggacttcatatggataagacacaacctaggaaaactgagaggtagcttccagaaaagcatccacttctgcttcattgactacaccaaagcctttgactgtggtggatcacaacaaa

SEQ ID NO: 52081 - DNA, 1536 bp, Bovine  19866880842969
tataggaagtaaagcaaattgtattgagactgaggagaggataatggaaatattagagacttgataagagtcttctagaaattttaaaagcatccttgtttttataccttctgtttttcttatacctatgtatcacaatcaggatgaaaagatgacttaagacatttcggcaataaggaaatagaaagtttttaaagatgtgattctccataagtatacttgtaataatatcattaccaataaatgccagttctcattttaccatcattattttaaaaagaaaggaagaatattagcacactgcaaaagctgaaaggctccatggaggatcttttcttcatgtttttcctttcaatatcctgaaaaatccaatatgctcacatgtgccctaaccttggccacttacacgctctttcctggaatgataaacttggaggagagtaacgtatcaacagaaatttggttgcaacaggttgcttcattctggtgttggtgacagggggaaaaaaagagcagacagtctttcatatttcctgtctctgaaatcttccagggctttcttgttttctgcttattagcaaacctgttctctctgccttgtcttttgtcctttctgctagtacattatttttccagtgacttcatttctccccttgagttagccaaaattcatttctgatgcttgcagtccaagcatccattttaatgaagacacaaaggctaaatctggggagattacagtcaagtaagcacatgctagatcttcagatcggaatacttttgaatgacagaggccaacatgtccttttcagcattctatttttttagctgccagcactccagacttgtcagaaactatgagtccacacagttcccacttacttactactcagtagaagccagcagtatatctctgagctgctctgacacttaaggggagtggacttctcacagataaaacatgagcctaggatgatttcatccatatagccatggtcaggattagacagcactaaaatgacctacatctccttaagctctaagtcattggtggcagatgtaatctgctaccacagagaccgaacctaaccactcaacaaattagtgtgtagatgaatttaattttcttattcaaaaaagcctattttacattatttttggcatttgattctgttaaaagatgacttaagtcagaggaaccaaagcgttcgattcaatttaatgagagaaaaatttattagtgtctatagctgcattgccttgaggaggtaaagaagagtaagttgatcttttttctaaatgggtgtaactgggctacttctcatgcagactatgcactcaagttgaaagagatttttgcacaaatgccaataatggttttaaataatagaaacactcgcttgaagatggctactcatgccctgtttggaactattgtggtctatcaggtcaataatattcatttagaaaagctctccaaaagtgttttcatacaatagtcccgaagataagaaagggccattaggtctcccaagt

SEQ ID NO: 52082 - DNA, 780 bp, Bovine  19866880847879
atgtagtagagtcgtaaataatacacattgtgataggaagatcttgtcaaatgttatagaacttaaatttttaaatactgagaaagtaactgccaaacgaatattgcagagccacttcattagtctttttttctcctgctgtctatcagatattcgattccagtggcagccatggattttccggaactcagctacctcaaagctccaataactccagtgaggtaagcgaggttgcagacagcagccgtcttattttccttggatgacagaaatgctaagttaaatggggcatgcttaatctttatctgaacctgttgaaaataatctttacctgaacctgttgaaaataaatttggagctcaaatggtgccgagtaggtaaaaggtgttttcagaatgccagttatttttgaaggtgtcttaaactaatgataactccatcttcaaagtggtatcagtcaggtcagttgctcagtcgtgtcaattctttcagccccctggactgcaacatgccaggcttccctgtccgtcaccatctcccggagcttactcaaactcacgtccattgattgagttggtgatgccatccaaccatctcatcctttgtcatccgcttctcctcccaccttcaatctttcccagcatcagggtcttttcaaatgagtcatttctttgcatcaaatggccaaagtatttgggtgtttcagcttcagcatcagtccttcccatgaatatagctagattgaagtggtatatagctagactgaagtcaaaatagcaa

SEQ ID NO: 52083 - DNA, 985 bp, Bovine  19866880869146
tcagcgttactggttggggcatagacttggaattactgtgatattgaatggtttgcttggaaatgaacagagatcattctgttgtttttgatctccattctgaaggagatcagccctgggatttctttggaaggaatgatgctaaagctgaaactccaagtactttggccacctcattcgaagagttgactcattggaaaagactctgacgctgggagggattgggggaggagaaggggacgacagaggatgagatggctggatggcatgactgactcgatggacgtgagtctgagtgaactccgggagttggtgatggacagggaggcctggcgtgctgcgattcatggggtcacaaagagtcagacacgactgagcgactgaactgaactgaactgatggtgtaggtttggatagtactgttttgtggctttatgaattatttggtatagacgctgaaaaagtgagtttcaatctgtcttgtgggtctgcaggtgaacgtgcctttaaagtcagactccattgcattttgactccatgttcttctttggtctgtggctggggcccttctggcagcccagtaagctccctttgtttgtgggattcgtcaccaagcgatgatgctgagtccttgttgacagtgggtgcatgacccactggtgcaggtggttttttcctggaagggtgtcattaggagggctgtagcagtggatcatctgtaattccattaaaacctaaaggaagtggaatttacatcatcctgctgtgctcttctaagggtcttttaatccatctgcttgcagctaaaactgataaagcctttaaggcttttctggatgcccggaaccccaccaagcagcactcctccacgctggagtcttacctcatcaagccagttcagagggtgctcaagtacccgctgctgctcaaggagcctggtgtccctgacggaccacgagagcgaggagcactatcatctgacggg

SEQ ID NO: 52084 - DNA, 3428 bp, Bovine  19866880872562
gagctggtagacgataagctgacagcaggtctccaccactgccgtcgatcactgctgtgttcaccttgccctcgggatggtgctggggagacacagaagtccccctagtacttcttcaggacggcatgtttctcattccctcatcataatgaaaagaagatggatttctcaaccacttcctccgggaggaggtaaatctggcatgtccttgggtttctctgcaagctggtagccacgagaacactgctggttaacaagagtcgtcaggactgggtgcctttctcagttaaatttcaggtccatgtaggactctgcacaaattgatgctatcctgttgtaggaaatggtacttgaagcaagaaattgtcaaaaccatgtgacaaattaagtccctctatttcaaagaatccaaaattgctttatacggacttccctaatggtcctgtggctaagactccatgctcccaatgcaggggactcgggttcaatcactggtcagggaactagatcccacatgccacaactaagacccagcatagccaaataaataataaatatttttgaaaacttgctttgtaagttctctcatggccctgggggctgggagtgtatattcagatgataaagacatctgtgaggcaagaggaaaaacccagtcagctcctgcaccagcttctgctgcttctcctgttccagaggctgcttgttcaaaacaagctgtctgtttttattagggaattccacaagagaaagtgtgtttgctgagactctcattccaatgacgtgaaataataataaaatatgcaaacagagttcccatcccttgttgggagagggggaaggaaggtgggagtgagcagggtattccagaagcatgaagagtagacaacaacaaagttcttttttttttctttcttctcctttaaaaaaaaaatggtaaaataggaatgtttttaaaactcttaacccaatagcagggaaaagacttcattaatcctgtaactttggggaaccactgcagatggtggtggtagttttaaaatctagaagagaacactgcaatgccaaaatgatttaaaaaaaaaatttttttttaatggagatgtattctttacagtataaagatacagacctaacttgttatagaaaggttatacatagtcctatcaaaaactatatctgatttaaaagcctggcatgtgaattttaaagcttatggcttatttaacctttcttttttttttttattttatttttttttatttaacctttctaatgagaaagtttgggtgaaaaaccaaacagtagccatgaaatcagggtattattgtcctgattaaataataaagatttattaatttatgtgtctgttaatttaataagtatttatgtaatgtgctagacaaaagccagatgtttttctgcatgacataatttcctcattctattactaaagtttgtaaatttctttttaaaaatgcattggaatgaagctgtttaaaagaatcaaattgtctatatgtattggcatgcccatatgtttatttcatatctatgtaagtgtgcagagtatagggtgcatttgataaacatttactatagttgttataggataccctaagactttctttttcttccttttgagatatattggaccaaggagaagttggcaaacatgtaaatctgagctcaaggtcacattttagctcatttaataccctagctttgaaactgaaacccacaaattatatatcatcgtcaaatagtaacttttagtaacaaattatatatcatcatcaaatagtaacttttaataacataacagttaatgtgatttattctcactactcacaggtatgggcttcccaggctcaaatggtaaagaacccacctgtcagtataggacacctggctttgatccctgagtcaggaagatcccctggagaagggcatggcaacccactcttgcctgagaaatctcatggacagaggagcctggcgtgccacagtccatggggttgtaaaagtgttggatatgacttagtgactaaacaataaacaccaccaccacacctgtatacctaaatggatttcatagctccacttacgaggagaaagctgctagttctaacataatggtggaaatccattctctacgtagtttaagttcaaaactcacttcccatgtgaagatcttgtccgtataccagatggctccatgccaacaaccctcaacttcagacgtggcttaaattgtcttagcccgtgaacggaagttgatctgtttttcctcccttcccaactcactcagaactgtgacatccaaactccaaaccccgaatactttcaataataataataataataagcagcacttatataacagaaagttacgaagacagtgctgttgaggggcaaatggaaatgacccaacatagtgaacagggctgggaggaagtacaaggaattcaggaagagtccaactagagatcctgcgacgaagtccaagaacaagtttaatgggacgagggaattgaaaacatggaactcagggccataaaggggaactggagagaaaaggtgtgctcttgttttgtatgtcttgcatttcatggaaagtttatgggttcagcaaacacatttccttggctgagggctccagtgaaaataaaggctggctacataaccatctgtcactcaagaattgactggacctctttaaggtatataagcattaaaattgatattttatgttgattcagaaaatgcttttacattttcagatatgcttatcagatttcataagttatggaaaatgaaacaaacttacaataacatgagttttatcaacgtagaacaatcagggaattccctggtggtctggtggttacagttccatccttccactgcagatggtatgggtttgatccctggtaagggaactcagatcctgcatgctgcaccactaggccaagagaacaagacaaaacccaaagcaacaagatcaacaaaaacagtcaataccacaggcatgtttttccccaagggtatgtcttttgagggggaagcccaagattgcccacatgtaagttacacggaagccagaccagggcgttggtaactcgggctgatcactcaaagctcactcacaaatgtaggagtagcatgctttccaggaagcactgaggacctctgtctcctttttggggatacggggagatgctttccatctcagggctagagcagagacagtgtcagccctggccaagacagatcctctgcaggattaaatgtgtttttttagacctggaatcttgagcaaccttctaaacaagcattgaccttttattatggggtagtaaaattaccttttgttttttaacaaagtaatcttaccatttttttctttcaagaataatagttccagt

SEQ ID NO: 52085 - DNA, 1767 bp, Bovine  19866880898201
aacttgggccataaaaaattttatctacactcaggtttttattcagacataaacctacatgcataccttggtaatgataaccttcttgctgaaatcgccagaacctaattattctttcacacgcatacaagaccatggggcctaaaacccatttccaagcctgcagagagcggcaaagagagaagaaaaggaaatgaaaatggaatccaaatattttcaatttgaaccaatcaatatataacgcgacggggtttagacattttcctttaactttgggccagttaccaacaacaaagatgtctccttgtattaaatactataacattcaattatgccttgaagtctacaagcttatttaagagattaaactcttctgtattggtttttatgcttacttgatcaatgatgcctttatgtaattagaaataattgaatttgcaaagaaatagaaagtagattgatgtttatgttatatatgatagggtcataaatgctcccaaactcaaccaaagtcaaaggcttacaaactacattactgagtcaatacaggacatgagaaattcaacaaaaaacatttcaaatagtaattttgggggccaagaatgcatcataactttgcgggtctgcctaaaacaactcacactctcacaccacgcatgcacccatgtactcacacacacatatacacactttcacacacatgggcatagtctgtgtcatctgaaataaagcaaagttagtttcacagtattgtaaatctagattaacagaatcagaacaaaagcctcaatacttgtctggagaattgtgacagggaacatttccattctgtgttagccttttctgagtataatctgccgtattaaggttccacggggctacccttgtaccaggggttgggttacaacctaaggtgtctgcttccttaaaagagaaggaatgggaacttaaaaattttgaagatttaatcttcaaatttaatcaaacaaccttctgaggcatataatattctctttattttgcagaagaggggactgcggctcaacaagatgacacaaattgtccaggtcacaaaggtgataaacaaggttcacagtgaagatgtgaaccccagatggccttgactacccagcctttgctcttcccaagtaatcgtgcttctttctgttcaatgaagaacagacacttgattcacactagagactcattaattcattgaattttaggatgatcaaaggttcttggaaatctagcctagttcttttaaagaagaaaaagcaacattccaagaatgggtataaattgtcagggacacggggtgaggtcgcagagagccaggagtagaacccaagccttctcctcatttccctcagttctctccctggaattctaaatccactggaccttactcttagaatcctatcttaatagcaataagggcgtccctttctcctgaacacggatattcactaaaccttcaccaaccgactcctcatcttccttgttcattactcccctgctcattagccttctctgtcttgtctgtctgttggcaggtcacaagcccttcagcattatttttgcttttgttgtctttcttgtttcttcgaagctcttttgtttatttctaggtctgtttgcatggcacctcttctcacctacatcaaccttctgtgctttttccctgggagcctcttgtttgcctgataaaggctccatttatggaggcaacacaaagcaattgacccacttattcttttcgcctca

SEQ ID NO: 52086 - DNA, 1026 bp, Bovine  19866880922182
atataaatactttctttttagcttttagaatatttggtaaattcagatcctaactgtgattcttcaacagttttattcaaatatagtactagtacttattttaacttaagaagctatctattgtcattcatgtagctctggatgaatgagttttaatttgaccctcaagagtcagtctagccaaataataacaatgaaaatgcatgagaacagcaatttcaacctggctatttcacagacaagcttattttatgcatcaatagcaaataaatcaagaaattggatggacttgctgaatgcctttcaccgctctaagtaaatccatctagctagcgtaacaagcagttctgaagattggaatgtaagcagagaagaaatattgattgattgctttatttagagtagaactgtaacaccacctatgcaaggcatttagcatatcaagctaggcagtaccatcttgttgctatacacttaactgcaagatagattagacactggtttgtggagtctggtcccataacttagagccatctctaacagcacagcagctcctactaaaggcattaacttcggggagatgcaagtggctgctagctggcacatttgctttccatatgcaacagtacaggttagcagagcatctgtgggaatgtcaaaattcacatgtagggtgcattgtttccaatcaaccttgtaggcacttggaagaggaagaaagccaaaatcatgcaccgttttcgatgtttggacattgttatggacacataatgggtcttccctggtggctcagaaggtggagagtctgcctgccaatgggtcaggaagatggacagaggagcctggtgggctacagttcatggggtcacaaagagtcagacatagctgaatgactaacactttcatttcactttcacttcaacataccttataaagttttctatagaagagagttatatctgaaaatcaaacataaatgatatcttcaattgctccaaagagtcgccttgaatattgtaacaggta

SEQ ID NO: 52087 - DNA, 1115 bp, Bovine  19866880962343
tggcagttcccaaacgtgtctgcactttacaatcacctggggggcttaaaaaaattagctgaggcccgcagccattcctgagatctgatttgtagggtgtgccctgggcactgggagttttaaaaaagatccccaggggttcctactgtgcagacacgtttgggaactgctggggtacagggaaggaaggaaaggattggtgagccggagcctgaatccgagccctgactcctgtctgttgtgcgagctggggtaagttacctaacctcgcccagccctgacttcctcgtctgcagagtggagataatcatgctggtgattttctcatctgtgtagtgaaaatatcatgtacgttacaccatcagtgacaacgcgcgtgatgtgtctggcacaggaaatagtagctggcgtcatctctcccaagggtaaaataacgtttagtccacttcaaagacagtgaaacgccctgtggatgattaagtgaggttggctttatgaaagtgagaataggtagggtgacaggctcgctgccctcacacttgccttttttttttttaaccccccaccacccacaattgaattgttcatctgttgctagcttgttggaaagaatgatgcaaccttatactcagagataaggccattgtgtttgtctgttttcccaggatggggtgagtcgccctagagttttgtgactaggatctgcccggcagatcaatctgagaaaaactgggaagtgaatgtttttggaaaggccagctggactccctgggttgggtgggcacattcactgattagagctggccccgacgtggtgggaagtaagggggtgggtctgtcattatgtccccacaccgtgcctgtcagctccttggtcctcagcgagttagagtctaacccctgattgtaatttttaatctaagaactctcttccactccttcaatctttattcacttcttttttgttttgccttcatctcaagaaaacaaaaattaacttcacagagaaagtaaagatcaatcatgtgaatgtatggcaaaaaccactacaataaagtaattagcctccaattaaaataaataatttccaaaaaaaaagaaaagaaccacaaaca

SEQ ID NO: 52088 - DNA, 1413 bp, Bovine  19866880984761
tagatgggaaatgatctaaggttaactacatgaccattaactcatgtcttaaaatgctccaaacaattgggagctgttagaagtagagtgtagagtgattttcatatctgtcttttagaaggataatgtgaagcccattgaaatacttttctagtaaaggtgtttttagcttacaaataactagactgaaaatccaagtctacaagagaacatgagttaatcctaacacgaatacaagtccaatttgcagaattacttgaaaaaagttagttttttatttgagtccctgaaatgtatctctgagtactatttaggacttcaggagtgacagaaggaaatgatgtagaaataaaactagggcatttggccattagtcagtctcataaaaactgcatcagttacttatattaatagcattcatcattttatttatactaatacattcattcatttgttcatattcaaatgtttaaatgtgtcctaagaggcattactattgcagcaactacaataacagctaaatggaatcatgaattctgctttccttacatggaaatgagtttatggattaatgttttatgttcccttgggatgtacttagtatttaatatttttaagtcaaataatcctgttagagtatattttctccactggaactcctaagaaactagaaaagtataaattaaatataccagtatccaaagatatagcacttatattttttgaaaagagatcttgtttggtcatttataaatggtcacctttgtaaagcgagaaatagccttgtttaaaaaaccactgacattgttgttctattgtcacatgctggtaattgaaaatgtgtttctgtcagttctggctaagatggaatgtaattccatctaagatcttgatcttaaattggtagcaagaaagccaaagaggaaaagcaagaagtctttacttgttctttgcacaagtaattttgcactgccctttctgataatgtgagttattattcttactgactcttggaagaaagcaatgcgcttctttttttttaatttttttttacagctcgcagctctgttttactcaattgatatggaagtgggtctccgcctggctttggaacacacatttgtaatgtttattttaaaataaaatccagattgctttgttagaacaagcgtctacacacagtaaatagctaaatccttgccacaatcttctcaggttcatttttttttcctgcaagaccgtagatttgttctagaacacgtgtaaccttataacctaaagtataacaatgattacagggaattagtcttcatctcaaaatcatggcttcagaataactcagactgttaccagcctcgactggataactacccgaatctgatgtttcagaatgatcacacccgaaatgcttat

SEQ ID NO: 52089 - DNA, 1044 bp, Bovine  19866881008724
caatggtcatgtatggatatgagagttggactgtgaagaaactttagcaccaaagaattgatgcttttgaactgtggtgttggagaagactcttgagggtctcttggactgcaaggagatccaaccagtccatcctaaaggagatcagtcctgggtgttcattggaaagactgatgctaaagctgaaactccaatattttgtccacctcatgcgaagagttgactcattggaaaagaccctgatgctgggagggattgagggcaggaggagaaggggacgacagaggatgagatggctggatggcatcactgactccatggacgtgagtgtgagtgaactccaggagttggtgatggacagggaggcctggcgtgctgctattcatggggtcgcaaagagtcggacatgactgagcaactgaactgagctgattggactggctgtcatgatggcagacagcagtcctaaggactgctctgagtttctggcttatcgcaagatcagcactttgctaaaggcactttgaaaattcctgctctaggaattccctgagggcagcacccctagaaggcatttcctttcccaaaaaaggcttgtaggttgttctgccccaccccacccctctgcattctttgaaaaggtgataacttagacacaggctcttcttcagttctcagaacatgttactgaaaaatgttgtaaaagaatttaattttctagaaatgtctgcgtctttcagaccctctatcttccatttgactttaaaacatgccagaatatgctctgaaacactgtatgtgaaaatagatgacttaaaaacagcgtagaaatgttcaaggcaaaaggagctaattaataagcagccttcctttctccttttctgtcttttcttcccactgagcagctctaaatacttgatgtggagttgggattttatttttattttttaaattatagcctgtgcatcgtgcagacctctccctgagacatactggcctggtacataaacagctgtgtgctccaggggccgtatatattttatt

SEQ ID NO: 52090 - DNA, 737 bp, Bovine  19866881037752
acgcctgtagacacatttttctgaacatttttctgacgtacctactcagtttgttgtcctttggtgacctgcattgtgggctgcaactcacagcagtggttgaatatacatttgtcattgaagggactaaaagatccccaaagtgttcctggcctgggtataataaaacagacagctgaactcgaactgactgaaatgctgtctagcctacagctacaggcaaagttaaggacacgagcatggcaatgcttataaattgactgagctatgaccaccggctccatggagtgtccaccatccttgtatgtgacttcctgaacttgaggttatcctgagaaagatcttcaccaggaagagcttaacagtccaaaagatcttccccaaatcagcagcataaactgtgcatttatacacgttctgagtatgtgtttttgtgtgtgtgtgcacatgcatacacacagtgacataacgactatggaaaatgaacgtctaagggcaaaaaacgaataatgatagttctttgtattgactcatttaatagaatcttcaagttccagtgtgtgggaggcatttgtaatccagaataagggttaaatgtctgtatttgcatctgagaatggaaattaggctctgccagaaacacaatgaacagcatcagtttctcatctgtaaaagtgcacaggatatgctagcaatctctccaaagccatctgtactgactctctcatgacagggca

SEQ ID NO: 52091 - DNA, 1751 bp, Bovine  19866881040880
ttagtgtttcttaagtggtcctccgatctgtgattactctgccctcttctgcattcattacatatgcatccaacaaagacccatgaaagaaaagaacaccgaaaaaaaacaggaaataacatttaaagtttaggtatggctaggttttcattatgtttgcttgttagtttgttattttctggcccaggacggagggtgttcttagttgtctatttctttaaatatgccaaggagatgaaattagagctgagtaatatctgaaattctaagtgatctgaatttcttataaaaattttaatttgaaaaattcatgcacattacccaataatcaaaactacaaggaaatatccatatctatttatctatctatacacacagcaaagcaaattctaaacagaacatcatctatcacccatctactcagaaacaatcaatatcataccttcaacatatttatgtgttcaatccataaatatttattgaaaaatgtactttatgccagactatcttctaggtttggtggtaaataagagaaaaattctctctcacaaggaacttacaatctgatggagagaaacagacttgaaacagaaaacaaattatgagcaaaataattttaccttgtagttaggttgctgtgaagataataagcagggtatacaaaataaaaggatttctgtttatctatctatctatatctgggagaatttcctgtttcataactactttgaaattcttgttcttccatttaggaaattatgttcctttttttaggagaagtaggggtcaatttcagaaatcttacacttgatgggcaatgtcaatcaaagcggttttcatcttcactccttgtctgtccagaagggaaacaaggtcattttctcttaacctctgacccacagagggatttgagggttccatgtacctcctaaaatagtgtgcaaacctttatacttgcagtttctagggtgtggtctagacatatttttaatctaacattctatgcaccgttgccgcaggaacatcctgacaatatcaggatgcatcaatatttattctaacatcacatctggtacatttggatcagctgaggtttgaagcaatgttttagagttctagtaaattttgctcctagttctcttggaaatctgcatctctcctctgtggtggggtcttcccatctctgcatatttttatttctgctcttgcaggatggcttttcttctgtacttgctgtgtgcatgaatcaagaatcacatacacacaaaatctaagttctgatgaatgcaaaaaagcagagctaaaaatggctacacaatcatatgctgtggtctagaatataataattttaattactgatcacaaaccaaatgaagtatgtgtgtgttgaaagctatgaaaatgagaagcagctgccttaaatccttacacgaacagagtttgtgtaaacaaacaaacaaacaacaaacaaacaatgatgaaagtggccttgttttcagggtactgcagcagacccttttgaattcctttatgtacacggtttttttttcattctgaaaaataaatgaaatcatctccttgtaattcattcttcccaatggaaaatgcactctctggtaactgtatttatgtatgcagaattttatacctcattgacattctcaaaatgagatctccagcaggaaaactctccaatacatgacaaggaatttttaaagtaccttcctactgacatgtcttacatactgaaa

SEQ ID NO: 52092 - DNA, 1247 bp, Bovine  19866881044831
caatagctttaaggcagaattggactctaagagaaagttataaagatataatagagagaagggaccaaaaaaacccccagagcatcaaaacatgtcagaaaaggaatcaaagaataaaggaaaatatgtgttatgcaatgatttttttctccttaaacctttgagtatgtatatttcttcatgcagaatcatatatcaatagtatgtatgtatgtgtgtatatatatatatcagtgatgcgtgttgaatatctgcctcctgtgctcaagataccatgataggaactatatataacctcctgaaactggtacagtcagtaatgatttcaggatggagcataattcacagggacagcagttgactagaagcagatgaccaagttattttatacccctgctactgatgggttgtgtgatctcagataagttccttatgttctactccgtggaattaaaaaaaaaaaacaaaaaaacacaccaataatacaatctatccattcttatgagatgtgcagactaggtgtcaagagtggatctcttagaaacctacagacttcaagtcccttactgctgccactgcaaagagaatcagatcaagcgtagcctggtgggcaggctcccaccaccaagtcccgcccactgcacaccaggctcatccttcaccacacccccttgccttttcctagcttctggtggtccctgagcaggctgtgcatttgcccttgctattggctctgtctgaaatgcttgctctctccttcttcactggataaattgtcaccatatccagggctccatgcttagccagcttctccctgagctgccagatctgggctgttgggcttccttatctctgggccccaggcacccctcctaccacacagtacaatttctcagattctgatcaccttaaaatgtgagactgtgccttatgcctcttccctctcctggttgcggcatacaacctcaataaatctggtcaaacctgaggatgagtaggaaagttggccagcaggaaaaaagagatagatcgagggatttcttgggacaaggtgctagatgtaagcgttcaggagttgccaaggaaccgggagtgttttggggtggacaaaagatagtgtgtgggcagcaaagagactcaaaatgatgccagtcatccacgataattaattcacattctgctatgacaagacaaagcaggatgcctgttctccggctttccctcacaaatcccggagagaatgaagt

SEQ ID NO: 52093 - DNA, 998 bp, Bovine  19866881116599
ttaattcttcttgtcccagtttctaggatacagaaagaaatgtagacttgtccaagggagcagcatgaataaaaaaaactttgaattatttttaccaagcacaaggctagcgagatgactcagtaataccaaggccaggcctcaatgtccgttactaacaaatactgtaaaacatttaaaaagaagtctctctccaggaactgagtaagtgggtaaattaaaaatcaaaaggaaaatgtcaattaagaaactggcacaatttgacttggtgattattgtgtttcaatatcaatggtaatattctgaaatttttttcacaatattctaaaatcaagagtaaataattagggcagagaggccttctccaaccccagaccagcaaggcagcctctgaacaggcaggtaattgtaggtctgtgtctgagtttagtgcaagactgagccctacagggcttctcttctctagaaataattacccatcaccacgaaaggggctcagcacacattcggagtttatagaataatcaccttctggtcctttgggcccaatgtacaataatctatggggattgttgagaaatgagcataaattatggcaaatttattaaatgtgaattctgggtatgcaagataacaaggatttggggaaaggatatgaatttcaaattctcagcaggtggatgtgactgagggcgtagctatgctcttctcctaattttgctcttctatggccaaccatccagcaatcaagctccaccttctctcccaggaccgaatcagagtccaattagcatcaaattacagttaccagctctaaactatctgtacatccctgaacaaccataatcacagaatttccttagactggaggtactgcagacatttaattttaattacttcagcatggaatcagcaacattatttcccacaggtattttattacctgttcttttcatgtggatgaacaaccaaaatgtcaattagaagagggctatacg

SEQ ID NO: 52094 - DNA, 3581 bp, Bovine  19866881119587
caggaggagaaggttgggggcctgcaggggacccctcacccaggttcacacaggaagtcacactgctgagatttgagcctgggtgtccgactgtgtgttccttcttcttgcccgccctctctcaactgttcacgtgcctgtaatggtaaaggaatcgaggatttttaataaaaacagtgtagaatctgaaagcttttatgagttcagagttttaagaaagaacaaaaagtgccctatatgaagccctctcaacagactgaggccagtagatgcaggctggtgcccgagaaggttccttgccaggaccgtctaatgtatttcctatcttggacttggtctggtctgggatccagcccgctcctctctgggcgtcctgtccagctggaaatgggtctgctttgtttccagttaggaggtttgcagattgaggaacagaatctgggctgcagctttcattgtgttgcaggtggcgttgggttacaaggtttcttttaaatctaccggttacatttctgagcttgtctcttggacatggttctttaagagttcccactactaagtgactttttgcattgggaatagggtgagaaactagaattttggattttggcatccatagtttgggaaatggcatagtaaataagcttggaaagcttctcaaactggtaaaagttaaggatttccaaaatcctttaaagagtcttcatggtgatgaatttttgtgcaacattttgttgttttttaaattcaaaatagctttttgtcttgtgaaaagtgttctctgtgttaggattttcatctacaaggaaggtaacagtagtgctttcttcatagaagattatttggagaactgagaaattgatgaagtaattaacatagggtgcttagaaccctgcctgccaggatgcgagttcaggaagcgttagttcttccttccctgtggatgggatcagctttatcaaatgatgtaaaacgaggatgatgagcatggagctgtgagttgggctgcaaagtggagttcacagtccactcgttttccatgagtttacctctctctgtccttccctctgatgcttcttccctgtttggccaatgattcctcatcattcactgagactcagcaaagcgttttctcggagcactatgcactctgtcttgtgcttccaggcactttgtctgtatgtggtctgtatcagctgaggcgttcattgtgggatatttagttgtgggtgacttctccatcacatggggagggcttactttcttttcgtacctcttccagagccaacatggtgccttgaaaggccgttcttaaatggtggttgatagaatgcatgaagtgtccattaaaattgttctcatatttcttcatgtttgacattataccatgattatgaagttgagtgatcctttgccgaatatttgactctctaagtggactttatgaataataaagtgctaaaaaacagtagttttctccatcttaagtgtgcaatagtaacaacatcattatactgtgtattaatctagactcttgtctggaatacactttttattcattttgcaacttggctaaatattggagggccttagattcttcaaggagaaaataaaatttttctccagtgattgccagtgtcttctatcagcggaggtgtcaaattcctctcatggactttcctcttcaggaggaagtgctaggagatggttgatagaataatagtcatatttaccctcaccactatggctagccatgagactgatttaaaatggattttactatgctctcagagagtgtttatacatataaacagaaaccaaggaggaccatatctggaatgtgctgaaatgaattaacttatcaagtgtgttggtggcatttgaacttggggatcagtacctaccatatgaaggcatgaaaccctgatgaatgttagccaaaccggaaccgagatacttactcattaaacggttcctttttgaactttccctctggaagatcctaatcattctatggaactgtagtcatcggttgtaattctcccttcatgactgtctgtcgaacttcttgttgggaagtgcactgcatgtcatgtggggaaattacttcattgtacatgagatgtggaagatgagaaataccacagaatggatgcattcattatgtatacttccaacccccgagagcagctcacttaaaaaaaaaaaaaactgtcttctgtatcagaattctgttgttataactagagagcactggtctcctccaggccccaggctcacctcacatgtcatccttctgaggctctccctggccttttcctaacacctcatcttttcttgaaatgttaccactccgtcctcaccatttttggaattcatcttccgaatggctgtgttgccaaacagcggttgtatgtgtatctgcatccttaatcccttctcagttggagtccttattaataaagtaaaagtgatcaatccataaggtttactttttgaagtgttctggaacatacatgacttttatcaatgccttcacttttctccattctgataaacaacaaggattaactgtttgaaagatacttgtatgtgtttgtttgaacgattcttgtattgtccagtcagagatgataatcatgctatattgaaaaaaaactggggttctgggttttggatagatttaagagctctgcattttgggtagttttgccaaaaatagctgtgtgatcttgaacaaaacaggacattctctctgggtttctgtttcctaatttgcaactttggtggccagggaagtcacattggactaaatgactttttgagatcctttcagctacaaaactcaatgattctgtgccgtgataggatataagaaagcagaagaaaaatgtataaaattttaaaaatagtccttatattatgctattatgctcactagcatttgggcctttctagatgacgggtaaccatcaccctgcactagtaaggaaggcaagatctgtgaacctgttcgtcaagaatatatatatccagaatgtgtaattagacattgctgacccactccagtactcttgcctggaaaaccccatggacggaggagcctggtgggctgcagtccatggggtcactaagagtcagacatgactgagcaacttcactttcactttcctgcattggagaaggaaatggcaacccactccagtgttcttgcctggagaatcccggggacaggggagcctggtgggctgccttctatggggtcgcacggttggacatgactgaagtgacttagcaggagcagcagcagccatgtagaatagatgtagcacaaagtccccaggtagaatataagtaggaggtgtatacactgggtcaaggttaagctatatgagaatgttgataaatgatggcactgctgagtcttagtaggacagactgtgaagagaagccagaagagactttagagagaacgggtcaagtcttgttaccgtctcttccagatggagaaagacagacaggagttctcaagcttgagtttgtataaatacccctttggcagtgcacgttcctgaaagtca

SEQ ID NO: 52095 - DNA, 1225 bp, Bovine  19866881163229
aaaatgtgtgggctgagtcctgtaaaagaaagaacttcatttactacaaaagttcagaactttcatcattttaccgaggacgactttctgtgtaacaaaaccttttaaagttacctgaggtattttaggcctctgttattcactgtagaatcctgaaagccgtgctttattcgggtaactgattttagggtggttttatttttggagactggggcggggtgagggttgggaagcacagatcacagacgtgcagcctattgtttgggacatttgttctagcgttgaccagacccttcctacgggaggaaatgcagaggtgggaccgtttgtcccttcacagcgagcgtccctcaacattagaaagatgaaagggaagcaaagtaaatacgctttgcctccgttcaaagtccgtcttctcctttttctgcctgaagcacttctcctgggcccattcagtgcccttccattgcctcctgcaccaaagccgcccagtgtcaccgatgagtcaattacagagggaaaaacacacaaagccattacaaggaagcaaaaaagtataaaaggcttggcaaaccctcagaacactgacacacagctaagccacaaaaaagcaaggacaggaatgatttctgtttgaaagaataagggtcagtaagtggaggaagctgagatgtgactgtttttcaagtaagggtgattggaactggatttgaaatgagaagttctctttttttttaaatgatacttttgtttatttcctagatgagtatatttttagcatgtttcttaaagagtgaaaatagtagaaaatacgtcaatgatgtttgttttataccaaatgccaccattaatgttctcagataaaacaacctaccagggggcagggaggagaaggatcatagatgagaatggcattaaattcagtcagggttttcgtttccatggggagcccagtgagccaaaggctgggggccgaggtttggaaataataatttaaatgaggcacctcacaaagtggaaagaagatagcagtatcagcctcataggacataaagtcagcttcccggcctccattctcccttccttccgctccctcgcccccatacaccccccagtccatcctcaagatgccgccagagtggtccttcccgggcccttcctcagatgacgtcttcccccctgagcagcctgcagtgtcttgccctgtgactcagagtaaaagtca

SEQ ID NO: 52096 - DNA, 1585 bp, Bovine  19866881187514
actgctgttagcattccctatcagcatctcatttcttttttttttttttttcactttgggttgagtaacctttatgtgttgatcagtctgtgcagtctgtgctcagcttcccaattataactcttttcttcccattaaccaatacattttataaattacagtgtatctcagacttgcagacagcctgttcatcttaattaacaagtgctggcagtgataaattacagacggccaaaatcagtataaacaatatgacactgcattaagttagcacagtgctcacttactagtgaatgttggactcttaagtgctttcctctgcataaaaagcttagaattcattctccaaaatgaaggtcactcttttcctttcataaaatatactggcatcttagctattgctgtgaaatcttttttttcctctctgtctccagccataagcatggtacagtttgtggcctgttctttcacatttctgtctcatagagaataaaggaatactttgtttcagtggttgtggtggtgaaatactgtgaaagtaggcaaaagcagagaggtcacatgtgaaaacttagttctaaatagcgctctcgtgcttccaaaatctgcatatagaacagaacctataatgttaaattcatgagctatttcccaaagaaattctgaactggatttcatgaaaatgtaaagtcagttttccagacaagatttatttatatcaaatctagcatttaaaaacagctttacaacttataattcaaaccaagttatacacgaaggtctatatttagatccccaagcattatggaagctcctcattttccataccttttgtcagcagccttcagtatcttaactctcttctgtcagtcgccttcagttgaaccccaacaaggtctgatgaggagacaccacattcatgaggctcagttcacagcttctgaatattaatgataaaactccaccaagttaacttgcagatagcaacgagcaacacagaaatctggagaggtgaaaactgctgatggtgctagaagataaataccaggttctccatctcattttttgagctgtgggagaattaagacaagagaggcggggaagggagggagttgttgttaaaacaggatttgtcgaaacctgaaagctgaaaatgctcttgtgtcacagtatacagaggaggaattatttgggtgctgacagaaagactttcttttcttttaatattatgttttagtccatagttataatttatttttgaatttttatctatgttgggagatacagtttattacttaatgtccccaattaaacaatgtggtctgaaatatttttaactagattgtgctttgcaaatgatagttcagtgagactttctttttatcctggtgcttctgacttgtgtgaaatcaagatttacaaaattggtagctttcagactaaaaattcaaaagacaggtttaaacatatatattttgataaaagtaaaaagaaaatccagtaccagctgatgactagaatctgatcagtaaacctacaagtgtttttctaggaagggtaagaggtgggtatcctgaattttctt

SEQ ID NO: 52097 - DNA, 1464 bp, Bovine  19866881353124
ttaagtttttttaccccgttacatcgctactggcttgcccacgctgctactctaagttcaagaaataaaaccaccccatccctgctgttggactgtacttcacaactttcgaaatatgtgatttactgactcagtttcttaagaggggccaaatagaatgaaatatcaaaaccccagaaatgttacatactccaactgtgaactgccatatttctaataatctttttcttgcagtatcatctttcagaaagaccagcacgaaaaaacgctggtagaggttaaacgactatatatatatatttgcaaaatttatccaactgtgcgcttcaaacaggtgaatttttttgtgtctaaattttacttcataaaacgtgacttagggagtgggaaagcaaactgactaaaatgtaagctccttggggacagacttggccttgttcattcactctcatatcccacttcagctctagtacaaaggggctggtttcatgagtgtttacagaatgaatatctgcaccctcgagggtgagactcaacaagtaaacttttaaatatcgaacgccatgaaatggatactcttccaacctgtttaccaataaagtcccggcaagtttaactgcataaaaagccaaatcagtcagcacgtgcatgtattccttattggtaatacaccaagatttggaattccacaagcgcctttcaggagacgcgaagccttccaaagccagtgtttgctcggcgtccgcacagcctgccttccaaagcccacggcaaacacccctcagcaaacgacacactctacacaccccctgggcggtggggctccggagttctctcagagcaaagcggcagaagggtctgacctacggccaccgcacacctttgtgcctgaaccccgtcgcccgcccgcagggtccgcgcgaaaccccctcgactccactcccccagggacgcgagggagacgccggggaaacactgataagccacctgtcagccttaagtccagaagaaaattctgggatagctgcttcacggcttgcagtctaaacaacttaatgatttctcgaatcgtgggtaacggcgggagacggaaagtgccgagcgtcctggaggaagccatgaaccctgaactggctgtacagatcccacgccggacgttcctccaaggctcctcaagtgagggcagggggaggagcctgggagaactctggcccacctccgagcctacgtgattggttagaagtaccccgtcggaagcgaaggacgcgaacaggaaatccaggcgcacagaaagcgcatgctccccgtcctgctaagtgcagggcaggctgggtaaccgcgccgtgtttgcacgtgaggtgggcggaggccggagcgatggcggggcggggagaggcggggcctgggcctgaacgaggaggggcggacccaaggattgatgaatgaagttcacctggtggagga

SEQ ID NO: 52098 - DNA, 887 bp, Bovine  19866881373395
tgccatttcctcctccagaggatcttcccgacctagggatcaaacctgggtctcctgcatcgcaggcagactcttcaccgtctgagccacaggggagtcctcttgccagtcaccaatgcctgcttggagacagggctccatagaaaaggatgctctcttgcaacaagtgaaaacctgtgctctcctcccaaagtcacatgaccacagagatgcagaatcagatgcaggaggtgctccttcctcagcagcacttgccctgcagagccttgggcagagctgaatagggagcccggacttgtcaacagcaggcagactccataaaagctggactgcccagacacctgattcccagagcatttactcgagggaaaagcagagcctttttttgccacctgccagaggaatggcaacacagaacttatcttttcaacagtcaagggacaccgctttctcttccaggggagaactctgcaccgtacccacctctatttgctttaaacctacatctacaatacttactctgaactgcgagggggtttcaagtatgttaaagtcagacgacgctgaaatcccatcctccagggtctcgagaaacaccttttgaaattcaagcatctctggcaagcttccaaaaagtgactccatctgagtgaagaccaggatttgaaaagagggtgttagcgatgaagatctagacaccgctctgaactcccagatgtacaaacgaaccacagtcattcaccaagaaggagacagaagtaaatcctttaaagaagacagcgtattcatgaggggacagagttcatacacagagggtcatatacatctctggtccctgtaattctagaatacgtttttaaggggatgtcaagttttcagaattcaaa

SEQ ID NO: 52099 - DNA, 1664 bp, Bovine  19866881384782
gaactcctatacatagcaagctctgaactgatagcctttgcttttctccttaggtgatctttgtttatttccacaaaagggtgatggagtgcccaaggggagctactccctcctcagaaggaggaggttccttgtgagccccaggagcatggagaccttctggcttgtttccaaatggctcccgggggtgagacactttacaatcactctaggatgtcaggagatcagaatgacatctacgacatttttgagcacattctacctgccaatgtaagaccataagacagcatggtaacccactccagtattcttgcctggagaatcccatggacagaagagcctggtgggctaagtccatagggccgcagaagagtcagacatgactgaagcgacttagcaggcacacaaaggactgactaatttccattctgccctccggtggcctttgtgcctcatctcttcttcccccttcctcttgataaaacctgaattcctcagccaactgctagtccagaagatcaactcctcctcctctaaggagccttttttcagcacctactcccaaaactagctgaacttccactgacctctccttgttcaagccctgtaaaaattccatcctttcccccaaggcagaacattccttcagtgccttccctggctacggattttgactaaagtcttgctttgcacagagctctgctagactgtcttcaacattggtctaaatgctttacatattttatttaatctaattttcagaacaactctcaaagtaggtactattactattcccattttatagaaggagaaactctggcatgaaaaatgtacttgggggtaacttccaacacccagggtatgcagagaaatactctgaatatgctaatatgatgaggggtttcctcacctcatcactgttgacatttctggcaggataatcttttgtcgtgagggggccaagaaatagaaacaaggagaggattagcatttcctttttacatcattttagaattttatttttatttcacttttaaaaataagcatttcttagttttttaatttgaaaatcatcaagagagaaaaatttcaagaggaaagaaatctcacctttgttttctcagcagccacaattgcattactggttaatattgagctcatgattaattaaactttacaagcctttttatattatacataaatcgctttgtctcttctagcctatactcaaaattgattttttttccaaacaaaattcagagccttatattcaacttgtgataaatatcacattctatgttctggtctttcattgcaagccggcagttgtttaattttgactctctcactcaacttacaatctatctctcgttatttatcctctgtaatattggccactgcatttcaatgccaaaatagtgctgctgaaacagaatgaaagagtcctgttttacttcactagagacttcctgcttggaagtggaaacacatctacaaacattaatttaaattgttctaccagctgagtgtccctgcacctaatccttccacttgtggggccccacagctggtaccctactggtgccctgcttgaccgtaggtggtgggcctgatcacctaccacacaatcctccaagcatatcccaccagaatcattaagtgtc

SEQ ID NO: 52100 - DNA, 686 bp, Bovine  19866881449602
ttattcctttgtgaacagtgagcatcaaacagtcctaaaaaaaataaatagagcaaaatatgtctcaatatttctctagagttagaattataaaatactatcagaaaagggcactttatataccataatagtcattatataaagttcagtttggcaattccaagccacatttaattttctctgaaaattcccacatggcagagaagatattggtctttgtggctttcaagtctctttcggggaactgtaaaatgacaaccttttagaataagcacttcatccataaataaacactaaattacttataccaaataaagtcacctgtgtattttcattaacataaatactaaaataataagtagctttcctatataaccatcctgggatttatgaggtttagaattctgcattttagtttagtacaaactaggttagaacttgcagttcttcatctccactgataggtggggctaggaatttctgtattaattataatattttagcatattaaaatttatatctagatgaagcagatacttcaaagcttcaaaactgatgaaactgcatacttctcttttaagggataaaactgtttgcattaatatgtgaaatacactactaaaacaccccctgctgatttcacaggctttgcagggagttatgcataattttcgaaaattaaaaga

SEQ ID NO: 52101 - DNA, 1191 bp, Bovine  19866881483137
cagcgtgtctcatccagctgtattgtattttcatcttcccaaatctgcccctgtcccttccaaggtccgatgcttctaagagtcattttttgtgctgtgctcaccaccaatcttccccagaaaccttgagtaacttaaggcacaagtttcagttctctttcctaccatctatcaaggacaattgcacagatcctgtatccaacccctgttatctcttgggccacaagagtacccagtgttgtcaatcctcaggggcaggtagatagttctggagctccagtgaggatacacacatctacccacatagtaaatcaaagaacaatgaaccaaaacactcaccatcaaaaagaaacatgttttcttctttttgtctttcctcttctaatcttgatatcaaacatatcatagtgaaaaagaactatccagatattctttttttttgctgtgccaggtcttagttgcagcatgtgggatttagttccctgatgagggatcaaaccctggccccctgcttctgaagcacagcatcttacccactggaccaccagggaagtccctatccagatattcctgcatcccagtaggacaaaattcagagctcaataccaagtacaagtgttttatgttagaataatgagcttctctggatataaattgggtatattttggtataatacatatatgtaacatgtatgctaatatattactatcaatatattataatggtgtatttttctgcagggtaggctataacatatatgtcttagtggttgtaaaagttgatgtcactcaaatctaaaacattttttcaatcacagagttataaatgatattatcaatgtagttgatgctaacatttgctaaaccaacttttctaatgatattcatttatgacacaaatacaacagtaaaaccaaatgcgggaagaaatagaaataggtgtgtaatagaaaagagagggatacctaaggatataaatttaatttgattttggctttcctgtagagtcgtttatggtaggaccttactgctggtagctctggtgatctaggaaggaggttctccagttttcctctccatggctctcagctactcgtgacctgaagtcaatctcagactgaaagtgaatcctcaggatagtggaatacagagctatcacagataaaggttcttcactctgcacactcaggg

SEQ ID NO: 52102 - DNA, 1533 bp, Bovine  19866881957537
ttagaacaggaagtaaatgtatgtactttcaatttctttctgtctcgtaagttgtggaaagaaagaaggcaagcttgcaaaggtggcctgattctcacttgggcactgcctgacattcattgagaagggatgctcttagtcctcaggatggagtgggcagtcgcccagggcatcagggagccgactgtgcggagagcagagggtggctagcccaccactttctgactcctccagagacagggctgtgcgtgtggggctctgaatcccatgctctcagacatccaatatttaaatgtaagtggaagaatacgtttcaaaacgaacagagtgcttttggcaggggatctcttttgaaattatccataactcgagtcctccattagcactcttaataaagagttggctttgtctcgtggtgacacggggctgttctttttttccagcatgtaaaagctctagctattttaactgtggcgacagctatttttaaaagctcctgggctcgttcttaccgaaggttccttgccagaaaattgaggcacggggcaccggacctgccactcctccgggtggtctctgcagagggtgatgttgtgcagcaggagactctcgggggtttggcctcgaacaatccggcttgttattaaaaaaaataataataaagccctcagattcgaaagtgattttgtgccttgtgattgccacggatacatagactatgacggactctacaataacactttcactgtcttgcaatctgggctggggtgcatttccctgagcttctttaaaaataggaatttaagaagcttcaagcaactttgaagagcccagaaaagaagtgcccctcggtggtatcctgtgttaaattgaaagtgtctacattagagaattcataatgaaggaaattgtttgaacacatccttttgtagactgttgaatctaattaggttacatcttgtcctgattgctgattcgggctaattggctaactgtactatttgggtcttttgtgaatttattgaacttcttcccttcctggtttgtttctgagcaccttcaagttgtcaagtgaagaagtcaaaagaagtgccttgaataatggtatgtgttcccccagtgacccagagcaggcttagtatttgacggggtccagaaaggtcgatgtaaaatgtgccttttaagatgatattgttgaattggagactgaaagaagaagttggccttcgtgaatggagcactggatcaagagtcctgtgatcctcctatattagatttcctacacatgcagtatcaactgaccccggacaatttgcttcggggcaaattccttcctttatctactggtgcacaggctgtgacgcgtggggtactgaggtcatacaacctaggcgttgctcactttctaggtgttttgagtaaaatacatgggtttattttttgaggaacatggtccttgcagagaaagcttagcatcacatgaagctttagtgtgtgcttcgcatcacactaggctgctcaggtcctgggtag

SEQ ID NO: 52103 - DNA, 1041 bp, Bovine  19866880506414
agttggacacgactgagcaactgatctgatctgatctgatataggaagcattgaagaggaatggtgtgtgtgtatgtgtgtgtctatgagagtaatgttaaacccttttttcccatagtgggaagtcaatgagtaataatcaaaacttaaaaaaataaacaagaactgtagtttaaggctgttatttagatatgcagaggtaaattcccaaataaagagtggtaaaagtggctgactgaaatttagagtggaggatggagagggtatgaacatttccattataagattcatagagttgttagatttttaaacttatatgttcaacttagataaaaataaaagttattcaataatacaattaagcaaattaaaagaaatattataatatcaccagtatgagacatcttttaacaggagagtttagtggaggtgatggaattccagttaagctatttcaaatcctaagagatgatgctgttaaagtgttgcactcaatatgccagcaaatttggaaaactcagcagtggccacaggactggaaaaggtcagttttcattccaatcccaaagaaaggcaatgctaaagaatgttcacactactgcacaactgcacttatctctcacactagcaaagtaatgctcaaaattctccaaggcaagtttcaacaatacgtgaaccaagaacttccagatgttcaagctggatttagaaaaggcagaggaaccagagctcaaattgccaacaccagttggataatacaaaaagcaagagaattccagaaaaacatatgccttattgactacactaaaacctttgactgtgtagatcataacaaactgtggaaaactcttaaagacatgagaataccagaccacctgacctgcctcctgaggaatctatatgaaggtcaagaagcaacagctagaaccatgacatgaagtgacaggctggttccatactggcaaaggagtacgtcaaggctgtatactgtgaccctgcttatttaacttatattcaaagtacatcatgcgaaatgctggg

SEQ ID NO: 52104 - DNA, 4399 bp, Bovine  19866880511075
cttccttctataatagttccctttgtagatttaatcatgttttcactggtgttgcaaaagtaccatttaaagtcttactcccctcccatgaaaccaaggcagaggttggtgtgtgtgtgtgattttattttcaaagaattttgttggtagatttttttaaaagctgcactagaggttcaactagttcatttccctttaatgatttactcattctacacagcctatatttcaaacagacagacctctgagaaggaaccaaggcctttcaagggtctgtgttgtggcgtgctcaacaaatttctggcagccccgctataggagtcagtgctcatttcctcacagctgtgaactcccttgcactccacacacaacagcactgccttgttgcctggaagactttctttaaagatacttcagagactctgctcaaccacagaggtgttcttgaatcctgaatgtgaaccaaggcaagctcccaccatcaaaccagactagcctaggacactactcacagtacacattctgggcaagtaaattgaactctccagtctttaagttgtttttactgtctccagccagttagatggctgaagggaaatgctaaccgacaaataatggtttccaaaggaaacctcccagttcaatgaaagagtgtgtcttccttattatgggagatgccatgtcacaagtgggtgttttgtgttcagttaaattaaaaaaaaaaaaaaaaaagattggtcttaaaaactgttaatgatagaacacatggcataaattataccgtaaactccaaacaactctgaaattataaacattgcttagtcaaggcttttcttataatgatgccctgatgtctctggcatagcccagtgatttcagtcaatattattttacttgaaaggaggaatttcttttccaaaaacagtctctctaagaaaacctatcttcccagctgactttatgaaacatctttctccagtggcctgtatcatgtcttgcctgtccaggaccacagggtgtgagatagcatagagagctagcagaagagagtcatatgatgaggagaaactacaagcttggtcctgacataggctggaggctgactcaagtcagtggcagctatgactaaataaagactgtcaggactctgaaccagcatacctgagacttggtgcagagtaagcactcgattcagaaggtcttccttggtttgcctatcagaacaattctccagggcagcagaaacaaggagatgtcttttaaataagaataatatttacatggtttataagggtgtgttattaagtacttactatagaccagccacttgtccaaatactttatgtacaatatctaatttaatcttagtcaactttgagataggtactattattacctctttattaagatgataactggggctcagggaggttaaatttctcccaaaatcatgtagcaagtacaaggaagcctagattctagcctaggttaaagtctatataatgaattattaacagctatgttatacctctttcctgaggattaattaacaaaatgtgtgtagaagtgttttggaagcagcacatgctatgcaaatgctagtaaaagtgctagtcagaagagcagacccattccacctcttgatagctctaagttttgttagtacttgtagagcagccctacagtacgagagaaccaagttggaggccagagaccaaagaggagactcatctgtggtcatcatggtgaaagccttttcttttgacactggtctgtaacaagtgctccactttccttcaacctaatttaactagagcccccttcatcatagtattttctcaaatgctcaccccaaatgatatttttacttgatacttgtcaagctgtaaatcacacaactggttcgcagaagaaagatgagaggccatgaatggtttgattcagtacattccaatgctggaaagggatgtgtgcctgctcactattttatggaaagttagcaccatatttgggcatccctggtggctcagaggtaaagaatccgtctgccaatgcaggagacctcgggttcaatccctgggtcacgaagatcccctggagaaggaaatggcaacccactccaaattcttgcctgggaaatcccatggatagaggagcctggtggggtcacaaaagagtcaggtatgacttacagactaaaacaaacaacagcaccatatttaaaaacaaaggtttgctgtgatatgaagaagaaaatttaaattaacaagaatgttatttttttaattccagaacattttttttcctggccagaaatggattagggaatcaatctagccagtgcacctcttcaatcagacaggtccctgccatgtgggtatgctttagcacaaatgtttcatgagtctctgagttcattcataaggcagatctccctaatgtcatattcattcactcagtgaatgatcattaaacctgtacaggtgctgtactatttagattataaacaatcctcgctcagaaggggtcacaatatagtgggaaattacaggagacacaggttcgatccctgggttgggaagatcccctggagaaggaaatggctacctgctgaagtattcctgtctgggcagaggagcccggtgagctacagtctatagggtcacaagaattgggcccaacttatcgaactaaaccaccaccacatagtataaataaaaatcataataaaacttgattatgctgtaagaatattgtgaattaactgctaaagtgatgcaggagagggagcctgtaattgcctctgactcaggcaagatagggtagcgtcagcctagctcctttctgtgttagtcctacagcaggcctcagagaagcaagaggtaattttggttcctaatttctggttcatttctcagtaacaaactgggacatgttgaaggctatagaaatagatgtttaaataaaatccagtcttttcacccatttgaattttagtgaatgatgaattggcagtcacagggctaatcccaggtttcgtggcctcaagaaaatacctgcactccaccttatatgtggcaccaagtccagctctgagcagattcagaagcttttattccagtggtactgcacagtcacataacacagtaagaggcttttatttttctaaaaaattatttgtgagaagtatggatatgtcacaaatataactcatgctcctgagtcgattccattgcttaagagctatgtgagaagttgagcaaggtacttagctgagcctcaactcccctgtttgtaacaaggataataagacagttagatctaaatatagcatacagaggaaaagtatttttcaaaccttaaaatgttatacaagcaataattaatatacaatatttctttcagctagtggtcactgtttatgttcccaagagacttttgtccgcaaaatcccactaaggagaccaatggtggataaattggtctttagaagatgttttggaaatgtatgtccaatacagaagctctgaaatgggagcttgttttctgcccatttcacattttcagcagattccagagtagcacttcctaatgtgattctgatagttgatcagtgctagatcatttagaacaatgactgttgaaaaaaaggtgcttaccatcatcaccaataggaatttgtaataatttggatttcagactttttcctctttctacttgaaaaggtgaaaaaaaagcctttgtggagaattttttttttttccttttcaatatgagacttgtggctcaaaactcaatccaaaccaaatttcaaatgtggaattataacccctacttctgaatggaaaccgtggagccccttagccagagtggcaattggcagctctgccttgttctctaggacacacacagtgggatgccaaccaagaaaaagaacaggcaaggagcacgaggggaaatgctaaaaccatctgtacagagttggattttatatgctgctggtacagcagggtccttgttatcttgcctagagtccatccccctcccctgactacaatgaaaagaagaatcagtaaacctctcttaccatattgatttcagagagtcagtgtggttcaggggagggcccatcagagtggggatcaggagacagggttctagcctggctctgtcattaatgcaccctttgcatttatgaaaatcctattaaaagcctttgcagtaggcccctggtcctctctgagactcagaggcatcatctgtaaatgtgggatgtttacagttagagtcacttcagatatcatggtgaggaaaacacactacaatgtatacagtattacttcagactttctgtggtagaaagagcgacccaggcctggcctctccagatacttgaact

SEQ ID NO: 52105 - DNA, 1491 bp, Bovine  19866880572195
ttggagacaaatattttacacagatttctacacatgtggtttgcacaccaagcaatcaggaactggagaatgctgtgtatactgacaattagtttacatgtcatatggtgtaaggtagtatgtagaggtgttacaactatgcttatctccctggccaccaacccaccaacagcataagcaaagtagactgtattatgtaagaaaagggaccattatctgccaaattctcaggagacgcaaccttaaataatcttcttttgaagtataatagaatcattttttcatttggttataccaaaactgtggttataaaacaaatgatttatgttgattaatataataccttaatgggcttagctgtgctaaaatttaaatgaataacaaaatatggaaaataacagatgcttatctctgctcagtcttaaaatttcactaaatgagaataagaaaatgtggtttaaaaccatataggcaaagtgaaagggtagaagagacaacagcagataagagacatcaacaaatttttgaaaaatgaaaaacagaggaaggaattagcagagctgagaaaactgaacactaagggcttgcagaagcaagaaataataataggcaggccagttcacaaggcaaagtcctgacaaagctcaagaaccaaatgcaccaaatcactgaattcaggagagaagcataaggcatcatatgtgggagagggagggcttgagagtctgtataagaagctttgagagtaaaattgaagattaaaagcttacttatgtactggagaaacactgaataaatcctagcagaagatggaagagaagtgccataatgggaacaagtgaattcagtaaaaatctacatactaaatggtgagaccacacctttttcccctcataagaacctctttatatcttttatctccaataacagtggcaaccaggattatattctacaagtaagaaattggaggattcttctgtgaacaaactggatagatagccttagacatttgcagtccaacaacaagatggccagcaaagctcctaatttttcatgctctagataaaatacgccagttaaaaagcccacccatgaaaatgagtttccaagcatatttttattgccttgcttttaaattaaaacacgtagacttaagaacttttccaacataaaagacagattaaagaaaaccaaaacttgtgggaaacaaagataatacagggagcagaacaaaacttcaaaaaaattatttttatctttggagagctgagtagatattgcatcaaagaaataagagcaaatttaaggcacaatcagagtgagaaatctcttaaaaatttaaatacagcattagtaaaaaaaatttaaatatttgagaatagtgactaatgaaaatctgatataaaatggaaagaaaacaaaaatggaaaatcagagctaaataaataaaaataaggcactcaatccagggagatcaatatctgaccaaca

SEQ ID NO: 52106 - DNA, 2856 bp, Bovine  19866880577207
tgatcttcccatcggaattgatattcccaatgggattgaatcaggtctcccatattgtgggcagattctttaccagctgagcccccaaggaagcccaggaatactggagtgggtagcctatcccttctccagtggatcttcctgacccaggaatcaaactggggtctcctgcattgcaggcagattctttaccaactgagctatcagggaagccctaaaggcaagtatatttactgcgttcctcaatcctcagttcctagaactgtgcatggcaagtagacagacaaggtagaaagaatggctaagtttgataaaatgcatttatcaactaattttgaagtgtttcatctcataggatagtctgaatttcataaattagcaaactttctgaaagaagaaggattaaacatatcttttttttttcctgttccctcctaagggaaaaccaggtccaaaggggtatgccggtgaaccaggaccagaaggcttgaaggtaaagcaactgattttcttaccagttacatagtataatttacgaaaagataaatttatgactttcagaacaatataaaatgaacacatatcaaagattttattcaattcccttaattgagggaaccagttgtatgttaaagctggttcaaatagcatttgaaatactgtatgtctttatatctttatctgtatctagatatatgtctgtaaatatctatgactatgtctgtaattagatatgcattttaataaagaaatattaagattggtggttatatataggacaataacgggcttcctcagtggcccggtggtaaagaacccatctgcaaggcaggaggagcaggagatgcagattctctccctgggtagggaagatcccctggaggagagcatggcaacccactcaagtattcttgcctgaagaatcccatggacagaggattctggcaggctacagtccacagggtcacaaagagttggacatgactgaagcgacttagcatgcacgcacataggatagtaaactatgactttaggggctgtctgttccactggtagaaatctacaagttaaaaatctataatgtttaaatctacatttaaaaaatgtgtctgtgtatcgtcactaagtctgggtcctctaactgaaaatatacagtgagtctaagtacatactctggatcatcattcggtatttttaagattttatgacattttaaaaatgtaccactgaccaacttttttgctttgtgttgaagttttatgtgatttttagtaacaccaacaaatataaagtaatgcagtggttttttatgtatagcattaagtaagatctgaaagaaactaacttatgagaactggtgatcagtacaaattttaaatttaatgaaaaattgaattgtatcacagatttactgcttaatttcttaaatctggagttcagagctcattatttatattaaatatattatttatattaaactcatttttattatactggagattaagggacaaacaaacactctttgtttttaatagtaatattattattaaggccaataataaatatgagctaaaatattttataatgtgtcagcatgtctgggagtatctgtacctgactctcaagttacatagaaaaactcccagaaaatagatgcatggtatttataaatagaagtcttaattctcttttactgtaattaatccctgtactaccaagcaactagaaaattcaccatgagctaccatccagtcaaactggcaggaaactaatctcagtcattactgacatcctgcctcctccctagagttacatcagcatctgggtggcatctgtgttacctaggaagtgaaggaagttctttactgttcaatcttcatacttgtccctgaaatttcttctttggaatatcatatagctatttcctagacctggcattcccttgggggaacctggaactctgggggagcactttggagattgttaagagccaccacctttcacagaaccctaggatctctgttctctccatagacctggaggaattattcctctcttctttgcatcctcaaagacaactcacctcctacattcaggctgtctgaaaactcaagcaggaatgtaggtaatctgcaagcaacttttgctttctgcctattaacatagacctcccttaagattatgtatcacaaagggttcatctccctaattggaatttgagaggaccattaagtaggagaagttttttaaaaaattatatctatatatgcatgctatgctatgctatgctaagtcacttcagtcgtgtccaactctgtgtgacccaatagacggcagcccaccaggctcccctgtccctgggattctccaggcaagaacactggagtgggttgccatttccttctccagtgcatgaaagtgaaaagtgaaagtgaagtcactcagtcgtgtcggactcttagcgaccccatggactgcagcctaccaggctcctccatccatgggattttcctggcaagagtactagagtggggtgccattgccttctccatatattgtatatataaacataaaatcaattcctgccacaaattttttataaaactgtctaatgaactatttttttttctattgggatcatttatttttaattaatttattttttaattgaaggataattgctttacagaattttgttgttttctgtcaaacctcaacatgaatcagccatcagttcagttcagtcgctcagtcgtgtccaactccttgcaaccccatgaattgcagcacaccaggcctccctgtccgtcaccaactcccagaattcactcaaactcatgtccatcgagtcggtga

SEQ ID NO: 52107 - DNA, 1330 bp, Bovine  19866880648489
acagcccacccggctcctctgtccatgggatttcccaggcaagaatactctgtatatattactttactgcctaatcattcattggagaaggaaatggcaacccactccagtgttcttgcctggagaatcccagggacgggggagcgaggtgggctgccgtctttggggtcgcacagagtcggacacgactgaagcgacttagcagcagcagcagcctaatcattctgacctgttgtgactacttatggtcccctgctaccttgagcggagaaggcaatggcaccccactccagtactcttgcctgggaaatcccatggacaggggagcctggtgggctacagtccatggggttgctaagagtcggacacgactgagtgacttcactttcacttttcactttcctgcattggagaaggaaatggcaacccactccagtgttcttgcctggagaatcccagggatgggggagcctggtgggctgccatctatggggtcgcacagagtcggacatgactgatgcgacttagcagcagcagcatgcacagtaagcattggaaggatttgttacataattactttttgagttcctgtgagtgagtgtaaattgctcagtcggtctgactctttgggatcccatggactataacagtccatggagttctccaggacagaatactggagtgggtagcctttcccttctccaggggatcctcccaacccagggattgaacccaggtctcccacatttcaggcagattctttaccagctgagccaccaaggaagccccgagttcctgcactcttatttaataatgctatatgtattttgttcttgctgctttagttccacattgcttcctcccactttctatagtttatgtccttgactctctgttctccattaaaatgttcacatccttaaaaacagactctactgtcaaggcctcaaataccattttaggcagatgatgaagaaatctaaaactctagctctgacttttttattcagctctagcttcaacagacctaattctaactccaacagatctttggatagttccaaaacagggtcctaccaagatctcagtatagtgtgtcacagattgagttagttgtcttccttttgccattggacagtggcataatttcttaatctttaagacttgaaatttcatctatatctcctcccttcccaatctaagaggtttttagatcttcttgatttcttttaataatgattctcttatttagcttttctgttgttcctaccatagttcatgatatgcttatttcaacacttaaaccaaatttatcctccaaacttcctct

SEQ ID NO: 52108 - DNA, 1088 bp, Bovine  19866880652178
attgaaggtgggaggagaaggggacgacagaagatgagatggttggatggcatcactgactcaatggacatgagtttgagtaaactgcaggagttggtgacggacagggagtcctggcatgctgcagtccatggggtcacaaagttgggacacaactgagtgactgaacgacaagaacaacaacaacgacaaggacactgcagtggtgcagtggataagaacctgcctaccaatgcagaggacacatgttcaatccctggtctgggaagattccacatgcctcagagcaactaagccctggcgccacaactactgagcccgagtgctgtaactactgcagcccatgcgcatggaacctgtgctctgtaacgagagaagccagcacaatgagaagcctgcacactgcatcaaagtgtagcccccgctcgccgaaactagaaaaagccctctcatagcagcgaagacctagtgcaaccaaaaataaattatttttttaaaaagactacaaaatgctttgtaagacttatttccaacagtttgatagcattcatttataaaaacttgtaagactaacaaaaataaaagcacattattagatttttattatcttttacttaggcaagccagtattaaatattatgtttaacaaactgccagaaatcactgcttcattaatacaaacatgaatgaactaaattacaaagatgttttaagaatgggaaaaaaaaggtatgatgttctaagacatagttaattcctactagaagcagtttctcttattttgtaattagaggataatgcaaaaatcatctgtgtagtgaaacattgcagctataccccctttaaaatcagttgaagttcaggcagggatttgctttcattgtccttggatgtcaaatgctgttgccaacaagcttaaaaatctacagtacatcattccattcagtatgaattattatgggcatttgaaagtttttatgatatacaggtaatggaaagagtacagttaaaaaaccataataaatctgaagtatgagacgattgatatttttagacagagcctaagtaagttttccagaaacctcagt

SEQ ID NO: 52109 - DNA, 1069 bp, Bovine  19866880760255
tttttgccccatctgttcctagttggcaggaagcacaagagcatgcaagaatggacattcagtaagattaattatatgattttaactgatatgttaggctgatgacaccatttacttgattcttcaaatatttcttcattaaaacccaatagttattacatactttgaaatcaagtaaaatctatatttttaaaaaagtaaaagttatttttaaatgcttgaactatatcaacaagattttatttcatggacaagtaattaccttttctccagaaagagcttgatctggggaaaaacctggatctcctttaggtccctaaataaaacagttataaaacacatgatgaaacataaattacatatatcatacttcatcagttgcatgtaatgtcatgcactatatacagtttatatggtattgaataaaattacacattttaaattaagatgaatatagattacttatctttttaatgtatatttcatttatccttaattttaaatgttgagaagattcctagaaatttcccagacatagctgatttttctaatcaataaagttatactaaaattgaaacatttcttttgagaactacatattgtgacatcagttcagttcagtcactcagtcatgtctgactctttgtgaccccatggactgcagcacgccagccctccctgtccatcaccaactcccagagcttgctcaaattcatgtccatcgagtcggtgatgccatccaaccatctcatccattgtcatccccttcttctcctgccttcaatctttcccagcatcagggtcttttccagtgagtcagttcttcgcatcaggtggccaaagtattggagcttcagcttcagtgtcagtccttccaatgaatattcaggactgattttctttaggattgactggtttgatttccttgcagtccagactctcagtaatcttctccaacaccacagtttaaaagcatcaattcttcagccctcagctttctctatgttccaactctcacatccatacatgactactggaaaaaccatagttttgactagatagacctttt

SEQ ID NO: 52110 - DNA, 1828 bp, Bovine  19866880893072
ttaaatatgagagcatatgacaagtgctctgcagaatttctgatgcatgtaagggctccacaaatgttacagctttatcttccaccctcaccacactcaccatcttttgaactatgtaatgagattttgtattgtgtcatagtcctttaaaaattgtttcctaaataataagaatctgtgtcctttaagtgtgagtgtaaccctcactcaaggggaacagctgtaagtgaaagaattaaaagcagatggggctaggcatggtcattcctttagggagagctggagagtgcaagaggaccagaggaaactattaggccaggataaattaattgctgcatgggagccatgaattgctattggagaagccctctggtgttaatcaggcaattaacacttgggttaaaaatagtagctaagttcaagttgaaacagatagggttgaaagcaatgaaaatgctctgaggcaattaaaggtgcatataaggtgaaaacacatatattttaagaaactgaactgctaaattagtaagtgttcatacaagattaaaaaaaattccctctaaccatggtattacatagataaaagaatgtaacatatagtattgaagaatttacttaggttaaaagacatgggtgggtggagagcttattccttcatctgtacagtacttctccactttaagtcaaactgtcttactgatattaccccaattctgtgtttcatgatgacagtctaggaattgctggtgaaatctccatgggcctgtccactgttatagtggatctgaagctgcagaagaaaaccataatctgcacctttctatagagtgaaaaccaaactctgaacctttagctttaaagataaataaagctctacagctcaaccttcattcccctttatttctctgctctcaaccggatacaactttttctccatcccccaaacagtgaccttttatttcttggttcctggttacagaaaagggcttcatctgtccatctcaaacactgcaaccctttccctgacacagctagagagcggcagaaattaccatgagttttggtgttcctatttatcgtggtagatggttgagaggtgatctgcaaaaagtcttaaactcgtacaaagatgtgtccgttttttacatgacaatctggtttcagtaacacctcactagcacttgctgaaacttcgtagacacatggtgatttaaaaaaaaaataaattaaaatgatttaaatgtaaagtaacccatttttctcctaaacaaaaattttaaaatctgaggacagaaatactttgaattaaatattaaatttatagcagatttttacaaatggttttacaggtaatatctttgaaagtttcctattaccttcaaataaacaacagaacctgtaaaaggtgttggagagctgaattaaagataaaaggttcaaatgtgctttgcctgctagagaatgtggaacttacacgttcatctggtctggagtttaaatttccactctaactctaattaatgaaaaattcaaacttcaaaaggcaaggaaattttgactaggttggtttaaccaagattagtctgatcaagacttttttttataaacccagttattcctaatttattgcagaatctttcttcctgaaaagggtttctgttcaattgtctgtggtctataattaacgaggctgactataagctagctgatttactgtgtagatgttgtagaaacatcttagaaatatttatgaaacataaataatgacaataacagtttagaatttctctgacatcctcagggattaaagcgtggtattgggggacag

SEQ ID NO: 52111 - DNA, 1011 bp, Bovine  19866881165434
agacacagctggagtcccagcaagtcctctgcttgccaagccagacttcaggccagttagggcctctgctccaagaggggaagaagatgatttaacatgatccaggcgaggtgcatgtggactggattatggacaatttcacattttgttgcaaagagctaaagaatctacagtctcatctgatgttatgtatgaaaaaaaaagtgtgtttttcttttgttgttgactgaatcatgcagataaaaagagggaactggttggcccactcctttctttctacgtaagaatgctgtctttccaatttttaacaaagggatctcagacttttcctgcttaaatgacccaagacacatggttgaggtcactagaaggagaaaacaatgatggattttatagagagtaaacaaatagaaaagtcttatatgactgatggctctttaacttttaagggcgtgttctcaagtcaaagagctgatggcaccaatcggtgcagtaatttcaatgtgttcatgcagaaatctgctgaacccccaaattctgctcatctgaaaggaccccagtgacagactagaatgttgcttatttttcactgtggaaaggagaacctgcttatttgcctttactttactgtattgctttcagttctgtctggcagaagaacttgtgcatggagcagattcctatccatcacatacctctggccctataagctatttcatgataagaatttgtctcagaataaaaaagtcaggcaagtggaattctatttttcaaccaggaaataccaacacacagattaagaggtcaatactaccacacttgaccaaccaataaaaaatgtttctgttgaaataatccagagtcataatatcttcattcattcattaattccactcttttgaaaataatttttctattcagctagcataatacaattcttaactaagccatcactagaaactctgggccaaccacacagtcttttcccactgagaaaggtttcagattttt

SEQ ID NO: 52112 - DNA, 1540 bp, Bovine  19866881528070
ctttctcagcatgttaactgaaacccttgttgagcttcaggaggtgccactgaacgtctgagagaggcaaagttgcaatgcctttcaaatctttgatacctctgttcctgatgacaaatgccaatttgggttctgtgggcacacagaagtttctggcttttcttgccatcctaaccatttgaatttcagttctgtgtatctgcttgccttccttgtgatagggcttagctttttcatagataaactttgcctttcgaagcatcttttaggcaaattatttctcagcacttgatcttaagctctgtgaaattcttttcctttttcttaaggatttctggcatagcaggaacctttatttccttctcttctgcaccctccatggttccagccaggaaagaggccattttcattttaaatagatgacttcagtcagataagcaacatgcaggactcttcatatttttatatggaaaaaatattctttccaaacttgggtattatgaatacaccaagtttgctttcttgggcttctttggattttgctgtattttttattattttatttttcattttagggaattccaggattcactggtaatattggttcacgtggttaccctggcaggcaggtgaggtaactatatttaaacttttctttttatgtctctcttggttaatgcattgtatgttccaatttcaagagttaatgttcaaatgataattggtttattttattaaataatgaattactcatagcaaaataattccccaaaattctgatataaaaattgtaaaaattcttcaaaaattttattgcagacaaattttacttaaaatgagagtgggatttttaaataagtttgatatgatattcagtggaactttttaaattaaaatggcccagtaggctaataaaatgttaaacagtgttgctactgattttacaatattaccactgactaaaatgaagtaatgatttgagttaagaccgtctttgatatgcaacattttttaataatacaattataaatacttgggacacagttgccagtgctacatataccactatctgaatactttttatctaaattggattcaagtctttgtatactgttttgaaaattcattttaatcatttcatatttatttccctctaatttctaactttctctagctatttcacataggctagtaagagaaaaaaattttctttcttaggctttcattacttacttactcgtgaaattaattgttcatttagcatactagaaaactgtatttatataaaatatcttttttattctctagaattaaggaattgaaaatgccaaaagataatctagtgttaataaaattccattttgaagcctttaaagtatgtggagggtattacatgaatcttaccaccaagtaatgttttgtgtttatctgaaaaatatataaatacttaaacatatggaaattgatctgaagttaaaaaatgtacttattttctaaagtaggaatatattttagataagtaattagaagtgttctaaaa

SEQ ID NO: 52113 - DNA, 1535 bp, Bovine  19866881758381
ttatggctgtgtcctgcttggagtctgctgggcacagtggaggtattgctccaggactttttttttttttccttcaggttcttaagaccccttttcaataagccgttgatgtctctttctctgtttctgggctctcagtttagtggctgggcacctataaggtttgcaggcctctgggatgctgcccagcagttggctgtaagtttggggcagaattagaaaaagataaagaaaatctgttctatatcattgatctctacctctctgttagtcatcaagttagtaagtaggtacacttatataaggtgtggctcaactgacttgtcataatctcctaaaatcacctggctaagggatgatatttgatgtgttcaggttttcctgcctcacaccaggaatagacttgttaacatgtctagaaagaactcttgtcttccatttttctcccctgaggtcattggggaagtccacgagttgactgaattgcctggtgaatagtgctagttgtactttagctgtattggaacggaaaggtgccttttcagttgtttctaaactctcagtgaactggattactttgggcaggtgagaagtgcttcctttcatgttccattttcgattaaaacaacataattctgatatactctccttcagtgattggaatcctgagctattttctagtcttaccgatgcacatgctgccagttgaaaatacaaatttgaaaggaaaagtgccttcttttactcaaattctagatgacattaggattcatcctggaggacccaaggaaatcattttcatttcacactgctgtccccaactttcctcactagaatcacctgggaagtgtttaaaaatccctgtaaaacaaattaaagtcagaatctctgagggtggggttggggagggcagaacccaagtattagtagtttttagaagtcaccaggtgagtccactaatcagctatggtaagaagctgaaaaacaagtaggcctcacaccatctcttgagcatcacctgttccagaactgtggtcctcagggtatgatgccccagatctgcagcatcagcattgcctgggaacttgttataactgcaaattcttgagctccaccccgacctactgagtcagaaactctcagggtggagcccagaatctttaacaagccctctaggtgattctgttacatgctcctgtttgaaaaccatgatctagagtagcagaaaagaattttttttttttaaggtcaaatcttgtgtcatattataaaattaggtatgtgatttaagcaaagtattaatattaggttattttaagtacaatgtaactattaacagtaaatattctaaattgttttttctcagagtttggtacatacacaatcagtattagatcacttggttaaaaatgtgtacatgctgaggatccacttcaaatttatgaagtctctgggaaggcccagaatctggatttttcacaaaaaaccaaaaatgtggcatactaacatttagaaacatctcaggagacaccgta

SEQ ID NO: 52114 - DNA, 1125 bp, Bovine  19866880391584
ataatctgcttttctttgaatattctacattccagcactattctaatgctagaaagggatggaattaaaagtgaatactcaggaaagagcaggagttttacctggcaaagccaacgcctctgctgactccattagcatctcttagtatccttgtggaaatgacatgtccaaagggtttcagcatattctcaagttcctgctcgtccatagaaatggggagatttgagatgtaaaggtttgttgggtcttgctcttgttgctaagggaaaaaagaaacacacgcggtaagttctgaatattgagaaacactgtggatacatttcccttacattgccatctagagtccagtctccaacattctgctcaagttctttcagtgagggcagtgtttcttttcactgaattcctatgggctggaacgcttctcatagaaacaatgtcatctgtggcaaccatgctttctgtccagccttccttagaaaagactaatgaacttttattgtggttggacaaaagtaaacacggatgttctatgaccattagctggtggttctataaccactctaattgccttcaccactagttacaaatgttgcatttagagagtgttcatagtcatgtgtgcatgcgcgtgctaagtaacctcagtcatgtccaactctttgcaacactattgactatagcctgccaagctcctctgtgggattctccaggcaagaatactggagtgggttgccatgccctcctccaggggatcttcccgacccagggatccagcccacgtctcttacatctccttcattggcaggtgggttctttacctctactgctcccgggaagcccttcaccacacactaggcattgttttaaaccctgatatagactatttcattcaatattcccagtatatataatcgttactattttaaagaggacaaaattgagccatggcttgtctaagttacatagctcgtaaacgtcaaagccagggctgaaacctgggagatatcccccaagttcgcaggttttcctgtcttactatattgctttccactgaatcaatggggggaaaagtagtatggtcctagaacatcatttatcatcagcctcagcatcagttgggaa

SEQ ID NO: 52115 - DNA, 1771 bp, Bovine  19866880400973
tcgtttattcaaatatataggctatgctgtctgaatgagtttgcttgggaaatgcaaagcaaaaggaaacataatttccattttagcatctctggatgtctgggtttgctcaatgtttaagctgcaaagaaaagtacatgctgcaattccactaaaaagcacaatgaccagacagctgatgggaatgtctggtctgttctggcctcctcctctgcaaaacagagctgcttacactaaagggatgtagggtggagctggttgccctaattctgaaataaataatttcaacaggaatttggataaagtttccagagatcattgatgtggagtaaacatatctgacctgaggccagaaaagcatctgtggtgttaacctcctgccgatgtttgaaagaaatttcaagtctaggagagttcaacaatgttttaattttccaatggaaatatgggatcattggcgaattgggaaaaataccagcaaggctctttcccatcaagaacacacataggtggtttaaatcctacgttaatgccaagatatggcctacaatgagaattacgtggatgaatgttcctgtgcttgccaatattctgggccaatgccactccaagtatgattaagaatttaaattagaatctctaggcttcaggcattgaaatcagtgttttaaagaactgtccaaatgattctgatgcccactgaagtttgagaagtgcactctattaactgctattatataagccagtgttacaaacacttgggtcttatttatgctgtttctcaattatttgttttaagccaatcctgtgatagggcatgagcctttgtgtaataattagatacatcctgtttaaaaatgcaaagaggtcaagccagcatttttgatgagctgaaatggggcgattatttgaataattcaggcctcagtctgatgacctgacatgcctctctttgatcagtttgtcttgtgttggggcacatttaagaatcctttctgttgggaatcttgctgctgctactgctgctaagttgcttcagtcgtgtccgactctgtgcgaccccatagacggcagcccaccaggctccgccatcttagggagccttgaatttgaaatcacagaaatgtaaaaataaaagacagaaaatgtatttgttaacataagtggaaaaaaagaaaaagaaatataatccctctttttctctcttgtccaatctaggtgtctcaggtcaaaatgtttgcagtccaaactggtatatatcggatggataacaaaaatgtcttaccgtatagcacaggggattgtattcaatatcccatgctaaatcataacggaaaagaatatgaaaaagatctttatgttccttcaaaaaacaatgcttacagcctgtattgtgatcttttcctatggtcacttatgccaaaccataggacttgttagtagtaatcattcaacacgattttagaaaacgtaatttaaagtgatttgtcttctttctaatctgcatgctttctgcctctgtttttaatatttctagaataaatatctagtggggtttgtgtacaccagacttttttttagcccctgtgaagtagcttccctggtggttcagatggtaaataatcagcctgaatgcgggagacctgggtttgattcctgggttgggaagatcccctggagcagaaaatggcaacccagtctagcattattgcctggagaatccccatggacagaggagcctggtgaactacaatctatggggtcacaaaga

SEQ ID NO: 52116 - DNA, 1400 bp, Bovine  19866880577554
tggggtgagtaggtgaatagcattgatttctctcaagaagggtgttatgtaaatgctgcctgctagaactgcattttcatttcctgcattgatctcatcttaaagccttggagtcaaccctattttgttctgtgtattcctattttcacagaaattccatgttgcaaaatgaaagtgagtgactagagatgttgaaatcatgtttaaaagcctcttatcctatcatctttggctgttatttttttttaatctaaacaaataaattataaaagcaacaaatagttgtgtactttagctgacatcattattaaaatagcttctcagtggcttattttcttccagaaaatccatttttggaagatggctttgaactaggcccaatctataaggactagatcttgtttatcattgaggaaggaggattttcttaccttagagatactgtagttgttgtttagcagctgagtcgtatccagcccttttgctacaccatggactgtagcccaccaggctcctctgtccgtgggatttcccaggcaagaatactggagtgggttgccatttccttctccaggggatcttcctgacacagggatggaaccagtgtctcatgtgttgtcaggctgattctgtaccactgagccacatagttgagctcatcaataaacggctagaactgtcctctagtccaaaaactcccatctactcagctaggagaacaaagacagaccttcctcttctaagatatcctggtgggtccactaataacctgttggcagatataccagaaaagacttcctttaacagagctgtgacagacacatcagtgtattttgcagttacatgtcaatatcttggacacataaataggaaatttgaattggcacttgcatataatggctattcctatacttaatcctcaccaatctattttttttcctataatgaccagattctactttttttaatttgaagatactgttataccttaatttccaagttgttttaaatcctgttgtagtttattgaatcttttcagttaaccagaaacatcactgagctctatctctggtgatctaaagtctaatgacacactaatgtaaattttagcatccaaaccggaatacagtgtcgtatcatcatagttctctgttaaccatataatgctatgatttctcttttgcacctttggaattctcaatctaaaagtaacagaggagtaaaaagagggggaaaaatggatttagaacaatatccaaaccttggttcctagattcatccataattaccattcatttttcacagcttcagttctagttatcaaaaaatatgtgcttgatccaaattcaactttaatttcgagacaggcatccccagattaatgtcatattccagcgaag

SEQ ID NO: 52117 - DNA, 1176 bp, Bovine  19866880620208
caatttgactactcaggagttctcaacatatacttttgcttatttcacgcaagagcagccccgaagccatctgcctgccaacaacccgatccttcattcccattacggaggcagcgcccccacctcatcattcaaaggcaatcttcaaagggaccttgtttttgctcattcccgtcatgacagatgttttctatcatccacctccacatgctaactcatctgcgagggtctgcccacccattccctctctctgcagccagctgtggaaatagcctcagtgtcgtctgtggcaatactcattccattcttctgacctcaccgaagaccacatccaagagcaggaaaaacaaagagccctgataacttccttcaaaacatttccagggcaggagataggccagccccagacaagagccctttacaaggcatgtaacaaaagagaggcaagcttattggaaacactcaaatgtcaccgagtgagccaattggggtaatccccagattaaggaaaaatgaagtaacagcatctgcggccatgattcagctgaaaacatctggttgactcagaaccacttcaattagtctgggtacatatcagtcaatcattcctttcctttgattgtataaagttcccacaaggacatgtttataccccaacccatccaagtctttgaaatactgtgaaaagactaaaacatttcttcaatgaatacacaatgaacttgaactgctctgtgtcagagttacaccctgatattagaatatgttttaggaacaaaacttaatatgcataagaagacatctgtctccacgtgtttattaccacgtggagacttccccttgtggctcagtggtaaagaatctgcctgccagtgcaagagatggaggtttgatccctgggtcaggaagatccctggagaaggaaatggcaacccactccagtattcttgcctggagaatcccatggacggaggaacctggtgtgctgctgtccatgggatagcaaagagtcacacagggcttattgactgaacaacaatgaacgcttagaaaaattatagttcagcttcgataatgatacctgaaaggaaaaagtgaaagtgaaagtcgctcagtcatgtctgactctttgcaaccccatggactgtacagtccaggaattctccaggctagaat

SEQ ID NO: 52118 - DNA, 1536 bp, Bovine  19866880667124
acacacacacacacacacacacacacacagaacaagtgctaaatattcaaaaggaaaaaaaaaacaaaacagtttgattgagaaagattctagttgcttcttggaaagtctcatttttccaaaactgattttcagtgtgttttgctgacaatcagattgttatttctttaaagagcttattcttggatgggacaccgatgaattctgctttttgagatgggtactgtccttgcctaatttatcttatagtgtctggatcttaactccttgccgctggatctagataggctctattactctgctgtactttgcactcctctttttattgtctgcacataaaaaggtgaatatcgtgagaacagacagacaggggtttattggtctgcatgttcatctctttggcataatgttgctcctctctctaggggaagtgtgcaggggtttatcaggcctactgtgatagagaggtataatacagtctgtaatgtttaatcagtgaggtatggtcagtatgtcttgctgaccgaacgttctctataattctgtgtaagtaccagtgagtagtagcataatttattcagagtctacagaacaaattctggctccagaatctgactgaagtaatcataatgtcatggaactgagaagaaggatgaacaggttttctatacatctccagaatcacagaccatcttcatctatgtttatccaaaatgataactccactcaggtcttcacatttctatgccttgaggttttcatggtaaagatttagaagggactaccctagtggtcccatggttaggactcggtgcttccacagcagaagacatgaattcattccctggtcatgggactaagatcccacatgcccctgtggtgcagcaaaaattaaataaataaataaaagacctacaaaataaatcacaaagccttaattttattcctaagttgatattggactttgccttctgtcagcatcactaatgagtagttaaaccatcagtgtctgtgagtgctattcgcaagcagagggggttgagtagcttaagaccagttaagagacaagccatagaaaccaggctctgaataattaagtgcttagtgcacttccaaatcttaaaattcatttaataggattgatttaaaaatacatcctaaccaatttttggatacatggatagtagtgtgaattagattcttgccactccttgccagaaaccatcaagaaagcttgtcatgcacacatcattttttatgatctaattctttagaatgagaagtctgcaaaatttaagaaaatattgtaagaaaaatataaatgaaaacactcactaagcaagctctgaaccaggcacgatttatctgatagctatttcctctgatttcttacctctttaagcctatgaatgatgaatcaattagcttactattattttttgtcatttctcatttaaaaagaagtctttcaaaggaaattggcatgtttacgatctttctttagaattcatatatttcaaagacatctgtcccatt

SEQ ID NO: 52119 - DNA, 1398 bp, Bovine  19866880743591
acggagccatgagaactggcactcgggtgtaatgtgtgtgtccactgaggcatgactagttccctgagatacttttaggattaggaaaaccccaaatcctaaaatcctaggaacaggagctccagattcacctctcttaatctgcaggggagggaagcaaacttgttgacaaacatagcagcagtaattcctaggtgtggaatgctgtggtcatccttctcctttttctattagattcatactcgcactccatacttcagggaggtcttactaatgtcatgagcattcactccatttttaaaaggaccagggacaaatatatattatttttatagagagagaatcttggtccttttaaagggttcattgcagcccatgagtccagggaaggactcatatgatgtctacaagtatttgcttccccagcacattcctttgagcctctcataattaggacagtaactaaattggcctttttttattttccactggtgtcaaatacagctaagaggatttgccatacttggatattaaagctctttttgtaactggcagcatctaatcctgattattcactgtttgtatttctaaaatacataaaaccagaaacaaagctttcaactgagcccccaatttcacacccaagttgaccttggttgtccccagcctcactgtgactcatggctaatgaggacagcggtacttttctctcctcctcgtcaccctccccccagccttttgccagtgcctgcaggaccctgggtagaattgggaagaaattttattgggtgtatacttatttatctcctgtgcctttcacaattgttttcagtttcatcaggggtatatatatttttttcctgttttattttccttaatccaagactctccaaggaggaatagtagaaattcaaagtactcaacacaaattacttgcatttaatattttgatcatttatgtgaattatagatttccttgggcaacatatataagcataattttccaaacacactctagggtagcagatttaaaaattttatggcatattagaattaccaggtgagcattaaatattaattcccaggccacacttcaggccaattaaatccagttctctgcaagtggaacctaagcatcagtattttgttcaaagagctcagataattccaacataaagacaggtttgagaaccagagtcctcgagattactcctccatctcatgacacgttatagtagttaaaacagttaagagtgttgaagtccagcacatctgggaaattgcatttcccttcttagagatacttgtagattcacaataaacatttgcacactaaagaggagaagtactgagggaaaaaaaaacaaggacataaagaaagaaagagaggaaagagag

SEQ ID NO: 52120 - DNA, 778 bp, Bovine  19866880812672
ttttgcacaggcgtcgatggaatgctgttttgtttgtttttttaattttctactttacccaatgaaaacaaccatgtttttacgtgctgtgcaaatggttccttcatgtggtctgacagtttatttttgcatcatttttttaattaaagaaaacaatcccagaagaggacaactactactacaaacaaataaagcaaaacatggaaggttgacattcacgtggaagaacatttgaattcagaatttatctgaaggtgtagatagatttttttttttttaaacaggaaatctgatgtcaagaggtgggcaagcagaaatggaaacaaattgtcttcctcagtaattaagctactctttctttttctcttcttgtttaaatctagtgggttgggttttttttttattttatttttttcttagaaatatttaggtaaggtttatcttgaatcttaattgccttaattttaaggacgtcaaaggctctcgaggcaagctgtcaacgtcttgttaaaaccaagaaagaattgaaatattgtaccggttttcactggtacagaagtctaagactatgagtttttagggtgggaaaaaaaaaactgtacagttttaaagaaaatgtttttcttcatttgaagaaaatttgctgataaaagaaaccatggcaactgcaagaattggggaaatgctgggacttctcatgaactttgtcttaagtgttgaatcgttctagaaggctaaaacattttaaggtaaagttattaatgtggtttaaaaacaa

SEQ ID NO: 52121 - DNA, 1057 bp, Bovine  19866880830711
tacagccttgacgtactccttttcctatttggaaccagtctgttgttccctgtctggttctaactgttgcttcctgacctgcatataggtttctcaagaggcagttcaggtggtctggtattcccatctctttcagaattttccacagtttattgtgatccacacagtcaaaggctttggcatagtcaataaagcagaaatagatgattttctggaactctcttgctttttcaatgatccagcggatggtggcaatttgatctctggttcctctgctgccttttataaaaccagcttgaacatctggaaagtgtattactgaatcctggcttggagaattttgagcattactttactagcatgtgagatgagtgcaattgtacggtagtttgaacattctttggcattgtctttctttgggattggaatgaaaactgaccttttccagtcctgtggccactgctgagttttccagatttgctggacagaatggattcagtgtggatggagaatccagaatgcggtccactggagaagggaatgtatcggtagacatacgcaaattgtcttcctgctcacaggaaatactgttccatgtaagtccatgtcttgggacttccctagtggctcaggtggtaaagagtttgccagcaatactggagacccgggaagatcctctggagaagggaaagactacccactctcgtattgttgcctggagaattccatggacataggaccctggcagggctatagtccaggggggtctcaaagagttggacttccactttacttgatcaaccattcataaaagtaggtacatttcaatgagtaaataaagaaagaaggagtgttgagaagttttctccaaaatactataattctccatttgcaaatttcatgacaatgcccattatatcctgactatagaatttacgtgaaaaaaaaaaaaatctagtttacagcacttttagacacaaactgcttcagttttattattccaataaaagcaatggcttggtgattctctgtttttctctcaccagggattccattt

SEQ ID NO: 52122 - DNA, 1730 bp, Bovine  19866880870173
gtctgatggatgatttgatgctgtagagatttttcaaataagcaaggatagtgatgattgccaaatattgggctgaagtctttgtagaaaacatctcataaattattttagtctctggatactggatcatttgagattttacttgctacacttataggagatttcttttataagaaaaaattatagaaagcaagattcttgaaagagaagactcagcattgagtctttaactgctaaactgttttcttttcctccttccctttccattttttaatcttaattttttaaggcttaacacataactagagggatggtggaagcagaaaatgctgtcttggttagaaatttgatcccttctccaaaaccattcagaccatcagttaacagagttgaaagggatagggcgggaatatcactgaagattcccaccctgccacccccgctccggctctgcttgagatgaactcacattgattaatttttgagaggctaaagctgattagtattctctgtgttgacttcaattcctagatgtcattcagtgtacctggagcatctatcatgtgatgtgagcagacagagctaaaagggatcagcagtgactacaaaccttgtagaaggtattcatgtggaaagcaggctacaggaaaaggtatcaaaatatctgggcagcatcttctacatatttgccgatataactaaagctctcaagggtccagaggtggggagatgcttctctactctccgtgcagagacaaatggacagaggcagccagtcactaaatcacagaattcctgggtcagctttcttccagttcttacttttgtttccatcaatgtaaattttacatgtaaatgagggtagctcatttcaatgaagtgtatactttaaatgtattaacatgaattattcaaggacacagcaggaaagcaacagatgtacccatctgacgggggtcatgcttagtttcacttgatgaatgtttgttttgttgcttgaaaaattaatgcaataaaatatttaaaatgaataaagaggtttcaaatttacttggagaaaaagaatatttccttccaggaatttttttttttgatgtgccattggcattaagtaggattgtattagatagtttgtcttgatgttctatgaaagttgcagagaatattcattaagtgtagctgtgtgagcaccgattatgcattgagagagaaatttggaaatgtgagaaactcaaacatactgtatcactcagatatctcagaaaataagtaagaggatggacaatttgaaaccggttatttggtggaggaagatcgaagataatatacaatctgaatcatttactcctctgtgttcaaagcttctttagtggtcttctaatcttgaaacatatttgcaagtcattaagtcaagctccatttatgaagaaaactcaactgttatctccttaatgagaattggcttctcttatgggtaaatcaatggcattaattgttacttttaactttttatttgtttattttttgctgcactgtgtggcttgtgggatcttagttccctgaccagagaccgaacctgagtcctcagcagtgagcatgtgcagtcttaaccactggatcagtgaggaattccctcaatggcattttgtaagataaacctgcctgaaacattttctaaattattatagaaattaaagaaaaaaaatccaataacggaaaaaatataataa

SEQ ID NO: 52123 - DNA, 2008 bp, Bovine  19866880895687
ttctgcaaaagcttagggcttaagctgtctaggtctctgtgaatcttagttatatcaattgggttaaacacagatgtacaacatttggggagcaaaaggactgaatataaagggaaatataataatttgcatatcttacacaatcatttgtgtatcttagtactttatataaaatatacgcaataatcactgaaatttacaattaatagttttaagtcatgtcaacaggcaaatatatgcctcaaaccctattatttccatagtactttatacttaatttgtgtatcttacacaatcatttgtgtatcttagtactttatacaaaatatatgcaataatcactgaaatttacaattaatagttttaagtcatgtcaacaggcaaatatatgcctcaaaccctattattccatagtactttatacttactcatgtatttttaaaattatttttattggagtatagttgccttgcaattttgtgtttgtttctgctgtacaacaaagtgaatcagctacacatgtacacatatcccttcccttttggatttccgtcccatgcaggtcaccacagtccattaagtagagttccttgtgatagacggtgggttctcgttggttatctactttatacatagcatcaatagtgtatatgtatccatcccaatctcttaattcactccatccctctctccccgcttggtatcagatatctgttccctacatttgtgtctctatttttgctttgcaaataagatcacctataccatctttctagattccatatatatgcattaatatacgatgtttgtttttctctttctgacttatttcactctatatgacagtctaggtccacccacatttctaaaaatgacccagtttcaattctttttatggctgagaaatattccattgtataaaagaaatattacgtttcatttttttcaaggcagagatgagaaaatttccttagaagtaaattccccttattgcaaaatgtgctcagggtaagaatgctaacagctcacagatgaattcgctggagcaaattataatcaactggcttctagacatcatggtgcttacctcttttcgtataaagaagtaacatcaggaaaagtgggcacaatgtctattttctttactactctacactcattgcctggcaaagtgagccaatattttcggatgaatgaactcctgctccttggcatgtattagaacaattacacaattgtttataccaaaacagagaaattgaggcattcccataaagcatagcattgactcatgtcaagaaatgaagccatgcgaggggtaggctgacgcttcatagaggcctccaaagagaacaaggagttccttaaacacagactcagaggttctggaaacaaaagcggtcacatgcctggtctgacagttaaactggatgaagagaattcgctgaaatgagacagacgatggtttcccatctctgaactaacacaccggggttttacttgaagtgggttctattctttcagaggacacagagctgtcatccacgactattcaggattttggaaaaagtatggatggcagagtcagactgatcttgcatacctttcttgctcctttctagctctgtgaccttcggtgactcatccaaactttctgaaccttagcatctcagggggttaacgtgcccttcccaagatttctggagaatccaagagaacatatatgtagatacacaagcactgggcctgcagaggcaatatatgcaatgaaatgtagctcttattatcactgagatatcattatctactgctaacatagtgaaaaagggaatatttaaatttaacttttcttcaataaaaaaaagtccatataaatttatttggccagagtccttatttttcacaagtctgaaaaggcaaataaataaaaattccaacagaagataggcgaatatttaaaatcaaatggcttaaatgggtgctctgttaagatttttcatacatgcaa

SEQ ID NO: 52124 - DNA, 2501 bp, Bovine  19866881010102
ctgtacctctactcagcctctccctccgcccactcctttttgaggcgaccatcccaaactctgtccttagtacacaagatgctctaaaaaccgatctgtgtcacagacagatcccctagatggatggggaaacaaacaaacaaactaatgatagataccgtattggctcagtgggtaaaagaatctgtctgacattcaggagacacaggagatgtgggtttgcttcctgggtcaggaaggtcctctggaggaagaaatggcagcccactccagtattcttagctggagaaccccatggacagaggagcctggtgggctacaatccatagagtcacaaagagttggacgcgactgagcaactaacactttcacttttcattatgaaggttaaggttataatttaatgtcacactctttctagtcaataaatattaatgcattcaaagaaagaatatatatatgcatatgtatagctgaattactttgctgtatacctgaaactaatattgtaaatcaattataatccaatagataaaaatttttaaaaattctgcaactatacttcaattaaaataaatatttacttttttttaagtttactagaccatggttttaaatgatgtgcttagaaaataaataaaactccatagtcatcttcccagggagcccaagctgcagccaacaggcaaccaggcacactgaggactctttaactggatgatttgcagtttcagttatgatttagtaggactgtaattaaaaagcagagacatttgccaacaaagatccgtctagtcaaagctacggtttttccagtagtcatgtatggatgtgagagttggactataaggaaagctgagcaccgaagaattgatgcttttgaactgtggtgttggagaagactcttgggagtccctcggactgcaaggagatccaaccagtccatcctaaaggagatcagtcctgaatattcattggaaggactaatgctgaagctgaaagtccaaaaatcggttcacctgatgcgaagaactgactcatttgaaaagaccctgctgctgggaaagattgaaagcgggaggagaaggggacagaggatgaaatggttggatgacatcaccgactcaatggacatgaatttgagtagactcttggagttggtgatggacagggaagcctggcatatcgcggtccatggggtctcaaagagtcagacacaactgagcgagtgaactgaactgaactgaatgctgttttacctgtgataggtcctgttagcaatacaagcaacctcacagctaatattaaaaggagagacttgtgatgtgaatttatagaaagaaggtctcaaacctttatctttacatctgggatcaagcattatcatctgtttggattggacaaatcaaaagcctctattctgttccgtgagaagtatattggttttagtctatgcagaagtttttacagttttggagttatgtgtatgaccctataaatttttgccttttaaaaacttagatcctttgatttatgattttgaagcatcattgccttctttattaggactcagtgatgctgccaattcaggtatctacagtgaagggcagtggtggccaagataaatgaaaacaatgaattatccaaaatctttctttttctctaagtactttttcttacattggaatacaaatgccttatggaatgcacctttaggtgggagggggtggttcaggattgggaacacgtgtacacccatggcggattcatattgatgtatggcaaaaccaatacaatattgtaaagtaattagcctctaattaaaataaataaatttaaataaaataaaataaatatatatcattttcagataatctgcctgtgcactatatttacctttgtctccttcactaagagaattataatcaaatatagtaataaggatgaagcacaaccttacataaaagtcagtttggtgttttatcagtcacaaaggatactaataggcaccagaggggccatggggtcgagtgagtgagtggctagtggaaagacacttgtggggaaagcagcttgcatttttcagattgcattcagaatgtgcttagtgactacaaacagaatggaaggagatggcttctaaggtggtgcgagtggtgaagaacccgcctgccaatgcaggaaatgtaagagacaaagaccacagattcgatccttgctttgggaagacccccctggaggagggcatggcaacccactccagtattcttgcctggagactcccgtggacagaggagcctggtgggctacagtccatggggtcacaaagagccagacacaactgaagtgagttagcagcagcagcacacactcatggttattgcatgtatgaaaaatcttaacagagcaaccatttaagccatttgattttaaatattcgcctatcttctgtggaattttattattgccttttcagactttaaaaataaggactcggccaa

SEQ ID NO: 52125 - DNA, 1393 bp, Bovine  19866881357348
ctgggaaagatcgaaggcgggaggagaagggcacgacagagggtgagatggctggatggcgtcaccgactcgatgcgcatgagtttgagccagctccgggagttggtgattgacagggaggcctggctactgtagtccatggggtcgcaacggagacaactgagcgactgaactgaactgatgtgtgggatctaagaaagttacacaagtaactttttattcaaatgaactcatttacaaaacaaagcaaactgatttataaaacaaaaagagacttgcagatagagaaaacaaacttatgattaccaaatggaaaagaaggggagagaaatcaattaggagtatgggattaatataaaataggtaacagcgactccctgctgtgtggcacaggaactatgctcaatagcattctaataagctacaaggaaaagaatctgaaaaagcacatataaacatatatatattttttaatcgctttgctatacacctgaaactaacacattgtaaactaactatacttcatttttttaagttatacatattttaaagtacaatgcactgaccctttaagaaaaagtttttgtaaatatttaattcagtcaaaacaatatcactctgtttgcttagctctttgaaatactaaagaagaatacatgttgtaggtgtatgtctcaaaaatatttttcctaatcaatacttttacaatttttgataggttttcctcaatctggtggcttggagatttcagtactgtctaaattttataggctatgccctgcctcctttgtttttaatattttgggagcatctacagcagtgctaatcacacactctttctccatttctatttactggaaatccccaatataatgcatttagatatagaaatttttaaagactatgctgtggttttgaaaagttcatcaggaaatgatagtttctataattggaattctatatcaaaatggataaattccaaaattttaataattcctgaaaatgtcctgaggcaaaatctgttctacttccataagtgtttccgttttcttgttaggtagaagagacacgatctgaaatctaactctaattttccccaaggcctaaaagagaagaccttagtaattagttgtcttttttcatccaaccacttagtatctttctttttctttttttttttttttgccactgaatgcaaaaaaaaaaaaaaaaaagtagatctccataaggagaatattctcctctcaaatggctgttcttagaccttccattgtactttagcctcaatccatttttgcaatattacacaccttgtcacagtataagagtgttccttagttaaaaattatttaaacatattattttgagttttcctttttttaagaatttattt

SEQ ID NO: 52126 - DNA, 1398 bp, Bovine  19866881480545
ttgattaacaatgttaatttctgctgtacagcaaaagtgactcagttctacacatgcatacattcttttttatattctttcatattttttccattatagtttatcataggatattgaatatagttccctatgctacacagtaggatcttgctgttcacccatcctgtatatactagtttgcatctgttaatcccaaatccccaacctttccctctttgacctctcctctaccttggcaaccacaagtctcttctttattctgaaattctgtttctgtaccatgcgctgtgctaagtcgcttccactcgtgtctgactctttgcaaccacatggactgtagcccgccaggctcctctttctatgggatttcccaggcaggagtactggagtgtgttgccatttccttctccagggaatcttgctgagccaggaatcgaactcaagtctcatgtactggcaggcagattctttaaccctgagccaccagggaaggctttctgttcgcgatgcttgtttatttgtgtcattttagcttccacatatgaatgatatgtgatatttgtctttgacttactttgcttaatgtgataatctctgggtccgtccatgttgttgcaaatggcatttcattgcagctggaaagttttgaagcctgctgattacattattaaatagtcactgacctaagtcttgagagagaaagtagccaccactttagggcatggctatttttggctctaagtggatacaagaatattaagaatttccttacatttttatccatagcagatgttctattggagaaaaatggaatagtaaacagtgtaatccctatagagctgaaattagatcttgtgggaaaggaaaagttctccttgttaacatatgaaaatctgtgcatatttgctctcttcatggtcattatctgggtttgatgctctcactgggatgtcaagaggagtcttggggaatggggatgattctagcaatgcctgctgttccgtcagtggtgggatgatgagtccaagccagtcatctcagatgggaagcagagacttcagttggcatccctatcccacttttcctagatctatcaggaatcataactaggaaaccaactaaccttggaagtgctgaagggggtggtgacattgtgacatgccacctgaatgccccagagtgaagagcgtgtcacctcagcgactgcaaaggctgaccacagaattagcagtgatgctcagagccacagcggacactggggccaaggtgatgcctttcttgggtgggcacatcccagggccgatctgtgtgctggttatctggttatctaagttatccagttgtctaagcacctagttatctgagcccaaatcagaacgcctaacgggcattctagct

SEQ ID NO: 52127 - DNA, 1115 bp, Bovine  19866881714122
tgtgtgtgtgttgtaatgatcttccgaagaaatgaatagggtgctgtagcaaatgtatggccatattcatgcccgttcagaatttcagtcgtttgaagaagaaccattgtcattgtccacaaatcaagtgatgacattctgttctaaaacccatggcatcgaaagccccatcggagaggtgaatgagactgaggaaaagggatgtactttgtttgcaatattgagtctgtttctctatagttttgtttcctgttctcattcttgaccgtcaggactctgagtacaaaaccatacgtatttgtgatataacagtacattacaataaaactatagagagagctcaatattgtaaaatgttaatttagcgttttctcacaggagaaaccatcccatcaggtgatactgggctgagttcaggaggtcctgtgaagggagaagtcaagcagagccaggaccccgcctggcccaggactacacacaggtaactccgactcagtcactgagactcagggcgctcacttagcccttcagagctcacctcacccctgccttaaagagcaacacgtgacccagtgttcaggttgtcctgagccttggacacgattttccattctctgctaagtgtgttgtccagaactaacctgtgtccccagttgaacttggggataagaactccaattgccaatgctgtgcttacatgaaatctgaaataatgaaatccttctttgcaacatgtgctccttagggaaattgttcttattgattcttattttatggaaattgttcttattggtgcctcagggggaaaaactgctggatgctctgctctgactccatcagtatgtaagagcaggggaagagaaatcaccttctcactcttagcagagggagaagacaattgaaaatagagggcagccgccttcattggttaagataagacagtggatatctttactgggcactatttaggggtgaaagcctacttcttagtagtctttctttactttccctttaatggtctctagtgcattagatgcttctagagaaagaggaagactctggctctctttatacctggtccaagaccatgtttttgggctagggaacaagaaggt

SEQ ID NO: 52128 - DNA, 1257 bp, Bovine  19866880490517
ttctgcagagaaacgggattgctggcaaggcttttgttacgagtgtcacactgagatcaatagagcatgaatgatgttcatgtcacctggtaaagtgaacaggtgaaacctaagtccaggaggaattcagttagcacattcatagatcaagatgcttccaagcttccaggtcaattctaactgttctttacacagtagttttccaccttcactggcacccacctatgtcctattcgtacttcactttccagttcaaataaaccttagtaagtttttcctaagacaacctaagtaagtttttcctagctaaccttccccatctaactctgaccagaagtgggaccgttatttctgtgtgtatctcttagaaacatttctgtgttggaaggaggaaaaaaatattttcacgcaaatttcttttagtaattcaaaagtgaaaacagtttacatcttagcagatgcccattctgtgggaggaatactctggtgatctgtaaatatgaactatatcaactgttcacgcttagggccgatgctctcactttgggaaagacgtcgtccacggttcgatgttctcaggctgtaaccctgagatgcgggccactggtgggcggggcttgaaaagctgcggttggcgtgtttatgcgtctggttcacagctgtcccagctggatagagtccctcagataccaagcagatgacaggcactgggctgatacgtgaggtgactgctgctgcctgctcacgggacatggctgtggctgcaggtatctttccccagctctgtaatcaacagtgccacttggcaacctgaggtcagccatggcggcagtatttacaccacggaaatcagcagtagctacaaatcaggaccttttaccttaaaaagctggctatgggacattaccaccatttaacatttacacgcatgggtatgtattataaattcaaaagcacagggctcagaatggatacacagattatagctatgttaaaatacgttaaaatctatgtgaggctcagaagcaaagaacagtgatgtaagtagagctttatgtttgttagatactttctctgtaaagttgagtgactaatttaaaacaaaatcctttcccagcccttgatatggttccaacttcttttaatgcaatagaaagtaaacgtaccatgttagattctaaaggaatcagtgaggtagggccccgagagcttgactgatgtataccaactccaagtgctgtgttctttgagccctgt

SEQ ID NO: 52129 - DNA, 1883 bp, Bovine  19866880610899
tgacacacacctggggacccttcacgacatgtgcctaaaacaatttgaagggatgaggggtgcctttccctcattagaatctgcgtttcagctcacacccacagagtctaatgctgacagcagaggtgtgactaaagtttcaaatgtgtgcaaaaatcttacttcttaaattgcttaagaaatatcccaatgttcatgctccgttttgcatccaagagagtaatctggaaaaaaacacaagacacataagattgttcaagtgtgaacgagaagagctggagactactgagcctgtgctctagagcccaggagccacaactaccgagccccgcactgcagctgctgaagcctgagcgccctggagcccgtgctccacagcaagagaggccaccgcaatgagaagcctgcacgccacgactagaggggagccccgcgctgcaaccagagaagagcccacacagcagcgaagacccagcacagcctaaataaacaaaatgatttcttaaaaaagagttggagaagagaattaagacctatcaaactacaacataatgtattaatatgagaatgtattaaagtaagagaataatttccagtatgtaaatctgcagactgatacctaatatagcttcaaaatattatctccccaagctttctacaatatttccttaatggtaacaatcatatatatatatatatatatatatatatatatatgtaaatatatatggtaccaatcatatatatatatatataaaccaatcatataaatatgcatatatatattggccaagctgcagggcttggggaccttagtttcttgaccaggtattgaatctgggcccaaagcagtgaaagcactgagctaaccactggaccaccagggaattcccatatagatctattttattattgcataatctctgatgctgggagggattgggggcaggaggaaaaggggacgacagaggatgagatggctggatggcatcactgactcgatggacgtgagtctgggtgaactctgggagttggtgatggacagggaggcctggtgtgctgcgattcaatgggtggcaaagagttggatacgactgagcgactgaactgaactgaatcttaaataaactatatcaacattttctaaattttacaattttctcttagaacaacacagcccacatttaaaagccccaatttggaaatagctgtcttagcatagcaagaatcatatgagatttgaactctgaaggtattgcagcatgagctccaaccctgatttagggatgttaaaagaccaacactgttattttcagaaacgtaataaaattcttagtatttttctaaacaaatattttattttcattcaaagagtagatccagtagcccttttaaaggaggaggtaagaaagtgtcctacacttttttcagaatttaaaagggaatttataagggaaaactcctaggctgtattttaccaagtctaagatgctttcttttttggcatgcgagcatttctggaatcctcacaccatcccactccatccacagggacgtgagtcaacccctgtccagcgtgtcctgcccgttagccacgcagcgtgtcctgcctgttagctatgggttatggggttaccggcatggtaccacggcgctttgtgttcacaatgcttgcttattttacttggtaatggcccaaagcacaagtgtggtaacactggcaactcagatatgccagagagaggctgtaaagagcttcctctaagtgaaaaggtggaaagttcttaacaaggaaagaaaaaactcatttgctaagggtgctaagatctatggtcagaaagaatcttccacccgtgaaattgtgaagaaggaaaaagaaattc

SEQ ID NO: 52130 - DNA, 1164 bp, Bovine  19866881397074
ttcctcaatttcttcatctaataatggggggcggggagtgataccctcaaaactaggtaattgagaaggcggaggaagataattccagagtgtgattattaactcagtgttctgaatacagtaagctctccataaataatacaccctattattactatattcttcagaagacagagggcatgttgcacttggtactaactgaagagtccattttcaggacatcaagaccagaaaatgtgttcctcagccctgttagatccccgtatccaggtgctctgtatggcttggtccctgccccttgtggggaggttgcctgagttgcaaatttccccccttcgtacttgccttccttgtaccctctgaacaggggaagggtccagactcctcccgtggcctgtgcgctgtctgatgaggctcagtctgcagactggtctaacagctgctggtggctgggtcacacggaggcgtccttagaggtgtggtggttttcagcaggatagatcagattcttttaggagcggtgggccctgcgaagccgcctcctccttccactgagttttcacacacatgtgttgtgtttcatgtcaggatcagttgctccgggaagttaaatgtttcttgagagtagatttctgcccagtcttactgagaatgtcagactgagtttgtgtctctgggaattactttgactgtatcaagccttaaagggagacagtgatgctagggttcctttaagccctgagaaaaatttctccatgtagtagataaaattccagttttgtccccatagagtaagagaagattctgtttttgttccaggaagcccaaaagaaagatgctgtgcttctaaatttttctgaaaaattgcttcatgttcaggaggctgccaggtaagcaagaaagagtatggtgagacaaacgtggttggttgtttttttcttaaccaccttcttataaaaactgatattttacaacttctggattcaggtttgaactttcaaaagttttgtctaattgaacttcagaccttcctttcatttggttacagaggtgtgtttgcacctttggaattatgggggttttcaaaaattaatctttatttttaatctaaaaaaaaaccctattgcagtttattctaagaatatcatcagtgtaaaaatgtat

SEQ ID NO: 52131 - DNA, 597 bp, Bovine  19866881590564
cctttagggcctcaagtgaattttacattttagccttactaagtttaaggagagatggaacttctgcattacttaaacccaaactagtgcctagtttctgaactgaaaaagccacaggatgaattctgatccctcctgaagtagcgtctaacgatttaccatatatgggcaggggcagagtggggctgtctgtgtcttttataagaccacatatgtagcgtgggcaagacttctgagaatcacagcacggcttcctgtctgaagcacaagagcaggtcatgctaagtacacttggtagatatttctattaaacatgtgctgaactgtaaatgaacaatgattaattgccttctcttatataatgagtgaaaaatgtttatggagtttaagaaaatagtgatactaaagatagtatttgatttaaacgccatgtatacagttcttaattccatttcaaaatgagatttatgttcattaagagggattactgtgccttcacagtgagggaggtaaaaaagagaggtggacaaaccctgtaattattgtgtattctcatcaccatcaaaaagcatttatcaaacattgttaggcatcatt

SEQ ID NO: 52132 - DNA, 1785 bp, Bovine  19866880396992
aatcgagggaactggtgtgtttattttttgacctctccttctagctcctgtgtgtttcccattgcactgtcgccaggctgtcagctttttacatcaaatgttttcactttcaagaaaaacacataacaagtgcacctaatttataacaatgatacagagctgtttgatgacgtggctttaatgccctttgccgatatttgctggcctgggtgtcaattctgaaaccttagctgggtatagaatttcagggtcggcagctttccttttcactgttcagtgaaggcttcacttttttcctagaatttactgttgtggaagggaaattgaggccaggctgatactttaaagaagaaacctgttttttaaaaattggattgctaaaggaagctttatccatggaagccaaaattttctccaggttttgatgtgggtctcagaatctagtgtaactggcaggtggagcatctgttaagtgtccagatgtgtttgtttgttttgaggacttttcctccctaacacggctgccttggtgaagagggagggtcaagtgaaaggggccccacagcccaggtgaatgtggagtcctggtgtgtgtgtgtgtgagctcctgggcatgcccgctccctgcccccgctggcctcttgcctgtctgacactgtggaacagcctctgccctgttcctcacaggtcctgcaccctcggtaggaggcgcgtgtctcctgtgggtgtctgtcctgggactcagtgactgtgcatagacacgcctctgatggactgcccggattgcagcccagccgcccctgtgttggccatgccggccaccccgctaccctggtgggatgaaggcttctgcctctgtgtcctttctccctgggtggggatgatgccattgtggcaccgctccagctcgttcacctccgtgaccccatctcccaggtatggccctccattcccatgttttagctctagcgtggattcaggcgcttcagtgagttcttactttcgtgcaagtgaattttgggagtggacaaggaaaatgcatgtgccagttgcactgttttgaaagaagaattcagtgggacaagtgttattgggaaagatggagaaagaggtgtttggagagcagggaacggcgtgggctgggatgatggccgtgatagccgcctggcagagtgcctcgtgtcctttgggggcgggaggtcagagggccctgcagggagggaagggtcagctcctgtcctggacccagctgggttggccggcttccttatttctctcataccccttctcccacttcacatttggaagatttttgtcctctgcttaactggaggaaagtgggtcccgctaccatgggccctcacatcttccttgaaaaatatggggggtaaattatttaattattgttttcaaattgatgtgctagtcaggcttctgatttataatttaattgtgctgctgtaggtagcttccaatttttcactggatccatttgaataaactttgtgttgtatctcagtattagccaaaggaagattaaaaagtaagccggagagtttagtagctttgtaacaatggcatgaaatgtggaataatgaactgtaaatgtgtctaattacataaataatgcatttgtgtaattgtcaagtaaggggggtgtgctaatgaatcaattatttttaattgtaggatgcttgattgtttcagaaatataattgattgtaatcaagaatcaattaaatgttgatagtaattatgtttatcaagcttaaatacatgacatca

SEQ ID NO: 52133 - DNA, 2005 bp, Bovine  19866880521939
aagagctggtggtcacaggcctggtcgggccatgggcttccgcgccctgcgttctcctaatcactgctctcaggggatgttcttcttgcttttcctttcaggggagaaaatcaggcataaacgctgcccaggacagtgggaggcaggggatgaaggggacaggggtcccgtgtttgtgagaccacgtggccacccccagggaggacaaaccagcggagggtcaaggcagtgcagagagggcggaagtgatcccaggcggctttcgtctttccctaaagagcctccgggcggtgaggtccctgtgcccctgcttccgccagcttcctgagggtgcgtcttctccacgtgggcaaagggtccggtgagattcacatcccagggcaggaaggggatgaagacaggacagaggaggccgtggcgcccgtggcggacacgcctggagacgccacacaggttcacagaaaagcacgctgttccaaggccttctgatattaacccaaacgcttctaccagttaatatgggcacaattggatcccaagacaagcaagccatttgtcactgtggggacactttttcttcaggacacagaaagcaattttaaaaagtaataaagtactaaagggggagtgtcaggtcagaaattactttttttttttaatgttttatgcctctatttttctaatgccttagagtgctaagcaaatcctcatcacgaccacttgtgtgtagacacttctgctttgctctcgggggcggaggccctgatccccgcaggctcttccgacgcccgcggctcggacggcgccatcactgggggtaacagcccaccctgcacgtccagcgcttccagggcggacggggcgcctgctggcccagacccagaccttccgcagctcgctcgagggtgccccccagaccctcttcaggatgcagtgtcccctctgttaggcccacgtggccccacgtccagagaacaggcaaatagagaggcaggtgtggcccacagcacagcgtctacgccccaggagtcggcgtcagcccgtggggagctccaggctcagccctgcaaacatcccacttcgcttgcccaccccccggccgctcaccagatcccacccctaaaccccctgcacggccccttccaggcagccaaacccctgcagaatccaccagaactcaggcaggcgaaatgtgcggacgtcaactctgagtccccaggggtcagcgtcccccagaggccccacgcaggcccaggaggcccctcggatctcaggggctggggcaggcctggctgcatgggccccggtggggaggcaggcacagcagctgagagccggggtggggttagtcgtctattccacaataaaattcaattacagatttaatctttccacccaatgaatatatgtgcacgctcagtcacttcagttgtgtccgactgcgaccccatggaccgtagcccaccaggctcctctgtctgtgggattctccaggcaagaatactggagtgggttgccatgccctcccccagggtatcttccccatgcaaggattgaaccgtgtgtctcctgcatctcccacgttacaggcagattctttaccgctgagccaccagggaacctaatgaatatatgtcagttcagttcagtcactcagttatgtccactctttgcgaccccatgaatcgcagcatgccaggcttccctgtccatcaccaactcccagagttcactcagactcacgtccatcgagtcagtgatgccatccagccatctcatcctctgtcgtccccttctcctcctgcccccaattcctcccagcgtcagagtcttttccaatgagtcaactcttcgcatgaggtggccaaagtactggagtttcagctttagcatcattccttccaaagaaatcctagggctgatctccttcagaacggactggttggatctccttgcagtccaagggactctcaagagtcttctccaacaccacagttcaaaagca

SEQ ID NO: 52134 - DNA, 1949 bp, Bovine  19866880885661
actctcagcttagaggtcactcctgggtcctggttcgcggcctctggtgggcagatcgggccagcaggagactctgatgctggagcccgacttggtgcaaaggtgtcgcttgtgtctcatgacctgaccccacccaggaagtcactccccacagtcccaggtgctccacactcagagtggacgctgcataggtctgttcacttgtgcgtggcggggatctcggggccagttcagaattctgtccacctgagacgctcatcgatttgccttagaaaaagtcttcctagttggtagcttacctcccagaactagactttcccacgtttatcagaaaaaaacacgtatttaaccagttacctctctcaagtcccaggtcagagcttcaggcttttatgtttataagcaatgcttctgtcggctctaagaggtgttgctcacacacacgtgtttttgtttctctaaatgagaatttggttccattttgtcaagagagagtcctttccttcaaaaggatgtagattgtttgctaaaactctccctgcctcctgggggttgatgtcgtgaaggcgaccccctgttggaaactggagaagagggggatgtttgggaatggtaccactttcagacaaacagaatttttgttactcttgatgctgtcaaactttaaaaaataatctagaaagtaactgaagaatatatagcggagatcaaagacgaatcaaagaaactgtaaaatcacctgcctgttgtgtaaatttgcaaatttcctttggcgtttcagctctccagagcccagagtattcaccctctgctcaggcacagagcctcttgggggagccagggaggaaggcactagaatacaagcctatttaaaagaaaaaagagttttattttgaaaacacactgttaaaaattggtcattcacattagccgcggtgtggtcagttggtttttgtaattcaggtatttttgcctatgaagaactcactccatcattttaggcaaaagaaaataagtcctcctctctggaaggcttacaggggcgcgccctccacagaaccggacggaagagcctcactgcccttcgcttctctccccaccagcaggtggtgcggctttctctccaatcgtgaacacgctctgcctgactccccgctcagacactgggttagctcccaattccttgtgcttttgcgtcgaatgaaattaaccggttggatactgacaggccacaaatcaatagtagaactagatctttgaaatattcatgtgctggttactcttgggaccagcatccacgaaaagagcccagacctcctgccagcctactcacagacaagactgcttcagcatccagattcttcttccttctcacggcagctctgcccacccattcctgctcagaagacagcgagctaggttcagagacgaggcggctgtgagcccacctgagctcagctccgatcaagtattcagagccaaacacaaactagggcaatgccagcatgaaccaatgcttcttaattagtggtaaagaaccttcctgccgacgcaagagatgcaggttcaatcctgggttgggaagatcccctggaggagggcatggcaacccactccagcactctcgcctggagaatcccatggacagaggagcctggtgggctacagtccatggggtcacagagtcggatacaactgaagcaacttagcacgcacaccctcctaaacgtcacaagaggcttacaggagcccaggtatgcgtttaagatgctggtggctcagacaagggggcaaaagagtcactgtccaccgtacctacgaggttcctgagcactgcttgtttgcacgtcctcgatgacccacacaccaacatccagcacacaggacttgatgcatttgtgtgtttccaatgtgggtttgtatgtacttttttctctttgatattttca

SEQ ID NO: 52135 - DNA, 1256 bp, Bovine  19866881189262
ctggcctgacagccctcctgcctgccgtaagggcttcagggggtaggttgaagaggtaaatgatgtggactaaaagtagtcgtagctcagctggtaatgaatctgcctgcagtgcaggagacccatgttcaatccttgggtcaggaagatcccctggagaaggaaagggcaacccactgcagtattcttgcctggagaaccccacagacagaggagcctggcgggcttcagtccgtggggtcgcaagagttagacacgacttagcgactaaaccgccaccaaagtaatcttccacggaggtcgttttaagagtttctcagcgtccacagagtgtccttagcccaggcgtcgaaacctagcgtgtgagtcactcattttggaaccacttgtctgaggaagagaagtgtgttttgtttgatcacgtgcggccggcctgtgggatcaggacccttgctcctgctatcctggccttgttaactgcacagagagcttttgtttctctcgcttgggtttatttgcagagacggccctttcctcgtgtttctctctcagtgataatgagggggtgcagtgtacatacattaggtggtgctgtctggctcctgacttgttaatacagctttatgtcgctcacacctatggagagagagtgaaaaagcagaaatatgggtgacttttatgaacaaagaaataaatgccctagtttggagcagcaagtgtggcagaaactctgggtcattttcctatgtttatagcgctggttccctggtgatgatgtgtgatgcagtagaatttccttttttattgcacttcgcatgccctgcttattcccgcctttctcgatcacagggcttgctccctgtaaacccaccgcacgtactgtcagatgcgtcacccccgggtggacagtaaacagcaactgtgctcagcggctgggcccgagtgagagggggcgtctcctctggggacagtcctgtctgtgtgcacctcaggcccgctcttttttagcaaggaccccgatcgcctggccgtgccgactgtctggagacggacacacacacacaccctgggtttgttgcttccatgggggcagaagttgtaggacaaaagggagacgcctgggaggagcacagtgggaaggtgggggccgggagccgggtgaggctggcaggaggagcgcagtggccaaggtgggggccgggagccaggtgagactggcaggaggagcacagtggaaggtgggggccgggagccgg

SEQ ID NO: 52136 - DNA, 672 bp, Bovine  19866881514759
agtttttttttttttttaatcctcacattgttatgacttaagaaatataatcttctcttctaaaaatctttcttagtcaaatgaagtcttgtcccttctctgtagaaccaaatatcctttgttcacaactcagacaagcttaacctctctggaggctcctgcaggcagacaggatgtcacagggactcgtctgcctcagcaagcatgggggtcattccggaaaatccctgcaggagggcgtcggggccttgagaaaagcgcctcaggagtcaagcaggcagattactcgtatgtcttagatccatgctcagcttcataatatgcttcatttctctggattccatggggttcgggctcagccgagctctcatggccaagagctctcatccccaaagctgaggaccagcccttcatagtgcttgtctctggggaaagaagtttttgagaaggttcggatgccttggctctttcgtattggccgagtcacccccgcagtccttctgagcagaagcctcccgtctgggcgagctgaggccatggaggagggagggagctggtttgcctcgtgttcctgctgctcactgcctccgtggtcttcgtggcccctctgctagttgagcctcactctcctgccctgtaaaacgtgactcattttctgcctcatgtggaggg

SEQ ID NO: 52137 - DNA, 1051 bp, Bovine  19866881655170
ctagggttgaggtgggcggccgactacctgcccagccggggtgtccagtgaatgtcggcgagcagccacgctgtacgaggcaccatcctagacccagaaaaccagaggtgacacgctgccgtggggtctgggagcaggtttccaggggggtgcctgccggtaagcgtcagtgttgggggctggcaggacgccccggggaccggggctcaggtgacgcggcttccccagacatgcatgtgagcctgggacacccccagtttggacgggggggctggggcacccctccctcttggccctgacctgcctcccccacatgcagggcagtgagaggccaccggccctgaggccccgaaccgacggtggaggcgtgtccctccagggcgccgactccgagtctcactgcaagcgccccagcttctgccccagccccggccgcccacccgctggtcagccgcccggcctccagcagggcctctggaatccccggaggcccgggagcccaccgggacgctccctggagcagggcgtctcctgcatcaacattctcagcaaacagccctttggcttgagtgctctcaggaagatgattaacataatttccttgacttcctcaaaatgagatgtttacaaggctattttggcaaaagcaaaagtcatgcaggttggcgggacccgatggaaacactgctcttactttcaatatcaacattgtcgaacaacgtgggtgtgctggtctcagccacttctcgggggtgttttgaagggaaatgcgggcatgtcccagaaggaaaggagccccacaaacttcgggcctgccggggcacggggttggggggcagggtggggggccggctctgtgctcaccttggccgcagtaccgctgcccagcactggggagggaatttattcttcagaagtcagttcatgcttcacctcctccaggaagccctccttggcttctcattcttggccccttctcattctttctctgagctaccattatgcctcttcaatatttctattattttacttacaatactataccaggaca

SEQ ID NO: 52138 - DNA, 1105 bp, Bovine  19866880420250
gggagcaacaagcaagaagacaaacaagattcattccaagagaaatgagtgctctgaagagaaaacacagggatgttatagagaagatggggtgttcagaaaaggcctggggagaggacatgtgaacacagatctgaaggacgtggaagggtccaggccaaggaatggggaagaggagggtggtctgggcagaagagtcagaggtggctgagtcctgcagaggtcagtgtggataaacagagtgaatggcaggaagggtggtaagaggtgacatcagggaaggaggcagagtattgcaggctatggcaattcaaaatgagtaacctagattctggagaaggcaatggcacttcactccagtactcttgcctggagaatcccatggacggaggagcctggtaggctgcagtccatggggtcgctaagagtcggacacgactgagaaacttcactttcacttttcactttcatgcattggagaaagaaatggcaacccactccagtattcttgcctggagaatcccagggacagaggagcctgttggactgccgtctatggggtcgcacagagtcggacatgactgaaagcgacttagcagcagcaacctagattctgatccatgtaaccaccatcagaatgggatttactctaacacgcttacattcacttatattcacgctccccatgggaaatcactgacccaagaaatatatacgaacccaggtctcctgcattgcaggcagatgctttaccctctgagccactagggaatctccactgatcatttactacatacaaaatgtggtgttccagaagaactttttaaaagggatgccatggcacctaacccacatatctaaagaatgttttgttcattgttatttttcaagataatagctaagaaaaacataacatcatttatactaataaaatccaaaataacagagaacaataatttctatttcaatattacatttatgttttctgcaacaccataggacctttcctgttaagatcttgccattcggcaaattccacaataactttcaaaagttctttttacttagttctaagcaaaatattattcctgatcttgtctagata

SEQ ID NO: 52139 - DNA, 2875 bp, Bovine  19866880514143
cagtattattaacaatagttaccacagtatcttacatcccatgacttatttattttataactcaatgtttttaacttttgactccttcatctatttcacccataccccctccctcttcctctggcaaccagcagtctgtctctgaatctatgactctggcttttttgtttgttttgatttgatttatgtgtttgtttaaggttccatatttgtaaatgaaatcatatggtatttgtctttttctgagttgtttaacttagcataatgccttcaaggtccattcatgtaacaaatggcaagattcttttttttaattgctgagtaatattccattgtatatgtatacaacatcttctttatccattcatccattgatgggcacttaggctacttccatatcttaactattgtaataatgctgcagtgaacatgaggtgcatgtatcttttaaaattaatgtttttattttctttggataaatatccataagtggaattgctagatcatatggtagaaataactccgtgaatgtgtggtcaatcaatctatgatgaaggaggcaagcatatacaatgggaaaaggacagtctcttcaataaatggttctgggaaaacaggatgtccacatatgaaagaattaaagtagaccactatcttctactatacacaaaaatgaactcaagacggatgaaagatttgaatgtgaagaccaaaactgtaaaactcctagaagaaaacgtaggtagtaagctactcttgacattagtcttggaagtaatcatttggacctgacttcaaaagcaaaggcgacaaaagcaaaagtgagcgagtgagactacatccaactaaaaggcgtctacatagcaatggaaaccatcagcaaaatgaccaggcaaccaaaggactgaagaaaagtgtttgcgaaccatattcctgagaaagggctaatatctgaaatatattttaaaaactcatacaactcaatactttttttttaaatcagattttaaaatggacagggggcttgaatagatatatttccaaagaagacatagccaataggcacatgataagatactcaacatcaggaaatgcaaattatcaggaaaatgcaaatctaaacaataataaggtattacctcacacctgttagaaatagctatcattaaaaagacaagaaataagtattggtgaggagatggagaaaagggaacccctgtgcaccattggggagaatgtaaactggtgcagccactatggaaaagagtattgagtttgccaaaatgttaaaaaaaaaaaaaaaaaacaatgagattttgcatctgtcagaagcttccgatgctactggtctacccaaagccccctctttgaggagagagggccattaggtctttagcagtcctcatctacccagatacctgttttctattttttggtcccttcattgtgttcctaccagtcatccttcaagttctattacctgctttttggtctgcaaagcacataggctgctagctactgagctcaacatgtcttccagctttaaaagaagctttccaaaactctgagacttgcatccgcaatccctccaaaaagcaggctaatcttattaagagaaggtctgaagtgtcctgaagaacaaacactcagtgtgacccctttgttctccctgcctcgttctccagtggctctctgtgcatgtgtttgtctcagaacagtcatgcacggtgggcccattcgtctccccttatcgccctgtgactgctgcctagcactcgttcagctgtgcactgcagcttctcggctgacaagataattacattcctgggcagacagggagaaagagtgggagtgctcaaaagttccgaagccgactacctactcattgctggtgcagacttcaagagcaagcacctgatctaattagcacacccccatccctgcccgccagattgtggaaagctgacaattaaaagcctgaaggcaaaacaggtattgcgcaactcagagatagacattcacgctaccttgtgccagaaacaattacatattctttttggaatcttgggtgtcctagtaacacagtcgggcctcggggtaaacttttgcataatactgggagacctgcgtttaccgtaatgaacagaagaataaaatctcacaagaatgcaagacctcttgggaagaaatccttctgattacctccagaaggccttatttcagtcaaaccagctggcccctggctctggaagaagcacactacctgacaaaagcaagcctctatccacaaagagctgttttcctttgaccagataaatagcacaatacagtctacagggaaaaaacatgttttttgcctctatggtttcatgacttcctacatttctttcaagatgtagccttcaatttgaaagcgattatagccacaaccctttctcttcctttctttctactttgagtaggagagtattctataatctctaagccccttcatatataagtaccagccattattgtcttaactttctaatgagactgccccttgatggctgttggcatttgcacagtgagcaaggggagccaagcgagcactggctttgaagtcaagatctgtttctaccatgtattagttccgtgaccaggcaaggtactcacttctccaactaaaatgaaggcttaaaatctttaaaggttaaagaaatcaaaagagccctagcagaatgttataggttgaattatgccctacctccaacccccaaaatatgttaaagtcctaatatctagtacctcaatgtgaccttgtttggaaatagggccttgcgggtgtaattcagttcagttcagtcgctcagtcgtatccgactccttgcgaccc

SEQ ID NO: 52140 - DNA, 784 bp, Bovine  19866880557533
ttaaagactaatatcatagcttaactccatttttatggcacatgattttaaaatatgcatctagcccagactttggaatatacgtgtttcatatatgaaaaagaccagtgaaaataagtaaactgtatacttacgtatgtgtgggagtaggtgtattcacacacattttcttaatgttgagtgactaaattacacatgtgaggtcaatcatagcacaccctatttaagattgcattacattgctcaataattgttgtatcacttccattgcttatttctctttcagatgcaccctggctcttttatcaggatgcagagtacctttttcatatttctgcctcagaatggtcctcctttgagtttgtctgtggctggctgcgcagtgatattctcactattcattctgcacacgaacaagaattcatccacagcaaaataagagcggtacttaaatttaattaactatgagaaactcagagcttaactcttcttcagtccttgaggggttttgttttcaaaagaccagacattaatttgtttcattgaaagtcttagatttttaagaattgtttttcttcctgttacaaagatttagagaaaataatggaaacacaggtttactatgcttgttggttatttcacttctcatgcttttttagcaacaaggatgagtgagtagcattttattgttttgtgaggttcattccatcattcaatgcttatttattttgcatctactattctagggactgaggttttatcagtgcttccaaaagaccaaaat

SEQ ID NO: 52141 - DNA, 658 bp, Bovine  19866880663972
aatgacaaaaacatgtaacagccaataagtataaggtttaagcaactaaatttgatgtagtgcacagactgtggctacgtgcctcaaagcttagtcacaaccaggtaaatgtaagatcactttgcaggattatcaacgcacataacaaaaaaaaaatgtttttacgaagcaccatgcaagtagcatgatccatatggatcacagacatacaagaagatacatagataacaggcaatagaaaataggctccaattagcaaagaagcacaataatttttcaagttaatctcaataacctacccgtcaccatcaccactaacggatggtgcaggagcagggacagtaactgtgcccacattatccagtttgatctgaatggtggtacttaaggggctcttcagataccttctttcaatgttccgctccaaatcagccagcctggttacagctatatctagggggttgtcactcttccgttccagtgcatgtgcactgccttcttcttcgccagtaaattctccatcatgctccttgcacaatttagaaaatgacttatgttcaaaatataccaagtcctccctttctgatgcaggttctggacacatccaaccctatatatcaaaagaacaatgttatatggtttcctcttgaaatgcctg

SEQ ID NO: 52142 - DNA, 2338 bp, Bovine  19866880733218
ttttttattgaaggataatagctttatataattttgttattttctgtcaaagctcaacatgaatcagccataggtatacatatatcccctctctttaaacctacctttaagataagttaactcagcagcactgttgatgctcagtaagtcagctccttgattctgacatgaaacgtaagcttccttccaagaaagagttgcctgaatattaaattggtagcaacttccaatctcctcgttcttttcccaattatcttcacagccactttctgttgataaaaagatatgtcagtgatcataaaataagggcataatgttgtctattactaagagtacttacaaatactgccatccaatttgcatactcttaagatatgctaagattgaggctgtcattgttgtactagacaatattttgattctttggttagatgaaaaaaccaaactcacaggacaggaaatgacttagactagttaaagcttccatgctgcttctagcttctactctccttttatataaccccattggttataatgtcacattttagcccacgcctaccctctgcctaagaacaggagtatttacctgtgttcaacccctcggctcacttgaagatggtatcagactaaagaggggtttgcccatgttctgcagtgaaaccactgaacgtgtttgcatgtgtgtgtgtttagacaatgcttaagtgcctaagatttaacgcgcagtgataccttatttgcgaaactcagtctagtttctccttatattttaaaagatgatgtaatatatgactaatcttacagaactaacattatatatgcactatatgtctgtatgtacatatgtgtgcatgtgtgtgtgtgctcagtcatgtctgactctttgtgacccccatggactgtagcccaccaggctcctctacccatgtaattttccaggcaagaatactggagtaggttgccacttcctcctccaggggatcgtcccaacccggcgatcaaatccatgtctcccgtgtctcctgcattggcaggcagattccttaccactagcgccacctgggaagactatatatgtatatataaatatacatgtacattgtgaacatcgtttttcttcaacaaatatctcaagaacacgcataacttcagatgaagaaccttcaagctctttccaggacagatatgtaggtcttgatacaattagttcaaaaatatactcagggcctccatgtgctcccaacaagaaggaaaaaccaacagagcttatgttaagtgtatccctggcttcacgtgggatcttccaaagggtctctcataacctatggacccttaagcaggaagggcccttagagatccttttgtgtaatgtcttcatttcacagataggaacaaggatctagggacattagcagcagagctataaccagagtacagctgtctaactcgggtgttgttgattctctgaatggcatacactgcttcttcagccatttctgaatgtcctaaaccacaacagaggtggttgtgacatttggtaaaaacaaagtaggtggatttgcaagtgcattacctaaaggttctttttttatcactaaggcaaaacacttgtaaatctggaagatttcagcaggacggtaatgtattatttgctgtaaaatacaatccctatggtttagcagtcctcagatttaagaaactcacaatctcacttctgtagaaagggaggcacatgaatgcactgataacccccgctttcctccaaagtaggctaaaggcaccaagacacacgtcagtcaaggcagcaaggtggaatgggatggggaatgaacaaggtggaacaaggtggaacacactgggaaatgaaggtcagaatcctgggagatctaccaggctccacacaaatacagtctgacactgacaggctatttcatcaatctaggtctgctgctcctcacctgagaaatgagggtttgctctgaataacgtctaagcctctccacaatccctaaagtttctgatccagactttgtgctaggctaagtcgcttcagtcacatccaactctttgcaaccctaagaactgtataccaccaggcccctctgtccaagattctccagacaagaatactggaatgggtgccctcctctaagggatcctttctgacccagggatcgaacctgtgtctcctatggctcctgcattgcagatggattctttactgctgcaatggggagcccatgatccagactatggtaagactgagccactggggaagcccatgatccagactatagtaagactgaaataaaattggtgcctggttgaccgaacccag

SEQ ID NO: 52143 - DNA, 785 bp, Bovine  19866880839434
cctttacttgcatttggaacttgagctattgtcattagcaataaatcagaacaagatgaagctaccacatgtataatcaaaaagaaaacaagattaaggtagtaattgaagctgaagttcatatattacacaatcaacattaaaggatttagaattaaccttaccattaaaccaagtcttggcagacaggtaaaagcattcctctccaaacattataggaaagtgatgccatgggtctcgtgaactgaaagaagatgagagatgtgacagcttgcaatgtagttacatgttccatcttgggctttactgtaagcaattttaattctaaatttaatgttaggccattattttatactacttttttcttgatgctcatttgcaaaaggatttggtttctcagtctcggtagtttaaggactaatgttcaaaactaattataaataactgctccatatagtattaaataaaaggggatttgggacagattcttttacatgataactttacaaaggcagcatcaaagatgtcacatactatataaaacgatgtgatttcagctgttcagtagttctcacccaccatttctgctcatcactagatatctgaaaaaaacaatgcaaaaacaaaacaaccaagtgaacacctacccttacatgtgctaacttttctaggagagttttgatttaaataccctggcttatcaaaatcacaaaccgctaaaatttctgaatattcattactttgtttactaaattacataaacgggtcctttcacgaaggaagta

SEQ ID NO: 52144 - DNA, 1917 bp, Bovine  19866880853553
taaaggtacttttactgagaatattttgacttcctttatcctaaagcagttgagcttccctcatatctcagttggtaaagaatctgcctgcaatgcaggagaccccagtttgattcctggatcgggaaaaaatgctggagaagggataggatacccactccagtattcatgggcttcccttgtggctcagctggtaaaagaatctgcctgcaatgagggagacctgggttcgatctcagggttgggaagatcccctggtgaagggacaggctacccattccagtattctaccctggagaattccatggactgtatagtccatggcatcacaaagagtcagatgtgactgagcgactttcagttgctaaagcagttacttaccctttcctaactgatgagggtatagacaaattcacaaagataagcaggcagcagttctaaagtatagtttaggtctctatccccctccccaagagccttcatctctctatttcctgccactaggaagtacaccaagtttttgcgtttttataagcaatattgatatgctacaacctatgaaatgagtaataataggaaaaatagctagggaataaaaggaatatactttaaccatttgggaaatattgatttaaagagactttctttactactggattgtttttaaaaatgtgctgaatggaaaattatcaccacagtaatcttgcttttcacttctcagatttacgaaaacctgcagactgtagtaccaacttgccctttgtctgtgaaaaacacaatgtatcttcattagaaaaatatagtccagattctgcagctaaagtgcagtgctctggggattggattacttttcagaacaaggtaaaaagggaattgctacattgtgcagatgatgattgctttcatgaaggttatatggcccatggcagaatgacatcccaagtaacttcactaagatagactctgcatatttcagtatctcacctgattctctacattttcagaaatggagttactctcaagttagtcacgcctagcgacttagcagcagcagcagcagccggcctttcagaataccatgttcctgttccattgctgctaacacttaaattgctgaagttgatctttcaatgaatagtctgttaactagtcaggactatctctttggcatgtagaaaactgactgaatttctggctgataaattttcctccttaaggaaaacatccaagcagcatttatcaatcaaattaaatcaacattgcccaaactgcttttggggaatatacacatatgctaacaaaatattaatcattgatcttgcctccagtgtagggtttatgattaaatagattgggaagtgccacattctatatttgcctccttgagatgcacaattcatgttggtgtatgtatctaaggaaatgcgactggctgctaaaaagagaaattactacagtatgctaaaacatttattctctcagataaaagaaatttgaagataagcaggctggggttggtatgaaagctctgtggtcttcaaaaccagacttccctttgtctttctgctctaccatcctttttttttttttttttcgctctaccatccttaacttgaggcttccaagctcaagttcagggtgtttgtttgcggagtcttttctagaagtcccccaatgactttatatctctctggccactcttgtctgtaaggaggctgaaaaaaaagtttttgtagaatgtttcaaggaacataatttgggccatactactacacagtaacatgacaataatatcaaacagaaaaaggaagagatgggtctggcaactgaaagcgtctgtagtaaatttaaaatattagggatatattttgactttttaaaattaaaataatcttttcccccccaaggtgactagga

SEQ ID NO: 52145 - DNA, 2454 bp, Bovine  19866880921951
atacattgacatgaatcagccatgggtgtacatgtgtcccccatcctgaaccccatccccatccctcagggttgtcccaaagcaccggctttgagtgccctgtatgcattgaacttggactggtgatctgtttcacatatggtgatacacatgtttcaatgctattctctccaatcatcccacccttgccttctcccagagtccagaagtctgctctttatttatatctgcgtctcttttgttgtctcgcatacagggtcatcgttaccgtctttctaaattccatatatatgagttaatatactgtattggtgtttttctttctgacttacttcactctatataataggctccagtttcatccacctcattagaactgattcaaaggaggttctttaccatgagaaggggatcggggccaccgtcaattaaatcagcgggtcctggagtgaaagggctgactgtagagattcccaccctctctcacaatcgggaggggtggggtgggtgatacagtttggggcgtggcactagcctgagctcaccccatatcgccagccctagaggtttgagctgtttggaaactgctgctattccaggacacatcctcggccttctacctagtcttcccctgcatgcattgtgagtgtgggtatttggctgaaatgttcacatgaaacaaaaagccaaattcttccttggaactggagattattcagagtgctggtttgcagcacttgctttattttagtgagtcctgaaaaatggcttactcttgtctctgtgtctctttactcatttcttgtaggtacaggaggaagtcttgctttagattttaggagctcctttctctgcttcctacagtttttagtaagtcgaagctcttattgaggcattattctacaaagtaccagaagggcagggaccattcctgtctcgctggcctttgtaaatcagatgccagcccagaaatagtccgtgttccatgagtgtgtgaaggccagtgaatggacggatgaatgactgaacagagctacataacaaaacctgacaaacaggtttgagggttcagaatttcagaagtaagcagctgtctttgtctctttttctttgttttaaaatgccagatatcacagaactatggaaaatggaaacacctccacttacctgccaccaaaaccacgctttcctactcccttgtttgttgctgatgttgcttagtcattcagtgtgtctgactctttgcgaccccatggactgcagcctgccgggctcctctgcccatgggatttacaggcaagaatactggagtgggttgccatttccatctccagaggatcttcccaacccagggatcaaacctgtgtctcttgcgtctcctgtgttaacatgtggattctttaccactgagacacccaggaaacccctcccactccccgacacacagcaaataacgtctgacaacagtctgcctttaacgccttgacatgcccaccacacagatgccagcctggtcttaggagacactggggtgccctgcacacatgcttcatacacagaactgacttttctacaataaaaggaatgttggcctgagaggctcttattatatttatcctgacaaggcttttaacttcaaaaatcttttccttctactttgattttctctctccctcatctttctgttctttctcctttccactgattcccaaagttatttaagtgttttctcccttaatacctttaaattcaaagttctgcttctttagcagaatttagcaaatctgttctaagactctggcaatctttttacaataagcaagtaagcaactcaaacctatttagcagaagttccttgaggtcccaggggctgtgtacctctttcatatatttcacaaatctttattatatcatttcatgtgtactttggttgacattattttttacctttgtgcagatagtcacaaatgcctccaccgctggacatataggaaacccacttatggagatacttccttgaggccacaagcgtgttgtcctgcttcacctggaccaggtactggagtgggcctgtgatcgtcttcttgttacagtgccacttcaaggaaacgtgggtggaatcacactcgtatatgctcagcggctgctctggactagacacgttcaggcccaggcagccactgccttccgatgttaaataggcggtggtttgaaacccacttccacagcatgtacttgttgggtggtttgcagttctccagggtcagtgtagatttgctggcttgaatacatttctcgaggttctcactttggataatgaagattcctttatctgaaacagcaaaatagaagatatagtagagagtcttcatatacaattaaccagtgtcagggggatcccaatgtgcatgtctgagctgtgacatgtcacaccaacagctattgcatctcaaa

SEQ ID NO: 52146 - DNA, 883 bp, Bovine  19866880937411
tgatggacataggaattgtcctacaatgcccacccacctctctgctttaccaggctgatgctgacaaatgaggtagaaaggagaggtatagatggacaaaatatgtgcgcagaggtgttttttcccagggagtttgggagtaagagagacacaggacagctgaaacttccaaggtccagaaaagtttgagaagtgttcaaaagaatggaggagagaaatatccttattgtcttgcttggggcccaccatatacccggtatttgattaaatcctcattgagtacttaaaactgggagaagaggttttaaattgtcttgtggtttaaagaatgttgagggaagagaataaagcataaaatttcttatcatccaaataggagcataaagctgttcttttaagattaaaaaataataggggaaaatgaacagtcatcttccaagttgattcaaaccaaatttagtccatacaacaaaaggcatagcagaaaggacagcaccaatgaaaataaaccagggtgacttatatagatcaaataaatatcctttagtagcaattattaagtaaatcatgatgtttccacatgattgaacaaatgcatttattaacataactgtgccagcaggaaaatacaaagaacagaacaaaatcatatgtttacttatcaatgtaatcttgtaaaaatatgtattcatagagacaaagactataatatgaaaacaattattttaagttcaattgtgagtgtttttccctctgttcctttattataattgtaaaatataataataagtgctatttcagaatcttaaagttaattgagttattttacaagtgtgagaaggtgaaccctggttttatcctttagtaaaaaacacactgtcca

SEQ ID NO: 52147 - DNA, 1464 bp, Bovine  19866881086790
gaattcttgtgcttgctggtgggaatgtaaaatgaagctcccatgggaaaacagtatgggtattcctcaaaaacttaaacatagaattagtatatgatgccagaagttccacttctgggtgtataacccaaagtaattgaaagcagggagttacgtgacacttggacatccatattcacagcagcgttgttgacagtagtcaaaaatagaagcatcttttttctaccagtggttggatgggcaaacaaaatgtagaatatacatactatggaatgtttttcagctttcaaaaagaaaaaaatactgacacatgctataatatggagcaacctagaagccattatggatttccctggtggctcagtggttaagaatcttcctgcaatgcagaagatgtgggttcgatccctgagttgagaagatgccccggagaaggaaatgtcaacccactcctacctttgtctgggaaatcctatggacagaggagcctggtgggctacagtccatggggttactaagtcagccacagcttagcaactaaacaacaacaggggacattaggctaagtgaaataaaccaggcacaactggacaaccactgtgtggttccagttatgaggtaactagagcagccaacttcatagagacagaaagtagaatggtggttgctaaaggctggggataggggaaatggggagttagtgtttagtgaatacaaaatttcagtttggggagatgaaaaatattctagagctggacggtggtgatgattgtgtaataaaataaatgtacttaatgccactgaaccatacacttaaaatggttaaattgataaagctttatattatgtatattttgccacacacaaaagttaactgtaaaagtgtttggaggatattgtggttgcaagaatatggcaggactgtaaaaatgcttgcaaataatgaatatttaaatttaggagaaaatgagatattgcgtcatttctcactttgggaaaaactgtcaaaatcgaatgtgttttggattattttgtacaaatattccatggctgatggattcaaggtatagatatatatgcatttagatatatatgcatttagacaattatcctggagaaggcaatggcaccccactccagtactcttgcctggaaaatcccatggacggaggagcctggtgggctgcagtccatggggtcgccaagagtcggacacgactgagcgacttccctttcacttttcactttcatgcattggagaaggaaatggcaacccactccagtgttcttgcctggagaaccccagggacgggggagcctggtgggccgccatctatggggtcacatagagtcagacacgactgaagtgacttagcagcagcacaagcagcagacaattatccaaggtaactttagaactcaagttttgcgtatgggtctctctaaagcaaagggccaggcctc

SEQ ID NO: 52148 - DNA, 1249 bp, Bovine  19866881189854
gacttctgcctgggctcctttgtgaaggcacttaatgcccaaatctttacaggcatctgcacagcttgccctcttctcaaagtcctacagtctccagggtgcttcataccaggtgggcacagatattggtggctctggaacagttcttgggaatccaagattaccctacttagctaatgtgctttttttatccaaagcaatcggcactccccatgatcagattccagtacactctttgaagtgtcatccagttgattatcttctatactcacctttaaaatacttggactattatatgtagtctgtgtaatgttttacctttagagaaaatttagcatcctttgaagtaaggtttcagaaggacctaatcctccttttttaattccttgaatattcttaggcatgggtttttgtcattgagtttgtacaattttaagttttaaaagaatttagagctgcagttaggtaatacagtttcacaattttggttagtacgtgtggaagtggtatgtaaaggagtcaaaatggtataataaagtgggacgtcattgagtgtaaatctttttttccttcataccttcttagtccaggtccatcgtgttggctaatacaaagatctcttttttgtaagttataatttatattttgtcaaatgtgatgagagtaatctgctgcagtgtacatttactcagattgctgttaatttttttactaatgttcttatttagaatttagttttttaagcacgtgaatgagagggaaaagatggagttgaaatatgtatatccaaactcagggtgaaagatgttgtgggtattactagttgactcctaaataccagagtactaatatattctgaaaactggttttgactgaattttcttctgtagagttaatccagtagaaaacagaaattctctgaaaaactattttattttttagtttgacatttctccatgatatatataaaacttaagtgtaggattttactcctcatgagctaattaagtatatgcttggtatcatttatttaaaatttctgcaaggtaaatatatggagacttaagtttcatctgtacatgttgcatgatttttttcttgttgattgcatttgctgggtgctcttaaattgtccagtattaaatacaagaagagtatgcatttatcttttctgctcttgataaaaggggaaatgctggttagatttttaggtgagtttccattttccttcacatgcagtttactatgt

SEQ ID NO: 52149 - DNA, 1779 bp, Bovine  19866881246438
tataaataaaaactgggatgtaaagagataaaatggttttgaaaaattaaagcataataaatacctcattttacctggaaattatatttagaaacacagatgttatatatttttaaaactgtaaagagtatattcatccaccgaatatttaatgggtgaaaaggcccatatagcaaattgtaaaggaataaaataacaaagcataaagtccagcataatatttaaaatggataactaacaaggacctactgtgtagcacagggaatgctgcttagtgttatgtggcagcctggttgggaagggagtttgggggaaaatgaacacatacatgtatatggccgagtccctttgtggttcacctgaaactgtcacaacattgctggtcagttacaccccagtataaaataaaaagtttaaaaacgaaaacagaaagcccaaagaaacagcagatcaccataatcttttcagtcatagagaccatattgtatttatattcatcctagcctctgatacactgccatattaaacagactgtaatgtctgctttggagaaggcaatggcaccccactccagtactcctgcctggaaaatcccgtggacagaggagcctcgtaggctgcagtccatggggtcgccaagaatccgacacgactaagcaccttcactttcacttttcactttcatgcattggagaaggaaatggcaacccattccagtgttcttgcctggagaatcccagagacaggggagcctggtgggctgccgtctatggggtcgcacagagtcggacatgactgaagcgacttagcagtagcagcagcagcaatgtctgcttaatacatgctctgttaatgagagatcatttgttcatgctatacttagacagcatattctaaaacctatttagtattatagccatggcttgaagcaaaggaaggaagcaagcccatttatatcagaaagtgattctaaagcttattctttgaacacctttagctttttattgcagggattgacctttctcagcaagatgtccattgtccaggttgtgttttgcctgccaaggagtgaagtcagattactgctctacttctcacaatctgagttccacatctctgtttgtatttcagtgaaaaggcttcagggcgcaccaaatcattgcggctctaagatctttgcaactcttaacaccagcccaccagggaaagccattgtgaaacaaagatggctttaggattagcgaagaaagctttgtttgcagagcgattgctgctgtgtatgctacctccagtgaagtggcatgaatggatttggatataaatctaaggctttacagactaagcacccccttcaaattgtgtttattagcagttattgctcaggtactgttttccttaggaaccagatacagcaggacatttgattgagagtagaaattttaccatagatacatagtaacatttcatgcaatgtcttcttcacctcatagccttagtacttggaatggaagaattaatagagaagttttcagtttgatttaattcctcagttacccatttcttccctcaatttttaaaacaaatctacattagattaatgtgatttccaattttcttcttctctttattctgcctaataaatcaggccaaagcagaaataggttacaaatgaggaaatattttccacctcttaacacaccaaaaaaaaaaaaaaaaaaaccccacgagtagctactattttctatatttataacacattaataaatcccttgaaaggga

SEQ ID NO: 52150 - DNA, 794 bp, Bovine  19866881442085
agagttctagtgacagagctaactgagcaaaatgccaatcagtaattctaatttaagaatgtagagattttgcaaatgcaagaaaaatgcaaacaaatattggaaatgaaatcacagcactgttgaaatttttaagaacatttgacttgtttaacaaaggatatttttgtagagtaatatttttgttttactaagagtgcaagctttaatcaattgttgccatgtgagactgggggcctgctatttccagatctcctaaatttttaataaaacccagaaaatataaatttttgaaatattaagataaataaatattctttgttttaaagtattccacttcaaggtaaaaagagggaaaagattctaaaataatagatgatcatttctactctaattcttaaaaatataataatttagaaaaaaattttagaaaaaataactcaggaacttccaatgaagaaacacttttcaacactgatccttgaacaaaacacacacttttagagacatgccctccaggaagatgtatcccaaagtcctcagtctcttagaaaataattagaaaatctttattttcagagtaaaggttatagaacatatttcattagcattcaagtcataagttccagaataggacaaggatgcatgtaaactgcaagggaagattctgttttctagtgtgaggggtatgagccaaaaagatattggcattttgaaggaggggctggaatgctattttcaattcagattagccgctattcttccagaatcacaaacaacctttctgtaggctg

SEQ ID NO: 52151 - DNA, 582 bp, Bovine  19866881474884
aaataggccttgttcttaacccaataatttatgagagactatggtatttcatagagctacacactgtactgattaaaagaacaaacaaacttacatttggtggtattcgcagcctccgaccgaccaataatgggtgaaagttactgtatgtcagctctctgttatccatccatttctttatcttttcataagcagtccagcgcaaaccaatccataaagaagcttccatatccggaaacagggatgtaataaaatctgtcagaaagatacatattttttttttttaagaagaatttgacttactgaaattaaaggtatactaaaaatgtcaatgaatactttgagcttatctaactatcaagataatctttgattatcacctctataaaaagtaatttaataaaattctttttatgtgttaattccccacatcttgccaacaggaacttggcccctggatcagaataaaacatgtttacagaacatttctgctaccttgctctctctggctcaacactgaaggcagggttccaccataggtgtgacaaatatcacggcttcagaaaacggacagatttgggg

SEQ ID NO: 52152 - DNA, 1000 bp, Bovine  19866881489917
ttaccattagctatctatgctttacccaaatttatgagacccgatttccagaggcatttaggcatattatttatggtaataataacatcatttctatttataagagaataggcctaatgatccttaaatattgactctttaattaaatagatactcaatagctctatgactatgtagtgatcttttgaccagcaggataaacgtttgacaatttgcttatatagaaaacaattcaatcaacaaatatttgaaataagatgtcaaagtaactatgtattagattaactaactaccatttctaagacttttcttaccaaaaaaagaagtaaaatatctactaaagttttatttaaaggagttttggttaatagtcctcgtactttttagagatatgaagaatctgaaaagccagagagaaaggcaataacaacaaaattaagaatacagaatctatgcctgccatgcttccccaatcaaaagagaaggctgttatatgtccctatatgtcaaagtttaattgtccacataacctcctacacaccatcttgtgaggttaaagttcacaaagatctcaacgcaaacctaaggattagggagagttgatatgttgaaggaataaagagtgaaaaaggagggaatcacccttaagacaaagagctgtgacttaaagagcagtatcttctaattcagtggtccccaacctttttggcaccagggaccggctacgtggaagacaattttccacagacttggaggggggatgatttggggatgattcaagcttattacatttattggacactttatttctattattattaaatcagctccacctcagatcatcaggcattagataccagacgccggttctaattgaaaggaatggcatgggtctcactggaaaggttcctgcaattagtcctttatgtggtataacaactgacaccacctatacttaatcaagaagccaaacctatttttggaggaaaatcaatcaata

SEQ ID NO: 52153 - DNA, 896 bp, Bovine  19866882063368
tgatcctcggaaggaaactaagcctcagagagtaggtggaactggtctggaattgagatcttctagctccaagctgctgcttctttccacagtgtgagactgactcttatcagtgaaatgatagaaagattttgttagttaagtgataattgccatttgtttgaaaatgtagtggctagacaaatagcacttaaactactggaatatagatgaggtcttgtactttcgtgcaatgtttattacctttgagaaaattgtaatgtgaagccttttactaggtgggtagttcattaggtaatggaggcttcgtgtttatccactgaactggcacagaataacccatgataagtctcttcaattctgtcagagagtttggtacacaatttgatcacttagagacttatttttttcaggtttctaaataactcaggtaaattagacacttggggagtatgcagttatactaaaagaattactaaacaatcatttgggaaacctgaagggctgatgtacccatgtgttcctgactgaagcccagggttggtgggaaatctcaagcaataaggaagttgcaattccaatgacacaatggcggtattcatctctacgtgtgatatttttgtattactactagaatgggattttaggatatataaatttcctttgtgtgtatattgggggaaggtagaaaaaaatctgctatttctctgcatcctgttttgatccaaggctggaccttgaaaaggtcaaaacattaacagtagtacttctgttcactgaagagttatgttacatgaagatacagtggttgttttttgtaagttgctttattgtattttgcattgacataaataaacatcataatttaaacaatgaaccttagatgaatgatgatt

SEQ ID NO: 52154 - DNA, 2002 bp, Bovine  19866880214387
aaaacagaatttaacagggcttgtactctcttaattggtgtctattttttcccaattatattttttaaatttttaaatgtaattttaatttatattgcagtatagttgattgggtaaactccgggagttggtgatggacagggaggcctggcgtgctgcgattcatggggttgcaaagagtcggacacgactgagccactgatttgatctgatctgatctgatcttatattgtaatctctaaaacattgctagataaagctttccaaaacttgcctcatgttatactttgctgctcaagaacttaatacagttttcatggctaacagtatcaaatcagaatttttattttaaaaaagaggtttgttcagggtttgttcgttattacatttaggtagttcactgatagctgtgttggatggcttttggacacaggttatgatgtattgaatattaactttatagttagtcctggtttaggaaataaaaaattgaactgataaattggaaattttggaatgagtagaaaatccaacatagttagaaaaatatcagtgaaagttaggaagcaaaagcagttcaggtatcaaaagtctcagtaacgggtaaggatttgggagattctgccgctcttttctctacattctgtcagtctattcatttaaaagatgactcgttttatttactgtgtgtaagacattgtggcattaatgtttttctatttcacatgcattttctcactgaatatttacagtggctttgtgagttgggaccagtagtaagatctccattttgtctgttagaaaggggtattcaagggagactgagcttgtctagggtcatgcgtatgatcagtagttgaatctgaagtaatatgcttgtctcccaaaatgctactctcaaaaaatttcacttccctggttctgtaaaggcaaatgttatgggtatcataggcatttgtggtgtttgtcatcctatttcttgacctataatatccagcacagtgacatagaggcctctgatcaaatcactgacttataattggccattgactgtgactttaattgacttttcagcatttaatcctagaaaaacattagtattttgtggaaatatttgtcttttattgagagagggctaattttttcgtcccttcccaaatatttatttttccctctgtacttgatcttttaaatattttaggaaatggaaacggtgggggagcaatgtccatctgagaattggattgtaaattagactggatatttgtgcaaaacgaggtcataaagttaaagcacaattttgcaggcagcttagacttaatcgtgcatattggataatggatttgggatttcttcatcaggtatgctgtgtgcagtgaactgaatctctgctgagtggcctgactatagacagattatgaagttttattccagaagaaacttgaaaatttctcagtaaaatgcctccttatctttggaggagacatttaatgctgtgacattctgttgactatttcctagtgttaatgttttgaagctaaacttggtctttggatgtatatgtgattcccactgaactttgaagcattttgtaacattttctgacactcagagtgatatttcctcgggtgttttgaagatagggaaaaattggtctttaaataatgaatctgagaaagatacaatctattctaaatgcatatgtgcatattaactgtgctgttagtaggaaatgtaggggaagggggaagaaatgaagtaaatacaacaaataaaccagaaattccagtgtacaaattggagtggacttaagatgataatccctagtcattgcttatggagagaaaaaagtgctaattcataatattttagcgaactcaaaatgtgtaattatctttaacattttatttgaattttcaacaacaacaaaaatgagaatatctaacattgattcagctcttacatgtgccaggcctcatgctgaacatttcatatagattat

SEQ ID NO: 52155 - DNA, 2722 bp, Bovine  19866880804656
gctgatctcctttagaatggactggttggatctccttgcagtccaagggactctcaagagtcttctccaacaccacagttcaaaagcatcaattcttcggcactcagctttcttcacagcccaactctcacatccatatatgaccactggaaaaaccatagcctttgttggcaaagtaatatctctgctcttgaatatgctatctaggttggtcataactttccttccaaggagtaagtgtcttttaatttcatggctacaattaccatctgcagtgattttggagcccaaaaaaataaagtctgacactatttccactgtttccccatctatttgccatgaagtgatgggaccagaatgccatgatctttcgttgtctgaatgttgagctttaagccaactttttcactctcctctttcactgtcttaattattttcattcttttttctatattctgttctgcaacactgatttccaccattctattttcctgataatttatgtgctcttttgcatcagttactctgctgctgggtccttgcactgtactgtcatttctgtttgttttttatttcttctaggtctttggtaaacatttcttgcatcttctccattctttttccaagatcctggatcatcttcactatctattctgaattctttatctagaagattgcctatatccacttcgtttagtttttatctggggctttatcttgtccttacatctaggacataatcctatatattttcattttgattaactgtttgtgatgtgattttcgttctggcagctgtgggattgtagttcttcttgcttcttctgtctgccctctagtggatgaggctaagagggttgtgtaagcatgctaatgggagggactgacagtgtgaaaaactgggtcttgttctggtgggcagggtcatgctccgtaaaactttaatccgattgtctgctaatgggtggttgttaaacagctagttgcaattttaatgctcttgcaggaggagatgagtacatgtccttctactctgccatcttgaaccaatctcctaggtttttaatttgataaatgaaaaggtggggaggaaatcaagatatctcaacccaacattgttgttgtttttcagttgctcaatcatgtccaactctttgtgacctcatggactaaaacacagcaggctttcctgtccttcactatctcttggagtttgctcaaactcatgtccatggagtcgatgatgccatccaatcatctcatcttctgttggccccttctcctcctgccttcaatctttcccagcatcagggtctttcccaatgagtcagctcttcacatcaggtggaccaaaagtattggagcttcagcatcagtctttccaatgaacaccccagggactgatctcctttaggatggactggttggacctccttgcagtccaagggactctcaagagtcttctcccaacaccacagttcaaaagcatcaattcttctgcgctcagctttctttatagtccaactctcacatccatacatgaccactggaaaaaccatagccttaactagatggacatttgttgagaaagtaatgtctctgctttttaatatgctgtctaaatacactcatgacattgcttaaagtctctttaggtaatattctttatcatggatacagcaactatttttgtttgtttttccgatctattgggcaaaaccctagcttcattccttcttacccaagaatggttcctggttgaccttgaaacttttcctgtagatctgaagaactagtgactgtgctttgattctcacacggaaagttgatttccgtgatttattgaagaaaaagatagcatccaactgggaatgtgaactgaaaagagatccctgttaatctaggagagaaagaaagagagaatgaaggaagaatggctagatgggtagtgaaactcatactactgtataacactcttaattgttctccaggacagaaatacttgagcagccttactctggtgacttcttgagagggaccttacctgatttgtccattgctgtgtctctgtcttaggacaatgtaggtgtttgtaaatatttgataaatacttgataaataaattaattgggatgtatcatgacaagtatactagtaaagaaattactgacttgtttttatttaaatgatataaaggtaccaagagcagataaagccttgaattataagactggtacaactaccaaatggacttactgtgctgtgcttcaaacttactttcaatccctgtttcaaagtcccagtgaattagctgactttatactgtgataacaaggctaataatctcacccacatctaaaatttccagtttgggacttaccttcaggatttcctccataacttgctatccataaatcactcaagttatctaggtattatgaactttaaatgatctccagagaaaactattttaatactcttattatactttatttttagcaaactgaagcaattacaatcattcccttattgaaaaatgtatgagacaagataataagtagtagggcttgtacaataaatcactttgacgaggtatagaaataataaacatagatcaaataaaagtctgggatattgactgatgacaccatcatggccatttgtatggggaacagtcaatccatctttttgttgaacgtgtgccattgtagaaaacaatcat

SEQ ID NO: 52156 - DNA, 868 bp, Bovine  19866881091430
tttaattgagttgactgatagccaagcttattcagttacatgggaacacaacagcttcaatgtccaactggccaattttcccacatcactcttgttcaaaataggatcctatttggggtctctaagtctccctttcacaactcaccaaactcatttggtgctatattttgtggatgcaattaactagcattagaaaaccctgattaaagcattatgattaattcaagcatattcatttccacttcatcagtcctgttcatctgaatctgctcagtgcctcgttttagacactgctcctttattgaaattaaaaaaatgaaaatatcttctctgtaccaatagcagagaggggggaaatgggtgccatggggttgtgttttgatctatttgcaggttcttccagagctgggagcctataaatttattatgctaagaacatttttagacttgagtcttagatcagatgtaaatttcaaaggaagtttaagcagcacgtttctccctcattgaagtatcaagtatcaaaatggtatttgatgtccaagaaacttttaaagttttccatttcgtttgagaaaagaagggcataattttctaccatcaaaaaaaatttaaagtcccaatttctatatttttctcagaagttctttttcctccacttagactattttctcccttagcttttcctctgtttcttaatggtttgtctatccccaggatccttagatttctttacaaagttactctgtacttgcacattgccatctatcatctgtgaggaagagaaactggttcacagcataaagcaccaaggatttagctgaaaatggatctggtgaaatgactttttgagagaaagaatccagag

SEQ ID NO: 52157 - DNA, 861 bp, Bovine  19866881328301
tgacatatgataaacaccctctgcaatttagcacgcagcacagagagagtgtgttagcaggatgagttaattgccaagctatcaaccgagctgatgtttcttgaatattctgaaaggcagctgagaactccctaagtgtctggggtggtgggaggttttcaagcctgaagagaaaattgggtggggacagtcagtgagaagattggcaggcagtaacacaaactgtataaactaactcttgaaaatataattacctacaaacaagaagaaaatgactcggagctttagaaataatgtaataaaagtctgtcatttttcaggtagaattgaggctctggatgaggcatggacaggtttagggaaaagaaagactatagccagtgacaaagtcagcactgcaatgtccatcttttgagtttgaattcatttttgtgcaatcatgtttttattattaaattttcttctcgatttcataaaaggcaacatagtgtaggctctggtatatcttggtttgaccaattactagttctgtccgctgaggcaaattattatttttttttctgggccttagtttccttaaccctaaaaggattgataatagtatctgttccaaaagctttattacaaatgtatatgtgcatgtgtgtgtgtgtgcacgcactcagtcgtgtctgactccttgtgaccccatggactgtagcccaccaggctcttctacccatggaattttccaaacaagaatactagagtgggctgccatttcctcctccaggggatcttcctgacccaaggatccaacccatgtctctcaagtctcccacattggccagtagattctttcagttcagttcagtcgctcaa

SEQ ID NO: 52158 - DNA, 1155 bp, Bovine  19866881406221
atatgatttttaatatttggtacctctgtatgggctttcctggtggctcagctggtaaagaatctgcctgcaatgcaggagacttgggttcaatccctgggttgggaagatcccctggagaaggaaaaggctacctgctccagtattctggctatagtactccactatacctgtgtatagccaaatagcctttgagagtcaagaataaagagtagggaagggttaatgacttttcccaatattactcagatataattagatctaattagggttagatctaattatatctaaaaattagatctaattatatcttagggttagatgagttaggcccttgacaagagacctaacatcattagaagatacaagaagattttagaataacagatattatccttttactgtatattacaggttccctccatgcttcacaaacatatcctctctcccctcaaataatttccacaccaataatcttctattatactgaaattttccttttggatttttggagcttcataaacaatagagctcaaaagacaaaaatgtggtttcactatttcttctgacacctgcagggaaatcactgccctggcattgatttaatcaacccagagcattaaacccttaacatttaaaatagataagtgaatgattctttaagggtcataaaatccctttgtctttattggcaaatccattatttaaaataggacaatcactacagtgtttaaaagttgagttctgctccaggacatgggcttcttgccaggactgagcaaagtgcaataacttagaaaaggctaataactgtgaaatgatattacattatttggacacttctctgaaagagactaatagcagtgactttttgtgtgtgtgtgtgtgaactgccagtctacagaagtggatggaactgaatttgtgtccatcagtaattctatgagatagcagacctcagtcaattgccttgggataagcttcatcacaatctgcaggctcttgaaatgttcccctcctctacgcgtgcccccgcgccccccccccaaaaaaaccccccaaaactactaacagctctttcccatcccaccactttttttttttttttgcagaagcccacactcttatgtgctgaaaggattgagactgatgggg

SEQ ID NO: 52159 - DNA, 2390 bp, Bovine  19866881542182
taatgctttttgttctgttgaaatgggaaaatttgtgtatcatatttttaagaggcctccattgctacatagataataaaacctaaccacaacaagctattattaataatacagtatatttattttagtaaagacttaaaatatatctactgccaatattttttataatcaatttttgtatattttattttgtttccagttttattgagaaataattgatacatatcattgtaaaattttaaggtgcacagcatgatagttcaatttatatatattatgaaatgactaccacaataggttaagctaacatccatcttttcatataaatatgatacaaaaagaaaaaaagaaaaaaacaaggaaagaaaattgtggtgagaactcaagaaataaacactgattgaatgaaattcattttatgacacttaaaactcaatgtgttcctgtatcatcaataagatgattcaatctacaacaccattgtgaagatgggaactgcatgggactatacgtcttgagtccctttcctgctctaaggcttccacctctatttatagaggtctcttgctagagcagcaggctcaagcacctgagatatggaaacatttcccatggtacccgggaccacttatatgacagatgtcccatttttatgcatgagaagggaatttagtgagcagtgcctagtagcttattgttgtttagtccctaagtcctgtccgactctttcatgatgacctcatggacagtagcccaccaggctcccctatctagtagctaaggctaagtaatttacatattgacttttccatttccagtagtccagtgggatcagcatgtatctcaagctcggaaaataaggcacagagaggttaagaaattaacacaaattcacccagtgaacaggtgacagagcaggaactggactcaggtctctctcactatgccatgctaagaacagaaaacagccccctccccctatagttctctacactcataaaagaagaccttctcagtgcgggggaggggcagtacctggaggcttgcaaaatgtccttaatgaggatggagataagtgtcttgatttaaatacatcactaagattagaactaatgtaaagtcctattaactgtaacattgtcaataaacatctgcgatttgaaccttcaacagccccgctagcaataattctatttaaggaagcaccacttcccctctctcagttactgtgcttctgatgtggccggagtcaagcagagcaatcctgacacagagtttgtttcagtgacagacacacgcccatttcagaaccaatggcatgtcatgagccttcaggtgggcatactaaagactctcaaacatttccactgggtttgtacccagaagtatgtggccctgagtctaatgaatttgttgagatgctccagctgcaagaggtgatcctaagttgaaaacaaaccaacactgggagacacagagaatccatgacctgctgagagtgtctgtatcccgtatgcctgatttgctgatgctaaacagataatacacctcactctctctctctttctctttttcgtataagacagcatgagttgggttttctattacttaagacccaaaaaattgtaactgagatatgattcatcttcatgtatctgaacaacccctataatataggcagggcaggaaagatattattgatgtcacacctgtaataaggatgtttcacaactcaaagtgaaattaaagaaatttgttacagtaatacaatcttcagtatgcagaagagtgttgggtttcaatccttccggctgggaacaaaagcatctaggggctgctgggtttggtggctggctggtcaactggctacatttattttccccccttgtctgttttcctttaaaggatgtgaactgtgttagcagcaaaggtcaaaggtgaaggcttctaatatgtgtttcaacaggcttttatatgtaactcaaatggtaaagggggaaaggctttttaattgattacgttgagcttccattagtaatctatagagtttctttactctgggtggtgctagtggtaaagaacccgcctgccaatgcaggagacagagatgcaggtttgatccctgggttgggaagatcccctggagaagggcatggcaatccactccagtatgcttgcctggagaatcccatggacagaagagactggtgggctacagttcataggaatgcaaagaactggacatgactgaagcgacttgatacgcaccttgtttaaataaaacattatgttcatttcacattatgcatgtgaaattgaacaactattaactttcctttttctttttgaaatacttgtttttggaaggtgactgctgattgaggtttatt

SEQ ID NO: 52160 - DNA, 1215 bp, Bovine  19866880376099
tccattcacatctctgtaactgatattttaaagagttatatgaagtaatatatgtaaattacttagcatagcactaagaatgggacattcaaagcattgtaattattatcactctcatggccatgttttttaagttggagttagattcccttggagtacacttacttgaacaatgtgtgtttacatatcacaaatatattatttaaggcatttaaccagcagtatgctgaataaatgtatatatttcgggtcttgttttgccttaggtttttgagtgaatcattacattttacttcctttctttcctgtctatactcatcaatatattcatttagtccttagaacagttctgtgatatagatgtcatccgcgttccctttaagtgggggaagaggtttatgagactaaataatttttcccagattacttagccaatacatactaggatttaaaccatggtgatctctctacagagatgatgttgacaacaagaccactagattcttcagaagtggcttcaactgaatacttaaattgattaaaaatagtggttttaaatatcctttcaaagcttttcctttactttttgttcattcttttcttttaaatgtaaaatactttgattgtgagtgtcagggaagaaaacattactgggttcatcttagacacggaaagagtagggagaacggctcagactctagcatacgggcctcctcctacaatctcagaccacagagactgcatcttatttggagctcagtacgtatttcttgaatacatgaatgaattaaaatcaatttacatctttcttatcttttgatcttcatagcagacgttataatatcaatttgagaaaaaagggaattgagtcttaaagaaggtcagggtcttgctcagagttgcaaactaattaataaaaggaacagggctagagtccagtcccactcacttgcaacactgcacagataccctcttctgtttatctgctcagtcctgcagcacacaaaccagaacgcagaaaacccgggcgggaagtcgttcctagaactgttattcaaaacagttcgctcttccctttagaatctgtcatccacccctcctttatgctattttcttcttttctggatgactgttcacaccctatggcaggcaagctgatgctccccaataatgtcagcagaggtctggtgcctccattatgtttggctaggcaag

SEQ ID NO: 52161 - DNA, 2338 bp, Bovine  19866880429954
tagaaaatccaagagaatcatttgaaaaatattggaaattcatctgtatctgcatacaccaattaacatttaaaaattcaatagaattcttaaatacttagagtagttaaatagaaaatggaccacagattgatgaacaaatgaatagtcagaaatagtacataataaaagtagcagttcaagtcagcagaagaacaatgaaatattcataaaattatttggaaaatatgttttttaacttaggaaattcacatccaacaaaatagaaaaatgtgctaagtatataactaggaaattcttagaaatgatacatatgtgactaataagcatattttagaattaaatctcactaagcacattttaaaaacgtattttaaaatctctaaggtatatattaaaattatatttccctcattgggaaacacaaattacaataacattttttttttcttattcagatggggaaaattttttttaatgttgattctattctgtgtttgtgagaatggggagaacactggggcatatttttctgccaacacggaatttaaaaacctattgggggaatttggcaccatcttccaaaactgaaaatacataaaacatttatccaggtgttccatttctaagaatctcttacatagaaacactttcatataagcaaagaaatttatgtctccaaatgttaattgaataattaatggcaaaaatatgttaaaaatagcataggcattaatcacaaaggaaacttgaaattgttatgcacataatcatggctgtgtaattctttagaatgatatatgcactatcatagtaaaagcttcaagacattccaagtaaaaagagcaaatcacaaggaaacataaaatgataccatttatgtgaaatttaaaacagaactgaagcattatacatgaaatgattaacagaggttacctctagtaagagcagtgggagttagagagtgatacttatctctgcatttttatgttttacaatgagataaaataccccttatattacttcataaattatttatctagaaagtagtcctagtttcctaaatgtgttagatggtgtcatgagagttttctcttaaaatattactaactacagggtttttttttttcctttctctttatctaaaataggaatgtggcacttgaatgcagccttggctcctattgatttgatgtaatagaaggaaaatactcttctcttacctcatgctttctcagatctgtcaatctgtgtgctgtttttctacatatttctagataaaccagattagagaaggatacttttgctttataacagggtagagggaggtggtaacagacctccctgaaggggaggtcttcactggtcttgtttcttgacattaactgtgaagttttatttcttttcacaattttaaattcaactgcatatccactagcctttccctttccttttatttctatcattttagcctttaaaaatgaaacccaaataacttcataggtcagccctggctaggcatggcttgtggcaaaacataaaaaggaggagggggtaaaaatcaaatgaaacaaaataattgtgttacaaatgtttggatataggttaaaaaataaataggtatttacacattaaagagtgcactgaatgcttctctactgtaaaccctttacagaagatcaataccgtttacaccactcactcccagaagcagtatatgtctttcacctcacctgtttataaccatttaacattgttaaaaaagatgactagaaacaattgaggtgatttctagtgggtcaattagtcttggcgatattcattgcacgaaacaggacctagagaaagaatgtgggaggggaaagtcacacaatgaatgtaaatgtattaattttccaagttcatgaaagttaagttggatttcagggttcaacaaaacaagctggaagagggaaagaaaactctgctcttatactgtattgttaacttgtttgataaatttgtactatgaattgcgtaaaatattgactgtgctgtaagtatatcaagctagacaataactctgaacctccagccctggacatttgtcatgtcaaatctcctcggcagcagtggaaattggtgatcaatgccattgtaaaaggaacagatattcattattaataaacatggcaagactgaaatgaggtaattaagtagaaataaattaagttctactctattccaagggaaaaaccagccaggattgattgctatattcatttaattaatgttttagtgcaattcagaaatagtagaaagactgagtagtggcacatgttatataatgttccagaaa

SEQ ID NO: 52162 - DNA, 1991 bp, Bovine  19866880456151
cataaagagcagcgctaagtggtcagcgctaaggtcattaggtccttcatgctactgaggtaggactgttactgagatttgccctacattctactgcctgtttgaaaacatatttgaagagtttgagtacactatccattaagataagattcaggttggctattataagtgaatacagaaagtaaatatacaaaagatgcagcctcagtaggtcactgtgctaagcctctaaattttatccagagccagggctgttagattgtaatgtagacaaaggtaggccatgaatcatctcaaaatatgaggtaggtttcatatacatcctggaaccccagatgtcaactcttcctaaagtaattcatacatagcagcaaatttaaaagtgcaaagtaacaaatgaaggccctggagctgaatgctttcttggtaagtgtgtgctactacgaaaaaccagaattcaatgactttcaccacacgtttagctttcaggctaagaaatggaaatggtgtacacagaaaattaagagatattctaatgccctgaaactttgagatcgcatacaatctcttacctgagtttctacttctctaagaaggtggaaaacaatctagtaatttgccaaagacatcttatctacaagggaaaactgcataaaatttggtatattaaatgcttatttactcacagttatgatgatgagaagcaggaggaggaggaatgttggtcttatggaaaccatagtaacaagttttatctgactgccttcaaatttagagccaacttggttcacaggtgatcagtcattctagggaaaaacaaatactgtatgatctctctcatatgtcaaaaacaaaacaccacaatttcatagataaccagaacagataggtggttgccagaaggggtgggggtagaagtttgagaagtggatgaaggggatcaaaaggtttaaaaaataaatgaaagtgttaaactttgtcgacctacatccaactccaattctaatcaattgaacagacagccttgctaagtctggacccgtgctcaccacttatatttgaaaaaccataaccaatcatgttgcaaaccacaaaaattctttataacctatggttaacatttcatcccttctttgtgtgtctggaaatgattgaccgggcttcagactattttctctgatgtactgcagcctgaaatccaattgttatcttggttcaattaaactcaaacttattggtttgtaggacacaatagtaaagcccaagcttagcaaaaccttttcagaattcagtaagaaactctctgaatgcagtctggttaccagagctatgtatgcatacctctgttgttgtgtttatatttcctgaaggcttaggaataaatacattttttaaaaatctgagatgacagttctgcatggatgtcatattaatagtgaatctttgtggcatatataatgtacaaaggtacaattcctaagatggtcatcatgcccttttctggattctctgcctgtatttcatagagataatcttatcaaggagcatttctagaatggtcacttagctcatatgtccttttaaaggtacatcacatcacaatttggctgtagcattaaaaacttaggtacagtcttagctattagaactagattaatggttataagcaacatctttttttggttgttgttatttctctcccttagggatcctatattttggggggggagctttatattagggggataaaaaggggatattttcttactcttttttagtttggatgtttccaacttacccaagagtaaagagaatgtataatgaaccctcaagcacctatcacccagcttcagttatcaacatttcaggcagtgtttattaaatggcagttcattttctgtttttttaaaggaaactcattacctaactgccattcaacatttgaggttttaataacctgagcagccttatctcaggcaaagctcaaattc

SEQ ID NO: 52163 - DNA, 2246 bp, Bovine  19866880465229
atgtatctgcgtacttgagatcccaaagctttgtcctaccgagtgaaaagaatccagtattgttgttattactgtttttgtaattttgaagccacagtacctttgggtaagttacatgtacatgtagaagtaaatgctatcctcaggaaaaaaaactaattgacacctcaaaatatttactcacctaatactgctgaatgtttactctaagtatgtgcttgtatttagttgctcagtcatgtctgactctatatgaccccatggactgtagcctgccaggctcctatgttcacggggagtcttcaggcaagcatactggagtgggttgccatgccctcctccaggggatctttcctatgcagggatcgaacccaggtctcctgtattgcaggcagattctttaacgtctgaactaccagggagccctactataatttattctttatgcttctttacatatcaactgtaataatgtaaataaagacattattagttgaggtaattttctataactatttgttacatagtaagttatagtcataatttcgtttcaaatctttaggcagcatttaaagttgtacagtattatcacttatttaaagaaaaaaaaaaaactaactacatacaaaaaacacctgactgaaaccctttttgatgcctccaatgagtgtgatatgtttataaattatacatacttctactcttaaagggaaatacccacatccattcattagttaataatgagagccttgaaaagtccctatttcagtccttcagactctgaacagtggcctaaatgagatgtacatttataggaaaagacttaggaagttctgttaaataatcaggtgaagagagaaaatgaaggcacaaacatgatgcttggctgatattaactgagaaaaggaacacaaagcaaacaggcccaagtacatgacgtgccaaagctggctagggtcaaagggaaagcaagcaccctagattctgaatcctggactctgctcattaccatactttccaccccttcctcacatttcagtttgtaaagtatcattagattcaacagaactcacactgttttctttgaagcaaatactcattatgtcgattgcagctctctgctaattgtgcataatacagtccttcacaactatgtgaacatgggtctttttcaaatggatacatattaatttactgttcccaaaatggaaagaaagcatataaatgcatgagaatttttaaaagcaagctttcataaatggcgccatgcatttgaagtgatgaaaggtgaaaacctacaatagagaatactctacctagcgaggctctcattaagacttaatgcggaaatcaaagctctgcagacaagcaaaagctaaaataattcagcaccattaaaccagctttaaaacaaatattaaaggaatttctctaggcaaaacagaaatggccacaactaggatgagaaaattagaaaaagaagaagctcactaataaaggcatacatacagtgaaagtaggaaataatccacacacagaataattaaatgtgaaatatgatatcaaaagcagtagtcataagcagaagagagtagaaatgcagagtattaaaaatgcatttgaaattaagaaatcagcaaaataattttgtacacacacacatatacagagggctatagaaaaacctcatggtaaccacaaccaatgtctgtagtagatacacacacgatcaaatgaaaaaggaatccaaacataacactaaagatagtcattaaagcacaagagaacaaaagaacaaaaatccaaaacaattaacaaaatgacagtaagaatatacatatcaaataattaccttcagtgtaccttaaatacagacttacaccatgatatattaaaagttaaagatatagaaaggattctaaaggcaacatgagaaaaacagaattaatagcaagggaacccccataaagctattgactgatttctctagagaaatattgcaatctagaagggaacagcaaggtatattcaaacccctgaaaaagaaaatgctgcaacctaggatactcagcaagattatcacttaggagagagaaagaaattctcaatcaaaacctaaaagaatacagcagtactgctgctgctgctgccaagtcgcctcagtcgtgtccgactctgtgcgaccccacagacggtagccccccaaggctgtcccacccctgggattctccaggcaagaacactgg

SEQ ID NO: 52164 - DNA, 1590 bp, Bovine  19866880548642
tttacatctgtgtctcacattcaactacctctgtcttcagatgcattgttcagacaccatttgttacccttgataaggaagaaatggcacagtgcccagctgatgtattttctgagtcattaaaccagatttctccatttttgaatttttgggggaaaaaagttctctctgtattggtagctgagtgaggcccttagccagaatcttttctatcatttctttaatgttacctgctaaattacattatttaaagtgagctttccctgtgttatacagtagactcattgttggctcagaaccaaatcctacagacatggagatgtgcatgcttcccagtggctgtaacctgaggactttatttaaactgtcctttgaatctgcagtaaggcggtgtcagggaggaataggatctttatcaacaaagggctgccagaaccccaacagcttcttgagtagctgtaatagatgaataatgttacaaccaaccgtgcatttcagtttttgctcaaaaggcttttcactgatgctgctggtatttcatatccatgtgttcatcttggaacccagtagcctccatctgactttcattacttttcttgagaggatcgattttacaactggaatcagaaaagcagtcaaagtaattgcaagtggcaatcactgaaatatagtaatcttagcttgggaacatatgttccattataaagaatatattcttttttttaataaatccaagactcatgttttcccaaagtaaaaagggaccatgtacaggttctactgctatctcttgtatctcctgtatcatgctaatatcccaataaagtgtttgttccttcaggaataggcaactcattacgtctggaggaaatctataccctttctgattctgactatatgaaaatgctttattatactggagatgaaattcatctctctctagttacatccttcagaactgaaagatttgggtctcaacatagtaatcctcaacctctcttgattcatgggcaactcttatgcccaactcctttttttttttttttttttgccaggttttaatatatattcctttcttatacgaaatagctttgatttacatcatcattctggtcaatcttcttggaagttcagacttccctgtaacccttataaaggcactgtgctgaaggaaaattagacttttaatcagaatatctgtattatgttacaactttgccacttattcaatgttagaacttgggcaaattatttactctttttgtcatcagggatagcaaaagtaaataaaagatatgtggtctagaggcaaataacacaagcagtatgcaagtgaacaattaaatttataattacaatgttgccaagagagttctgaggtcccagggtatgaagaacaggccccctgagatggaggctcagtgttttctgatgggaaggagacagagagtgtcttgtggaatgtgggatggcaccaagctagcggagcaatgttttctaacaaagccagcatgtagaagcaggacagggtctagagacggaaagtgagtagatgagtagacaagatagtggagaagtacagagctttga

SEQ ID NO: 52165 - DNA, 1044 bp, Bovine  19866880606426
ttgcttccacgtccaagctattgtaaacagtgctgcaatgaacattggggtacaggtgtctccttcaattctggttttcttggtgtgtatgcccagcagtgggattgctgggttgtatggcagttctatttccacttttttaaggaatctccacggtgttctccatagtagctgtactagtttgcattcccaaaacaatgtaagagggttccccttttctccacaccctctccagcatttattgtttatagactttttgatggcagccattctgactgatgtgagatggtacctcactgtggttttgatttgcatttctctgataatgagtgatgttgagaacaaacggattgaatgtgtcctgtcctgtcactcacaaagtagactccagcggtgcatcagttacagcgtggtcattttttttaagcaaatgcatcaactgtatctggatggtttgtcttttctcccacttcagtaaaactcaactgcacaggggcactgagagatttaatctgaattttttttaaagtgtgtctggatgaaaaattactacagatcagaagaataccatttccagtgacccaatttgagatcagcaattaattaactatgcatagaaatgtcacttaaagaaaagtctttgtcaatatgctgaaatttctcatagatttgtgattaacttctaattatagactaattgccttctccgttatcatcgaggatcttgagtgttgacgcagaatctataaaccataccaaggagacaagtgtggatgtaatacactcctgtgttgcctaatgtgattccttcacatgtgaacaaagataaaagtaggaaaatggtccctgtgctacttcaggagtaagattggctgcttgagaatcctggtgtgaaaatacagtgacgggatttctagcaacaaggaaaactatgccggtgcattttctgattttacttcaaggagaagtttaggatgattggtaagagggagaaaaatggggtttgtttctagataggcagttttgagatgaatcactgacgca

SEQ ID NO: 52166 - DNA, 2293 bp, Bovine  19866880632751
tatatgcattactttacaatatttgtttttctctttctaacttattttagtctgcatgagactctctaggttcatccaagtctctacaaatgacccaattctgttcctttctatgacttaagatgtggtacatatgctcagtggaatattactcagcctccctggtggctcagcagtaaagaatctgcctgcaattcaggagacagaggttcgagccctgagttgggaagatcccctggagaaggaaatggaaacccactccaatacttttgcctgggaaatctcatggacatggaaagcctggtgagctacagtccatagggtcacaaaagagctagacacaattagcaacaacaaataaatgctatgcttttctatgtagcatttatcactacttgatagaatacatatatcaaaagatattgtttatttttttttctcatctctggctcttccaactagagtgtaaatttcacaaacacagggacttgtcttaagcatctagaacagtactggtagatagtcacgcattcaacagttatttattgaaacaaacaatgaatgaatctcaattttgtgttcaacgccctgatcgggatcagcagttcctgaacctgggtatccttcagaattcttgacaggaacttaaaaatatatcagattccagggctctaccccagatctacttactcaaaaaacagagggaggaagactattgaggaatctgccctgctggtgcctctcgtgtgcagtcaggcctgggaaccaatgatataggtgccccagtttcaggaacacagggggaaatatgagggagtgtggttagcaggtgaatgttgaaatcagcctatgtttgactcctagctttgtcatttccttattgttatagattactaaaatttctgagcctttcaactttctcatacttaaaatgggtatcataccagtatcataaaatgccaaaatcttcagtttcctgtggcatggtagaatcagaaaaacagctcagctttcccatggggacatcacctggggtgcagacgcaggaataggacagcagagcattagcaccagcacttctgtaaagtccaaaagcatcagcccaggggtggggcaagatttttcctgaaaccctctgtttagcaacatgagaactatgatacagtggccatacggcttcccactaatgacagggaggggcaggcaatgtatgagactatggagctggaactgacatccacagttcagctatgtggatgacccttcttcaaccatttcaagactgcagagtaagatcctctcacacgcttgcccatggctgtgttacttaagttgaaacataatacaggaaatgaacattgcttcaagcttaactcacaattccaacatcattatctttctctctagttggaacctcaggaagcattttgctttttattcctacttgatggaaagtctctgaaacctgctcagcaaattattagaggcatgatacccctgtttagccagtaatggtaacagtgctaactgtaactaatgcatttggtattattgagtacagtaccagtgtcattccatactgatcctcatgttcttttctattaaaattccattagatttccatgtgtcgagccttagtgcaatttcacagatagacatattatatttatttatttgcatatactgagtaaaaaagtctggactgcttcctgtttttttcctcattattagtcttgtaatgttaatatcacatttatatgtgtacagtgaaatctgagctatttctggttcattgactttcctagagaattggggggagggtgagggagtcccttttttaaaatttatttatttattttaattggaggctaattactttacaatattgtagtggtttttgccatacattgacatgaatccgccacaggtgtacatgtgttccccatcctgaatcccctcccacctctctccccatcccatccctcaggatcatcccagtgcaccagccctgagcaccctgtctcagggctggcaatctatttcacatatggtaatatacatgtttcaatgctattctctcaaatcatcccacccttgctttctcccacagagtccaaaagtctgttctttacatctgtgtctcttttgctgtcttgcatatagggtcatcattatcatctttctaaattccacatacatgcattaatatactgtattggggtttttctttctgatttacttcgctctgtataataggctccagtttcatccacctcattagaactgattcaaa

SEQ ID NO: 52167 - DNA, 1430 bp, Bovine  19866880679395
atcatgttaaatttaagttatccctgtaggggcatccaggagtccccagtgtctggctgacctgccacctgaacatggacacaagcaagccaagtagagatccactgagcccagtcaaggtcagcatcacatccttgctgacttttagaacacaaggttattatttcaagtcactgacttttggagggctttgttatgcaaaaatagctaaccaatgcagtggtaatctgattgggagtttgttagtaagtttacatcctcaattgcagagtcatagcatgttcaaacttatcttaatcaacttctcccattaaaacaaaaactaacacaaaaaaacagaattcaagaaacaagaaccaaaatatgaataatcaagaccctgaattctcacaccttattccctgtgtgaggctcttcctgttgttcttctgtttctattagagagaatttattaaaggatattgtaaagcagtggattagaaatagtctaatttctaggtatacaaaaacgatgcaaaatggattcaccagaagtaatagttcaacacatttctgaatgctgagcatgtatacacaacttttgtcctattttttggtgagtgtccagacacatgacgcttgctttttattcttctatagggaccttatgaatggatttgaaatacgattgccaactaggcttagcagaccttataaaagaaaagcattgtgggacttatccatcaacttaacactcctatcctccttaaatcatggaaattctagaaccagtatttattagcttgttctttctgtacatcaattatcttagaccctatacactgcagctccatcaaaagcataaaatagttcccagtggcaaattcctggttatctttagctcatgctgttaagtaagtttccacagtctttatagctccagattttattgtatttttaaaatgacttggtttcagctgttaaaatctaagactttgacttaaagagaaactacttgccaacatgtgagtgtagaatttgactttttagcttcaccatttaaagccagtgtatttagaatattcctgctatattggggagtttccaaaagatatttgtttaggtttccgacattagtattttacatctatatttttagggcttcccaagtggcgttagtggtaaagaacccacctgccaatgtaggagacttaagagatgcgggttcgatcccttggttgggacaatcccctgcaggaggaaatgacaactcactccagtattcttgcctagaaaattccatggacagaaatgcccggtgggctatggttcacagggtcgcaaagagtcagacatgactgaagtgacttagcacttctgcagtgcaggcgggttctttaccctgagccaccagggaagcccggtggttgggatacagtgtgcttaacgcg

SEQ ID NO: 52168 - DNA, 1494 bp, Bovine  19866880781955
gcactcaccgtattgtttgaggaattgaaaaggcactgttatttgaagttattacaactgatcccttttctcttaggtatgtagcctttctaagggtgggaatattgcatggaaataactggactttactgtcagaagacagagtgaatctttattcttccacccaccctcttgaaccccatttaaagatgtgggatctctagttgaattaggtaccttatgaacagtttggtaaacacacagagactgggtagtactcacctttatgttttttgtttttttctttgttattggtcaaaggaagtggagagagagaggtggaaggagagagattccatgttgggagaaagcagaatgataattcctccactctaaggtcctttgtaaaaaagttgagaaataataatgtcttaaggcatctcaatgattcaaagtcttccatacttagcataagtctatgaaccggttacctcatccgtactctgaactgtcagaacaagggaacagatttgacatgggtgaccccctcctttctacagatcactatttcacatgtacttggctctcaggatcaacctcctgaagctcacgttatggaacatgctctatggtgacccctgaagtaggcaacataaaacctcacttgacatcggccttgattctagccttcaggcattacttcatctcaggaaaatttatttaatatttgcttgagttatataaccatatatatctgagaaaattacaactgattttcatctaagctacaattgggaccaagtcatatggtgaataaacacctccctcctttttataattgaaaggaaaaagtcactttcctttttataaactgagttgattagctaaaggtttcatagagggtggatgagtcagaggcaactcacaaactcaagctcacttcccgagcagtcacaaagtttacaccaagtcatgaaaatcccaaggcctttgcacataatgttaatgaggctgtggatcaggtgaagctacaaatcccaacagatgacaagctacaaattgggtgagctgcctctggtctcctggtgaaagagaatagggctcctgtgggaaggtgctagctgatacaaatgtctaattctgacaatgaggtgatgaaatttagcccagaaaatcagatgatgcagccccttggcaaggctgcctctttatctttcaccatatcatctttctgagacagttaccccttatcttctaagtccctatatatgggaaccttcccactctatctgtatcttgtgccaagtttttgtcttgttgttgtcgatagggtaagatgacagccactaattatgacagctaaagtccttctcattctgttcccaatcttcttttcccatcttctttctcatcattttatttgctcctccctctctccagataaatgagcaactagactccatagtattccacccaggctttattctttcagtttcctttacccaagggtgtttt

SEQ ID NO: 52169 - DNA, 603 bp, Bovine  19866880867793
gggaaaaagtcccttgaattttagctagtgaaatctttgatgacaatattttaaaagttctgatattgtccaggatcctataaaatgatcctttgacagttctttaatccagagttttcttgttaatccacatgccatagacttggcagagtattccatgaagccttaaaataataatcctcaaataatgctgtgaaagattatgtcatcatgagaaaatggggtctggcagaatgtaccttgctcaaaaagcacttacactttattataataaaatagcctctgcactcttggtgtgtatttgtccaattctcacagtgcagtttcccagaggcccctttcatttgtgaagcgattgctacagaatggaaacggagtccagaggcctcactcaatctcccctgtgatgatgagaactattttctcatctatctctagtctctgtacagacataatataaattactttctctgtattatttaaatttcactgcaattatcactttttagaagcaacaataaagaataaagtaacctccactttaaaaagtatacatatatgtatatgtgtgcatatgtagacatatatacaccagtatatatt

SEQ ID NO: 52170 - DNA, 1176 bp, Bovine  19866880898677
aatgctaataagaatctaatttccccaatgtatgtgggaatattagatccctttatagagtagaacatgctaagttccatataagtcactagaaagaatgaagggtacaatcgaagtgaaattccttttatcaacaacagctttaacaaaataaaatggggacttaggcttatggttagtgttagttacttagtcgtgtccaactctttacagccccatggactgtagcccgccaggctcctctgtccatggaattctccaggcaagaatactggagtgggttgccattccttctccaagagatcttcctgacccagggatcaaacctgggtctcctggattgcaggcagattctgtaccatttgagccaccagaagatatcatttaactaagattaaacttacctcaaatggatagtggaataaagtgggcaaacagtaaaaaggagagaggtggtttaagaggaatagaagaaaacaggagaaattgtcccaagatcctagcacgtctattcacaggcagcgttacgctgtcaccgcctgctcagttaagcagtctagttaagtcttggtttgttgaaatagtctttgtgcctcccaagctctagaatgtggcctgctgtcctgaaaatctgaccagtttacaaagaaaatagactcacgtgttaatgtgaaattcatagagtatgtttcagtttgcttcagccagtggggattctagccaggggctatgaatttaattacttgctgataggataagagcagaagttgggattgttaaccaagtagctttattgtgctaatcctccctggtttgtaaataatcaagggctttgctggatgatcaaataaaatgattcttttattctaaaacacttttcttaggtattgcacaggaagcaattttaatttgtacttatatttttggattttaagccattcacccttcagtttctgaaatgtgctttttatatacatcatacctttgcgtatatagttatgtacaactattatataatatgacaatgttacttaatagtatgcacaagtagagacttaacaatccatgattttcaatgaaatcagaaacctgtgatttatgtaaccagcccctagcacagaatttgatcttgaaagcaaattgatttctacttctgatgagtctgttgtggatgat

SEQ ID NO: 52171 - DNA, 1049 bp, Bovine  19866880904459
ccttaatcatcacagaatccttgaagcagtttcgcctgatatattgctggttctgctttatggatgaagaacctaaagggaaatgatgttcaaagttacatacaaggaccaaagttagaacccataagtctaaattacaagtatgttccattgactctggcttccttcctgcctttcaaccttgggttcttccacaacctctttaagttaggtcaaaaggacaagtctgtgtctgattctacctgacctgtgttctagtattgtcactcagtagtcttgtgacaaaggatatgtcataaaactcaaaacaagcctcaattttcttacctgtaaaaggggggaaattaagcctgtgtttcaagttgtgattatctgtaacaaatgatcattgttggaattaaaagtcaacataatttctccaattttcttattcttccttgtgatagagcataaacccctgaggacacagatttccacttacaaactgctttataacagtgattctcagccttaactgcactcaagaatcagttgggcaacgttttgaaattatccatttcttttttttttttttcactccagatcaattaaataggaataaataagaggtggtctcaaacattatacttttaaaaatctccccagatggattctatcatgcagacttcatataaggtgaatgatgacttacagagctgattttaacttcctctattttatatactagttttaaagtacttataaactctggcattttattattagcaatagtaaattatttttgcacctgattgataggatagtccaacatgtcaactcagttggaactgttaattcctggataggataactaattctggatggggtttgggaaagggtaggtgggaaaaaagggagttgatgcaaatttaagtacctggatgcatgggatgggattaatggagatggggaatgcagcaagaacatgattttgttatgacaaagcagtgaacaccaggcataatctgctagggactttgaactatattttagaatcaagaccctaaaat

SEQ ID NO: 52172 - DNA, 1640 bp, Bovine  19866880912398
ttgcacatcttaaggtgaactgcagaaattttgagacagtcactatctgagggtttaaaaatagatttcaatataatacacttataggaagagacaaaaagattaataagcaaggcctcacattgagaatggtcaacttcactttatgtataacagtacctgtccccaaacagatacaggttatttgtaaaattatttgacttctaatatagtgtatactctgctcttgtattcacaggcactctgttcatactgatttttggtagttcctatacaaagactttgaacatagatgtataataacagcacattaatcacttcctactgttcatgtattataggaaatgcataatttccctttgccttgtttaaaaaaaaaataactttaagaacaggtaactgaccaaataaataaataaaattcatagagatggaataattgctcaagataaaacagtaaggggatataagtgaaagtgaaagtgaaagtcactcagtcatgtctgactctgcgaccccatggactatacagtccatggaattagtccatggaattctccaggccagaatactggagtgggtagctgttcccttctccaggggatcttcccaacccaaggatcgaactcaggtctcccgcattgcaagtggattcttcaccagctgagtcacaagcgaagtccaagaatactggagtggatagcctatcccttctccagcggatcttcccaacccaggaattgaaccagggtctcctgcattgcaggtggattctttaccagctgagctaccagggaagcccaactcatcttaagatacatgaagaatcagacttctactctgaataatcctcttcccaatttaggggacataacaggaaaatggattggtttaggaggttctggcttaaacttttaaactactgatcacatctacagttctctatgaattaatgaacatgcacagtgtatgtgacaagataaaactggcatatatcctactagacaacttgaaattaaccattagtccttgaaattaaccatcagtccttgccagatatcttactagcgtaactgcctaaaaggaaagaaagaaccggctattaagaccccaacatcaaggaaaatgataaacacagggcaggtaagccatcactgtggcatcaagggaccaaatatttgataacctaacgctttctatcaaaagatgaatgattaaagaagggaaattaatgaagtaaaattcctattttatggcaaaacaagaaaattttaagtataaattttttctctgtctgcttgggactcctcccttaagtgtgtaatgtgtatctgcattaatcacacatacttaggagataacctcccttattaatcttgtaaagggtcatgatgattcactactagctctgtacatgcagatctggattgtgtaaattgtcaatacgtcatttgaagtacaatcctttgtctcaaaaaggtatatgactgtactttgacttctgaccggggaatattcctcagagctttttaaaagactatctcccaggttataatccgcaggttgattggaataaatttttccatttctttcttagatattaccctattgaataattttattgtcaacactgtatttta

SEQ ID NO: 52173 - DNA, 1576 bp, Bovine  19866880918644
tctgaaaagccctccagattgtgaaactcaaccctctttatcctccccacaaacatgctggtggctgtatggtcctaggcaactatcatgatagcatctacccactctgccctgagagttctcctgaggtcaaccaaaaaccaaacttcctggcaagggtcaaatgaagggacattaaggttggacccatacattgatatgtgagacttggcagatacccaaaaagggaaggattgggagcctctcgcatttgatgctctttctactgaagggatatctttgccacatggctctcaggagccacctgacagaggctctaagggaatctgactccatgtatcaaacgtctattgatttcatcagtaattctttaaaggttcagttaatgatgagaaggaaacaaaactgtgttaagcagtggggggataaagaaacagattcaaaagaggtaaagctggaattttcagccttcctcaagtgtggtaaggatctgaatgcaagagggctgatcaattacatcattaagacagtttactttcatgtagtaaactttctaaatgattgacagatggatggataaagaagttgtggtacatatatgcatatggaatattactcagccataaaaaggtaatgtgtctgagtcagttctaatgagacagatgaacctagagcctattatacagagtgaagtgagctggaaagagaaaaacaaatatatattaacactcatatatagaatctagaaagatagtactaatggacctgtttgcagggtagcaatggagatgcagacatagagaacagacttttacatgggtcagggaaggagagggtgggaacaaccgagtagaatataaacatgaacactatcatatgtaaaacagacagccagtgggaaactgctgtatgactcagggagctcaacccagtactctgtgacaacctagaggggtggcagggggtgggaggcgaagggacactcaagaaggaggggacataagtatacttatggctgattcgtgttgatgtatgacagaaaccaacacaaattgtaaagcaattatccttaaattaaaaacaaataattttttaaaaaatctacaatggaaaaggatctgaaaatcatatatacgtacgtatgtaaaaccgaatcactttgctctacactctaaactaacacaagattataaatttactatacttcacttttcactttcatgcattggagaaggaaatggcaacccactccagtgttcttgcctggagaatcccagggacaggggagcctggtgggctgccatctatggggtcacacagagtcaaacatgactaaagtgacttagtagcagcatacttcaataaaaaatttagttgtggggaaaaaagacagtttactaacgggtaacaagaaaaaaaagaaacacaggacattattgataaaagcaataagacagtatataacaataatggcattttctcagtcttttgggaaaatttcctgtaccaccctccctcaaagtccatatctatcttactttttaaaaagttatagatgataaattcctgacactgg

SEQ ID NO: 52174 - DNA, 1719 bp, Bovine  19866880987099
gagtttagctttagcatcagtccttccaagaacacccaggactgatctcctttaggatggactggttggatctccttgcagtccaagggactctcaagagtcttttccaacaccacagttcaaaagcatcaattctttttgtgctttttgaagaaagcgctcagctttcttcacagtccaactcttgcatccatacatgaccactggaaaaaccatagccttgactagacggacctttgttggcaaagcaatgtctctgcttttgaatatgctatctaggttggtcataactttccttccaaggagtaagcatcttttaatttcatggctgcagtcaccatctgcagtgattttggagcccccaaaaataaagtctgacactgtttccactgtttccccatctatttcccatgaagcaagttcagtgactatgaaataacataatgattgtgttcagctgacttatacttacacctgaagcaaagaaatatattactgaatattaggcatcagttgtcacccatcggatgggaactagactctggaggtcagcagatactcacaacccccatcttctctctcaattagttccacagctctggtagcagtggttgtagggatgtgaatgatgtagaaaacatttgttaatcacgtgccatatgccatgtattgtgttagccattatatagggtctcttaatcctctacaactctgtataatggctattactatgttcatttcaaaggaggacactgaggttcacttatccagcagcccaaaaattgctgagacagaatctaaattcagttctgactctacaatcccccatctttcccctttgcgacaccacctgtcttaggtgttgggctactacatcttacttcccctgtcacttaccctcccttctttcctgagttcttcatcctcatttctttcctcaggaaaggaagacaattattttttttttttccaaatctccttgtaccatctctccatttccctttcctcctaagaacacgtttgagaaatcatttttaacgacatcaaatcattttttattggtgttctgcaaaaatgatagtggtgtcacaccaggcactctgaaaggctggtatattatagagagaaactgctcaaatggcagcctcatgctgcgatgctgctcacaactgcttcttaatctgcaaccctggggctatgaatgacaacccataaaagttcttagaaagttaaagctcgggaaaaaaggtccaaatccatatccatttatttaaccaaaatatattaaacatgtacttgcttcagaatcagtagtaggcactggaggtaaaatgataatcaagccatcatatcagccctcatgaagcatgtaacctagtacaagggggaataaattggtaattaaaatacaagaggttgaattccatgatagactagtacagagtgccagaggggaggtaaggaaacatctcagtccttagaagtttcttccatcagggacacagtctcttaggatatgagatttgagctaaaatatgaaggatactttcacatcagccaggtatgctggatagtgtccactcgccctttgtttccggtagcaaatgatcctaaaacttagggacttaaaaacagttatttattatgatcacaaacctgcaatttggacagagtttaatgggacacacttgcctcttactccatgtggtgtaaactggg

SEQ ID NO: 52175 - DNA, 2274 bp, Bovine  19866880997398
tcctccgtccatgggattttccacttaagagtactggagtagggtgccgttgccttctccctatttaactgctagaatagtataataaaaaataatctcaacagttgactattttcagtcgagaaaaagaatgagattcactgatttctacattttcaatgagaaacttatgaaaaacttactctataatactttcatgcatattaacataacaaacacagaaccgtgaacacagtaaaagccaaatcaagaagatgtatgatttttagtataactatgataaaccacttctacagttatatttttgatattttagtgataaacccatgaacaagccagtaagaaccaaataatagtatgaaaataaaggtaggagaactacaaacatactagatttctagtagccaaggcgaaagttctcagccacaagattcagaaagtccacaacataaaaacaagtcttggggctggtgcactgggatggcccagagggatggtatggggagggaggagggaggagggttcaggatggggaacacatgtatacctgtggcagattcattttgatatatggcaaaactaatacaatattgtaaagttaaataaaattaaaaaaaaagactcgtatggaaaaaaaaacaataagagaactaacatgttattaattttaattttaaatatcagtaaccttatacctatgtaatgtattcacttcaataaaaatctctttttaaattgaagaaaaacaaacaaacaaacaaacaaaccgtgtctcttacatctcctgcattggcaggtgggttctttaccatcggcgccacctaggaagctgttatttgtgtgggtaatcccccaatttacaaattcagagattgtactctggaaggtaatttataggttatttatttgtatcttatgggtttcccaggtggtattagtggtaaagaacccgcctgccagtgcaggagatgtaagagaggcaggttcgatccctgggttgggaagatcccctggagggggaaatgccaacccactccagtattcttgcctgaggaatcccatggacagaggagcctggtgggctacattctgtagggtcacaaagaatcagacacgactgaagtgacttagcatgcaggtacacacttgtatcttataaattgaatatgctcttttttagccaaccgtagcagggtacacatgtgtgctatggatgcagtggggaagaggaaagaatttctaaatgcttggattctctggtgttagaagcaaatggttttgtgactggaactaaaattctttcattcattccaagtctgtggataagaagggagttctctttctcccaaggcatattgttttacttattcatttgcttgtttatttaattgaatagttaatttacaatattgtgttagtttctggtgtactcaaagatattcagttatatttataatttttcatgttcttttccattatagtttattgcaagatattgaatatagttccttgtgctatacagtaggaccttgttatttatctgtcttgtacatagtagtttatatgtgctaatgccaaattcctaatttatcccttcctcctacgtttcccctttggttcctgtaagtttgttttctgagtctttttctgctttataaataagttcatttgtatcatatttgagattctacatataagtaatatcatctgatatttgtctttctctgacttgacttcacttagtatgataatctagatgaacataggttcatctgtgttgctgcaaatggcttgttccattcctttttacggctaatattccactgtgcgcatgtgtgtatgtgtataccacatcttctttatccattcatctgtcaatggacagatgtttcctttctaaagtcagagaagatgctagtgtacatgatttttcccagagaaggctgtaatatgcaccccaggaacacttggagtgcttgagaataatgaatacctttaaaagatgaccagactacttttatgagaaattacagtgatatctggagcttgaactatattccattctcattgttttagtaattgaaaattttaatcaataagttaacctcttctgattaaattcattaaaaattaagaatatacttatttttatcaaagtagtatatggttcatgagtaaaaataccaagctgaagagcttatgaagaaaaacagttgtcctatgcctgtcttttcacccatcctgctcactggaggccacattttctaattacag

SEQ ID NO: 52176 - DNA, 2317 bp, Bovine  19866881011682
tctactagagccaggaatggcagagcctggtgggctgccgtctatggggtcacacagagtcggacacgactgaagcgacttagcagcagcagcagcagcagcagtagagcgtgaagagaagacagcctataaagccattaggaggtgctgtggggattttaggaaggcgaagacaaaggactttgatgtgaagagtcaggagctcttgaagcaacattggctattttctagaagagatgcccacaatatgcagagacatcatggtagctgcactgaaagggaaggactgagctcaggcaagacacagatgttttgatgctcctcaacatgtgggcttttcatgctccttcacttacatcctcttatatgagcaccaagggcagaagctgctcagtgtctcctgatacaataactaggtccccgaaacctgacttttggttacagccatttaaaatccatatatctgtgacagatctaccttgtacagaagggtacgtttttagctggaaaaacaaattcatgaagataatatagtagcttaaactactacttatctcaatagtgatatttctgttgagccatagattttaatggttacttaacccaatgataacagttatgacggaactgtctaaaaagccggaaagagtgctatttttgagcagaaaaggattctttacaccagggaacagcaagctacattcatccaggggattgctcaacatgctccttggggaagaaaaatatttaaatttatgtttttattatgtattatgatagcctttcaaattttcttgatagtacacaattcattggtatacaggacacatttaaaatttacaaatcaattaatttacatgtattggggttgcatatgctgtattttttgtttgttttcctgataatgatatgcatttctccattcaaaccttacccatttggtaactacattatctaaacctgaagaatattctctcattctgatccaacagcttggatggctgattctgctccatttcagtaaaagtttaaggttttgggaatctggttataaaggagagttttgtttattttgtacatagaaaaatacacacggctgactgagctaggatatctttgctgtccatgcattatcagtccagcattatcaatctctctggacattcagcaccaagttacaggtggaaaaatggtgaagttacgtttctatatgcattgcctatgactgcttggtgcatttccttttgacaacggttgttatgttttttctactcactgaaagtcatcagtttgaaatgataatctttttctcctggtaaagaatttctaccctgtctcagcctgcctaaggaatacagttaaaaccattcaaaacagaacttcaggattataaaaacactcacttaaatttttttagaaaaattccagaatcaaattataaaactacagcatggtgatgaatggaatctgatttttaaaggcagaaatgcatcctgacaaagcaagagaaaatctcacagactattcagaacagaacccattagaatgtagaaataattctcaaattcaaagtctttggccgctagtgttttatgaaatattttctataggatataccagcagctacttgactctgttttccctcaatagctttggattaattagaggcctaggataactttagaaagggaaataactcatctttttcagacactatccagttgaatcttgaaatgaggatgtgggtatcttctcaccatgcctgactctttgtgactccaaggactatatcccatcatgctcttctatccacgggattttacaggcaagaatactggagtggcttgctatttccttctctaggggtgggcatctctaccctagctccaaatccatactgtgaatttgacttataacatgatagagggaaaataaagttctttgtgctccttttagtaacagagaatgaagtaagtattgtcaggaaagaggggggaaatcagccttcaattttcttctttattgaaacacgattattttggaagatccctttgtatatgcttcttttttgttatcatcaagggaatttagcttaggttcctggctatgcccagcttcaagaaattatacatttgtataaaatttataggtgttactaacattggtatggcctggtccacaggttggagattcagatatgatcacaacacagctgttttttttttttttttttttcaaggattaaagggcaggctgactttttgcaccactcacacatttatattctttttaaaaactacttacatatacttgccca

SEQ ID NO: 52177 - DNA, 2009 bp, Bovine  19866881105713
ttccttgtgcttgccttattacagactgccttagagcctgaatcctgcaactgtttggtttccaccaagcagattcacccatgagagaactggcatgcagaaatgatatggggggcatttgctagtgggtattgggtttttcagcaacagaagaagcactctaagtatccagtccataattttatgagtattgagagtttgatggaatatccattctattgacatggcttgtggctgtgttgttgtggctctgaagccagttgttttctcagtagcttgctggtgctcagatcattgcaggagtgtggtgggagcccgcaattgaggcaatggcttccttgttcctgaacttcctgtttatccctcacctttcttattgtgtcagtggtagcagctcttttcatagatcagttctgcagtgttgctttcaaattaattcttatagtctttgcctagaatcttcctcaagcccttctagagtttttaagcaaccaattcagtggattaaatcatttctgtgttcaaacttgaattaaaatatgtcagtgtaatttttctccagttttgatactttcttttttaaggtttgaaataatagactgtcttctctggggttctataacccatcccaagggtacagaataacttatacctgagatggaaagagacagatgcaatctttctttaataagtttacttttatttctcaagtactgtcctcaaagacagtactatttataatatttgctctgttcatcataacttaaagccagagaacattgaaatttcacagaatcggggtggttgtccatctgccccttttccataatttcactccccacaatataagcaggcagctgtaataattctaaaagcaaaatcatcctcagttcttccacatctcccaattctgcattgtggaaacctcgcctacttttcatcctttcttctttctaatcatccccaaatcaggtggtttaagattaaggaatactcaaaactaaattgttataaatctggaaaagtcactaggggtaaatatttgtatactagaatgtagtacgagcagcactattgtatggggggaattattatcatttttatagttggatttttgatcaaagtgatcaaaatatatttgttttcttcttctgaagaaaatatcccagaagcacttgtgaaaatagttttgtaacaatttaaatttatcccaggcccctgtcttaagtcctaagaaaaaagaaaattaatacatttattttcattaaattataattttacttgggaaaagtttaaagaaatatttgcctctcatcttttttataaatctccttggatatcactgataaaatgatcacagcatgtgtctattcatttacaacatgttttggctattttgcctcatttttaaatagcccattattaagaaagagaggaaaagagagactaggaggacaagaaggaagagaaggaagaggagagggaaaagaacttttcattttcccaagagagtaaaataatacttacaagcatagaagtcacaagtttttgtctaaagactagtaaaatcattccacctccagttagtgcctttgagaatatacttgatgtcttctgtttagtagtctggcattttaagtggtacatggaagcttataaaatatatttagcagtttgttttggattaactttgactactttttttatatctcttggatttggggaaaaggggaagggataggctggaaagagagtgggaggaaaaggcaaatacaggcaaaacagagtattctctcagagggatgttggcctggcttcagccactggttcctatatagggagcccatctcgaagcatgtgcataggttgatttttctagtcagggaagttgtcttccctgtaatagggctcctccttgagtctcactggttggtacatcaaatgaagtcaagatttggccttggatgacagataaagacagaatcttaccaattccatctacatacatc

SEQ ID NO: 52178 - DNA, 1254 bp, Bovine  19866881118085
tagttaaaatcaaatgcagagtttcagcaggagttctgtgtaggacactcacagtgcccgtctcctcatctacatccttatatatgagcagcactatcacaacattcttacccaacatccctgtgagagtttcaaatgagtcaattaatttgaaacgtctaaaatacacattggatactagctattcttatgattggtgtgatcaacaaaaatgaaataaacctactcatttctgaatactatagtgacaaaaagaaaccgcaaatctggaaggcctcttccctattcttacattaaaaaaaataatggagcagacaaaaatagtcattttttaactttccagtcgtgtacaacctgcgcctatattctacaaacagagccacacacagatgacacaggtctctctgcagcgttagagtaacggagtgtagcttcattagcacagcttgcctagatgtaccatacaaatgaaaagaaaaccccaataactgaacaaagcaatggagataaaaataaactcagagctttctgatttactcttcgattagcttcctgggaccaaaagtaaaggaaaaaaccaacacaaccaaccatcccttaaaaacgttttttctcctttctaggtaagaagcaccccaggggcaggctgaggagggtgctgggaataacagacccccacacacttgctctgctgctcacaggagagaggtgccatttaaatagctctaattagtctttacaaagcctgcaaagtaccttgtgaaatcgttccaagtttccagaggtgaaatcccatctagctttcaatttaagacaaattcagctataaaaatttgactgtgcactgttcctcaaaaagaaagaggtctttatttattaaaaaaaaggatcactctgcaataaaaggattaaattttgtcatgcttgtaaataattaacttgaaaactgaaagactggaaatgttgaagaaatggagctaactcagtgattgatgttctaaacaatatgagaaaaaatgaactcaaccaatatgggatgagattagacaagtttttgtgtgtgcatgtgtgtgttttaagatgaggcatattttctaaccaacttccttcagtggtgtaagcagaatttcaagagcaaaataaaacaaacccaggtgcccacaaatgagtcattagtgtctggggtatgggaggagaggagtgaggaagagagagagagactgaaccaggagagaggaaaaggaatcatattaa

SEQ ID NO: 52179 - DNA, 1158 bp, Bovine  19866881130357
tgcctacagatttcctcttgaactgtttcatgataatcaggaaggacattgttgggtctacttgagtttcaagtcaggaatgttcttactgctgaagcaagcatttctatttcagaaatgcttcatgggctttcagatggttagctaaatatacttagcatttgagtgtgtgcatttcccaacaattgctttagacaatgctcacatatgcatacagtaaaatgcaacttatatagccataatatctttaaatatgatgccttttttgtaggattaggaaacattaaaaactgagttgttatttttcaagcacacgtggataaagaaaacaattaccaaagttagaatcttatttctccatattaacgtaactagtttacaaggccatgcacatatctattaaatggcatgacttaatgatagccagatagatcctcataaaatacaactttaaaaaagtaagcatctttttcattctgagtaataacaaatgtcatgtgatgtgatctagaaacgcagttgtcaacaagcaattttctgctctgaccccacagcaggatgtcaacatatagtcgttttctgtaaaacatatatttttaacttttttcttattgtattctcttttggtaataagtgcagtacataagaagcaaagggtactagctcttgcctgcctggactcacatgggatcttttactgttctggggcatgtgggaaccttgcgctttcaggccttagctcttacacaagacacaagtgatcaaatacaacaggctccttaccagacacactgataagatacagactggaagggggtgactgaaccatcaactaagatattctggccttcaatcatttgctttttcagccattgtagggagtggacaattgagtaatggtaataattaggaaaaataatgattatcttcattctttctaattctgaaagaggataggtaatttaatgcactaggattgtaaacttcttcaacttgacttttttttttttttttttcttttcttttctcagccctggaatgtgattggaaaacaccctcagaagagagctagtcaaaggagcagtgtcttgaaaagtactgttttgaatcaagagaagagattagggaaaagaaaaaaagatgtatttggagaacaaa

SEQ ID NO: 52180 - DNA, 1825 bp, Bovine  19866881145551
cctgttgactcctaatttcagtctgcaagattgtacagttgctgcttgagatccaaccatacatcattcattctcccctcttttgctcagctgtcaagtggaaagttaaaagaaatgttaggtataatataagacacagcaataatcacagcagtcataattcctaccataacactatatttttctgactacattagtgacttgtcatttctaaagagcatttgtttaatggtaaagttattttctatgcatcagtagcccacattaaaaaaaataaaattaaaaatactcaagctttcacacttagccattttaaaatataaataactatacagcatgggtgcacattgggaatggaaaggataaccttttcttgcagtccaaacaaatgtcttaatacaactggaataataaaatctaccaaataccaagttattatagacactcttataatttcttcagaaaaatgaattcctggggtccttgatagtcataagctctcagttcctcctctcctcagtcccagtgaaggtctacataatttcaggacaattgtaaaaaccctgagagaaaggaatgctcgttgccgcttggccaatggccatccagatagatgctacatatgtaagtgtgatttattaaaatgattgagtcagaatcttgttttggtctgtttgtttgccactgtggctaggctgggaatctagaaagcatattctttcccctgcactctccctccacctcaggaaaaagagagcagcattatttgtaaagactctggaaagtggttaagcgctaagttccagggcctcagaagcccttagtacagagcaaatgatcatcaaaggaacatgtgaatttttacattggccccaacagtctcaggccaggactgtctccaatatcttgggacatagaagcctctgagactcttctacaacaatgtaattcagagggagagatatttgaaaataagatgcatctgaagtttgaaagggaattcactggaatttgaaaaataaagaactgtgaaatatcccactctgctatgaacaaaatccatggctttaacactagcctcaaggatggcagtgaataagtgaaaacgcgcccagtgctgttccatatactgctgtgcagttacaccaaattctgtttgtgtgaaacttccagttaaatccacacactcttccccagtagaatagatcacctggatatcatcccatcccacaatactcagggaatgtcctgccagcaccaccctcttcctgacattctggtgactaggagtaatcacctctgctgtggaacacatggaataacaaaggctaaaaggttatcaaagtgagccatgtttctgagctattgtcagtgctttgagttgggagtgggggtgtggggataggctgataagggagcctgctacattaaactgggaagggcagatgccaccatgattgttagagatcaaagtagtctcagtcaccccactcttgataaagtgggttttgttttattttgttttgaaagagaaagctcaaaaaaaagaagaaaagatattgtgtatttttagtgcaaaagagaggaatgacctgtttgccatgaatggaggcaaccttaatctcctttcgaaggcacatggagggtttctggaagttgaaggacttcctaaccttgtgaacacaagtttgtatatctttgtcagaaaagtataaataaacttaagacacaaaaagtttgagaaccactggggtagggcaggggagaaacagctatgtctccagggtccatgtccgtggcttcaaagcctgtattagtcctagaa

SEQ ID NO: 52181 - DNA, 2985 bp, Bovine  19866881165599
aaaaactgcatatttactcttttccttctcctaccatggtttccagtccgttttaggtgtcttagcattttaagatgttaaagggcaacctattaacatgttaggttaatataaaacaaaactcatattaggtgttccaagatgcccagcagaaaagaattctaactaggacatatttaaataggagacttaggatgacttcatgttgacacctaagatgaattttcaggggatagaaaggattgttgttgagaacaaagggtctcttcttggttagagcctctacttcttgcctgtcatgctctccagccatgtaacttcttttcagaattgacactgtgtctgttcatttccttgtcatctttttggacgaagggcctgaaaagaaggagcctcttttcctccctttcctcagcactgttgtgcagttccattcctgaagtctctcaaatgattccacaattctgggagatcgaacatatgaatttttagtgctcctttggcactgccatttatgtcccagagcagcagcatctcaggattgtacagttggagttggacctgagctgagatatggcatattttctgctgatggagtttctaactgggaaagcacattcaagtggagtttttgtggctttttccagattaaatgaagaacgagtgattttgctggtggtgttcttgagcatgaagacacaaagatttcaaggattctgataggttgaaattacctcatagagaaggcaagagagaggagaggtcatacaggctcaaactcttggagtgctggtcctaaattgtcttttctactagaaaattcaaagggcaaagaggaggaaaacaaagggaaaaatggaagaaagaaattagattttctcagttgcctaattaatgcaagattgagccatcttgaaagcctaaatttgaaatacttatcttctgtcccccctttctttctgtataccttcactttctgattactgcacacacatacaccttgctaaaaaaaaatctggctttaacataagattctaaaaatttcttatttccagagaatttgataagaatactgccttttttttttgttatctaactcaactctctgtctttaaacaaaatatttggcttttgtatcacaaagtaagcctcccaaaagaaccagtacatgaccagctcccatttctgataattgtaaaaaatattaaatcacttttaggtgctttttttagctgattcaataataatttaattatttccagcttatgattaattctatcagcccctcaccatctccttcctccccagggttccctctaacccccaccaagattcttttttaaaataatctcacagtaatatatattgggatgcaatttacatcccatacaattcatctattaaagtgtaaaataaaatgatgtttattttattttaataaagggctgtgaaaccatcaccataatcaattttagagcatcttcatcactttaaaaaaaaacttcatcaccgttagcaatcttccttttttccccaacatacccagtctctggcaagcacaaatctactttctgactctatggattgtcctcttctgggcatttcatataaatggaatcatacagtatatagcctttcatgtctggcttattcagattaatgcaatgtttttaatattcatctatgttataacctctatctgtacttccttgatttttattgctaaataatattccattgtttggatataccaccttttgcttgtctgcaattgatggacctttggattgtttctacttttaaatactatgaataatgctgctatggacattcatatataagttttgggataaataactaggtctcccaaaaatttgaaagcatgttggtaatggtccagtgatggtattggagagaaaagggtttccttcttggttttatctccactcaattatggatgatgtcgaatccagcatgtgtttgtctccaggaatgcccaatgctttctgcagaaggcagtaactgaatagattgcaaatattcattcagcatgctctcaattcgatgatgctggcaatctttagtaaattgcagcctgctctcctttggtccccagcttgggtaatctactcatgcatactgatgtggaatcttccttggcccggctgaggaaatcttcaggcaggtccacaggggctctctctgaattaaaatcctctgcccctgggtataatgttcctctctgtgtctctaggagaaagacagcccatgaaattaaaagacacttgctccttggaagaaaaactataacaaacctagatagtgcaataccattgcagttatatctacatgcatggatatgtttaacttttcactgttcataatttagaagacaatgacatccattttcttctgtgactgaaagaagcttcttgttgcttttataaataagtcttttagaaccacaagctttgttttctgaaattgcataaaggattaagctgagacaagtttgctctttgactaggcagtgacttcaagacatttatatttttgtagaacataaagttagcacagtcatttttaatgaggaaatcatcacagagctgatgtgtacatttcaacttagatagttaaattcaatttgctacaacaaacatagtctaacaaatgtgttctctaacaacatacagagagtaaattcaatatccaataacagatatataaagcatttttgcagtaattgtagcctcaaggttaagaattctattctataagaaatgaaataaaacatgtacttaaagagcagactgtcacaggagaagttctgatcattattggcaaacaaactgcctacacactcaatttttatattgctgaggtacatgtgatgtttatatgtacctctttcaggatattcacacagccagtactttgcattctcaaatacttgcatcatccatcttgtgttctctaaagatttct

SEQ ID NO: 52182 - DNA, 609 bp, Bovine  19866881183485
tggtcctaaatggagctgctttgtatggagaaggcacagggttggggcatctgaatgcttcaacttcccttaactcacagcatactcggaaaggagtacattctgcagggaagttgatgaggttctttggaagaacaaactagaaggacccctaatcactttattctttagacttttaagacatggataattattttgctgaatactgttcattgattgactagtgtatatacggattagcacaggctaagaaaggaaagggggttttataatctgtagtaaattagaggctgcaatctatactgctgagaatttctgtatgtttagaggctattcatgactgttaataggctttactctttacacttgtgagtttattattgtgctgaactctatccattataatacaaaatgtgtgcatccttaatattgtaacagctgttggatgtattttactttcaagttgtagatatcaacataaaagcatggaaaatatccagtatcgaaaataaccagtatcgaaaaattctatgaatttagcaaagtgtttttgctttttaaagaatttcatcttgggaatataaacctaatgtatcattagttccaaaa

SEQ ID NO: 52183 - DNA, 696 bp, Bovine  19866881185342
acacatttctaacaatacactgcccttggatatgttgcagttacttccttgactggccataactctgtcctgcctgtcttctgtctttggatagaaagggtggcttggccaattagccctgcacttgcgtttctgagtattttagcaatgctcctgaattttggtggcttcttgagatgggatgtccataactgccggccagtttccagctggtaacatcatgcctcacgcctgtattgcctgtgctattctctctagtgctgaattcagtttagactaaaagtgagtacttgagccatcccaataacttgaaagcacttttgcacaactttcaagctctttttgaactgccttccagatacaatattggatgtatttttattccccaccaggagttataactcattgagaattcaaaaaaaaataaccaagatgtccagaaattctagtcatcaacatgaataagtttaatattcttcataagaaatctaaagaaagtagcagggacttcttttgaatttggataagttttatttcctctgttatataaaacaagtgctgatcgtaaagtctaaattttatccaggccattcaactgtttgcttagaagacatttaagcaaatgtcttatttatggtgaataaatgtttgactcatcttctgagatgctggatttgttgctgtcatcatatggga

SEQ ID NO: 52184 - DNA, 1018 bp, Bovine  19866881189384
tggctctctcagctcctgcttacagaatcgcttgcttcctgtactcatgagcctttgtgtacaatttcttccatctgactttttgtatacctcttctttgtccatcaagattaaattcagaaactttcttgacccagactctatcactagcatgtattacatctttctgtttctctgtgcccctcaccctatggtaaactaaagacagggacaatagcctcttccccccgcccagggcgtaccacaatactcatacttaatacactttggtgaaaacgcttattttcttctactggctaccatcaactagctatataaaaccaacaaactacttaattgactggatttaatttccacttcataaaacactctcattaatgcaacattaatgagaatctgtgtcaaaatgaactctagaaaatgcaatagaacatgaataataaaactgtgagcctatgcaaaagcctcttgcactctatatacagcaatatattctacgcatttttttataaccacataacatcaagatgtaacctctttttcttgtttacatgcatttctgtggtccagccctaagcttcagtcaacttactttatgttctcatttgcaggtacttcgggcagttgcacggtaatcatgccatccaagttcgtcttcccgatgaaggcaggcttggtgcgcagaacgtcgggcgccgtcttcgcagtcaccctgtgctgcaggcccccggcgctgttgccgcgattcgtcagcacaaaggaataggacttctcaggcttcaggttgacaatcagcttctgggtagcgcggccatccacttcttctaccattttcccatcatcataaagaatctggagacagacaaccaatcaaaaagatttggttatcggttaggcagggaatattttctaaactaatgtgcacctgcttacggaaaatacatatgggtcatttctaatttggggcaatttgtaagcctataagtgctccccaaattctagagatggcatcaatttt

SEQ ID NO: 52185 - DNA, 1288 bp, Bovine  19866881192817
tgagaacacagatttttataaaacagtcatttttttttttgctatcaaaaatgctcaacatagtcacctaataaacaaaataattttaaaaagaaaatatttctatacattcacattgtaaatcaaccatacttcaataaaaaagaaaagaaaatattcctcagtactaatcacctgaaacttacaagttggaactattgagaatagaactctgagcttgagataaagtttaaagaaattgatgaatgaatttccaatagtcagaatttgggcaaaatttaacacttcatatatagcagttgtaaaattagttccttgacagaaaaaaattacaaggctctattatgggttcaacaacactccttagtgggttagcaattcattaattacagcagcatcactgaatatgtttcagtaataagatactttattctgtctgtaaccatctttacataggtatatggaattacatattctataatatctaagaatgtcttaggctcttctactgataaattgggaacaatggatgtgaattaattaaattagtgaaagaattctggacacattaaaatacaaatgtctatttctcatacatgcatcaaatattttaatcaaaggatctcttgttggataatgtgaaagaggacaacatagtaataagactatttgagtacattttctcttttgaactgttcttgttcttagcttcctctgtgcatcatacaatactccaaaattttaatgaacttccatgtgatttcacatctttaaaaaattcatggatatatatttcatacttttatatgcaataccaacttattctttatgcactcacttcaataactaggttgaaagttctttgtggatgaagataatatcttttacttcttttatatccttgaatttttaaaattattttaatttaaatacacagttgatttacaatgttgtgttagtttcagatgtatagcaaagttatatatatacacacatatacattctcttgtgtatgtacatatacataaaattatattcctttataggctttttacaaaatattatattaagtatagttccctgtgttatatagcaggtccatgtttttatctgttttttatatagtacagtatatatgttaatcccaaactcctaatttatccctccccttcccccttgagtaaccataagttttttttttttccctgtgtctatggatctatttctgttttgcatttaagttcatatgtatcattaaaggaaaattattttaatctataattttaga

SEQ ID NO: 52186 - DNA, 1703 bp, Bovine  19866881233864
catagatctttgctttttgatagatgaatctaatgttataatggaccctaagtctaaaatgacatatcctcagctgccaacatctctttgtagaggactttttgcatacttttcatgcatgtttacaaagtgaactgttttatcagctaactaagagatagaaggctgagggtgaaggaaatggggaaagccaaaggaattcagctttgttttgatttagtccgttttagcttcatttagtagcaactatcttccaataagcagattactgtgtaaacaatgatggaatggcatatgtataacaaaaatgtaagactcttaacagacatgaagagagcatttttaaattcacaatctctttatgattagagtaaaatcagaataacttgccgctgcatgaatggctggtgagggaaaggaagattctactcctcaaggcttgtttggctagcaaccaggccagatagaatcatctgaagctatatgctacatttacttgccagattgtttgaagattgctcctgggaatttttctggtctgctgtgtgtgtgtgtttgaaggacagacaggcagaggcagactgataaacaagcagagacacagagaaattgagagagagagaaagagaatacttttggagcagctttcctcttcacatcaatcagttaaacaattccagatcagtttctagataaataaataggcataactggaaatatttaagaatgatgggacttccattcatcctgcctattttaaccatgtatcttccttacgatatggtattgaaccagattctttaaaatattttcttattgttctatttctgaattgaaattattccttagctcttatgtgttatgattctttcatctcatgaagttactaagccccacatcatgctctaaaaatatatcttctttatgaaatcgtagaatattgtctctggagaatactttgaacataatagcattcccccaccgcccttcccaccttttatgctgaggagcctaaaatccagaggggtagaattctcaaggcttcagaaagttggtaaaactccataaataagaatctaaatccctgtctaattctggttttctgttttgctttgatgtactttttttctttaccactttggctctaaatcaaagaaggaaatctaaatatttaagtaaagatataaatatgccctgtatttccagaagacttccaagaactttattcattcattcttttcacatatttaataaaaaattattgagtacctacttgctagataccaaggatagaaaagactatacaacagattatattttccctatttaaagtttatttaaaaatgcatacttgtatgtgcatatatgtagtacacattatctgactcatagtaagtaagggaaagactaaggaacatttttgcatgctaaaaagttattagtgtctctggtatccacgtctgaaggtgtatggtctgttccatggttagtctcttaaataaggaaaaccaccaaccctgtccaccaagaaggggcagccaattagagtccagaaggttgataattcagcacacatgtgcttccttctcgctggtacaccttcccattatgtcctttgtgccttaataattaagtatatttccccatctaccttgcagctttgtgcttatctgacatcaacataaacagactattttcagctc

SEQ ID NO: 52187 - DNA, 1000 bp, Bovine  19866881235845
acctactgtatagcatagggaattatattcaatattttgtaataacctataatggaaaataatctgaaaaatgtatatataaccgaagctctttcctgtacacctaaaacactgtaaatcaactatactttaattaagaaaattagctcagatattggctatgggaattaaatttgaatataaacactagcataatagatgacatatagttagtacacagtacatttagctttagatacttagattctgtacttgtttgagttttgcttatttattttgcttttttaaagtcttagacccatccatgaataatggattgaaagatagatcaaatgtttttctacttaagtcccacagatcatgtatcttttgagcacagggatgaactcttaaccccagtgacagtactctgtcccattagaggacatggcctgggacagagtagctactgaataaataagctgtacttgttgtatcctcctcacttttacttcatgcataacagatgcagccttatgggtaggtgattctcggtaagcaaccttaggtagaattcacagttctcattcccagcagataatctgcttcactggaccttggtgaaataatagatgttttctttgagattcagctgaggggcagcaaatagggatttatattacgtggcatgcattttctgtcatggggaggatgtacctcattacaaacatgctttatatctagtgagcttgcatgcacctgcgtgcttgtgtacacgcacatatgttagaaaagtgggttattatcttattattataaaagaatgtttggggtagcaaggaagaaatactattgctgggaaaggaatacagaaaaaatgtgacacatccagttctcactagattcaggcacagaagctcagagatattcagtttgatgcttttatttctttaatccacattctcagttcttttgttttcttgcatttctatttttaatcatccttgtattcctctcctat

SEQ ID NO: 52188 - DNA, 3029 bp, Bovine  19866881248756
gaccttttgccggtgctccagagagtgacactcctccttgatccccttcccagcccaatctctggtctttttgactccatggactgaggcccacagtctcctctgtccatggaattttccagataagaatactggagtgggtagccattcctttctccaggggttcttctcaacctagggatcaaacctagggtctgctgcattgcaggcagattctttaccatctgagccactagggaagcacctatctctgggttcagtccaacccccagtaagtgttaggaagatccctgtcctcttacttccaagcacctgtctatctgctcccacctctggggcagcactgatcctccccactccctgctcgttgcagacagagctttttgcccagcttgtaataaccatgatgacatgtgttcctttatccaaggatacccttcatctacaaacatggcaaggttttcactggaaccaggagatttagatgtgagagctcatggtttttgaactgactacttaagctctgatcaaattttctcatctactataaatggaataatacctatcttcacagaggagcttaagagcctcttgaagaaggtgaaagagaatgaaaaagctggcttaaaactcaatattcatacaactaagatcatggcattcagtcccatcacttcaaggcaaataggtggggaaaaagtagaaatagtgacagattttattttcttgggcttcaaaatcactgtagatggtgactacagccatgaaattaaaatatgcttgctctttggaagaaaagctatgataaacctggacagcttattaaaaagcagagacattactttgccgacaaaggtccatatagttacagttaaagctttggttttgacagcagtcatgtacagatgtgagagttggccataaagaaggctgagcatggaataattgatgcttttgaactgtgctgttagagaaaactcttgagagtcccctggactaaacggaggtcaaaccagtcaatcctaaaggaaatcaacccagaatagtcattggaaggactgatgctgaagttgaagctccaacagtttggctacctgaggcaaagagttgactcattataaaagaccctgatgctgggcaaggttgaaggcaggaggagatggggatggcagaggatgagatgggtggatggcatcactgactcaatggacatgagtctgagcaagctctgggagatggcgaagaacagggaagtctggtgtgctgcagtccatagggtcgcagagttggacacaactaagtgactgaacaacaatagacagatattttgattgtctatattactagaaattatgaatttacatcaactccatttatatcaatatgtatgacggtactcttagaaaaaatcaaaagtaataatgtctctcttaaactcactttatttctaattaccgtttctgcagagtctgattttaaacaaaaacaggaatgttattgtcaggggattaaaggtaatataatgaatgtacctttctgattaagtagacatacaatatatctctctctggatataaaattaaaatatatttgagaagttcatatagatatattactgacctgtgcatttttgtagttttttggaaaagacaaaatattagtgagaataatcataaacttaaattttatataacctaataaaataatattttataatggttttatgttttgctgagcaagtggttctatgaattagctaatcaagagcatctcagcattaattatatcagaactaacatcattgtatttggcaggtgtccactaacatcaaatggcctttgttaattaagtctggagaacagatcaaatcattgtgccattttggaaggttttcttagcctattgatcttggcaggcacaagtcatcatgtcattatatatcttctcaatcaatgggtattaaaatcacaactattatgcaaggttcttggaaataccttaatgtaaaaaaaaaaagttaaacagaaattgataacagctattctaatgcatctgtgagccattcatctagatttttttttttttttaggtacagagtccctggatcacattaactcaattgctcttgtcataatattaccttcactgagtaatgatttatgttacattatgtcccctggtaatacagaaaatcaaaatatggtctactgaaacatcagttctatatctttcattaaattgtgactaaaagcattatcgtctgccatttcatattcttaagataaggatactcatgattcgcaaagattcttatgttttggttgaatttagtttcagaaactatttggtttcttagctaaatcctcctgtcataagaaaaaaaaatatgaaacactttgatattcatgctaaaatttgtagttagaaaattaagaagcagatttagtgatcaagtataataacctattaaaaaggtattccttcttcttttagataaatacatatttttttcctatctaaacggtttagtgtacctctgtactaggataatcgaatagctactacaagtatttcagaagtaaatcatccttaattcttggatacaatacttgaaactctgtatttcctgcctctgttcaaaaacctagtaagaaccaaaaaaaaaaaaaaaataagacatttgtaaattattaatttaaaagacaatggtgcttcagcaaaggaaacaagaaaataaaaagacaacccaccaatgggtattaggataagggataaggaactagtctcaaaaattgacaaatagctcatgatgcttaacagtatcataacaacccactcaaaatgggcagaagacctaaacacatatttcttcagagaagaatacagatggccaacaggcacatgaaaagatgttccatgttgctaattattagagaaatgcaagtcagaaccacactgagatatcacctcatagcagccagaatggctatcatgaaaaaatccacaaacaataaatgccagggaaggtg

SEQ ID NO: 52189 - DNA, 1666 bp, Bovine  19866881269990
attcttcccaatgactcttggaaagtttcatatttcttcaatgaaatcaatagtttgagaatgaaatcatatcatcatgggccatctttgaaaactctcttgaggtcaaacccagcctgggccatccaacccctcatgactttgccatctgaaacctcaatgttgagctggccttggcagcattatgcctgagccctttattgaatatgcttcttttttgatctgcttttaatttaccttgtttttcgtgctgcctcctgctctgccggggacagatgggtgtttgttgtgccactagatgtatcactaattgcttgactatgagcttcttgaactaggtcagttgtttcttctccataaaatgtcacttgctttctccattgtgtgtatcaatgtctccaaaactttcacaactgcgtggacatgcttaaaaacaattagatacttgggaaaatcggactataggcaagaaaattaaaggtgactaggttcctcactgaaatggtttctgagggagggaagcatctgatccagtactaggaagaagagggaaggtttggcccaattcttccacacactgggattttgattcattttgatgttgatctgcaaagcatgcagaaaatcattgcctcttcttgttgtcctctcctcactgatgatatttaaccacctttgatccaaattatttctcagactcctggaagcctactgaaaatgaagtttgttttatagcccttgtgctgttcctatgtatccaatgatcatttccattataatgggtgtcaatccatttatgaatttatcacatcagattgaggaatgcattcagataaaatctcatggcttacacatttctctgataaaatattcatgacatgaaggtttcacctttataaatcatggttactccattgattatttttttcttccacatttttcaaacaagcccataaatttttttaaatgttcatcagggaaaacaatatgaatgaatagatggatatacctttcaattacatgcatttctgattttactactgcctccagcttatattataagaatggaataccacatggaaggggatctttttccaaacctaatggatatggagactgatttcttcatttaaagaaaaaaaggttctctatcatgatggcttaattataatgggaagcattaatataaattgaaaacttttcgttacttggagtctggaatgaagagtataacttatgaacctgtatgcatcttaattacctttgacctttgaacaacatggtggttaggggtgccaaccctctgtgcagttgaaaatttgagtataatttatggttgaatctctgtatctatagttcctgtgcatttacagttcctacatacactcagttccgcatctacaattcagccaacctcagatcatagatcatgtagtactgtagtatttactactgaacaaaaaccaaaaaactgcatgtaagtagacccatgaggttcatacccatgttgtttaaggatccattatattggtatgcaagtttattggcttccttctttttaatccttttgagatatggcatatgtgaataaatagggaagttaaatgtttcagttattgctgcataacaaatcacttcaaaactttggacaaaaccacaacaattt

SEQ ID NO: 52190 - DNA, 1733 bp, Bovine  19866881381815
tgattagcatgtgattattttttacagacaggcatcaatgcttggtgattttgatgtgcttttatcttgtgagatttatttaaagaagcatatgcatggcttagagccttagggaatgataccaccccttaagaaagcataaaagaaagcaaaagaaaacctgcttcatttgtaaaaaaaaaaaaaggacttgttaccctttcagtatctccaaattctataccagcacctctttctctcaagtccttctctaactcaactcttacaaggatgtctttctgtattcatccatcagggaaagttcttgcccacactccattcgcaacttctagcttttagtagaagaagccaaaaagggcaagagaaagacaatgctgactagaaggttgagaagagggagttagaatgatttttcattgttttggaaatgttttatttctcttaaaaagatgaagttaatttttataaataaaattttaacttgtttctagatgatggaaatttttaccctcgttcttcttactttccataattcaattaaaataaagaacaactgtgaaaaaaacattaactccacacagtatcctgccctgcttttctatgttggtatttcaacgattatcactctggaacagatggatctttacagtgtccatgttgttaacataatgctgtccagtaactatttatgtttaatttttttccacattcatttggtatttatttagaaatgtccctgaacaagactgttcccattaaaaagtcacaggatgggataaggcatttagaacatattgcaaaactgcccccagcttagccgtcaactttacatatatacatttccttatgtaagtttgcatagtactttataggctattaaaagtaagacacttcactaaagtgctcaccatttaaataaaggatagtgagtaggttaaaagttcagaactaaaagaacaaaaggactagaactcagtaacaaaaccatactctaaccagagtatttaaaggcactcgctttttcaagtcagtttcagcttcaaatattttcagtatggactcttgagttcatttatatttatcagattatggatgccaattttgtttagaaacgattatttttgatatcaaaatattaagtagagcacatctactgtctgatgggtgattttgtttctatagctgttgctttctgaatgctggactaggtccaaaggtgagaagaggaaaggctctattccaagaacatctcaaaattttaacggaaatatgttacttgtggtaataactttttcttcccgtctcctattttgctaatatttgctatattacccacactatgaaggccgtcctggaagtgctagaattacgttttcaaagagaagaataattttgatgttctttcaaagttctcatatagaaatgtacaaaatatatgtcgggtaatgatactcttatttgatatgaaaatttttgatgtaaatattgagatgggtagatcctgaaataggatcaaagaaagctgtaacactggacaccactgcaacacaaagtctctgcagaaagaaaagaggaatattgcattttatgtaaaatactgccatatttttgctcattacaacagatgttctcattggacatctttctacactatgtctctaaatagatgataaacaagtcttttagtaagtcatttatttgggggatccttgcacatattttattaatgacag

SEQ ID NO: 52191 - DNA, 1263 bp, Bovine  19866881389647
tgacttcactttcacttttcactttcttgcattggagaaggaaatggcaacccactccagtgttcttgcctggagaatcccagggatgggggagcctggtgggctgccgggctatggggtcgcacagagttggacacgactgaaggtgacttagcatagcatagcaaaggagcattgcagaggggtaggtcacaagaaagtatccatttttaacccagatggcagaaatggtgatgccctattgaaatgtggtgctaaaactcagcatctcagaacctgcatttgagtccctatttggccatttaccattagctgtatgacttcaaagaagttcctgaatgttgtgaatcgctgaaggggaaaggaaactgacagataatgtcaaatgcctccaggatacccagcactgtggtgagaaggcccttcactgccatctcatttaccttgagaataaatgtgaaagcacaaacttcctcaaacagtaaggtattattattggaaatatggggagaaaaggaagaacagctagagggagtagtttaaagcaagattctgagagcctaatcgcaaatgatcctgtggtgattctataaaaaatttcccggtattaacattgcctgtttcttgttgtcagtttcagaggtagaatctttaaatgaaatttctgtctacaaagcaactgcattcttcctttatgtctgcaaagcaaacatgtttaaagctgtcttaaaacttactagataattaacaagttaattaacattagaacaacagaaaacccaagagagattaagtgcctttctcaaggacacccaatcactggtatctggaaaaaatattttgaacttcatggtcttgcttaaagctaagagacacctcccaccatttaaaacctccaagaaatcttcatctttgaaaagagataacatgttaagttccaaggagcactttcttcctctcttccatatagacagcaagattgggctgttaacaatatattctgttcagaggagaaaaaatagcttttgcacaagtcagagcctctgttcctgttttgttttcttcccacaattcatgagttagacacaggcatatgttttattattttccctcttcagttttttttgaaaaaatgcattattacaccatgaagaggttgaaattgttaggatctggagttatcccatccctactagttttgtaggattctgtagtatctttctgccagaatacagaaccatgcatcattcagaaattaggaag

SEQ ID NO: 52192 - DNA, 801 bp, Bovine  19866881422122
atatttatacatccattagtcattcacaaacatttgtttagtgttcactatacacaatggtgggtaaacaagcaaaacacattgcccttgtctcttagagctaagaatttaatatacatttgttgctgttttagggttcttacaagctcagaccagaaatgctaagagtctactaacatttgacagatatttagcacgtttcaggggcttctctggtggcgcaggcagtaaagaatctgcctgcaatgcaggagacctgtgttcgatccctgagccaggaagatatccctggagaagagaatggctacccactccagtattcttgcttggagaattccctgaacagaggagcctgaggggctacagtctatggggctgcaaagagtctgaagtgattaacactttcatttttcttttttcactagcaagtttctattacatgccaggtagtagagcagtgttacagggtgggtactgggaatgcaaagatgaataacagtctctgctctcagaaaatcacagatcaatactttgcttcttggtctcaaggatggtggacttttgacctactcttacactttcattttcagtgaaggaggaaatatgaagtgagtgttatcttccatatttctcatttcccctcctcaacaacgaaattccttctgtaaggtttaagggacctctatgaagaaaaatgacagcaatataacagctcttgggtggccaaatcacaattcatggactctttgtagatcccaagaggactattcagcatcaacctcattcttaacagtggaacaa

SEQ ID NO: 52193 - DNA, 974 bp, Bovine  19866881431616
acaaagagcaggacatatacttcttggttctcttccaagttctggaaaagaactggccgcctgactggataacagagcaagcactgcttgcccaccctgttcttccgtgtcctcaacaggaaaacacagatgcagatgcagacaggcccacactgacttgcctcccagtaatcctgggaggataaattaggccccacctgctaagtgtcttgagtttctaagaaaaggaggaggaggtgggcctgcggtgggggtggggtgctacctgaggcctaattaacagccaggctttgacagtcccactgagtgaaacacgctgccctaattaccgcaggcaagtgctcctctggaatagagtttgtttagacattttgttccaaggcagagcatttgcagacaagaaggataatttaagagtcaagaatatagtgatttgtttgagggtagaaagaaagacatgaaagggaaaaaaaaaaaaaacctttctaactgatcagctcttccccaggtatgtacacttagtcccttcccaggccgaagaaggcaatttaattgctcataactttattgacttgacaaggcaagctattgttgcttcttccctttccttcaccctcagtgcaatcaaacactaaatcctgaccaagtcattccccacaccgaggctaaaatgatctttccaaaacataaatatggctctgtcactccctcacttaaagcactgtaatggatttccattcttattggccataaagacatctaagtgttctcaacctggcttattgaaagccgagcaaaatgtgctttgcctcagtctccaagtctccttcgcaccaaacctcctggttgctgttggttccctgcaaagctcacacagggccagagtctctcacctctgacatttctaaagatgtcatctccttacttagaataatctaatccttgcagacacttcatatactattcttcagggt

SEQ ID NO: 52194 - DNA, 1667 bp, Bovine  19866881476679
cagatgtcactcttggacttgagatgcttgttagatagcaaatgttatgcacaacaaatcttttctagttttttcattcaaatagtattggttcagtgcctactatgaggtaggcactgcacatagagtggaaaacaaaagtagacatgtactctgaccatacattgggctttcatctaggccagaagtctgttattaaacaaggaatgataccaataagtgtgaagctataactgtaacaagtgataggaatgaaacatacataatacagaaaatgagactttgcttggatcagattagaaaaggctttcctgaagaagtgaagattgagatgagattttaagaacaactaaaagatatcatgttctaaatgaaaacatgtttgtgtgatcaaccaccaatccttaattaaagccagtgtccaggatgtggtagaaactcaggaatttaggacaattgaagttccaagcgaagaaagtagaaacaaatggggaaaggaatggtgtgaaagaacacatagaataggaaatatgagaaagagaagatttgaaagtgaaatttcagactttcctccacttccagttcactggagggaaatattcacccttaatatagtgcaacaaaaagaactaattacaccattaaccaaaagctgaatgctgagtgtttgtgcgagtggaattataatcactaagtcttaaattttacacaccatatttattggctgctgctgctgctgctgctaagtcacttcagtcgtgtccgactctgtgcgaccccatagacggcagcccaccaggctcctctgtccctgggattctccaggcaagagcactggagtgggttgccatttccttctccactgcacgaaaatgaaaagtgaagtcgctcagtcgtgtccgactcccagcgaccccatggactgcagcccaccaggctccttcgtccatgggattctccaggcaagagcactggagtggggtgccattgccttcagtttgtcttaaatttccttccccgtcatctttattacaaaagatagcatttacattttatttgacatcctgcaaatataaaactcttcacaagaatttgcttctttagaaaatgccagagtcagcttgtttagtgattattattttattacaacaacatttcactgccatttattgtctttgcaaaatcaaatcctgatgagaaattggaaaggaagagacttgaagaggatcacctatctataaatttaagtctctagtaatgagtacaatgaatgatcttgaaaaattccaggatgagtaggaaattctgtcagtctctctatcctttttgggttcctttaagatgaaaaaagatacagaaacagtattggattgtgtgaaagcatttacattattttcaaggtttcttgccaactgccaacactgattccagataacttccctgtgtaaggggaaggtgtaattgattctgtactcactgattttcaccacaaattttcaacatcaagactgaattgattctgtgaatccattgcttctgggcagaagaagaaacagattccataacatctgaaactttctgccagttctgagtgagcctctttgtccagagtctattgcttgccctttatctactctactcttttaacactgagagactcaccacta

SEQ ID NO: 52195 - DNA, 1151 bp, Bovine  19866881479925
tcttctcccacaggacagttcaaaagcatcaattcttggacgctcagccttcttcacagtccaactctcacatccatacatgaccactggaaaaaccatagccttgactagccggactttagttagcaaagtggcttcagagatcagcaaatcccagctcctgaatcagaaattatctcaaatcaaacttattcatgaaatttgtaaagatgtgaccctgtggtatgtttgtgagaaagcaagtggcagtttgtttggctagattgaagcatgaaatggaaccagtttacatctattcccagttgtttatatttattggaaagaatcctggacccagagtcagaaaatctggctgggcttctagccttgtgcagttaatgactaattctatggcctcggataaattatttaatttctctgatgccaatgtcctcatcagtaaaacaggacttttaataatacgtactttattaaataagctactaaacgttaaagtgttcagcatagtgcctgacatgtcataagtctcacaaaatggtaactagtgttaatctttgaatattcgccatgtaacaagttgtatggaaacccttttgtattatttaaccaccacaaaacccttaaggttgacactgtgtatctgacactttacagataaggaaactgaagttagttaaactaaagggatttgccacaaactggtaaatggctgagttgaaagtcaaacacttgcctttaggttattagagtataccatttgttcctttttttctttcatattagaaagcagtgtctcaaattattttaaatcacagagtgttgtcagtgaggggtaaggaacagaagaagcaattaaggtgaattaatcagtcttaaaatacagtaatgtgggtaaagctatttaattataattatgatcttcaaaggtagaaataaagacagtgtctttcattagtccttatcaatatctattacaaacttttgggtaactttgatttcattttagcaagatttatttacatctctagaaatctgtcttatacataccagtttcttataactaaaggatattgtagaatctgcaaaattttataccttttgctttttcttgggaattgagtgtaagaggcattggggaagcagtttcaaat

SEQ ID NO: 52196 - DNA, 1556 bp, Bovine  19866881482871
aatgtttgtattattgcttcactttctcctgatcctcgagctgatcaggacatacatccaatgtttcagcacattcctgtgttaccacttgtgaaggagtgttcttggaagactctccagttcctgacttctcaggaccttggcttctttccaaagaatgtacctttggagagagtccttatcagtcctgagttagggctttcttgtctccaccaccttgcatgtctaattccttctgactctgggctcagatgaggtttaccaccgtcatatgtctaaatgaatccaagattccttttgaatagcactttacacgtttcagaacactttctacgagaactctgatacctaattgttttaccggtttttacttaagacaaggagtgggctggataattagtgttttctaacttgaagttgtgtccttgaggccagctgtggagctatttaccctggttgtcttcagtaatagcaaagatgccgggcagacgtggttttggatacgattgtagccaacagggtaaaccagtcttttcaaagcacatatggtctgattttcatgtatatcttgaggaactactttttttttaatttaaaaagaaaaccagtctggtgtacttatacatctgcatttctgagtgatattatgagcagatacttcatttagtgtattgggatccaataaccatccccaccccacaaatatctttcttgtttattcttgtatgccagagagagttagtgtggttactcgctaaatcagtaccataaccgctaaaaaccctcctctaactctcatactgggagaaagctcttgtgttactattacttataatatttcagtaaaaaaacaagactgtgaacaaacatgaaggttttgcatctttaaggagctttgacatcataaacctacagtgttgttccattgatgttaatcaaaatcaactgcaggagttctccaagtttaaatttactgttcattcagaaatcacacggtaagcactcactgcatcacccaggcttctgggttgttctgcttgttggacatggctggatacaacagacttgtgaattagatgtgaaatcaaccaaaagtctttagggcatctcttgctgtgactgctcatgctctcaggaccattctctctgggagttcttcaactcaaaggttttgacacaagaggaaaacctaagaagatcactggcgctagaggtattctagaaggctcatacaggttaaggaagattatacagctgactagtggccaagtcaggactggagagatcaaatattttaatattatcctggtgtttccacagccacatgtaacctttacatgttcttccaggtaagaacatagcagcaattctgtgtcatttgtaactgaaaaagataaactcaagacaagtaattttctgttggtgtttatggcaaaaggcaattgttagtgtgtagctaaagagcatagcattcattcttaaaccttttctgatgctcaagtttatttagaacctttgccaaaataaagcacacattttgagagaaacctttatct

SEQ ID NO: 52197 - DNA, 863 bp, Bovine  19866881608736
gatataatcagtgtataaaccccaagatgggttcaaccatatcacttcagcagaggagacagacatagcctgtcgagaagttcctgtgaatttgatgggatttgtagccctatatcacccatggactcagggctgtcaagcaaccagagaaaatcaataaagactccttacttgtgctcagaattgcaggacatgtttgatgtgctaccagccacctggcctgaaccactttctggcagattgtgatcatgtcattgcactgttctagatcgatcaaaatctgtctttggaggtaacgtagtttgtgtagtatttatttctgaaagcaaataagtcactgaacactaattctgaaagttactctttttaacacctactgaatgtttctatttactatattaccttcttggaaaatgacaatcagcctcaacttataatgactcagataagtcttgtaataaaccttttgatgttgtttaattcagcatttgccaagctagtgtgatcaggaaacttctagtttctttggggaaatgcttaactgacatacctgggcacactttggaaccctctggtttacttataagtggaccttacttattgtttatatgatcctggtcaagtgacttagttttcttaagctttcttataaattggggataataatatatgaggactaacttaatttaatgaaataattgatggaggaagcatctttataatggccacacatagaagaggcacacaggagctcaaccaatactgatttatgcttttctactttcctgcccttccctgttcctctgttattaggtaaactctcatgcaaagaatgtaatctgtagaaaataaaatttctaaag

SEQ ID NO: 52198 - DNA, 1277 bp, Bovine  19866881633446
ctgcctttcctattcatggcaagttcacatgggagcttgtgctcattaacacaatgttccctactgagtctctcctcccagggtaacttgctcccctgcccatgaggactgcaggtgttatcaaagactgagaatctagatcctgagcctttcctaagggagcagcaactgacctttcctacttaatatcttcttaccagaagtttcctgtttacaagccctcctatattcactatatcatttgcatactaatgtttgcatgctagttatatgcatatataatctaaactaatatgggcatgttttcaataattagttacaaatttttttgacctgtgattgtttatcctatttaccgccttcctcatttttttgagatttaaatagatttctagtatagtaatgttgatttgtaaaacagcataggaacttctggcgtattttgatgggaacaattgaacaaaatgtttggaattttgactttattttaaaatccaggaagaagtttgcaatgccttttgtacaaaatgcttggcattattttgtaatcagcagcgaggctctgcacattcccttgcccatcccaagccaattatttatggtatttttctagcagtgataaaatagagccagagcataaaatgtcacaaggaatgctgaaaaagaatgaaaagtaacccttaaatattgcatattgcctattcttagcagcattgagtgatgttgacctttgataggaaagtgtgtgtgtgtgctcattacttcaaatagactataagttcaacttgcaaagactgataacaaaattataactgtccaatagaaattatctgaaattcatgcagctagatcaaaagcctcccccagctccaaatgagcagtaactggaatgaattacattatggagccttcccaactgcagcttaaatcatttaagccttgtttggtatggcacctgctgctcacttatttttaggagagaaaatgtacattcttgaacataagggcttgaaggatttttatacccaaggaaaagcctaaatgtgccaaaattttggaagctgaatttttagaagggcagcttaatttgctgctcttgtaggaggtttaaggggctgagatcacagtgaaagagctcacagcatcatgacccctctgtgtccttactgtaggaactttagtgggaggccgttgtgaaggctgcttccagttttgatcacataagccgcagacttcattacagtgtgcagaaggatgagcttaaggaaagaaggata

SEQ ID NO: 52199 - DNA, 1148 bp, Bovine  19866881703173
aattctctgtttagaatgaatgcaaaaaaaaaaaaaaaaaatatgcaaacacttataccctgcagcaaaggatcacttaagcagggagagtctgactatctatttacttcatgagcacttatcactgtgagcccacagcttttacagcagtgcctgattagaatgagaaagattagcagagacaaaaacaaggagctgatgctgtactatcatttagtgagtcgtggggaaaggctcaaggaagaaatttagtgaggtattcattaaatgttgatacaacctaaatcttcctattcatgagtactcccctgtatacctgaagtaactgaaatgtgggaagcaaaattatcttgctgaaatataccacactttcccaacactggaattcaacactgtccaacagaatgataaattgtaggcccagagagaagtatttctgagtccaaccatgacatttcacacaggaaaggaattcacatctgttcttaaatgacaataaaccagaaagatggaagattgattcagaagcttctgcaaatgttatagctgttaaagtacgtgaggactgacgacattcctttctgtaagtgtagacaccaggctagtaattccttcagcaggaaaacaagctaacaagcagtttatgctccctgaattgtgttttctaaacataaaatgaaggggctgaggctgtggtgatagctcactttgaaagttcagcatttgcttccataaacatctctgagggctgggtgccacgacctgtgcaaggagtttgacatctcttattcaacttcttaaaactatgagcaacgctgaaaatatctgcaagtaaaatggttcttcctaacaaaatgggatatagagacacatgtcatagtcaacgttaacatgaataaaagattgcatgcagtagtggagatggagcccacattaagtaaatctatggtgaaacatgctttaatgttataattttgattcaattaaagtaaaagggaaagaaatgaattaaattccttttttctcctgcttccacatttcctttgtttctttcctgacttcctccatgcccatttttctggtctctatgaagagttatttttctctggaaagaactttgatggataaaccctcagcattcctatagt

SEQ ID NO: 52200 - DNA, 850 bp, Bovine  19866881938082
cattatcatttctttttccaacagattgcttttgtaattatattttgcttatgtcattgccattactttgcattctctgagaactcaccaaggacaactgaggtgaggaggaaataaaatgacctagagatatactagactcatcttctggaggtcagaaacctgaatgtacaatattacttcttcaagttgataccctaaccaaaagaagacagataataagccttggtcttatgttaaatgcaaattattctggagaggcaatatattcaatcttgttagttgtttacatcttactgaaaacaagtttataacatgatttgttgatgagggtgaggctggagatgaggaacaaatgagaggtttgacaactgtagagattaagggtgatgcacttctaagggctgtaatgatataaaaagtagacactggggctactaaagcccaacttttcttacttaacagttatcaattcttggatcataaagtggcctatttttttttttaatgtacttggaagctgattgcacactgaaatgcttttgaatttattttctacacaactaaatgctactccttctgattctggatgcaaaagcaaagtgctggcattcagctagtcacattaatgcagtataaccttactcgatgctttggagagaatatgaacacatagactcttatttcttttataaatacagtaaagtttcattacactcatatctgtatgctgtgcatgtgtatagtatagctcactttctgtagtagactcaaaagatagccaacagcaatctatccttcctcatacaagcattcctttctatccatcaagaaatagagtatattttcc

SEQ ID NO: 52201 - DNA, 770 bp, Bovine  19866881989179
aactttctaaatatttatagatcattaaatatttgacatgaagattgggggtggagagaacagagccttaaaattagagtgttaaaatattcaaccaactaatggaaatgaatttttaaaaatgaaaactacctaaattgcattgtaaagtaatagaaaatataattttggcataaaataattttatatgaattgaaaatgctgttccttatgagggaggtcgatggaaaattgcttgtctgttccttgcattgtgcccatcataattcaagagtttaaacataaacaatgctttgaatgagctttgagtatgtgttctagtttactgaaatggccttgtttttcacttttataatcttttttgcttctgtcctaactgcttcaaaattagaagataatgttgtctcaaatacaattatatttgataccaagatgtgctgatttgatgattccttttattaagaagtgttacatgtattcactcacagaaacatgtaccctgaaacactcctactcaatttggtcttcaaattgtactcctctgcttttggctttgttgatcttacatagctttggggggaaaagtaatcaaatttgatctataatagaggttagaaagttttccaatgcaaaagtaaagaaaaaaacttgaattttttttgaatttttgatgcatgttgtttctgatggtttctaaatgtgtgcaagtaacagaacacagctcctttaagaaacaggtaggaaaagtagatcttctctaggaaggaaag

SEQ ID NO: 52202 - DNA, 2018 bp, Bovine  19866880294408
agaggcaggtgggaaattgcactcctccctctgggcatccttggtaaaatataagaagagccaaactggcccccctcacctcctcttttccatgaaaacaccttttaaactgaaatcctcttagctgggaagagatatgactcacagatcttcccaaagaagagctcatccaccccaggagaagatccagttgtttagctgatctgagtacagggacctcagtgacatcccattttccagttcagactctgtcccaagctagcagcaactaccaaaatcccaggtacttagaacagggactccctttggccagctggacagatatagacccatgcaactgggttcctcgacctttggggccagcgttactgtgtaaattgggcttccctgatagctccattggtaaagagtctgcctgcaatgcaggagactccgattcctgggtcaggaagatccactggagaagggataggctacacactccagtattcttgggcttcccctgtggctcagctggtaaagaatctgcctgcaatgtagaagacctgggtttgatccctgggttggaaagatctcctggacgaggcaaaggctacccactccagtattctggcctagagaatttcatggactatgtagttcatggggtcacaaagagtcagacgggactaagcaactttcactttcactgtgtaagttttgcaaagcgaaaggacaaactgacagtttttctgattaaaaatgagggtcttgggagcagacagggaggttgagcgtggacccggggggctggcgagggtgggggtggggggggcgcggcgaggaggccttcacatctccgcggccacggcgcgagtgccactacttggatccctcttctggcttcggagctgatccagaaggccaatctggctaagcaggccaagcgctacgatgacatggccacctgcctgaaggccatgatggagcagggtgtggagctgtctaacgaggagcacaacctgctgtcagtggcctacaagaacgtggtctggggccgctggtccgcctggaggttcatctccagcatcgagcaaaaaaccgacacctggacaagaagttgcagctgatcaaggactcccgggcaaaagtaagagtccgagctgaggtccatctgcaccacggtcctggaattgttggataagtatttaatagccaatgcaactaatccagagagtaaggtcttctatctgaaaatgaagggagattacttccggtaccttgctgaagttgcttgtggtgatgatcggaagcaaacgatagataattcccaaggagcttaccaagaggctttcgatgtaagcaagaaagagatgcaacccacacaccccatccagctggggctggctcttaacttttctgtattctactatgagatcctcaataacgcagaactggcctgcacactggctaaaacggcttttgatgaggctattgcagaactcgacacactgaatgaagactcgtacaaagacagcaccctcatcatgcagctgctgagagacaacctcacattatggacatcagacagtgcaggagaagaatgtgatgcggcagaaggggcagaaaactaagtgcatacagggtgtcatctttcttccccttgaaacctttttactcatctccattccttattccatttggatttcctatagcaaagaaacccattcctgtgtatggaatcaactgtttatagtcttttcacactgaagctttgggaaaactccattccttgatttgtgtttgtcttagccttgctggtgggcagttactgctgtagaaaattattaatagcttcgtttaatacaaacataagtaacttccaaacacttatgtagaagactaaaaatgtatctggtatttaagtaatctgaaccagttctgcaagtgactgtgttttgtattactgtgaagatatgaaaatgtagctaattacaatttaaagagtggtctacataacttcttaatttctacattcc

SEQ ID NO: 52203 - DNA, 1463 bp, Bovine  19866880297693
aggctattgcagaactcgaccacactgaatgaagactcgtacaaagacagcacccctcatcatgcagctgctgagagacaaccctccacattatggacatcagacagtgcaggagaagaatgtgatgcggcagaaggggcagaaaactaagtgcatacagggtgtcatctttcttccccttgaaacctttttactcatctccattccttattccatttggatttcctatagcaaagaaacccattcctgtgtatggaatcaactgtttatagtcttttcacactgaagctttgggaaaactccattccttgatttgtgtttgtcttagccttgctggtgggcagttactgctgtagaaaattattaatagcttcgtttcatacaaacataagtaacttccaaacacttatgtagaagactaaaaatgtatctggtatttaagtaatctgaaccagttctgcaagtgactgtgttttgtattactgtgaagatatgaaaatgtagctaattacaatttaaagagtgttctacataacttcttaatttctacattccctcccttactcttagtcagagatttcctttcaggattttccatcctcttaaagtattcctttttagtaggaatccagaagtattagattgaatggaaaagcatttgacattttggggctgggggaatcacagattaaatgcctcctgtatcatatgtgatggaggtcttgtgtatctgtgacaacagggagtttccttattcactcttcatttgctgctgtttaagttgacaacttcccttcccaataaaaactcacacctccaaaaaaataaaatgagggccttttctcctaattttgaagagattgggctgcctttctgagtgtctggtgtcctccgccagcattcagaagttgttttgtggaagttgctccacattcaaataatctttttttttttttttcgatgagtctgtgaggaagaaagtggtctccccatcctattcttccaccattttgggaccgccccttctcttgatttaattagaaaatgtctctccatctctgtccagtttctgagccctgtgcacattggatggtggacttgtccaaatgatcagagaataacattcaatttatttgccttgatgtgcataaggtttgctctggaggggaaaattggcacagcatgccatgtactgacacaaaatatgagctggttttcctcaagactagctctcagccagggacttggcacatggtagggactgacacataggtgctgaatgaattagtgaaagggaaaggggtccaagataggctggcttctccaccttcaagatacactatgcctttaagggagttttagaaccaatgtgcaagatactgatttcaatctgaaaaaatctctttcatggttgaaatggctcaaaattctgcagacttaaggaaaaaagtggttgcattaca

SEQ ID NO: 52204 - DNA, 1865 bp, Bovine  19866880401906
acttagaaataaagacaaaagcacatatgtgcaaacttctacatgtagactaacctatatgatcatttgtaaaaaagaaaatattgctagataaaatcaccgagtaggctacatttataaggaaatgggaagagacacatttgtaattttaacaggattcaatggcatatcccagttgaacatgatttttaatttgatgttttattgtgtttataaatatctacttataggtcaataattaagaattgaagacagtgattttctcaagggcagtgaggtagaccttgtatgcaccagtagaccaaatacatttgtagaccttagggtcagaagatacagattccaccatgaatgagcaccaggaaagctaatcttgagggtttgaaaggctatcatcatctttcatgaggtcaggggatccaaactccctaagaaggcagaatagtaaggaaaggaagaactggcttgtatcagttggagatggcaggtcaaaactgtttcttttcaacctattttattgtttgcacatactagaaactctagagggacagtctccccacccactttgaattgctgaagcaagcatgctgaaaagaaggaaacacttggattatttctcttatcaacagaaaatagacttcttgcttaaaaaactagagaccacaaagattaccattcataacaacactgtaggaaaaaattctgcttctatgccccaccaaaagtctataaaacaatttaggaataaaaatcatgtcaaaatcttaaatgtaagtaacagatagctaaaggttataagctaattctaatatatgttggatattcgctttcttgagggtgatggaatataatgaacaaccttgggacattctaaccaatggttgtgaaggctgagtttcccaggtaacaacacaatagatgctctagaaaactggattaaaccaacagggaagaagtaatttaaaatgaaatagtgccgaggaaagatactacttgacatggtcttcattgtatatatagcccactcctttttaaaataaaatactccaagaagaaaatttataaaacctaataataaaagaacatatgtagatcctggaagcatccactgagctaaaaggcaagaaattaaaagtgtatgcatactccctatcttaaagatgactaaataaaagctctctggagttaagtatttcttagatctcctgcactggcaagtggattctttaccactagtaccacctgggaagcctgagagagagaagtaaatttcccaaggttatgcaactgacaaatggtagaaatcatttgacctagttgtcaggtcagttcacaccaagatgcctacccctagacctggggctgaaacatgtcaggggccaagtggccgcctgtgtgaatggaaatttcctaatttgtttcactcaggcccagaagctctgctgacactgccgtgcttcggtatgtggatccagtagattaggagaagggtctgggctctagaaacagacgtggtgcttaagccatgggttttggtaccagagattattaaaaagtgaaaagaccaaagagctaacagagtcctgggaaatatgcatagttaagagtttcaaagggagaaaataacaggaaaaaacttagcttccaagcaagaagaccaagaaggaaagccctgagtgttagaaggacactccagaaaaaaactaggtttataaaagtctaatgaggagacatttcaggaaaggagtggcaactctgcaaagtatgacagaaagttcaagtattattggacaattttcataggataaaatatttataagacaaaaaaccaatctcagaaactcatttctaaacctaaaaacaaa

SEQ ID NO: 52205 - DNA, 940 bp, Bovine  19866880485325
taaagtagaatcttaagagtttctcaactgagaattcctaataatactacaaagatttctacatgtttttaaatttttattctcttctaaaaagtcatttatataatcaatttttaatacaacaaaagatcttgacctttaatagactttataacttattttcctctgataatagcatagtatacaacatagtcaaaagacaggactttacttaatgtaaggaatttttttaatctacttcacttatttggtttacctcaatctattaataaatatttgacccctgcatttaaaggatttctcagtggttaatttccaaagtgttatgagttctgcccttttacaaaatattttaatacatatattaaatgtaaacgtgttcagaagtatatttagtataaagattgaattcatattttttagtatttactacctaagacataaaacactaccacaaaaacagaactataaacaataaataagcaaatgaatttttttttaataggaagcataatctcatgtaggagaagaaaaccaaataagtggacactaaagtcaactgagtcccagctttcaccaccttcactaagactacaagtagtctcaatcagtacctgtatctctctctcttctaaatcatctcatatcctgcggctccagattcatcctgtccactttcataaaactattcagtgacataccactgtctacagaatcaagttcaaaatccctggtctggcactcaagacttccataagtttggtctctatctgccacattgatcattattcttataaacaacattcagttcatttcagtcgctcagtcgtgtctgactctttgtgaccccatggactgcagcatatcaggtctctctgtccattaccaactgcggagtttactcaaacccacgtccatgagtcgggatgccatccaaaca

SEQ ID NO: 52206 - DNA, 804 bp, Bovine  19866880567950
attgccccatgggtctgtctctagttgcagagcacaggctcagtagctgtggtgcatgggcttagttgtcctgtggcatgtgggaatcttcccaaatcagggatcgaacctgtgtctcctgcattggcaggctgattctttaccacggagccaccagggaagccctcagagatttttttaatgtggaaaaatgtgtgttttagcattagagaaaaaaatgatactaactaaaagtcattaaattaacagccttcctttaaatacaggaccatacctgaagggaaattatccatgtttatagtgaagattaactcaatcattaacttaatcaaaggacagaatttcatcatgatgcaatgtcaatttcagcagcacatcaagtgttatatgggccttgaaaggaatctcggagagtagcctttttgccagaccctgattctataccttccagattcccattccctaagagacaattactcccattgttagaatctgcgtgtgtttgttttccctcagttaagaaagtacagctatgcgccacaagcttttaaagcaccaaattgtcttactggcttctaaatcctagctctgtggctgtatgatgagtcagttagtgaatggctcttcaagatacctaaaacaaccagcacaaccagcttaagacagctctggaaatggtaaaatgtaaaagcagggcataaaggcagcaaacaccttaattcacatttcccaatcccagtaagtaaggcagaactgaatcccccaaaaacgctatgctgaagccttaacccccaatgtcagggt

SEQ ID NO: 52207 - DNA, 1244 bp, Bovine  19866880581157
ttatttatttgctgagcatgacaggaggaaaaataaaatgcagtgctacagtcttcacaattagaactcagtcaatttattgtccactgtcagggtgctgaatttcgatctattctttcaacataaaacacacacacacacacaaagactgaatatgaagcatacaacaaaatctattacacagaaagcagggaagacatataaagaagtcttttcctgtctacaaggtcatccttctaattcacggaattcatttaatcctgaggtccaattcaatgtgtcctcctctacaaataaatccatacaggttcctaacaagagccctaatagtgggttcagaatgcaaatgagaaaagcagccacaatatagacacggggagattgtttgggggcactgtaagcaccacaaaagaagccatttttctaactatcttttagaggacaataaactgctttacccaaaaaattaaactctaagcaaaaaatgaaactaataacatgtgctagagattaattttcaagggcttggagctgtaatttaccaaccacttccttcattagcggcaccaactcgtcattaaagacttctccagactgtgccttccattggaactcgtgattcacgtgactggcagagtaacaattattcatcattcaatctatagtaactgctcagcaagaaggaccaaggcctgacttcatttcgttttacctgtgacagattttatgagaagttacaaatatttaaaagtcctgctgtttaacctgatgaactagggacacctcaattttccctggaaagtcagtgaaataaaaatactcccagaaaaaacaaatatcatatattaatacatatatatggatcctagaaaaacggtactgatgagcctgttttcaggagaggaatagagacacagacatagagaataaacttgtacgagtgggagaagaaggtgaggcacactgagagtagcacggacatatatacactgctgctgctgctgctgctgctaagtcgcttcagtcgtgtccgactctgtgcgaccccatagacggcagcccaccaggctcccccgtccctgggattctccaggcaagaacactggagtgggttgccgtttccttctctaatgcatgaaagtgaaaagtgaaagtgaagtcactcagtcgtgtccgactcttcgagatcccatggactgcagcctaccagactcctctgtccatggggtgtccaggcaagagga

SEQ ID NO: 52208 - DNA, 987 bp, Bovine  19866880607076
ctgagatgctcagtcgtgcttccctctttctgaccctgtggactctagcccaccaggttcttctgtccatgggattatcctggcagaaatactagagtggttgccattttctcctccacaggatcttcccaacctagggatcaagcctgtgtcttttacatctcctgcattggcaggaagattctttaccactagtaccgcataggaagcacaaactcaaaaagactaaacatataatcagtggctaaaccacgttctttcttgccgagtctacttttttatgtctatagtctaaatatatatctgactggtaacttttaaagaataatgttgatgatgcttcggaaattgaaaagaggtcaagatcaatttgcttaaggaaactttcactgaacaaattgcagtctgtggaagagtatttcatacagttggccagaagttgctactaactgatgatttccctagagacatattcactatggagtagaattggcaaatcatttatttgaccaagttgttggggaaaatgagtcaacagaaacacagtgcaagataggtatcaccttacctggatgttcctaggggcccacttaaatagtcattaatggtttctggcttaatgtgtaactaaaattttgctgcattagtggagttctttccaataaaaccaaaatggacagatgtaacttgtgttaaaataatgaaacattatatttcaaaggcacggtggccagatgacattccaatatggttgaaaaatctaagcttgcagaactgtagaactgtttcatcagaaccttctccatcagcaaaatttacagacatacttatgcttcttatgcaaaaggaagaacaacataaagttactggtattcaggttctatctccttttatcagttggtgaagcaaaggtagtaataatttgcttcctaggaaaggtagataaaagtattgtggtctctttatctctttattctcacacaattt

SEQ ID NO: 52209 - DNA, 1163 bp, Bovine  19866880614615
taagtgatataaaatagaaaaccttcaaaccaatttgccatgcaatctttgacatttctggtaaaacttataaaattcattttttcaggatttctcaaatttaaacacaaagagataactagaagactagtaggtacaaatgaaccacagtacccgagtcatcagaacaaatatttatgatattatgatgaaagctgcttatattaactcctcattagaactttcattatttcgaattcagcagtaaaataaggcatgatgttgatgttatgcatcagtgaaacatacagtaaagtggcaaatattcttttggagtttggaaatagttctgaataattactgattaagaattaacagtcatattcaaatagctgaatctatagtactgataatatacggttcacattagtcatagaatgcagcagctttggaattagcattttggattctgaaagtctttagtttttgcagtttcattccatgtattatgagaaaagcaatgctttatatcctttaggaaaagtatgatgcagtggctccagtgctagatgaaaatggagagtattatgattctatttctggctcagacaattatttaactcttacctttaataaatactgtctagtttcaagccttgatgtcttcttttgtcctttgattcatttaacaaaatttttatgagggcctaaaatgtgtgaggggtttccaaggtggctcagtggtaaagaatctacctgccaaagcaggagatgcaaattcaatccttaggttaggaagatcccctggagaagaaaatggcaacccataccagtattcttgcctggaaaatcccatggacagaggagcctggcaggctacagtccatggggcctcaaagagtcagacacgactgaatgattaaacaacaatgtgttaggcatggttataaagtgatgaaatcagaaacagtctttgccttattagaatttatatgatggggggagaaagaagtaaatgaaaatgtatcagattgcagaagatttttggaggaaaataactccatggacagagaagcctgaccagccacagtcttccctggtggctcagacagtaaagacttcacttgcaatgggggagacctgtgttcaatcccgggggggaagatccctggagaggggaacag

SEQ ID NO: 52210 - DNA, 1390 bp, Bovine  19866880616576
atacaatgctttttttctcaccagcaataagacaaactgtttaaatcattatttacttcttttatagctaagggtgctctgtcctgactggctaaatgaatcctggaatatctccttggaaagaatatgtggcagaagtgctcctgtttaaatgcccgcagacgctgggctctgagagctcacagctgattgcaaagtcactgtttgcaatttacttctggcaactgttgccatttgggacaatgctaatgggccccccttgggagtcagcgcttatgctttccggataactcacttttcaaatcacccaagtgagtcaagtaatttttctttgccagcatgaactatgccaccggtgaaagttatgaattcatactgttaaaccaatgcagattactctaatttctacattgttccgattaataccaaatatagaagggcaggctgttgtcaagagccagatacctacagctttggctacaaggacaacaggtagtcatggaagtggagagctgactaagtcagtgccactcacccaaaaggcccattagtgttttagaaaaaaggagtttgaaatatgcttatttcttgcctccctagccttcgtgggctcctctaggccggctctttgttttctcattgggcctggacacgcccattcacgggtatgatctttgcttcctcttttcttctcacccgatacgggaaaggctttctatttcccttagttggcctccacaagctgtgtgcatattacatgcttctctctttccaaatcacttttacacaccacacagacacacacacacacacaaattagaatgattgggatggcaaaggggctgtctacggggaaggcaaccatattatggaaaagggagaacccatcgggaaatattttttacatcgtattgctctgagaagagttcctcttctccgtgactgttctctgctcaaacagcaagctgatgggctcggggtttctaatgagacttttatttacagctgggttgcggggaggagttgcggctcaggggtagtgtccggaagtgaggcgtgtagtataacacgggcctcacctgtccttaccgtgctgctggaagctgtcccgctcttgaagcccggtgggactcagctctcagcgctcctcaggtgaaccttaggggcggggctgcaggaatctgcaggagtgacagagtcctctggagagaaacaatccccgaggaaagggaatagacatcagagcggtgggagggcaagggcacgtggtgagtaggacgtggtgcctttgctagcagatcccccaggccccgcagactcactccacacagcggctgggggtgaccggcacagagaaactcagtgaaaatggctcgttcacgaaaaccgg

SEQ ID NO: 52211 - DNA, 869 bp, Bovine  19866880719962
tactggagtggggtgccattgccttctccgaatcacagttctagtcctgttattaactatgctgttatgtaaatctgtgacttaagtactaatttctttttcccttctttccttgagctgtggtagcaaacagtgacgatactcaacacctgacaccaggaaggatgagtcagcgccaagggaaagaggcttttccaacgccaaccaaagatttgtatcagccatctttcagtccagcaagtcctcataccccgggtacggagttgtacttttaatgttttttgttgttactgatggtgggctctgtgtgtatggattgttttgtttttttaggcaggtctgtcctttgctggtgtatcatgatttttctttttgactatttggttttatagaggtttatgtttgttttgttttggtcatccataatacacttcaaatgagtgcattttcctttggagtactttttaattctctttacattctctaaaatatttggttagttataccattcttttaattcagtgattttcaaacttttggtctcaggactcctttaatactgtcaaaaattactgaagaccccaaagaatttttatgtggattaattaacctgttgatacatactgtactgcatattaaaactgaaactttaaaaaaatgtttactttgttttttgaattgatgtatagttgatgtacttatcagctatatgcatgtggacttccctggtggcttagtgggtaaatagtctgcccgcagtatgggagagccgtgttcagtccctggcttgggaagatccctggagaagaaatggcaactccctccagtatttttgcctggagaatcccattgacagaggagcctggttg

SEQ ID NO: 52212 - DNA, 1714 bp, Bovine  19866880853550
ttcccagcatcagcgtcttttccaatgtgtcggctcttcgcataccaggtgtgaatgcaaaactacccacaggaaaaatgcagaaggaccatagctctggtattaagagttatgagcttgagactcaaaatacctaaactaagcgaaccccgtgtttgccaagtaaaaaggaatggtaactgtcatgtatttcaactttcactgatgaggaagttgatgttctagttaagagtcaactaaatggtaacctgaagcctggtctctgaatttcaagcctacaggccattccattacaccaagcaatctctggatttgtcgcctgttgaaattattcctaaagtaccaaacaatgaactacttcacaaagcaaaagtttatgaagagagaagagttatgttaaaatacacagaatcagtatttatgtatttaaaaatactttcacaggaataggtgatgagaaatattccttagcaacattttcagcgcatcttctgaaaactttgtctatttcttgatataattttagggccggaagcgtgaactaaaagagagatgtctccaatgccaattctgagaatttttttttaccatttggtaaaaaaagaacgtttagttttattgtacatctctgtttgttagaacagaatagccttttcactgagtggcccaggtatatgcctaaggaactgtcccactgtttttgataagtcaaagtgacaaatgagaaggtgatgagtattagtatataacatgggtaagtgcttgtatttatattttactaagtaatataagcatgctatgggcttccctcctggctcagtgataaagaatccacctgccaatgcaggagaggtgggtcggatctctgggtaggggaagatcccctggagaacggaatggcaacccactccagtattcttgcctgaagaatcccatgatcagaggagcctggaggtctacagtacaaggggttgcaaaaaagtttgtaccggacttaaccgctaaacaacaaacaataaacagggtataatctcaactgcagaaataaacagaatcattctaatgcatgataaccagttagaggcttccatgtttgttcagcctaccacaacacagagattgtcttcatcccttaagctcataaaaactatacgagtttttcaggaagctttgccgctgccctccgcacatcactgtggatcatttaaaaccggaatgcatcaagaatcgcttccaggcctgaatgagcactacctcagttataaactaagacgtaaacacgtacagaatgctactgatcctggagcggagcactgtttacttacagggaagatactcatgtgatgggaaaacgtgttgcactatcctcttctggctcctgctccccgaaaaaacaagatactttgacaagctactgtgagcgtgggtccattcccaaaagtttcgacctctctttttaatcgtttaaggataaacgctaaaatacggacatccaaaacaaggtgccccgaggtgctgcctatggcataacaggaaggacatcactttggccaagaaactgtgtttgtaccctacacacctccagagagccaaatgggaagaatagacacggtcgttcactctggtgaagggaaactgaagaaatcaaaaccaaacgcgcttccttctctccccacccccgcggggaagcttgagcagaactagggagctcaag

SEQ ID NO: 52213 - DNA, 1607 bp, Bovine  19866880930170
cagtctcccaggtgtgccctcacctggcagaaggggcagggagctctctggggtctcctttataagggcattaatcctaatcctgaaagctctctccccatgatccaatcatccctcagagcctccacctccaaatacgatcacactgagggttaggtttcaacacatgaattttaagaacacagcagtcagtttacagctcatacgagccacctcagaggattgtgaaaaatgtagatctggaatcagctggtccagggcagtaactcagattctgcatttctaacaggctcccaggtcacgcctaggctgcaggtcttgctaatttgaataacacatttctcttcatcccccttactttcctggaccttaccattcctaattgctagttatcacttgttcttccagtatgcatattcctcttgctaaacgtgaggtaccctgtcccttctcacaaaatcatcaagaatatcctaatacaaacagaaggccatgattatgcaatatctaggcagctattcatgggaaaagtcagctcagatatttgaggtcatgaaatcctatttttttttttaaaaagcaccctaataatcatcatctatactcaggaaaatattaaattgcccaaggttttcctgtaagtttccaagctatagagcacttgaacatcacacatcaccctataggaaacagctcagtcctacgttaagtctgctgctgcttctaacagctgcataggttatatctaataagataatcccatgtatgagcaaatcacatgcctccctcacaatcctctaagggctctttccatgaacataaaaaatcagctcctttcaaaggatttaagggagggggagtgtcaaacaatgtttaacaccacagttagcagcttagactgccctaaaccctctaagcacacataaataaagctagatttcattatgggcttgacagcactgtgtagccctacattttttattttatttcaatcccaggaaaaagcacagaggaagaaaagaggtgcttgtggactaaaagaatgcatcataaaatatcattctaggaagtaaagaaacaaagaaaagggaatgccagtgagtcgagaaatgccctcaacatatttagcactttctcaaaaatatatgaaaatctgatctaacagattgctctcactacattttaactgaagcccctcatttggaccatagtttcagcactggaagtctgactacaaaaaaaaaaaaaatgtacattttccaatagtgatttttaaaccaatgtgttcgctttgcccacaactcctctccaagaaattatgaatccctagtcacactctttcatgtctcaggacattagagactccttcaggtaaacacagcttatcatggtttgtctcttaccagagcacctctaatctactcagaatccagcagagtctctaactcctggactttgttttctgaaacaaccaattccacagacatcagtttgcttccagaagaatccgatcaaatcacacttctgcagaaaaacagatatgaatgttatgaacttcaagaatatgagttcatatttatcactccactgataagtgaaaaaaatta

SEQ ID NO: 52214 - DNA, 1091 bp, Bovine  19866880932613
tggtgcatatataatctcttattatacatgaactcctgttctcccttattcttatacatcatgtccatcttcttcgttaaatcatagccctcttgggagggaagtcacatctacgcttatttcctttgggcctttccccccagccttgcaaaaactctctgcccattgtagctacttaataaacattagctcattgcctgacggaggcgactgacaacccagtcataaagaattcacagtggtgcatacatttatcaatgtaatttttttatgttcctccgagaggtgattaacaaaatattgtctaatcttaactgagatcaactctggcaaccagacaggaaaaggaacaaagtgtcacttacactcatggctcgctaattttgtgacagcaggcttttcagtgtgtaaaagttaaacttacataaacgaaagcataaaagaatgtgctcattggtgtggattttttgaatttgcttctttccttactgtccagatttgtaatatatgatatcaacttgggggccatacgaacaatcatacttcctaagagaaggaaaacatttcctcaaataatacaaaactgcaaaatattaatagcatgttgcttatttgtcagagggagggtgggctttgagtctggatactcctggatttgatcttggttctgccactttctcattatgtgaccttgcatgagtcacttaatctatcagagtcttggttaattcaactctaaaaaacatttttaaaaaaatctaccacacagcattcttataaggattaaacaagttagaacctgtaaaatgtcaagtactgttagtatgaaccaacccctagctaatatttttattaaattttcttccacaacagcttctattttgttacagatattggttgctagagggggagctggtgaggggaagaaattatgtaatcttttcacagatcagataatagctgtaacagggagcaatatccccacaccaatttctccccggccactgctccacctcctcactacaagcaaggttcatcagcaacagcagtcaaaatatcagtctgcagcatgccctgcacaacatttattt

SEQ ID NO: 52215 - DNA, 1146 bp, Bovine  19866880958715
cttctggctgccagtatcattcttgccatatatctagagaaaacgggcatggcttctgagttgggagattcagggggtaacttacaacagagagtatttctgtgtagaaggaaaagggtagcaatgggcagtggtagccagcttcagaaaacgcaggactggtttgtgattaaaacctcatgatgtccagaaaaatgattatgtatgaatggtacattctgactgaatttgtcatcagccatagtgtttgattcatacttacctcttttgtaggaaaaataaaataaaattaggtacacatggctgttaacatcaaagaagcaatccagatctaaagaaagagctggacgctttcctcgcattatctccaaagctgtcagtgatgtaaaatgtgatcgtgagcttctgctattgtggcagtgttataagtaggaggggtcccagatgaaatgtgtgtgactggcacttacatccttgattttgatttataaaaacaagaacagaatcatgaagggagtgtaagatttaccctacctaatctgtcatgttgttgggttacatccaattttataacttctttcagtacagtttttccccccttccatcttactagaaaaataaatgcaatgctaccatttttagaaagaaaattccagtgtttattgtatttagagggaatcatgaatgatttatttatattaagtatgagagtttccagaacagtgattaaaaatgcttacaaattctagattagaagtgtgggaatttccttttgggataataaccctttagaaagttaatattataatataactcacaggaaccaattaaaatcaggtcatttgcatttattctcttcagagcagtgtatacctgttgcgatttttaattctaaaaaatttttaacttgccatcaaaattttgaacatttattgatatttggaaatcatagttctccctgatttaatgtgatcgaaaccattcctgagacacacatctcgtatcctctgattaaactcagttttacttctactaagttggaaatagggaatgtttaaactgcatacagtaattcttctccagtattctttgttggaaacatctggaacatgactaatgttttgggaaataggacctatgagtaaa

SEQ ID NO: 52216 - DNA, 807 bp, Bovine  19866880989400
ttgataagtataatgagggagaagcacatgaaaaaagtgagacctggtgatcaaactgagtgagcactttcctgaaggatatgatcacagagctgaaatctgaaggaagggatggtttccctcagcagtttcaaggtggggtacatctagaggtagagggtggagtgtgtttgaagtcccagaggtgggaggaagtgaggactgttggagaggttggaaagaggagtgtatggtagacggcagagaggggagatggaagtgagggagtccctggagaggaaaagacttacacgataaaaaggtaccacccaggtagaggcacagggttgttttttcaccccaatagttgttagaagccattgacagaattatgaatggaactgggggtagagggtccattaaatgatagaatttatctttggcttattcttttcagttcagatactgcttgttagaaaattatagtatttcttgttgttacatacagtgaaacacactgaagtacccaaataggagctaccgcagatataaaaatagggtcaatttcactctgcacaggagcaagagtattctgttttcagaaacaacaggattctgaatcaaagaatgaagctatgatttgtacatactgaaaacttcccccaaacagagatacatcaggttgttataaaagtattaattgcttacaggagggacctttgaggtctttgcaatatcaacttgggtgtaaaatcattcagctcaaagggagattgagtgttgtgtctatgaaaacacttgaagatggtaatattacattcccagtgg

SEQ ID NO: 52217 - DNA, 1602 bp, Bovine  19866881055877
ttcatcataatgaattatgtaattacatattcacaggttaatgacacctcaatcttgttgaaaagctctgcctactctttccacccacattgcctattcaaagttaggtgcatgatgtgacttttaatacatctctggaaatagttaaaaatttatgctcaggtgttagggttgactcctgagttttaattcagctcagagggcactctaagcgccaaataaatttttaaaaaacgaacccatctctttctgatgactacccgactacatattacaagttttaaatatattttttattccaattttaggagagtgtataataatgtaaagatgggaaacataggccacacaatccgttaaggtcctaaaattgtggcagctataatgcaaagatggtacaggaattatactttatttttttcaccaaaactttactctctttccctcagcccccatgatattattcaaaatatactttcttctataatactttcttaataaaagtgtaatttcactgcagaatgctgaaatgacttttatttctttgtatcttttaacatataaaagattacatattactactatagattattccagttaactttgttcagcttgtatgtacatatctacaaactttctgagaggttacaagtaattcagtttgtttaaaccagagtactttaattcttcgattcaataagttatcagttttaccagaactgaggcccattctctttcaaaaaaatatctatcaagaatctatattactccacctctttcctgaaatgaatgagaagagagcaagacgcctcaccctataaactaacagtgtttcaaaactgtcctttctgctgtccgctggaatgaaggtgccatattccagcattatcaggtagcagccatctacccacccctcccaacaaggacagatcctactgacctagatgacttccaccagattctctaggtaggtagtgtctctcctacccatctagaacactggaacccagaggtgacaaaatggagaaaaaaagcacctaccctatattccagtaacatctgtccggtgcattcctgtcaggatcatccctttgttctaggtcttgttgatactcctctctacttgttttcagtcagctcctttgggaactttacttttgtctagtgttcttacatgcacagctaaatgaggctcccagtcccattccccctgtcatttcctttaaccacaagcctcggtaacccccgcttagaaatgagctggagttgacacagccccatttaagactttgtctttgaatgtcagctcctttccagagatggctgaagactgcacccctagcgggccttcattgttgattacttcccactgttttttgctatcagccaatagtcttggacctgacatcatttgcattctaactctgccctcctttcttatattgttacaaaaatagtaccctatataaacacaaggatctaatctaagaacagggaaaattctgggagataatgacttttattcacaaatgaaggcaaggaaaagaaaggcactgtcacgggttaaaagagatgcatcagacacaccaaccaaatgcaacg

SEQ ID NO: 52218 - DNA, 1500 bp, Bovine  19866881075169
agcagggctggcaaacctggcttgcaggtcagtttcagctcactgcttgtttttgtgctaagaatcgccaatttaatggtttgaaagaaatcaaaagaagttttcacatcatgtaaaatttatgtgaaaatcattcagtgtccataaataaagtttgattagaacacatccacgcccatttgtttctatattgtctgtggctgttttatgcaacagtggcagggtcgggtggttgtgacagaggcttacgacctagaaagcctaaaatatttattatttagtcttttacaaaaaaaaaaaaagaaaatcaccaattcctaggcgagatgcatacctgatgttacctctaacccgtggttctgtgaatgtctatatttcatttctctccagatcctgcccagggaggggggctgggtaaccacacttatctccatgataaaatgggagcttagagcaactgcacaagtcacttaaaagctacaatccaggtcttctggctttcagtgcagtgttcaggacgtaataaaagagttgacgcttattacattcttaatttgtgccaggaactgctctacataccttacccatattaacttatctgagtttcatgatgacgctgtgaaatatgttctattattattactcccattttactgatgagaaaacggaggcacagagtgatctagtcacttgctgaagaccacagagtgtacgggaggaggtggagccagggtctaggctagaacagctggttttagagccagagggctgaaccacgactcttcatccttctgggccatccgacactgtcccattttattactctgaaccaacaagcaaacctgcatgctggtgaaaatgcagtcaagtgatacactgtctatagaggtatatagaagtacactgtttaactaagagacaaaaggtttacagtattctgagtgggagttcctcggagcaaagggatttgtactagagccttaaactgtttgttccttttttgcctattgtcttatattgcaggttacaaatacaggaagtggatttacaggttgtattatctgatttgaactaagtaatcctctcaaaataagaggattgcctgaaagaatccatacaaagaaactgtgtagtgagccatttatactaatagaaacatgggcatattttgcaggtccattacgtgtaaagtgagagggaatcctttgtgagccaaagtgaaataaagcagttgaaaatccgagcagatctaacacaggtagtcttattgctctctttagaaacataattaatagtatccaagatgttttacagtcaaaacaggtggtggccactaacccacacacacaaggtcaagttgaacccttggacagtgaccctggatcacggagttcagtaagcattggatactaggaacattcagttagggtgtttgggcctgttcatatgatacataacaatttctatcatactctttgttttgcaagtgtaacagaacgt

SEQ ID NO: 52219 - DNA, 1274 bp, Bovine  19866881083657
ggtatgtgtcccaagggtattagacacagctttgaaaaatcaataaaacttgtcataggttgaactgtgtcttcccaaaagataggctgacgtcttaaacccagggatctgtgaatgtgaccttttttggaaatagattcttacagttgtagccaaactaaaataaggtcatcagggtgggctcataatctaatatgactggagtccatataagaagaggaagacactgtgtgaaggcacagagacagagagatgcgcaggaaagagggctgtgtgacaagagagggagagactggagtgaagccgccgcagacctgggggcaccaaggattgtgggccccaccaggagacagtgagagcgcccctgccaggagacagtgagaggcaaggagcgattctgcctcttcggaccccttagcaggctccttctgacaccttgatttcagaacttttggcctctagaactgtaagagaataattttctgttgttttaagtaaagaaaaaaaaaaaaaaaaagaagaagccactagtagattcagaatactgaacagaaggtccaaatccttgagagtaaagaggggtgtgaagatgcaaccgtcactgtgggtacacaatctgccgtatgatgtcatgagatcatcttgaaccaatggatttttgagtggtcgtccctcttcattgtcttggagggcagtttatgtggttgttgcagaaaacagcattgttgctcttttgagaagcctttccctttaacgatggagcagagctagttatgaaatacccaactgtgactaattttggaggagtaacgtctcacataaattgtctcctggagatgctgttggagccagtgaacagcagaatgatgatgagtttatctgtgctaattgtgcctttgaggaatttttttctggacagagcacaaagtagatcaatgatgcacttctcacctctttggcatgaagattctgattgttgataactgtggtaggcagaataatgaccctgaacatctccatgcccagtctctggaacctgtgaatatgctgtttcatggtaaaaaaaaagagctttgcagaggtaattcaggttatagatattacgatgaggagatgattgtagtggggccagtctaatcacatgatcccttaaaagcagagaactttctccagctggaggaagatgtagcagaaggaaaagccagaaaattccaagtgtgagaaggagtctatgcactgttggtcattctaagatgtcaggggtcacatgtgag

SEQ ID NO: 52220 - DNA, 1259 bp, Bovine  19866881109571
aactcaagaaaaagaaactcttaccattacaatcttttggaaataccacaatctatacaatgttactagctgtattttcactcaactcaattgatggaaaataatacagagactaaatactccaccaactttcctttgataccaaacttttgcatcaactggcctaattctaagaattacaaatgatacatagataagcataacttcaggccagggcagcaggtttatttcagaatctggacaatcctcatttcaaatataaggatctcacatgtaacgtaataatgaaagacatctcttcagcaaccaggtgattgactcaatttcagagttgtgttctccgttcaagtaagatttcccaccagctctcttaccatacatggagtcaacactctaaaccagtcacctcttgccaaactcatttcttaagtacagtgagtcatagtaaaacaaaatgtatccctaagcacaatgcatatatctctttattttttttaattttgccttcccatttgcttaccaacccagaatatgatttttcatagttgtaaaactgactttttgacctccttctctaaaagatattaaatgtaaagacttgatgggttcaaggtttacattttggaatacttgtagatgatgtagtatatttttatatagtatctttcatgatatttgatgacaattattgacacttaaactgataactgaattaacgatatggcaggcttatccttactttatgaacttgtgactaagaagcaatttgtatgacattactttgatactacagagatgtctatttcctcttcaaacatgaagcttatcctttaacactcatttaaaaccctcatgtgagccaataatttcaataactgtaaaataattctaatttaattatttctgccttattctgacattcctcagtaaacttcattacttggaacactttggttatcctgaaatatggttcctataggaaaggaaaaataaataataattctttgctttcagttactattttcaaagtaaggatattttggggactaatgagcaaaactgaattggggttttagataagatgaaaatgtattgatctggaaaggtggagatttttaattttaaaaaagtggctaagttacaaaactgtacattaagtatgataaaaccacttcaatgaaaaatacatatttatataatatgtctatgcatgtatagggataaataaagatacacaataaactgttaacagtggtaaa

SEQ ID NO: 52221 - DNA, 1824 bp, Bovine  19866881134990
agcactcaaaagaagacacccccgggaccatgaaatctcctttcatcctttgagctgcttgaattgatttcaagctactaacctggatccttgagggaggatctttcggggataagctttttatttttttattttttaatagtatgagaccctgcttctgcttggcaattgcttttgaaaatttccgaaatagactgctaaactgcattttctttctaagactactttaggatcaatggcatttctctgctttaacagatgagagctccagggagaagatcctgaaagagctcccagatgcctgccgaaacctcgggtgctgacttactgacaagagaaaagcctttctaagagtgagctaccagcctgcgtttgcctgtgctctttcaaatagccacattgttaattactacatcggccactgaaccacttactctccaaaggtcttaaagtttgaatgaagtttcctcctatcaaggctggaggaaataatagtctccaccacacagcaaaatgtcacctagatttcttttttttaaggcatatatacttaaataagcaatgcagctctgagaaatgtaactaagttgcctagatgaacagcaggaagtggcctttagaaatatcatttgggagggagggaaatgtaagggaacaaaaagtaaaaagatgatgaaaagaaagggcatgtaagaatagttgggaaggcagttgctgtgaatggcaagacaaccttcattgggagactgtcagtttcagagaaacagctgggatgtttcattagggagtagatctctttgggaaaaacaataaaaagctaaattttcaaatcagaggactgttaaaaatagattactacctgaatttgaaagtagctgtgaggttacataagagaatatccctgttcttaggagatttcagctgacgtgacactgaaacagctataaaaataataataagtgcttatgtaagaataaaaatgtttcttattcttatataagaatatgaatatcttatctttatataagaataagaatatgatcatttaggaggatgggattaacatatacatactactatatataaaatagatgaccagcaaggacctactgtatagcacagggaattatactcaatattttataataccctacaagggaagagtctgaaaagaaatatatatatgcatatatacatatatctgagtcaccatgccatacatctgaaattagcacaatattttaaatcaactacaacaatacttcaattttaaaaaagtttaagacttatgttttatatacggagaaagaatacaaatgtgatgaacattaatgaaaggtgtatgtaggtgaatctaagtaatttgtaatagacgtataacttctctgcagatttgcaactttttcaaagcaaaaagtgtaattataaaagaagagatgaatgaaatttctgcaaagtaagcgactcaaaggaacaatacaaaaaagagtttacaatgaggatgctgaaaatagattcttagtctcttctaaacaccattaggagattggcaacgtgttccccctcataggactattactgtcattagagatgaggcaaacacattttagcacatcatatcttgcaagtaatcagaacgctagtctgtaccatggtgacctttgaatattctgcaaattgatttccaagccattcctgttccttcttgtttatagcccttggttaccctagaagacaatgagcaagactgaccagctgtgaggcctgcatttcctggctcatcagcactcaatcacatttctctctctcccagaggcctcatga

SEQ ID NO: 52222 - DNA, 2083 bp, Bovine  19866881146475
taatgcagccggtcctgctaatagtcatttgaaacttcccccattcgaatctggacattaattggaaacaaaaggagatgctttcactatgaagaaaattaagtgtggcatgtgaacggaatccggcgtctggcagtggtccttgctgcccatccttctggtaggagaagatgactaactgatgagaaagatgaaggaaagaaaaagtctttctttaaacatacatcttacaaagtcaaactcaataccttgaaaaagaaatagaactaatggttgaattcaagaatgcacatggaaaaatacagtccctacctataaataccttgttaactggcaacacgagttaaatacataaaacaaaaccagatgaaaagtcttacttgagagctaaattaaatataaaccaagaggcaaatatatactatagacaacaaggactctgatgagaaaggagccaatggtttaaatcaaagaggagttcctaagatctaagattcaaggaatttttcttacggatcaagatggaaaggagctggtagcgggcagagaaggaagcagtattgactgttcttttcctcaaatattaaaatgctatatggttggccataatcatcactcttcccttaggtcaacatacagaaagcactgttgataggccaagtgggacttagggtccttggtctgccactaattgtctacttgacacagggaaatgtagcctctttttttcctaatctgaaaactggaggaattgtagcttagatagtcttcccactcacaggattatatagagataacatatgtgaaagggctttggaaaaataacaagtagtcagagccttaaattatacattccagcacctagaagagctgctttatgttaaaaaagagaaagagagaatggttttcctgtgatttaacaaaggctataatttcagtggagtgatcatcagtagtattatctcctgaagcattctttaaaaagtatctgtcaaatgctgaatagcaaaaataccagtaattactgagatgtccttctcaaatctctcctaaactgagcacagtcatgataaacagctaacacagaagtagctgaccaatggaaaactgcagtggtgaacacactctggattagaatccaaaataaataccaaattgtttaaaaatagctgcatgatttcgaaaacactaaaatacaaacacacaaaattcttcaagttatttgggtaaattctgataaacatgacaaaaatatcctgaattttcaaatcagatatgaattttcccaagccatctcttcaatctttatagcaaagtttctttctagagaatctgtagaacctaagtggaactgtgcaggctttgtttctgggacacagttatgtagccttgtatatatttctatattttgaaaaattccatttaagcatttgtaaaataggataataacctctcctctgcccactgcatggtgctttaaaaaaactgagtgtgaaaatgtcttgaaaacaatgaggtgtttacagggagacattatttcttccagttttcattacgattcattatgatctaagattctggaatcttgtctggaaaaagtcagaggtggtgagcaggggaaaacctaaaaaatccttcatttaaggctataatgaataataaagggacagaatcctcattagtgggctttgttagaaataacacaaaaaagaactaaaattaatgagtattaacctgttagcaaccagctcctggttaccagaaatctctgtctagtcaaaaattaataagtgttatgttgcaggggaagagagggaaaaattaggagattgggattaacagatacacactactatatataaaacagataaacaacaaggacttactctatagcacaggaaactatattcaaaatcttgtgataacctttaatggaaaataatctgaagactatatacacgtaactgaatcatttgcagtacacctgaaattaacacaacattgtaaattaactatacttcaatttctaaaatcctatgtatttttttaaaagccactataaaaaagcatcatattgcataca

SEQ ID NO: 52223 - DNA, 1658 bp, Bovine  19866881158368
ccgagaagatcattggagctggaaaggtgaggtgctgtctagagtcagtaagcccgctctctgctccctctctcccccaggtcccttcaaggcccactcaggcactctgccttataaataaatgccttgaactaaactttttcttaatcaaatttccatctgaatcattaattttttgaagtgatccccttgtttgacagatcacatccatgtttaacagaaacttgtttttatgggggggcacttatgaaggtgttaacgaataaaacaagacttttaacacacctggactgcacaggtttttcagtgtggtgaaagggaaaaaacaagaaaggaagcatcagggcacctgatgctaatgcagtttggaagagttgctcgagcacatctcctctctaagctgctgtgttctcaaccacggaggaggtggtctttacagggagcccactgtgcctgcagccagccttcggacagctcttagggaaatggcccttctgtggcacagctcccactccgtgtcttctgtggatgaaatttgaactcagcgcctctgcaggcagccgagcatgtggagagtctggtcttagcctggctggggctcacccacagcagtcaggagcccatgtggggttgatcttccagcacctaaacttactcattcttctcttccagccctggcacaaaaactgtttccgatgtgctaagtgcgggaagagtcttgagtcaacaactctgactgagaaagaaggtgaaatctattgtaaaggtataatttaacttcagttactgctgtccatatgaatatcctgtactggctattagtgaaggaaatgtcaccagcaggggggaaatactttaaaagtggggaaaaggtgggcatagtgccactgggaatttgaaaagatctagggatgcttacagagaacagaaaaccacagaacattcttgaggacacggccattaaaaacgcctctacataaacagcagtcttctttcaacttaaatgttttaagcaaaacatatgaatatatgaaggtaatagacaaatatataactagtctggtcccaacttgcaactcagttgcgactatgagctgaatcctagcgaactagaacactcagacttaaatttgcagctttaagatagttactgtaaggcagagccagcaggtttttataatttacagaggtttgttgatacatgggtcttaagcagtgctagcaaagcagagacaacagcccaccaggctcccttgtccctcggattctccactccagtgttcttgcctgagtcgcacagttggacacgactgaagcgacttagcagcagcagcaaagcttaatggacttgcactaattcttcccttttctttttgtaggatgctacgcgaagaactttgggcccaagggatttggctacggccaaggagcaggggcccttgttcatgctcagtagaggtgcaaacccagaaccaagaaagatcacacactgagaatctctacacaatctaggcacagataatctaatactaaactactgtgaaattctgcagtactgaagtactgtatgttgccctgtacttggataggctggctgactagtaggaagacagcactgtatctttttgcttttattcatcagtatttcaagaacattt

SEQ ID NO: 52224 - DNA, 1779 bp, Bovine  19866881171235
ggcatgtgggatcttatttcctgaccgggattggacccgtgctgctgcagtagaagcacagaatcttaaccactggactgccagggaagtcccttggcattttcagcgatattctataacttcttgccagttatcctctaccttggttctgctgaagctttgtcacaagaaggggaacactgcttcatgtgtctcccacttgaacttgaaactcatttactttgataacttttcagcagtaacagaagtgagaagacacgacagtgaccacttctgccacagcggcagaaacagaaacccccgtgtagcatgaagacgtagcaaattctaatgagcatggaaaggtcaggcgttagttttacatgcttcttgaaaagtgatatgaggcctgttagcagttcttaaataatgttgcagtattggttttcatcccgaggttcatggcacactacctaaatagaacagataaaagaaaacagctgtgttgtggtttatgatactcatgtttgccattgacagagtcgcagttgaggttttcttttaattaatcacactaaagaaaggttccaaaagtaagtctctctttttccaatttaacataatctctatgccataaattaaaattttaaaagtcaaatgcaaagcagttatgaagatcatactttcttttctaagcttacagtttgaccattcccacatgcataagataagagagtagggaaacaagtagctttgctaaacattttggtatgtggaaaaaccatttcggcactgatgctatgggactgcaaaaaagttcaaacacaaatgaaacctgcctattgtaataaattactgggcacgttagagccttgatttgacccaaaatgcttcataacgggtgttttactgtgtctaaacctctactttctttgagtttaaaaaaaaaaactgcatcttttcctatctgtggttcatgttctatagctactgctgctgctaagtcacgtcagtcgtgtccgactctgtgcgaccccatagacggcagcccaccaggatccgctgtccctgagattctccaggcaagaacactggagtggggcgccactgccttctagggaattccctaacaattgtatttaaaagttaaagaaatgcaaatcaaaacaatcacaaggcaaacttagtaaactgcaaaattaaagacaagataaaatccagtggtggcaaggcagcagggaaacaaagtcagacttatttaaagtgggtggcattataaaccgataaaaactcttctggaaggacatttgacaatattcactctggaactgtgaccccaaaacataattgaaaaaaggggtaaattaattatatgaaataagctatttatagcagtatcattcacaagtgactaaaaaattctggaaaataagatgaacacttaataaggataaatggtttagtagttcatgagaaaatacaccggcctcttctctcattaatcctacaaacattcatcggtctacctactctgggccccaccctattttaggtgctaaagatggaacaaataacaaaacagatgaaaactccagtccttgagaagcttacatttggatgctggtggtagataaaaaagaaaataagtaagtaaagaacatagcctctgagaaggtagagagtgttttggagaaaagtaaaatggtgaaaaggaaaagagactgtcggcggggcgagagaaaagggtgtgatgtaacagcagtggtgaggaaaggcccaccaggaaggcgacagttggca

SEQ ID NO: 52225 - DNA, 830 bp, Bovine  19866881193001
gtgcattaacaacaacacagtgttgttaacaagcaaagataagtatgaaccactaatcttttgcatgaagatcccacagctgtatgtataggaatggtggcaagagtatggaagataaaattgagaaaggcagtggaggttagaccatgtgggtttctgaatgctgtgttaagcaacacagagaatttcctcgtggtccagtggttaggactctgagcttccactgcagggagttcagggttagatccctggtcagggaattaagatcccacaagccatatggtacagccaaaaaaaaaaaaaatacagactcaattcagatcttatcccctctatttccctcagtggatgctgagttttttcaatcaggaaatgttaaaatatactcaacataaaacacaaagccgaactctgaccttgaaacaataattataagattttcaaatcaataactgtgattcataaaaacttgcttaagttattccattgattaaatgccacagagaatgctgtgaactatttaggtgttagatatctacagtgcttgtcttctaaaaatactcaatttgattaatgtagttaatctagttttttaaaaacactttctgtatgcaagatactttgttagcctctgggaaatacagtatttaaagctttctgttctcaaacagttttgcaggttacaagagccaaggcagtcacaaaacctcccactaaagagcataatgtgagacacgttacatacagcaacacaggggccccgatgggggagcagctacttctccagccttctggcccgccaagcaagggcacacagcagcgttccccag

SEQ ID NO: 52226 - DNA, 3339 bp, Bovine  19866881219607
ggaaggagggacaaggggaagaatacctggaagaataatcccaaactgataataagcagattcttcaggacataaagtggggtctagtggcaacagaaactaactggatgagcttctatagctgttgaattttacagacagcatatgttgatatgtttttggtttaaaaaacattagacaaaaatatgtcaccaagaaaatgcatctccaaatggcttaagtctgtcttcagcccccgcccgctccctcatgtgtatgcacacatgcacgcgcacgagacttgaaagacaggactttgtaactggggttgaccttgaaattatcttaatttggcttcacattaaatgtggtcttccttaagaatagtataacattaacatgttagaataattctaacaagccagggtcattaaagaaattaaaagtctaaattataaaagaattacacttaaagaattttcctttatacctggaactaacacaacactaaatcaactgtacttcaatttatttaattttttaattttaatttttctttagatacctaatagtagtagaagatgaattaatacatttgtaatgaataagagtatttgtaacttaaaaattactttcatataaatacacactaaaatggttttaatcatgttaaaaaaaccatcttggtaggttaaacatccaccccgcaacttccctcccgtaagtttactattacactatggcattccttgcaaaatggtaaagacttgagctcagccctctatgtaaattatgaatttcaaaattaataggtcaaaacactgagatttcattaatatcatatagttctcaatagaaccatatgccggttagttgcccatcaaggttatctacttttcccatattttggaattttaaatatctcgccaaagaataaagagtaagtaaattgtattttcttcagtccttcctccctttccctctgaacccactgagacctggtgcctgcctctgtaatcccactacagttactcacacgaggatcctgcatcgccaagtgtaacgctccctttgccatgcccctccaaaggtgctcctgaccgtctagtccctccaactgaccctcttctaattctttccctagctctcttcactctgctacaggtcttgtaaactaaagaatctcagggtttcattctattagaacctcttctcttgttttcaaataccctcttcatgcagctactccatattcacatcaccaacttagagctttatcctataccaaaatcatgtatagtgacctgcggcagaggttcaaaaactttaggaagcatcagaatcaccggcaaggcttgttcaaaatcagatttctaagctccactcccaaagcttctgattcaacaggttttagtaagaacccgagaacctgcacttctgataagctctcaggtgacacaccttgagacccattggcctacaggattctcccttggataagccatagggaccttaacttcaacacaacctaacgagtctcccagcatctaccctggtcgcttcaaaccatcttacacagcacccagagtgattatgctaaacttgatcatttcacgatccctttgtttaaagtattctaatggaccgtgagacataaatcaaagtccttaacaagacctctcaagtcttgtatgatctggcccttgcctactgagccacattactgtcactcattattattattatttttttttacacacagtggactcttagttctagcaaaagtcaagttccttgctgttccaggatatttaaacaagatgttctgccagaaatattcttcttttccctctcagcttaagtcaccttccttgggtctccttccttggctcccctccccaactaggtcagcaaaatcttctatcaccctcttatttcctcctcttagcactgtccacagtggtgactacacagtgaattgcacaattagtagtttacaatctgtttcccatcctttccccccccacacaacacagaggtcacatgtctatctgcttctgctgctaagtcgcttcagtcgtgtccgactctgtgcgaccccatagacggcagcacaccaaagctcccccgtccctgggattctccaggcaagaacactggagtgggttgccatttccttctccaatgcaggaaagtgaaaagtgaaagtgaagtcgctcagtcgtgtccgactcttagagaccccatggactgtagcccaccaggctcctccatccaagggattttccagggaagagtactggagtggggtgccattgccttctccacacatgtctatccagttcccactaaattttccgtcccttgcataatgaaagtcaaagtgttagtcactcagctatgtctaactctctgcgaccccatggactgtagcccgctaggctcctctgtccatgggattctccaggcaagaatactggaatggactgccattctttcattccccatgcagggagtgaacacgggtctccagcattgcaagcagattctttaccgcctgagccaccacggaatgacttacactcaagtatctgttgaattaaaggtcttgtaacattcaattattctgaaccctcaaaaggaaaagtattacgaaaaagggactagaggcattttttagtatcccttaataatcacaaatgaggaagcttcattaaactctatcctttgggattttaaattttaaaaaataatgcttgaaaagataaaatgaaatcttcctgtcacaagttcttctgcaacaagatatataggtatagtattgcttatatctgtaccaagagagtacagcactgatatccaaaagccattcagtaatatacgttcataatgtcccccagtataatttttgcagaaaagttattttatgtgtagacctacatcaaagagtatactcaggcttagcagcagaaccgcttttagttcatactaggaaatgggacaaggtagctgactggaattaaacctagatacagataaccacaaattatataataaatatgaatataactgagaattatattattatgcaaacaaatgttatatagattctgatctcctttcaaatggaaagactaccacctgcctgccatgtataattcattcaccaactctgaaacacaggctacatcagcacagcactggcctaagtcacaaacagagaacaagtataaccattttaaggtgtaactttaactaatttagaagaatttacatccaaataaaggttatctccattagagtagtcatttttagactatttcaacttgccatcatacaaaacaactctagaactcctct

SEQ ID NO: 52227 - DNA, 3183 bp, Bovine  19866881238171
gaggtttttaatttttaagtcagcttccctagtgattttgattttagctctgagctacttagttagccttcagatgttctctgaatctctcatcactaaccattctccttttcttgcctgtttaagtagtccagtaaaaataccaattatgaatcatgatagtactcagttctatcacgaaacaaatatcattgcttaacattgggattcactaaatgaaaggtggagataaacataatttaagtgatgagacaaacaaaatatgttacaccattaatgcagagcaattacattcttagcatctttgactatattatcactaaatgattatcacttttaaaataattaatatattaatacatacttccatttattcatctgtttttttgctggaaatgttttcttgaatcttttaaaattatttcttgagactctattatatgccaagttctattcaaggtagtgggcatacagggcctgggatctaggaggtaggatctctactctgatggagtttatgttcagtggatagagacagacaagaaataggaaacaaaatgtagaaaaataaagtttcaggaattgctaactactataaaatagacttccctggtggctcagatggtaaagcatctgcctacaatgcgggagacctgggctcaatcccgggaagctcccctggagaaggatatggcaaataaaataaataattaaaatatggcaatgtgaacaggcagggagaggacaactgtagttagggtgattcagaaaagtcatctctaaggaaataaaggctctcacgataaggatctcatcaatgagaaggagctgtgggaagatctggaggaacagtggtctacacaggagagacgagtacaagggccctgacacgggaaaaaacatgcatatttcttgtaaaaggaaggactggcatgacattttatgtagtgaatctgtgcctgggcaagagataatgatggcttgaattagagttttaacactgaagatattaagtggttgaatttggtacatattctggagttccagagtccaaccaacaagacttatgtgggaggtatgagaacaaaagaggctcctggggttttgacctagctgtgtaagtagtgatgccatttcttgaaatggagaatatcaaggagagttctctttgcaatttatttattttataggaatttgagaactatataatacattcaagaagaactttcaagggagggaagttgaatacatgaatatgaaactcaagagccaggagtagagttttcatcaaacatttctctgttaccagctactttgttcatcaacttaaagttcatgagagctgtggccacctgcatcagtatgatataactggaaggtctaaaaaccaagaccaccctgtgtcaacatgacagatatttgctccaggaagctttgctcagagaagataaaaccataagtcaataaacaactccactgtttgctgcaggaaatcactgcaaatcagtttatctgagacaacagtctccctcatcaaaccatcgtttatttaggaagactcatctcacctcactgtgcccaccaatcctaaagttttatttcatgaactttcccagtctcaatctgccgcccactttgaaacatcagccataatacccttgagcccagagtgccgtgcgtgcttatgctcagtcgtgtctatttgcagctcctctgtccacgggactttccaggcaaaaatactggagtgggttgccattttcccctccaaaggattttcccgatgcccagatcaaacccgctcctcagtgtttgcggtatggtaggcgggttctttccccctgagccacctgggcagccatccagaccttccagatcctgtataatctttctctgatgcctctctctggattctgctaaggcactgttctcccaactgcagcaacttcaaatgaactgagttctgctttggtaactgagttacaaactgagttcagtttgtatcttagagttcaagattctttcctatttttactctcttgcttttagagtgttagtcctgtaaataagtgtttacccacatgctctgagacctaccattagcaaaatgagatttttgaagtcaggaggacccttagacttactccaatcaatttattttacaaacaaagctctgaagccagagcaattggaacttgtctagtgtcacagagtgtagcttctagatcttgagactgataactcccagtctggtagtctttatggaggaacacacaagctcatgttgagcaaggtgaaatatataatatatataataatatagcttattgtctataaaatttctgagaggggagagagtagtttgactgttttgtttttgtttaattgcaatacttgtgcaacacttgcccggctggcttggacaccaaatgcatggactcataaagataatagtaaatcttaatttacatttaccaaaaattcagatttttaaagttcattaattagcaaaaatatatagaaacatcagcttccaaatcatacaattactgatgtagcttcagtttttgtctaatctaaatacagaagaaaggaataaagacaaaaaataaacaaaaaacccaacttattgactcaattgtatatctttctctaagagcaggatttgacctgcaaaacattcaagaaattagaatactcaagataaggggtatctttgaagaagctgaaatatacaaaactgttatgggtacatcttcccaattttgaatgaaagctgataaacactggaaaacttcaaacattttccaccataatatcgtaccattgcatggatacctgtgacatttccttctcctcattcctttatttcagaaattgcttctgcccacttcatccgtattatgtcagtaggagctgccccatgatgactccatgcctttatggcttcaaggctccatgtctacgcaataattgattagactgagggtggacatctggcctgtgttgggctaatgggccaatgaactggagaccccaaagagttaagtccatctctcattgcctcgattgtgaatgtataaaactcaggtgctgctgttagctgtgttctgtcatttgccccgaggagcaagggaagccaagtttctacttgaatattctctagaccaagtattacgggtg

SEQ ID NO: 52228 - DNA, 1474 bp, Bovine  19866881250625
tgaggaaaagagctctggtgaggtcacatagcttataaatgacatggttaggattagaatagagatctgtctgattttagagttggagctcaactcctttacactacactactttggtgagtcaaatttatattaataaactttgtaacattgattgaagtgattttggggattttttgggacctaatagtcatactaacttaaaacagtttctaaattatcactagtaacctaatgggatttctatgcatgaaataaaagtacttagttcttgtcaaatattagcattaaagaaataaaacattaacagaatacttctgattttcttttcagatgtcagtgctattcaaagcaaagcctaagctcttacttgacattttgggctactttttatgaatttgacagttgtgcatttggaatctgttcaaattctatttgtggctaaatcatgtgagtgccaaggagatcagtacaactgcttgttagcatctctagagtaatctttatttgtagactgtcttatataaatttaaagatgttaacatgctcaatcagatctatttgccacaggttatataatgttaggcttttcacagtagtttaacagaggtttggagcaaataataggtagtgtgagttgcttttgatttgaatacttttactcagaaaaattatagacatgataaagaggaaacaattattatattttgttaagggtagaaaataagtaatagttgtagagtacattcccattagcctcacctataggtagataaaagaagcttacatgttttaaaggtttttttttttttttttttaaagcagggggcacagttatagttgagaatatgtttaataaatgagacattttgggacttccctggtggtccagtggctaaaactccatactcccaatgtaggggaccaggtttgatccctggctgggtaagtagatcccacatgctaattagatcccacatgctaagagtagatcccacaactaaagattttacatgctgcaacaaagacctcatgtgctccagctaagaccaagtacagccaaataaataaacaaaaaagaaatgagatattttaaaaatagattatcacacttaaaaccataattctttaatatcatgtatcatcaagtcatgacagaggatgagatggttggatggcatcaccaactcgatagacatgagtttgagcaagctccaggagttgctgatggacagggaagcctggtgtgtggcagtccatggggtcacaaagagtcagatacgactgagtgactgaactgaactgaagtgaacatgaagtcagtattaaaatttccctgttgtttttgtttagtcgctaagtcatgtccaactctttgtgaccccatggactgtagcccgccaggctcctctgtccgtggaacttcccacgcaagaatactggagtgggttgccatctcctcctccaggggaat

SEQ ID NO: 52229 - DNA, 1262 bp, Bovine  19866881337230
tggaggttggaaaacttgatgggatttctgactgcattttatacaagaaattaggggcttccttgatagctcagttgataaagaaactgcctgcagtgcaggagaccagggttcaattcctgggtccggaagatcctctggagaagggataggctacccactccagtattcttggccttctcttgtggctcagctggttaagaatctgcccacaatgtgggagacctgggttcaatccctgggttggcaagatcccctggagaagggaaaggctacccactccagtattctggtttggagaattctgtggactgtatagtccatggggttgcaaagaatcagacactactgagtgactttcactttatataagaaagctaggtaaaccactgggccttagctttctcatttataaaaagaggagaataatccttattcacatggttgttggggaaatgagattacaaaatgtatgtcagagtgcctatttcatttcccccctccagacttgaaacttttgtattgggatttaactgacgaacaatgttgtggtattttcaggtgaacagcaaacggactcagctatgcatatacatgtatccattctccctgaacgcccccccaccccccggaagtgcctattcagtactaacagataggagaaatcaaatgttaaattacttaaaacatttatttgtcattagagctttaaaaaatattttgatgtatttatcacagactctgatatctacttatctttgcattgacccattgtgttacctttaaatttaccagtatctaaattctagatacttaattttctttcagtcaagcataatgttttctgatagaaatgaggcttaactgtattacttcttaatgttacaaaccacagggaatgttagataccttaaatttgtaaagctttaagggatatgtgttactgaaaaatctgagcctttaggctttctttacagaatttgtttttgaagaaattgtgcttgcctgtcatgcaatctgtctattcactgttgtgaaaaagaaaaaaaagtacattctcctgctattacagaaaaaaaaaattactgaaaatatcatctgtatgtttttagtgatctgagtgactgtaaaccatgaggagtctctatctgctgtgttttagtttaaaattcaatattttgtgagcagtcttatagacttctgcatcattccttatctaagctttttgctctattagctgggtattctttcatgaatctcaa

SEQ ID NO: 52230 - DNA, 1393 bp, Bovine  19866881353937
atttggagagaaaggcagttttaactcaccattccatagcttatcacatacaattcacagcttcccatttatatgctttctcagctcatttttgttaaactcaagagattctaccttcaaatcatgcttttatcttttaaaaaaacatttttctcccctatggctgcttctatctggatgcaaaataaagaggagtcaaactctgtttatctggcaacttttggttatcttctctaagttcaggacccattagcctctgccaggatatagtttatgatgtaggacatttatgctcttgtgtttctacttttaaacactctgtaggctgctccaccttgcccatgaatgtttaactatatgtataatgatcctgccagaattgatttttcattatagaagtcattttccgaagaggcttgtcactattttaaaaatcacattttagcgtgttgatataaaaaacagttctaaccgcaattttgtgtagcagtttttttcacagatagaagaaagggattttttttttaggcatttaacattattcatatgatattgataagttgaaaatattgaaaagtctaaagtatccatttagactttatttttgtttagaaaattaatttctaaacaattgaaaatgcagacaaacgtaagttaggcatgttcaagggtgctatgtgatgtttacaaatcaataatttttcaccaacataatatattgtatctagctaacagtcccaagtattcctaccatcctatatcaagaaaaatgagctgtaaatgaaaattaatgttttggtttttaaatgggtgcttcttttatcttttgtattagagatcttgcccttctagattttaattgtcctttcatctcccaccacttgttcattttcagtttaactctcatttctgagtgaataacgttttcatattacgttgtcccattgtctcgatcacctgaaatcaggtacaagtggtctagccagttctcagtggggaagttcagggagggttggagctaaagagagctgactagagaggatgatcctagactgccctctgtgataatttaatattaaaaaatgaaagctctttccttcacacacaaaaaatattcacaagggcttccagaaagagatgaaggatagtggttatgtttccttgggccctaaatcttttctgcagatcttcatgatagaatgaaggagggaaagaacatgtcattatttcttgcctccatgttcttgagagccatatatcctaagatatcatagaacttagcaaaatagcttggatgctgattgaaagccagactcagagtctagaaatgcaaaataacagcccatatgccaaaccacatgcatcgtaagccttgatacttctgaaggaagat

SEQ ID NO: 52231 - DNA, 1172 bp, Bovine  19866881373658
ctatttccctaggctcaaaaatgtacctgataaacagcctcaaatcaatctgtctcctggatgaattgtcctcatagcttgaaaagcttcacatacattgtatattcagttcagtagtatggttaacccaaacccttgcaaatttttttcccagtcagagaaatgagaaaagagctgcattttaattttattctagtgataagaaaattagttattttgtattaaaaaccttaatatggtctgaaaatcttaacaatttttttttatcatctgaaatgactttaatggattttctctagtatgcaattaatataaatccattttcgttttattgaggtcaaactatattcccttgtcttgctccccaggagaaggaaataaggtaaaaattagctcactgtggttatattcattttatttgctgcataaagcagaggactagcaaaagggcaagctgatacctcacaaatatcaagcgctttatgttaaggcacagttcctgtgatgtaaggggaaaatcagaaagtaagaaagacaatccataaataaatgaatcaaagcaccattgaatgtagtggttattgacttttgaaagcttttttaaaaaaattagcatgtgttttacatataaattcattaggtattaagccacctaaaaaattaactttgagtgcttcatttctccatatcctcttcaactacaattagagctaactacaaatatatatttccttcctataggtgtgattttcttaagagctttcagcctaccttatcatttcagttacaagttaattgattactatacacaaatacataaggcacaattatgcttcacatggtataaatatatatatatatgacacaaatacatacacatacatatatatttgtgtcatatatgtatgacacaaaatatgtacatatacacatatatgtatatatatgacacacataaataaacactgcacatatatgctggatattgaaggttgctgtttttagtcactaagttgtgtctgattcttttgagatcccctaaactgtagcccaccaggctcctcgtccatgggatttcccaggcaagaacactggagtgggttgccacttccttctccaggggatcttcctgacccagggcccaaacccatgtctcctgctggcagacagat

SEQ ID NO: 52232 - DNA, 959 bp, Bovine  19866881533896
tatgtctctttaaatcctttttggaaccaatgggaataacatcaaattgagagggattaaaaagcacttgtttcagaatcttacaagctgtgtttttattctatctctgctactgtctctctggctaatcttagacaagacactttaatttcttggttcttacttcttcatctgcaatttgaagtataactgacatgtcgtaaacaacatatatttaaagtataattcggtaagttttgacctatgtgtacagccatgacagcatcatcttgatcacgatagagggcatatctgttgctccccaaagtgttttcacgcctctttccttcctccttccttccgcccctcccatccttctcctgtcctcaaggactgatgtgttttccgtcactgtagtctaatgactgcattgtttccgaggaaaacagaaatgttaggctcaatcgtttaagtgactgaagggaaatgtgtaaacacttaaattcttttaaacttgagacttcctgtttgaacccttagagagaagtgtgatacaggggctagggcccttaacttcagagcaagcagacatgagcttgagtctcagctctgtcattcactagctgttatgaccttgggcaaattactcaatatcctgacgttcacagtttccccacatttagaggaaggcataataataccatctgtcctcaaaaagatgttgtgaaattgcatgcacagcagttagctcagtaccgggcctgttcatacaatatactcaaccaactaaagacagtcacctacctttagacatttcagagtcctaactcacattttaggaaaaggaaatgagaactctgaccatgcagacagggcaatcttaaggcaacaattttagaagttttatgtgaagattacgataattcactgtgctacacatggtgtccgtatgactctgactcaagtccttttgatgagca

SEQ ID NO: 52233 - DNA, 1552 bp, Bovine  19866881659214
ggaaaagcaaaagaagaaaaagaaaagtcctacagagagagaagattgaatcccgagaaaaattttactttcttcagaatcctattcaggctggccatgcactctctttttagaccttgtaattttcttgaatgactttgttttgacctgcttcaagttttccacatctgtctttagcatcaataatttgcagagagctagggtggggcagggagggatagaatgagagtttgggattgacatgtacacaccgctatatttaaaacagataaccaagaaggacttacagtatagtgcagggagtgctgctcaatcttccataataacctaaatggggaagaatttgaaaaagaatagacacgtgtggatatataacatgtggaggaatcactttcctgtacacctgaaactaacacagcacggttaatcaactatgctccaaaataaaataaaaagtgtttaaaagggaaacgtatcaatacacaaaaatacagacaagaaaatccctgatggtccaatagttaagactttgtcttccaacgcaaagggtgagggttcagtctctggtcagggagctatatgccaggtagcaaaaaaaaaaaaacataaaacagaagcaatattgtaagcaattcaataaaaacatttaaaaatagtctccaatgaaaaacaaatcttaaaaaaaatgcagacaaccaaatataataagaacccattacaaggactgaagaaatacagaggaaaataaatctaaattaaggccaattgaagagcaagaccactgtaatcaggagccaattaaaaatgcagagtggtttctccttgggatgagctattcgtattacttttatttcagcaacaggagacattcttttcctttcaaatctctctttcttcaaaggaaagatgtcacctgttcttttgctttaattgatcaaaaaaaaaaaaaattagcctgacaaaaatattcttaatataaatgagccatcttccgttgtgaactatcacaatttttatttctgtcagcacctatagtatagtgtgttcacccagaagtgtgcaccctctgctttattagaaagcttaatatgtgcttatgttcattaacaaaggtaatcctggattaattagcatccaaattcataggtcctcttttgtagagataagccctcgaaaattaataaaaatgtctaatttatgcaaatcaccttaatcagatctgtcattaatttcatgcgcatgaagttcctatttagaaaacgaagagagcttggttaaggccagaacacacgcaaatccaagctagagaaaagaaattttcgttcctaataaaaatgtggacaatagaggggctgcacacatggatgagaccttttattaatttgataacataagagattaacaaggccatcttcaagttatttcttctctggttaaattgaatctgtaagacagagtcagatacccgggggttgtaaaaacactgaaggctgggacaaatagcaaagccagctttagtagcagcatgttcatttttttttagactgagaaa

SEQ ID NO: 52234 - DNA, 1036 bp, Bovine  19866881916680
ctttgcaatgatttctgttcagactctagttataaggcactttgttcatccatgtagcatgtgagtgggggtgtgtgtttcaacagaagctttgtgcttttcacctccatcctcatctttgtgtggctaggtagtcatgagccccaaggggaagagaggaagtgactgcatttattcttagtgttcctaatggtcagggacagtggtctcatgctgtgggatatagcaaggttgatggcatttaatgaatgaataagccaatctttcagagcacgggtccccaaacctccagaatctaatgcctgatgatctgaggtggagctgatgtaaaaataatagaaataacgtgcacgataaatgtaataggcttgaatcatccccaaatcatccttcccctgtctgtggaaaaattttcttccacaaaacaggtccctgatatgaaagaggttggggacagctagaatagaggaggccgtgcttctcacatgaatccgtgacagaatcaattgttataagaaccaagatagattacatgagaggaggaagcaagggagtagaacttcccagctgctcaaagagctacaagtaaaggcctctgcgtctgtgcgtgtgtgcgtgtgcgtgcgagcccgtctgtctctttctctctctcacacacacatatacacacttcttttcctgtgaattactagaatgtagttatgccgttcaattttaccatctttaaatgaaaaattacaaatcaataacaactgactttttaacaaatagagcagaatttttacattatgtaaacaggttttgtccttgtaaagaaaagaagctatatgtttatttcaaggattctgttggccagtttttgggtttttttgcaactcttattttagaatggtctttggaacccgtgacgttcttttgaatattgtccatagtaacaaaacttctctcttccgagtgtatctaattggtgaaaataaaaagcattcagagccaagtccaatggttacaagcagatgtcctccctgggtgatataat

SEQ ID NO: 52235 - DNA, 1795 bp, Bovine  19866880391869
ctctttcctcggtcttggcagcctttgctccagtgtggagctgtaatgtgaggcaaatggggttggagaattcattcatctcaggctggagtatacatcagggtgctcatgagaacacaggcagccactcaggaacttgtgctgtcttcagtctactctctctgccccaccttgggttctagtctgcatgcatgcattaacagtgtccaggcttcctacagtagtcctgttagtcccaccatccctccaaccagccaagggggctctacttccctgtgttgtacaatatgcgattggaattgctcacttcccagggagctactctgtccatgtaatctcccttttcttctgaatcccctctcaggggcacaggtcttgacctggtcacttctctttcctttctactcacttttatgtgaatctttcttacagccttggttgtataagagactttctgtcagtctccagttagtttccagtaagaattttccacatgtagatgtatctttgatgtgttcatggcagggaggtgagttccatgtcctcttgctcgaccatcttggtcacactcatctattgatttaaatgttaatatccaaaaaattccctcacagatacacccaaataatgtttgaccaaatatctgggtgcctggtagcccaatcaagttgatacataatgttaactatcacaaagaggtttaaattataaacaaaagaattgtcaaacacttctctctaatacacaaatgtcaaatatatatatatatatatatatatatatatacatacacacacacattcaaagctgattcataatcttcatgttagttaccacatctaattaagacaaattcctatctcatgacatatagtattaatttctctttcagagtataccactgacacatgataaaataatattgtaaaatatttattatgctttctttccaagtatgatattgtcactaattctgaatatggtttcataaacttttcagctagaatgtatctttatgtgtttttagcataaggacaaaaattttaaatctacttttagcttttcttcattttggtgacactacactaatatttgtatttttccccatagatatgctcaattcatttgtcagagatttcactatatgattttggagattacataaaaccttccatgactccctcctactatttggaaaagtctcataaaagacaacacactagaaactaggatcaaatggcccattaatgtaaataagtctgatttccaaatattcatgaaaatgtttcctagtcaagcttttgctctggctattcttataaaatcatcatgcttacagtttcacttgtcccagaagcaaaagattcacattcatgaaactggagtattcttcattcttaatgattatagaactattttaaattatatcattgatactattattttattattaactgaatgcttcagtatagttaaatcattgatccactgtgtgaattcagaatatatacaactcatgatcacaacaacaaaatatggttagcaataaataaaaataatacataaatgatgtgagcagaagttatataaacagattgatgtagagtcataccatgtagacaatccttgaaatatagttattattcagaacatgaagcattttctgtattatgtatttgtattgtgcattatgctatattatgcataattattgggggtatttcaaatttatgaaatgtatgtgtgcaaacatttcatttttattttcctaaatcactcaaactcttatgaactt

SEQ ID NO: 52236 - DNA, 2478 bp, Bovine  19866880500300
attatagaaataaaagataccaagagttggcaaagacgtagagaaattggaacctttgtacactcttcctggaaatgtatgataaaatagtacaacagttgtggaaatagtatggacattcctcaaaaaaataaaattagaattaccatgtgatctggaattccacttttggtatatctaaagaattgaaataaggatattgaatagatgtcttcatgtccatgtttattgcagcattatttacaaacaactaagatatggaaatgacccagttgtctattcacataggaataggcaaagaaaatagtatatatatacaaatgaaagaatattgttcaacctttaaaaagaagaaatttctgctgtttgtgacaggatgaatggacctggaggacattaagctaagtgaaaaaacctgcttagagaataataattcattacttcacatatatgaggtttctaaagtagtcaaattcatagtagtagagaataaaatagcaattgccaagactgcaggtggaagaaatgagttgttcaatgggcataaacttttagttatactaagtgaaaaaattctagtgatctgctttgcagcataacaccaagagctaacaatacagtattgtgcacttaaaaaaaaaaaaatatgttgagagtaaaactcaaattaagtatttttaccatccaaaacaaaaataaacacaggggtccaagaaaactttgggaaatgttggatatatctattatcttgattgtggtgatgcatgggtgtttgcatatgtccaaactcaaaaaattgaatacattgaatatgaacaattctctgtatcttaatcatatttcaataaaaaatgttaaaaaaagaaattctatctaaaataatgaaatgtttaacagtggaaatgtatacaaaagtagttgtgatatttctttaaatttaatgctgaccacaatactttgtaattttccttacaaaaactggattttcccagcatgacacccagtactggcatcagtaacagacacttgaaaacgctcatgccaaggagttaacaggaaatatcttggcaaattcagagtcaaaaggaaagcacagaattgtcagaacacatatcgtgtttctcagaattatctgtgtcatgttggaagtttttatacggaagtgtgtgttgacactaatgattaaggccaggattcctacaattgacaggaaaatgacctataaataatgacccgtgatggacttgtcatacagtcattaagtgaaatattctagtaccagtttcctccctttggtatcccagtttccggcttctgtgaagtacttttcctttgtaaagatcactcattttatctgagaccatcaagttttctttgggctttatcaaatgataatttcattctctcttttagtagataacaatatcaaatggagtttcttgagcctttctggaacacattttgcttgcacagaaattttctctggagagcttcttgtttctctgtttataaaaagcaaaataaattcttgaaatgttgaaagtttatttttttaagtttaagataaaagctaattgttatgcattattaagcaatgagtttgccaattatttcatgtaacacaaatatttttctaataaattaattttagtgtaacttcttagaaaatggtattcagaaatgattcactattaaaattccattattttaccatgtatgttgcatgtgtgtgtttgtgtgttaatgaaatataaatttctggaaaaatcattttattaagtaaacactaggtcagagtttctccaactgaggactgcaactgtcaagggtcatagggcagtaacattagggaaatgaaggaagatgtcattctctttgagtccttaggaagtgcaacaggcttctcctctcctttgtaattgctccttttcatcccaaaaggcacttttgtggaccagtggtatactcttttttcttccttccttccttcctccttcatccttttcttccttccctgtcttcatgtttatgtttgggggattaagtgaaaaactaagtgataagcattatcttctaagtccacaagcaagatgctatgtatttaggcatgggggaaaaaatggggaattgtaaatcatctcactatgatcacattatgctaattcagagtatgatgtgataagaagtggcatgtaattaagcctgaggaatgcttacagaaatcactctaataccagagaattaatagcctataaattctacattcaataatttatttgctgttcattctaaatgataatattgagataattcctttttaaagaacacaaaatgaccagttttaagactcctttgtgaaaaggaaaagtgaaagtcgttcattcatgtctgactctttatgaccccatggaattctccaggccagaatgcggagagagtagtctttcccttcttcaggggatcttcccaacccagcga

SEQ ID NO: 52237 - DNA, 821 bp, Bovine  19866880554245
tgccctgagccctgtctcccggtgctgggcagagagagcagcagggcagcacatagttcttacttctctgaaaggcagtattagggcctttctcaactgtgtcctgatttaaaataatccaaactaatatttctcaaaataaagccgtaatacaattgcctgtagatgatgaatcatttttcaaaaacatacatcacaaaactctagtcaccctatttatggatcagttggtgaaagttcttgtgagatacataaaacagtaactatgagctaaaactgatttattaatacttcaaattcaaaactgtgtgcattagctctatttttgatttggaccaaatcagcttgaagaaatcagatcattcttctcagactgaagaaattagaagaccaaaagagaaaagatgtttttacctactctctaagactctgatatttagttctggtattgtaaggaagtactttctgtattagccaaaacaattcttcatattctagactttagctttctgagggcataagtataacccatttaagtgaggaagaagcaacagaaaacagatgttcaggaatacttcaaacagcatgaatgactgtagtattttgctctgccccgttttccataatcgttttctggaaacaaaaaattcaatttcctattgaaattaaaatcctattgtggattttgaaaataagcagacttgccttttctaattgattaaatggagtggaaagggaaaaagaagaactggctctttgaaggtacaaatctatgaaaacacttggcatctcccgaagtctttttattgttaataataaca

SEQ ID NO: 52238 - DNA, 1611 bp, Bovine  19866880605282
tgattttggagcccagaaaaatgaagtcagccctgtttccactttttccccatctatttgccatgaagtgataggaccagatgctatgatcttagttttctgaatgttgaactttaagccaactttttcactttcctctttcactttcatcaagaggctctttcgttcttcttcactttctgccgtaagggtggtgtcatatgcatatctgaggtatttctcctggcaatcttgattccaacttgtgcttcctccagcccactctaggagcctgattttttccccaagacaagtaggctttcaaatatttgtttaataaagaatttgttattttgccttcctttcattaatgctcattaaagaaagtagtgagttttgtttacataaaaaaaaagtattctttggattgacttcatatgtgctttaatttgtggggactagttctacaacacagaattgaagggctgatagaaaaaatattggataaaggtagtttatacttctccctggcctccagcaatagatttggaaacatcctgtcttaattctcccagaaagaggaaactagctctcctcctgcctagaaatactacacaaaatgcaggaggaaaaagaataaacatgtttatttatttttcactgtgagtatatttcacacaggtcatcagctgacatcagcagatggacccacagcaatgaggcaggtaagataaattgcacccttgactgttaaaataaccaaatcatttcgatttgacactcaaataataatgtttaaacaattaggtttcttgaacagacaataaaatatccttttaatttaaatcaaatatcctttttaaaggcaacaatcaaacttaagatgtttcatttttgcatatcaggataactggaattcaaagtattaataccagtcaatgaagtacacagcaattaaacctggatatttgcatacattctctgtaggtgtcagcattgctttataacagttacacatacagaactgtgttttcatcatgtcacaggatataatttttatgttcaattcagacctaaaaactcagaagagtcaatccaaggctttagaacatctcccaaactattctttattttttaacataatgaattgtgactgaatgattaaattccaggtagttttttttttttttttaaagtatgtttatgtttctgctttaggcaagaatgagtattttcaaagttttgaatggcattctctgaatttaaaaaaatgctttgaaaatatattctgtaatattcttagaacctaattgtatttggaatacttagaaataatttactgtgaaatatataatttatttataagtaatttattatcatgatactttataaataatttataagtaatttattagcacaataatttattgtgaaatattttattagaaataactattccattatttattgtggagagaacagttaatgtagcattcttcagagtgattcaaatggcagatatgactgcatcattatgtacatttcgttttccttaagtttccagaaaaaaaaaagatcttagaatatgatgcagaagatgctataacaagcaaagccctttccattagtagt

SEQ ID NO: 52239 - DNA, 1652 bp, Bovine  19866880764938
cctagggcttttttatttgattttagattttatttaataggactgctatgtaaacaaagcaatgtaataatcccatgttggtaatttattttaatatttgcttaagcactaaaaaattaatgtaaagtgaaaaatatgcattaattcactgtcattagcttgaataaattatacatattacacagagctattatacaatgtacataaaacataaacacattatatatgatatatatgttatacatatattgtatatatataaatgttatactattatatacaaaatagtacatatatatacagagtttataatatatacatatatggattatgtatactgtatattattatttatgctatattatgttatataactatatgtaggcatattcttatactatctcatttgatagtcacagtaataccatcctgtattaacctgattttctagagaaagatacataaaggtgctactctgtgtttgtaatatatctgaaaaacctgaaatctcctttaaacactatattatttcactgtttttctttactttcttcagctatattaaaaaataaacattctctacacctgcttgaaattttacagttgacttatacaatatcaagatgtactccatacaaggtacaagataatggaggtcataaaatattcttgaaatcttaccagatcagtcattgaaaccactaatctagagtattttccacagcactgagccctcagatcttcctcttcctttcatatatctctttagtctttctcaaatcaataaaagttatagttacatatctcttgtaatagataattgcaattactttgcatttagaatgatgtgatggaaactgtaaggttgtatataaaaaacaaaacacgtacatctcgttttactctgtctatgtctttgttgttactattctttatatccttgtactactgactagctgtctgactgtcaatcagcacccagaattgtgaacatttagtaaaaatttgtgctgtatgatctgtttgtaagctggaaaaccagacattctttagaaaaaggtttctttcactcttttgacatggaagttaggcattcttagaaaaatgtatttttcattttcatttacagtatgtgaattatgtacttagggtacattgaaaagtgtttatcttaatcaagttttcacatcaactcatccaaagctcatatctttcctaattcattgcaaaacacttttattattgaacatgtgcccagagacatatgcattgtatgccttttcttaaactaaaaataaacaaatagtgaattttgttacttgaacagatgccataattccatgttctatatctatcaccagactgtgaaattctcatttctctctaagaactgttagaagtttagctctggttttagatgatgttttttactagcaggctagcaaatgccatatgaatattctgtagacatttagtgctatggcctgtgtttccactgacaaaaataaactatttaaagacataccaatttctgatgctgtcagtatccagattggttctctttatacatagttgaaaatgttacactgttctatttgacatgtctctttaagattgttttggatttcagtttagattgacttccatagcag

SEQ ID NO: 52240 - DNA, 1656 bp, Bovine  19866880866920
tcagagaggactttttaactaaagaacaacaaactactacaaggctaagaagctaaatgttcaagacaaggttttcctcaacctgtcatcgaattagttcaaatctttatgtttccttatttttaagcatttctacagatgtattggatttactaaggctgctatcacttttaatacaaatatgttaattcagcaggttttagatgttaagaagaaaagatctgtaggcactcaaaaacaactgagcaaagctacttctaaaaatagaagagaaagttacaatttcaaaaaaaaaaaaatcaatagagtagatactcacatgctcacagcagctctcacctttagctgaaacagagggcaacagaaagtgcctcatgtaagttaatgtgtggtctgtggttaaaggttggtaggatactttgatgtgcaccaaatttgagctacaatttatgacacaaactacatacacaccttctaagccacaaaaacctgagaggcaaaactgtgatgtctacagtaagaaccaacatttttggtgcagaaagccagcagttgaatgtgtacctaacacctcatgctctactgccttagcacagaaagaaaaacaaaacatatacacatatacacacaaacacacaatttatctggtttacccattaaaactctgattttaaaattaaaaatatagaatatgtgatgagtatccactataagctattctaaatcatcatgttcagatccaagcaccatctcatagttgaagctggtttaaattaatctgttgtctatctgtaagtatttttgctatgattgaaaaaagtataataaaaattaaaatattggtctcatgtaccttaaaccctaagatgactcttgaaagaactgtctctggataagacagactatatatatagacacataaaaagcaaaataagaaaaaaaaaatctcttaccaagggagaggtgacttcctccagtacccatctcttacttcaatataatcataccagcacaaactacttttgtataggtccattgtagtaaaatttaaaacaatctgcaaaatggaaaaaaagaatacacaaattaaaaaggattataatttcatatggctaggaacccagatctactgtgcaaacagactaatagcaaattcttttttttcttcctatattagtatccaatattttttatttaataaaacctaaaaaaaaatccattttcccaacttaatgtctaacaatttagaagcccaatgccaataaatgaactatacatttcagcaattaaaccaaacttctataaagttaactgaacaattgtgagatgagaaatctttatttaaacattttattctgaattttcttagataaacatgacaactatgattttgttatgactgtgttttaataatttatttcagacatctataattatgttaaaataaccaccatgagccatattccaggaatataataccattgtgtacttgaaatgttttaaatacagctttagaattaaaatttctccatataactataatcaaagacagatgtcactatgcttctctaaattcaagaacatatattcaaagaccttttaagttagaagatcttgtacatgaccttttattttgtactttgctttgaaatgcta

SEQ ID NO: 52241 - DNA, 1838 bp, Bovine  19866880895236
ctcttacatacttggagtcctaaaactgaaccaaacatattctacccagacatcttgataaacacatgcaaagagttacacttttttcctttgttatagtctaatagcatgttctttcttcaaatgttacttgaaatgtatttattttcttgtggtgtgatccatatagggattttcatgtgcttgtagcaatagaaaaatcagaaaacagctgaaaatagctgtttgttcatattctttaatgcctgtaatagtggtgatgttatcccctgataattttttggccctattttatgccaagaaagaaaatagcttgagcaataaaaagtcttaagtatgtcatgattgccataataatatagtgcatagtgcagccgaatctcagaaacccattctggcttgggaaaaaggagaaatattccacttctggttttctgtgctgtggcaaactgaagaaaggaagcgctgctccctaaggctggatggtgggagctcgcaacatatgcatttcattatggagcctggcagttgtgcagagtagcaggaattgctagttaccctgcacaggttagagacactctactctcagattgctgggaggtagactgtgagtctcagggaggtaaggggttaggacactgtagtcatgaccagggaaatagacaccgttaaatcataatgaaaagtacctcaagatgggtgaccttgcccatattatgagaagaaacatagattccaagaaaaggatctaaggagaaattaaggttttattttgggcaatctcatgtcacatctccctgtatgcattcagatatttgcctcctggagccacttagatagccagggggttggaacaggaaaactaatttcaacattggcaaccaaagggatttattttttgctgttgaatcttggctgtaatttggggggcatttgagggtcctctataatgaatcaaaatataagacttttagagaactgtttgcaaaatagtttttagaaagattgaggtgttcttttccaagagaatattttctctaaatttcaataatgtacattcacttcactggcataccatgagttaaattactaccagtttttattaaaaactaattttcagacttttatcaatccagcatctggggaacattgtttattttaacttgcatttttctgtaggtaggtaacccaattatgataattacattatggaaaatgtattaccttctcctttgctactcataatttattttacctggttttgtagcttagggtaaattgttgagagtcaaagagcagtaagaaagcattttgcaatctcattgctatgtgagatatattaaatctgatacttttttgaatgcaaagatggcaaaccaaattctataaaggtgttattaaaatgaaaaaaaacccataatattgatacttaaaatggaaaactcaggaaagaggcttttttgttatctatttctctgttgtcctttattgttatggtcaacttaagttcctttctctaatttgacttaaaagtgagttattagtatgttgagaaagtaaaaaattgaggcattaactgtgtttggatatagcatattttaagaaggaaagtgaaaatttactactctctaagtttaaaaaaatttgtcatggttgcagaactatggaatgttaaatgtcctcagatgaattcacagtattcaggaacagtgaatttattaatctgtctcatctttaagataattattttgttctgtattttgaattgcttcattacatgaaattaaactaatttggggggatcagtcacagttagttgtatgcttagaggaaaccaa

SEQ ID NO: 52242 - DNA, 1527 bp, Bovine  19866880899521
aactaaattcatcccgtcaccactttgggggcctgaagtctggaatgagtcttaccggaggctaagatcaaggtgtctggaatgctgttacttctgaacgcttccaagaataactttctcaccttttccaacttccagagttgctgtcattccttggcatatggtcacatcacttcaacctctgcttgtggtgtagcacctgatctgacttctcctgattcctttcttgttaggatccttatgattacactgggcttgcctgggtaatcaaggttcttaattttataagcaaagtgcctttggccatatgagttaacatattcacagactcagggcatcagggcatggacatctttgtgggccactattctatctacctcagtgagctccgaggtgaagtttctccaggcctccctgtgcttgagagagcatcttgccttgagggaggaaaaatgcaaagaaactatgcaaagaatactgacttgacccaggtcacttgagtcccctcaagacaatgcttgatatataccatgcccagaactctctgactgagggatctgcaggctaatttccaattatttttgcaattctctataattatgaatttcctgagaaaggtcatttgatattgaatgtacagtaaacctgaattcttacaaaacaaaaaataaaggaactctcgggttgatcccagtcaatcttaagggaaaatcaaccctgaatactcattggaaagactggatgctgaagttgaagctccagtgttttggtcacctaatgcaaacaggttattcattggaaaagtccctgatgctgggaaagattgagggcagaaggagaagagggcatcagaggatgagatggctggatggcatccctgatgcaatggacatgaacttgggcaaacttcaggagatggtaaggaacagagaggcctgacgtgctacagtctaaggtgccacaaagagtcagacacgactgggctactgaacaacagggttgattagctgtacatttcatcaaatccttttgcttaaataaaatgtaaatcaatgagttctcctacatacaaatggcaggacagtgtctatagttacatatagttaggcttggatgctcatgaacttcactgttaatagcagtgctttgtaccattgagaaagaactgtgatgtcaatactgaattatgtattgacagcttactttaattttgaaaatcagaattaatgtgttccaaataaaagaaaaccttcaaatgaactcatttaagctaactaataacaagaacaaaacaagttctgccctttttggtcttatcagaatttagattaaactccccagaggaagtggtagaaacaggtaggataaatgttcccaacaaaataatgactcatctggaagttcataattaaaatctgggccaggcatatcaaacacttttaccagtcagtttgacagcagaggtgtgtgtagcttggggacgtgaggacaatgggaaatcttgaagacttttcagcagagaaataa

SEQ ID NO: 52243 - DNA, 1018 bp, Bovine  19866881193321
tagttggtaaaagttccaaggatagaagtttatgtttagaaggaagataggtagatggttttaaaataaatggtgcattgtggttgaagacatttttctcatggtagcagtctttattcatggaaggaggctttacagactctaacatatcctggaaatctcaaatttatgatgaggttactgtgtggaatgttgttaaaaaattctgtgcattttcatagtttaaattattggctatttaaaataaaggcatgagcaaaatcttgacttatagaatactgggttatgttatcacttcattgtttcattcattatattcatatccacaaggaaaaccaataggaaacagctttaacctcagtaacattattctacttttgtgtcagagccctctctaaataaaagttgcagtggtagcaaaatagatagaaaatttatttcacttttcctagcaacattttgcttattcattacctaattaatatcacaaaaaaaccagtaatttaggttgacatattacaaggcacacataatgtggagagttcaaatcatacgcattgttaaacaaatactcgtcacccatctcagctttcctgaagtctgtatatttggacctattaatccagtttgacccacaggagtgaaaagggaaaaacataatacatttttaaaaaacagctgtcaattatctgatgctttcagatttggtgattacagtaacctgtttatttctaggtatgcaagtatgattatgtggagatttggagtggtctctcttctgagtctaaattgcatggcaaatattgtggtgctgaagtgcctgaagtgatcacatcccatttcaacaatatgagaatagaattcaaatctgacaatactgtatccaagaagggcttcaaagcacatttcttctcaggtatcagtattctcatgttgcatgtgtattacagactttcaaggtggattggcttaaattgtatgctatccattcttcatagttttctataaatgagctttg

SEQ ID NO: 52244 - DNA, 1454 bp, Bovine  19866881234672
cccaaagggagagcaacgatgtgagagttgatgtgctgatgtgccagaatggtgaaaggattgttagagttgccatgataggaagtgctgcttggagaatatgatgaaatgcaaattgaaatgaaaattatggttgtatttcagtgcttccatttgcaaagataagagcagaatcctgaaagtaaatatctgagatagggggcaaaaaaaaaaaaaatctttgagagggagttaaggaattcagtcaccatattgacaggtgatttacatagatattggaatgttaaagagtaacagtgagtcaggtgctgaaatattttaaggaatgaggaaatgtgaaaataagagcagtggatgatttggaaagctatttagagggtaaaagataagacttgattattggctactggcaatggagtttaaataggtgtcaagagtcaatcccaggtttctcacttgtgtaagtgaatgaataatctatccatttacattagagaaacattttagaataaatgtctttaggagataaattatgagtttagttttagatatatacagttcaaattttttctctctcatatatccaaatgggcattatgaggtgattgcttgaaatctaaggttctcagagaaaaaaacagacatgaaatgcatatttgagactcataagaaaataagcagtatttaaaaccatttattgttaatatcatctggagaactattaggaaacagaactgagccttgagacatatagaaaaaaaattaagcacaaagagagcaattttatttgttcaacctatcatatattaattcaggaataagtaccctcacattgattaatatttcctgatccaatattccatccccttggtctaaaactgaaataatatactctcacatatatccctttggtttacgccaatataacttcgaatatattgtaatcttttggagtgtagcctatttcttcctaggttgaatttttacttatctctgttgggatatatttagaactttctagttataggtctagacacaataaaggtgatagggataaatcttgaagacaatcagtacctcattgaaagaaggcttaaagtagattcaaaaatttcatctttattcatgtcttcccaaatatcctcactcctcctaatcaatgccttagtttccacttaaggatatttgaatagtctatgaaaagaccttacatttttattctataatatttaaatatataaatatttataaatatataagtattaaaataatttaaatgtcagccatttctaccctcccccaaacagataaaaataaatatgaatatacaaaagtaagatttttggggggggatgacaagaatttgagttgaaattattaaattcctgatcatgttattttccttttgtatggtctccaggacacacttaaatagcccttctaccaaaaccaaa

SEQ ID NO: 52245 - DNA, 2063 bp, Bovine  19866881248874
tacttagttcttatgggaaatcctatccaggtcatcatatcacaattgaaaacaactgataatgaaaagaatgctaattggtttcctctctcttatcactgattcatacacaaactattatttccacattcttcctcttgtttgtactcaacttctatatctagactttaaagttttttggagtaattaggaactagcatagcattggtaaactatattgagtcttaggatgatgaatgtgaactaggaataatgtatttaaagctactgatcaaatatttatttaacaaccattgaacaaagtgctaatgacaaaaagacaagtttcagtttttgcccttttgaaactcagagtttagtagagatttgtaaacaaattcaacacagaatgatatgttcaataacagattgtagccaaagtaataaacatttagacaaataataagcatgctggccagcagaaaggggaacattacatcactcaaagtcctgtgttctgttctgaaccttctgaggccaaagcaacattgcctcaagttgggtggtgagccaagaattataggtcagtctttcaactctaccttcttcaaagagaatgtcaggactaaattcatgaattctcaggcttctactttctgtttaatttcaccaatatctaaagtctcagtgctctctttaaaaaatagcatcagttcagttcagtcgctcagttatgtccaattctttgcaaccccatgaattacagcacaggcctccttgactatcaccaattcccagagttaactcaaactcctgtccattgagtcattgatgccatccaactatctcatcttctgtcatccccttctccccctgccttcagtctttcccagcatcagggtcttttccagtcagttcttctcatcaggtggccaaagtgttggagtttcagcttcaacatcaatccttccaatgaacattcaggactgatttcctttaggagggactggttggatcccctttcagtccaagggactctcaagagtcttctccaacaccacagttcagaagcatcaattctttgccactcagctttctttatagtccaactctcacatccatacatgactactggggaaaaaaaatagcataatttattgcaaaaaatctgctttctactgcattatgctgtttaccttcctgagacgacgcccagcacctcttccttcaccttttttcccacttatgccacagtgttccctaaaagatctattccataacataagaaatcctctgtaccatcaacttctattcaggacgttttgcctgcctctgcctcaattggatcctaactttcttgagagcttagtttttacctctggccttagtatgtggcttttattttctgtcacctccatactttaataatgagcagtaagatgagcagatttcacaaatttctttcccactatccactgagcactcccactgttgggaagcttgcttctcagtccagtcactcactcccatcccttatgagtggcagataccaaccattcactgaacatcttgacacttgagtcacagataggccttcgcttcagccaagattcctgctgctgctgctgctaagtcacttcagtagtgtcgcactctgtgcaaccccatggatggcagcccaccaggctcccccatccctggtattctccaggcaagaacactggagtgggttgccatttccatcatcctataaaatatccaagttcatgattttccagtcctattcaagactctaaccacttgtttccaatgttttcctctgtttcattctgatacatattcttaaagccataatatggactggccataatctgaagtgaataagtttgaaatcatttttcagatttttcagttactcttacattgactaccctgcaactttttctttgtcccttccacactctctacctttactctaaccttaatattgacctaaccataaccataatcaagactataaacataaagacaatcataatccttctttcctgccttcctgttcaatatagattccatagctcatt

SEQ ID NO: 52246 - DNA, 1280 bp, Bovine  19866881297885
ctccaccaagctacaaatacctatttaagtaaaaggaatggaaaaagaaataaggaaaaggaaaaaggaaagcaatgaggaaagagacaaagtataaacactccctagattcatgtttctcaaccttgacactgttgaaactttggacttgttattcctttgttgagggctgtcctatgcatggtacaatagttagcagcaactctgccttctattccttagatgcctatagcaacccacctctcaaactgtgacaaccaaaaatatttccagatattgtcaaattcccctgggaacaaaattgctctttgactgagaatgattgccccagttgaacaatctcagaggaggtaatcttctacattactttaagcaaagtgccaataaattagcatgtattggcttcaaaccaatacttttatattaaacatagaagccagaatctaaaatgcttaatcctcttacattttattagttcattttattaaaaacgatgatgttgtcacttagtctaagactaccaatgcaatagctacagcaaaggaaaaaaaaaaagctagctagtttccagttttaaagggaattaaacacagctaacacatgctagagataatcttcatcattttaattttagttttactttaaacttgcttaaaggtccttgctcggttaagaaacacatattcactatttctataaaacacagtctaaggaataaaaggagtgtaaaaatttgtgaaagagtaagcaaatatccttcatttgattttaatatctacttaccaaaaaaccatggctttcttcatagtagcaaaagtttacaattgagatttttgaatacttgtttttttatttttttaacttttaaaggtgtgtgtgcttagttgcttagtcatgtctgattctttgtgactctatggactgtagacccccaagctcctctgtccatggggttctccatgcaaaaatacaggagtgggtacccattccctcttccaagggatcttgccaacccagagatagaacccaggtcgcctggattgcaggcagattctttatcatctgagccaccattctaaaagagtaatataacatcaaatttacatttcaaaactgtaatgtcaaacatgaatagtcaatggtcagagctatgatttttattttgataaagaatctggaattgatttaaaaaaaaatagcatgaacctagtattctccattcatctaatgcaataaagccttatacgatttaataagagttcaaaactgtagcgctcaat

SEQ ID NO: 52247 - DNA, 1233 bp, Bovine  19866881522746
actagacggacctttggtggcaaagtaatgtctctgcttttcaaatatgctatctaggttggtcataactttccttccaaggagtaagcgtcttttaatttcatggctgcagtcaccatccgcagtgattttggagccccccaaaataaagtctgacactgtttacactgtttctccatctatttcccatgaagtgatgagagagtgcacattaaaacatttgtgtgggcaattactattatatatttcctgctgagatgttcccaggtgctgaaaaagttgtttgctgtgagaaagcataatgttcattttaatgtttagtgtcttttgtcttaataactcaatgtctcacagcatagtataaacatacacaaaagcacggccaataacataatacccatatgtttgtggatacaataaaacgttacagattttattgaaggtctggtttcacttctcactcccacagagggagtgactctcatgaagttggttcttcttatggatgattttatattttcactatgtatatatttctataaataatattatgaagtaatgaatgatttaaagttttatatgcattaattgagtacaccaatatgaattttttcatattgtttaaaatatctgtaagtaactggttttatatagtttaatgttatttttctttttagttttttttttctttttttcatataggtaggtatatatttcaatgtatttattttcaattttttcccaagtttttcactactacaagagtttgtaaaatgagtatttttgtacacatctccttgtgttcatatgtgcagatccttctaagtttcatacctagaaatgatattccttgatacagtcaactttactgtatcaaaaagatctttcaatatgttactttgttactttctaaaagccttacagttcccttggcattctgacttttaatcgatctaaaattaattttcagtgttgtgtgaggcaaggaccattatttgttcaactcggaaaataatttgtccttgaaaaatgcattaactagtttatctttcccccactgattttttccctggttttgtagtacaaggggtttccacattcctggattctctactctgtcccattggtggtccacttctgtgccagcaccatgtggtgttgcctgttccacttgtgtatgaatcttgataactgataggcagctcattcttcttcaaaatcatcttagctatt

SEQ ID NO: 52248 - DNA, 1133 bp, Bovine  19866880491377
tggggcagcgtgggggtggggcggggtctggggaggcctggaggagccccccttcagtcaggggctgggcggtgggggctgagccaggagccttagcctagcccctgaactgcgggggccccctccacagcagtgagcttgcaatgcccccaccctgcatgacggcgcttgggctcccaggtggtgcctgtccgctttggatgtgggcacgtgggatgggcggagggatcacaggaagtggacgaaagggaagactctgaccgcccggaaggcccctccggaaccctagttgagtgctccccaaccctgctcccttgagtcctcgggatgagggagaagatgcccacacaggagccacctggggccttcttccgggggccgtcccgactattcatccattcgtcccgttctagcctggaggtgtagagtcattttttgaaaaaagaggaactttcctggtggtctggtggttgactctgcgcttgcactgcgagggtcgtcatcttggtgtctggtccttgagccaagattccacagggcagcgtggccaaaaataaaagagcaaaaaccagcgcctcccctgcctcccccgcctccccgtagtttatatcttagtgagtgaggcaggaaaggaaccagatagaagcatgtgtggctttttcagctggggatacactcagaagacagagcgggaggaggaacagaggatgtcagaggccgcccagtgcctggggcggccccctggggagcggccctgcaggagggagggacccaggtggtagggtagccggggcaggagtcccaaggcggctgagcctggttcgaccccctcaccccgcaggagaagctggaatacttcttcctcatcgtcttctccatcgaggccgccatgaagatcatcgcctacggcttcctgttccaccaggatgcctacctgcgcagcggctggaacgtgctggatttcatcatcgtcttcctggggtgagtgaggctggggtgcggggctgagccgggcggggaccccagggcccagaggcgggtgcagcggtgagtggggtggggcaacgggggcgccagcaagtcacaccctccccagccaggcaccaccagcctgcctgctctctgcacacacg

SEQ ID NO: 52249 - DNA, 3165 bp, Bovine  19866880606273
tgtttttcctctacattccttactcttagtcacataaaatgttttttctttaagcccagaactgggctccccaggtggcactactggtaaagaagccgcctgccagtgcaggagacaccagagacctgggttcagtccctgggttgggaagacccctggaggaggaaacagcaacccactccagtattcttgcctggagaatcctatggacagaggctacagtccaagaggctacaaagagtcggaggagactgaacacacaggatgatacagaactgatgattacacaacaaacaactcagtttaaactctatactgaggattatataacaacaatgtatcctgctgaggacagtttctccttcctgaaaaccttctggctaatcctgttatcttaaaatgtaaactatgggagcgggtctagtaagatgtttacaaccttgagacactcttttaatttactgtaataaccagttaaaaaagtatatagctcccttgctaacactggaaaggggcgctctccgccccccttctgagtctgtgtgagaagcttcctctgtccctttttcactttaataaaactctgcttcacaaaagctcttgagtgatcaagcctggtccctggtcctgaagctcaatcttcttcggagatcatgaatccgacatcattcaccgtaagctaccgcacagtccataagccaagaactggggcagacacgctgcctacgtgcctattattaacccgactctaggaatgaggacgctaatagagcacagaggccgacagtcacggcgctaagcaccggctgagctcagtctgcagacactgctctaagaaccgcgcacaagctaatgcttccagcagccccatctccaccctccctgggagacagaaagacagacaccatgtggccacaggcctcgcctcgccagcaacagcgtttgtgcctgttcccctaatgtcgtcgttaaagtcctggggagggtaacacacagtcacctgggctgaataacgtctcaaaggtcaaagagcagctggcagggctgaggctttgacccaagcccagctctgccccggacatgtaacggtgctgcctgggcagctcccaggggctggtctctgcacaaaggcaggcgatttgtgaaacaccagaagagagagtgtgagagccagagagtcctccccctcgctctctgctgatctcacagaggagagaaccaggctcagcaaaactgaatcccgtgctcaaagcgcaacagcttcttgcgtttcagcagcggccaacttacatggtgcaacacagtcggctccgaaatcagttttccgtttacgtatgtctttgcttccccggccgggacgatactcactgtcccactggaattggtgatggtgctgtgaagacagggagcccgtggttacggtgatggacagactgacgaggaaggaaaagcaggacacgtaatgctccctggggtgctccttcagtgagaaggttcctgtcaatttatgacaatagtaacgtacaagaatccccttattttccttccattagattttacctttgctgaaaaaagcctggcttctctaacaattctatccagcagtgataggaaaatttttcattgtatgtattatgattaaaactacttaaaaaaacactaatccctctcctcccaaaatgaaaaaagaatacacaaacattaagggaaaatacattaaaatacttacaagcactgacccatgtactctaaccaagggccaggcgagtcggggacttcctggcccccttctggactcttcactctttgggggcatgttctgtatctttgccacaagtgtaaataattctggacttatgtggtacagaaaacagttaagagaagaccaagaggaactaaagatcaaggagccaaaccacaccaggtacaaagacatcgtggagctcagatgaccaagaccacgcgatattagtgagaacacgcactctgtatctttagaaacttttttaatgtgaacaccacattaaaaaaaaaaatccacatcttatttaagatatggtactggtagaattggttattcacaaggaaaataaatgaatttagatctctacttcacagcaaacaaaaaattccagactacttaaggatttaaatgtgaaagcaaaatttcaaaacatttaaaagaaaatttgggagactgtctctataacctcaatacagaaagggttttttttaacaagacacagaaactgacaaccataaaggaaaagattcgcttgtgtgatatactaggaactttgatccattgaaaggtaccataagagagagagatgagccacacgctggaaaagctatttacaacgcatgaaactcacaaaaacctgccaaccaagacacagaaaggtctgctacaaattatgaaggaaaaaacaatacaatacaattgaaaaatggacaaaagacatgaccaagttacaaacaagttacaaaagagcaagcaaaattggccaaaatatgtgaggattactagtcaaagaaatgcaaacaaatgcccaccgagtcgccagtttgcatccacccagcagtgctaagtgttggcaaggatctgagggtaacaggaagtctgagtgccaactgtggcagaactgacgatcattctggaaagcaatctgaaatcacctcataaaagtgaatacgcacatatcctgcaggctgctctctcccctcctagacacacgcttagggctgcttcccaaacttgggaattatcgtgacacggtaactgcaaagtcgccacgctcatacagcacgcggggcaaacagaagggcccaggcgccaggctgccccaagggccgtctcgcatgttgacactccagggacgcgctacccgtttgtaccaggagacgtgtccacgcgctcacagcagtgctgtgggggtggaatgtgagaaaccaccgaacgtctaccgacaaaatagaccggtaactgcacaccaacgtgacactctgcagccgggaaaacgcaggtgtgtcaacagagacaagtcatgaaaacacactatggagctaacacagttcacacgaaccgtcaccccagcaacacacgcagcatcgctccactcacaggagcagaagtttaaattcatcatccaaccaaaactccag

SEQ ID NO: 52250 - DNA, 736 bp, Bovine  19866880761532
attgcaggggagacgctggtctccgcacagctccaaggtgaacgcggtgacggccttttttatctttaaagtgaattatattaaatttaaacagtaaaccatgatttttggtgactgtttgattttgatggttaggaagtgtttctgtacagaacgcgaagttaaaggggaaatgcaaacaaaaaccacgttgggagcataacatgctgagcttgaagtgtcttagttctgctgaacggcaaacgctcgttatcagctaatgaaaggcgtgtgcctaaataatatttggcctctcagaagtccagtgaacttcttcccatgcccttgagtttcctgggcaaactcccctgagagccccagcggcctcctgtccagcgggcgaccggctggggcgggcgggccggcccggagcctcctcaaggcccgtttgctctccggcggccctgcgctcagggtccgtcctgcccagcacttgccagtcaaacctctctctgctgagatttatgacttggctggaacactttattcatcactcaacttttctccaaaggattgttattatggtgcttttttttgcttgtttttttaacaagttccgaaaacacacgcacccaggaaaacaaatcaaacatgttatgcgcagcccgactctcccttcacgagctgtgttcttgcttttcattttaagatgttttggaaaaggatgctgttaggaaagtgtgtgtttcaataaggc

SEQ ID NO: 52251 - DNA, 1185 bp, Bovine  19866880846002
ctcacgtgagttccccccgccaggctgtcggggctggggtgggagccagggcccggcccgcccggcgggcgcacccccgactctgcctctctccctcgcatgcagatcctcgggccaggtggtctcgggggacgcctgcgcggccgcgtccacccgcacagtgaccagcgggcagggggagcaccagatcaaccagatcgccctcagccccgcgggcagcatgctctacgccgcctcggggaacgccgtccgcgtctgggagctcagcaggtggggggcccggggagggcggggggcaggcaggtgacccctgggcggcaggacctcactgttccccccagcccccaggaccctggccagcatgttcacccggggccgacccctgtcccaccccagggtccccccgggttcatccccccaagctgggcatctccgccctgcaggttccagcctattgccaagctgactggccacattggccctgtgatgtgcctgacggccgcccagactgccggccagcgtgacctggtggtgaccggctccaaggaccactacgttaaggtaccgagacggccttgaccttggagccgggttcgggggatgggccctctcctgcgctccccaccctggcctccccctccactgccttgggactcaacgaaaaataatgtgactcctggggctttatactgaacagtccctcccagggagcaaggtctgtgcaggagggagatggcagcgtgattttgtagatggtgggaaaacccgcagggctgggagcagggtgactgtcggcctgaggaacacacgagcacaggaggcactgacgatctttgctccttggttcaaagtcagagactgagaagcagaagatagacagggtggagggcttgtgatgaatatttcaagtgcaagtagaactacatttatttattaaaaagtaaaaaaccttaataggagactcaccccccagacccatgttgagtcagtctccctgcccccagtccccatcccccaggagcccctcttcaccctgagtgccagcctgggggacctcgagctggcccgcagaagtggctgcgggtgtgggggggtggcccgggactccctccagcccttcttctgcagatgttcgagctgggcgagggcgtgacgggcaccatcgggcccacccacaacttcgag

SEQ ID NO: 52252 - DNA, 693 bp, Bovine  19866881077562
gactctagactgacaccaaaatcacagcccatctggtcagcaggactttccccccaaagccaaagcatgaaagctccttaaatagaaatttcattaagaggaaaccattttggaagtgattttttttttttcagaccttcagtgaagacattggttcaacataatacagttgagtcccagttactaacgacccaggtattcagttccagttccagttttttaacaagcttgaggctgacgctggataaacccctcgcctgtttgagctcacacaggtgagctctaactcacctgagacagagctcgcaggatgactggaagcaggaaggcggccgtttttccggagccggtgtccgcgctggccagcacgtctctgcccagaaggcccaccggaatcatctgcatctggatgggggtgggcacctcgtaaccggaggccttgaggttgcggtttagggcctcggggaagccgcagtgctcaaagtcaacgatgggcctggggacgcctcggcctcggaccgtgatccccagctgccgcctgaggttctcaatctggtcctcccgaaggtgcgagacgaaggcatgctcggtgtagacgtagggggcagggcccggcgctgccggctcggagcccgctttctgggggcggctcggctcggacgctgcctccacgcccctcacctgcagcaggtg

SEQ ID NO: 52253 - DNA, 1127 bp, Bovine  19866881193399
cccatcccagcagccacgcatctgttcctaactctcagggcatcaggctgcatctttgcttagacgtttagactttggaaaccaacaagctcctgctcactgtacaagattttgcttagttgtcccttctgtttgaagtcctcccagtgaccgccctcatcatggggaattactgctgctcctcggccactgcattagggtgactcatacggcacagtgtgagtgcccaccagtgcccaccactgtgtacctaatagatggcacatgcgtggtttcaccctccaatcacacgacacttcagtaaacctccctctgggtcacacgttctctggattcacctcggcctccccaggcctggcacagcagcaacatgtgacatctgttgaacccattgaaccaacgtgaagagaactagattgtttgtattttaactttccaaccagctcacaggctctaagccatcacaatcctgatcttaaagctcctcacaagattccctctaagattttgctccatacagttggtatacaatgagcatttgagaagttacatctgcatatttactggcatatctctttgcaaatcttcagtttagagagctgaaatgatacctgtaactcctttgttacttgaagttttcttttttcagcttgttcaagtttttctttccacattcttttcaaagaaaaacaaaagtttaaaagggttaaaaaaatatctagatatataaatgattaagaatcaagagataatcaacaaaacttagaaaaccactcaggagtattcaaacatcatggtctggggatgagctgctccactcgtatgggagggaggggtgcctccccgccgggccccccgcccacccccaccagcccagggagcccgggcagcacagggtctgactgcctggggcccagagcccacctctgcatgtttgccatgtctctctcctgctgatgcagcttcattctcaaggatgctatttcttgccggcagagcctgtaccgttcagggtcaatgttctgactgtttctttgggcagctcttaacttttcaatttccgctttcagttctaaacatttgtaaaaaagggccgattaataacatttgatatacagtccactaga

SEQ ID NO: 52254 - DNA, 754 bp, Bovine  19866880541244
ttgtgtgtctgtgtggttactgaacacaatacactcagtgcatgatcttcaaaactcactaaatctgatatctccagtttaccagcatttggggaataaatacccttgacagctgtgtttgagctgggttttgatgatgaactaggccagaatgagcctgcctttgaggtaggacatgtggtcccatctgtttaaggctgatgttgaaaaactgataatgagtgaccagacttgagtaatgcactgataacaagactgtttggaacagcaaataccactttaaaaaaacatattgagataaatgatatctccttgaatgcctggtctagtacttaggggcttgtttacatttttccaattagagtgattcattctcggttatggcttccctggtatctcagcagtaaagaatctgcctgcaatctaagagacatgggttcaatccttgggttgggaagatcatctggagaaggaaatggcaacccatgccaatattcttccctgggaaatcccatggacagagaagcctggtgggctacactccatggggtctcaaagagacttagcaaatgaacaacaatatttcttggttatattagtggcaagaaaaaaagggacaacactttagaaagaagagctaatcttccagggtaaagatatttttaagtataaacaatgatttggggggcaagagtaaatacataatcactttctcttctaacttcaatgttgaaatactggatgatcatgaaat

SEQ ID NO: 52255 - DNA, 2056 bp, Bovine  19866880800683
tactgtcatattgcatatgtgctcagttgctcagtcatgttggactctgcgacccaacagactgtaccctgccaggttcctctgtccatggaattttccaggcagaaatactggagtgggttgccatttcctactccaggggatcttcccaacccagctcgaatccacatctcttgtgtctcctacattggaaggcagattctgtaccactgagccacctgggaagcccattgtcatgttacttataataaatcctgtactggtatggaaagaagttctaccttatgaagcaagctttgtgtgtgtttctgtgtttgtatgcttgcatgtgtgtgtgttttaaagactcctacaatttgtgcaattagccagttcagttgctcagtcatggctgacttgttgcaaccccatggactgctacgcaatttgagcatacaaaaatctaactctacagaatccaaaattagccgcatgatcagtgagtgaactaacaaagtgatgataatcatattcagagcaataaaggagaagatactctataaagaagcattaatgagaaatgatgaacttaagctgtggtcaaaacagatggaaccaagcctgttgggtagtttcccatatgacagggaagctagactttgaatccctaaggtccagctctggcttctgtttatcatgtcacagagctttaggagaactttagaaaaattggattacaacacaagcacagacgtttctggaaagggtgtgggaaagccaagcctctttattttaatatgaaattaagtcttcatctctggttttgagttgaacttgctcttgttcaggttttcccgctaacacttgccttggctgcaaaactaagcttcaaggcatcaattaacatctcacactttgcctcatccgtctcctgcttgtcacctaacattttgcttgaatcactttcaaattctctctctgaacaaacctgtacttatcccatgattgggctctgacttaatcaagtcatgcttgttcatttattctttctgtttagaactgtgtctgggaaaatgaataccttttacttttaaattgtggattaaaaaatacaaatgtgtacaggttaaaaatagatatatattttgctttctgacactactttataaaaatatgggtaaaacaaggaaaataaatatttgaatgtgtcattccaggtgttatacattttcctcatagacaattttgaaattacttttaaagttagcattataatttttttatgttttgctgtcatagacacagatgtcatattctacaacaggtttgcgtttgaatataagaagcttttggtaacctgctacattacaaaaattttaaataaatttattatttaaagtaactttccttttactccttgaagtgttctaaatatataaccacatcatctacaagtgcagacagtttcacctttttctttccaatccttatgcctgtaattgctctattttcatctaattgtatgagtaattcttctaacacaatgttaaatataaggagaattttcccccatatttaataagaaagcccttagagtttctccattaagtaagatgaaggctttggaactcacacacacacccacacacagaatggatataagaatctttaaggatgtattcatcgattcctacttcatttagtctttctcacatgagtgggtgaatttttccaaatgtattttctgtgtccatagagacaatcatattatttttctcccaaactcaattaaaatgatggattataccaatgcattgcctaatattgatctatcctcgtatttctgaaataaaaagtatttggtcatagtttcttaattttaattactattagatgtatttgctaataatttatttaaaatttttacatcaatactaataggtgaaattgcctgtaattttctttgtattgcaatcattgtcaagcatagggaacaatgttaaacccactgcacagaaagaatctggaaatttcctaactgaaactatcttattcttaacagttgagttgatagacc

SEQ ID NO: 52256 - DNA, 1249 bp, Bovine  19866880937302
ctaattcatctgcagcattacaaacttcttttgtctctctggaaaagtgccaaccaaatacatgcgcatggatatgcaaagtagaggatggagacaaatatttgggaaatctgaaaaagttaggatcatggattaccctgaaatatactcattgtcatcatttaaatacctgtattgactgttacattgggtagctaatgaatatcagtgttctagaaaatttagaaaatataattgcattatcttatttctgaaaattctttttccttggtctatctatgacacaaagaaaataagtttgctcaagagatatgataataataaatgcaagacaaaagaactttcattcattaatttagacaacaaataaaaatctgaaggtaattaaagtaaaatcataaatgctctccactctacaatataagaaagagtctctaaatccccatttaattttttctatcatgtagaatatccagctgcaataaaagaagaaattttctagtctctgcttttgggtacaaaatttatcttttcttttttctaaaccctgaatatcatcaattaaacactgtcctcagagaaaatgcatatttgccctaaattcaacagagcttaaggtttaaaataaccagtggtatatgtaacaattaaaaataaaactgtaatttatcatactttattaatgaagatgactaggaaatgacttcttaaggagagaaattttccattcacagcaaaagtcattttctaagatagcctcccaggcctgtgtctactgaagaaaatttccactgtaaatggttaggcattgttatagtttaatcttgttatgagaaatgatactttggattcttgaggatttggagtgacagaaatacactgaaataaagttttccttgcatgcccctatagtaagaggcgtgggtttgatccctgggtcaggaagataccctaaaggaggatatggcaatccactccagtgttcttgcctggagaatcccatggacagaggagcctggtgggtatagtctgtgaagtcacaaagagtgagacacgactgaacaattgagtgtgcaagcgtgggaagaggatgaaccttagagcaaaaatacccatttgtttttgatgctatttaaagtaagaatgcctggccatcccatggatggaggatcctggtaggctgcagtccatggggtcgctaagagttggatacgactgagcgacttcactttcacttttcactttcatg

SEQ ID NO: 52257 - DNA, 1472 bp, Bovine  19866881032174
ttgctacctaccaacctgaaattgtctgcctgtgaccaagaagacgagagtcaacttcaggtttcttaagcaaaagaccattaataccctcaaaattattatccaaccagtcaattctaaagaaaatcagtcctgaatattcattggaaggactgctgctgaagctgaaactccaatgctttagccatctgatgcgaggaactgactcattggaaaaggccctgatgctgggaaagagtaaaggcaggagaagaaggggacgacagaacatgagatgattggacggcatcactgactcaatggacatgagtctgagcaagctccaggagttggtgatggacagggaagcttggcatgctacggttcatggggttgcaaagagtaggacatgactgagtgactgaactgaactgaacctcaaaacatagcacatgaaacagtcccttggtgccctgagaccttccctaagcactttttaattttctctagttccacagaataagaaggcaccctgtctctctagggttccagttccttggctgtgtaaaacagtctatgattcagggacggtgaatagaattcaacactctgtattgcctagagtccttaaaaactataagttcatttcatttttgcatgtttcttaattgaaagacaattcaaaggggaaaaaaaaaatgttggaaagggcttggcttgccaatgggtgagctgtacctttgctttcatggcatagcaagagaatgctgggggccttacctggttctgccattttgctatcaaaaaataaatcccattctgttcagtttgcaaaataatcaaacaaagtcattcatttcttaatttttttcagtttcatgggaatagaaataagttatccagattttctttcactaaagttcaggattttcttttcttccccaatgttttccatggactgcctcccccaccccacgctggtcccttctttgggagttaggcacaaagcaatagagacatactggacatattgatcaccaagtaaaacggtttccctggcaaccacaactcaatgaagcccatagaattgccttccttttgcatatgaatttttttctaataatttccaacaccacagatggcagaaactgatacaaaagtacctgttcaaactgtattgttgcaaaaataaagctgatttggcaagagatacttttctgtgttctgtggttagctaatgtatttctgattttagtataattcctccataattatgaaatgaattcattcctttgtgtgttgcagtatgtgaatggattagttttattactgccacaataaatcaccacaaacttagtgcttagaataacaagcacttattatcttagagttgtacaggttagaagtctgacacatgtttaagtgggctaaaataaggtgccagcaggaccccatacctcccgggggctcaaaggaggctcaaagggagagag

SEQ ID NO: 52258 - DNA, 841 bp, Bovine  19866881110360
tttttttttggccctgcagcatgtaggatcttagttccctgagtgtgtgtgtgtgaaagtcactcagtcatgtctgactatttgcaacccgatggactgtacccaggctcctctgtccacggaattctccaggcaaaaatgctgggagtaggttgtcattccattctccaggccatcttcccaacccagggatcgaactcaagtctcccatactgcagacagattctttaccatctgggccaccagtgaagccttaattccctgacctgggatcaaactcatgcccccagcattggaaacatggagtcttaaccactggacctccagggaaatcactgtgacatcgactgtactgaagatgaccttgaagagaatactgactttcattcactcagcatcacatatcaagcctttccatgaattcagaatagcaggacctactgagtttgacagggcagtccctggtcttaaagaacttcccccagcagttgaaagagcttattgcagtttaacatccacacagaaaaagaagtttttgcagagtgcagtagcagcttgggacatctgagcacacagtcctgagtattcaggaaaggtttcaccaagctggtatcatgtttggtgtatggaggatatggaagaattccccaggcagggaacagagaaaagagaggaaaggagtaatcttggtgcaaagataaatatgtataagagagcccatgtacctaaatacactgatgccttgtagtttaaaagcgtggtgcaaattttagaatggatgaccaggaaaggggtaggaactgcaatgggaagtgggactaagccagaggtaaaggtccca

SEQ ID NO: 52259 - DNA, 2395 bp, Bovine  19866881196386
ggtggctgtgaagatgacagggtacagaatggaaggctctcagcctgcgacccagcccacagaaggcagacaatgaattttcacagtaacatgactgaaagcattgaaagtgcctggtgtcacttgaaaaatcatttccctggtcaattcatcgttttcaagtcacacagaaattccagatgttcttgtaaaaaaaagaaatgcatcaaaacaggacctgtatctacaaaaaatctttatgggattttgccaggcgttacaaatgggggaggaactgacatctttactagactaagtctccagttgatcaacacgggatgtctctccagtgatgtggatcttctctgattgctttcatctgagttctagtgttcagcatatgactcctatatgggttttgttaggtgtgcatgtgtgtgtgctcagtcgtgtctgagtctttgggatcccatgaactacagcccaccaggctcctctgtccatgggattctccaggcaggaatactggatggagtatgttgccatttccttctctaggggatctttccaacccaaggattgaacccgtccgtctcctgcattggcaagcagattctttatcactgagccacctggaaagcccaactttgttgggtgtacacttaagtatttcatttttttgagccattgtgaagagttttgtgttttaaattttggccagttcaggatgcatccttatcattttccacctctctggacacaagttactaaggtataggctctaatggcttttctgagagtcaaagagtgtcagcaaaattaatcaaaagatctaatcagaaaaatgacttgtgcagtgtcatatggaattccagtctctatttaaggtagcctgttagatctgtttggcttggaggatgaaatttttctggtagacaaagcaatccaagaatggatccattacaagtccactatgctgtgatttctggagaaggaaatgggaacctactccagtattcttgcctgggaaatcccatagatcaaaaagcctggtgggctacagtccctggagtcacagagtcagacgcaacttagcgagtaagcaacaacaattattagacctgtggccaagaatatgttactggggaacccagtctttttttttttttttttcaagggctgaatgcttccattaccaatttctccaggttaatacttttattaattaaccagggaccactcccaccacccctccccaaaataaaataaaaaactgaaatagataaaaaagagctaagataaagtagattaatagagatgtaaaagaggatataaaattgaaaaacattttcctatatggataccaaatcctcctcatttgtaaggaatcagaataacacatttcccatggaaacaagaataaaactgaatccctgtcacaaacactattaattaactcagaaatctgcttttattctgtcttccaacggacatctgtataggaggaaactgtttctcagaatctataatcaggacagaaacaaagccaagtctggcacaaccaacaaattctttctcaattaatcttgataaagcaggagttatgttaataatccaataatttataattgctaactgtataaaatcttcactgtgtcatgtggatgtgttacagaatctagctttttctgcaaaatggtttctaaacatggaagcatcttatggggactattattagcttagaaactgactggctctaatttgaataatgtgaaatatacataagaaaagtgaacaaaatcccaaaggttacttttggttcaaaacagtactgtggcttcttttgtttatctcctttcgttccccagaccttgttaaaggagaagacaatagtaaaaagctagaaagagcacgagagacaaagcggatagacgagtagtaactaacctaatgggcctgggaagttaaatgctaagtgctaagtcacttcagtcgtgtctgactctgtgcgaccccatagacagcagcccaccaggcttccccgtccctgggattctccaggcaaaaacactggagtgggttgccatttccttctccaatgcatgaaagtgaaaagtgaaagtgaagtccctcagtcgagtccgactcttagtgaccccatggactgcagcctaccaggctcctccgtctatgggattttccaggcaagagttctggagtggggtgccattgccttctcctaaatgctaagtgtctagtgggaaatcccagggaaaagtgactgtattttcctggcatcctgacaccccaccccgcacaaagtgccaggacccccggagcaggacaggcccagagctgggggttagaaaccaagctgagaacatggagcttataagctccaagctcagtacggcgg

SEQ ID NO: 52260 - DNA, 1486 bp, Bovine  19866881208128
ggacagcatagaaaatgtataaattctcttttaaataaatcctgtttcatttccctggcattttcagagagtgttccacatgaagccaagactttaaagaatatgtctgaaagaaaaaaaaaaaagaatatgtctgactctttcatgtctgagcatattgagaaaaaaaaaaagttcgtgcactttcttgatgattccaacattaaaaatactggttattgtactctgttccaccaaactagcaaacaggaaacaaatgcacttcactaaacatgtttatgcttttgagagctcctagggccactgcaacacagaggatggtttgccttgtcttaagtggccccagctgctgggccgccgtcatttattatcaagactttggaccctgatgttccacaccttctcccgtactttacatgcaattttactgcaaaaggcacatatcttatgacaaagcaccagggattttgccagtcagaggcatgtttccttacttttgcattgcagcctatgttccaaatcgttaagaatgtcaggttcttgctgctaagtcacttcagtcgtgtccgactctgtgcgaccccatagacagcagcccaccaggctcccctgtccctgggattctccaggcaagaacactggagtgggttgccatttccttctccaatgcatgaaagtgaaaaatgaaagtgaagtcactcagtcgtgtccgactctgcaaccccacggattgcagcccaccaggctcctccgcccatgggattttccaggcaagagtactggagtggggtgccattgccttctccagtcaggttcttagggctctgttaaataccttcatgtcattcacaaatcctgtgtacatacaatacatttaacaatcacagatatttatttcaaatggtggttactatacctccagatacattaaaaactactatactattttataaaccatatatctattatcaaaaaataatgaaattgtatgcctgactgctgctaaaccatcccagtcagctgaattatcatattccttcattctgaatgcatctgaataaacattttaatgtttctgaagaaaagctgtgactaacctagacagtgcattagaatgcagagacatcaacttgccaacaaaggtccgtctagtcaaagctatggttttttcagtagtcatgtacagatgtgagagttggaccataaagaaggctgagcgccaaagaattgatgcttttgaactgtggtgttggagaagactcttgagggtcccttgatagcaaggagatcaaaccagtcaatcctaaaggaaatcagtcctgaatattcattggaaggactgatgctgaagctgaagctccaatattttggccatctgatgcaaagagctgatggtgggggaaagaccctgatgctgggaaagaccgagagcagaaggaagcagcagaggatgaggtgatagatggcatcattgacacaacagaca

SEQ ID NO: 52261 - DNA, 697 bp, Bovine  19866881212581
actgaattgctccttttatcacttacaattgaccattaaaatgaaatttatctcagagagacactggaaaaaagaaaccacagaagaaacctattgtctatctcaaaaaatatctcagcagcccatttccagtcattgcaggaagaaccactcaatattcaacttctcatttctcaatgccagcttttttcaaatgttatgataaacactctaaagtgacctatttcccctgatacctgagaaaagtgacgtgtcattccaaaatctatttctcctacgtgcacgggaagcgatgatacttctacagtcaccctgctctgacaggtgggaaaatctcttctaagtaaaaatctcaagaaaagagttactctgaaaaagatcacatcttctcttcaagttcggcaatctggaacagtgttcgtcttcgcctctttaacctgaaccagaatgttagactgggagcacccaggacagaccctcgaggggaactaggcagtgaagtgatggaaggattatagggattgtcaaagaacaggattatctcagagggacgtggcctgagacccccagaggggcaggaacacagggtgcagatcaggttttagactctaggggggtcggcgtttgaatcctgcttctgtgtcctcaagctctgtggccctgggcaagtcaattcccacttggtgcttccattttc

SEQ ID NO: 52262 - DNA, 1430 bp, Bovine  19866881222811
tgataaagaatcttcctgcaatgcgggacacttgggttagatccctaggtcaggaagatcccctggagaagggaatggcaacccactccagaattcttgcccagagaattccatggacagaagagcctagcaggttacaggccatggggtcacaaagagttggaccagactgagtgactaacacagacacacatgtgtgcacacacacacacacacacacacacacacatagaggaaagagaaactaagcttgtgctacaaaaatatcttctattcatgaggctcttctaaaatattacactatcacaaatcagtcagactcctcgcagttcacaattttaacagagagagacgttaataacacattcctctcaggaaacaagaatgtgtttctacccttggaagtaagttctaatttctaagtaacacattaggcaacacaattattttctgttttagtaacataaaggaattatgaagcatttagaaatataggcaagtcaaatgaaaataaaaggttttttccatcctaaagtctattcttctatgtgatttcatcactgtgattcatttttctctcttacggaagatgtgagttacctaggaaaacaacaatatacttaatagcaaggtatatccatataaactctgagactagattgtttgagagatttaatagcattattgaagaaattatgtgcataacagatgaaaacctaactaactaggccaataaaagatgtaaatttttttgttataaacagttacaaacaaagacaaatgctcagattcaaatatccagctttccaatgattttctggggaagcgatatcgattggctaagtcaactgatactcaagccccactctccttggcctgtcttcattagagtttgtggaaattaaatactttccagcctcccttacaactcatggcagccaagtgctacaaaataagatgaaagccaatgtctttgctgggatgaaggaagggacttctggaaaagtgcttggattcttgatagaaggtatccatgtgactgttccatccattttctttcttcctctcttcaagatgcatgtaattcttggaactctgcagtctcattgccattaaaaacaatgtgtaaaaatatgaatgactaacacattaagggatagtctaacagaaagattaaaaaaaaaaaaagaatttgagtccctatgatattggtgagaaatctaacactaaaatctaactctagcaaacatttgcctctagacttccttttatatgagaaaaataacttcttatcaatcagttcaaggggacagttagatattctgcttttttcaagttaaatcatttccaactaattttttgatcccaatcactcactgtgattgtctatgagacaatcattgtctatgagtcaatcattgtctatgagt

SEQ ID NO: 52263 - DNA, 1709 bp, Bovine  19866881242500
tattaagttaatagagagggaaaagacatacccatcttgtcaagctatgcagagaaatagatctgatttcctactgggaaattataaacatctctttctttcctgttgggataaaatcagaacccgtagttcatttcctattggcctgatactggctgcctctgtgtcattgttaatgcagaagggatgagatggtttgcgtgtcagaatcacaatggtgaaaagtatctgtgcacagaaagcgtgcaaagggcagcctggagacgaggaatatgagataatcagatgcatgtgttggttttttaactattttcaaagtaaaatcgtgaattgcataattaacatatgcttttcttcagatgcctgggtctttttctcacctgaatatgtcattttttgttttagctcaataagtatttattaaaagtcttttattttattgaaactatcagtggactctttttttgttacatgcaattacatgcttatcagaagcaggagatgaaaactatttaggatggctggtccatagggcaaaggaagaccacagaggcttcttataaagggaagtctacctccgtgaattattaatagaatgtgatggggatgagaagttccgaggggcttttcactcccctagtggatgtttgagagaaattacattcttgaaaaaggaacagactgtcggcaagtgtcaccaccactagacctgggataaggcgtggaatcacatccatgtatcctgagtgaccccattctcccctctgccttatgcagtgcaggtcagttcaccaaatctccaactgtccttcctgcctccttcctaacataagccctggtcaagtcctctggtatctacaaacacaatcagggaaaggatctcagcctcaccccaagggcctcaatggagaacccaaagtaaaagtaacatgtacagatttaacgggcctttagtagaacatcattaagtcactgatagaactacaagttcagtgtttcacagagcggaaacgtttcttccctggtccacctttaagtgtgcagaagtttgttcctttccttataatgactacaaggacgtgaaattagatatggcttgctttgcagccacgcaatgtctgtcacaactactcagctcatcacttcagtgcaaaagcagccacagacaatatctcaattaaaggggaggatggatgtgttccaactcaacactatttataaaacctgtttgtgggctatttggactgaagggcttagctcactgacccattgtctagggcattgagagcatatccaagagatctatcatagtgatgaaccatgggctcgaagctggaaatggatgaagtggatacacaaaggatgtgatcgattgcaaatggcttggagggcccatgggatcagtgaacaaccagaatatgggtgccggtgaacataactggagagagagaattgagggccagtgtgttcgctacttgacatctagttgttagacgggatgccctttggggtaagagccctatgaggacaggaacctggagccttggagctttgtgggcatcctttaaacgtcccagggctgagtctaggtgagaggaaggaggattgcaccgagagcaagaaaaatgctctcaaatcgggacccctggagtttttctaagtctcctttatagattgtcatgagcagcaaggtgggctgactttatagg

SEQ ID NO: 52264 - DNA, 682 bp, Bovine  19866880510464
gtctcctgcattgcagatggataattcccatcagagccccagggaagcccataaatccttaagcttacctttattacatagtaggcctgcgttttctcctcttctccttcaggaggcagcataacaacagtaagaatttcatatctattcttcagcttatcaattttacttagccgctcatgaaactcagcactaacatgaaaagaaaaattaaacactgaaaaacaaacaatatacttttttaaaggactatactgttcttagagaagacatctgtatttgtgttactactgaaacagtttaaataggttctcactttgaagttttacatttcagtttgaaaacaggaaatcagtcctgaatattcattggaaggactgatgctaaagctgaaactccaatactttggccacctgatgtgaagaaccaactcattggagaagaccctgatgctgggaaagattgaaggtgagagaaggggacgacagaggatgagatggctggctggcatcactgactccttgtatatgagtttgagtaggccccgggagttggtgatggacagggaagcctgtcgtgctgcagtcaatgcggtggcaaagaattggacgtgattgagcaactgaactgaactgaactgtgaaaggtctcagatttcaccctatttaaaagctagcaagtt

SEQ ID NO: 52265 - DNA, 1675 bp, Bovine  19866880595011
aaatcccccaactcagtggtttagtaacttgaggaaaagatgttatcctaaactgtttataattactaaatcacatcaggattccaaaatcttgggattgtttttaaaagttcaataaatttatagctttctaatgagacttgtaaaaactcatgaaatagttacttatctatattaattataaattggtattagaaacatgacttgttcagttttaagaattacatatttcttcatagaaacatagatgtacttaaaaaaaaaaaagtttgaatgagaagctagtaaagtctccaatgctgatttacagaacttttggattttctgggcatcatcagggaaagagagtcttcacatgaatagactgtccataaaacagatgcttacttaattaattactctaagttttaatttttattgtttgtcctaatatttctaaaatgcattgtactgtccctagtcacctgagcttcctgaacataaattaacttttctattatctcaggattgttattgtaaaattcagtccttaaactatgctaaaatattgtggtgtccttaggactactgaagtgtgttgacagtttgcctcctctcaaaatcactccaggaagttgtgctgaagaattttaaagtagacagaaactctattataatgttttattaatctgtttctacttaggccatcacttctctgcactgctgtcactgcacccttctcatataatcagctgcctaatattatatcagagtgtctgaatgatgatatctcctgatgaattaattgttccttgaatttggtggcagtagagttcctaaaaatctttttttctacctactttcaggtttaagcttatgttcataatcatttagttatgtgaaactttcttattatatctctaaaatcaaatcacagatgtaaatgcaatgtgaaatgttccatgactacacatgatacactcaatgtgaatttcaatcagtattgtacctgggtaaacaagaactcttgcttaacatttttgaagtgagaagtcatagcattaattcgatcttcatagtcacggagctgatcttgcatgcttgacctttcatcttgcagctttgataactgtaaataataaatgctatgatcaaccaaagtcctactaagtttttaccatattaaaaatataaaatcaaaagaaaataaaattttcatttactttgcttctttcaatatccatttgaatttctaaaatctactgatcttttaaatgttataaaatactgttgtgatttagagatagctgtgggaaaattagcaccataatatgtgaaccgtgaacttccagatgttccagctggttttataaaaaggcagaggaaacagatcaaattgccaacatccactggatcattgaaaaagcaagagagttccagaaaaacatctatttctgctttattgactatgccaaagcctttgactgtgtggatcacaataaacggtggaaaattctgaaagagatgggaataccagaccacctgacctgcctcttgagaaacctatatgcaggtcaggaagcaacagttagaactggacatggaacaacagactggttccaaataggaaaaggaatatgtcaaggctatattgtcaccttgcttatttacttctatgcagagtacatcatagaaa

SEQ ID NO: 52266 - DNA, 947 bp, Bovine  19866880617308
gttaaacaggctaaaagaaaatgatttcctgctctccgttgcttttctaatctatagctttagatttgttactggataattttagagatgtgatctttctgtagaggaataaacatgaagccagcctataaacagcagcagcctataaacctatgagaagctatgtgctttgtgtaggcaagcaatttcaaaacaatatgtaggtacattattaagaggaaaggttaaaaaaagcacagtatacagctaaaaatagatgattttctgtatcattttcgagatgtgatgattaagtacttgcattctttactttgtcttatcagcaaatacacagctgcagtaaaaaaaaaaaaaaaaaaaactccatttaccctataaatgtgatctgagagaactaaattctgtgtctacctggtttgggcttttcttcgtttaacaggttgatttaaggggagtatacatccaggttcagccttaatagttacttgccactcacatggtttaatttagtgtgtactgcaagttcatatagtgtccctggctaatttatatgggacacagaatttcctttcttcaagatttgattttaaaatgttacctagtttttaggtcacttgaacttgtttggttctcagtttctaaaataattcaggcctttctggctttaagtttctgtgacagtgtgctttatgtttgaaagtaaagatgtttccttttcagagaaaaatatcccaatgtgtaattttattattattagccccaatttgactcattaattcatctttctatgccaatagtttggaaagaagtgacactaactaaaaaagaaatggctcctttttttttttatcaagaattggtgtcctaaagagaatgcttatgtgtgcacactgcttgtagatatagaaagctaatataaatgtttaataccacaacaaatcaaatat

SEQ ID NO: 52267 - DNA, 788 bp, Bovine  19866880620791
ccttctttttacccctgaagaagtgaaaatgtaagtttgtgagagcattgtgactcttacttagagctactatggataacaaagaagactcccatcatggctgcactaaaaggtagtttctagaagtgacagactagaaaagaatccaaaaaatcttaaataggccccagctcatatagatgccaacaggcctcagttcccttcaccaaagactttctaaaattgtatgcattgcaaaaagtctgaagccttgtcttgatactcaattgagcattcaataccaagcaataaattattcaaatggaaagactgattgtctttaaactaccacatattcatgtggtttatgttttttttccctttatattgaaagtgaaagtattactcagtcgtgtctgactctttgtgatcctctgtccatggaattctccaggcaagaatactggattgggttacaatttccttctccaggggaccttcctgacccagacatcgaagccaggtctcccacactgcaggcagattctttaccatccgagccacctgggaagcccaaataaacaagagtaagaaccactcaggttctgacacaaagagataactctgaattagcctgaaattggataactgaggataatttaatagactacaaaagtatgggaagggttacaggaaatcaattaagcacagtgctttaatccagggtcggatggtggagcgtggtgagctgccgtctatggggtcgcacagagttggacacgactgaagcaacttagcagcagcagcag

SEQ ID NO: 52268 - DNA, 1577 bp, Bovine  19866880633537
aaacacatatagtgatgttaacatacaatgaaataataaatgtaaaaacacttgaatttttagagaaaaggttgctatgaacatataagaaggtaatgctgttaatgcacataatttataattctgggggaaaatgattgccaaaaaagaacagtatttcctttctagagcatattgtaaatatcagcagatgattattttcttacagcttattttctaggacatacattaaactaccttttacagccaagtaaaaactgaaattaagcactttgaatacaaaattatgttatatcaacaattttgcaataagctacctgcaaatatcaacattattccccaaagagttcaatttcagagctaaaaacatgatttaaatgaataagcaatttagaattcaaacctactaaactaagcagttatgttggtatagcgtctataattatatttacaattttgtggtgtgttttagagctactgagaattgtaaagagataaaataatatttgccctattaaggccacttctatcaaaggtgattttcttttatgttaaggctagataacttttcactcttcctgacttcaaaggaaaacacattattccaaatatgttttaaacttttaacataaaatccttacacattaaaccattaatatacggttggtcagtaaaatgtctcattccactcacaataatgtctcagtttaattagaccctgagaagtaatggatttaaattcaaatcctggccaacattaattatagaattcttaatattgtagcatgccctttactaagttcctcggatatgtcctgtgctaaataaaaaaggaaatgagcttctggggacaaaggactgattattgcaaaataatgtatgtattgatacgtggtacatcattctaaagtcttctcttaagactaaaaaaaaagaaaaacagaactttgaagtcctagaactttgaattttgaagtactggaactttgttccagttatctttttctatatgcatgggaaaccaaagaccagctgtttctaacagctgactcttcaacatttttttaacctatttaatggggagatcactcttccatgtacgtgtgtgcatgttcagttagtcatgtccgactctttgcgaccccatgggctgtagttcaccaggctcctctgtccatgggatttttccaggtgatagtactggattgggtttgccatttctttctctgtgggatcttcctaatccagggatcaaaccctcgtcccctgcatctcctgcactggcaggcagattctttaccactgaaccacctggaaagccagagttaggcacgactgagtgactgcagcgcacacacacctgggaagccatggtccttccttaatcctagttccatggagagttggtccacacacagcagctatggacactgccagggaagaagtattcctgggccatttcatggacagtaggaataggacatagcaatggtcgaaaataaaatgcacaggcacatctcagattctctccagacttattctgagatccttgccagcctcctctcacttcaattaga

SEQ ID NO: 52269 - DNA, 618 bp, Bovine  19866880731708
tggagggtcctggggctgggcaagatggaggaagggcaggcaagctctggttctgagtgcatcagaaaaccctttgaactttcagtctaaagtctgtgactataacttgcttcctctctcccttccttttccttccttccttctttctttttcccttttctccccacacatctccttccttcctctctccctccctcccttcttagttctccttttcttctttatttatttatgagaacctccttacatccttgtttcaaggtgttccaagcgcattttgtatctctctacccagttctactggtggtcattttgatattaaattctttaaatgcacagagagcagaatacaaagcagccagagttcacaatatagatgctaattagtaatcagcgctgcgttgttgcttagtcactcagtcatgtccgactctgcaatccatggactgtagcctgccaggctcctctgtccctggggttttccaagcaagaatactggagtgggtagccattcccttctccaggggatcggacctgtgtctcctgcattggcaggagaattctttgtcactgacccacaagggaagctcaataatcagcataggatccatataataa

SEQ ID NO: 52270 - DNA, 891 bp, Bovine  19866880735000
actgattagatctacatattttgaactctatttggagcatagattacagttctgtgactctgtcattaaaataagcagccccaaagtaaaatgtaatcacaatgaaccaaggaattagcatgaaatactaacttagtaattcattcaaaggacaagttagcttcccaagtgttagcttcaaagattgcagataataaactaaaaacataagcaaattgaaataaagtgagtgaacataactcttgaggctgatttaggtcattgtactccttcatatctttcccagtagataaaatggaggctgaactgctgatatcttaaccaggcatattaagaatattttatgaccaatacagtactagcactgacctagtagcatagacccagcttgccagagtgaggaagtagtgtctttgagggccttttggggcaggcatcaaccattcacttgctgatttgggggaagtctggtggattccggtgggggagactctacagccaagccagcagggtgagagtaggcccactcaagagcttgggtataggatctttactcatcagtaagaaaagagccatacagtgcataccaactgaacattatctttaagactgtcataagctttggataattgaaaaaaggaattgggaaagaatgaacattttgaggcaggagatagatgggttccaagctactcatttaaaatactcctctgtccatactttgagatagaaatgacaggaaaaccttcttcaatgaacaatccaaagaaatataggaaataacagaaggggaaagactagaaatctcttcaagaaaactagggaaatcaaaggaacataccatgcaaagatgggcataataaaggagagaaatggtaaagacctaataga

SEQ ID NO: 52271 - DNA, 615 bp, Bovine  19866880784028
aatgaaaaatattagaagtttaaattatgtattattttaaatttgctttctacacagcacgttaaaaatttaaagcaaaattcttttaaattctaggtgctgagtatgaggtaaaaattcaactagaagaacaaaaaagagctgttgatgaaaaatatagatacaaacaaagacaaatcagagaactacaggaagatatccaggtaaattctataggctttaataataagcccttagtaaaagttaactagcactattataattactctactcttgttaatatacaattttttatagagaagcagttagagatatctcacttaaatgagaaaaaagtgctcaaagtattaactagttaaaatcccagtgctaagccctgacaattacttggtaatcagtggataaattacagctaactacctatgatatcccctaatctttatttcagttaaatcctttaaaatcaccttaaaagactattccttaaaacaaaaatttgaaagatgagaaaacaatgtgcatggtaataagcaggctctatataaacattttggagaaggcaatgggcaccccactccagtactcttgtctggaaaatcctatggacggaggagc

SEQ ID NO: 52272 - DNA, 913 bp, Bovine  19866881016834
ctgcactgctaattttcaattatacacacaaatggctctcagattggaagaaaatggagtgcatggggagaacagtagtagatttctatgtttgtttggtagtgagtgtggaggcgggagaatgacatcttgaaaagaaagccatagtgaggagtcggtgtttgaacttcagaggatgcgccatccgggatcttagggagacctgtggtttccccgtttcgctctgggctctaaaaggcgtgaaattacgagttactttccttcttgggtttgctttttgtttgtttgtttgttttgagccgttacccactttatactgaaccttcgctgctgacctcgctactctgccttgggaagcccgttaggaatgacagtctcggttccccgggtacccctgccgccgtcataccaaatcccacagacgcttccgtctcctgtctcactgccttcgtttcccaccaaccgaactgtacttcaccccttactctttacttcgctcccgtcagctgcaattcctcagagccagagttcaatgctttgtattctctgaggaggtactccttcacccacagtaaaaaaaaaaaaaaaaaatctttttgaggagagaaaaattttaggaatctcagggtttttgtttcttttttctgaacaagattttgctttcagggatcctaaattttggtcagggatacaaaaatttctctcaagtgaaaacaggtgtcatgaggtagtccttattcggtttttgcggtgtaaattaacacacattgtcattcttttttctatctccgtgtcctgtcagcctgtttttcagctgatttgggaagttagagtctagggaggaacatgctgctggtccgaactcttactctttcaggaaggattcacgggtaacccatgcccagctccgccc

SEQ ID NO: 52273 - DNA, 2516 bp, Bovine  19866881205406
agaagtggggttcaattcctgggttgggaagatcccctggaggagagcatggcaactcacctcagtattcttgcctggagaaccctatggacagaggagcctggtgggatatagtacaaagggtcgcacagagtcggacatgactgaagtgacttagcacgaatacatatataaaatatgtaaacaacaaggacagactgtataacacagggaactacagtcaatattttataataacctatgatggaaaagaatctgaaaaagaatacatttttgtaaaaaaaagaatacattttgtaagtatgtatataccatatatatatatatatatctgaatcactttgctgctcacctgaaactaacacagcattgtagattagctatacttcaattttttaaaatggttttaaaaagatacatattattaatatttgtataacaaattctaacaatttagaaattaaaagcagaaggtgttttacctctttcccttctgttttttaaaatatttattcatttggctgcgccaggccttagttgtggcatgtgggatctttagttgtggcatctgaactcttagttgtagcatatgggatctagttccctacccagggatcaaatcccaggccccctgcactgagagcaaggagtcttagtcactggatcacagggaagttcctccattctttttctaattccaatttctagaaactatcttgctttctaaatatcattacagtatatttttcattttattatgaactttggtacaaatacctaatatagcattatatccctggtgtctcagtgataaagaatctgcctacaatataggagacataggtttgatgtatgcaggagacatgggtttgatccctgtgttgggaagatcccctagaggaggaaatgggaacccactctagtattcatgcctggaaaattccgtggacagaggaggctgggggctacagtccatgggatcacaaagagttgggcatgactgagcatgcatgcatatattggcatgaatatacacaaatttatttacacactctcagagggtttgattgtttctaatatttccataagttttgtagttaacatctttgtacagactttgtttttttgaatttaatttttttccccaaagcagaatcactgagtcaaaagttattgatatttttaaggtcttactatctaatgtaaaattgcttttgaaaaacattaagaacaatagaatttcaaatactggaattttgaataccatgactgataacagattctcaattcttattttgaggctctttctatgttattgtaaagccactttacacagttgcctttttagctgcattactttaactgcattgcctgtccaattatatcctccctgatgagactgattccaaataaaagttatttcaatctctaaaaagatgtatctattttaccccagaggaacaacacctgccaattttacatccttgggacatcttattggacactctctcagtggcgatcaagctttaaagtacataataatcccaaggatggggttggtggcagaagtatgtgtcagtatgcagattgtgggcctgaacgctagcgagtctgaatcagtagacttggcgtaagggccctggaatctgtatgtttaacaagggattctggccatgacctctcacggtacaaagagaaaatctactttgtggattaagtcactgattcctaatgtctgttttgtggtgaatagtggttgattgtgaaaagctagccagccagtgggtaaaaataaatgtgggcaatgcagggataaacatattaaatgggtttaaatatatattttcagaatttttagtatgctgaaaatgttttgtggatttccaaggatggcttctttgtagaatattccaaatttatatgattcactgaattcatttcattgtttatttagtttgttttgggtgggccacctattaacatctgatgttcctaggaacaaagtttgataatcctggattaaatgatttttctattacagcatttcccattatcctcttagtatcttgaaaaatttaataaacgtcccacaggcacatagctttttctaaaagtttaggcaaaataacatctttttattttgtaaagctaaattatcagggctgaactaagtgaattactagcaaaaaatgtattaactttttttctttattcaaatgccttttctgttcattctcttaataaaaaaatataccaaagaaaccttttttgaggctctccatttcctattagtgtctgttaactaagcaagatgcaatctagaagaacttcatgtaatagaaataaggcccacgtgaccaaaaatttaacactcatccaacaacaattgcattagaagtggcagaatcttcattgtttagaatttctgatgttggggttttattcaaagggttataaaaaaggtcctctgaaacactcccatagcaaattatttggctaattataactccttaaaa

SEQ ID NO: 52274 - DNA, 1379 bp, Bovine  19866881386936
taaatttcccggcccgtctttgctgtcgctgctccggagcgaacagcaggacaacccgcacttccggagcctcctggggtcggtggccgaccctgcccggggcccgccgggccagcagcagttaccgggcaggtaatgggacggcggcgccgctgcgagacgggagaggggactcagctccgggcttcatgaccgcagtccggctgctgagccgaggctgtgtgcacacgaggactacggcgccggtttcgagggcgggagggaggagggtaccttctccctgatgtgggcaatgcgggatgtgggttgaacttttaaatctagtactgccaccagaggcgcggattctttagctaaaatcctttggtcttctgtatatatgaaacagcgcggctgtgtttttaagtttccgcgccctccatctacagactggagtatgaggggatccctggttaaaactttttttcggaggatgtatggccaagagcttaggatggtcatgattgggcgatgaaagcagagagcagaaggttgtacgtactaaaaggttttgcagaaaaaccagttttcataaattttgttttctttttaagaaaagagaggagagttgacaacattgaaatacaaaaattcatttccaaaaaagcggatctgctttttgcactttcctggaaatcagatgcacctacaactgctgaagttagtgaagacaatgatggtgtgtttagtcttaaaattgttgcgttttggtttaacagcactttgatgaagcagaacacagagctgttgttagtaattttgttacttattttttcagattattatgcagtcatgccaccgttagagcaattcatggatatacctactatggaccggagagagctgttttttcgagatattgagcgtggtgatatagtgattggaagaattagttccattcgggaatttgggtttttcatggtgttgatttgtttaggcagtggcattatgagagatatatcccacttagaaatcacagtaagttactcaccttttaggtatttgattgtttttgataaaaatgtcatctcagtgcaaaaattatatcttttcatccagctgtaattaagtgtactctgcagacctagttttgagaattaaataagtattaatagaaaatttaagtacttttttactttttaaaaaaattattagtaataaaattagtttctgccactgtttctagtttgggggggtttggtcctttggctggcagaagtgggtcctgttttaaatgctcagatattagtggacctggtgagattagttagtagcctgggttatcttctagctgagaagtctttaattatttagtattcagcattagatacttgcatatg

SEQ ID NO: 52275 - DNA, 1108 bp, Bovine  19866881403930
tagaattctaatttctcttatttcaaaatatgctaattttatttttataacccataaatcggttcaaacttggtaaaaggaaccaaatcataattgccacactttcatgtacaaaaatggtctgagtatttaaatcccatgtaataatgttatttccataatgaaaatgggacacgctatttaattgtgttaatcatcttaatcatctttatattttgtgtgtgtgttttttttctttaaggaaaagcgttgaactaaatagcaattctttggaatcctatgagaatatcatgcagagttctttgggatttgttaatccaggagtagttgaattccttttaggaaaactaggaatagatgaatctaatccgccatctttaatgagaggccttcaaaggtatagtaaatcagtatttgttctgttaagtggtgaggtctgtggtgctgatgtgagaagctgcataactgaagaacatagttgattatcctacgcttggtggcagcaatatgccaaagtttgaatgaactaggttatcccttcttcttctggagtggagtcttatcagtgattgatgtgtgccgtgtgaccaggtagatgcagaaaaaatgtataagatgcagaaaatttataagaatttcgtgtatatgctaaaggaaaatactttttaataatagtagtcattcctgagagttcaaaaattttgcagtataaatgggaatacaaatttcttgcttgagattgagtttttatctgtcatgtaaagtgagatatagttacagtttgacttttattttctttaatagcaaaaatttctctgaggaggattttgcttctgcgttaagaaagaagcagtctgcatcatgggctttaaaatggtatgaagattttgtcattcaacaattgcattatttaacctaataggttaagttaaggcaagcatgcttatgtcatctttaagacaaaatttgtttataaatgaatttaaatgatacctttttgagattagcttttttatagataaaaatgctactatgttgtaaactttaaagatttacattttagccaatattttttaaatttgttaaaaaggaattagtatattatatc

SEQ ID NO: 52276 - DNA, 1709 bp, Bovine  19866882014736
ttcctcaaggttcttgtgttttgaaatattaagtggaaaattccagaaataaacaattaatgagtttttaaattgcaagttgttctgagtagcatgatgaaatcttacaccatcctacttgctcatgccaggggtccccattcactgacattgtctgctcctaacattcaaccatcatcaagctcagtagtccaggatcacccaaagcagataatccttcttttgacatatagtcagaagatcaaatgaagcctaatgctaagtcgcagtgcctggcattcacctcatgctatctcctcatataggcatcttatcatctcacaccatcacaaggagaaggtgggtatagtataataagatagggaaatcacactcacataacttttatttcagtatatagttttaattattctattttattcatagctattgttgttactttcttactgtgcctgatttataaattaaactttatcatacatatattattattgtttcaggcaccacgctgtgcccaacccttcgcaaccccacagagagcagcataccatcataggtatgtatgtataggaaaaaaatagtatatatatatatatgtgtgtgtatatgcataggatatgccatatgtgtgtgtgtgtgtatatatatatatatatatatatatatatatatatatatatataggatttggtagtatctgagatttcaggtatccactggaggacttggaacaaattctccctcacataaggaggaactgttgtatccttgttatctctttctcctctcacttgaagacttaatagatgaaagggtaggattttttttaagaaaaaaataatttaagtgtttgcattgaacgtctttatccctagtctgttggttttacgtctagtccatataacccagaattgaagctgaagacagtctttgtcacagcattctttgaattctgccccccacagccaggcatcatagcaatagtattaggactatctcaaaaacaagttatttatgctacaatttaaggcttatgccctcttgtaccctgagatacacagagaagttatttgtgttcacagttttgactaagccaataattggaaataatgacatccaaaagggctttaggatcttgaatggtacttgggagctaacaaatacttctcctctaggaagcaggtagttgggaaaaacacaacatgaagttttaggatgggtttgcccagcagccatattgtatcttccagggttagttgcagaagaggactggcagggagcactttggttccttctccaggggatcttcctgacccagggattgaaaccgtgtctcttgtgattgaacctgcatctcttgtatctcttgtgtctcctgtattggcaggtgggtcctttaccactagcaccacctgagaagcccctttggtcctacagaagagagcaaatagggattcgggctctctgccatgttttttggctttggggcaaatcatcaggccttaaaaaaatacatcgttctaatttactgccttttccaggttcactctttataaagatctgtctttctcaaatagccttcaatcccggaggaatgggttactggcagagatgagtaaggtgttttggacaaacaatgattcccccctctcaactagttgctgcctatcaagaggatagttgctctttctctcttcataattcattca

SEQ ID NO: 52277 - DNA, 1095 bp, Bovine  19866880385369
tttgatgacagtgtgcaaataaacctaagcatcttctaggccatcctgtaacgaacactgggcttgtattccttctcgtattggggtcaaatgattcctagtctggactaaggaggaagcccagaagctggctgaatggggcagcccccacatgcggtggaatgggtgtgctcagtccaaagaacctgccattagcagtcagcagcacaatgcacgttcccaacagtgactcagttttggcaaaagcacataaattcgtcacattaaagtaaggctattaattggatttttttggttttgtagttttatttgcatttaatttgaaaatttgctctggtttgatagttgcttaaaagaacaataagtatatagggtttagttttacatttatacatatttaaatagcattataattttttaatgtaacgcaatattaggtcttgagctttttttccttccagttctttgaaaacaagtcgtataattccattttgagaaatacttcaatgggtcatacttatgacgctgatttgtggggaagagtttgtcagtgacctaagagccccctgttgtatggcgtactgcatgccacaggtgcccaacaaactctcagtgcacctgaggagcaccctggggtcttcctctcattctgtcccctgctcattgggcagatgtaagcaagttgcagacttggtttccttacctaaccaacttggtgctttttcaggacttctttagctccttccgtctccaaaatgacagcctccagagcctgccagtgtctgccatttgtttacttttctaccacatcacccaccctgacccataaaattggattgtttttttcaatttcttggatatcactgacaacgctgccatgtttgagttcatccaatcaattttgttgaaacatgaactcacctttcttattggaagttgtaaagtcttttttttccccccttgaaagaaaagaaatataagaggaaaatgcttaacccagacctttgggcttatagaaatagtatatcccctttgaaaggactttaatatctcgcacaaaggctgctggcagaacgctgaggagcgttgaccgtc

SEQ ID NO: 52278 - DNA, 950 bp, Bovine  19866880417042
gggccttgccagcaacacaatcagtcaggtaatttgcatgaatagttctttaataaacatccaagcccccttatcactgttccctgcaggatcctcattagtcagtaacctaattcaagcttgaaagatttccattatggtgccctttgtttcttgcccattgcctaattttctgttcagcaggacattttttctgcagtccatgacttgtttcttgactgacatatatgatttttttttcctcaaaataaatgagtgcatacatgcacacagtccatttcccatcaatggtgaattcatttaggcaatacgataaaatgtcagaggggtgttatccaaacagcccctaaagttagctttaaaaccaaaatagagtgacttgggaaaaatagcagtcagtaacttgactgtgggtatatgtgaaggtaaatagacaatccaaatagcaatatcaatttaatcattgaattaatagttgtcatttcaccagtttaagaactcgattatctctcccttttttgcctaacaaatttgggatgaaatagttatctaaattggaatagatcacttactagaaaagtttggaatatttcaaaactctagaatcttacacagagtgctaagccagtaattttcacccctgactgcattttaccatcacctaggaaggttcgacggagaaggcaatggcaccccactccagtactcttgcctggaaaatcccatggattgaggagcctggtaggcttcagtccatggggtcgctaagaggcggacacgactgagcgacttcactttcactttttcactttcatgcattggagaaggaaatggcaacccactccagtgttcttgcctggagaatcccagggacgggggaccctcgtgggctgacatctatagggtcacacagagtggacacgactgaagtacttagcagcaaagctcag

SEQ ID NO: 52279 - DNA, 3319 bp, Bovine  19866880608007
tacttgaatctccttctagaaaactctgatgacaagggctgtgttctcttcctagtacagctttggtggcagtcactgttccaagcacttgccttggattgattatataatcaatacatggaagtcttaaaaacaaccctatatggtagttgttgctattattaccattttaaacatgatgaagcaaaaaggttaagtaacttgaatatttcagttcatatagctagcaagaagagttactgggatttgaacccaggtaatctggctctgggttctgagttcttaatgaatagctgaataaacaagtatacttgaactagtacagagttacagatgccaagaggcaccatgagtggctttcacttaggtgtgctctaagtgagtatgctgaattattgagatagtaataatcacatttcaccaaagagaaattgtgtgtatgtgtgtgtgtttctgtgtgtgtgagaaagagagtggggaggtgagatggagagaaagataacatattatcataaatttaaatacacaagatgcaagattatgacaagtcagtcaatgggatgactcaggagcggtcagaaatgtaaatatgcaatactgtgtcacaagcttttgaatcagcttgtctttgtcttttgtataataagagaggacaagaagtagtgtcagaatctacctgtggcttaactggaccatttgaaaatccctaggtgacctagcatggggaaaaggatttgagagttcacaagactcagagctgtttatattgtcagtggggtaaataaaaaagtaggcataattttctatttcaaactttatttcagagttttatggattgaaactctttattagttttccattgctgttgtaatgaataattataaacttagtggcttaaacaacacaaatttattatcttgtctacctgacggtcagaagtctgaaataagtgggttttactgagctacagtcaagtgtacagaagcctgcatcccttctacaggctctcaaagagagcctgtcccctccttctagagactgccagtgttccttggctcctggccccttcctcaatcttcagtgccctcagcagagcatcatcaaatctccattctcactctgactctatttccttcctataaggatgcatgtgattacattagcccatctggataattggtcttccttcagtggtaaagaatccgcctgctaattcaagagatgtaggagactcgggtttgatccctgggttgggaagatctccaagaggaggaaatggcaatgcactccagtattcttgcctgaaaatttctatggacagaggggcctggcaggctacagtccatgggtcacaaacagtctgacactattgagtaactgagcacatacctggataatctgcaataatccccccatctcaagactcttaatcacatctgtactgacccttttgctatgtaagggaacacagattccaggaacatcattcagggtggggaccattattctgtctatgatgactactaatgatctctaagaaaagcatgagtagccaaaggacatccgggttgagggcattgtagaaaataaatccaaagactcagatttttttattcaaacttacgatgtaaaaagaaactacttttaaaaagaattgagttgcagaaagggtgggaggaagtcttcccagttagaagcttgggactatcctatctcagttcagtacatatcaaagttactggccttctatacatgagactagactaggaccccacatcctctgacctgcagttaaaaaagaggaccatctctagatgtataagagagataagactatctggtgcttaacagaggaggtagaggtaaattttgtagtcatcaatgagcaaacttcaaaaaggttatttgagaaagagtcaactccagatctttcaaaaggatcacaaggtttttccaataaagcattaagggtctctcctttgctagagactttaaatttttttttttttctctaactgtactggcttgtatccctgacataatggaatggctgatctcatcaggatatacacataggcttgctcatatttctatatatgagaagtgacttttggtctaagctaaaacaacttctttataacttccagttcacatacaagtttgcaatattctccagttggtcccatgggatgaggccctcgatgagtgaaagtggaaggctagttaaatgggatgctttcctctgcactcaggaatatctatggagcaatttaacgggtttctctttgccctttatgttttttgaaatttttctctgttgaggcatgaataaatcctaatggacaagaagtgagtctacagcaggtctgtttcattctttgtatgtctcagatttccatgacatatgctccccgatatttcctttttcactctcacattagactttgagaggcagcctccgtagcagattaaaaatgggagaagattatgggattgaagtcaatgcatagttctctatggtctctgttttggtcttagttttgcaaccctcttcccctgaaaaaattccttttctgacgccctaaggccctaggtgaatgtgtttggagatagggcctttaaagaggtatgcgggcatgctaaatcacttcaatcgtgtccgactctttgtaaccctatggactgtagcccgccaggcttctctgtccgtgggattctcccggcaagaatactggagaatcagagagcttttcttgtatctgcttcatctcagctgctttcagcttaataattaaaatgtcaaagtggcatatttgggggtaatattcccttcctcaggggatctttctgaccagggattgaaaccacaactcttatgtctcctgcattggtagtcatgttctttactactagcaccacctgggaatccctttaacgacatcagttcagttcagttcagttgcttagtcgtgtccaactctttgtgatcccatgaattgcagcacaccaggcctccttgtctaccagcaactcccagagttcacccaaactcatgtccattgagttggtgatgccatccagccatctcatcctctgtcgtccccttctcctcctgcccccaatcccttccagcatcagagtcttttccaatgagtcaactctttgcatgaggtggccaaagtactggagtttcagctttagcatcattccttccaaagaacacacagggctgatctcctttagaatggactggttgggtctcctttaacgacataattgaggttaaatgaggtcattaggatggaggccctaatccaat

SEQ ID NO: 52280 - DNA, 2587 bp, Bovine  19866880672364
attctctagattgattatcagagcctaaaaagagagaaatgtgtgtttctcattttcctagctctgtggcttatatccttaacatctttgtttgttttcctgttgtcattgcattatttttcatacaacaaggtgtggcctgtcccatgtcactccctttggctctctgaatgtgtctttcccaatgtggggtgagggttccttgcaatgattcctattttctgcaggtcactcatataccacatgtccatgccaacagatgaacagagagggattcctttgctgatgtggccttaactaccctttaagggagagagctttgtatggtccagtccatacactggacctcaaagaagatttaagagtacattcacgagttcatgtgataattgcacactcacagaggaaggcaggagagttattaatttcccaatctagctgcctcctccccctgcatctcataataaaggcagatcttgggggaggtgggagtcagaagtaagaacttcagaagatgactctaaggctgtcctctcctctcctggaacatcttcctgcctccttttactacagccctctcacttgatctcaatatcccccattcttcctaagaaatctgcatttttatccaacaccataatagagtctaagggaaatactccaaggagaccgctcactttgagaagccatggctgacacaatggagccagtgacttagtgtggtgttggtgtgcttcccggcctttcctggcctccaactgccccttctcagcttccttttctgctcttctcctgtattctttcacctgccctcaacaccatgttattattatttggcggaaactgaaccgttaactttatccagacacgtggagttacatcaaaattcagagctgttgcactggccacggtggcatgttcccactttcacttcccacagagttgtgctgccctcagagagccagtgaggagcatcttattgggtgaggcccccacgtgccctccctgttccccataatccctcagccttcttccttctcaagttctaatgcctcatctctccatctgctgggtcacttctccctttgcttatcagtcttattgtcctcgtcacgtggcttaaaacccagctcatttcctccctgaagttcgtcctgctctcatgagatgtgcttctatttccttaaccatctattacacgtcttcttaacttgtcttatgttacctgtaacattctatcctaaaattaataataatacatacatatacagcactcgctctgtgtcaggccctatgctaagcccttgatgtaaattagttcacgtaagcctcacatcaacctttgcaagcaggtgctactattaccccttgtttcacagatgagtaagtgcaacacagagaggctcagtgacttatggactcacaccactgctaagtggctaagcaatggttcacacctaatcagtctggctcagagaccattctccaaaccattatactatggagcctgtctctatatcttgtgttttgtagctatttgtgtacttgccttacgattttattttgttccatctttgtattcttgtgtctcctagcacatggtactctccaaacacttgaaaaatggaattctatggggatgacctttttttttttttttaggagatccttgataactctaaattttgagaacccttaggaaaagctttcaatatatctgggaatgatatttctggtggcgataaagggcaaagcataaatttcttttggcagttagcattttctcatgattttcattttcctgcatacctttccaagcagttttcattttgttttacattttcttaagatatgttcacacttatattttaaacgatggaaagaaaaagatcacttgcaaatgccaactgggaagagtgtttattttaaacaatgctgttccggtgtaccagctgctgttgctaggactgcatactggttgctaggggtggtgaagagaattaagcttgtgatgtcaagataaaaagttgcttcaactccgcattctattggctaggattttctgtaaatgaggaatcctcagtcttaaaaaagtagaaatgtacttggtttcaacttgcacaaataaactacagagaaaattaattaatctagttattttctaagggtagaagaaaatttggcagttaatacagactcagaatttggacaaaagtttttaaagtttgcttcttccttgtattgtcaggattcttccgcagaacattcaggtttgcatctctcccaaagatgatatcagttcagttcagttcagtcgctcaagaggcaggtcaggtgatctggtattcccatccctttcagaattttccacagtttattgtgatccacacagtcaaaggttttggcatagacaataaagcagacatagatgtgtttctggaactctcttgctttttatatgatccagcggatgttggcaatttggtctctggttcctctgccttttctaaaaccagcttgaacatctggaagttcacagttcacgtattgctgaagcctggcttggagaattttgaacattacttta

SEQ ID NO: 52281 - DNA, 1079 bp, Bovine  19866880673099
acaccaactcatttactacttccaccattatagatcccaaagcttggaagacattgacttagtttaatctccttagtttttaaagtggaaaatctagatttcacaaagatgaattattgggcaagtcagccctggaacctatctcttgatccccattttccccaaacactttctccctgcaattaaaacaacacaaaagagggatgctttttagtggtaacctgtcaacttagggcatggtctatctgaactctcctatacttaggtaccgataatgcttttggtggagaaggcaatggcaccccactccagtactcttgcctggaaaatcccatggagggtggagcctggtagactgcagtccatggggttgctaagagtcggatacaactgagcaacttcattttcacttttcactttcatgcattggagaaggaaatggtggcccactccagtgttcttgcctggagaatctcagggacaggggagcttggtgggctgccttctctggggtcacacagagtcggacacgactgaagtgacttagcagcagtagcagtagcaatacttttggtaatggagtactgttgctttcctgccttctttgggtagattcactattccctttacatatctgcttgcttatttgtatatatttattcgtatttgaacacaacacagtgtatgaattttggaggttctcaaaattaaaagactgaattcaactcaacatcagcaaatcagcaataacagtaagtgcaattcctgctccactctcacccctgctccactgcctgtgatgaacagctggagttttactactacccagggaatggttcattttgaccttgtcagagttctacctgcttgctattcctagtatggtacctcttctcatcagagaacttgaagcaattattatattatgctctttaaaacctggctatttcccagatggctcagatggtaaagtgtctgtctgcttgcaatgtgggagacctgggtttgatccctgggtccgaaagatcccctggagaaggaaatggcaacccactccagtactcttacctggaaaattt

SEQ ID NO: 52282 - DNA, 1123 bp, Bovine  19866880699146
ccagattgttaggctgcaggaaaagggagttacttttgtagtgaagggtaaagtcctgttccttgctgtaattcctataacagtggaatttataaatatgggatgggggctcagaagaactgaacaaaagaaaagaagtctcctctgcctgctgttgtaagatgcccctgatgccacatttgatcttctcatggcccatgccaagctcactgattccaactggccacatgcctacactgtgccttattgctatgcatagactatgccttgttattccccctggagtgctttgatcacttttgccagcttattaccccatcccacctagcatcctgtgtgaaacttgctttggcccttttaaatgctggcttttcaggtcctttcctacaacacttggctttgttttgagaagtaaattcagacctgggtcctatgtgataagtctcgtgaccattgccccgatttgacccatctccggtggggttttctgatctgtaaaatgagtaagtcggctcaattcccgttagtctcaaagggacgctgatggtgcttaacaagatggtgcttcgagatatttggaacacagggtggcattatcacattattattttcacaagctgttcacctgaagggagaaaataaagagtggaaatttaatgccagagagggtttttggcactttgtcaattcgacattagctttgagggattttggaattttgcctgaaattttcagtaccaagcagctaaaagctgtgtttttctgggcttatgatattcctgtccccagggatggcattcagcatttgtgagggatgagctgtgccagacccattttccgatgtgccaccaacagacacaaaaaaaagcagtgcacactctgtgaattgctgcttgtacccacatttcacacttggaacagcacctctgactggtttcagcaggaaacggatgagagaggagtgatccacgtaggctgtgtgtaggaagctccctgtctgacacgtgggtggtttgtggctgggcagcttctgtttgagtggtcagatggaccctactgaaggtcacagaaccttttttagacctttcaaatttacccacatcacagttctctttaaagagag

SEQ ID NO: 52283 - DNA, 1173 bp, Bovine  19866880996314
tttgtttattcatcatacattaccggtttccttccacagtatgtaaaatccatgaccgcagggcacttgcatgtcttgtcccagagcagagccaatgcctttggtcacatagactataccatctaacatcatggaacgcccttcaccttgaagtctgtgtgaatggcccccctagggctgtgctgtctcctctatccagagccaagtgctgactctggcgcagaacagttctttcaacaataatttattattctcacttgaaaaagtgatgagaaattgaaaggttttgtgtcccataagtcgaagcatgtacatttacatgtgcaaactgattgcactttgacagatgactttttctaagttatttcttatagactggtttagttcaggtaagcttgtgaaagtcaaaccaataacacagtccaggtcttctgacttcccatgtcacgctccgtgtgcttgaggttcctggtcaaagtcaattccttcggaatcctcgtgcttgtcagggtctgagtctatgactggagtgacggtgcctgtgctttttgtttgtttttggcagcattcagcgagcatggcgtgaatacctgcagcggcaggagcccccggagaagcggagcccctccccgccctccgtgtcctcggacaagctgagcagctctgtcagcatgaacaccttctccgatagcagcacacccgtgagtgcacatgtccttctcatgactcggttggccagtcatctggtctccagggctttggctccaagagaggaatctggggatgtgagcaggtggtttgtgatctacaagttgcttgtttgctatggtgagggttttgtcatctcaaagatgtgggtcatgaaggcaaagagaactttatgaaggcttagggaattgactgcatttgaaatcagtctaaactatgcatttgtgtgttggcattcctctgttactttttacttttcttgatgatagtgtgttccttttaatctgtgctgttggcagccttttgtggcacaaataggatagattagcttggttactaggattttaaagagaactttcaggagaagaactgaaaggggtcttggattcagagattgcatcttaaaggctttcagggctgggtaagtaacccatgtgactgatggggagagttgtgactggctca

SEQ ID NO: 52284 - DNA, 1663 bp, Bovine  19866881017309
gaaaatgttactgtagtactagctcatagcagagaaataagacatacataaatatccagaatactgaaaagttaaactacaatatgtttcttcaaatgaatgttgtgcagtcaataaaaaagataagttcatttagcaagatggaaaaataaagcaggatacatttgacctgatcacacaacacaggaaccatgttacagataagttaaaagtatagacttaagatttggatccatcagaactcaattccagaaccttgccatacaacgtaggacgagttgtttaactttccgagtctcacctgtgcaatggggacagtgctcttaaggtcattgtggggattaaatgagcaaatgtggacagtgcctgggcaccctgccctactacctatgcagatgagcaaggactggcagggaatatggacaaggaaaaataatctatgcctttggtgggggaattgtggattatttttacttaaaaatttttattacattgcaaacataagtaacaactaattaaaaagtcacttttaaaatatcctacaaattaggattatgtctaatttagacaaccttccttcccaacaaatgacattactcagtgagtgcaccctgactcttcttagggacctcatgaggagagccgatgcttctgtgtttcctactgcttatgaactgttgagattcaccatcgtacactagtttatccaattcccactacatatatgtgaaacagattcatttgcaagctaccaggatacacacagagtcatgctcatctgatactgatgaagatgtgggctggtcctttggattcctcatgtggaaagtatcttgtaaccttccaggttatcagatcacacactcctgtttctcttcttcctctttgttcatcttcctcttgtcagactgaaattggtaaggcaaattaaaggtgcctacattatcccttgacctgcacacaatgtttccatactgaagccttacttctcatgaattttatttaggtgactaccttgctggatccacagtggaatatttggatcacagttttactcaaagtaagatttttgagcatgatttacctgaagtcattatgataaagttctatgtagtaagaaccaataataattatattggtataaattcttttcattctttagggccccaagactcagaaacttgtagagaaaataggcttctgagtctttaactcaagcagaaataaaatccagagttcagggtatactcaaggctgtcaacacctgctcaaatgtgagagcagtgctttgggcatgcccgagtctgcttagattccttttattagtgggggcatttaattaaatcaagacagtctttctgcctgaccagggcaactactgatgagaataaaattgatgggagatgaacagttaacagcaggagatacacgggaacaagaaataaaagagccatagtcaaaatgaagaatattgctgtagtatattatatttgacatttactgctgtgtctaataatgcgtccctcacttctctccagcagccacgtgatttcattatttcaaattttggaagcttttgtttttgaaaaatgacgaaaatctcagttctccattcctcattagagtgcatatttaattgggttcctctcttcattatatttga

SEQ ID NO: 52285 - DNA, 1669 bp, Bovine  19866881020815
aatctcctctgtggtattccattacatggcaaataccatcaattatttaaactttttctctggatatatatttagttgtttataggtttttaatatcacaaacaatgctgaaaacaatgactctaccacatgcctttgctcaatgatatgagaccatctataggaaaattcttagaagtaacactgagaggtcacaagagagctgcatttaaaatgttgatgatattacagattggcatctcaaggtggctgtactaatctattatttccctcacaatcagtatgcgaccttcaccagcagtgagtgtggactgtataagaaatcagtaggctgattaggtgcatgatatctgtgattcagtggacactggtttaaaatacatattcgtaggtcttagataccaagaaacttaagtttacttggtaaggaatggccaggctcctcgctctgagaagaaacaaggttgaaatgaactgaagctcataaagagggggcttaacactcatggagtgcttcctacatgcgaggcactgctctaagtgtttatttagatcaagtcatgcatccctcctcccaattctaagaggaaggtgcttttattattcccattttagagaccagaaaacaaaggcacagagaaatcaagtacttatcccatgtcactcagctgctaaatgacagagctcagatttgcacttaggaagtttgagtcctgctgctgctgctgctaagttgcttcagtcgtgtccgactctgtgtgaccccatagacagcagcccaccaggctcccctgtccctgggattctccaggcaagaacactggagtgggttgccatttccttctccaatgcatgaaagtgaaaaaataaagtgaagccgctcagtcatgtccaactcctagcgacctcacggactgcagcccaccaggcccctccatccatgggattttccaggcaagagtactggagtgggttgccattgccttctccaagtcaggtacttataaccgcttatgtgtctactcctgttgatgagctaaacacatgttaaatatctattctatgccagaaatgatcctgcaccactttgtcctcacagcaatataaactatccccattcctcaaagatattaacgtgacttgctcccatgacagagggacaatttgtactcaggcatgtctggttctgaagcttgtgttgattttactataccatgtcttcagaatgaaatgtgtcaatataaggaggctaacccagagtcattgatgtcaataaatagagtgtatctggggctgtatcacacctaacctttccttcgtctgacttctgcatagttagaatgttcatgtacttttaatcccttgcatgtgatcacatagtggcaattggccctctcccattaagagtgagctcaaattttccagtgtggaccaaaattgaaggcagaattaaggtcccccaattccaagtatcaacaaagcccatttaagaaaagtgacatagttgggtgaggatatgcagatggacgctcacactacagcaacatatatcacaagactatggcagcaacatatttttatctcagtgagcaattcactatcagtccatcagaaaatgaagtttggcactggttcctgagtttacaactgtacttctttaatgtataca

SEQ ID NO: 52286 - DNA, 1430 bp, Bovine  19866881044709
taagtcttaaatttattttaattatagtgagcaatctcctgaaataatattcccagttgtggaatttgatctggggatttgatctgttttgtatcatcttacatgatgatataggaaaataactctcaacatctctgatgaaccagcacagaaccaaagaatatatttggagcttcttacaaatccttaagatattgcatgcatagtgaatagagatcagtttcatttgaatgctttatcattcagcatgaaaacgaaacatcaaacaggccttctgcctctttctttggctgcgctctgcctaataggaaccttaagctctttctatgtcacctctgagataattaacatcactcagaaagtatctgaacaggagctgtagcagagagagcaagcactgttacttgggaaaagttgcaattaggatctgcaggcaaatgcagaattcttttaaattttacttcaaaccgagataaaactccattatcatgaaagaagtggtaatgagtaatctgatgtaaaatgtatgtttattatatgtagtataattataattacagttataaaactgataaacacagtcatagaaaatttggaaatgaaaggaaaaaaaatcccatcatcctgacatgacatttattgttttggtttattgccttctggtattttcttcctatgtgtactttttcatggttgcaataatagcatttatacattttcatgaggatttaaatcataacacttttccatgttgccagctttcacagctctcatttttaatgactatggggatgtcattatggggatgtgccgtcacttattaaaccaatcacctactcttggacatttttagctgaataatatttgacaattataaaaatcagttctgtgaacatcaagcttatagctattttccatatctagtctattttctcagaataaattccccaaagtgaattaccagaccaataggcataaaggtgtttatgattcttaatatatattgctacaatgttttccaaaaatgttgcaatttgcagtgacaaccagtggaagtgttgcagttcagtcagccagcacagaacatcagagtctaatcttgaaagcaggatctttcagtggttggttcctggaccagcagcatcagcataaccgggcaactcgttagaaatgcaagttctctggccagagacctactgaatcagaaactttgggagtggggcttaacaaaccatgctaacgagccctccaagtgattataatacaccctaagactgagaaccactggtctaaaatcagtgaccctcaactttcgctgcacataataatcacttgtagaacttctaaaaacctgttatgccctgagacacagttccaggggttctgatttgtctggaggaaacaaaggcatttgtattttttacaaggtc

SEQ ID NO: 52287 - DNA, 1060 bp, Bovine  19866881124825
gaaaaaaaaaatgtccatgacactggagtgagaagttgggacgcattcaagccacacagcctcacagtaaaagggccaacaatatgccatcacataaaatatattttttccaagtaaagctgttttcatatatagttctataaaaaaagaagtgaagacaaagatagttaattcatttattttttaattatgttacttcaagaccaacatgtcaacagaactaacctaggtttcactttttcatcactaagtcaatacaaataaagtaaataaacatgtaaataaaaattcaacattcttactaagcagaacccaaagaagaaaaaaaatgccctgtggtttcatattctttccttactcaggaaaattcattttataaagatttaagtgcaaatgtatagatttgcttgactattagcttggcttcttacagaaataaaggcattgtttcaaggtctcagagaaaagataattgtttgattcaaggccaagtaacaaataggtcataggtcttgttttcaggatctcagtgttggaagaaaataactgcttcttatataagaatcaatcactcttttatgaataaacctccaaattacttcttatgaaagaccgcaataaataaatacatatagaaaatcaagtatggactatcaggccaagagcatcagtctgaaacagagacgggaacaatctcatctgaaagcagtagaacatatccaccagggaaattcaggtgcaggtgttaaagattataaagggaacatgaacacacccacttgatccaacaaggcacaccttaacacaagcccatgctaatgaccaacttctccttactcaagtactggttaagccacaggccagtaccagagcctagttatataagatttgctgtttaactcaataaaggtaggtggacttccctgatggctcaaactgtgaagaatcttcatgcaatgcaggagacctgggttcaactcctgggttaggaagatcccctggagaagagaatggcaacccactccagtattcttgcctggagaagtccataacagaggag

SEQ ID NO: 52288 - DNA, 1182 bp, Bovine  19866881262596
actcatactcatgaaggcttgttttccctgtatgcttggcaggtttgattaaactgatctggtggaaattctgagggcctaaatgttagttgttttttgcagagaagattggagtttgcacctgctgagagccaggaggtttgccaatcttggaatgtttcaggctcttttaagagtccttgcttgaagcaggagcattgggttcaatttcttcacctggccaagggcggccttccagacatcttatcagctctggcttctggaaaattttctgactttgctccttcatttgtgtttgctgactggcacaatgcatgattcagctcatcatttttcttttttccctctcttggttcttgaggatttctcctaagctcaaaatgccttataaaatatgtttgtctaaaataatctatgagtttgtcttatttatccaagcatctagttttgggtccatcattttgctgaaaggggatgctacttttctccaaagaaaataatttctcctgtatatagtacttgaaatatgtaaaactcagagggcaaagataagatcttttccattaataaaaatcatagtgttaggtattcaaaaaactccatcaaaaatggttcacaacattcttttatttttgtcttgcattcttccatgaaattaatttaaattagtttttgttgtagcttatctattaagaattttttttttttttgctataactctagtcatggttctataaatacatctattttctaaattctttttgaaaatacatttttaaatttgtgaaatcaataaaacattacagaaaatgtgggaaaaactgtaactgtgcctccttgaccttgaactgagatacatagagcctaggtaaagaagaggtacaaggattcacctactcatggttcagtcttctgggataaacacatgggagaattcaggaagcctggcaaaagaaatattcagaaggaatcagagaaaaaaaatttttttttccttgacacccagagactaagaatgtctgtttaagaatgtctattcctgaacactgtcctagacccaccagtcaggatctgtagttttgataaattctctttgtgatgagttgctcacaaggaaattttaaaaccactggctttaggaatctcttaggaaagtaaagaaactagagtattaacatcaga

SEQ ID NO: 52289 - DNA, 1121 bp, Bovine  19866881325185
tggcttagatggtaaagaatctgtctgcaatgtgggagacctgggtttgattcctggattaggaagatcccttggagaaggaaacggcaacccactccagtattcttgcctggaaaattccgtggatggaggagctcatggggtcgccaagagtcagacacaactgaagtgacttagcatgcacatgcttattacaatgtagcataaatatacaatgaatagtacaaactcagttaatcaaagacagagccaaattcggggcagcaccagcagcaaggctgactcagtgttgagcccctgagtcaatagtcacagctttgaaatttctctcaattagaaaaaatacacataacaactgggataaaatctctaagggtcaattatgcggctatagctacacaggtcgaaaggatgcaggcaacaaagttcattagagatttgacaatagtgaatagaattgtggaatttattagaggtcaatacatcctaaatttttgtttcttttcttgcattgaagtatcttcatgctagagataatgaaaagataaattataacttgggttcagcttttacccctttaaaccagttttcttctcaaatagatccaagtaatggaacctactctctctcctgggtcttttttcccacccttgtatttttaatccatttctcaatctccccattttcttactccttctcaagagagtggtttcttggtggctcagtgagacatgggtgatcagtttttagaatcaaacgttagcttaaatgtgtacctaatgtctgttgagcaaagaaattattcttgttttctctttttaatgagaaaactgcactgtctcctctccatgttcaagttgaaagagaccttagagatcatctagtccagtcactacacacccaaacccacacgcctttccacaatatagagtccccttccatagcattcattctatgcagcccatccattctgtgcatgtatatttctggtgacaagcttactgttttaagggaaagtcgatgtcattgaatgacagtttcaaagtttaaaaagttgttcttattttaagtaaagaaaaaaattatcaatgaaactttcactaatgctcagcactagggtt

SEQ ID NO: 52290 - DNA, 771 bp, Bovine  19866881557837
ctggaagtggcctatctaatctacctgctttccccatcacttgggtattcctttctcgagaggagaaaatacattcgttattttaatgatgtctcttacacaaatttttttcttatccttttctcttctttactgtaactataatcctggtctttattatctggccaatttgaatacccagctaaatgattgccttcattctccttgctcactcccaccacaagccattctaaaacatcccatttatctcattttcctgcttcaagttctttgtttccctgtagcaacatttttcaaactgtagatcacaatccactgatgatttgttaaactgatttgttgggtcaccactgaccttttaaaaaatctgaaatataatttaaaaatatcagagtacattatatgtagttggagaattcataattcctgaaacttttgtttcagttttaaacacacggacacatacacatacacccattaccacatgattagatgtcaaatattttatggtaaccacagtcagtagaagtttagtaaagtctgatattaaaatcttccaaacggtgctttgtagtggcaagagttgagttttaatgtgatttctgttgagttgcacataacctctctgagcttcagatttctcacctctatgctatggaaaataatgcgtgactaatagaggccattgggagaactaaatgaggtaatacatgcaaaatgtcacaacagtgttttgtacacattgggtggctaatgactattagttttctg

SEQ ID NO: 52291 - DNA, 783 bp, Bovine  19866881840936
taaagcatttatctacagctttgtcatgactctacacagttgaatgacataactatttgggttttgaaggaaagttctaaaacatgaagaaaatcatagaatattaattataaaattaactgtttaggtatatggcatgaaagcaaaaggagtaacaaaataggaaatataaatagaccatgtgtataaatgtccttcttctactattgcatgtggaacagtgactgacgggctcaggggctctgcacagtaattccagagcttagtagagttctattatgatgttgaccactgactagtatcttgggatcttagatgaaagcaagttagagaaaccaaattactagggttcaagaactaaaagtagagttggcaagctctgatgtctcaagaaatcggcaagtgcaaaaaccatatgggacttttgacaaagtgcataacctttgtgaatttaaattacttaaactagctgaactagaaattttattcagtagatattagttttcctcatccctgtactttataagactaatgaaaagtcaataataaggttccactggggttctttggttgccagcagcagagactgcaaggctaacttagaggaaaaggaagaatttatcaacaggatatggctagctcatagaatgagcagaaaagctgaagaactaggtcttggggaaatggcatgaaccaaggcagagttagaggatgcaggtagtgaatctaagggtccacctgttccatcattcacaggggatgaatgatgctatccactttgaa

SEQ ID NO: 52292 - DNA, 3626 bp, Bovine  19866880413083
tgcagtgattttggagtttaggtgtttacaaaagatgggaagagcccaaaagagtaggcacaattgctaagagcagccaaactttctttggacaaagggttggaggagggaaaatatagggaggaaaagaactaaattagcctctaaatcaatgattctgacttatttggtgatagagttattgctgctagtttgcttccacctttagccaaggagaaaagacatattttagccctgcagagatgtcaatatataatcttgctaggtgagcactatcaataaaagcctaagaaattcggaggacagggttgatctgtcatacacagagctcctctctgggactggctagaaagagatgaggcttatgggaaaacttgttagggaaaaaagaggcatgtttcgaacaagcaaagtaaaagtgttcagccatttcattaacaactcatggaaggaaaaagtaggaaaacaagggttaaagatcagacaggatctccaaattggtgctttttcccactcttatgggtagaaacagaaatcacactaaagtgcagtgagaatatgtaggtggaatctctatatggtaagagttggtgtgttgctctacagtataagctccaagagggaaacatctagtagatgctaatccacaaagctgtccagtcttggccttgatcctaaaaagaagcagcaacattttaattcctccaaccaaaaaccagctttttattataccactaatcactcccactaagttggatagtctaatcctcacccacttaaaaatggcacaatcttaatccagaaggaaaggggtggtggtctggaggtgggcatgttttaacgtatcaccagcaccaagcttttcctcaccttttgatgaacttgaactttggatgaatcaatgtttgcaacactcgagggcatcataataatttgtttgaggtctgtttgtgatttgttggctgtgtttattaaagctgatataaaaggacttaatccctagggctttagcaaataaccactatcatttagtgggaagtgggtggcatgtcagttgtcaactctaatttcccctgaaacatgcttttcttattatatcgcttacatccaccagactgttgcacacaccatgaggagggttctaggggaacaggagacctagagctacctgatgagagaggatattttcctgggatatacaacatgtattgctttgatgtgaaagaaacagtaataggatgttgaggttattttttccctcgaatttttaaagacttcaagacaatttctgtgaaaaattggtatagatttttgttgcctatttccttcacataaaaggtgagtgaaaggacatgtgcaggattactgctatattccactaaatttaagctaaatcattattttatgttccactaaagagaagaaatgccattaattaaagtgacacacttttttcttatcactcagcatttatatattgttgaaaactactttgagactcattttaagtaaagattttattatatattatacttttctgtttctctgtcttctatgtgtatgataaaacttccatgccaattcatggtgtaatctttttgaagacgtttgaaaaaacaattaaattcacccccccttttttttttagcatcacctgtgtgtataattccaggaaatgacagtcatatgaatagctgtgacaaagtatgacaatgcataggctaagcaattatgtcacaatcgtgacctgattgcaagatgcatcagttaaaaaggtgaaaactttgcatcttaggatcaatgaaatacagcattgggggatgaacaaagcttcccactgtagagagtgtgggtgtgtttccataactctcctccatttttcccctaaggatatgctgccctttgaataagatattgtgtcagaccttcatgtttaagatgatgctatcatccatcatgaacttggagttgcttttctagttgggggagtgcaatagtgattcatggacactctttactcagcccccttgcctagaaatggccttgattcagtaagtgtattttatttcacacaattccaaatgcagaatttggatgtgtccttgaaacttgagaaatcttaacccaactctacacctaagtgtcagtctgaagatgaagacttgatttaagactttgttctttgacttaagatttctgatcttaaggagacaccacaggggacacagccttgacccctggtcagggaactaagatcccacatgccatgttgtacagccaaaagacagaaaataaaagacttctgatctgatcttgcaagcagttcttaaaagcttccacagtttcaatatttaaaaggcgctaaggttggaggtggagtttaaatgctaatgagtgtcaaactggtgtcaatcaaaaataggagaaatttggttatttcttctattgtcctcagtgctcactttgtcctccagcaaaaagcagtatcctttggagcttgaatcaaagaagaggaaggtagagaggagatggaggtattctgtgaggttatatagtcagtgggaaagtcccagtggtggaatggctgaaaggatttgcagaagaagaataccagttctttaatatttaaattggtctattttgctaagacaagaaccactccatttgtccaaattctttgtacaacctgctgtgcacacaaagatcttataaacaggatgtgtgtgatatggaaaagaaaacacaagagggtctggtttccataattgaggaaacttagtaccttttgaaaagtgggagtgttagctgctcagtcctgtcagactctttgggaccccatggattgcaaccctccagactcctctgaccatgaaattctccaggcaagaatactggagtgggtagccattcccttctccagggaatcttcctgacccagggatcaaacctgggtctcctgaattgcaggcagattctttaccatttgagccaccaggggacacaagagtaccttatggagtgaaggaaaacctcaacctaaatttattctgggaagccaagagttcagagtcacaagtgagcatgacaacaaaagtctattagatattctcagcaatcctggagaaaacctgaccaatttcctctaagtcacagaatgaaggtgtggagtattcttttctatagttcatgtgtcaccttgtccccaagtagcatctagtttccacacagttcaactcttatgctgggccagggaagtggactatgaacgggtgaggaagacagctggccagagtccaaacaagaagtgggctaccaagggcttacatggctctgaggttgagcaagatgttgctcctccttgggagccaattatgaacaaggaagaatgaaaagcagaggacccagatggtaaaaataaaaagaatttgtgttagaaatagataatcaggtcctagacagctcccatcttagtactctatttgtaggctccagcctcttggtccccagccgctgggttaccctactctcacttctttcttccagctttactcaatccaccaaagtatactgcttttttgctggaggacaaagtgagcaccaaggaaaacaaacagacaaaagcaatt

SEQ ID NO: 52293 - DNA, 979 bp, Bovine  19866880493186
taggtttttaaaaataagtgcttaagattctgtggttgggttcatccgatgccaaccaaaccggaggaaaagaaaacaacattgtcagtcaagcagttgcttgttccacaagacctcaaatacgccacttgacagatttgttttcttaatgaactgactggttactttggcatcacttaagagctgccgggcaaacagtgaaactcaatcagaactttatcccttttaaatgaagataaaagagaaaacacttaataattatgtcacgggacaatgataatgagcccacaaaaccctttaaaatatgtgaacataaatcagtttaccagagtagttgtgacccagccaaagagaagacttcatcgtcttgataaagaataagaaagatcaacccaatgggacaagccaggctcccaaagagggacagatacaaaagggtagatggacaacacagacacatcatcctcccaatccataaattctgttcttggtggagtaacttctcccggtgagccgttcctggaacagcaatcacctctccaggttcagtcacacaagttcgcaaagaatttggcacaatgcctggccaacagtaagtgctcaacaaaagttagaaaatgttctttctctttcttttcctgcttccagtcatccctagaaacaccttagcctaaataaacattactcagcatgttacgtttgagatcagattgctgttgctttatgaaaatcttaccttataacaggatttacctacactaggggtcacaaagagttggacacgactgagcgactgaactgaactgagaactagtgaaaggatctaggccagtgaatatataagaccaatgagaacaatgaaaaaagccttccataccaccttctatttcccttctatattgaaaaccttcacagttcaaacacatgtgagcttagtcagtcgtgtctgactctttgaagccccatggactatagcctg

SEQ ID NO: 52294 - DNA, 3053 bp, Bovine  19866880805973
ttctccaacaccacagttcaaaagcatcaattcttcggcactcagccttcttcacagtccaactctcacatccatacatgaccacaggaaaaaccatagccttgactagacgaacctttgttggcaaagtaatgtctctgcttttgaatatgctatctaggttggtcataactttccttccaaggagtaagcatcttttaatttcatggctgcagtcaccatctgtagtgattttggagcccagaaaaataaagtctgacatattagatgctaattaaaaaggcagatggggcaaaataatgaggtgagtgtgtgtgtgtgtgtgtgagtgagagagagagagagagagattgtgtgtgtgtgcattataagatagacctgagcagctttatacactaaggcaagagccagcagaaagggagaaagtaaagatacatgaaatagtaaccgtgactgatgaagtcagatccttgaccagatggaaggagacaggacaactgatgtataggttccctgtgaacaagaggaggaattttattcttctgagaccacaacaagcaagaggatgtgaactgggaagttgaaagagggtccacttgtctgaatgaagtaggttccaagtgcagaggacacatgggcttaattgcccagtatccatgcccccttctttgggtaagggaatcttgacttcccttggagaccacccctttccattctccaccgtctgatgcttaagtggagcacgtgatcatggcctcagtaaatctgagcaccacattctgccatctatagacaggtctaggcatgtgttacaactggagctaactggatgattggatgggatatttgctatggcaaaaaaaataaaatgattaagaggcagataaatgtttcccatagggtttcaagcaaagaccataggagttattttgttcctgtggtgggaaaaatatagagataaaccagaaggaatggaggtgagagagaaggtgagaaaaacaagtctctgtttcagagattgaggtttatctctgagctttatttgaacctccatcttttcctggacttttcagtgagtttaatcagtaaattccaatttgctgaagtcaacttgagctatgttttccctcatttgctgaaagagccctaaaccatagaatgaggttgtctgctgaaagtgaaggggatggggcatattttttaaaaaaaatataaagcagactgatagcataaacagcaaaaaaatggagctgaaccaataatcacccagttaggccataaaatacagttcagtttggctgaactcaaccatgctaaagtcaagcccgagtcaataatttggtgttttaacgttctctgtggcaactaaaagaactgattttttttttcatcacttaacaattgcctttgtgaagtatggaccgcctttggctgggctcatatgacacctaacatctggataaaaattgaaaaatgtgatgtcaaccatgtgtttggtcaaacacaattacaaacccctgggtagttagaaaatatctaataattgtttcatatttcatctgagtcatatgcacacagaatttgtgactccaaactttcacagttaaggaacataatctctgcacccaccattcctctgttttacaagtcagcccccagcccaaatgtgatgtcagcttttcccccactaaatatttcccctgtgtagtgtttccaccaaacaaatgcatcaaaatttcagctccatgagcaactgtttgtgttggagtcatatttcttatattttaattctgtgttgtatacattgcagtagaatgtagggtattccagttggaaggtgaatgtcaacttgaaagggcaaattcaaacctttaattttgccaagagcgaaactaacattcaggtcaagacagttaagtgacttgtaccaagttctattcttagctagtggctaagctgagatttgaacccatggtacggctgctgcctcttcctgtcataacccagaaatgttgctaactgtgcaatgttgcaggaaaggtcactttgtgactatgaacatccttagagctgctcaaaatagtgtcagtaatcactcaaatgcatccttctagccagtcaaaaaagtgcaagcttcagaaatttaaaatatttcttgacattattaaatatcttagcactatagccattgtcctgtctatatacagttcctgagatttattgttcaaatatttaataataacctcatgtggctacatttaaagggacttttatgtgaattagctcatctatgcgattctttttttatgttttgtttctggaacaattttctacatttgctattaccttgtggaatggaatgtaatataacaatcaaacacattcatgcaatatgatctcatttgcaattggcaggacagggttatctttattttatataaatgtataaggaggggagcttagacccttgtcttttgaagtaagtctcttacttctgagagtgacctgagattcaaagtcattgttcaagctgtagggagattatgatcctatgacttcttgcttattaattcattccattagaattataatagcaccaaatattccataacaaaatttccattacttcactaggtttaatcattagcatcaaatggaatattatagattcacataaacatgattctgagctaaaaaattgtacaaacaagctacataatttattgtgaattaacttcagaataaaaggttttgtcattttccccatgttttagagacaaagtcaagtttatgagttaaaataagacataaaaaaggggagtttggttcaaaaacctaaagaaatgaacccaaaatttggtaatttaagcaatcagtatctattttgcttttatttttgtcagaaaagataaaagtggggtcaagaatttagaagaacatcgtgttttaaaaacggtagtgttcagggctctcacagctttttaactgcaaggagtaatattcgtggttattatcaagcaaccaaccaattaaccaacaaatattcactgtgc

SEQ ID NO: 52295 - DNA, 1800 bp, Bovine  19866880819976
gtgttttcttcttggctttaggttaatttactaactgcatgcttttactctgggtatcatgctggaggtgactagatgttccactactgccaatttggccaacgatatgtctaccagcacgcccttctttttatccatcgtctttcttttcttttttgttttccttctctttttctcctgctccctgccagataaccctcttttccaggacctccttttactgatttccttatattcacagaaagtatgtaatgcccacatgagtgactatgggctccaaagttcagttgagggccctcaggggttaggggtatctcctaactccatcctccttaatctcccctgaggcgtgccaacgttcttcccacttcactttggtgtcacagaacagaactcatttcttctgtgcagtagcccatatggtacacattggtggctcctacattcatctcttactcagtcttgcctttggctaaatgcagtatcggtttgtgttgcctattttacagaggtctcaaagggattaagttttattgtgctaccaagtagcacaggcaagatagagagccaagcttttactctttctaccacaaaaatgctaccaggcacaagatagacagcttccttgctgtgtttttggtaactttcaattcataattggatcaatctattatgtttccccacattaattcccatgtttacaaaggaaatttacaaattagagaacattaaccttttaattatgaaattaaatacaaggaaattacagtttgaagattttaacagatactaaaatctggtttcatttaaaatacttcaagcatactttagaaaaatgtaaagatcaaagattttgtatatttacttctggttacaaatgccaggttattgtattatctctgttctggcttatagagggactttactatagtaacaacaaagagattttttaagaagccataaacacacaatgccaagataatagtgaagataaatgcaacaaaattattgcagaaagaaaatgaatgagagcaatagatttagcagagccaataaagctaaatgctaatagcagtaggtaaagctaaatagaagccatatttatgccacagaacctctaagaggttcaggaattggcaaaatctaagatttttggacaaaggggtgaagaaggtagagctaataaaagcattattgactgacagtcttcatgagatttccaaatacctacttctatatcaacaaaggtccatctagtcaaggctatggtttttccagtagtcatgtatggatgtgagagttggactataaagaaagctgagcaccaaagaattgatgcttttgaaatgtggtgtggggagaagactcttgagagtcccttggactgcaaggagatccaactagtccgtcctaaaggagatcagccctgggtaatcattggaaggactgatgttgaagctgaaactccaatcttttggccacctgatgtgaagagctgattcatttgaaaagaccctgatgctgggaaatattgagggcaggagaatgggacaacagagggatgagatggttggatggcatcaccaactcaatggacatgagtttgggtaaactccaggagttagtaatggacagggaggcctggcgtgctgtgattcatggagtcacagagtcagacactactgagtgactgaactgaattctatgtcccaaatctcagctggccgaatagtcttcagggtatactctgaggcaccatatactattttcatatttctatagtgaatgtaggcttccctg

SEQ ID NO: 52296 - DNA, 1348 bp, Bovine  19866880831816
tattagtcttctgatggtacatgtacttcatgcacaattttttatgtatggcatatttcacaatacagttttaaaactgcattatatactttagtaattataaaattattatctgatcctatggtggtgcagaatagacctcaaacagtaaaatagtaagcacttaagtttcacagaaagatatatgaaagtatagcccaagagatatattccaatgacttcaacaaattgggagagaaatttcgagatgatagaaatttcagaaaaagagattgatatacatatgtgtgcatatatatataagaaaatctatattttaatttgtggctgtctataaaacttctaccattcctgagtatacgcagagcatcagaaaagagccgaaagacagtcaagggtctggggagggttgcgagcagcatggtgaaggagagaggtcctccgttatgtttctgccctgtaggtatcaaccttgtgtgagagaattagaaacagcagttatattcacaatataaacatagctagtgatgacactttagaagtatgaattctgagtgaatataacagtgacagtgagaattgccacaatttgggtattcatctcattacaaggacatgacttgtcaaatgggatgcatagcatcgtggggacactgaagaccagaaatgatgcagaacaagatgatgaaagaagaaggtggtttgaacaaaactagtcatggactatctgttcccttaacacacctggctaagagttatgctgatggcctcttgtgttcatgtactcagttgctcagttgtatccaacttctttgtgacccccctggactgtagccctccaggctcctatgtccatgggatttcccaggcaaaaatactggagtgggttgccatttccttctccagggagtcttcctgaaccagtgatcaaacacacatctctttctttggaaggtactgagccaccagggaagcccaggattatcctagggatgtggaattgaaaacaatatcagagacaccactgtgtatcaaaattgttttaagtatattatctctaaagtaaatgttttactgttttataggttgcagagcttgctcagtggtaaaggctcaattattttcaaacaccttcatcatattcacaaatttccaagtaaagaaacccctccagtgacttctgtgaagggactcacacagggtggatccaactgagagctaaaggattctagatgatggcaaaggataagtaagcatcaagcttcctcgtggaacagtgcctgatacaaactgcttcttacctggacagagttacatactgttccttaaccattttttaaaatagtct

SEQ ID NO: 52297 - DNA, 1490 bp, Bovine  19866881013737
cagagatgtgtccttaaatatttcctcggaaaaattaatgaagtgaattaaaacagaccttctttcaagtcgttccaaatgaactcatttcatagcctttatcatggcttccctgccattggggaaatttatttaagttattaaaaaaaaaattccctaaaattctcagctgaaaaattggcttctgttttttctacaaagctaactcacctgatttgtcagaacagcttgaaaatgaagtgctaactggtgggttttattgaaaggaaaccgagtggaacaacatatgtattttcttaggaaactcaaaaagctcacagtcatgtggtgttcctgcgggtgaattctttgttatgaattacaacctgcttactgatgagttgttaataaaaagtaggcctgccgggccattatatttttccacacagtacacacagtttagttttctttttctttttttttaagttttcattaatgcactgagtgtgaataaatctgtttctaatttgtgattgttttcccttcatctggacaataatttattgccaaatctcacacttgtctatgactaccatcccccccaacaggaatgttttaatttttctttctccccccttcctttcttgccccctcctccactgccttgttctaaactgagggaacgtgagacacaaaaagttgcaggatggcagggttcttgtctgtggaggtcacgtccaaatatctggactcacgggaagccggaggtaacccaggcgctggtggacccgtccacgttcatcgtaagacccgccagctggagttgtttggagctgagaaaataagctcagggaaaactgttgaggcaaactagaaacagatggtaacctgaggtggcgggacaactttatttagcgtggcagttcgactttatttatttattttacacgcgcatctggtcgcgctggggcgccgctatgcatactcattattaggctgttaatagtggatctgatttgccaaggaatattagcaattaagttcactatgtattcaagtcgattcatattttagtgggcctttgtgaggcatgttagtggttagggttttatgtggaaagggcgtaggagctgccgtttgaagttctagtggtgtggaaaatgtgtatctaccaatttaggatcttaaagtggtcccaccaccggagaacacggtcaggttgtccataaacggccagcgggatgctaatgcattgctgtggatgcaaccttgatttagaaatattcggggttgctcctttgtggataggtggagggtaggtcctcccttattttcactggaggtttgagaacccatctagggatgggtttgggccacttaattcattggtccatgtctcctttctccatcaatagccccatcaatacttaaaatttaaaaaatcattttgtgacgggagaggcaatatgagaggaaactagatttgcacaaacaaaataataaactcagac

SEQ ID NO: 52298 - DNA, 1116 bp, Bovine  19866881284880
ctattattttaatatatattttaaaaaggctactcattattgttaattcagaaaacattctagtgtcattcatgttttatctcactttctctttctaaaaggtcaaagagcaataattaagaactaccaagtaccaagtagggcagctaaagactaaggaatccattctgcagaactggaaaaactcgtatttgatttacataaggatcctttcttttttcttcattttggttaaatataccagttgcagaaagcattccccataatattggttttgcttctccaaaagaaaagtagaagaattatgtactcttattgttataataatcagtgataataataaatattattaaaatagtaaatattaatgacaaatattatttaaataataacaaatattattattaagtatagtaataatatgaaggtttggttcttagtaaacaagatttgattatcaagactcttttccaaaaaccttgattgtgatgagtgaataaggaagatggctgaacatcctgtctttctgtctttcatgtagactgctctactgtggctgtgggtttcccaggtgtctcagtggaagagaatctgcctgccaatgcaggagacacaggttcaatccctgaaggaggaaatggcaacccactccagtatgcttgccagaaaaatcccaggaacagagaagcattgtgggctacagttcagagggttgcagagtcggacatgcctgagagactaagtgcacacacacgcaactgtagctgtacaatgaagaaaagacacgcccttcttgctttgttttcctgaaaagaattcaattgtgctatacatcttaaaaaatagtagaatctctcagtatgtatttcttctgtgtttgcttgcatgtgtgaaaaatgtctctataaacatttaagagattaactttgactcccccatttggttttaagctctctgaaattaaaaatgagccatttattttgatggaataggacataaaattgttaagccttctccttttatcactcagaactgtctcttaattctctcttaaatttatgaggtctttatatctgctctgttttctttccattttccttataattcgtcttccaa

SEQ ID NO: 52299 - DNA, 1373 bp, Bovine  19866881473765
cccttgtgtttctgactctattttttgacagagaactgtttttcttagattacttttccactaatatctattataaagaaagctgagtgctgaagaattgatgcttttgaactgtggtgttggagaagactcttgagagtcccttggacagcaaggagattcaactagtccattctaaaggaaatcagccctgaatattcattggaaagactgatgctgaagctgaaactccaatactttggccacctgatgtgaagaactgactcctttgaaaagaccctgatgctgggaatgattgaaggcaggaggagaaggggacgacagaggacaagatggttggatggcgtcactaactcaatggacatgagtttgagtaagctccgggagttggtaatggacagggaagcctggggtgctgcagtccatggggttgcaaaaagtcagacatgactgagcaactgaactgaagtgaatatctgcttgtttctaaaacacaagatctaattttaaacttgatattattctctgtaattttctatcagaagagagaaaaatatactcctgaggttccagtattggaacaactattgaaaatcctagagtctctgaactagaattttcaactcttaatgggaaaaaaaaggatttatgtggtgactggaaagactgttaaactgggcttcactaaatggatcagaggaaagttgaaaagtttctttatgtatgtggaatatctttacatacatggactatttttagggctgatcaagaaacatgcatttaattatctaatttttaagccagaggatgcagttgagctgaccaagggaccgctaagataggtctacctcttgttagagtttggaggccatccataattttggggcacttttccagttcaaagagctcaaaggcaactccagaaagcacagatgaccctttgtttactgttaaagtgaaaattaatgtttacagtgttgatcagcctgctgcatgctcagtcgtgtccaactctttgtgacccctatggactatagtcggccagactcctctgtccatgggattttccaggcaagaatactggagtgagttgccattcccttctccagaggatcttcctgaccccgggattgaatccatgtctccagcattggcaggtggattctttacccctgagccacctgggaagcccctctattgttgacacaagacaacaaaagatcctgaagcaacttctaaaccaaagaatccataaataatgtcctatattcttgaatatgttttaacactttttttttaattacacatttagtgtaacttcttaaccacaaaatcctgttcccagaccatctcatatgaagaaaaaggagcca

SEQ ID NO: 52300 - DNA, 970 bp, Bovine  19866882132913
ccacacttctgtccagaaaagttctatcgttgggattttcgtacctttatgaaaaattattgattttatctaatgtttagattaaagaaatgaggggaaatacaaactctttctctctcttttgcatttttaatctacaaaaaaactttctactgtagtatcaacaataactggatgtgttccactgtcttttacttactttaatggtgttcaatttaagaaaagctctgaaatgatttgattgaaatagggaaaatgctggagggtctaaaagaccttgttacttttgtttcagaaatgttcaactataactggctgaaactttgaaggttttaaagtacaattagtcctcgactttcaaatactatgagagttattcacttcctaactcctcctccagagaaggcaatggcaccccactccagtactcttgcctggagaatcccatggatggaggaccctggtaggctgcagtctatggggttgctaagagttggacacgactgagcgacttcactttcacttttcactttcatgcattggagaaggaaatggcaacccactccagcattcttgcctggagaatcctagggacagaggagcctgttgggctgctgtctatggggtcgcacagagttggccacgactgacgtgacttagcagcagcagcagcagctcctcctccctaccctaccttttgggagaacttggaacttttagagaaactgtgggatcatacaacaaagaaactgggaaactcaggaaaagttctgtgctgtgtatctccaatgaatgtttcctttgaggatccaggacatcagagctgcaaactggtcctttgaggagggtctgctggcatggccagaagtagcccgctataaacaggaaatgtaactgaagtctagcattttattcaagtgagtctgcattcaatcactaatacttctgtatttgtcttaatatttacata

SEQ ID NO: 52301 - DNA, 1792 bp, Bovine  19866880553656
tttaggagaatggtgataatgagggacagcaaccccagctatggcaaatgaagtggtagtgactgtgtttgaactttcaatatcctggtatctgtgcttctgatcttcctatctgtgctcctgcaagttcttaaaaccctgtggacaaagaagggtcatttggctttttttttggtttagtattaaatgttttatttgcaaacaaatttacaacttgtagttgacaaatcaaaattaaaagacggatagtgattaatttagagttcaacaacaaaatagttgctccgtaaatactcactaactggtgagagtgaaaagagactgaaactgatgtctcctgattctttgccctgtgacattttaactccctctttgcattttcctggtggctcagctggtagagaatccacctgcaatgtgggagacctgggtttgattcctgggtcgggaagatctcctggagaagggaaaggctacccataccagtattctggcctggagaattccatggactgtttcatccatgggtttgcaaagttggacacgactgggtgactcactttcacttttttgcgtttcctaaggctaaaaattcactattttaagtatgcatcatttatgccaaattttaaagtagtctttggtagctctaaattgagaaatggtctttgttgttttgttgactatttctaattgttcagttaactgtacagtgcatagtgaaaggacatttgcaaccacagtatgctaaagactttaatgctattgagcactattcttgacttacgtcatttttatctccacagagattggcccagtaacagttaccacagatcccaagaaatttcaatatgagctcagagaactctatgttcaggtgagtgctttcttttaattttatttcttttaggggaaaggaaaatcatgaacttttggctgatcatcttcagttttaagtctgaaagtaataattcttagtttttagattccaataccactttttctgacttgaatgatacacatggaattgggacagattgggttcaaaacaccaccttcatttatgcattgtctgtagctgcttccacgcaacagaggcagagttctgtagttgtgacagactggcccacaaagcctaagtgtttactgtgtgatgcttcagagaaaagtttattgacttctgctctagatgacttccagagaaggcaatggcgacccactccagtactcttgcctggaaaatcccatggacagagaagcctggtaggctgcagtccatggggtcgctgagttggacaggactgagcgacttcactttcacttttcactttcaagcactggagaaggaaatggcaacccactccagtgttcttgcctggagaatcccagggacgaggaagcctggtgggctgccatctatggggtcgtgcagagtcggacactactgaagcgacttagcagcagcagcagcagctagatgacttcagtggtaaatccgcttaccaatgtaggagacacaggagatgtgggttcaatccccaggtcaggaagacaccctggagtagaaagtggcaacccactccagatccttgcttagaaaattccatggacagaagaagcctggtgtgctacagtccatgggggctacaaaaagtcagatacaactgagcactagatgactcctttcgctgactcctttcactgtgtcataaggaacagttaatttttttcctgtaatcgttgtgctataattaggataacttaaaaattcttactctaagtcatctatata

SEQ ID NO: 52302 - DNA, 1584 bp, Bovine  19866880747935
cctggcaaggctttatctctcctgagtatttttttttttttttggtctgagtatttcttataactgataaaaggtttatctcaagtgtccagtgtgatttgcaaaaatgtatataaataagcttcaggaaatatttcctgtctttgttgaaaacaggtgggtatttgaatctctcgataattaaatgaaggctaatcagttctcctattttaatagcatcccctaatctctactattgaagacagacatgtgtcagggctatttaaaaaattgttattataaggaatgttcttgcatgtctgtactatttattttcatataattgatttttctagtattcttttattcctttctggttcttgagttttcaattctagaattattttagtattatgccatgtagaagcacagaagcgtggcttgatggtgctgctgacaatttatatgtcagggtgtaactgcctggtatattctttgctgttttgcattcctttgcaaaatatgcctttgtttagtcttgagggagtagtcttctccgattttccatatactcaggacatgacgtttacatagctaatgactgttcttctctgtatggaattcagatgtttgcattttcacacagtttctccaatcacctcttcattccttttgcatgctgcaagatgtctaatctgtggtgaagaatggagacatatttttgtgtaatttctaagaaaaattacatgggctatgacaagcatatcatgcttcctatccagtttacctcatttatttctaaaattctgcaatctgtttttgtatcacatttagcatattatagaaggcctggctcattaattattatcctttgaagtcataagtcctattctaacagtatgtgtttgaagctaatgtctcataaaaactaaatgttaagtatctttataattttgtattattatcttcattacataaaatagaaaagctttgatctaccctaggaatttaaggtgctatgtctgtacacatgatacttggatgaattttaaactattacttaaatatatggatgtttccgggcttccctggtggctcagactgtaaagcatctgcctgcaatgcaggagacctgggtttgattcctgggtccctgggcaagaaagatcccctggagaagggaatggctacccactccagtcttcttgcctgcagaattcctcctggacagaggagccttgtgggctatagtctgtggggtcgcatagtcggacacaactgaatgactaacatatgggtgtttccaggcttccctagtggctcagctggtaaagaatctgcctgcaatgcgggagacctgggtttgatccctgggtcgggaagatcccctggagaacagcatagcaacccactccagtattcttgcctggagaatcctcatggacagaggagactggtgggctgcagtccataggtcacaaagatttggacatgactgagtgactaaatacacacccatggatgttttctgggggaagtaattgatacctgtaaaggccagtttcagcttgtctattttaaaggttaatttttttttttttaaga

SEQ ID NO: 52303 - DNA, 1455 bp, Bovine  19866881028015
catgtgcagccagcagtagtttaaccctgagcaagatggtctgcctccctaggcctcttcccctcatctgtgaaatagaggtgatgttcacggtgtcttttttttttaacttatttttttattgaaggataattgctttacagaattctgctgttttctatcaaacctcaacctgagtcagccatagatatacatatatcccctcccttttgaacctccctcccatctcctgccccatcccacccctctaggttgatacagaggctctgtttcatggtgtctttcttataggcagtagtaaggattaagtgaaatgaaacgaagtaaaataaaattcatctcttgcttagaggccatagcaagcacccaatcattctgatctggtgtcattttcttaatcacacagcatattttcttacgcttggaccacagaaaggagttacaggagtctttcatgtctgatagaaaatcaagaggaatatgtctatgccaaacagagcagcacagggcaccactccagaagaaagccctgggtattaaaaagcaatgttggaattaaaacatccctacactgacaatctgaaagttataacagtcattaaaatatactctcatgggacttctaaatatcatcattgacctcgttaaaaaatgtaaatttcttgacaattatttctttatttaataaaatttctttctgctataacatagtcagctagccagcattacttaggaggggggaataaaagcaatctacaagtgtgggatgtagagggagaggttttggggcggggactggaaacggagacatctgaagctatcagctggaagccgtagacagaaaggattgggaaacagaacaagtgaatcacccactggatgatggatcttttgtgttaggttcttggacacaagaatataacatctgtgggtaactttgagatttcaaacttgaacttaaacctaggaagcattaattggatcactgacaatcacccagtttataaagaaacgaaaaacttagactgttcaggtccttttccgtcttcaaaggtgaattaagtgcatctctgagatgtgtcttaacttgtattgccaaagagtaataccacacaatgacttatatatccctgatgctcagccaaatacttgcttttctttggtttctcttttatgttaaataaagatgaaagatacctagatcttctccaaaaaaaatgaacaggaagaaagaaaaaaaaaattcaagtaatctcgagagagttgacacaaaatataacctgctcgtttaggaaactgatgaactgggttaggaggataaagcacaataatcaacagattcctttggaaacaaaagatgaaaaaaatcactctattaaaatgaaaggactcagtatgtgtatgacttcaccacagttcttatacctatcaaatgtgcagacatcattatagcat

SEQ ID NO: 52304 - DNA, 2236 bp, Bovine  19866881031869
ttgttgttttttgagcatttggttcacctgttttatccccataaaggtgagggcccttagcaggtttctgaatctagtgctctgttttcaagaagaaatatacctatgtcaagaatatagtactttgcattcatctcctggcatataagttaatagattttgtgtatgtctttgttgacagtaacataaatttagagctggaaaggacctcagaggtcatctagtccaaccaagtatcttttaaagccaatgaagaagtagtaggtttatttcatcatttcatacttatgcactgtatattaaaaaaaaaaaaaagtctttgagatgacctacaataaaaggcacagacactgtaaaacaagggcaaaatgacagaataatgaagggaaacaggtaaaaattatattaggagacataggaaggaaactacatttccgtctaaaacttagccataagactctttatcagaggaaaagtgaaattcaaatactaggtcttactatttagtgacagttgtatctacatgtgttagcaggcattttttaaggttatctgtaaactttcaagcagaatgtataagtctttaagcaagagacaatgagcaatacaacaaaagccgacaaaagtccatctagtcaaagctctggtttttccaatagtcatgtatggatgtgagagttggaccataaagaaagctgaacattgaagaactgatgcttttgaactgtggtgctgggagaagactcttgagagtcccttggactgcagggagatcaaaccaggcaatcctaaaagatatcaggcctgaatattcattggaaggactgatactgaagctccaatactttggccacctgatgcgaagaactgaatcatttgaaaagaccctgatgctgggaaagattgaaggcaggagaagaaggggatgacagaggataagatggttggatgccatcactgacttgaagcacatgagtttgaacaaactctgggagtttgtgatggacagggaagactggcatgctgcactccatggggtcacaaagaatcggacatgactgagtgattgaactgaactgaatatcaactgggtgttggagaagactcttgagagtcccttggactacaaggagatccaaccagtccatcctaaaggaaatcagtcctgagtattcattggaagcactaatgttaagctgaaactctaatactttggccacctgatgtgaagaactgactcattggaaaagatcctgatgctgggaaagacagaaggtgggaggagaaggggatgacacaggatgagatgattggatggcatcaccaactcgatggacatgagtttgaataagctctgggagttggtgatggacagggaaacctggcatgctgcagtctatgatgttgcaaagagtctaacatgactgactgaactgaactgaactttaaattcatgaccccagatctgaggtcagtcttagtgctatttgggattcctactacatttccttagtcaatgtctactctcattcttctaaatacattctaattttctctctcttcaatcttccaacatgccatacactgtcttcactctcgctctgtcttcagacatgaaacagaaggcaacagaaaacaacctccactccctcccagcagtctacttttctaacctaatctgagttcatatactctgcctcgtcaacagcttactttagatgtactgttccttctcttaagtcaacacgtctcatgccctagatcagccctatttaaagtgcaaaccacgggctgctactggttatgaactgttacctgtttgtgatgacacaagtatagaaatagagaataactgtgtatagtttccgtagaaacttttagaacaacctacagagttgattttacattttttgaatctcagacttaaaaaaaaatgggtcatatataatgtgactgtgttttctaactttgtgagtttgacaatgctttgtatgtattttgtaaaaacattggactttgacagttgaaggggaaaacatggtttttcctcaccagataggttgagaaacactgaacttgatcttgttctctttgtctctcatgcgattgtcccctctcttggaacataaaacttttccttaaatctgtatcatttccatcattatacaaataagctgtcctagctcccatgtggagaaggcaatggcaacccactccagtactcttgcctggaaat

SEQ ID NO: 52305 - DNA, 1507 bp, Bovine  19866881578057
atagtgcacaacaggttgcaggggttactggggttctagcaatgtgtttcttgatttggatcctaattaaacaagagagctcattttgtacattaaaaagagaaaaaaaagacatgaaatgcacagggcttctcagatggcactggtggtaaagaacccacctaccaatgcaagagacacaggagatgggttcaaatccctgtgccaggtatatcctgtggaggagggcaccacaacccactccagtagtcctgcctgggaaatcccatggaccacggacagaggatcatgtcaggctacagtccatgaggttgcaaagagttggacacaactattatttggttacgctggctacactttatgcatgtattttcaacctaaacaaaacatttacgctgaaaacttcttgtgctctttttcctaatgtgtatacaacagacaaatttgcattgaacaaggtataaagaaaagatcaacataggcatttcttcacatgggctaaatggttttgtcatcactaaatgactaatttaggctgctagttcaacataaaaactccctgcaaactttaatttgcatgcaaaaaatacagttactaaatcaaatcaaagttcttccaacaaagacttcttgagtttttaacaaatcattaatcactcttttttcctcctaattttacaagtaatggataaaacatttcaaggctccctacagaggcttcttgacttgaaaaattactcacattttagtgagaaggagagaacaaaatacacacaaaaatgaggcaagtattttgtgaaggaagtaacagacccaccatttgtgcctatttcttctgagcaggtctgggaatgtatgacagcagtttaataagaatactcacttcacaagaaggactggtttctcactaacatggaaaaaaggcaagtacagatacatttacattctataaaaatgttttaaaatgttgatgaacaagattccagttctctttctattcaacagatgaaatattaaaaagaagtgctaatgcacctacatccaggacagtgaagccgggcatgctgcagtccacggggtcacaaagagtcggacttgacttagccagtgaacaacaacagatacatctccacatagttgacttagccagtgaacaacaacagatacatctccacatagtgcatcattaggaagtcatttctcctcactttactaacatttcttacttgaaacatgacatgccctatgacattaatttcattttattgagagtgcaatataatttgtttcagattcacataaaaagtatggtacttttcatgtgtacttacaccatttcaggtggaaaatatataaaatctgaccttgtaattctttgcaaactaaagtggtcaaacatagaatcgttttctaacttcactgggacaaggtacaagaaaacaatcactgacaagagatgaggaaaacacctgatcagggggtttctctttttaccattatgccatct

SEQ ID NO: 52306 - DNA, 2073 bp, Bovine  19866880120006
atgtgagagttggactgtgaagaaagctaagcaccgaagaattgatgcttttgaactgtggtgttggagaagactcttgagagtcccttggactgcaaggagatccaaccagtccattctaaaggagatcagccctgggtgttctttggaaggactgatgctaaagctgaaactccagtactttgccacctcatgtgaagagttgactcattggaaaagactctgatcctgggagggattgggggcaggaggaaaagaggacgacagaggatgagatggctggatggaatcactgactcgatggacatgagttttgtgaactccagaaggtggtgatggacagcatgcaggcctggtgtgctgtgattcatggggttgcagagtcggacatgactgagtgactgaactgaactgactgacccagggcacaaacacacaaaaatagtagaaagcaaaataaccagtgggtcaagtttagactatccagtaccccaaagtcaatttctcccttataactgactccaattttattttcatattccccatttagaacttctcaacaaaataaaggttgataataagaagtgtttaggacattaccttaaatagaggaaaatggaattagatatattttggttagaggagcaataaaagacaaatgtgttgaagtaggtagagaaatcacacaagacggtcaggaccctgagttataaggcatggaaaggcatgagggaaatgtaaggtttagtctagtcttgtgcttccttcaatgttcttagcacatcagtgccaacaatttggggtatgttctgcagcttataaataccaatttataagcctgttactggccatcctggtagtaatggagacaggtgaagagttgtgggctaacattttctgttttaatgttgactataattctggtctttagtaattattacccttttaccgcttaaaaggtaatttttaaggggcttgtttttagcagcactatgcataatttattgctcatggcatgtcagttggaagaaagttaaaactttaaatactaacaaaataaaaggcattttattacatagagaaaattaacaaaaataagcaaatacgttttacaaggtgagtctttcctttagtgttgtatgtttgtaaaccactctcaatagcttaggaaagttttacaagaccattcctcctgcacaatttctatttctgacctttataatagtaagtaatctacaagctttagttttctaccctcctaacacctttcaaatatgtaagcctatgaagtcacagctcagcatgcagattgcttttcctacttttgatctatcaaaggcaattatgtagttaaagattatttgctcaatccaaaccttagctaaataatcagcatttccatggcccatttcagtcagaacatgtaagaagaaaatatcccaaggacaaattttctcttgtatctagtattatggatactaacacaaaaatagtttaaatatcatttttttggatgatagccttcaaaatacagagtatgctggcctctctacttggattctctaaggaaggtcactggggaagtccaattagtaatcagaatgtattctctgagcattcctttcacattcttactctaactagaatctggctcttccctgggggtcactgaagctctctcaaatggggacaacgcttttctcatacagctcttgtgctactgggttgtacatgggtaaatgatctctatgctcttctttgcagctctcagaccatcctcccttcccttttctcataaagaaaaaaaaaaaaaaaaaaagctttgaatctcagcagactgtgtcactctactgttcattattgctgtcattctatggcaatccttgtccccactcacagcctggtcatttcttctcattttaattactggctcacactcatactggtacttagactgactttctttttggtaagtatgtaagtgatcccgtaacaatttggtctctcaatgatttagggtttttcctccatcagtcttgtattttcccctaacttactactttctcttaacgg

SEQ ID NO: 52307 - DNA, 1977 bp, Bovine  19866880172799
catgtccatcgagttggtgatgccatccagccatctcatcctctgtcgtccccttctcctcctgcccttaatccctcccagcatcagggtcttttccaatgagtcaactcttcacaggaggtggccaaagtattggagtttcagcttcagcatcattccctccaaagaaatcccagggctgatctccttcagaatggactggttggatctccttgcagtccaggggactctcaagagtcttctcccaacaccatggttcaaaagcatccgttcttcggcattcagccttcttcacagtccaactctcacatccatacatgaccacaggaaaaaccatagccttgactagatggacctttgttggcaaactaatgtctctgcttttgaatatgctatctaggttggtcataactttccttccaaggagtaagcatctactgcaaatattttcaagagatacaaacttgtttactatttttcaaaaataagtgtgacttttgtagtgtgatttggtggaggcaggtatgatgagaggaaaaaggctcacaggttaaagcattacttctcactcacattttcccttcatcatttttctttccttaatgaatccccagagcccctgctgcattcaagaaaactttaaaaaataacatatgtttctgataaccctgctggattccttagtacttttagcatattttccttgtaactattgctgcaacatttgaaattcactgatatgctacttagctgatgcttccagtgtctattcacagtcacaacatcacagttcatcctcagtgaggaaccttatgaaaaaaacccctgattatgtaattgtcttatgaggaccaaggaaggagctaactgtggagtagaatttttctcctaatacatacatttaccatcagaatggacaagaaaagacaaaaaggttatacaaacactagctaaataagaatgtggtttgaaagttccccatcttccaaaggctgtcttaaaatgattttctgctatttctgtaggtaggtcacacattaactcattttactttcagatgtgtaaaagaattatgcatgaactagtcttctaggttatggataatataacataactattgaaagatagtgtatttttaactgataatgaaagtctttcttttcaaacaaactcttcaaccatccagttttacattgctgaaagagggcagctcagagtagagaatatccaagtgcacagtgataagccttttcttggcctccaatattctttcagtgaacagtcatcccatcaagaagtgttttttaaaacatcgagttaacacccagcactgtgctaagtgacagaaagtatatctagggcacgtaaaatctaactaagaagactactgaataattcaaaatggtatataaccaagtaattgatgagtgacataaaaatcatggattttctagaatttagaaattttctgttctcctccatttccttgaattatggaagaagaaactaaacttccatgagctggtaggaccttcccgcattcacaccttattggaggtaaattctgaattagaattcattactttttaatccattgtacagtgcttacctctaaaattcaaagacaggaaatataggtgttgctaaagttagctgtaaatatatatatatgagctaaaagctaaaaccaaatacttgtattgaatactccaaactggaaatggcattttatttatgaatgctctccaagttttgatgactacatgatgcaaggtatggtatttgacaattaatgcatttacatacatgctgcattcacctgggtttataagaaaatgagtgaggaaacagctctgttgctctagagtgctttcatttatcatcttacagatttatctctttgtttctttctacttttagaaaaataatcttccgtaccacatcatctatgttctaagaacatttgctcttctttga

SEQ ID NO: 52308 - DNA, 1329 bp, Bovine  19866880341495
cagaattttctgtatttctgcaatttgaaagagagggcaactatctcctgtgctttgagtgagcgctgcctgctggaagaatgtgaaaaacagagtgccctctgcttttgttgagctctccagtttttctcataacaggtgtatccagtattagtaatgctgataaaatgaccttccatgaagagggggtagttgaggggtttatgaaataaaagagacttaatacattctgtgtatatacttgcatgcatgctaaggcgcttcaggcatgtccagctctttgcaaccccatggactgctgtccaccaggatcctctgtccatgggattctccaggcaagaataatggagtgggttgccatgccctcctccaggggatcttcccaatccaaggattgaccccctgttcttacgtctcctgtattggcaggcagactctttaccactagcgccacctaggaagtccagtgtatatacttattcctccttcaaaagcaacgtttgaaagaaagagtaaaatatatagaaacacaaatttaaaaattaatgtaataaggaagcagatcactaaagctgcaggaaaagacttctgtgaatgaggaatgagatgctgcaatgtagatgctgcaatatagttttcctctagacagccgtctgagaattttttttttttttttttttcctctaagtctaagccttcatggaactgactgtacaggtgctggaagcattatgccttgagatattttgccaaggcagtggtgtttcattttatactaaagaaagccacattcttcctcatactcacacacaaaaaaatcacacctctattcagagcccaagttgtcatcggaatggaaaaggttggagttcatttatcatgtgcatttctatggctacagagataattgggttgattccatctagccttctgcttctctcgcattttaattgaaaagcctcccgagtgttagaagcacagagctggcctgagacatgaggatatttcacttaggcagcaatggaccaaaatgacaaccagaagacagcctaagcagtgtgtgggaccaggagcctgttatgtggctgctggaaactgaccagcaagggggcaggggtggcacattctgtacctggttttttttttttttttgcttgagaatactcacagatttcatttctggctacttttaatttaacatttttatcacagcttttccatcaggtgtgagtacccgaagacaggactgctctcagcctgaacaatttaaactgagtctggttgattaaaagaaaaggctcaagcccaaatggcactggaggcagcaga

SEQ ID NO: 52309 - DNA, 1799 bp, Bovine  19866880364149
atagatatccccttcctttcgagcctccctcccaaccacccacaccattctacccctctaagtcatcacagaacagtcaagctgggctccctgtgttatacagcaagttcccactagccatctattttacacatgatactttataaatacacgacaatgctatcatctcaattcatcccaccctcttttcccctcactgtgtccaaaaatcctttctctatgtctgcatctgtatttctgccctgcaaataggctcatcagtaccattttttctaaaataccagatctagctcagatcctgtgctaggtgcaaatgtactcatgtgagtactgtccaccgtgagctcataatctagctggggaatcatttataaaaatacaactctaatagaatgtaaaagccgctgtggttataaaggaataggatgaagtgatgaagaaaagacaacagtcagaacattcatggggagggattggtgctaaagagcagcctggcagagaaaaccagaagagccaagatagacacaacctaatcttaatttttctcagggtgtagtatggtatatcaaattttttgatatttaagtgtttgcaccaaaagggtggttaattttcatagttctcaaaggatgctcccaaagaagacagctcttaggtaaaaatgaaagaatctctctattataaatttgatttttcttatatttttttcttcaactttttggtaactgcttttgtcagctacttagaaatatctagcatatattaaagaaatcattaaaagcggatgtttgtgcctggtttgagtcataaatttgaatagtaaaactatccctgctgctgctgctaagtcacgtcagtcatgtccgactctgtgcgaccccatagatggcagcccacaggctcctccgtccatgggattttccaggcaagaatactggagtggggtgccattgccttctcccaaaactacccctagattttttctattaaagaattaatataaatcaatttccatgttattaccaaatatcatatttttcaagggctctgctgggtgaacaagtgtactttgcctgttaagaatgatcaaattcacccattctgatcagatttatattttatgtttcaaaactttgctatgtgccttagaccagcatacatgacacaacaaaggtgaacttattgcacatatcagtaatgctagcaagttcaagtcctctgactttttatggcatacatgacagcataaataatgcacacacacaaaatcatttaagaaactttattcttgaaagtatacaggagaaatgattaagaaaccccatgtggtttgcaggcatagcatatggcttatggttttgacactgtgaccaagacatttaccaccagctggtaccagtgtaactagttgcaagaaaacatccaggagtagcagaaccacttccactgctgaaagttctacaatacttatttggctaagatatagcaaatgtcgggcttcccaggtggcactagtagcaaagaacctgtctgccaaagcaggagatataagagacgtgggttccatccctgggttgggaatatcccctggaggaaggcatggcaacccactccagtattcttgcctagagaatcccaaagacagaggatcctggtgggctacagtccatggggtcacaaagagtcagacaagactgaagcaacttagcacgcatgcatgacaaatgttatttggatagaaatgttatacctatttggggaggaaggagagcaatataatgaaaagaataagcaaaaaa

SEQ ID NO: 52310 - DNA, 2366 bp, Bovine  19866880411510
catcaattcttctgtgctcagctttatttacagttcaactctcacatccaatacatgactactggaaaaaccatagctttgactagatggacctttgttggcaaagtaatgtttctgcgttttaatatgctgtctaggttggtcatagcttttcttccaaggagcaagtgtcttttaatttcacggctgctgtcaccatctgcagtgattctggagccccccaaaataaagtctctcactgtttccattgtttccccatctatttgccatgaagtgatgggatcagatgccatgatcttagcttcttgaatgttgagttttaagccagctttttcactattctctttcactttcatcaagaggctcttaagttctttgccttctgccattagggtggtgtcatctgtgtatctgaggttattggtatttctcctctcaaacttgattccagcttatgcttcatccagcttggcccttcacatgatacactctgcatgtaagttaaataagcagggtgacaatatacagccttgatgtactcctttccctatttggaaccagtttgttgttccatgtctggttctaactgttgcttcttgacctgcatacagatttctcaagaggcaggtcaggtggtctggtgttcccatctctttaagaattttctatagtttgctgtgatccatagtcaaaggctttggcgtagtcaataaaatagaagtagatgtttttctggaactcttttgctttttctatgatccaatggatgctggcaatttgatctctggttcttaggcattactgatgcatgcatgcatgctaagttgcctcagtcatgtctgactctttgtgaacctatggactgtagcctgccaagctcctctgtccatgggactttccaggcaagagtactggaatgggttgctgtgcagtcctctagagaatcttcctgacccagggatcgaacgcttgtcccttacatcttcttcactggcaccactaacaccacctggaaagccccaggcattaatgatatgaaataaataaaataagattcctgtgtatgtgtttctcatcatcttgtggagctatgtatgcaatgtattcccaaaacagtggtgtacagagaaaagtcattgctatagcatcctttgttttttcacttcagttctcatggggcaaaaactgagcccaacaccaaggcccacttactcagtcagacaatcagtttggatggagtggctgtagaatcttctagttttattgtcaagataatgaatattcaaatactgtatgtgagttgagagcatagacctgtcctgttagtgagtagacagcaattggagcaaatctgcttttctaaaacatccccaaacttattttgggccagtttgggtgagttcatgctgctgctgctgctaagtcacttcagtcgtgtccaactctgtgcgaccccatggactgcatcctaccaggcttctccatccatgggattctccaggcaagaacactggagtgggttgccatttccttctccaagggtgagttcatgagattagataaatcacagaatggatgactcagcgagagattgttgggacaggtaacaaaagaagacatctactagggacaaacacaacgaacatacaaagtgaaatgaaaggaaaccaatccttagacgtaaaaagtgagcctcaccactgacacttgacatatctgacaggactgtatcaacaagctgtgatgtattttctgttggctgttcctggtctatttttctctctagacatctttctttaaaaagaaaatccagatttctagggttgggcagagtgttgggaagaaatgacaggaggcaggccctgtcaaggaaagacattctctctggaaggaagtgaggggccagaagggaaaggctggctgctgcaggcaggcttcctcgtcgccctccatgtgtcttttccctcccacttctgtgggcactttctctcttggctcagggaggatttaggaaagtcacgacaaaaatcctgtcatgtgcgagaaaaggagaaaaagttttagatctctgccttttcacaaatggagagtttcttggaaaccgatgtgcagtttgagataggagctttgccttgttaaagtcactctaacgttctctccaagttcccacacgccctgcttcaactaccttaacaaaccactccctccccggccctcccctcccctgccactgccgcggccacccacacgaaatctaagttagttggcagtcagcaccatctgtcccagggctactacctctaaggactgttgatttatcatgaactgatctgagacatttcccctttgatcttctactggcaatg

SEQ ID NO: 52311 - DNA, 711 bp, Bovine  19866880433643
attagtagcatcttaaataatgcaattttatcttgtcagtgaaatagctataattaaaacaaattatctctttccattcatagcttaattccaatagcacatctgatagattcttaaaaaatgttaacttgtcttatttcaaaattaattcaagttagagtacagcatttagaaagttctcgtgtagggcaagtccatgagtgtttagctgccagggtgtctccagagtccagtttaatgctagcagagaggatgttgaatgcagtgaactatcccactcaggagaccacccataatttcaataccaagagctaattgttgctcagttgctaagttgtatcccacactttgagaccccatggactgcagcacaccagctttccctgtccttcactatctcctggagtttgcccagactcatgcccattgtgccaataatgccatccaaccatcttatcccttctcctcctgccctcaatctttcccagcatttagagttttttctgtctactttttgatacctatttttccaatcacatatgtgcaagcatacataaacaagtgtatacatgtataaaactatatgtttacacagttagttttacaaagcacaaagttgggtggctgttatagggcatctatgagaaatgccatgtgacaatgtgatgaaagaattgggcctatttgctcttaatggtcccaatagctgac

SEQ ID NO: 52312 - DNA, 1721 bp, Bovine  19866880502320
ctacttctttgggttgttgtgaagatgaaaggataagcacttgataatgttagttattatctcaggaaattgcttgctgagttttggaagaagctatgtacatcagtatggccacagtatacatataggaagagaagacttaaagcctgctgtgaagctaaagctaaatggaatagaagatgtgaaggttccagcaatgttagtgctctattagctcagggcaaatcagctcttatgggttctctctggagaggcaaagccagaacaaaaaatgagtcaagtgtatcgtatgatgcccacaggaaaaacaacaggcagagggcagttatgctttccccaatgcaataatgtcaattcttctctatgtgaaaggctaatagacaaaatcagggtcactatccaaagagcttagcgttgaaagaggtagttgcaaataacagctacagatgagaaataaggtcaacacagagtaaaattgccaattagctcgatataaaccagatgaaatgtacccttgaggatataaactggatgctacattaagaaatataagtatgatcaagaaagtaatgactgatagaaattgaagtgtgttaacaaattcccctggtgggagaaagagtaatgtatcctcctttctcctggaaaaagtttttagataatttcctaaactgacactttggtgttaagatttttatttttatttagtttcttttatgcctaagccacagaacttgactaacagtaacacagcattcaattacaagtgttcctattccaaacatatactcacctctccccatccatcaaaccttgattgaatgccagggcactgcatcatgtcctgaaacatttgaaatttgtcaaacaggagggaaaatgaatccctgagatatgggcttcccttaaaaaatgacttgttcaaatttagagaccatctggagaaggactagcctctttatctacgcccccactcgctcattcatcagcagctcttcctgtgctgtgaaggattaaaataagtaaataaatgaaaggagttctagcctctgtccttaaagaacttttggtctttagttaacatcctgccagtacaaggtagaaaggaaccgttcgactgatggttaatagttagtatactccaaaatatgccaacagctcagataaaaacagctgaatctattatgttagtcatgaaataacagcctcaaaaccaaaactgtttcttcattttgaacaatggtcaacttattactggtaataacatatatatgtatgtttgctgctgttgctgctaagtcgcttcagtcgtgtctgactctgtgcgaccccatggactgcagcccaccaggctcccccatccctgggattctccaggcaagaacactggagtggggtgccatttccttctccaatgcaggaaagtgaaaagtgaaagtgaagtcattcagtcgtgtccgactctttgcgaccccatggactgcagcctaccaggctcctccacccatggaattttccaggcaagagtactggagtggggtgccattgccttctctgatatgtatgtctatatatatgtaaatataggaggaagggcaaggttacagctttatcagctcaatccacatatgctgctgctaagtcacttcagtcatgtccgactctgtgtgaccccacagatggcagcccaccaggctcccccgcccctgagattctccaga

SEQ ID NO: 52313 - DNA, 1497 bp, Bovine  19866880549459
ataaacttgagtatctattgtttaagatacccagtctctggtattttgttaaagcaacctggtccaactacaacaatagattatatgtggaagagtgttgggagatgaggccagaaaatgttacaactatctttttctactagcgacaaagtatataaatgtaaatattgtcactaattttaactgattgttagttcttctacgttaagaaaaaaaataccctgttattttgtgggtattataataacttaggagtatgagatgatttggaaattttgggtgattatactgcaaatgaaagttaaatattttactacactattccatccatttggagatatagaccatgtggagaaagtagttgttttgtctttaatcatgtgccatttataagactgcataacgtgcctaacaatgtaaattgaaatgtgtgtaaggaagtggaaaggtaagtacatatgtgtgtgtgtgtgtgtatatatgtatatatatgtacaaatggaaactaagtcttaactcacacatacagagcaatgcaaatggtatttttctggaagaaaatatcctacttaacattatcctcttgagtgctgctattgttgtcataggaaattattgaacatatagtagtatactctatgcttgggagaataaacattaaatgttccccaaaggtattctccaattatcaatcaatatatttaaaacaaggacataatcttttacattcacacataaggttttgttcagaggttaaggaaaaatgaagtatataacaaccaaaagacaggttgccttcaaaaagtgattcatgactttggagaatgtataattgatgtgtggttgtctggatggtaaaataacaatgccatccattaaagacgggagctctaacaactcaggcagggaggcaggatgtattttataggtcacctgggttccatttggatctacaggttgctattccttctccatacttgaaagcatttaatggattattataaaaggaaaaagatggtatgcaataatggtttaaattgaagctctgtgtgtatatcaccactatgtgactcctaaacgagagcttcatttttaaaatcctcatatggcatgcttgagagtttgcctgagcatggaggaatcaaaacaataaattcagcagtgagaaagaaggacatagagtgctggggagaagcggggttttttcctttccttctatctttctccattttggcatccacgactataaatagtgaaaatcttatcagaaaaaaaaattgcaattttttatgaactccaaatgagcagtaattgggtcatgttttttaaaaaacacattgatttggaaaatggggtataagatgaaatgtaaaaatatcgtaaaagaagctggggggaaaatcttgatagtaattgtgagtgaaaatcaaatcaaacagcaactcatctggaaaatacctcctcctttcgaaattaagatagctgcagggggagact

SEQ ID NO: 52314 - DNA, 2897 bp, Bovine  19866880562709
cggcttggtagattgatctgctactgtaggaacagcatgtgaatgaaattatgtcttgccacttgtcatgcttgagggaatttaaagagaattccacagctggtttagtgtatgatgcttggtatgcagttccatggggactgtgccacaaagatagctcttattatttaatcatccgttagtttgtgcgttttcagaaacatacaccctgcactaaacaggggtatgcccatatcatcttaccgcttgttcaaggtcctgttaaaactgccctttcttctctgcaacctccattcccaactagcctgagaaaaaccaattatttatcttttgtattaccataggcttctatacatacctttagtatagcacttaccatattgaagtgtgtatttgagtctccctaaatatattttgaatcccctgggggtagggatcatggcttattcatctttgtgtctgcaactcctagcacaaaacttgacacatagcagatgcttgataaatatttgttgaaacaaaataaaatatttactatagttcttcattgaaactcataaaatttgcacttccttcctccccagatatttaaccatctatgtgaagggaaaacttgattcagaataatgaatagacaacattgtactatacagggctggcctgaaataaaaggttttctagcttccacttttctcactcctctcaatggctctagtccaaatcacctatgacctacattctaaatatagtaacaaggattttccagccctggtcttacctttctgctctgccatactgacacagttaagtggtttgttcttgtactctgcctttgggaattctctcatggatttccatgatattgctctgttgcttttttccctaactctgtgattgttccttaatctcttagcaactatcttcttctttctttggcactcttattttctcattctacatgtggtttttggggggaaatcattcctgctcaggttttaattattatctatatatcgatcacccctaaatctctttactgaactcagaattatataatgccatcctcctacatgttcaaagagaacctcaatataacctcctccccaagaaacagaatagcttcctatggtacttgttatatcacaattttagttctggcaatcgccccagctagaaatctgggaggtgatgatgaatccttgtgtctcccagatatgatcattattacttgttgaaaaaccctctcctttctacactcacattcatcacctttatgcaccataatagcttctatttgaccctcctccctcccatgttccacagtcttgccagccaagtccctccaagatgttagttgatgatgtcattctcattcttgaaatctgttaacagattggtactcttcataatgataaggaaatctaaattccttagcacaatgtaaaggctcttcataatccagaccgtttcctgttcagccttacgtcttggcctcctcaaatttcagctctaagttccttccaagcttccttccaccttccaaaacactggtggctccttaacatcctgcctcttcagatgttgcttgtccacctggagcatccttatcccatttacgtttcatatggctaaagtgcccttcaaaaggtggtaatcaatcattcacattgaatcaacacatatttattatgtgtttgagatgctgtctgggctctggacataattgctgaacagagttagccctttttctcctgaaggttacattttaacagaggagagagtaattaagcagataattatactaataaatctatgattataagcttaggcaaaggtcctaaggaaaaataaagagtatactgaaaagtgttgatttgtcaagctccctaactaggctgtgagctaccttaagggcatgaacttcttcattattcctctttatatttttagtgctcaaaagggatttgatttccagaaggtgatgagtggatatttctggatgagtacaagttttatttcattagttcaagaaatggtatatgtgaatagcctgttgcttataattcaatggaataaattatcattttttaatttttttaacttttagaaaaaaattaaattttgtttatttttgactgtactgggtcttcatagccatgtgcaggcttctcattgcggaggcatctcttgttgcaaagcttgggctctaaagcagagactcaatagttttggcgcacaggtttagttgcttaatggcatgtgagatcttcctggaccagggactgaatctgtgtcccttgcatcagcaggtggattcttaaccactggaccaccagggaagtccaattctcatcttttagaagtaaatcaattaatctctaagattttttccaactctaaatactgataggttaatgactcatgggattaatgactcatagaaggaacttgccttgtgtgttatgctgatatgatgtttaggacaatgcttcctttgaatgagcatttactgtgtaagataagagaatagagatgcctaattttttttaagatcctcattgttaacttcagaataatccagaatataaggagacagtctaaaaatggactcatcgatgatgtagtttagcaagctaaataatagcttaaggactcaactttttaacattttatttttttgctttgttatttgtaatatttacttaattcatgaatctcaaccacatattaggtgatactttacatggtataaaacattagagcaaaaaaagaggaaaatgtcacttttctgtgcagatacttaagcgcaaaagtagacaacatttcataagccagcccttttctgcttccctcactatggaatcagaggcctcctgtctgaaattgacaagaactga

SEQ ID NO: 52315 - DNA, 1926 bp, Bovine  19866880566434
cattgaaagtcaatgcaatttagagcaatttctctggcagtggaaattaacctgcaggaatctgctggcaacaggtgtattttagggcatccataccagcgtcctgcactgcggagacaggaccttgactaccaggtgtggtgtgggaggctggataattggaggaggcaggaaatcagtgcagggagggtggccaaattgctggtccatatgggttggtataattattggttaaccctctcctggctgttaactaaaagctacttgtatactcaaggagccaggaaatcttcactgaagggaaaaaaaatcactcactgctcaagcaggcttaattttttgataactgaggttttctgcaaagtatcttcactttaatgtctgatacttagaatagatgattgccaggagcccacagatcttcaggaaggcacaaggggaagtaaattttaagtgctgaaagcttacttcttcagaaacataatttttcctggtgtgtttgtcctggtccacttcttttgaaagacctatagggaggaatattcagattcaggaaacagcaattgtgttctatactttcatttcttctcgatttgtatttctacctgtgttttatcttcatatggtctattttgcctccttgatataattctctttccttggtttgttaatgtctattgtttcttctaagcaacttaattggcttaaattaagcaaatccaaggtcctgatctattcaaaattccagtcatggaataaactttcaccccaaatcttaatagtcatataatatccatgacatacactgatgaaagttatgtgccaaaggcttttagttttcttaatataacatgtatgacactcttaagaatcaagtaaaatatattaatttttgccaaagcaatgtgctgctatgagtaattattattgtgaaagtaactgattttattaaaaaataattatttggtgttttcaaataatcagagaaattgatggttcttatgaatactaatgggcttctcaggtggcactagtggtaaagagccctcctgtcaatgcaggagaagcaagcgacttgggttccttcccttggtcaggaagatcccctggaggagggcatggcaacccactccagtattcttgcctagagaatcccatgggcagaggagcctagtgggctatggtccaaagggttgcaaagagttggacacaactgaaatgacttagaatgcacgcatgcacatgagtactaataaagtattggatagataactttggaacatatcctttttttgagataactcatgtttacaaaatataaataataaaagagaataattaagatttgaataaaccataattttaatccttataaagttgtttgacatagtagtattgaaagcattagacaaaattgtacttaagtaccgtatttagtatttagctatataattctatttatgccaggatttctttcaaaaaaaattcctattttgaatttttcatgattttgagtatgtcaatttttctacctcaaaatgttcatgaggaggaaaatttcccatcatttcaatagtacatagcataagtatttgatacaaacaaaataaaaaaatgacatgaaggaaataagaaagtattccacacattttatttttactaaccaagcttcagaccaaccaacattgccagacaaatttaagaaaattacttgtaattttggagtctatggaggttaaatatgagatttgaattttgtcaaatagacgtgttctggtctagtggttctcaaagtgtggtccctgaaccagcaggtcaggatcagctgtgggtccagggcccacagagggtattattaggagccctctaatgatccaagagtgttccagagtataagaaccactgctctagactgctaaccatttt

SEQ ID NO: 52316 - DNA, 2072 bp, Bovine  19866880673894
ctaattatcatctcacttattagctaagtgagcttggtgaaacttctgtaaacctcacttttttcatctacaaagcagaggaaaaatagtaaataatttacaaggttactctggtaatacaaatattaatacaatgcctggcatctggcaaacactcaataaatattgactgtaattagtatccccaagtcatggatgaaaaaataaattcttagggaagttacaaaactttccccccctatccacagctaatatccaacatactcagtatgtgaatcacagtatatctgattataaaaatcatgaatgaatgaatatatagtaacatgggaatcagactcaatggtatctaatttcagaactcatatgctttttagtcccctacactgtttatcaaaagcaggtgggaaaatatcatggaaggtagatagaagcagaatgaaagaagaaataattggctcaagtgaagcttgcagtcctggtggaagtgatgggaggtgggaggcatatgactgaggtccaatataaacaactgactatgtgcacacagtttccgagtagaatttggcaaagagtgacagggaacccaagggctccataatgtcccttgatgttgttgacatctaatcatttaatcttcactagaaaacattgcttcaatctcaaataacaacagccaactattttctcaaaagaattaattttcaaaccatcatgtgacatttacattttgcaccttccatcttaaatcttcctacttgtcagatgttttgttgttcttttatgaaatggtcagtcaggcgtggccacaagaggagacagaggagatgctcgggaagatgatctgttctgtgcacacgtgcacacaggagccacgccacacagggtcacatggaaatacacaggctggtcaagaggcagaagacatgagaaagggcaaagtttcgaccacagcctttgctgggtttctgtgggaaaggcaagacagggcagggtaaacagtttaagactggttagcttgaatcattccagtgaactctaaattcaggaggtgacccctagttgtccggatcctggccctgggatgcttaaggcagaggagtattgccccctgcagtggacaaaatggattgcagagggacagctctggatggagcagtttgtataccaaaggcatgttcctcacggagcactttgccatcgctaagaattggctagccccaggagaggcagacgccccagccagaaagatttgtttttttcacaatgttaaaacattaacatacagaaattatatatttataaaaatgttatgcctatacaatagttaactttttagctgcatattcagacatcaaactattttttcaaatatgatctgaaagatatcttaaagtcatctataaatgagactgatttacccaactacccatacaacaggtctgaaattatgtactaaatcagctaatttctgaaattccctggtgatccaatggttaagggtctgcctgtcaatgcgggggacctgggttggatccctgatccgggaagatcccacatgctgcagggcaactaactccatgtgccacaactgttgatcccaagctccagagcctgtgctccaaaacaagggaagctaccacagtgagaagcctgggcactgcaactagagaaagcccactcacagccgtgcagccaaaaatcaggaaataacttaaaagtaaaaataaaccagctaatttccaaaaccaaaaagctggataattcaagtttttttccttttgacaaaaaagttatgaaaacttttctaattgggactccgtttatgtgtgccttgttttataaacattgctatatcctttattcttggtattatttctctattaatattatgctgagttgtcaggacttgctttcaaagggctcagggaaatgagagcatcatttcttcctgtggaaagggggtgatcaggaccccaaacctcaggatcgagcagatgatcaaatctcactgactgctcaaactcttccttattgagacaggttctgtcaaagctgctgctctttcaggg

SEQ ID NO: 52317 - DNA, 1356 bp, Bovine  19866880754761
ctctgcagcggttcttctctgaagtatctagataatagtatctgatgcacatttcctgagttgtcttacagatgctaaccccatcaacaaatgaaagaaattaacttcttgatgaccatgtgcagtagcccccagacctatctgctcctaaggatcgataatgttaacccctgtgacaccaccctgttacttcatcatcaactaaccagagaactgtgcatgacttgatcacataccctcagacgtccctcccttgccttgtcttttttttttatttttttaagtctttattgaatttgttacagtattacttctgttttatgttttgtgtttttggctgtgaggtatatggaatcttagctccctgaccagagatccaacctgtacctcttgcattgaaaggcagtgccttaaccactggaccaccagggaagcccctcaacttgcctttagaaaatgctttgctaggacttccctggtgatatagtggatcagagtctgcctgccagtgcagggaacacaggtcagatacctagtcttggaaggtcccaaatgctgtggagcaactaagtcttcatgccacaactactgaagacagagcacctggagcccgtgctccacaagagaagacatcacaatgaggaggccgtgcaccgcagcaaagagtagcccctgcttgccgcaactagagaaagccctcacaaagcaatgaagactcaacacaaccaaaaaacagatagttcttttaaaaatctatatatttccacatgaaaggttacaacttaaaaattgcccagtgttcaccaatttcagaaatctgacctttgctgatgctgcaataaaatgttgcaattgaaaaaaaaaatctatattaaaaaaagaaatatttaaaaaaatactttcctaaaactcgtcattgagtccagactttttgagtgccagctgtcccagattccttgtctgacaccttacagtaagtgctgcactctcagtcaccacagcctgatgtcagtagattcgctttactgtgtgagggctagcagacccaactttggttcagtaacagggctgtttatttcagcatttgctttacctacatgagaaacataaacccctcttgtttatatctacacaatcaggtttctgtcacatgcagccaaatgcaaatctaaataatatgtgggttctaagaatctctgtgtaaagaaatctatctttcttaaacttatttgtacccaagcatttttaaactatttattttttacttcatttgatataaaattccacaaaacaatgttccattggatatctgtttgggtaatgaagttttatttcctgttataaaaaacttgtgta

SEQ ID NO: 52318 - DNA, 735 bp, Bovine  19866880775612
actgcaggggtggcacttagccttccatgatgttatgattggcattttaggcaaactttaaccctcttaccatgttaataaatagcagtagattcccatatgtagtcacacaatgaaacaaagtaagaaagctgttcattacccttaactcttctgctcctttgcccttgttttccctctgcacgtggtcagaaattgaattgatattgaatttgcttcacttgtgtaatactattcatacatggttttataattcattcacttcattcacatttcaccttttgtcatttcgatcactttaatctgctatggtctctttcacatttcatctgctaagttcctgagcatgagtagatttattaattttactttctgggcttctagttgcagtataaatgatcccatcaggacatgggtttagatactgctaggcctgaagtaaggcctaaagagtagatagataccagcattcacagcaagtattcatcaggaagcaggcctgcaggtcatagagacagtattacgaagtcgctaaatgtgcaggcagagttcacatcctggagtgctgttgtttgctctgggaacttttgcaggttccttagcctctgcatgcctcaatttccacatctgcacaatgcatctaacaatattattgaccatatagaattattaggatgaaatgagaaaatctccaccaagcactcagctcacaacacatacgcaatgaatatgaat

SEQ ID NO: 52319 - DNA, 1435 bp, Bovine  19866880801968
ctttactaagttctatttctttgtagacatagtgccaagtactttatatacatttgttatatcattcagttgtcacaagcctcagggaagatttcttatctccattttataggcaaggaaacagtggcacagacttcaaagtcacataaatagcaagttccagagctgggacttgaactcagttacctccagtcagtacctttaacctcaacttttccttcagcacttgtcacctctaagagagtgtcaagacaaaatgggggtgggtggatgttgctaagaagttcaggccataaatggagggagctgaaagtgtcattgacactagaactaatagcaagatttataataataaaggaaagagagccaaatataaaatgcatgtggtggagaaaacacactaattcagcaaagcttgagggaggaactagctctcttttatgcaaagacttgtatgcccacggtgggctttaagaacttgccacactgatttccattatgaagcaatattcagttactcaaaattgttgatgaaagtgttgcttccagaaagactcaaatcataaaacagtatctctaagttccttggaaactgatttgcaaaaaattttccctagatacctatatgaaggagaatctaatttgttcccatttgtgttatgtaaatgtgcagattgtaagagtattagtacttctttttttatttcaagctctttgacttaaacacttaagaaaaaataaatgtataccagttccttctgtaccaggtattttgttcttgccattaatgctagcaactatctatttagaggaaatcttgtaatattacatgccattaaaggataaagttgcggatttttctgttgttgagatgcttaaatgtatggaagtctaacaactttttaatgtattatttattttagctttacttattatggcttttggatatatttttcatccttctatttcattagcttttgaaatgaattgccatatttcttatttcaatcatccatccaagtcaagtacttttctgaggtagattcaacaagaccataactactaacacctggaattttcaaacattaaaaaaaatctgtatcagaagccataggtatttcaagatgaattctatcttttcttctctgccaaccttttggcctaaggccctggggctacgcattgttatgaagaagttcaggggacaggcagctacaagtaccatgtgcaaaatgtgattcattcagggcataaggtaatatttactccagatattaatggttgcaatccacaaaagcaaaagattgcttcactttatctctcctcagatataacacacaaaagtgactggcgaaactagccactttctaataacagcttccagaggtcacagagaggtgaaatcgtcactgtgacggggatactgtgggcgagg

SEQ ID NO: 52320 - DNA, 756 bp, Bovine  19866880851586
gagcagagatttctctttaaatactttcttgagagtaggtctttaagcagatcgatatgaaaactgaaataaaaaccaaatgcagtatgtcactaactttgagcaactgttgctgtatgtgtgtgcatagtatttatagtctgttgtgcttaagaatgaattgctaaatggcagctctaggaatatgagctctgtaaacgtgaacagtcacacaaaaactatgatgtatatgtgttgtgcatattagctcacctgtgaatttaacctctggagagaattgtaactcaccagcactttgtgggaatgcaaaaaaaaaaaaaaaaaaatcagaaataacaaaattgctaagaggtaggtggcaaaatgttattattatcattttatagaggagcaaaaaatgtgcagctgaaaggtcaagtatcttgttcaaagtgacacagaatagtagagttgagccctggaattattaacttctgttttctaatctagtggacctgaggttatagaatccaactaggaaggtcaaaaatatcagttttatgatatgaggcagttatgctacgcggtcgctcctgttcttttgtcccctcacctgggagccacttgatgactttagtctcagcaacttcccccatcctggggaactgaacctgaaacaagagaccatattaacagccagtacctcccactgactatgaatttcagatccctgctccctaggccattcaatagctgtagctaatcagaatctctttt

SEQ ID NO: 52321 - DNA, 1407 bp, Bovine  19866880883126
ctgccagagacatttgcatcacaggatagcagcctcactgtgggaacttgctacagtactttcatttttatcatggcagtgatttctgcagcccctctttcctggaagtgtgcacaatctcagcattgtgcttagttaaaaataattgtggaatgagcttcaagtaacgaaagtgaaaggtgtgatctgcatgcacagaaattcctcttagaagcatcagaacttgtggaggaagagtgcactccttctggcaagtgtttctcttcatgcacgtgtgcgtggtaagtagtttcagttgtgtctgcctctttgtgaccctatggaccatggcctgccaggatcctctgtccacgggattctccaggcaacaatactggagtgggttgccatactatcctccagggaatcttcctgacccagggatcgaacccacggttcctaagcattggcaggcaggttctctaccactagcaccacctgggaagtccatttctcttcataccagttcactaaactagaaattgtagtaatctttcaaaactaagagtagcgagaataagaaggatatattttttaaagaatgaaagaaagccctggctttatctctttctttggctatatttgtcggttttctgaccaacctcagtggcagacaattagcacaaagcacttcccgttcagatgagatattgctgtagtggaatttacaagcaaaggtgaaaagtgttagacagtgctgggcttgtaggctgaattgctgcagatggaacagcccaggtagcttgttattaggagatgtccctggttgcaacagaacagtcaaactaagggtattccttttctttcttaattagcaacttgaataaataattttcctcataagctcaaatcaggatttgatttgagcttcccaaaactgctacatgaggcatcacagacagcctttaaggggaaaaaaaaaaaaagctccttctgatttattaacttaagataaatggctctgctatcataacctgtcagtaccacgcaatgaaaaggaaaccagtggcgggaaccatgtgtgaagccgctcagtgtaaccagcctcagacacaggagtcgaactttcaataactccaccaccttcccctacaggaaacagcccaccagcacattcctcgttcattaactttccaaagacatctgtctttgcagaatcacagaggcagccaaacatgatgtgtgaaataaagaatcctgcccacctcatgctccaagcatgaggaaaaagtagtgcttggtggaaaccatcatactacgtatggctgctgtaggagactcaattgcaaaagctgcccctcaagattcgagtaaaggagtttctatccctgtttctcagttcttggcatttggcttatttcctttgaa

SEQ ID NO: 52322 - DNA, 1173 bp, Bovine  19866880907657
tgctgaacaggcctgtggctcagcagaggctagggtcagcatgaggcttctgtggagtgggcagaatgatgggcttgatcaagtgatatgatatatttttgcatcatcctgttgcatttggtttcctagactgcaagctttttgaaggtaagattttacttatttttttggtaaatgtattgtgtataggacaacatctcacactacaatattcaactagtaaatactaattttaatctgtcttcataggcagttcagatctccattatctggtaatatgagcatcccaaatgatctcaaatataaaaagcattggaagatctcttatagttgaactcaatccaatggttttgctaaagtttgtctccaggttttcctgtttattccgaccttgggaacacaaagtacaattccttcttcccacagagaaacagtataatgttcttatatgtttctccttttaacctcaacaaagcatttcaacctagattccatatcagtgaaacctctattatataatattatgtcaagaccttttcaagttagaaaaaaaggtcagtgtttttttccactgagtaaacatgtggctctttcatctcacaacatacttttcaacttagtattgtcattctatgaacccaaatgatgtctctgattggattcacattgactatgagacagatggaattttcaaatgagctgaattagagaatcaagggggatgacttctactgtacttggtgatttgattagtttttcatgttatgttacactctcttatattgggctcatttcagattttaatacatatgagcagctcaagttacttttaaactgtacaaagaatgtatgcatgatacatagtgggactattcttagttctccttttctctccttccattcttttccaaaacggtcatatctcaaagtaggactaagtcacaagctttctgttttacatgaatgacagtagttcttaacgctagacagctttgcaaaaatacacttctggtcccaaagtgggacagagatatagggtatgcacagaacacaggaaaatgaattgcagtactctaaggcttaatgggtcagtgtaaacatctctctaaaaaattataaattattatagtttaagcaatttgctactactaaaatttgttttcatgaacatta

SEQ ID NO: 52323 - DNA, 508 bp, Bovine  19866881022310
attgtgacaggcagtacgtaagtttcattttataccagcatattcgatatgaaagacaatcattgtgtggttggtattaaattagcaaatccaaagagattgcaccatatcacaagttgggaatgctgtgtgtttaaggaacttaattatcatcttgtctctttttaaaagaaaaaaacaagtgtttcttttccttaatcggcaatataccctgtaaataatgctgttcccttcacactgaaaaccatttaattccccattatctcacttcattagccaaatgtcctgtttaggcacactctgaatatgaagcacattataatgtgctgggcaaataatatttagaaacatctttgaactggaaagaaaaacccaggaaaacagaagtcaacacagatgatatgtattcatcgtattctgggctatttcagggatctagttcctattatgactgaccttgaaaatcaactaggagcaattttcacacactgtagtaaggaaacaatta

SEQ ID NO: 52324 - DNA, 1030 bp, Bovine  19866881079691
atctcgttttctatgatcttgtttgtttttgaaatacaattgatctataacgctatgctagttcctgttatacaacgtagtgtttcatatttctatacatttcaaaatgatcaccatgataaatctagttaccattctcttacttaccatttttacaaagtcttagaatattttttttctttaataatagatacattcttataaaataagttaggaaacatttaacctaatactgttgttttacaaacaataaaaatgagactcaaaaaagctaagtgaattatataaagtcctcttcttgcaatgtaagccaatttctttttgtactatagtgaatcaaatcagaaaagctgctaactttcacagatccatgtcctgtactttaaacccatgaatgttctggtcattctgtcctctctagcaggttagaggggaaaaaaaaaatggccatttttcaaacttatgaacctcaagctatatagttagagagaatttccaaagaaggtttatatacctttaatatataaaatagtatcctgaagctagattttttccattaaaaaaattctttcaatttcttccatttgattgtttcgttctttagtataagttacccagcaaaaggcctgaagaataaacacatggcaagcaattgtgatcactcttccttgccctggacaaaagcttattagattatattgatttaccagctctttccttgcagaaatagcctaattaaatgtttagtaccacctttgaaggtgaggtcaactcaatagttactttggattctaattttagaagctctcccttctctgattatatttttggtaatgagaactaaatgttgatgccttaaattggcaccctttccattcttttacatattatttcttggaacaaaaatgttgttgggagtctgagtttgaattgggcccaatcacagagaatttttacctttagtggaaagattattctcttctttactgggagggatggtgatatggcaaccctagtgttctttcttttt

SEQ ID NO: 52325 - DNA, 1069 bp, Bovine  19866881136272
cacagttagtgagctgctgcatattttatctgtctgcaaatctgtctgccctaccgactactacttcctgtccacttacactaaaagctcagcatacagagaacattcagtaagtaaattatactcccatggctggggaaggactttcccacttcagcttatttgtcatgactccctctataacttgaggcccttgcttatttcttatactctgattcatttgcttcctggttaaatggaccaatatccgtggagctctccatgacaaagtcagccaggcctcagccccttggcctttctccctgcagggctagtccagaagctacagagggtgcttttttatcttaagcccactgttgctcttggattgactctggtttaagaatattcctataatccctttggatcagcttttctcccactattccttattactaatcactgttagatggaaaatgagaaatctcatcattttggttaactgggtcactatgaaccaaagtattcctatgttcctaccctgaaagcataattaaagccttgactaattactgttaaagtaaccttaattaactaacctaacttaccactaatcaagggaatgggtcttctgagggactgtgaatcattttctagtcagtatataacataaggtaatatacatctatatccctagggatgtactcattaaaaataaataaaaactcttcattattaggagataaaattggagattgcttgtttacttgtttatttatttacacaaaggattggactcaggaccttgtcttgcatttttactacagagcttttgccatgtttatgagacaagtagggacttggcatctcccttacttactctgggttattagtcaacccatgataattatttcagcagtatgcagaggctgctatatctgatcgccacattatgtggtatgtttgtgggcatgcacgctcagtcatgtctgattcttcatgacgccatggatggtagcccacgaggctcctctgtccatggcattttccaggcaagaatactaaggggtttccatttcctccttcaggg

SEQ ID NO: 52326 - DNA, 1719 bp, Bovine  19866881206293
acctatatttgtaaatacttattttgatctgcacagcccttttatcccttttaaaaaatcattcagccacgtcgcatgatttctttctcttgcctgcctggacttcagtgactctgctttcagttcagtatctgaacactagttcttagttttgccctttcatagattcagctttagctctccactgatctcttcactgtggtcttgcctagaggatgaagcaaagtcttcagcaactgtgctaaaggcttgttctgcctcattcttctcagtgtgcaccatccttaccatctgagacttatgattagttactcattaggtaggctattataattcataaactaatatggaatcatgaagaaaatggtttagcctttactgaccatttctaacttctcatgttaaaataatttctgacctcgtcaacacagaagggagctaaacagaagcattacctcaagatcgtttcattgttcaaacagagaaaccataaccaattacaattcctacagcttgccttacacttcccattctcaggtaacatgtattaaaccacaattgttttagttatgatggaaagggtcagtaacacaatcttcttaaattctactcttaatcaggccaaaataaagggcacaggcttctgtctgacgccaatttaattacatgaatctgaacatgccaacttttaatagttagcaaagtaaatcttccatgtcctttaagactgtaaatgatactgtgaagttatattgaagggtataacacacagcacaaatatttacagcaggctaaactatttgttacaatactcatttctaaatgaattatcttgtgggtagtagtaaagctgaaaactaagaaataagggtcagattcctcctgtgagatctcacttgtataattatcccaaatgtaataatacgacattattgacttaagcacactttccaatgacatgccatagctgacctgtaatttttatcctacacgatgccagccctaataaaatgacacttgtgaatgtaaattaagctcacaaaggggacagattgcatgattctggtttctttcagatgcctgtaggctatcacaggttccatatgtgaagtaattatgttcactgaaggaaagaataaatgctgtcaaattgtgtactgagagagaaagcagttattatatttcagtagtcgctagagcattgcccccagacagtagcaagatgtataagaaaataaaaactgtgccagccatatattacacatctgcctttatatttgtagctccctttaaatgtatattatacaaagtcaataacttaccaatgaacgtttggctgtctccttcagtatattttctgtggagccattttggaatatgtggcatgatggttatagaaggggtaatgaatatagatgtttcttagttctgctttcccttatgttgagctgcaaaacaacaatcctgttggatccctgatgtttggactttgcttttttcctttaacaacatctcaaattcaacttcagacctgcccactgctgttttctttatagctgatgggaatggctatgaaacattctaccttctaaagcatccttacctattgagagcattttaaaaaataaatttagatagaataacagatagcaatgacttggtactcattaggcattgagtaatttattagagaatcctcatactttatcttactcagca

SEQ ID NO: 52327 - DNA, 1333 bp, Bovine  19866881206740
tgttatttcttgcatgccagctagagcccagaatgactacatgccatcattttcaataatgcctgtgtgtttttgaggaattacacacacatatgcacacatagagcctcgctttaaataaattctacaatgagccacctgtccattaaatatgattacacaaatgtgatttaagatgtcttctgagctttcctttcaattcccttcttatagacaaattggaagccacctatggattccagaccatgctttgacacccttccttgcttctttccaaactcaaaatcagtaacataattgccaatctgggtttaagcctttgccacctcctgaataaattaccaaccagtgaaagggtacacaaaaacacctgcaaatcatataacttggtcaatcacttcacaacctctctctggctatcacaggctgggcttcacaatgcctgatacagcatattatgcaatgatgttccatgttgccagtaaaccatggctttatgccaccgttccatacagcagctctatttagctttatttattggatttttaaatcctcttgtacagtaggcattgatctctcctgaggttgtgattatagctttaactattgacacttctatcagagccaacctcaattctttgccttctgctgacaagaaatggtaatcattccaacaccgcaatctctgaatcttgaacccccgtcccacatactttgccctgcataaagagtacacagatgttggttagctggtttcctcagcaaaatgtagtcttcaaagagtaaaggtaaatctgtaagggtaagtctgactggaagcactgaaaatgctctgagacacatatgcatttaaaaagctgccttcttcccactcaaaaatttcatgtttgtcattatccacctggagcactgtctgtcaagttattgaagtaattgacagtgagaactttcttagaagagattctacctttctgtttgctgatgaatctcagaaataaagtaaattccatcattacaggtagtaattagcaagaagctacattggaaatcaaaacatagaatataaaatatcagttcagccattaattagttgtgtgactaagtagctcaacctctcctagcctcatctagaaaatgagaatacctcagccttcctcctagtgtaagtgagagacttgtgaaaaagtgtgcatgaatatctggcatatggtggattgccagtaagttttcatttaacatcccattttgccctttcctctaccggcttctcaagaattgttgcttgtgaaagactagtcaatcattctgttatagttcttcaccctagtatagg

SEQ ID NO: 52328 - DNA, 899 bp, Bovine  19866881274788
cactgtgattaaactcctaggaggcactcaacatccacatttgttgtgaaaagggccctgattagcatttgtactatgcattttggtaatcagaaatcattatagagaatgcaacattaaatgaaggaatatggcaatctcccatgcattaaataggctaattttttttaaagaaatgactttatatctaaaggaaataacatcatttcttttcctgcaaagcaataacacttggtcagatgctctctactaccatctataagtattgccacagtgaacatttgattagcaaatagccactctgcatgatatggaggctgctttcatttaaatgttgatatgtaagagctatttttgctatgtgtctttactcttggggagagctaaatgatgaattaaactagtcagagatacaacagcaagttttaaattcttaaaacattccaacaaattaggtcaagattcaagaagtcttctgacaaaagcatcagaaatatttttctgttctataaaatattaacagggatgaaagctgttaatataatgtttttggcatattttgacacaatctcttgttacttcaagtgacttgcatctactcatgtattaaaatcttaaacaattgaatcaagaccattttgtgtatgaatttgtctttttcacagttttatatctgtaagtaaacacattttgagaaatcctttctgtatcaaatcttgcaagatgatattgtccctacttacaagtattcaattccatttgttttaattatatagattccttggtaaaatattgaggaaaagaggcattgttaagaattgaacaagacagtcaaactgtgcatttactcaaaagaaattttaaacattttattgttggcaggtaaaattgaaatcaat

SEQ ID NO: 52329 - DNA, 1712 bp, Bovine  19866881278937
tgtttgctgagtgactgaagcacactcattctgtcttatttattattacgtactgatgatctaaagtggttttattgaaagttcttatttatctagatttcaacttatcaaatcttctcccaaattaaaaaaagctgcaagttttctttgaagagtcagttttatttctcctttagtgagctgtattccactgactattctaaaagcttcttttaaataatttgcatcaggcagttatgcttctattatgctaaactctgatcacacaagtgtggcccagatgtccatagaccaaataacttaaacatcttctcacatgctacagaagacaaagaaaaattttctatatttttcaagccaagatttcccttttaaatttttgatccttatctttttttttttccataacattagccaaagtctcatggatcttattttctatatgttgcccttcagagaggtcctttgatgacaagaagaaaatgttcaaagatttgatctggacaacagagaaccacagagctgtgctacttcttttttctttgccttgaccttacccagaagaaagcactcctttaggctcaaactcttgaaaatgattgaagtctctcttaggatgtgcttaggtcatagaaaaaaaaaaaaaatcatttaagttccattcaaggtacagcctccctttactgtatagattaaattggaaagtaccattgggaagggaaagaggatcatgagtatttaaagtttatcataaatgagaagtttgtgaacaaagcctgcccatgaggctgaggattgtgtcacattacttcttaaaagcaaatctgcaaaaaggagtactcaccatacaatcacaccagagaacaaaaattcagtatatgcctcattatcactctgagaaacgccagtaccaatggtctttctttaagctcttgaccaccttttgacatttttcctttaagtcacatcatctttggcagctcacacagcaactaaaaaattttgtttcttgtcaattataagtccttttatgttttctttctcacagatttttgaaatgaggaaaatacatgagaaagacatttcttagatgaagagagaaaggaaatatttgccataaaatgactcactgccaaagttactattttactagacaagagaaacagcagtcttggaataagtgtttacaataacagtgttaagtattcatttatctatttgaccacgttaattaaaaacgctattaccagacactgcaaaatgggcaagtgaatttatacttgatgccgatttgaatttatacatgatgacagtttgatccaagttttctattctcagcgtatagattgtaaaacaatgctatttggtgagattatataaaccctatattatagctttaaaggtaaataaaacaactcccactccaaattatttctcactccaactgcttttactacactgtactccatattgtagagtccactggtaaataaataacgtgcaatccattgtccttattgtcactgaaaacatgtattcattcagtgattcttttattcaacaaacattctgattctattgtatgcaagaacaaactatccataccccaattcagcatattccatattgttgagattttggggtctaagacagggatcagtacttttatctataaaagaccaggaaataaatatcttacaactgtaaaaagg

SEQ ID NO: 52330 - DNA, 739 bp, Bovine  19866881303478
caaatagattaactaccttttgtacataattgcacctacaacacacaaatacaagggggaaacatcattgacgtttgtggtgctttgagagaaagagaaatgccagtggagaggtctccactgtgatcctgaaagaagatgaacaattttagaaaggaaacgtagcccagaaacactttgaaaaggctgcaatgcaaattcacagtacacgttcctatactcctttgaggaagaggtagttctctgaaagatgataggattgacctgtggaattatgacagaaagagttcatcacattaaactacttctgtaagtggaggagagacagaactccatattctaaaggatggatgtgcacagtgaactgactgaatatcatccataaagtcaagaggagctgagctggttgaatggatagggcacatattaaattgatagtgattaattagttttatgtcacgttggtgcttttagacttgttcatggtgtggttttcaattattttagtattattggaagagccaagattagaccatagttattagaattagatgagttaccttatttgcagagtaggataacctttgctattttccttacacgtgataagtgccatttgcgaagaaaagaaaatgaggcagtgtgaatatctataaaggcttagagtaggctagatattttttaaaaatagaatcagatacaccatatgcccaagattcaaaaagatatttggatagat

SEQ ID NO: 52331 - DNA, 997 bp, Bovine  19866881345781
catccaatgcgagacacttgggttcaatccctgggtcaggaagatcccatggaagagggcatggcaatctactccggtgttcttgcctggagaattccatggacagtggagtctggtgggctccagtccatggggtcccaaacagtggaacataactgagtgactactactccctactcctctgtttttggctagtaaaatggacacagcttggatttataagaccatgtatccccactcatgcacatcccttaccttctagaagactacagcaataatagaattcttagttgtaaggaatgtggaaattccccaaatgagtaattaatcaacagtattcgaggtactagaatgtggctgggtggactcagacgcccttggccaaataagactgtccaggtcctgctgaataacaataggaatttagatactgacaaagtaggaattatttttatttctcctataaaccttgttaattgtggttagtgtggtagcatacccacctaaaaattctataaattcttatcacattccttctgcttgatgtttaaggtacactttcttagaaagagaggtaaaggaaaaagatgtataatagaagctctttaaaatatatcattttttttttttttatctctatggggtatggggcaatgtattaggtacctcagtttcttccttcaggtatcttgcagcccaataagacagacagattgctatagggtataaaagagagagagagaaaaaaaaaaaaagattaagtagtaaaagttgttttaaatagcctcacagaaagggaaacaattaagggaaatctagagggatcccaccaggtagaagaatggaaattatagacagaaaaagagcagggccaaaggcaatgaggcataataaaataattgaaatgtacaagaattgtgagtagtgtgttacacaaaaatgataggagtttcagcagtgaaaatttaatagtgcataaggtccaagaagggcttcc

SEQ ID NO: 52332 - DNA, 1358 bp, Bovine  19866881405645
ttaattaattgaaataaaccccatgacttatatatgtagcttccctggtggctcagatgataaagaatctgcctgcaatgcaagagacccaggttggatccccaggtcaggaagatctcctgaagaagtacatggtaacccaccccgtattcttgcctggagaatcccatggacagaggtgcctggcggactgcaatccaaagggtcacaaagagtcaaacacgactgagtcactaacactttcacttttcatgttccatgagcaacatataatttctattttacagaaaaaggtctcagtgaagttaagctacctgcctgaaaaggtatttatttgccaggatttgaatgtattttcatctgacataaaggtcactagctttattttatatgacaatatcctagatatccaaacaatgaagagtctacaactatgtatttgactattctgtacctctttagtgcgtatgtgaaccacaacaacaaaatatagattgtgggtaagaacttctcacattgtcacactgtttgtatccacatgggaactgagtctgtgaaacacagaaacctccctgaggaagaaaccagtcacaaaaaccaccatgagcaccagtaatacacaagtcctggtgggatcatcctccattcctcatgcccttcccacttgatgaaataaacatcccctagtttcctgtaatttgggcttcagactccttggagagtaaattcacatacttttctgtgttgtagtgggacggagtcctataaaatagcagaaaacaaatgattggtgaacaacttttttaaaatcagattctttctgagaacctgatttcattatttgttcactagacaagctccccctaaatctattcacaattaaaaaaaaaaaaaaattacccagctagtagtattgaactgtgccttaattagagcagccaagaatgtcttgtataattaactgggctttgtttataattatttccttgtggttaggactgctttctgcttgtaactggggcaatgctaatagtaacactaacctttgattttcatgtgagagtaactgaaggacaggcagaagaaacacgccagacctagcaaagtaaaaccaaaggacatgaaacactgggattccttttgaccttctgttttgcctcaggatgaacacaatctccctaacctctgccccagtctaaagtctagatgctgacctatgggtttctttatcatcctgtcaagtaaaagaaattattcctttacttttggaaaatggagtgaagtcttttctctttgaggtccgtgtgctagtttttcgcctccagatccactctcatcttctggacccagctctgtgc

SEQ ID NO: 52333 - DNA, 1337 bp, Bovine  19866881413712
catgtggtttatttcgacttctgcagcaaactcacatctactattaaagacagaactctatacaaatccaaacaaacaaaacaaagctgaactaaaccagttcctctgaaggctgaagtccaagtaactccagtggcagttgatttcacagtggagatgtgttttgttctgacatgtatgagtgctttagttatcactgaaaggttagcgtcatagacaaaataacttcatggtgacaaattcttctctcatctatagaactcaaaagaaaaataaaattttcacattgatgtgctttgctaaattttaaactaggaggaaatttttgaaattaaaattctaacttctccatttattcaactataacaagaattttaatagatcaagatttttcagattattttattaatgctactatttttgagtactaccaacatgctgctggcccttgcttcaggaaatttattaacactgttgcatttttgccttctcaatagcccatccaattatgcatttcccctatttcacagatgcagaaactaaggctcagagaattttgatggttcacccatagtcaaggtagattacaatgtctgcccatagtttcagcatttattcagaatgattctgaatgctttaggtaaaagaaggtcatgattttaaatctcatcagaatgataaaacaggcattacactgagggtttatattactatttccatggccctggaacttcatatgcataaagtgttattttctgacattatgtagcttgatttatttttatggtaaatccattgtagagtttgatacatatttaaacaagaaaaaggatattaaatcttaaaagatcatttatataagattagaaaagctatcctaaatacacacatgtggataaggaaaatgttaactaaactgaaattcatacctgagtcatattctcttcctgcttttcttggtctgaaaagtttttcaatcaccattctttcactgacagaaaaaggcatttggctcattcttttcaataggtcctgaaataccagtctaacagtgatgttagactatatgcaaaacaggtagtttatttaaagatgtccaaagaagatccaaggaagagctgcctcactggaaaagaccctgatgctgggaaagattgagggcaagaggagaagggaacaacagaggatagatggtgggatggcatcaccaactcaatggacatgagtttgggcaaacgcaaactctgggcaatggtgaaggacagggaagcctggcgtacggcagcccttggggtcacaggagagtcggacatgacttagtgactgaacaacgacaa

SEQ ID NO: 52334 - DNA, 944 bp, Bovine  19866881521089
ctaggcctggggttagtgcttgcaagttcaggtggaagggtagtttctttaaagcccaattatacacaaaatcaaaagctaaggagatcagttaagaagtaaggtcactaaaactaataggccaaatggcagccataaaactatctgcctccatcaaagtgaagctagatgctgtccccagcaaacccccaattcccagtggcttcaaacaaatgagaaccatttctccttgtaaaatgtaaaatccactgttcttttcaagcatgactctttttgctcctttctgtggctccaccctttataatgacctttgatctgctgcatcctctgactcttgctcacagatcaagaaaacagagagtggaagactgagtgggagagtattatgggataagcctgagaatgacctgcattgatttggctcagaaacaattgtcaagaacttggtcacatttccccctccccagcaggggaactgggaaaaaaataattcctgatttaaagagaatttcctagcaagttgtctaccttatagaaggggagcatgactcttcttagagagttagtcaaccttgccagataagccaaactaaaacagctcgataagataaagcatcactgaaagtggaattcaatgaacttgggcaaaatgaaccatgtgccagtcctgaaacccgccagaaaccagatgcctctggtataaatatccctgccaataagggtatgacccagttgataaaataagtaccagggtagaatgaacaatgtgaaaaaaccaatcagagaacaaactcccgcatgaaactcagtatttctttttccttccttcctctcatccaaagatgggctgcctaagcacaaaattcaatccaaaagtgaattctacttaatatcaccaatacaatttttcactgggcttgttctgcattcggggataaaagcag

SEQ ID NO: 52335 - DNA, 2318 bp, Bovine  19866880143853
tctcccaacacccccagttcaaaagcatctatatatatatacccatacaaaaacttttataccaatgtttatgctgctgctgctgctgctgctaggtcgcttcagtcgtgtccgactctgtgcgaccccactgatggtagcccaccaggctcccctgactctgggattctccaggcaagaacactggagtgggttgccatttccttctccaatgccatgaaagtgaaaagtgaaagtgaagacgctcagtcgtgtccgactcttcacaaccccatggactgcagcccaccaggctcctccatccatgggattttccaggcaagagtactggagttgggtgccattgccttctccgaccaatgtttatagtggtatttatattagccccaaagtagaaatattaaaaatgtccatcaacagatgaagggatacataaaatgtggcatagccatacaatgggacattagaaataaaatagtaatagaaaaaagaaatgaagtaatgatacatgctacaatattaatgaaccttaaaacatgatgctgagtgaagaagccagttacaaaagagcatgtattatataattcaattaagacgaaatatccagagtaggcaaaattatacagacagaaaggagattagtagtgacctgggcctaggaggttaggaagaaaatggaaagtaattgtcagtaggtacacagttttgttttggggtaatgaaaatgttctaaaattgattatgttctaaaactgtacactctaaatgaatgaagcgaatggtatgtgaataaaccttttatttaaacaaatgcacaaatgaagtatagagcctgatggtgtaatatgtaatactgctaaagaagctaattagtaagtcaaacattaagtgaatatacttagccagatcacaattccaataagaaaaactaaaaaacattgacaatcaaaggttttcctaaatgagttatcaagtacttgtcacttaaggaaagaccaccactctttctagcttcttttttttttttaactcatagaccagctcatcatgtaaaaattaatatttttttcctttaatttctgctcttcttttatcactgaaacaacaggctagacagctaatggtttgagcagtactctagggctgctgctatatttggttggggatcaaaaaaatccaggatctggccctcagacttccaagttcaaaaatctgattttatgtcacttaagagcaagaattagtctcttgggaaaaaccaactcattaatcaaattcataggagactagctaacaaaccaaaatgtcaatttattcacttgtaatagatgcacagcctttataataactgaatgactaggatttgagagaccctcatctaggggtgcattttttgcaaaattgctttggaagtgtgattttaaacagaggggtttgggagatctggagatgagtatcatcgttcaactatatacagctttactaattatcccttctctactacaaagctccctttcctaggaaacatggatatttatatgtttccctttcaaaagcactaaacaagaattatttgactgctttccttaacaagtaagtttgggtgaccaaaaataaagatttacttttttggtaaatttcccaccggtcttttcttctgtttttaaatacagttcaacttctattgtttatactcttgttgcttgcttttctcatttaacattttaagaaattttctatcttacaacatattaaaaatattttaacttgagtcataatatccctttgagtggaatgtatttgtttatctcttttccttctgtgagacatatatattgttccaatttcttgatactataaatgaagtaattaagtattaaaaataacacttaaaaatttttttgaggcttagaccctttttttaaaaaaaaaggattatttccttgggacacttcccagaagtgtaactactaggtcaaatggcatgaatgcctttagagctcttgaaatataccaccaaattgctttccaaaaaggttgtatcaatatatactcctaccagcagcatggaagcatgcctgctttagcactgcctcagcagtaaatttaaatttgagtaagttaggaaataaaaagccgatcaatgctttctaatttgacacagatgtacagatgtttttagctttgcctgcaggtgctcctatatgcctgttccagagaatcttgctatttaggcacctgaaattcttccaagtgatgccatctataccaactctcactttacttagtttctacagcacagaacctacctcaaccag

SEQ ID NO: 52336 - DNA, 1459 bp, Bovine  19866880448930
agagaagcatagagatgagatccttcgatttcccagaagtgagaacatttactaaacattttctaatcctggatctattgccaccaaagacccttcccttagactcagcatttcccattcggctaggccagtgtccagggagttatgagagaattccacagaaacatggagctcggggccccagtcaccgagcccacctggcctttgccaggccgtgcccaggcctccctcccagactgagtttgtctgcgtcatcccccgcttgtccagcctctgtgtgcactctgtaggttggaaagaacagaaggcatcaggcacagcccgtggctctaagggcagtcgcggaggtgggggcttccaatctcccatgacttcagacttgcctctgttctgaactccctaatttggcatcagattccttgaaagcattgaggtttcacttggaattaaaaatgttctctccagttttgcatcttctcttgtgcttcaggccatgacatatgactggtgcctgttttttcctctttcagccaagagacatttggagcaggttgggggattaatagtacctcttccaaaatagccatttctcaaagttttctctttttcactaaagcaggaggggaatatatcagtcagtagagtgtatctatatttgttgtctcaaactacaggacactgaacgtgtccagtcagaagttttccaggcatatcctctaaaggaggcaaggagtctgtctttcatccttcttaggtctttttacttcttttgctggatcttagaggatttgaatcacttgcctgtaagagagtttagagtaataaacatcttagccaacaccagaaatatttataaaaagaccaatatatcttttagaacaaacagtttttctaagagaacatgttgaacaaccagtgaaagtggttccatcacaagaggcctccagagtgactgtcaccagcagggaggggctgtcacagccccagagtcattccagggcgagtcaacccagatttgggctgcaggggatgaatggcttccaggcagtgcattcctggctggaatgaagaagcagcaggatttggaggggaggggatgaacatgtatgtgtataggcatgtatggtatgtatgtgtataggtacatgtgtatgcacacgtatgtgtgtatgtgtgtgtttatatgtatatgtatatacacacatacacacacagaatgtttttttttcttctccatgtgctttggtcatctgcaggaattttctttggccttcctacctagctgaggggtaggaaagtaggaatcaagtacattacctgggtttgctttatttgatgctcgcaaaacccctgagagactgatatataaccccactttccaaatgaaaaagcaaaatagtcttgaaagttaaggaattagttggaattcacatagcttacaaattcgcagagcataata

SEQ ID NO: 52337 - DNA, 1700 bp, Bovine  19866880648349
ctcatgacaacccttgtgatccaatgctgttatcatgcacattttcagaggaggaaactgaggcacagaggctgagaagtagtgaatgaagacagagctgtattcaagccctgtgtgtaacttcagcgctcactgtgctgtactgaccctcagcagggcaggcgtttcccgtgtcccagagaaagcagagactggttcctgttatgtctcaggccactggcctcaggcctggaggagacacatgcacatacacacattgaactctctttcgagacatatttttgatgggaagcagtccacacctcctgcggagcttcctagatctgtttacactgagaaatatgtttatgacttgggcaaagcacaggaaatcatgacgtgtagactagaaactagccaaaaaagacggtatattcaagcaaatagtatttgtgtttgttgggctttccacatagacaggtgtttgcataggtgtgactgtgcagaggagggaaagagagccgggaccagggaccacagctgcttctccctcgttgttgttcagctgctcagttgtgttcgactctttgcaacccagcagactgcagcacaccaggcttccctgtccttcaccatctcctggagcctactcaaactcatgtccattgagtcagtgatgccattcaaccatctcatcctctgtctccccgcttctcttcctgccttcactctttcccagcatcagggtcttttccaacgagtcagctctttgaatcaggtggccagagtattggagcttcagcttcagcatcaatcctttcaatgaatattcaagattgatttcctttaggattgactagtttgatctccttgttgtccaagggactctcaagagtcttctccagcaccacagttcgaaagcatcaattcttcggcatttagccttttgtatggtccagctctcacatctgtaaatgactagctaattcaaaaaccttctcaccctgcaattctgcacagctgaatgatgctatgcttctgtttccccagacaagccagaccccccagccggtacaccttgtgcctctgacatccgaagctcctcactgaccttgtcctggtatggctcctcgtatgatgggggcagcgccgtacagtcatacagtgtcgagatctggggactcagtggacaagacgtggaaggaactagccacgtgccgcagcacttctttcaacgtccaggacctgctgcctgaccgagaatataagttccgtgtgcgtgcaatcaatgtctatggaaccagtgagccaagccaggagtctgaactcacagccttgggagagaaacctgaagaaggtaggctgccttcctttcatcactggcttgagataaatgtacatgacttaccttgtgtgtgtagaagtctgaatggagagtggtacaggggaactgacaagactttgctggtgactgtcagggtcttttgggatcttgctttccaatgtatatactgaaccatactctaaaaggggtacctgtgatctttcaaaaaatattgaaccagcaattttgatacactgccaccagggggcgatggtgtgttaatcaggagttcagttcagttcagtcctcagtcctgtctgactctgcgaccccataatcacagcatgccaggcctccctgtccatcaccaactcccagagttcactcagactcacgt

SEQ ID NO: 52338 - DNA, 1248 bp, Bovine  19866880820908
gagatgtgcatttgaaagctttggcaatgttctgaaattgcctccaacatccttgaattgctcatgccgagactcagggatctcagtcctttggagaggaccctgttaacatctcagtgtcctttcctaggaaagccgaggccagcgaggcagccccagtttgaggggtgactccctgcacttcttgagccttttggtgtgtttcctttcggtctgtgctcctcggggagggtagtcacggtgaagagacagacttgagtctgagcaacctcactccaatccctgctccgcctcttgttgcatgaccttgaaaaagttacccaagtgtgccagttgttagttttattatctgtaaaaggaggctgtaaaccaccccatgaataaagtggggcttagatagaataacatgtgtcaggcagaggctttacaactgagagttattcttaggagtatgatgcattgactttttctatatcccagtcttttctccacttaaaattattttgtgagcattttaacacacaaccgaatgtgtggaaatcctacttttcaggaagcccgggggcagcttctatgactgttgagccatgattctgtaattatgaaatccttccactgaagagcagtatttgatgagactccctttttaaattctgcagttctgtgtaactttcacacagattcaaagaaaatcctcattcgtcggttggaatcagttttcaacccccaattcaaacttcgctccacacttctagggaagattcagcccgagtgcatggcctcagtcgtcatgcccccacagcagccctgtgggctgctgctgttcacatttattgtacagcaggttgcttggtccaggaagtgtgggcatgtggggacatgtgaagaaatgtctcatctttagaaatcaaaccttgagcaagttcatgagaaggtgcaggagggggtaggaaggcagcccagcctgggtgaggccgggcagcagcaccagtgggcagaataccatacttagcttggaattgggacttggcaagctggatggaaaatgttgggagaaaacgtaagaaggcttcatctggtctggctttcatccctctgccccacgcctcccccatggacaggagtgagtcttccatgcacagacaccagatgattctcctgcacttgcagtaaggagcttgccccttgataggagctcgactaaagttgaaggagtagattgatactccgtctgtccttcccttccaa

SEQ ID NO: 52339 - DNA, 1962 bp, Bovine  19866880981810
actctggaccaggatttgggatgggtccagggaaaagcccataacttggaggggttccctgaccctctccttccccttcaggctatttctgggtcgtctggggggggcaggggtagagaaggagggcgcaggtccatgtgcagcagtcggtccccgggtacatcagggcagctcagtaagcagtttgatcaattatcccttgtgtacaacagggtctagactcagcttcttgcctctggataccaaaggcatcaggcagcggggaggtggtatctccggctaaatgaggcagctcaagatgatagaggccgaccctacatgtatcaaagcaggaagaggccgaggccttcactgaggagatagatggggtagcatctctaagacagtgggcaagcaactaaccccgttggactttaggaggggccctgccaatccctgtctatccaattcaaacaacatgtttcagcatcacgaaaactaccaaaaaatatggactatctgagtcaatttttgttaaaagacaaccacaaagacacattaaaaaaattgaagcatatttttaaaaagtacaccactatatgcgacttatttatgtctgcctgtcatacaaacattgcttttgtaataagaaggaaacttttcatgcagtttttgctaattcttgtgtaaagtataaggaaaagaccatctagttgtattagacaaagaataactttccctctgaaaatagttcaacctcaggtgaaacagttaaaaagcaattactagatttagtaattattgtcagggcaaagtaaaagtagttttgaatttttccttgtaggttgtattaatgaaaaataaaatcaatctcccaccttaaaaaagaaaaacaactctaaatccccctccaaccccaacccttcctttctccccatttggctgaagaaaatctctctggagtcccttaccttcagattctagtttttctgcattgagcgggctggttggtgaccctgttgaggatttcctgccactgagccctgagatcattgccatagaggacagtcttccgatggctctcacagcattgcccgttttctggaaaatagacactggcgttgggctcaggccgtgtccctggttccagctgagcagctcagggagaaaagcccagcccgggagaagcagctgtccctgagacgagggcctcccgagtgctgagctccaccagaggagtgagcccaaccttgctctgctcagcactatcagcgtgtcagaagatgttcggagaatggaatggggcctggaaccgatgcgtgcgttaatgtgactaaacaaggtcaacatgagacaaaaacccttttcatactgtgcttcaactcccataaaagggatagtttatataaagcaactgcgggctgagacagctccaaagacttattgcggacggggcgcagtggggctgtttctcataaaacaatgctagtgataggattttaattgggcaagagaacagttactacagatcccacaggtcctgttggaaagacaaaaaaaaacccaaaaagccttctgttgatcataggcaagtagcctcttcgggcttaacttcgctgggcttcagtttccttctctttataaggagggggttggacaagatgatctcaaaggtctcatctaggtctcatctagttctgtttatgattcagatacttaggagatttggggaaacactctgctggccccagcacaagtcttcagtggagttctggaggggtgttcctccctgaggtacatacacccaggcatcaaaaaccagcatccgaagaaatgaaaagcacagctcttggcttttctgagttggggcgccttgggtgaggacagaatccctactgaaaaagatgccaggacttgaacattttctttgtattgtaaaattctacccagtacaggatttaggtcaagaagtccccaaccaca

SEQ ID NO: 52340 - DNA, 1730 bp, Bovine  19866881071321
ggagtgggttgccatttccttctccaaaggaagctacactagatgtttaaatatacctgtgtgtttgtgtgctaagttgcttccgactctttgtggccctattgactgtagcccaccaggctcctctgtccatgggattctccaggcaagaaaactggagtgggttgccatgccctcctccaggggatcttcccaacccagggattgaacccacatctcttaggtctctttcattggcaggtggtttctttaccactagcgccacctggaaaaccccgtttaaatatacctatgatatgaatattaggaaacttgtttaagtatagtagttttagtacattttccctctcagtgcatttttttaattgaagtatagttgatttaaaagttgcaggtgtgcaatatagtgattcacagttttaaaggttgtactccattaatagttattataaaatattggctgtaatccctatgctgaacaatatatccatatagcttatttattttatacagagtagtttgtaactcttaacccccctaccccaatcctgccgttcctcgtttctgtctccccactggtaaccactggtttgttctctatttatgtgggtctgtttctttttttgttaaattcacttcgtttcatttttgattctacatataagtgattttatacagtatttgtttttttctttctgacttactttacttagcataatgtcctccaagaccaaccatgctgcagcaaatggcaaattttgattcttatttatggctgagtagtattccattgtatgtctatagcacatctttattcatctgctgagggacatttaggttgcttccagatcatggcaattgtaaataatgctgctgtgaacattggtgagtatgtatcttttcaaattagtgtttgggtttacaccaggagtggaattgctgagtcatatggtaagtctatttttagtattaacaagaaacctccatactgttttccacagtggctgcaccaatttacattcccaccaacagtgtacaaaggttcccttttctccacatcctaaccaacatttgttgtattctttttgatcatagctatctgacaggcttgaggtgatatctcattgtgattttgatttgcattttccctttgattagcaatgttgaacatctttccatgtgtctgttggccatttgcatgtcctctttgggaaaatgtctgttgagttctgctcactttttaatcaagttgtttagggtttttttttttttgatgttgagttgtatgaactgtttgtctattttggacatgagccccttatcagttatctcatttgcaaatattttttccaattcagtaagttctgctttctttttgttaatggtttcctttgctgttcaagaggctttatgtttaattaggtcctatttgtttattttgctttctcaatgcattttgaaagccccatcagagagtggaattagaatcatgagaaggacactcacattctatggcatacatttacccatgatcatcactagatggcacccttgtattagtaaggagatacactgccctaaaggactcctggaggacgtctaataaaaatagacagtaatgagtcaatagctgaaactgaggaatgagcgagttaagaagagaaaagagaggtgggatgtttttctatcactgtctcatgctgctgctgctgctgctaagtcacttaagt

SEQ ID NO: 52341 - DNA, 976 bp, Bovine  19866881936645
cagcctccttttatatcaccgctcaagataactgacctacatctctagagctacttcatagtttcacagcatttcagatcgtcccactgaaaggaatgttaagagattatctattatctagtccaactcctagttcttcagatgtgaaaactaacacctagggggaggatggctgacttatcacacagctagtgatatttccagtggggttggtttgccttagcttgattcctgatggcctggaaaacaagataatattacctcacagagaagagattttaaatatctcaataacagctttcaattcaaaccaaacccaaagctgttcctataaagatggcaaagggtaaaactccttgatctaggctctcttcatggctttcccttctgaactccaagtgaacacagaaactctcagggattacattttgcccactaataatcaatggagaagccactacagcttactgagtgcttgctaggtgccaggaggctctctgatcctgagagctacctctccttttgttaccgggagctgacatggggtcacatggaccttgctggctctcttccctcctgttctcactggctcaaccctgggacccgctgagttctggttaagcccagtgtgcatgagctctgggtaagtcccccacctcccctgctcaggcactctgggctcctgatgagcatgccctatttctaccttcatctcagtacattcacacagagctgggaacaacttagggagctgtgtgttccaggcaaaggacattttatgtacaaaattatggagtgtgaaaatgcaaagtttattcagagaacagtgaaactctgggcatccaggagcagaagatgcaggtgctaaaactatctttctttcctcttctctctctgtctagagaggaggaggcaaaatgtggtcaggaggcaacagactaattaaagtaccaaagcagagggagactaagctagg

SEQ ID NO: 52342 - DNA, 1578 bp, Bovine  19866880432357
atgatggtttggaactgaagtctaaatctcataggagcagatggggggcatcttgaggactccagttgtaaacgtctagaagattggtctaaggagaagaagaggcagggaaatcagcaaagatctggccagagcagggcaacttagataggatgactggccagtttttgtgtgtactgggcttgcttttgactacaaaggatatcagatcagatcagtcgctcagtcgtgtccaactctttgcgaccccatgaatcgccaggcctccctgtccatcaccgactcccggagttcactgagactcacgtccatcgagtcagtgatgacatccagccatctcatcctctgttgtccccttctcctcctgcccccaatccctcccagcatcagagtcttttccaatgagtcaactcttcacatgaggtggccaaagtactgaagtttcagctttagcatcattgcttccaaagaaatcccagggctgatctccttcagaatggactggttggatctccttgcagtccaagggactctcaagagtcttctccaacaccacagttcaaaagcatcaattcttcagtactcagccttcacagtccaactctcacaaccacacatgaccactggaaaaaccatggatcataggagaaggcaaataaaccaccattcaggaacagattttggtacccactcttccttaagggaaattttctgttttgtgtatgtgtgtgaagttcagaaatgaaaagaagcatgcaatctcaacacagaatgggaaaaacacagctggtgcactttgattgtatactgagcttttctttcaagagtcagactctgtgataggatatattcagttattttaaagccttcacattcaccaaaccaatatgagttcctagactcatggatttacacgcaagctgaaggtactaaatctcttttgagaaatggtgtatgcaagattacattaaaaacagactgagaatctaaccataacttaattatgcatacttaattatctggtggctcagaaggtaaagaatctgacccagggcttgaacccacatctcatgtctcctgtattggtaggcggattctttaccattaacgccatttgtgaagcacctaaaactgtgtaagaggaggatataatccaaagtaacaccatcaaagcacataatacaattggttgaaaatacagttgagcacgcccagcaaaggaaggtgtgaatttcctcatccttcatcttaatggcaacattttgtacaaagctacatggagcactcctttcatatttcatgagttctatttgcttgacttcaaaatgccaaatttgcctgtgaacagtgctttaatattcatgggtttttgagatggctttgacacttgtcaactggagaaatggcttcatcaggaaagaatctgacttgtgacttccagcacacacataaaatcatgtagtcattcacatatgcatcctatttgagaggtattcggtaatagctatattttatgaaaatgatatagacaaattccttataaaaaggtaggatggttttaagtcttatttggatata

SEQ ID NO: 52343 - DNA, 1675 bp, Bovine  19866880445311
tgtttgtgatccatggctccgcaatccacagccctctccctttctgtgcaaagtgtttggggctgactctaacccagagaacttcactgtcattatcttttcccaaattgctatttagaaagtttccgacacacacttgcctcatgttgatgatgcttgcgattccccttgggtgaaataatctgatgtagtgttaagcctgtcactaaggattgttcatgtataatttatagtcacaattaaaaagcatttttaactgtcgcaacacagtatcgactaaagtggccttaggaagaaaagagatttttctaagtagctatttgaacatatgcatttcttaaatatttcaaaatctgcatattctcagttttagagtccttgtattttagttgctaagtcctgtttgactctttgccaccccatggactgtagctgccaggctccttggtccatggaatttcccaggcaagaatactggagtgggttgccatttccttctccaggggatcttcccagcccagcgattgaactggaatctcttatatctcctcactggcaaacagattctttaccactagcaccacctgggaagccctgattgaattaaggcttcacaatcatcatgactcaatgtcttctccttttaaagtggaataatgttcaacatacataactgttctgaggctctaataggccagctttctcaagtagatagtacattagctagcatgttataatacctgatgtgttagtactgcttcagctgaaattcctgtcctctgtggacgtggataaatgttccaagcagtgggactgttcccatgcttctgatagtagttctcagatgcccgaggtctttcaaagaaacttgaggctaaagaatcctgatccaagactccacaaccccaatcctagataaaacactgaaatttattaaaaaattaaggtataaacagatgaaagaaaaaaaaggagttcagttctaatgttaattaatattaaagcaaataaaagtatgatgatcagcaagtaaaagcaaatgatcagtcgacgggtatttaggttgcttccatgtactaggtattgtaaaaactgctgcaatgaacactggggtgcatgtgtgtctttcaatcacggctttcttagggtatgggcccagtagtggggttgctaccgctctccagtagtgggtatttgttgcagtagtggatgatacagtagttcagttcctagtttgccttggctttcaaaagaacacatttgagtcagtcctaatgaggtagatgaacctattatacagagtgaagtcagtcagaaagagaaagacaaatatcgtatattaacatatgcatatggaatatagaaagatgggactgatgaacctatctacagggcaatacagacatatggagatccagacacagaacaaacttgtggacacagtgggggaaggaaagggtgggactaactgagagaatagcacagaaacatatgcattagtccattcagtcttccagtcctgtccaactctttgggagcccatggactgtagcacaccaggcctccctgtccatcaccaactccaagagtttactcaaactcatgtacattgagttggtgaggacatccaaccatcttatcctctgtcatccccttctcttcccgccttcagtca

SEQ ID NO: 52344 - DNA, 769 bp, Bovine  19866880477078
ctattttatcataaaaaacccatagaaatgattgagacccaccagcacaggagggttttttaagacctatttttaacataaagtttacagttttctgttttcatttcctgtcagctggaaatcaatatactagtaaagcactaacaatttaataacttgcctgctaaatattggttcagtgtattacctttttattgagctatggaaccttgatttatgcagaaccacaatagaattattctacataagtgagcaggcttttcttgtgttttaatttttcagactgtttacagaagtttcaggaagacatttaaaattcacaggagaaattcagtaagataaagaaacaaatatttagcctcctgttaactaaatcctttcttttggagcagaatattgactaggaactataatccatggaggtcaagagcccaagtttcagaatcaagcagaaggtgtgagcacaccattaggtttaaatttggctaagattaaaacagagaatagaaaagacagtgtctcagccctcaattgggcaaatattcaaaatgatgagacatcacataatgcattttctagagtatgtctttaaatgaagtgcacatgagctgtgttatttgctcagtcactgaatagaatcccatatcaaacttatctactggggacaagatcacacttgttacattaagcccttcatactgggattcgtaagttctgggattttatgattattaagttcatcttttattataccttccaaagaacaaat

SEQ ID NO: 52345 - DNA, 2730 bp, Bovine  19866880512076
atttacttttcccaaaagtcataatttgaaggatttctaaaattcctaaaagaataaagttataatttatgggcaaatattgcttatcactaaacattaataaatcttgttagttttgtggctctaaaagcacagactttgatgtgagcatacgaattgaattgagatatgagattatgaagttatttgttatttgttattaatactcttaataggtggggttggggggtagaagggaggcccatgagggaggggatgtatgtacacatataactgattctcttcacggtacagcagtaactaatgacatcgtaaagaaattatagcacctttttttttctttaaaaaaaaaaaaagcactccagcaaaatacattttgagaccatagcctctgtgtggcaatcaaagtttactacctttgtttctgactaaagcttctaattacattttggtctgtgattaaaaagtccaacattgaaaattcagcaattatcagtgttaaacttggggctttctaccattaaaatctttgctgctgatagaccatcaatgctttgatggatgatcatatcaatgaaaagaatgtttttattccccgtggatgtggatataagtgaagcaggagcagtggggattttgacactgatgtaaaacatttcctattcaataaaactctgtgcacctgggaaatcaattcttgctcagcctgtatttattatgacactctctgacttatgttttatggattcagaatgagaaaatcattaaaaattgtacttgtcacattagaggatcatttaaaattatactcctcagggactgtttttagcaatgtgctgaaagacctcctttgctgaccatcttgtctttacacatgattttctgcagctagctagagaatgtagggttcaaaacatcactattattgagatatcctcctcaggcagaatgtattttatctctgaaattttctcccaaataggaagctgtttttctttttctcttttttattcaatctgcaaacagcctctctttttctcaattcagtttacttactgtcagtcttctgcaggtttgcagacatttaaatagagaaagtctgacagttaaatagctaaaaggactcaacaaaataaattaaaaaaaaaaagtcttggacctgaggccaaagaatcaaaccaagtaagaccggggttttccagtgaaaatataacaaaacagaagttcagatatatgaatagtttgccctgggagaaataaattgttcatgaacagaaagatgacatcccaaaactggcatgaagctcagaggcatgacatcacaggctgacatataatgtgaaaatgaggaaattgtccagccttacaatgatttattattacagtcagactttcagatggtggagattgataagtgattatttcaggaacataagtttaaaaaaaaaaactatcagagatatttataagaaataacctaagtttcactcatgttcatgaaatgagctagacttagttttgtttaaatggtttagttgcttggggaattttgaaatcttatttccatcttattttattttaatgtatctaagaaatctaaaattcaaaccaaggttgtatcgggtaaggatatcaatatacactttatctttccctaacagataatctctagaacatttttccatctagaaatcataattacatccatcagtcgctctggggcagtatcatcaagcagatgctatatctgcacgtctgccaatcacactgccacagaaactgggggaaaacccagctttacaacagtttggtctctgagccactgaaataaacatcctcttcatggctatttgtatttaagatagtcatccaattgccacattttttaaattaatatttatgctttaatatagctctactttgaaaatatagctccaactcagtaagaaaggcttcatctaattaaaccaaaacaagattatctaaatttgtgtatatatacggaatagaaaatacaattgatatttgaatagaatatgtaaaaaagttgaccaagagaaaatacaattatttggaaaactaataggccctaattgcaacatacagagaggcaatacatatataaaacctgtatgcaaaatttaattgatatttgcatagagttatcatgtaaatggaatgttaaccaacagaaaataaagttctttaagcatataacaagtactgactgcaaaagagtttggactgtttgaatgtatagcaattttttgatattttgaagatatctaaaaagataaatttttcacatatacactaatgtcaatactttatactatccacagtatgcataatacatatattatatgcaatacactaatgtacacaagcagtgatatatgtacactaatatcagcccttatgtttttctaaggaccaacatcatggtttaactaccttttcttctatgaacgatatagttctaatgttttgctaacaaaaaattgtatctagtcaatcatttcaccgaagtaaaattccaggaaagttctttttctaaaactcatctgtaggtgatatttttgtgaagcaaaataagtactattcatttcaagtctccctccttggattccagtggaatctgttttccttattgtaccatgcaaataaaagtgtgcacccaaatagaaaagcagaggtcatttgagaagcaaatacatctttccaaaaaaa

SEQ ID NO: 52346 - DNA, 1782 bp, Bovine  19866880580660
ccatgaagtggtgggaccagatgccatgatctttgttttctgaatgttgagctttaagccaactttttcactttcctttttcactttcatcaagaggcttttgagttcctcttcactttctgccgtaagggtggtgtcatctgcatatctgaggttattgatatttctccctgcaatcttggttccagtttgtgtttcttccagtccagcatttctcatgatgtactctgaatatatatctataatttatagcatatctataaatatatatctatcatctatagcaatagatggacatatctttgaaagtcacaatggctctttggaggcagatgtaataggggttggtttagtttctaagtcatgtacaattcttttccaatcccatggattatagccttccaggctcctctgtccatggaatttcccaggcaagaatactggagtaggttgccatttccttttccagggcatcttcctgacccagggttcaaacccatgtctcctgcttgacagatggactttctaccactgggccaccagggaagtccctagatgagacagtaggtgaaggctgaatcacttactaccattaagcagtaaaatattgggcttctttggtggctcagatggtaaagaatctgcctgctatgcaggagacctgtgtttgatccctgtgttggggaaatcctctgaaggaggaaatggcaacccaatccaatattcttgcctggaaaatttcatggacagaggggcctggtgggctagagtccacagggtcacagagaactggactcagctgagcaattaacactttcaaacaataaaagatcagtttagtcctgcttttacttggtccctggtgaaaaagtgcctacatgacccataaacattctcattcattccaagcaggcatgtctattagctacaagctctacattattaaaattataacctctctaagcagtcaactaactttaatctctgcttttatatgacagtgaaactctactgcctggaaataataatgttataaagaaattttctgaaaatttataaactgggcaaaagtcttaataactttctcaagtaatcagaagttatttgagcctaaagtggattgaaatactagtataagggagctatagatttccctgctcagtgtctgtcattgctccagtgagaaaggattaaaaaatactccagtattcagccaatattgttctccatacatatgtattcaggttatcctagtgtaagtcaaaataatccattctaggggatgcattggactccacaggaatattcacaataaagagaaatttagggacttgtgggtttacagtgtgctgactgatttctaaggaggagtctacatcttttgtgctctggtggttttcacacctcaaggaaatgtacaaatgaagtaggatttgtgttctgtaaggggtgtggctttcttttataaaatggtaaggtcagtaacaaatttaagaaggtctgttttagaatataatacagatagaaggtcagaatctaaattaatcttcttaaaattattcccatcctttccctaaaaatctgtgccatcggggaaatcagtatctgattttgaagaccactgttaaaaatcttttggagatgctaatactgggcttcccaagtggtgcagtggtaaagaatctgcctgccaattcaagagatgcaagagacacaggtttgatgcctgggtcaggaagatcccctggaggaggaaacagcaacccactccagtattttttc

SEQ ID NO: 52347 - DNA, 1298 bp, Bovine  19866880599988
gagcgttttggccccgccacagagcattctgcccggagggcctgggaagcctttcagtcactgggccaggaccgctgggccgggtgtcagctcagctgccaggactggccaggtctgggccaagctaggacccctcaccgcatgctgctaggaaatgagatcacccgtgaaaacagataactccaaagcttggctcacttctcacagtgacccacattcttccttcacaagagagaaggtgagacacacctctgttctttttacacgacacaccttctcgtgtttagctctttcattaaaaacacctcttttgctcttttctgtaacacagttctgctcttttctataacagctcccctcccctcgcttccacctagaaaaagctgagacaacactctgagaaaaagatgtgttttagttgccaacatgagaaggtggcatctttttaaaccaccacccacttactcccctaagtgtatcatccatatcaatgaagctaattttataaactgaagatgctctttctattaagttctcctccaaatgaaagcagcgagcttcattctatttatcaccctgctctttacaattagttttatgatggatggcgagaatactaatgctataaatccagtctgcaactctcccaaggctactgacagttattaatcccttgaggaggactgaaaatatgctatataacaagtcagtctgacttgtaacctccgctgcagaactgtttaaccccccacactcagattcacgccacaggttttttaacaagatatgaggatctaaaataatcattttcccaaaagtaaggcaatgcctgagcattgagtaaaatcagacaatttctgatcctttaatacagccatacaatatcactggctattatatacaggatgaataaacaatgaggtcctatcgcatagcatgggaaactattttcaatatcctgtgatgaaccataatggaaaagaatattaaaaactgtgtgtgtgtgtgtataaaactgggtcactttgctgtacaacagaaattaacaacattgtaagccagctatatacttcaataaaataaaacaaaagtagcaaaaaataaaaacaaataccactggctgacactggagactcaccttcatttctttaaataaagacctaaaatatgtcatgaaaaatgagtttatgtatcagaaacagcttaaaaatataaagtgcctgaattttgatccagtgtctggatcaaactttaagaagagctctctgctaccatcctctgctcataactggtaacat

SEQ ID NO: 52348 - DNA, 859 bp, Bovine  19866880600697
ttgtagcactgagtccttgaaacagtgttgtcactaagttctttgtgacaatgaattccatttttgattcacttgacataatcactgaactgagaacagtaccagactcagtgcaaagactgaacaaatatttgttggtttatcaagagaaactattgttgggagaatgcaaagaaaaaaaggtgaaagagaagcagtattcagatttctttaagatatagaaagttaggctgccctctggagataacagctggccactatgatgttgattgcctgtaaaacatttgtgggtcattgggagaagagagataaccttggcttcttctgtccctctagagtttcacctggggaaataaacagaggtagaggaattttgattattctgccaagggttagccattcagaagcagcagtaattaattaaggaactaaaacgcaaatacagataatccatcgcctgaggtggagctcagcaccagggctggaaatgggtgagaagcagcctggatctaaattacaaagggctttaataatatagtaagattgttcagcaactactgcatgtgtgctcagtggtgtccaactctttgtgacccatggactgtagcccaccaggcttccctctgtccattgggaattctccaggcaagaatactggagtgagttgccgtttccttctcctggggatcttctgaacccaggggttgaattggtgcctcttgtgtctcctgcaattgcaggtgggttctttaccactgagctacctgggaagtccttacaaagcgctttaaaagaggtgtcaaaatctgatgagggacgagctctccaatcagatgttaacagctggagacgggtggag

SEQ ID NO: 52349 - DNA, 1636 bp, Bovine  19866880614554
aacctcatcccatacaattcagctgcacaattgctcactgtattgaaataaaatcaatctccctggacagtagtgctgattctatgcctagtatccacccagtatacatccaagtcccttttccacatgacagtattttcctcacttgatgatattctgtttagtaaagctcatccatggagcctataatgtatttggtaacattttcaatatcttaattttgattgagagtaaacttattagcttatttttacatataaaaataattttcataaagtagataaatttatcttcaggtacataatatatgatctttaattgggtggaagtttcattctccacccaatcctctttttctcatcccttatgaatgcagtttcctggaatatttcctactaaatctcccatgaccaagatacagtatccaaatctacttttaactgtgctattttctcaactcagaatgtgcagaatcagtaattctatattcttctgtaatattctacagcaatggtggtattttcttcagattataagcatatattaagtagtattataaaaccactttgaagatattttccaaaaatgacttaaggacttttcatggtccctgtttaattaacactggtaacatactttatagaaagtattacttagggaggaataaaaacaatatattcaacagctataatggctgcttttaatgtcaaaacattgatataaaatccccataatattatgtctatagtattaaaacctcatatattaccactaaagcagcagttaaatgaccaccttttttcccaatattcatttggataatctggcataagatgaactaggaaaggacagtcttaatggttaaaatgaaagtgtgaattcagatttacagagagtggaagtaacatcaaatacaaaacgataacattctgactccctgattttagatttccatctaacttgactttttgcttgctaagatctatcttgtcaagataatgccccactgtccatccttcacctatcatgttatagggtggacttaagggaactgacattctgtgaataaaccaggcatccaaagacgtctggagaaaaggactttgtactgatggaaaagggacaagcgtgttgtacctcttccccttgttgccctcacaccaggtacagtgtggctgaagctgtgttcccctcagcttccctcctcactgcttcacagtgagattcaggagtctttggctattttctgagataaaattcagatttgaccgttttgtcaaaaaattccaaatattcacgaagtacaaaaagatgcacttgtatacagcaataatttgttgttataatttttatttgattacatcctcatttcaacatcctcagttttcctagaacagtggtacattaatttcaaaatatgctgtataaaaaagaaaaagcagatttataaattaccctttgtcccttaagtctatcaagaccccacagataaggtaggagattcatgagtgatccctttatttgaataactaaggacgcctatctattttaagtaaggtaaagttttacttcattcaattttcatataattcttaggcttcttctaagtgtaagtcagtcttttaggcaagtttca

SEQ ID NO: 52350 - DNA, 3599 bp, Bovine  19866880662790
tgtgaaggaaatagtcctgaatattcttggaaggactgatcctgaagctgaaactccagtactttggccacccaatgcgaagaactggctcatttgaaaagaccctgatgctgggaaagatgaggtcaggaggagcaggggacaacagaggatgagatggttggatggtatcacctattcaatggtcatgagcttcggtagactccaggagttggtgatggacagggaggcctggcgtgctacagtccatggggtcacaaaactttggacacgactgagcgactgatctgactgactgacttatacaaaagtgttactctgaaattccaatttaacaggatgtctcttatgtttacatgtcgaactaggcaaccttagttagagggataggtgtgtgtctagtacatggggagagagcttttactctttgacctaagacatctgtatctttagggtgagcgtatgtcccctctgctgaaaggtgatcctaccaaggataataacattgtgttcattaaaatgtttaaagatgttctaaggctattttgcactcaagtctcctcggaatggtgaagtgccttattatactacattactattgtaagcatcaagaagggatggagtgcaagatgaaaataatgcagtagtctatattaaagcacatttaagtttaaaatcatgggatgaaacttaattaagtgccagaaggtatattaacataaatgttgagtttgcaaacttaaatacacaaaagtgaaaatgtctagacactaaaagttccctggcaacattaactcacctacatcatgcaccgtgcataataaaattaacatttagcagccagaaatgtcgtttagagcacaaaatatgtgcaattcaagatcattaacattttccatattttcatacttatttcaaaggttcactattctcattaaactaatgtagaaaaaattactcagtctcagagttaaaaatcattttaaaacatatttgtttatttcacagtgtttcattagagtcctaatcaacctgggttgcattctgttatagcaacacaggaaaaaatcatttttacatcaagaaaatgttaagtatagtataaatcttcagtgtacatgtctttaaattattgcaaacttgctctcactatagatgttttctaaaaatatatctgtatgtattattctagtataattcctggtattttaataaaacctggggattgtttatagcatggtaaacctgccaacttatttcatctccctgcacgtcaaattcttcctctgtagaaggaatctaataatagtacttggttcatagtggtgccatgacaattaaatcagttactatctgtaaaatgatggcagtgaagaatggtacgtggttattgttgttgtttagttgctaagcagtgttggactcttttgggaccgtgtgataactacagcctgccaggctcctctgttcatgggatttcccaggcaataatactgggagagggttgccatttccttctccacgggatcttcctgacccagggatcaaacctgtgtctcctgcattgccaggtgaattctttataaagagctaaaacatcatagtgtttataaattgcaagattccagataaataggtacaaggagattttatatcaccattcttagacttctacagtaaaaatactaagacaactgaaagaatgttagtgagtctataatatttcaacatttaaaggcatcctttaagcttacagtttagagcaaaataaatctgttgattgttcaggctaaaaaaaaaattctctaatgagtgttcttgactagtaaaatatgaaaaaacgattcaaatttattagtaaaaattgggggaaaagccatgaaaattagttgtttttgcaggtgtatgatagaatataaactgaatcagactggcaatagcaagtgctggtaagagtctgcagccaaaggaatcatcaaaggttgctggtatgaatgtcaattgctacaaccatttggaacaactgtttggcaactgttgcctcctaaatttgacacagctacatcctgtaattttgcaattccagaaatgcatgtacttgtgcacccaaagaaattacagggtgatcacagcagcagtactcagcatagctaagaactggaaaccacccaaatttctgtccacagtagaactaattggacaaattgtggaatagtcatacaatgaattcctgtagagaaatgagaattaaggtgtgacagcagtgctcacaacatggatgatcttcacgatgtttagcaaactgtataacaaaagagcatacatagtgtgaatcccataataagaagcttaatatggggaaatttagtgtagtgtgttttaaatgaaaatatttcttttcctggatgttggttaccacatgatgattcattgagatgaaatcttatcatttgaccactcttctgtatatattacacttcagttaaaataatttttttaattcagaaaaggattttaattggagatgcaaaaaagtactgtgacctctattgttaatatgtctagttccctgtgttgttgttgtttagtcgctaagtagtgtctgactctttgcaaccccaagaactgcagaacgccaggcttccctgtacaccgctatctcccagagatgctcaaactcatgtccattgagtcagggatgctatctaaccatcttacctttgttgccccgctctccagtcctaccctcagtctttgccagcatcagggtcatttccacagtgttggctcttttcatcaggtggccaaagttgatttcctttaggactgactggtttaatctcctctccaagggagtcttaagattccccagcaccatagttcaaaagcatcagttcttcagtgctcaaccttcttaatgatctaattctcacatctgtacacaactattggaaaaagtatagctttaactctatagacctttgtcagcaaagtgatgtctctgctttttaatatgctgtcgaggtatgtcatagctttccttccaaggagaaagcatcatttaatttcatggctgctgtcactagccacagtgattttggagcccaagaaaataaaatctgtcactgtttccactttttccccttatatttaccatgatatgatgggactggatgccatgatcttagtttttgaatgttgttttaagctaccttttccactctcctttttcactagacccctataggatgcttaaaaacaacaacaacaacatccatttaggaaagaacaaaatgatcctaattgacatctttgccataccaatttgtcaaaataattcattagaactggaagaaagatatgtagtgcattgatgagaagtacagggtcttccctggtggctcagaatctgcctgcaatgcaggagacctgggtttgacccctgggttgggaagatcccctggggaagggaacggctacccactccagtattcttgcctggagaattccatggacagaccatgggtttgcaatgagttggacatgactcagcaactacgaatgaggtaagtctaatttttaaatactttcagttttag

SEQ ID NO: 52351 - DNA, 1139 bp, Bovine  19866880700503
ctggtaaggaatctgcctgcaatacaggaaatcccagttcgattcctggaagatacacaggaagagggataggctacccactccagtattcttggtattccctggtggctcagctggtgaagaatcccacctgcagtgcgggagacctgggttcaatacttgggttgggaaggtcccctggagaagggaatggctatccactccagtattctggcctggacacttccatggactatatggtccatggggttgcaaagagtcggacacaactgagtgactttcactttcactttaagtgaatagatcacagtatatttgagaaataatccaaaaaaactgatagctataccaactgatctagataacattgatcgagttgaacacttaacccaaatatccaaaaatatttctttgagataagcagataaataatgtgttagaaattttttttaaaatcttttttttagtacattctaatgtgtggaactgatttattagtgcttcatgatgattgaggcagacattttacaattcatgcaaaattacagttttgacttctaggagttagcatcctaaaataatgacatagatgtttataatactcttgctgctgctgctgctaagtcgcttcagtcgtgtctgactctgtgcaaccccatagacagcagctgatcaggctccactgtccctgggattttccaggcaagaactggggcaggttgtcatttccttctccaatgcatgagagtgaaaagtgaaagtgaagtcactcagtcgtgtctgactcttcgtgaccccatggactgcagcctaccaggctcctctgtccatgggattttccaggcaagagtactggagtggggtgccattgccttctctgatgatactcttaaaagaaagcaaattgatattgctcattaactttgttggccattttttaaaatgatgttgatggagaaggtagccctttgaatgcaatacatctagtgtccagagattttctttcagtgccttttgtgattttgcaatagcctctgctattgcatacattgtaatataatgtgttacaatgacttctctagattttaatatagtcattgtactatggactctttatccatgaaagtgttagccattca

SEQ ID NO: 52352 - DNA, 774 bp, Bovine  19866880769134
cacgcatgcacttccccatttgggtccccccagagcactgaatagtgctccccatgctgaatggtgggttctcattagctagctgttttatatgcaattgggattagcatatgctgagtttcttgaattcagtggaagccttttaagcctgagggattgaaatcctaagaaaatactgctcttcttggctcattcctcccatcctgcttaaccctgactcttccttccatcaggggcatttttaagacctgggctggcaacatctgctggttttggatcacccacttccttttggaaaccacagcagtctcttatccttttttaattgtgtggcatcagttgtaataccttctctttcattcctaattttttaaataagaattcatttttaattgattgctctacaatattgatttgatttctgtcatatatcaacatgaattaaccataggtgtacatatgcccctccgtcttgaattttcctcccatctcccagccattcccaaccctctcggttattacagagccccagtcatttctaactttatgtgagtgttctttctttttgccttatgccagataaatggttcgtccattttgttgatcacttcagaagacaaactcctagttttattggctttttctgtcctttttcctggtctccatttcatatttctgctctgatctttattatttccatcttcatgctaaattccagcttgatgtgttcctttctagttcgttggggtgaaacattaacttatggtgtctgag

SEQ ID NO: 52353 - DNA, 2184 bp, Bovine  19866880861288
tactctgcatataagttaaataagcgggtgccaaaatccagccttgacgtactcctttcccaaattggaaccagtccattgtgccatgtctggttctaaatgttgcttcttgacctgcatacagatttctcaggaggcaggtgaggtggcctggtattcccatctcttgaagaattttccacagtttgttgtggtccacactgtcaaaggctttcgtgtagtcaatgaagcataaatagatgtttttctgggattctcttgctttttctatgattcaattcaagaataaatacccatttttagaagaggaggcgcaggtaactgactctctgctttgttctgatttacccagtggctctgtggtggttactatagatagaattatgtttaattttgaggggtaagctcttgttttcagctgaaccattatcttcttgcagaaaacaaatcaaaaataaatcttcctagagttctctcatggtgaaatcgttctgaacttcagctcactcttcccatgagctgtagtactgaactttctactttaggtattatcttactagactattttttttttcttatttagatcaaatttcattgaaataaaaatttttttactggtattgaattctctgatcagtttccttgcagaatcttcagtgccagccatttagaaattttagaaattctacaagagcaatctgaccttaaaatattctgaactgcaggctgaactcccccattcatgtgagctgtcactactgtctgactctgctgatcagcagactatgtcaagcagagctgtcactgactttaggaaaacaagcaaaccatttaatcatgcagggtctgaagcaaagttggaaataaaaatcacaacagttttcccttctcttgtttctgatactgaagccaaataatataggattatagtgcctattaaaacacatattgaatgttttacttataaatgtttcagtctgtaactatttgtcataatgtctccatagactacattctataattatacccattttatagttgaatacaataagatattgtgagcttaagcaattttcccaagtgaaatgtctagtaagggacagaccttacacttgggcagcctacattgaagagcattattttcataatgctatgaccatcaataccattctataatagatatattgcaaactgtaggtttttatttggttttatttaacaataggaatttgaagaaaacattgtatttgcttttatttaataccatcagaaatcatttcctattagcttaaaaaaaaaaaacaaaactctttagttccaactaccatggaagaattcagggttgtggtgtatgtatgtgtttttaagacaatgacttcttaacatccccatgtctatacttattaatttgggtcattctcacagccatcaaatccaatgacccttctactgtgagctattctcatcagcctattaggagtgagcatttatttagtgcctactatccatcagaaattataataaacgctttaactgatccttactcctcacatccatcctctgattaagcatatttattatcttctttttatagatcaggcttagagtacttaacttgttcaaggtcacaaggacagactgacactaaaaatctaatgtcttctgccccaaagcacgttaacatatattttctttctctcttataaaaagaggaagcttcaaaaataatattccaaacatgtgtcaaatcttctgcatcatacttttagaactatatagtcttggaaatcccattttccagcatatactttctaaacattttattcttatcaaacaacttttgaaagtgtatcagcatctgcatttttctaacactgggtagggaaactggtttcaaatttcactagaggaaataattgcaattagctcctttcctcaaagagaaaaaggaggaggaagaaaaaaaatgtcagaaaaagaaagaactgtaaccatttgctgattttactgtggattcattagccattagtcaaaaactaactgatgctttcaaattgtggtgctggagaagagtcttgagagtcacttagaagatcaaaccagtcaatcctaaaggaaatcagtcctgaatactgattggaaggattgttgctgaagctccaatactttggccactgatgggaa

SEQ ID NO: 52354 - DNA, 1311 bp, Bovine  19866880892432
cacacctgtctattatatgtactaaacagcatttgccttaagacactgaaatatatcattcactattaaaaaaaaaaaaaactttctgccctgtattggagtatagtcacttaacaatgctgtggtagtttcagatgaacagcgaagagagtcagtcatatatatattgtatccattctcccccaaactcccctcccctccaggttgccacatagtgttggacagagttccctgtgctgaaaagtaggtccttgctggttatccactttaaatatagcagtgtgtacatgttgatcccagacttcactacttgtttttaattcatcttgattaaagtgatctaaaacatgtcatagagtggaaatccattagatcagtacaatctggtctttccgaagaaagtgaaataacaaaagtaagaatactacaaaggatcccagagacttcaagaactttggttttctcttttaatataaaaaagaataagcaaaagaagtttgcgttatttgccaggcattaaaaatctattcatgctgcttgattttctgccattacctttcaagacctgccccgaggaagccaaggctccgttcagagcctagaaatacagacacattcagacacacaggtgtctccaatcagaagagacactggctgaggtgggattgaggctagagtttctgtcaggaagatgtctgctcctccgtggcctctctcatcctgctgttgcctctgtctggaagcgccccgccagggctgattagaattctgcagtgagatgcttgtgcacctctagaatctttgtctcagctgattagtgttcaggtaacccctgcattcctcagggaatcacacatttcaatccatgccagacataagatatctgttttgacagtctttgattgtacttaagtagtgcaggttttaaataatcaaagagggcttatatgatcaagtctaaggtctcagaagtgcttttctgtcaataaggagaagaagttttctgaaaaaatagaataataaaattacagataacatggagctgcctagactcaagcactcatgtgtacagagggaaaagggaaaacaggacaaaagatgataaagaggttcgatgcaggatacaggaagcttggggctggtgcactgggatgacccagagggatggtatggggagggaggtgggaggagggttcaggatggggaacacgtgtacacctgtggtggatgcatgttgatgtatggcaaaaccaatacaatattgtaaagtaaaaaataataataataaaatttaaaacaaaaaggaaaaaa

SEQ ID NO: 52355 - DNA, 3005 bp, Bovine  19866880913593
ctgagtgccaaagaattgatgcttttgaactgtggttttggagaagactcctgagagtcccttggactgcaaagagattaaaccagtcaatcctaaaggaaatcagttctgaatattcattggaaggactgatgctgaagctgcaatactttggtgaacttctgagaagaactgactcattggaaaagaccctgattctgggaaagactgaaggcaggaggagaaggggacaatagaggatgagatggttggatggcatcactaactcaatggacatgagtttgagtaaggtccgggtattggtgacggagagggaagcctggcgtgctgcagtgcatggggttgcaaagagtcagactcaaatgagcgactgaactgaacagaaagataatttattaaaggctaattgctaagttttccatatattaaaaatttgttttgcataagggtctcatagagtcaggcaggactgagtgactgaaccaaactgaggtcaacatcaagttatttagcagcaaagaaagaacaataggaagggatgaggctagtagcaaaaatagaaagttttttttttttcctatttctggtatgctgcaattcatggggttgcaaagagtcggacacaacttagtgagtgaacaacaaaaccaatcaattatattagtagtgcctgggaatcatttttgacttcaatccttaatctttctttagcattaggcatcacttcatttaacagtgagcctgaatatacattgtctttttcaatatttaaatctaataacaaaagatgttataagtaataataagtaccttaaaaagtacctgctagaagtaactactcaagccaaagaatgcttcctatcataaaataattatttaaaattttaatattgacatcagggtatcctatggcaatttctcctgggttatttgcttttatcaatcattatatctcatgtcatcctagaagagatacaactttatttccataatacagacatgaaaatggacatgtagactgtacaagtcatttgcctaaagcttcaggaacaaaagtatgtaataatcacagtgttcacatcactgtgtaattgatcacatcaagtgatttgaatatcaaaatactattcttcaggattaaaaataaagaaaatagtattttgatttacctccagagatgtcatatttaaagagaagagaattagaacaatgaaatgcatgatcttgtgaaaatcacctgactttataggttctgaaaattatgatatacagataaaggctagaaaaacacgtctaaactactatccccgactgtctctagggaagaacaagcattcagcgctggccaaggggaagacgaactcagacgctttaactcttgcttaagaatagttctgccaaaactaatacaatattgtaaagtttaaaaataaaataaaatttaaaaaaaaagaatagttctgcctttctacacttttaaaagtaacaatcatacattacttttgaattaattttaaacgaagcaaagtctttcccctggacttttccgctggcattaacagttgggtgctatatgctagttgtcaaaatattggaaaggatttagtacatttattcttctgcattgccaagtgtggtagaatatttgcaaaacataccgtatgtgagtaacagaaaatgacttgacttttccatcacacctgttcgctgcaactgctttgctacaagcattcatgaggacaacttatttgaagtcattattggcaacacaagtgggaattttttctaccttgttaatgtgtcaacattttatcgattctagaagcaagtctgtcatctttcaaattcattgttattcacttttttttctcagcaatttagacacccaaatatagtgacagccaaacctattataataaagcaatatcagagtactgtgattccgtctgatgggcatccagacatagtaacttagtaacctaatactccaaaaataaatttcattcaatggaatgattttcttatagattcagtctagagtgatttgatatcatcatctgcatgaaaatccttgcagtattttgctagtcttctgaatgtataaagcatccataaatatacaatttcccagaaaataatgacataaatacaaagatggaaaattgattattctacaccttggttgataagaaaacagagcaatgcttaccacaacctatctgtcaggtaagatatcttttatttatttaaaattaatttcatgctcctaaatattttcctggtttcaaattattttactgcatacagtaaatgtcttttgcttttttagctataaaaaatttacacttcttatgatgtaaagtctatatttttttccatcattttacttaggttactttttaattgagtcatcaattgacatctattaaaatttaacaactgctaaattctaaagacctcattagaatactctctctctctgtttttcagatcacataaagtacttacatcagggagaaattctttgttttatacttcagattgtgtatctatttactggcaaagaactacacagtaaatcatagtatttgtttggtctaaagacttaagtccagccctggaatactttaaatgaagccctaatcaaaggaaaagaaaatatctctggccattttcatagacatgcatgcacttcgtttgtagagattcagttcctatttacaaatgtcgtgtgtattggtgaggacctgggatccaagttttcctctttcaaaggaagtgctggatctttttcgttgctgttattgttcagtctttaagtcgtgtccaactctttgtgactccatagactgcagctcgccaggctttccctgtccttcactatttcccagactgtgctaaacctcatgtccactggagtcagtgataccattcaaccatctcatcctctgtcagcccttggtcctcctgccctcaatctttccaagcactagcatctttttcaa

SEQ ID NO: 52356 - DNA, 1857 bp, Bovine  19866880979422
acactagtaaagtaatactcaaaattctccaagccaggcttcagcaatatgtgaatcatgaacttcccaagatgttcaagctggttttagaaaaggcagaggaaccagagatcaaatggccaacatccttctggatcattgaaaaagcaagagagttccagaaaaacatctatttctgctttactgactatgccaaggcctttgactgtgtgaatcacaataaactgtggaaaattctgaaagagattggaataccagaccacctgacctgcctcttgagaaatctgtatgcaggtcaggaagcaacagttagaactgaacatggaacaacagactggttccaaataggaaaagagtacgtcaaggctgtatattgtcaccctgcttatttaacttctatgcagagtacatcatgagaaacgctgggctggaagaagcacaagcgggaatcaagattactaggagaaatatcaataacctcagatatgcagatgacaccacccttatggcagaacagtgccataaagtgcacttcattttcttgagcttcaaaatcactgcagatggtgactacggccatgaaatgaaaagactcttgcttctatctaatcgaagctatcgttcttccagtagtcatgtatggatgtgagagttgaaccataatgaaagctgagtactgcagaattgatgcttttgatctgggtgtctaagactcttgagagtcccttggactgtaaggagatcaaactagtcaattgtaaagtaaatcagttctgaatattcattggaaggactgaagctccagtactttgaccatctattgtgaagaactgagtcattagaaaagaccctgatgctggcaagatcaaaggcagcaggagaaggggcgagcagaggatgagatgtttagatggcatcaccaactcgatggacatgagtctgagcaagcctgaagcacgttttattctcctcaagcatgtttctcagtatataaaatttcagtgcaaatgcttctgagttagaaaaagagagctaatttctgttttgtactttctgtcctttttgaaaataactttaaagtcagttttatttttccttgtctcttcataaaacgatgacctggttaatgaagtatatacactcctttaacactgtttgacatataaactgtgctttcatgcaggttgttttactacatttatggctgtactaaattacagtgtgagtatgaagcatagccatagaaacagacccacggaaatcgacatgatgatatatagttagaatttttatttagttgtgaaggtaaattacagtgaagcacttttaagctattgaatattagcagtaggctttccctggcatctagggaaatggaaaagagattaactcttattatagacaggggaccaccctccccgaagaaagaatttccaaacatcaaaatctctgttcaccatacttcttatctggattaataaaaatcttatccatgatacttttacttcacatgaattttttttttcataaaatatgccatttcattgccgtctgtggatctgcagaaagaatcactttttttctctcctctatttaaggagtctcaggctttgttctgtgatgtttgcctggcttaatacaatgaacttaattctgtgatgttacccctgtgattactaaaatgatttccccttatattctagaaattgcatctatgtccaatgggtagtctccttgctcactacagaatgatttataaacgtgtcattttaaaagataacacagaaaatctctccatgaggtcaacggcaaagctacctttcagtaacataatttccactatcaaaatacaatcaa

SEQ ID NO: 52357 - DNA, 1141 bp, Bovine  19866881003338
tatcttttggtttttcatcattatgccaaatttttaaatatttctgtcacttttatataattgttctcggcttccaagaattttggttcctaacagctcttttatggaaagaatggaattgttaacttgcgggcataaatgaatgtttcatgtagtgatttattactacaccctgagaatattttctggagactaattgtattaaaagccctatagaatttttttttttcttctagcataaaaggaaatgatccacatctgaaaatatgttttgcctcacaaaagtctggctcctacaaattttgcatttttttaaattacaataacctgaaaggaaaaataaatcaactgctgaagcaaaaaatccccaaaattcagcatctaggacacctccaattaagtcagtgaaccaatgctttccattttgaacagatgttcctccccttttccaagtactgaacaggttttcatacctacttggtctatttttattgtacttggcttgtcttcaaattctattaaatgacagcctttaaatgaaaaagggcatttgattttgccaacaccatgggccacataagttcacacatccccatgttcatcaaaaatcaagttccttcctaatctaggggaccagtatttgaacctggagatcataaataagttttatctgacttttctaagtaataatgctaaattaagcacagatagaatcatccctaagaattattattatccttcatttactctgtgaaatgaagcccacctttgtcatgaatattatcattgttttacttttgagtaggcttcccagggggctcagtggtaaagaattcacctgccaattcaggagccacaggagacatatgttcaatccctgggtcaggaagatcccctgaagaaggaaacagcaacccactccagtattctagccaggataatctcagaggagcttggcaggctacagttcatgtggttgcaaagagtcagacacgaccaagtatgcatgcactttgactgctgctgctgctaagtcacttcagtcgtgtccgactctgtgcgaccccatatacggcagcccatcaggctcccccgtccctgggattctccaggcaagaacactggagtgggttgccatttc

SEQ ID NO: 52358 - DNA, 1247 bp, Bovine  19866881016047
aacaaaataattcagctcattcacactaaacttaagagctatctgagaatattcttgctttcttcaactagcagatgaagttaaaagagattggttgattctaaaaataaacataatatatagctatatctcaggcattgtcaagagcaatatacagagactgatgagccttcttcttcaaggttttaatgaaccttctttcttgattcagtcctagtgtcatttctttttaaagcaatctgtcacatctttctgctgggaagatatccttctgattctgccagattacagaacaataagaaatgacaataattctagaataaagcaagggatgagctaggtttgcagtcagctaaaaacatgagatagaaaagttaaggagtatgaacttagttctataatttgcaatatgtattactttggagatcaaggagaacaagtgaatatataaaaatgtttctattttcacattaaagtttgctgccatcttttacttcattttatgtcttgtgtatgctgtagagtatcagatgttcctggagaccttaataagaggctaatattgctcacaaatgtagaaatgtggaattaaagctctgcaatataatcattcttcacattgcattatttgagaatcatatccactaactatcaaagtgtctaagaaactcagaattcacccatgactatctcctgacagaaaatcatgtgtactataaaacaaatggaaacagtatcatgaacagtagcaatcagtgtattggaaagtgaaaaaaggaaaactatagtgtactgaaaccttatctacagacaatgactgtgtctgttcttgtagaaaaatgaggcaaaaaaaccccctgccattggcagctatggtgctaagtgggtcaacaattcattgggcatcaattattgacaatgggacattctctgcctgcattaatgagggactagaaactgttgtcacaaacagacctcaaatgctagttgtccaatgtgtgtgtgtgtgtgtgcgcgtgctcagtcatttcagactctttgcgacaccatgaactgtagcccaccaggatcttctgtccatgggattctccaggcaagaatactagagtcaatttccatttcctcctccagggacatggacacatggatggaggaacccaggtctcctgtgtttcctgcattggcaggcaggttctttactattatcaccattggaaagcccatgtttaataatgccaatatttttc

SEQ ID NO: 52359 - DNA, 1748 bp, Bovine  19866881021012
agtgtcccctcccaggggaagtttgagagtaaatgagttaatacaagtcaaggacctggagaaagattgagggcaagcggagaagggggcaacagaggatgagatggttggataatgtcactgattcaatggatgtgggtttgagcaaactctgggagatagtggaggacagggaagcctggcatgcgtcagtccatggggtcaaaaagagttggactcaactaagtgactaagtttagttttttaagcttttgattgtattcctttatcaacctttagggttcctctaagctttggtctatattcctccactggttttaatgaaaacatctaagtctgagcatatcttaattttatagctttgggtgagccatacaaaacaagcaacacgtttctggaaaatcttcatctaacttttctttcttcacaaccaatacacttcaaattctttaattcttattctacagagacattcaggtaccatattccatgaccaagtatgacttagggatctcagcttccaccccaagtagggttttaaagcctttcttctggtggaaaaattgcagagctctttaaaatcattcttctgaatagtttcctgtcttcttctgtggcttctaggctgtgtatgcattactccttcattttatggttttgcaggtgttttcaagacatgtaagtatgtggtcatctgccctcatgagaagccctacagcccctcctccccgcacctgtcaggcccaccagggctcagcaatgctctgattcccctgattgagcaggagcggacacagtccttgtgacacgtgagtgcatgctaagtcacttcagtcatgttccactctttgtggccccatggactgtagcccaccaggctcttctgtccatgagattttccaggcaataatattggagtgggctgccatttccttcttgtggggatcttcctgacccagggatcgtgcccacatctcttaagtctcctgcactggcagctgggttctttacccactggggaagtgccctgggagacacaactagtgctgagaagggaaaggctggcagatagcagtgagagtgagtaaagggaggtcatgggacacagggcttctcagccagccctaagagtccgctgcatgtcctctagctcagaaaactgccttcaaagacagttcattctcaatcagcctgactctccacgatctccctttaataaacccagaaaaaaagggacttgcatgagaaacagctgaggctgcactcagcccagggatgagacagacagttcagagactgcaggcagatgagctttggttttgatgtgtctattctctgaaaggcctgtgctgtcagcaagctgggccatcagtctggacaggcctccacctcccattgccctgtgcagcctagggtgaggctctgcctccacagacacaacatagagccagtggtaactgtataccacaccattgtacaatgacaaaattaaaccagaacgtattagggggctaagtgtttgagaaaagaataagacaataggagttcctggaaaagacttttgagagtcccttggactgcaaggatatcaaaccagttaatcctaaaggaaatcaacactgaatattcattggaagcactaatgctgaaactgaagctccaatactttggccacctgattcaaagagctgactcaatggaaaagaccctgatgctgggaaagattaagagcaagaggagaaaggaga

SEQ ID NO: 52360 - DNA, 626 bp, Bovine  19866881137722
catattgtgagcacttaatcaagtctggctggatttaatttacgagttaccaatgtacatgtcatatcactaaattaaatgctggcctcatatttcattttttgtaatcccgtaatattatcatatgtaaaacttgacattttcacaaatgacagagataccacgtgaggatattttagaagataccttaaaaatctttttaggagattcagttaaatgggacagaaatgaatgatggggaaaatatgcatggaaaatgtagagcaatactatgaatagtttgtgggctggtttatatgaaacaagctgtctcatttgtctagcaattacttttggtgatgctatggatatggttatttcctgctgtagtaaattctccccaaatttttaatgtgatattttgcttgtcttaataaatccatatctttcctttgtctcacttgtagtttcgtgaacactatccagtgtacctattaccactataaaattgaaagaatgttattatcacatttgtgttatgaaggttggcatttgaaacgctagcaagagtgtgacatccttacactcctgttgctccagatacagaagctgggctattttctaattatgcagattgtgttctgcga

SEQ ID NO: 52361 - DNA, 2743 bp, Bovine  19866881190917
atggttgtgtgtgtgtgtttattttttttaaccagggcaataacaaggtggtagaatggagcaaatgagacctgacacggagcaggttgtgatggctgccagtggagcagctttcagacagactttagggattctgttttggacatgatgactctgagctgtttctaagatactcaaatagtgctgtcctgactattgaatatatgaatctggacttcaggagagaagcctggatcagagataaagattttggagttaccatatcttctgggcagaattgtgccctgctcccaatttatatgttgaagccctaactgctagtactcagaattatgactgcattcctaagtgatgaataccaagaacgctttttgttctaatgtttgttcttcagccctgtgcctgatgcaaagctcctaagcctctttgcgtatcctaggtgacagtagtgtcttttgtttgaatgaggtgactttgggtgggctcctgcatgggggctggtccccagaaagaacaagatatggttagaactctgaattttcagcccctcctcttcattccctggagaggggagaggggctataaatggagttaataatggatcatgcctacttgaggatgccccgaaaaaatcccaatagtatggggttcagagagcttccaggtcagtgaatgtttctagtaccaggagagtgatgcaccccaattccacggggacagaagcccccaaccttgaaaccgttccagacctagtcctgttggtctcttcatctgtgttctttatcgtttgttcttgtttagtcacgcagtggtgtccgactcagcgaccccatggactgtaacccaccagtcctctgtccatgggattctccaggtaagaatactggagtgggttgccatttccttctccaggggatcttcccaatctagggatagaacccacatctcctgtactagcaacttgattcttttgctgagccaccagggaaggccttgttctttatcatagcctttgacggactggtaaacttaaatgttttcctgagttctgtgagccactctagcaaatcatcaaagccgttggggaggaggtcactggaacctccagtttgtagccaagtcagatggaagtgatgggtaacctggagacctgagacccaccattggcatcgtcagtgaaggagtcttacaggactgagtcctttccctgaggagtctgtgccatctttgtagacagtgtcaggatggagttagattgcagtacacccagctggtgtcccaactttcttgatatggaaaaacctgcatgcgcacacacactatctgaagcattctgagtgtggtaatagtgtcagttaaggagacacagaggcagaagaactgagtttttgttttttttttttccctgcacacaaacctaaacagtgctacttacggccatggagagattacttctagtggattcaggaatgtgtgtagcaatacagccagatacagagcttaagatttctttctgcctttttaaaaaacttttaattttgtattggagtatagccagttaacagcattgtgtagtttcaggtggacagcagggggattcagccatctatacacattatccattctcctccacactcccctcccatccaggctgccacataacattgagcagtgctatacaatagtccttattggttatctgttttaaatatagcagtgtatacatgtcagatttctgatgatacagtaagtcatgttgctttttaatctgctcttgagatgaatgttcatgcagtctgtgaggatgcccagtggtgttaaatgactgtattgtttcatcactttgtaaaatttattgatatgtttttaatttgacaggcagtcttattgaatacttgggaaaattaaatacccatgctttcattttaataaactagaaattgcttagggaccccatggactgcagccttccaggctcctccatccatgggattttccaggcaagagtactggagtggggtgccatcgccttctcctagaaatgcaatacccctatagataatgtcttaaagtaaatttctcatagcattttatactatttacaaatatctcaattttgtgattcttatttgacatgattctatgattctatacaaagttttgaatccttgattaccaaaatttactaagcttaggatgaaataataatagcctaggaagagttaataatagcataataaatatttgtgaatacttatatgaaaaaattagccattaattaatggagaaaataaatcttttcaagaacatttaagactatatattcagttttttggtgttaggatccaataatttttcggaaatatattctactagttcaagtacccctgacaaatctgaatcaaagcatatttatgttactactttcttaactatctaatatctgaaaggtttaccagggttgggaaaagttaaatattaggaagaaggggaaaaaagtcttatgttcttcaataaatgtctttcagaataaataaaagtcatcttttatcccatactcaagaatcctcttacgtgaacacattttttaccaggagcacttggctaagaagtatgttagtttcctattgctgtggtaacaaattgccataaatttatgtcttaaagccatacaaacttattttcttacagttaggaagcggagatccaaaatgggtggcagggctgtgtcccttctagaggc

SEQ ID NO: 52362 - DNA, 874 bp, Bovine  19866881226649
tttttctgaatggatttccgtgtcccagacaagactgacaaaatggcacttggatgcattagaattttaaatgacatcaggacaagtaagtaattacaaataattaaaatgaatagtttatcatcagctaaatgtgaactggtacaacacagagaaatgcaatgctgtctttccccattttttatctgttattaagtatgccaatatacatcacagtaaagagcaagaaatgtttacagcagtctgtgaattgaaaagacatgcatgcacttcagcatatggatctatttaataatataaaagtataaacattgttaaaatatcaaaattattgctgaagagactaatggtcatttttaagggaatgctgtttttaatcacacttttaatttgcagaaatagtgcaaagagagtccagagaattctcataaacccagagcagggtttctgctgtcattaacatcttacatcatcaggattcatgtatcaccattattgaagaatgttgatatatcattgttaactgaagcccacactgttaatacttctgtaacttttgcctgatttttttttttttttgatcccagcctgtactctcaaggaccacatcacatttcattaggctcttctgggctatgagtttcatgcactatccatgttattgatgaccttgaccattttgagtactgcttaggtataaagcccttcatttggactttgccatttttctcatgatgagattggggttgtgagtttttggaaggaagaccactgaggtaaagtgctatttttatgacattatattaaggacacataatccttcaatgacttaacagtctgatgacttagcagtattgatgttgaccttgaccat

SEQ ID NO: 52363 - DNA, 1422 bp, Bovine  19866881420006
ttctttgataaacttctcagattttttttaactgaggacaattcaagctctgaagaaaatgagggtgattcaatggtaacggtaactaaagcccactgcaatatgttatataatgtacaaaaaatccccttctgtcagaagtaatcattagtttttcaccacttaacaccaggcatattataatttaatctatttttcaaatataaaacttccaaaagttttgaatggagcaggaaacacgaatggctttgttgttattcagtcattaagtcatgtccagttctatgagaccccatggactgcagcacaccaggcttccctgtccttccctatctcccagagtttactccattcatgtctattgagactgtgatgccatccaaccatctcatcctctgttgccccttcctcctccaggctttactctttcccagcatcagggtctttctatgagtcagcactttgcagcaggtgacctaggtattagagcttcagcttcagaatcagtccttctaatgaatattcagggttgatttcctttaggattgacttgtttgatcttcttgaagtccaagggattctcaagagccttttccaccaccacaattcgaaagcattaattctttcttccactcagcatcaactctcacatccacacatgactactgaaaaaccatagctttaactatatggaataaattcccaatttattataaatcacatcatagatttaatacattggtacactgacgattatagcacctattttgtctctttaaaactacaaatgaaatgctcttattttaatttcaaattttagtcataaattgactttccttctggctgtttctgcttcaactaatataatgtataaaactgtataaacccaaaggtttcttctacattcattatcaaagttcatttgtaaaaactaaggttttatccttcactcagccttgtctgttttctgttttctaaatattttgttcattcactggcttttgtgacagtaatatctttttttgtgtgagtgatttcgtgtgaggaagggggcaaggctgacatggacacttcattggaagaagacggggcttctaatagcactgaaccatggaagcataaccttgaatgatttagttcagtattttggcatcaagaagctctaattccattttcagataaaataagtcttaagttattatatccaatataaacatccatctgtggggctttccatataaattattactctgaaaagaaccaaaattaagacttcagcttgctcaagtaaaatctcatttccttgaagtacaagaggagctgtatttcaaggaaacagcattcatcctcacggagagggagaggatttgaaagcctggaacccggccacccagccgagggcagaaattgctgatatgaaca

SEQ ID NO: 52364 - DNA, 1970 bp, Bovine  19866881545298
tctctataataaaaaacctagtaatagcacttgtgtttgtttttgttaagcttgtgagcaaagacttatagacaggtgcaaaaataaaccctcttttgcaacccagaactcattgtttagtatgagttttgatacaggtaagaaggaacatgataactaaaacagattcaaatgatagggctgtattgatgaacttaaagattgcttccagggctatagtttttgttgttcagtcactaagtggtgtgtgtctctttttgaccccatggacttcagtatgccaggcttccctgtccttcatctcccagagttagctcaaactcatgtccattgagtcagtgatgccatccaaccatttcatcctctgtcatccccttttcctcctgccctcagtctttcccagcatcagggtctttcccagtgagtaggctcttaacattgggtgccaaagtattagaatttcaacttcagcatcactccttccaatgaatatttaggattggtttcctttaggattgactggtttgatctccttattgtccaagggactctcaagagtcttctacagaactacagttcaaaagcaacaattcttctgcactcagctttctttatagtcaaactctcacatccattcatgactactggaaaaaccatagccttgactagatggaccttctcttcttgccttcaatctttcccagtatggagctcttttccagtgaatcagctctttgcatcatgtggccaaagtatcagagtttcagcttcagcatcagttcttccaaagaatgttcaggactgatttccttcaggattcactggttggatctccttgcagtccaaggaactctcaagagtcttctccaacaccacagttcaaaggcatcaattcttcagtgctcagccttctttatagtccaactctcacatccacacatgactactggaaaacccatagctttgactagatggacctttgttggaaaagtaatgtctctgctttttaatatgctgtctaggttggtcataacttttcttcccagtagcaagcatcttttaaatttcatggccaaaatcttggcatacactaaatgtacagaatgaactaaaatcagtgatatctacattgctggacattaattctgacattgagacttttgttatttttgttgttggcttcagatataagagtaaagagtcggataggaaatattggaatttccaccacactttatacttaccggtatttctatgtcacctggatgaaaataattattagaaaaagattgtggcaattgtggacttttttcatgaatcattcttgtttcatagtgttctctgaattctcatgaaatgaatgaatttttctcccttaggtcattggtctatcattaaatcaaaaattaaaacatagctattttgttttggacactgtatctcgagcactgcattgcattgtctagctcaaaaccaatttacatccatgcagtgctgattgcttctaccaaacgaacttccaaaaatttcatctgaataatttgggggaaaaaaatggtaataaatgttcagccaatctcacactgtaactggatggcggtgcccccgactggtaaagaaaaactgtatgaggtgccgagtgtaatcttatttattgatcgccttcattctggagtcagtgaagggcaaaaaaaggaatggttaaatgaaagccatgaaatgttgtgatttattaatagaaagactgtgtcacatccatctgcacatctacaaaattgcttatttgtccttaatgtattttcagatggtgttttcattttaggaaccaagatgatgaccaagccactttccagtcatggttgtctcgtctctgagggaaaaaaaaaaaactttcccttatatatgatggctcatggtaaattacttaagatgtgttcagataactggacatatctcatattcccttcaat

SEQ ID NO: 52365 - DNA, 1598 bp, Bovine  19866880213808
gagagagtcacttcttactgcagctaagcttttcacttctcagcttcactcacctctgccaagaggcctccttgttcctcagggaattgctttctcatatttcagaaggacagtgcatgcttgtgtcaggtgtgaaaagaatctttcctgcttgatgccaacgagaagcggcaccagggaaggccgacagacagagcacacattctcctctctaactgggttactctttgctctgcttatcttccaatgagatcttcctactggtgttcggtttgtaccgacatttaaaatcaatattctgatttttcaaggacacatccctaaaaaagaggacttaaggaaaggggggcaattctgaaaattctcgaaacttgacactggcctttagaaatgaaaaatgttgagaaacttctaggacagggtcctcaaattgttaagtattttctttaacatctaaagctcttattggtcttggtgcgtatgggtcaaatagcacattgttttggattttaatacttaaaaaaattccttgggaaaagggggggggggtgtggataaattagcagtttggaattgacatatatatcagatcagatcagatcaaatcagatcagtcgctcagtcgtgtccgactctttgcgactccatgaatcgcagcacgccaggcctccctgtccatcaccaactcccggagttcactgagactcacgtccatcgagtcagtgatgccatccagccatctcatcctctgtcgtccccttctcctcctgcccccaatccctcccagcatcagagtcttttccaatgagtcaactcttcgcatgaggtggccacagtactggagtttcagctttagcatcattctactactatatataaaatcgataatcaacaaggacctactgtatagcacagggaactctattcaatactctgtaataacttatatgggaaaagattctgaaaaagaatagatacgtttataggtttaacttaatcactttgctatacacctgaaacgaacacaacattgtaaatcaactatactccaatgtaaaataaaaactaaattaaaaaaattctttaagggatcaaaaagaagaggggggagcatcggaaggtaatctgaaggtaaaaactcggcaaacaagatatttcaaatgcataggctacctttattttagtgtaaaacattgtgactcaaatgtatttcctttctaaggtgtttttaggtcaagcaggataactgaatgtcaagggttaagcagttcttccagggtcacggttttctttttcctttcagtgagtctccacttgaccttgtggccagcagtccagtagctggtcatgaagctttctccagccactgctgttttccctaatgtcctcagtggatcctcaaaacctggataagagtagccaggtgcatggtaggctgctgaagctgctagagaacttgtttagtaactgcacatgtatggcaagcacactctttttatattatttattgcatggtttggggtgctgtagactggaactcttagctcagtaccaccctttccctctgcttccagagccatattcaggccacccaggca

SEQ ID NO: 52366 - DNA, 1501 bp, Bovine  19866880293093
ccagccatctgatcctctgtcgtccccttctcctcctgcctccaatccctcccagcatcagattcttttccagtgagtcaactcttagcatgaggtgaccaaagtactggagtttcagcttcagcatcattccctccaaagaaatcccagggctgatctccttcagaatggactggttggatctccttgcagtccaagggactctcaagagtcttctccaacaccacagttcaaaagcatcaattctttggcactcagccttcttcacagtccaactctcacatccatacatgaccacaggaaaaaccatagccttgactagacgaaactttgttggcaaagtaatgtctctgcttttgaatatgctatctaggttggtcataacttttcttccaaggagtaagcgtcttttaatttcatggctgcaatcaccatctgcacaaggtagtcagcatgtattaaataaatttttatggttttttactttaattaaaagcaattttcagtttaaagtgacaaagcaagtgactatgagtgacaaatttccctaagactagttagacagaatggttggaaattccttcagccggtgtgtcacataatatagcagagtggagtgggtttgtctatgccattctctcggtgtctcatattcatttggaatctgtttctgctgatgacagaacatgtcagaattaaaacagatgtttccttatttttatttttaaaaaaggcctctcaaatttaggaatggagtcacattcatcatttccctggaatcaggtttagtaaatgatatatggcatgtattcaatgaatgtttttattgaatgaatgaatacatgaatgaatgaaaaatgggcaaatttgctctgaaaactggtaagaggggcaaatttttcccatttatctcaagttaaacagaatgaaactggtttcataccctattttgtgattactatcatcttattttggtggatgatttttttatttttaaagtaaccttaaaactgctaatctctgcacaggtttaggtctctgaatgtactcagaggacaggaatgaaattaaatgaaacctggatcctcaaaagcaaatgtttttgtgaacaaatagactgttatttttcttggaataactttacatgatcagttttaccagcacagaccttttttttgttgttttaattttaaatgagtcttaactttattgtcagaactagttgctgagaggtggttgagtgaccaaacccgaaatggaagccagaggccacttactgtttcgtgtatcttgctggtcacagattaaccatgtttcactgtgcatgatcaaaggccagcgcatttgcaccaaggtacagtttattgcctaatacactggtgagccagaaggctgggcaggtacatgtcactcttctagactgtgagtcagggctcctaaaagacctgcttgctgggtatatgatgcccaccattgaagtttgccttgaagcttcaaacag

SEQ ID NO: 52367 - DNA, 1496 bp, Bovine  19866880399545
acgaaagggtctaggagacataagttttgtcttggttctgtcttgcctggtcaaacctttttctctgctccttcctgggctaatgactatgttgaacagtagaagctttgtttccataacaccccatttatgttaacaacataggagacctacaatggaagaagctggacaggacccgttggatgatgtgtaagtaacaaggaggaggaactggtatgggacgcatctactgcaattcagtaaggaaggaaaccttgactgcacaggacagtgtcctcaagcctggaagccttcctagggaggaaaggcggtttcagttctttggacttcatcagactagaagtggggtttgtagagacagccaatgtctccaaaagcaaatcagtcttatttagggaaaagaccctcgtccctgccccctacccagtccatgttcctacatgactagtgcagaaggttttcaatgtaataaactccttagtagactgtaacaaaggaaaactgaaaacgtgcctcttccttgaattctttatacgtgtggcgtggagtccacatactctgtataaattttttgaaaacaagtaagttagaatataattattcaaatgaaaaaaatacttcttttgcttcataaaagatttgtgttgtaatgggttccatttataatattttaaattaaaatgtgatttgactccaagaatttggtttatgcaaaacatcatagaaatcaatttatcgtggacaatgataatgcaaggctggtgaggcatagtgacagcataagacagggcgataaatgagatgacagctcatctggtttcctgtcctgagtttggtaatgggatgattttcctgcaggcgggatgtgatggaaataccgaaactagagatcacaaagcagaacctggactcgctgaactcagaccttgaaaaggacctgcagagaatggatgaggcaaatcaggttcttctcaaaaaaattcaagagaaagaagaaactattcaaaggtcaggctttgtagttggatgggaaaggtctcctcatctgaaggccccttgggatcaagaggtgggtgggaggaaagtttacctctttgtccatgaattgaggcaagttgtttaaattctaaactataaacagtggcgtcctcaaaaggttttatgtacagatttttcactacgtttccacattaagtcattattttattgccactgcaatgggtgatcactttggctccctgagaccttggcgtagcttctcaagctggggccctggcagcttcctttggactgagccacccctgggtgactgtgtttcagtctggaaagagatatcacgctgtctgtcagacaagccagagagagggaggagctggaccaccgcacagctgagaaggaggcagccctgcgggacctggaattagagacggccaagctggtaaggaggtgtactagaaaaggacagtgtgatgcattttgctgcaatccaccagtct

SEQ ID NO: 52368 - DNA, 1283 bp, Bovine  19866880407632
ttaagtaatgtcccgggtaccacagcttccaagtgccaggatagagtgaaatccaatgaaattcggttttgatttgtgtgctttctgtatctaacccactctctgttttcagggtcatccttttcttgaacaactccagggggcaccattcctattgaattctgcaaatggtacccctggagcacaaatcaggggggaaatcaaaatggctttgattaaaatacgctatttccagaagtttatagattaactgtgaagaccattgtgagcacatttctaaaaacaacataaaataagaaaagataatagaggttggagggattaattctgttaggatttgagggtgtggtatctgaaagagtgtagaagaagcaccatttgagctgagctgggaaagatgggtaagctcatgacagataattgtgtgggagagagattttcctggagagagagtggtatgttctgtaaggcctttccaaggacttaaggttagtacaatttagctggaaaaggttagacttaaatcttggagaagtgaaccaagtaagaagtatagaaatgaaagatatgaagtccaggcacacccctttatagatatctcgccaattctgtatctcgcctcatttcctccatcaatacagagaggaatctagaactggttagtagagtgacattgataatgtaaaatcccatctactattccagtaatttaagatctcaaaaaaatgaggatagaattatttataagtgagcagttgagtagggtctctggacctaaccctcctctttcctccttccagcttgacctccacatactgaactacctttgaaacaccaggctttccttcccaatgacttggctgtgcctccttaggaaaaataaatttgttttgctgctccaaaaatccaacttgattaagaatgaggatttgcttggctcatagataagacatctttcatattcttcctaccctgctctcagatcttcctgcctctcacctcttaactgcattgactagaggtgcttggtttggatttgggtacagtaatttgctcacataccacacagaggttgtgaaggaaatgagcatgatatcaactactgctgggtcaatgggtttggggaaatgaaggaatgtgtcccatagagatgagtgctgtttcagagcagtttaaactgtgtcaagaaatttgttccatgggtcttatcgctctttagggagagaattaaactgtcctaaagttctgaactctgctctcattctgcctacagagatgacaag

SEQ ID NO: 52369 - DNA, 785 bp, Bovine  19866880442593
ctggcataataatgagatctgtttccgttggagggctctttagtgttatgggcaagtagtaattcccaggaaagactgaaacctgcttctccttctcacaagaccaggcagtgaaagccaacattaccatccacacaggaaatagcatgactgctcttggtccacctcctcttggctttgtaattttccttacttttcagtcccaggtctgtgcacaggaatttcttgtctgatggtgatatgatcaaacagagaatatgctaacaatggatggtggccagatttgtcttctgtggtcctcctcttcccacaccctcatcctcccctcactgccaccctggttttatggaaactgctgtattttatgttcccaagcctttgtggaatgtagtattttctcaagcctgagggactctagttgtgttgacctgcatagtgatatccttagggccgggattcccttctgtttttctggccttcttttacctttgatctgaaatagacccttttaatgccggaagaatcacatggaacttgggttaccatactcaggaagatccccagtgctgcagtgctctgctcagcaatctcatgatctttctccttttgaagttactgaggtggtgatggagccacatgccccaggcatagttccttttgatattgtgaatcatttgaccagtgtttgtgcccgtcagaagatgtaattaatgtcaactgattaaggattgagaggcatatttatagtagattttgttggatctaatgctactgtcaaagctttg

SEQ ID NO: 52370 - DNA, 1169 bp, Bovine  19866880472564
taccaaccaagttttgtggtaatggggtactttctaatttatattcaaattagagaagttaccgaggaaagataagttatgtaaaacaaagtaatttcagccttaagggagatactgacctttttttttcctttttgttctattgcttttacctactggtgcttagttgatgccataatctctatttttctgattcattctaatcttttagatggacttcttagtatgcccttgagaatctctatctttagatttgggattatcaatgtttccaaatggagtcagcgctaaactatgaggaaagttgttagtaaagcaaatgaaaaaattctttcattataattgcttagagagaactaataattaaaacagaaaaggctaaagtttcccacagaggattttaggcaatgaatcaaataattttaagtttgcaagctatgttttgtgagacaagcatttcttaaagagatatatacacaggtattcccatttactcagaattcatatgatttcatcttacaaaatcagaatcagctttagaaaaggtctgtccagatttacaacgtgttacatcattattttgatttaggatggcaaagactttctatttaggaacaggaaagagaatattgtttattcttcttccccactaccattccatcaccaacaacctagaacagatgaagaataggcattacagtgcagagtaaatccaaattttattcctacttcaaacactaatttgctatttgaccctgagtatgttttataactattgtttgctttaatggttcttcctttaaagatataaagtgtgtcctatctcatcaaaatggtacaaaaacactatttgtaatgtgatgactatttttagtagatgtaggtgaaacacatattaaattaagattgtttatgtatggaatcacttgcaaaacattactttctttttctatgaatctataaacttttgtctctgaagtagactcaataactttttccaggtgcaggaagcaaacattcagctcaatccatagctgagattttccaacagcagttttcaagggtaaatcatttgtttcggggaaaagaagttcaaaagcatatcctagttaaataagaatactccaagaattgaatgcaccttgtaagtctcacagccctctgtattt

SEQ ID NO: 52371 - DNA, 1064 bp, Bovine  19866880486248
cccggaggagtaatggggtagggtttgcagagaagagagccaggaagagagctgagctcagattttgatgactggcagtgtagggctggctccttcatgaattaattcaataaacatttattgaatctttggctgttctggacaccagtgtcagcaagaagcaaaatactgctgtgacctcacagagcatctattccaggggttctgctgctaattcccagtgtaaccttgagcaaagcttccccactgtacgggtgctgggcatttctaagattggaatcttttttctctccaacattctaagattaataggaaaaggttagaaatttggtggaaccagatgacagagctacggaagtgggacttcttcatttgggcagcagaaagcctttgtgttttctgtgtatgggggacactttcaaggtttaagaggcttaaggagtttggtctgatcaactgaaggcaggaaaaaaaataggaagctggaaacaatttaagagataactgatctttataaggtgatgaagacccagacctacatcctaagatttaaattcatgggtgaatagcatagatttgataaaccatgaataagccattgcttcctaaaaataccgtctctattaaatagctggctatcaaggcttcactgccatgatgttagctgagaacaacagaactagagatagatctgcaggctaagaacaattttggatctccataagactaggcttaagggtacatgtgttgcttcacaggctacaaaggaatgtcctgcatgccagaggaataccatacagcctgtaccagatgcagaacactccaaggggttcggctttacaacgtgtaaatacacacctggctacaccatgtaagatgaatgaagcccaagtaatgtgagttgtcttcctggcattctgataataagtacagcatgtggaatttgctatctttagccctttcgctagagaatactagagtacttatcaccctggtagttaatcacaaagccatttctagttcagccttcccatggctaacggaactttgaagtcactcaaaga

SEQ ID NO: 52372 - DNA, 1202 bp, Bovine  19866880515784
ttgacatagttgcttaaatagacagatactaagtttcctgaacatgagacttctattcaaaatatgaacacaggctaaagaagaatgtcaggctaaaactggatactagtggctctaagttcagtaaatttcaacaaaatctttttacattaaaatgatttagatagctacatcattttaggaaaagtcacagtcattgccatttttttgtgctatgatttctctagttcttcaagcaagaatctctgtgaattatttgagttcttagccaatcagacacagagaagtggcttgcatctctcctaggctaccaagttcccccaaaaatgaaatcgactagtggtttgttcttatccagtgattattaattatgtacatgatcaaataagggagaaaattcctttgaggcctgagtgatcttcctggagcttacgggtactattctctgtcactagctgtttctaactggctacttccactctgtgctaagtagactgtggtcaaccccattgctgcatataaactgagtcacgagaaatacccttcccaaactgaattaagcatgagttgaagactgtgcaagaactctatgaatatagttatttggggggaaaaaaaaaaaccagtatccaaatgtaaaaagaggtattgctaagtggcaatgcatactgcagaacctctgagggttgtggggatgagagccttcaagaaaagtagaagaacctagagatctcaagctttcttaagtcaacggccactgttcagacagaaaaggcagccacttccctgtgtgaccctgaagttccaccagcctaaagtatttctcctgccacaatgtgtgaaatttccaaccatgtcattatacattttaagtcctcaatgttctgagtaaaacaaaaataacattaccctggagaaggaaatggcaactcactccagtactcttgcctggaaaatcccatggacagagaagcctggtagactactgctgctgctgctaagtcgcttcagtcgtgtccgactctgtgtgaccccatagacggcagccaaccaggcttcccgtccctgggattctccaggcaagaacactggagtgggttgccatttccttctccaatgcatgaaagtgaaaagtgaaagtgaagtcgctcagtcatgtctgactctagcgaccccatgaactgcagcctaccagactcctc

SEQ ID NO: 52373 - DNA, 1226 bp, Bovine  19866880568620
aaatggaaattaaaaggggtccacattttagtctcttcatctcttaaagcatggctcgcactgcactcttcttggggtcaccatgagtatacaggaggagcttagtagactgtctcctctctgaggttcttttaggcattattcctccctgtcttctgagcaggagtgggggccactctgtagcacacgaggccctaaacaagagcccagaagaaagtctgtctggagacagtaggtacaaagaggctagtggaaagaatgaggccaagttcctgaaaaaaccctcattctaagacacctaactcaggtgaagaaagggcttacgtgtaaccttctggatgcagagtagatgcccaaggccctggaccttcattttcttggttttcactgcagtgttttgtggacagcctgccagagggcaaccatagagacactgtgacctgtatcatctttcagttttaaagtgtaatttgaaaccaaccaacccaacaggcaaacaaaaagcaaaaccttgggtgtttccaaattttctcctgaaatgctacactaatataaaggataagtgtgttatcccacagtccttttgtttgctgacttactctcggctcagattacttgtaagtcaggtgttcagcatggctgaagtcattggctggctttgggtccctgccaaagagacactattacaaggattatgtgtaataaacaccctgtcacatatccagcagtcatctctattgcaaaagtacactgagcctaaactcttaacttctgcctggttgcttaatatccaagtttgcttaccaggaactagaataggtctaggagcctgagagctctatgggacattaggggtgatctcgttgtttctaaactctattcaagtggaacacactggtggcttgtgacatgtttaacaggtgtccctttaattggattctgtggtcaactaagtttggaaaatgctattatatagagttaagtttctttgctaaaggacatctcaagttctttagtatgctaacatgagtcatggctctgggtataaaagctacatgcttacttgaccacaaagtccttttattgtaggacaggtatcgccatctcaaaaatgtcaggcagagaccatggagtctcgtcattaagagcacacctgcctgtgtgtgactgcctgggttcaattcctggctttatcatttactgatcttaagccattcactgaaaat

SEQ ID NO: 52374 - DNA, 1077 bp, Bovine  19866880579158
tgtccgactctgtgcgaccccatagacggcagcccaccaggctcccccgtccctgggattctccaggcaagaacactggagtgggttgccatttccttctctacaatggaatactactcggccacaaaaagaataaattttatcatctgcagcaacatggacggacttggagggtataatgctatgctaagtgaaataaatcaaagacagacaagtactatatgatatcacttatacgtggaatctaaaaaatataaccaaatcatgaatataaccaaaaagatgcagattcacagatacagagaacaaaccagtggttaccagtgggggaggagcaatataaggctaggggagtggaaggtacaaatgactgggtataagacaggctcaaagatacactttacaacacagaatatagacaatattttctgatagctgtaaatggaaagtaatatttaaaaactgtatacaatttttaaaaattaaaaatacattaatgggtttctataatggtaaacaaacgtatgatgtataagaacagaaagttaatgcaagtatactgaaccacatcaagtaatctatctcctgcttcccaaataagactaaacccaaatgggaagcattaatctttacagtctgaaaaaaaaaaaagaaaagaacacaatcaactccctttatagtgcagtattgtctaatggtgtattaacatatgctaagtgaagacgaggcaaatgtctacaggcaagtgactaaaagaaatctatttctgaaatgagcttactattattttttctgttcaatcaattataatagtcataatgattctattctacaggtgtttacttttccacatgaacttactttcacagacaagagttcatagttccatgcttggaacaaggcaggcactcattaagcgagaacaatctaaagtttcttaaaaattacagcaagacaggtcttaaaagctaaaggtgagtcctgacccacacacagaagctcactgtctgagcagctgggcactggagccccttgcaaaattaagttggaagagttacatattctcgaagccaacca

SEQ ID NO: 52375 - DNA, 1157 bp, Bovine  19866880584904
ttatacttaatttttttgaatcttctccagatccattacatttttctttaagaataacaatttgaacggcacacaatgtaccaaatacataagcacccttgttctccagaattataggataatattttgtaccttttctaatgatagttgacattttgttggccatttttctgggcaataacacactggatcagtgtcattaaaaatagtctgtgatgtcatcaaggcttcttttttaagttgtgccagggagaaagctctttaggcagctgggaaaatatgagttaatttttttttagtaaaaatactgtcttctggtcacctgggatgaatttttttaattaattatctttttaatttattcttttattgaaggaaaattgctttacagaattttattgttttatgtcaaacctcacccatggtgaaatttactagttgtttgttttgttggctgtttgccagtcacagcttcacaaacttgctctgcacatcacctccagtgccatggtggctgtggtacttactgtttgtattgctgcagaagctctgtgtcatcggcacatttaaagatttcaaagtatattagctccaggaggtgttagaactcagttgaatctattctttccttcccatatttccagtgtgtctaaaactatctcctctccattatacagaacagcactgaccaatttcatggcgatgtttttgaaaatagagtttggtatggaaccttgtcagttttatgacatgtttcatacatataaaaatacatagtacctctatgtaaggtacaaagaataaaatgaacatacgtacttattattcagcttagccaacattatcaataaccgtatgtgtctctaactgtatttctttccctcctccccagaggtaactcctggccaaaattttgtatttgttattctcttgcttttctttaagattggctacatttctctaagcactaataaacaatgtttgtatttttttttaaatttttatatacatggtgtcatattcttctggaacttgttacttaataatgtgagcttcgtttatgttgacatatatagttctcatcagttaatcttcaattgtcctatggtattccgatgcatacatttatcacagcgtatttatcctgttagtggaga

SEQ ID NO: 52376 - DNA, 2760 bp, Bovine  19866880591766
atatagtgcattttagtctgtgatctggaaaaatacatttaatattaaataatctcttctaatttaaattccatgactctgcatctctttcagtagtctaaaactttgaagagtaaccctggcactacattttatttctgggatgcttgcaaggaggttacaggaagaagctgacttacaaacattggttttgtctccccgcaaaaaaacagattctaaaaacaaaagaatcaaatgcaaaaaggtgtttaagaatcactggcagtgttttttagtaacttttaaatctttgatgagcaagaagggagaaagattaggagtagcctgatcttgaacctaaataagtttctggtcatgaaatctctggtagttcagatggtgaagaatctgccttcaatgcaggagacccaggttctatccctggattgggaagatcccctggaggaggaaatggcaacccactccaatattcttgcctggagaatccccatggacagagaaacctggcggctacaatccatggggtcacagagttggacatgatggagcaactaaccctttcaactttcttgaaatctttactctttactgaaaatccagacattctcatctctttgttgaaacatgaaaggagggtttctttaacatagatcttctctcttttatgtaaaaatatcccttttattctgaaactggtccaggacagtttctgtgggatagactttgggatgatgggtggtgtgctagaagtaacctagtgaccagttggcaattagttgccaaggagaggagaacccagaaaatcagagtgtacaggtatcagcttttgcactaaaatccccaagctgggactgagattagggatctggaatctttgaagttatatctgagctctggccaccagtctgcttcccctgtcctcctttttaactttgattttttagaattcctggaagcatgaaagatcattatcttctgctcctctgagagatccctaaaaacagtgtcagcctgtttctctaacttcaaggcagcagaggcaccaggtgtgacttttcacctatttataatctcaaaatgaaaacatcattcccaacaggctgtcatttaaataagatgagattcattacatataaagccatgaaatgaaaagacacttgctgcttggaaggaaagccatgacaaaactagacaccatattcaaaagcagagacatcactttgccgacaaaggtacatatagccaaagctatggtttatccagtagtcatgtacaaatgtgagagttggaccataaaagaaggctgagaactgaagaattgatggtttcaaattgtggtgctgaagaatactcttaagagtcctttggacagcgaggatatcaaatcagtcaatcctaaagggaatcaatcctgaatattcattagaaagactgatgctgaagctgaagctccaatactttggccacctgatgtgaagagctgactcattgaaaacaacactgatcctgggaaatattgagggcaggaggagaaggggacgacagattgtgagatggttagatggcatcaccaactcaatggacttgaatttgagcaaactcagggagatagtgaaggacagataagcctggtgtgctgcagtccatggggttgcaaagagtcagacacaacttagtgactgaacaacaacaacaatgatcaatattaatattacacattcatataaacattttttctccaagagaatggactctctgataccttaaaagttgttgcattatttggaaataagtcatggctatactaaaatgaaggtatcaaggaatgaaaggccagtgagtagaagaacttaggcattctatccttaattataccttcttctaagaatatataaagcaaacaagggagtgatgctggaagggaaagaatttcagggcctacgaataaaatgaattgccaccaacttgtataaatcggctagaaatttaaaaaaattataaatatttcagacttttaaatccatacattcttcttgaaaaagtgttgtttctgttttacaaaagtaggcacttttggagaaaagaaaggagggtagtggcatcaatacatttcatgaaaatttttaacgagacaaggcattcctgccctaaatcagtgacagaggatgaatatttggctttgtcattcagattttaaactctcaggttttgcttttgtttttttattgtaggaagaagcagccactttttaacttcaggtctcctccctttatatataaaaactgtactggaggtagctacagaaaaaaatgacttgaatcatactgctcatcatgcagctaaaaataggaagccacacttaagtatcttggcatttacagaggtaagaaagaaaatttccattgtcactgttgttagcaaagagaatatatttcttcatcttctacaaggaaacttaaaaaaaaaaaaattaccaatgagtacaaagaggtagcacctggctgtaattcaattctgccaagaggcccagaagtaatcaataaacacttattaactaatcacacagcatctcgcttccatgagtgaaatggcaagtgctgtacacatgctgaaattaaacaatccttaatatagacaaaaaaagtaggagaataaagaaaaagctgaggaactggtttatgtcaaatttcctaggaaggggtttagccttctttctattactgaggaccacctaggttggaggggaaaatatcaaggcta

SEQ ID NO: 52377 - DNA, 1150 bp, Bovine  19866880699239
cacataaccaatataaaaaattattaatgaggtattttatgttcttttggttaccctaagtctttgaaatccagtttgtgctttatgctaacagcacatctcagtttagacactagttttccattggaaatacttgatctgtattcagagttcataaaacttgcagtgggaaaagtggattcacatactcaagttgtttctaacatactaaaatgtttcccaataactgaattcagtattagatttttgactttaaattaatttgaattaaataaaattgaatttaaattaactttaaaactctcaatcacacatttcaagttcttaatagccagtgcagttagcagttaccatattcaacaccagatatagttacttaacctctccaagttttgcttctgttattatcatgaaatggagattattctaacgtaagatttttgtaagaattaaattcggaagagcaatgtgtataaagctctcactcagcacagggcccggtacatggaaagtgcttcgtaatgaaggccactctgagggttatttctcttccccacttcggcaattgcccctctgtcatccttaagccccatgtgacgtactgcttccctccagctcttagggaaaggttgttaaatgaatttatgctaagctgccaaaaatgaccagagtattcaaagatgcatgcgccctcctgtctctccttactagacaacattccctcacccctggtgtacctacagcttcatttatcattcatgtatgaatcactcccaactctgtaagtaaaacacagatcttcagagctgtatatccaactacctaggaaaggattgactgagattttccaaacacatttttaactcaacccaccaagacctgaattcgttattatcatccctaaagtgactctcctgggctctcctgttggcgtggtgctgtcatccattcatgcctgatgcctcagccaaaaatctgacagccatcctaagcttttctctctccatcgttcccctcaccccagatccttagtcagtcaccaagacctaccgattttccctcctaaatagctccccaatccatatatgtctccgagtcttcaaggccaccgtcatccttcacttggatactgtaactggtctttctgcct

SEQ ID NO: 52378 - DNA, 970 bp, Bovine  19866880732677
ttgtattggtttccaatgcctgcccttcatatctatttgtgtgcctctttaaaaattgaagtatagttgatttacaatactgtgccaacatagggaactgtattctacatcctgtaataaaccataatggaaaaggatatcttaaaaacaatgtatataggtctgcctctgtcaaagttcctttctcttctgatttgtcatgaggcctctccccaccaagaaagacacaatgcctctgatttcaggacccaatttcatgccccaataagcaaaacgttctgggccgatctcatgtgttgtgagttcatggtgaaggccgacactgcttttcggtgcttgtttcccacagagttttgttccgagctgtattatgtccacatctttaatgagaaatgtattctgttgccatggcttattgaaattcatggcttcctctagtaggtggaatcttccctgcccacctccatcgtcaggttttgcctagggctttatgagactgagatctctgaaactacacttaatcagataagtctcagttacactcaactcaatgcctttgatttctaatttctgcattttaatttttcctgcctgcagttcagtggcacagatttattgaaactgttgccagcaacaatttgctctgacccgctacggttttaagagttgctgctgaaataggcaggtacacagtgggaaggagataaatggagtttcgtgtcatttatttcaggtgccagggtaagacccacatttcaggaggtaataatggaagtaaacaacttttattctggttctaaagtaatgtttccataaccaacttctgggttaatttgtcttttcagcctgtgctgagcagatctcatttccagtgtctttgagctggtgaaatttcctttacaatgattaaggaatttatcaaagcaaatcttcttgctctttacaaggatgcacaattttccattggcat

SEQ ID NO: 52379 - DNA, 2121 bp, Bovine  19866880886952
taggaacgtgctctcatgaagtagacatgaacttaaatttagcgttggaaatgttgattgtagcatcacagactttaggactcatgggcaccattttagttctttctcttgcttcaagcatctctgttatccaccagagttggatcctaagttctaaaaaacgattatctccacttcatgttttcatttagtaatacattccagatgaatctaacagtataactctcgcttaatttctttttagaagcatttgactgacactggcatctgaaggtcacttaggagcctgagctgtgtcggttacgtttcattcggaatccatgtctggtcatgaatggaatgcacttggccttgtgttcttatcctgatgaaaggactccttgtgctgaccttgacctaaaacatttgttttaatgtgagagaagtagctgtcatgagatctgattggaacagaccagctggcaggcaggcagggtcacacagcgtgttaaccgtggtgaagtgaccacagctaagagactgttcttcagtctttcagtcatatattcagctttgtcagtgtacagaggtaggtacaataacttgtgcttcatgcagactcataagaagctgatgaataaaccagaaagctagtatatccactcagaggacaatagagaattttccttcagcatgacaaaaatgtgtataatatctattcactgttacttccacctcacttatctctacttggcattagatatttgcttatgccattgctcctcttgctgagataacagcttggtcaccttaataatagttctggctgtttcagcccactgttacctcccacagaggtaatggataatccagtttttacttgttcaactcttaaaagcaaccttactttcttcatttgtaaagtgggcccttctgtgttgtctgtttgacactgcctatagtgtatattgaagaagtagaatttgggggctcagtacctccaggtctgttaactgatagcaagtaacagagccagtgtatggtcctttatcacatgtagcattactttccttagaatttctctggtaattaagcattgtttaccatgaactgggctagtttatcatatatagaagtcattcaataaagaatcttttaaattttaatttggttttaaagaatagagtaaaccttagactagatggcatcagaatgtcataaatttcattctagtgcatttggacaaaacttcttcctgcctgcctacctcctcccttcctctttccctctctccctcaataagcatgtgctgaatgccagctctgtttcagacaccgtgactacccacaacacataacatcctgaatttcacattctcaagagttcacaggatggtgggagagatgtacagagtatcctaagatcacagaataaagatacctgtgaaacaacgagagatcaatgtactggctcctcctgtaaaacttaagatgagtcttagaggatgaaatggtggtggtcatcacacagagaaggagcttttccagctgatgaaaggaggcatgtgaaaaggaggcaaatctagagtctacaagttgaatgtgaatgtgggtggtttcagaacaaagtactcgaagggcaagtagtatccagaccaggaaggatcctgactgtcatcagataaaattcaaatattatcctatcagtaacacggagacagaagttaaaaggggcagtgctgtgatctcattttgagtgcagaaatacttctccaatcacagaagactggcttccaagccctttcatgctctggcggcagacctatcttctcctgtactcgactgtgctcacttctctctcactgttctccagcgtcagtggtcctctgattccttaacaggccaagttctctccttcctccgtgtctttgaaggcacagtatgtgccctctgtttgaaatgcttttctagccccattcaatagcacactctttttctttgctcctaagtcgcttcagtggtggtctgactctttgcgatcctatggaccgtagcccaccaggctcctttggccacgggattctccaggcaagaatactagagtgggttaccatttcgtagggttcagctaaacatctcaaag

SEQ ID NO: 52380 - DNA, 1949 bp, Bovine  19866880975001
catagaaagccctctatttgtgattccccaagtgtgatgacccttgtatcaggggtggtccttcaaaagctacgcatgtggagttgttacaagatacatcagctcctgtggtacagagccttttaagccatggtgactctacacttgcctgatgtggaccttgtctctttgagcctgagctgtcatttggggtggggattcagaaggcagaccctggaggctgcaaggatttctgcagaagtgcctgacacttcccagcaggcaagctgtggctcttgtcctactaagcagattggggtctaccagcatcttatgagtctggatgttaagttgaaccaaaggcaacctcttggtggacactgcagatacaacatagatgagacacaatattaagaactagaggaaaaatagacgatttctgattcctggaaatacattttccacttaaaaatgactgtcaatatataaaataaattgccactgggaatctgctgtatgactcagggatctcaaaccaggactctgtaacaacctagaggggtggaatggggagggaggtgtgagagatgttcaagatggaggggatatatacctatggttcactcatgttgatgcttggcagaaaccaacataattttctaaggcaattaccctccaattaaaaataaataattttacaaaatgaccatccataagcatttgctgctattaataaaaacagagaagcaacatttcccttcaatgttgcctgctccctggtttcaacactgaatcttccctaccaaacaaaataccttttaactcctcacactgtgctcatttgaatgaaaagctgaataagggtgcttctgtgaattaatatctgcaatttcaggggccttcagaaaaggccatgacaaacaagactcaaagtcacaagaactctcccaagtgctcagcagttcctggtctatggcaggtgttgatattctaaaacttttgcttcctgtatttctaccctcttgctccctgcttcaatatgacctcttttttctcaggacttgtacacagagaatatcttttaagtaccttatctcatgtcttctttctctgaggtatttcttctccctagagttcatctcaattttacctctctgagtctcaactaagttgaaatacccttgactgggatggcccaaggtcaccagctggctctgtagccagttgataagagtgacatttgaggtctgtgccttatacccagtttgccaggctcaggaaaaaacacaccttctcattttattgcatggttaacattagtttccaagagcgtaagaatggcaccattggttgtgaaatctgatggtagagagttaggagaaatagctagtgaaaagggagggaacaggacagaagaggggtgtgcacggctggagccgactataggaaagcctggagccacataaaatgggttaatctagcaggctgctcccaggagtggtgacaggaaattctgaagacctatctatcctttccacgaacttatcctgtttttctgtgagaagccctcatggtgcactttcttcgtactacatacagaagagacacacactcatgcaatgatagcatgggtgtcaactctaacaactggtttatccttttggaaaaccaatttaatgttgtttatactctgttgccattaattcttctcctgaaaaataattcaggaagcaagagtaaaccaacaagaaccacgtacatgaatttttctttaataaccatgaagattacatagcaatatggaactggatgaaatgtgaaagaaaaaaggcagaaggtctgaatatccatgatgagtgtgactttgaaaatatatgggtacatgtggacaaaggccagagtgaaaaacaaaaatgaaaatagttgggacagggaatacagtcatagatgacacatgtcttacaaaactt

SEQ ID NO: 52381 - DNA, 661 bp, Bovine  19866880980186
aggaggtatcatttgaaataggctttgacagagagacagatttcaactctcagagacaaaggaagggctttccaactaaaggaagatgagaaatggtgattcagatactccctggtcttgtaaataaactaatctaaaaggcacagggaaagagttgagcgtccactaatcctttcaacttagaaagaaaattctctcaagagagaaaatcttaacagcagtttacttgattactaattgttcaagagacgttattaattattcacttatatttggtactcaagaaagagttccaaagcggattcaggcaacgtctgtcttcaatggattaaatattgacacgattggagggcaaattttgcaggtaaccctgagcatcccctgttggttcacaaactagcccccatacaccaggggtaaggagagacagaagaagcaaaccactcctggttggtgggcagcagtttaataagcaagaagctgaggaggtttgccttaggcaaaaaaaaaatgaggagacctccacaccaaccaacagatctcaaagtttctgtagaggccttaaatgggccttagtcacgtgtaccacccagatggtttcaacaaaacattactctctcaaggcagcattcttgaggcatcttctagtgtgggggtgggg

SEQ ID NO: 52382 - DNA, 1568 bp, Bovine  19866880999556
tgcagtccatggggtcgctaggagtcagacacaactgagcgacttcactttcacttttcactttcatgcattggagaaggaaatggcaacccactccagtgttcttgcctggagaatcccagggacaggggagcctggggggcctctgtctatggagccgcacagagttggacgtgactgaagcgacttagcagcagcagcagcagcaggtaaaaacacaccatttgggtgtgctgaatacctaatctaagcaacgaggtcttgcagaaacacaagaaaaaatcatgcaagaaatcactgagccactgtgtacatgaatatgagcactgataggaattgttagaaattaaactaactaaagaagaccttgcccctagagagcaattcagttttgcagagaaaaggagatttatgactcatgaaaccaagtttgcacaatatgatcaagtgccagattacttagttcagacaacaataattagcgagcactttccagtaatagtccacactaatcttatagcaaaattttaaacaaaccatctgaatgtgctgatttgaattctgatctcctatttttcctcactattatatataaccatataatagggcagcaaaggcaagaaccagcatagaaaagcctataaagtctattcaagaaagggtcacattccactactacagtggctttagggctcaggtgccccgtggtcaagaaatggcctctggaagaagcacaggagccaaagttaaactgtctgaggtatgagggacactgatgatactaaactgttaacagccagagtcttccctcagtaacacctataatagagctacagcccttcagcgctagccagtttctattttctagatgttcctgaagtgcccactgctttttctgttaccttaaagccttgtcctgagccaagatgaaacatcttctatagctatagagtagatctcattccatgagggaaagtttaggtacaacgtgagactcttctttcatttccattccatggccaaggccaggaccctgttatagtgaaggttcttgctggtaatagcctaagtcctgtcaagtcctgtctttacagatgatgaagcttgagttatctgtatctgtccataaaggggagaaggcaatggcaccccactccagtactcttgcctggaaaatcccatgggtggaggagcctggtaggctgcagtccatggggtctcgaagagtcagacacgactgaacgacttcactttgacttcactttcattcattggagaaggaaatggcaacccactccagtgttcttgcctggagaatcccagggacaggggagcctgctgggctgccatctatggggtcacacagagtcggacacgactgaagcgacttagaagcagcagcagtccataaagggacaactggattctcaaagtatcagatatacaactgtgaactgaagaaatcagtagaaaagagtacccttacataagctggatctgtatgttctactctaccaaagctatgtaatagtgaattaccataagcatatatcttcagatcttcagaa

SEQ ID NO: 52383 - DNA, 897 bp, Bovine  19866881010005
cttggctcaggactggcacagtgtcacactggccacattcagtttcaccagacaagtcacagggccacacccagcatccagggactcggagtccatggacctggggaaatgtatgacatctacatcggtgggagaagctacaaaagcaactggaaaggccttgggtgaataatcacaatgaagcgagagagtaaagatgtgggaacaataaaccagtatatctaaggtagggagactaactccactggggaagctgggctgtggagactgcctccaggtttaaatggcacatcacgtttcctttccgtctgcttcctttgtattgataattgacagcaaaatcccagtttgatgttgtaggttagcatcaggaagtgcagctcatatgggaaaaacacagactttcaaagtggtcccaaggtaagttgcccttcctgtactgtgactgtgctgtatgttgtattaacagatggtcaattgtggaattaacctgtgtgtgtacatgtggtccatcaagctgctgaaatgattctgagaaacaaaataactaataaatactgagtaaaaattagatttatagtctgggcacatgaaagggggaagacatgattatgttgataaggctgttttaagcttttcgtaaaatgttcccatgaaaatctaacacctcaaaatctatttgcattagaaatttaaatgatatttgactgttgtgacagaatatgcttacttaatttcggataatttttatctctctttattaaatatattcagttgaagagagtagtatggatactacctaatttagtaggcatagacatatgctttatttttgactgttcaaaaaatgagttgatattattaaaactcttcaaagacttactttagttatacaca

SEQ ID NO: 52384 - DNA, 1037 bp, Bovine  19866881169436
gagtgttggtataatgagcctgatacagatgggagcgaaagttagagagttacttggaatactgtatcagggcttggaggtgtgctggagaattgtgtaggctggtatttgcttattcaacttatatgatataaagggttttgtgtgtataagagagagaaatgagtatgtttttgcaagtacaaagtggagggggctacctggtcctaggtaactccaaaaatattttaatcaatgactgatttatttctttgatgtatttgtcaattaactaacagaataggttcatagactgcttcttaatttgatagtgagcactttcaagtatcaattctgtaacacactgtcccgtatcgggggactagcaggatcatgtatagattctggcccttgtaggaacttaaactgttcatggtaaatagaaggcaggactatgtacatgcaaaatgtctctcctatgagtcacggcactttggctctttttacttttgacccctttggccaatagcctaaccttccctggccaccctgtaaaatagaaataatagaaagtgtttaatttcttaagttcctaggctcaaccagatgatctcgtttcagtgctgcttccacctctgaactttattttactttttcagttttaagctcctcacgtggaagaggagaaacctcagcggaatacttggcattggccctaaattaacctctccattgacttcttcctctccccgactcctcccccaggtcctaaggggacagcaccttgcatatccatgcatatccatgacatacgcatatgcgtatgtcaccttgtcagctcctctgcctattttgtggtggcccaagccctccctctacacctaaacggaaaacctcaggctgatttgacaccagacttgcttccctgggctcagttgatgacagcactccccagagctctgcagtctttctctcctgttctgttctttctgtccacagtactctggctttcactacctctgccgtgctaactaagttctaaaagattctttccaaat

SEQ ID NO: 52385 - DNA, 768 bp, Bovine  19866881197867
agaatctgtatggaatatatgtgaccgctgccccataaaagtctacctaacgtggtctgggccacactgccatgcactgaacaaatacattgatgaccagttatgattagaggtttttcaaaacctatttccatcttcagctgacattgacttgttcagaaacagcaccatataagtcagtaaaaataataaccctcctcatcctcattttgctatagcattttatagtttgcagtgtactttcccacacatctgatttgatcttcccacccaccctgagatggtccctgcaattattatttaccttaaaggtgaagaaattgaggcccagaatttaagcaaattcctttgagaaatacagctagtaagagatggaaccaaaatttggatctaggttttcttagtacaagtgtaagcttttaaactgataacagtttgttgatatatgatagagctaatgtgggtagtttggttctaatagtgtggttgaaagaatcagataatttcccaagccttctggaaaaaaaaaaatttcttttctctcattaaaaaatgtatgagtgtgtgtatatatataattatagtaattatatttataattctagaaaactttggaaacatagaaattattttaaaaattgataattaaagctgcatcaattctataagtaagcctgtagtagccacttaatattttgaacttttaaaactgcatatctacattaacaaaattatgagtttatattgtatcacaacattttcccatgc

SEQ ID NO: 52386 - DNA, 742 bp, Bovine  19866881226898
agaatttctggggccctggagagctattttctagggatacctttaatttccttcgctaactcccagttcctccatcactgtctccagcttctcccacatgatgtcttgcccagatctgcatctcctacactacaccctctaggtgtttccaaataatccaacctggagtagcccaaggggcttagtctgtgagcacacacccccctctactggacaaaacactaagacacacgcacagttgggaaaggatcacagaattctccagtacaaatatcctattcactaccctcactttgcacaagagagagacatgacaaaaaccaacagaatcacagaaggaactgaaggcaaaagctctaactctgtaccattgttatcccgtgctgttcaacagttcaactcacaagaacagacgactacatgactgagctcatggaggtctctgagttgaaacattctccaaggtgcagccatcagtgaagaagtaaggtattggttgaaagagtcagaggagctggtctctagttccagttctagcatctacaatctctgtgatgctaagcaagacatgtaaaagtctctgggcttccctgccctcatgtgaaagagttagaagtgaaagagttagaagagatgatctctaaaggagtctctcacggtatgaacccataaagtctataattgtacataagcgggtgaaagagcacaaacaggattcaagaaatagaggggaaaatgcatt

SEQ ID NO: 52387 - DNA, 1414 bp, Bovine  19866881274305
gcaactaagaagggggagggaaattgattttgaaagccaattctgagaaatgaatggagaaaaaattggaatttgaaaggtagggagaactggtatatggtacaccatgagtcatgacgagttttaaaaatgctgatgcctgggtgccagagggttccggtttcatttgaatgatatggagtgaagctttggcactgggattttacaaagccaaaatttgagaaccaccaggttagaaagtaatgtgtgttcttccccgagttgtgatgtcaagataagttttagagaaaaaacaaaatttactgagatgaaccagaaggcttccctggtggcttagtcggtaaagaatctgcctgccatgcaggagacctgggtcaggaagatcccctggagaagcgaagggctacccactccagtattcttgcctggagaattccatggacagaggagcctggcagcctacagtctacaggatcacaaagagtcagacacaactgagcagctgacactagacgaagaaggtggttgtaaggtctgattgagagaaactagtccctgccctcttagtgtgcacacatcgaagtgtcactttccatattagtcacaaacccagggggctagctggagctggtacctcaagcaatggactaatgggaaagcatttctttggagatgatgtttttaggtttcatatttctttacccagagctccgggagcactgttgtgcttgtaatagtttgaaatttaaaagtggaagccatccagggcccttttatctctaccatgggctacataatgcactgcgcagaagtagtttggcaccaggcatttctaaatgtcagactaggctctcggatgactgacaggcaaaccagagagacaggcagaacataaaatttgagctggtgatagaatctgtgccggacccactgactgacaggctgccagggaaccaggcaggagctctactgagtctttcctctggagctggagccccacatttgtcagacatcctagaaatcatatctggctgctctctgcagtgacgaacgtggacttgcttcagtctggggctcctgcctgttaagtctcctctggttagcggagtgatttattttggggaccgctggcctcagaattgagtgttttggtctgctctgcctgtccctggggacatctggctcgcatgagtgggtgtcagactccatccacctgtgttgtcattcagggacacagacgttttgaagtcatgacttttccttggattctgaagaaatgtgggtgttttctgaagtgatcttgtattcagttgttggcccacttgggtaattctgaaaagttgggtgtattctaacccaaagtggctcactgaaagagtccagcacaggctttgttgggactgccctcatttag

SEQ ID NO: 52388 - DNA, 1926 bp, Bovine  19866881296429
ttgttctcattcattttcccttctttgaaaataaccccagtgtatatataagcatgggcttcatatacataagaccctgcccctgtacagggctacttaaatcagggatagcattctgatccaagctgggccagttgcagcctcttccccaaaaatttgagtttagggttgaagggtgttagtgactaagagtgagagagtcaagtcacagagagtgctccaaggacagcccctgagcactgtcccagtggcctttggaagtctctgcttcctattcttcttgctcttgggtttcctgctctttttctgatttcatgaaattgtccatgaatttcatgaacttggatatgcttctctttttgttaacatagccaaaattagtttcagttccttgcatccaagagtaatttaagaattgtccttagaattacaaaggcagaaaaacatggtgacaaggaaactgaaactcagaataggcaaagagtaagacagaagttagatatttagcgtgtgtccatctaatgacttaaagtgaccattgcaagaattgtatttggaatcctggaacgagttttggccttttttgaggagtcgtttttaacagtgctcatggctttgtggtggaaactttgacacactgagggacagtcagatggtatactggggtttcaaggatgaaagcgtttgcatttgaggacttgaagagactagggtgttttagtcaggatgagatgtcttaggaaacaggactgtctttcaggtgtttaaaggacaaatggatggaacagaagttgaatttactcatttcagctccagaagtaagaacaagcccccatgaagagatattaatggagatggattttaacttgaaataagggaattttttttgttgttgtttttaacatttagagctatctgacattctatgatttccttggggggtagagaacaatatgccatagaagagttcaagttgaactttgatgtccattcacaaaggttcaatgaaagagagaatccagaattgggatgaaacagataacttctaaatttactttaaattctagatttcatcattttccatataaatattactaactcctcaactagaaaaatgccaacacacattttgacagaatgtaataggatttaaagcactttgcaaatacagtttttatgaaaaatttcttcctttattaaaaaaacaaaacaaaacaaaaaaccctgttggctacaaactgtctttgaaggaagacattttcaaaaaataaggcaacaaaaatgtattttctctaaatggaattgacagtgattaatggtttcactgccaggtggttcactgaattgaaaaaactctctgtgatgttaacataatcatacaaaacccagggaatactgaattccactgtctctaaatttctaaactgtaagaaactgagtagattctttgaattattttaaggaataaatcagaatccgaactcttctcccaaacctttataagtgaaaagaatgtcaccagagcacattctattaaacctaaacagatattttatccaccactccccagaacactcacagaaactagtccctttcacaactctgagaccctttgtgtattttagattattgttcttaactagagggtaagaactaggttattctagtttatcatttacatagcaagcagatgttgacactcagtaatcatgtcttaaacaagaagggacaaggaaagccacttagtttgaaatcctggccttacagactccaccagacagaatctgacatcatgaagctttgcataatctctttcataatctcgtgttctccgtgtaaaaacctttgaaaacgtaaacacatacataaccattcattagctctctactctgtttatttaagtggattacatttataaagagcatt

SEQ ID NO: 52389 - DNA, 1203 bp, Bovine  19866881345171
cttctagcttagcactggaggccagagaagtcactgaccccatcaaagtcccttcactaatactcattctcaaaccactgtctagctccagccagttacagtcttagaaaaggtctaactatatatataaatgtgttaagtacaaatgaatgaggtccagaaaaatacaggtgagatttcaaaaattttactctactaggaataaaggataacatacttaaaaaaaaaaaaaaaaacacacagatatttggaagtgttctctcatagtacatcttgtaacatctaatcaatttctttattttccaatcagagaaccctgagtccatattcaaatacatcttcactccctttaggtatggacaatgtaaagaactctgtgtgtgtggcggcaggcggggggagaaggaagatgatcccaggatcagtctcaaaggggctaaatctaatacttcataaatttttacactgctgtcattcattctaagtactggaactgtgcctactaatgatttctattctactaatacctataagtctttctagtatgcatttggctcccaatactttgagtggataatttgctgtaaaatctggcctcatggtccaaaataaagacatttaacaagaagaaaggtagtgctgaggggcagttaactttcctgtaggttctactgccccggctctaggacagaagccactttagctctggagctcagcattcgaaggtgccctcttgtggtgtgggtaggaactgaacaccctacaatcctcgagctggcttgaggtataaatccagattaagttactgtttaacagccaacaagagaaacatagctgaactccaagaataatactcaaattcaacattctgaaagaatcactgatatccatacttgacaagttctaacaaccattaaaaaaaaataagtaaataaagtaaaagtacaacttaactttctgggctgtcttatttccaaataaaatttacaagacagaatttttgtaagctggtgcttgccacggaatagaagctccagtttgctttcagtacatttggccagtcagagatctttaaaccgaagaataggaaagcccagatcattccaggtatcactcaaagaatctggacatagctctaatgacctcaaggtcatatattgggtgtaatcgacacacggggcaagtgatttcactcactgctat

SEQ ID NO: 52390 - DNA, 820 bp, Bovine  19866881361603
tttgcaaagtttcaggaatggacacacttagatttgaaggccctctaacagtggttcccaccctttttggcacaagggacctggtttcgtggaagacaatttttccatggactggggaggggtggggcttggaataattcaagcacatcacatttattgtgcactctatttctattattattacattagttccacctcagatcatcaggcattagatcccggaggttagggacccctgctctacaaggttgcgggaatcagtgatgttcaagaatttctttgcaaagttttcatatttgttcataaactaagagattattacatttctagagaatacttaaaaagtactttcacaatcatgatttcattttatcctcagaacaaccctgaagggttgttattccctattttgtagagaaagaattagtgtgtacaagttatacgacttgccctgaaagctatccgagagcaaaaaaataggaggtggtattaagcattagtggtacagacaagagatgatgttttgagctctggttctcaatttggtaaatgttacgtttgtcagggcacaatggtctcaggtcacaaatgaggaaggctcatgtctgagtatgcaattaagaatttgtcatagttagggtcaaaggaaaacagttccaattctccatattcttttacagttggacttatacctaaagtgtctttttattcaaagatttggattcttactgaaagaccctgaagaaaactctggataattttaccatgtaggacacattttagatttgcacaactgtagctgtatcttgttgatgattct

SEQ ID NO: 52391 - DNA, 1046 bp, Bovine  19866881475615
agtagggtttcgcccattaagatataataaccgtcagcagggacaaaaagcagatcagtatcacaaattcaaactaacaggcacacataaaaactatgcgcctgcttcaggcacaggacgggggtcaaggtcttacacaataggtaaattccctctccactttggagacagctttttcacaagagcggggtaaggagaaagaacaggcaggaattctcacagccctctagccatttttaaccctgaatgcttttctatcccaaagcgcaccttgtcggaataaagaatggttgtgtttgctgttctgaagggtttctaattagtaaaaaacatgtacttactcaagagagctgttcttgatcaaaagtagtatctttgggcaagaaacacatggcagactgaggtaggaaaggcatactccttttattgttgttcagccgctaagtcgtgcctggctctttgcaatcccatagattgcaacacagcaggcttccttgttcttcactgtctcccggagattgctcaaattcacgtccattgagtcagtggtgctatctaactattcttagtttgttcggttagaccaagtaaatctggttgtccaaggtgtgaaagatgtcacatgggtagggttgggttgctttagcaggctttggctatcgctggttttaaaactggagcctatcatacagagtgaagtaagtcagaaagaaaaacaccaatacagtatactaacgcatatatatggaatttagaaagatggtatgtatgcgagacagcaaaagagacacagatgtgaagaacagtcttttggactctgtcggagaaggcgaggctgggatgatttgagagggtagcgctgaaacgtgtgtattatcatatgtgaagtggatcgccagtccaggttcgatgcgtgagacagggtgctcagggctggtgcactgggatgaccctgagggatgggatggggagggaggaaggaagggggttcaggatggggaacacatgcacacccaggctattcatgtcgatgtaggcaaaaacca

SEQ ID NO: 52392 - DNA, 878 bp, Bovine  19866881525483
tgggcaggctgccagggtttgtggctgtttttagcccatttcctgctcttccctttctgtctcagacctgctgcagaatgaacagaagtggtgtaagaaccctcagcgagattcatggacctttttaatgagttttagaggttgatatatgataacattgaatataagtaatatacatactctgtgaataagagtagatgtagggtagatgtcttgaaagaactctggacattctaggcatcgaccctcgaccatctgtgcccaccttcctttctagctttatctcacactcagttccctggcacagattgtgtgcctcaaggcttcctattatttgtgaatattctgtgctgctttttcacactgcctgtccatggcacttgtatacttcttatccatccagtcttgcccatcggtgaggtggaagccgccatcctgtctccttcaaggtgttacttcctcgatcattccaccttcttgtcctcctctgaatctagaactgtttatataatatttcttcatggtgcttaatcacacccagtgtctctaatgaggatgagtgctccttatgaccagggataaactccttttagtcagcagttatggcagcagcagctacagaaacataacatttacatggtgcgttatcatttgtaaagccctctcatctctgctatctaatctggtttttcagaattgcactgtgaggttggtattattattatttttgtctcgtatacagatctttagaagctgctgtcccagcttagtgacttattgcaaaggagagcctttaaccatgaattattaaaaagagatggtttttaggaagaaatttggcatttttaatgggctatatacataaatgatcgattgtt

SEQ ID NO: 52393 - DNA, 873 bp, Bovine  19866881653414
tggaaaaacctagccttggctgacggacctttgttggtaaagtaatgtctctgcttttgaatatgctatctaggttggtcataactttccttccaaggagtaagcatcttttaatttcatagctgcagtcaccatctgcagtgattttggagccccccaaaataaagtctgacactgtttccactgtttccccatctatttcccatgaggtgatgggaccagatgccatgatcttctgtgctcattacagctatacaaacgttaccaccctcaatgatctcaacagttacatgaaaagttatcaatatgtgcatttgagagatgaggaaactatcaggatcttatattgtgcaaacgatcaatccaaaattcacactcaggtttgtttgacctgcagctcttaaactctcttatcaaggacgatatacaacgatggtgttgacactgatgttaatgaaggtaatggtgatctgaaaacggtagtagtgctagaaaaaccatcaacagaagaactgttaataacaggagagctaagacatgcaatttttaaaaatggtcttgctaggcaacatttatactaattatagtcatttatgtgaatcgtgtacaattatgcctaattataagtcaccacaatatttatgtacaaaaataaatatgtcagaataactttgatctaaaatggatttgattataatagtcacctctctatatatgtaatcagacttcactgttgcccaggttctaacatgcacgtgtgacatcttgacagcattttatattctgcaaaagatgctgtctgaggacattctcaagcaccagacattatcaagtattgggaggaaacaggcaactaataataacaaaataggg

SEQ ID NO: 52394 - DNA, 920 bp, Bovine  19866881834900
gagcgaaataaaatgtaatattctgataaaataggtatttatgaaattgtgaatgattctttctttgcaaaatttaatgtttttatattactttttcaggatgcagtttagtatttattattattattatatgcagctgttttacctttcagaaatatttacgaaaatgtaatgtgacagtgaattacatgagaaaatagcatcctataaatatgctgctttggcactaagaaaggtcactttggctataaaagagttacaatgaagaggaccatttataaggctatgctgatcagtttccaatttctctcatttcaaacataaattattgctgaaaacatggtttatgtttgtcataaatggattttatgtcactagatgagttggcttcattgctggaaatctatgcttttattccaagcagtgtcttatggttgggagacaggagaagagatgggcttagtttctaacgtgctttgcaaatgaaagcaatcatcaagcatagcccatttgtgttgtcaattggagatttacaaaatctggggttggtatattctttgggctgggccaagactggcttcaatacctgtatacttggaggcatcaggcactatgcctgagccacttaatactgatgttttccaaactactcaggactatagaacttcctactaatttacttttctttctctattgatcttaggatgttgaaaatagggggaaatgtgttctattggttttcacaaattcttatttacaggaatggtagatgtgcagaaaagagttaatataacaggcctgaggccttttttttaaggctctgcttacaagggctggcccttggctagcatttgggaaaatgtggcacttgactccttccctttagagataagggcagtccactgtgcctagactgttca

SEQ ID NO: 52395 - DNA, 2077 bp, Bovine  19866880255453
tcttgatgaaagtgaaagtggagagtgaaaaagttggcttaaagctcaacattcagaaaactaagatcatggcatctggtcccatcacttcatgtcaaacagatggggaaacagtggaaacagtgtcagactttatttttctgggctccaaaatcactgcagatggtgattgcagccatgaaattaaaagacacttactcttttgaaggaaagttatgaccaaccttgacagcatattaaaaagcagagacgttactttgtcaagaaggtccatcttgtcaaggctattgtttctccagtggtcatgtatggatgtgagagttggactataaagaaagatgagcaccaaagaattgatgcttttgaactatggtgttggagaagactcttgagagtcccttggacctcaaggagattcaaccagtccaccctaaaggagatcagtccttgggtgttcattggaaggactgatgttcaagctgaaactggaaggactgatgtttggccacctgatgtgaagaactgactcattggaaaagaccctaatgcggggaaagattgaaggcaggagaagaaggggacaacagaggatgagatgcatggtatcaccatctcgatggacatgggtttgggtgaactccaggagttggtaatggacagggaggccgggcatgttgcggttcatggggtcgcaaagagtcagacccaactgagcaactgactgaattgaattttacagaacctggaacatagtaggatttagataggtttgttcctttctaatctatatttcttgttttgccttacaatgttttaaataaagatcatatggtgtagtctagcaactaatttttgcagttaaatgtatgaattagttacctaatagttgctatattttaaactaaaattattgttttacagtaagaaatgttataaggaacttattttctaggctttaaaatataattgcactttctagtttttgtgttatatatacgcttacattattattgcttcttttgaattgtgctatcatagaactattttgtttcttcttatcactatttaaatagcaattaacttatcagtattatataggacatatcagggaaaataaaatataggagttacagagatattttcattatttttaaatctaatactaacttggtcttgaaattgaacacaattataaagaattatatcacagtgtaagtctaggcagggaaattcaaggaaactgataatcagagattcaattttttgctcatgatccataacagttttaagatattaatcatagtggatgctgtccaaatgcatgattttccaccaaggtttattttttccacatcacaacttaatatttacattgttgagtgctacctgtatttttttaactctacctaccatcttctctttctttcttgaaccacttacaatgttttgccctgttttattctagattgatttcctccagtctggtcactcagcaaagaaaaagtaattttctgcaaaactctacagaaactggctagagtttagtgaataaggcattcaatcctggacagcccaaactgaaactgatgtcaccagatcatgtcagaataatctgatcatattttctaaccaaggattcttatgtggggaatcttactgccaatgttttatcttatacagctacaagctccaaacttggaaaccagcccactgatcaccccagggaaagagctggtactgctcccagctattcaagctgagttagcaagattgggttgcagccaagtttctgccaaaatgtattctgttgtgtcctgcccttgttcacaccagaagaagagctagtggttatttaaatcagcataagattcccaaagccaagcttcctcattagtacttttatgttcattcttgctggatatctgacagttaccttagaatgaatgtgcatgataggatctgtgtatttgctccttctcctggatctgggagttttatcccagtgaaaccaggggacaaacaaatgtactctttgaccacttaactcccccccctcctcaatttttaatgaaaatac

SEQ ID NO: 52396 - DNA, 2066 bp, Bovine  19866880361797
cttatagtttcctttgttgtgcagaagcttttaagtttaattaggtcccatttgtttatttttgcttttatttccaatattctgggaggtgggtcatagaggatcctgctgtggtttatgtcagagagtgttttgcctattttctcctctaggagtcttatagtttctggtcttatgtttagatctttaatccattttgagtttatttttgtgtatggtgttagaaagtgttctagtttcattcttttacaagtggttgaccagttttccaagcaccacttgttaaagagattgtcttttctccgttgtatattcttttctcctttgtaaaagataaggcatctggagaagactcttgagagtcccttggactgcaaggagatcaacgagtcactcctaaaggaaatcagtcctgaatattcattggaaggactgatgctgaaactgaagctccaatgctttggccacctgatgtgaagagctgattcaatagaaaagaccctgatgctgggaaagattgaaagaaggaggagaaggggatggcagagaatgagatgagtggatggtgtcattatctccatggacatgagtttaagcaagctcagggagttggtgatggatagggaagcctgtcatgctgcaatccctggagttacaaatagtctaacatgactgagcaactgaactgaactgaactgaactgaagtaatttaaggtaaagccctaggtgatctagatcttttgttcatttccagtttatccattttaaactaaactccagctacagtgagcctcctatgtcttgattcctctgccttaaaagatctcttacattcccctccacctgtcttaatcaactccatgtttgccagtctggtttgtttctttacctttatgttttccttttctaggtaaatgatattcagttatttgttcaatactctatagaagtattggctataatatcttctttttttgtgtattgaatacagaaaggaactgactaatgtgagctgtgaaagaatttccctattttcaaccaagatctctttaaagatgtttgaattaaaaactatttttaataggtaacatatgcacaatgttcaaagagtagagaaagcatattgctccacccagcctatacttcccttcccagagataaccagagttagagtttccccaaatgtcctttcagagacattttatgcttgctcaagaaaatacacgtaaatagaaacacacacatttctaatgtttctatgggtaattatattttcaactagtaaatgatataaagttataaagctttcatctgacctattcatgctgtggatttcataagaataattttttttggtttcactgtttcaatcagtaattgagtaattaaccatttattaataaagaatttataaagtcctgattgaaaattttaagtgggtcatgccctacaaaattatgctccatttcactgtctcaagtttttaaaaatttaagcagacaacctctctaaagtttacatacttccttttgttttcacttttttcttgttatatttataaatttcctgcttcaccaagaatctttctactcattctcaatgctcaaagaagttaaaaattaaagcatgatttactcaaagaataggagggaggagggttcagtatggggaacacatgtatacctgtggcggattcatgttgatatatggcaaaaccaatacaatattgtaaagttaaaaaaaaaaagaatatagaattagatatgtttaataaaaatataaactaaaccaaccaaaatattaacttattaaagcaacatacttattttctctaagatatttaaaattatataatgtgttttgcctctattttaatgtaactcaaaattctaaattatatttatataaaggtcattttatttagctttttgaaaaaagttgaatttatacatatgtatttgtatagtaaaaacacaatttgcaattatagctttagagtatataaagaatattctggttcaccaatggaagaacagagatcatgcttcagatgaatgatgtctaa

SEQ ID NO: 52397 - DNA, 1450 bp, Bovine  19866880612421
atttttatttgttctgagtggaagggtaaaacctatgtctgtcattccatcttaatggaaattaaaaatcttcattcattctatactactcttagaagaagaaatttctcctttgccggtgaagaattcaaagccttatcaatatcaaataactttctgagtttcacacagaacatggaagtatgagttagcattcacgctcaactttttaggaaagtagggttcagggtcctgttgttatgcaatgaatggcttatgccattttctctagctttcagggaaatcattcttccattgttatgcttcatatttgttcatgtctcctcgacccttccccctattggagtacttagatataaacagtatgttttatcctataaacttgctttctttatgggaatctaaaatcttgattatggtgatttttttctgtatatcatagacttggttttccattttaaaaatagtttctacttattcttgcattttattctaactttacttttataaattatcagttatctctaatgcacattcattgatttctctcaatattttctgtctacataattgatatatgtgcatttcttttggaagaaataatacataagccgagccacaaagggaagcccaagaactggagtgggtagcctatcccttctccagcggatcttcctgacccaggaattgaattgtggtctcctgtattgcaggtggattctttaccaactgagctatgagggaagcccctgatatatgtacattgttattgaaagaaacaatacataaacttataaagaaaagaatcacatgaggttcagtcaagagttgccttttttgttatctcttgatgaataaatatactttatgctgttttaaaacttggaaaactacttttgactttactttgttatgctttttcattttcctgaaaattaggaaccagtattttgaaggcactaccaaattgccagaattggtaccgaatgattctggaatctactatcgtgtgcatcaatgatgtggaatgttgcatggccagtgattgttcctgtaacatatttagtcaagaaactaaaaaatatgatagattgcacagaattttttgcttgaattttaaagttcaactcagaaaatagatggcaatcttattttaaagaatgttttctcccatttctttcttattttagctgagacagtaaagaattcaaattacataatatctctgtcttctagaccagctgtgttttgtgtttgttaaatgtttcaagtgattttcaaacagctgggctttctcagccgtatcttatcccagttatatttctccatgatctcaaagctatttgaaatgatttttcccctgattcaatacacatgtttatagtaaaaaaaaaattggaaaatggagaatgaaatggtgaagaaaatgagtcagctataatcacactaa

SEQ ID NO: 52398 - DNA, 3261 bp, Bovine  19866880739856
ctcttgaccttttattaagagattggaactgccaagagtgtgtgtgtgtgtgattggtaagttgaagtgttgctttcagaaaagaatacagtgtaatctatacattagatataagaatagcatttcacagaagtgaatttttgtaggatagttgtgattcataacacaacactatacaaatggcaacatttaggtctcaaacaatttcttgccagaatctgccaaaatgtttttctattaatcattaactatgatgttataaaagattctaatttgttatctttcagttattgatgctattaagaaaagaaaatacaaactgagcttgtgccaagatgcaaagttaattcaactaaactcataggcaaagatgcaataaatgcaagtcaaaacataacctttttcataggcagttgggcatttacatttctgagtaggtttttagaattataattatccaatttagaagtcaaaaagataatttccttatgaaaataaagcctcaccaagcctgatcaaaatgcacttggggaccttatactaatttatgatgccggaattggagacaatcttagagtaatgatttcaggagatgaatcacagagcaatttgtacttttccccatcatgaggcaataattttaaaataatcatctcctatattcatatatatactcgtttcacgtttcctcttatttccactgataagtgttacgtaggcacaaattggaggaatcatgaattttgtgttaagctgataggagatggtggaaaactgacatgtaactggtttccagttcctctagagaatggattgagagtattgtgagtattgaagattatgcagtgttcatgaaaagagttctcaaatattatggagttactaattataaaaagaaaagaaattggataagagtaaggcaaagagtggtaaagaatgaggaaataagaatgaatggtaaatttactgctcatcaaatattccatttgttccattcattttgcagttttcttgcagctggcaactgccatatgacaacttctaatcaatggattctgagcaaaagtaactggcatcatttctggatttctggactaaggtcataaaaatgtatatacaggataccttttcttgttctgataaacctggaaacatttaagtttgttctgttacacaaagttcccattagccttgtgagtgagtgtattagtcattcagttgtgttcgactctttgcaaccccatggactatagcccaccaggctcctctgtgcatggaattctccaggcaagaaaagtggagtggactgccattctcttcttcagaggaacttcccaacccagggatcgaaccctggtctcctgcctcgcaggcagattctttactgtttgaactacaaggaagtctagtacaggcacacagtagtactctacaaatgctgctaagtcgcttcagtcgtgtccgactctgtgcgaccccatagacggcagcccaccaggctcctctgtccctgggattctccaggcaagaacactggagtgggttgccattgccttctccaatgcaggaaagtgaaaagtgaaagtgaagtcgctcagtcgtgtccgactcttagcgaccccatggactgcagcccatcaggctcctccgcccatgggattttccaggcaagagtactggagtggggtgccatcgccctctctgctacaaatgctagttaaatcctaatcacctaaaaggttaataaactatgcacgtgcacatgcctatgttgtttataaggagagtgacttagttttctgtgagccctctcctatcccaaccccactttcccccatcctcatacacacactccaagaactggaggggctgtgagaagacaaaaagataggctggaagccatgtgtccagaatctccaaaggagaagaaaacacacaaccaacaattcctctctgggaggaatcagaaggaaagtcagtgagaggacacctgataaacgccactgcctgcctagaatgattcttcagagactcactaaatccagatcaggagaatcagtgcagaacaggaggaaatctcaaagcaaggactgggagaggtacactatattaatgtcagattgacgcagctccagagtctggctgtaggtagcaaaggactcaagaggcctcatcacaaatacgtatagcgtgcggctccgtcacactcaagagcatgagcaggaggaaggcagaagcagttgtggagctggaaggcaggtcatttccaactgatagtgacatcaacgaacctgataagtggggactgaccctagtgaacccaagtaagtggaaggaggctcaagatacagactctctagtcactctgcaaagcccgagtttccactgctactctttcagtgcctcttcttgaacctctgaaatgttaagactcaaggttaccttcatctgcccaacatacatagtccagcttgctctcgcccagcagtcaaccactaacgttgtgcaggaagatggatggagaactcttaagttctcaaggagtatttaaaaaaaaaggcgaattcagtttatttttcgcttaactctgtcaagcaagaagttcatcccccaattaaatttctctgatgcagtctgagactggaatcagcaagaaggtggcgactctttcactatgctctttcccaaatgaggcagtgacctctgagcagcagaaccggcatggccgcctctgcccatgtggatctgtctctactcgcagctgtgggtcgcacaggaataataagagggaagtgttcatcagtacctgctgcaactctgtagcgccctgcaccaagggttctcagattcctcaaattcatctggggccactactaccctttaggtctgcttagacactcacaaaacagactcagatcactttatataaccaactctttttttttcaatctctctatgcttggcacatgattctcttttcctctactccagagattttcaagacaccaaaagctcctaaaagaccacttatcaaaacttccaagggaaaagaagttcagacatcctcccacatacagcatttcagatttcactaggaaatacagacgatctggaaatggtcacaactgggattactactggcaccaggaaggaaggcgaggaggccattatttcttttatcccagggttgagctagaaatcccatattacagtatttaggggacttgcccactgaacagaacaggtcccccatttgacaac

SEQ ID NO: 52399 - DNA, 834 bp, Bovine  19866880754409
taaaagtgatagaatattttaaatttctgagaagccagtgtatgcattcagcatacaccacgctaccttttttagttcatagacaaaagcaatgtatttcacagtattcaattctgaatacttgttcttctcctagcattcatgacactaatagtattataaatagtgaggaatcaatttttattctattgcaaattcccaaatgctccttgttggtaagaagttacataaattcagcaatattcatggcatagtttacaaatatgataaatattatagaaatagctattatccttagctcaataacttttgaaaaataattggtttgagtaatgaaacctgtaatttctcacaaaaggaaaataccctgaagttatttcacaccatcttcacatatggtctgccaaaagttatataaagtcaaacctcccagcctaaagctgtagcaaggtaattagatttctattttacaaatgaatatgttgatttcattggaagatgtttaatcatatattttgcttataatgctaaaatgtcacatttagagggtgataagttgaattacaattaattgaaccatttaggggaataattggggcaaaggcagtataaagttcccattgagatgtaaatgaagcccacttaggttttaggaccattgatttatttgctgtttagaaccaacccctttattcaaagacttgcagagtgaaaaatctggtgacagttcaaagcagcatgtgaggatggctaggcaatttgatagtctaacattcctagattcctgaactggaaacagaaagcatgttctttgtgttgggactgatgctagag

SEQ ID NO: 52400 - DNA, 1564 bp, Bovine  19866880816916
taccccattcccttctcttaagacttggttagtctgggatcaagagaaattcaaacacagggtagaaatggcatattgtgtttctgtgccctctactcaaaacttattctgtaacatcgaggagctaaggaatcacaagaaataaaggatagtttagacattgcctagcaacacctcataaaatgaaagatagaagactcatcagaaatgagaacaggtgaaatcatataaaaatattttagacatactgtctaagtcatctaggaggaaaaaagagctaaacagaaatgggctcattttctgtgcaccagaggagcaatagaggaggagagagaaacagacatactcttctagtcatcactgcaaactcacatcttggaagtaaaattttaatcagaaatcataaaaaatgaattccaaatgtaaagtagtaagatataaatctaatataaaaacaaataattgtgccaaaatagtaatagttcttgcttcaatgtggggtccatagaccatttctagttcttatcattttatgaaataatagctaaatctgtccttcattttaaaatttaaaggtttttatattaaatatatgtttctttgtaatcactgagcatactgactttttttgcaaatggctctcaatagtattaatagtaagattcaagatttcctctaaggcagttgtgatagaatgcaaaaataaattgtggagaattgaaataggagggaaggggatagggcacaaactttaaaagacgacaacataaattgctgtcataaaaagatgacaacataaactgataagaacaaaataggtccaagatagggaactagtccatttccactagaccttaaatctcagtatacacacattgtaacacatcagtgagctaaatgacgcagccacaggcaccatggcagttctgaggccaaccatcaaagaccaaaaagtgggaggcggtccagctcctggaaatccccacctgttcctcaaaatagttggaatatttatctgacttagcctatgaaattacccagcctatgaaaagtaaccatgccttctgagggacactcttgcattctaggatggcccacaccatctgtgaagtgtgtttctttctaaataaattcacttcttacctgtcacttcagttctcactgaattccttctgtgaaatgaatcaggaaattactaccaggcagtttttaggaaagggaagaaacagagccactttgtgtggagataatattagggtaatacaatctgtcttaatataatctagcttttggttgaaaccactatgcatgtcaggagtgagaagataaaatggggaaacaaatcagatcagcagtgtgaagtggctagcttctgagtaggttagggtacatatgctaagatgtcatcccatatagtgctagtggtaaagaatttgcctgccaatgcaggggacgaaagagatacgggtttgttccctggatcaggaagatccgaagatcccctgcagtaataaatggcaatccattccagtattcttacctggaaaattccaggacagaagag

SEQ ID NO: 52401 - DNA, 960 bp, Bovine  19866880967330
tgttaggtcactgaaagagagcttgaattactcttcatagcagtcaaatgtaggaaactgatacattttctactgaccatctggtgaactctgcatcagatcagcaatatgagttcactctttaaatttaattattattcaaacattgataaagaaaactaaatgaatagctttaaactgttatttcataaaggaaggtcaggctcagcaacaaaaggaaagtgaacagcttcttatgaatgttaaacagaggacaagaaaagttgttctgtaataatagaatcttccctcattcccaactgatgttcatgtgattgactaagaattatgacatgcacctcgatccttcatttctcattttaatttacagtgtcacatattttaaatatgtaataaaggtgactttgttaataaaattatgcaaaatgaaacaaagaggatacttagaggaatataggcaagaaatagcaactgttcttaaatgcactttatagtaattcttattttgtatttttgcaaatgcaaactacacacactacaggaattctattgttttatttatattttttcacatttatctttcttgttgctattttgtggtagtacaatcctctttttgttctagtttttttgtttgtttgtttctgcctcttcactgctcacattaaacaccaagtactgtggtctgaattaataactcaatatgaatccttctatatttttctttgtatagtcttcatgtgtatatgtgtgtgtgagtgcaaacccataacatgaatgcacatgtatgagtttgtcattcattcataaaagtatattttttatcttgcttttatcattcaaatatgtcccatagaaatgcttgcaagtcatttggtgtatttctacttatccttaaatattccattatacagatgtagcacaaggtcataaccatccgactacagaggagaattcaat

SEQ ID NO: 52402 - DNA, 1820 bp, Bovine  19866881014089
aaaagaggtgagaaatgaagtatttccttcctatcagtaaacaaggatgtcacagtcggtgacattggagggctagcgattgtagccctccagtgtgagctggtggttccaaagggcactcattcatgctatgtcacttcagttgtgtccaactctttgtgaccccatggactgtagcccgctaggttcccctgaccatgagattcttcaggaaagaatactagagtgggttgcttctacaggggaattcaggacactcaggagggagaaaaatacttgcaacctagcacaattagactgtagcccctccttactgtggagaaggacatggcaacccactctggtattcttgcctggagaattctatggacagagaagcctggtgggctacagtccatggggttgcaaagagtcagacatgactgaatgactacacacgtacacacgtacacacactcctcattgtgagcccaggatgtgaaaaacacaggatattggccctagatagctgacgttcttatgaaaggaatgatttcagtaaacccaaagtcttgaatcatcccatatatagaaaagtgttaaattctttaacttgggacatctacttttctttaattaaatatttttatatttagactacctgtccttcattgcaaaacttccatatagcctggctcctctcctcacctcctcagagcagttttctcacgattacttgagatgctgacttctgagcttgaagtcctccctcctccaggggatcttctcaacccaaggcttgaactcaggtctcccacattgcaggcagattctttactgtttgagcaccaggaaagcccataaaacataactctcaacttttaggttgtgaatatttttttaagtcaacagaggtatatttacgaacatggaaacatttttgttagataatattaagtgtaaaaggaaattataaaactatgtatgccaagttcatatatttttttaatacctaaaaatgtgtatgtgtaaatgcatgtatgtaaatgtgtttgtgtatgtgtgtgtttacttacacacacatttgtgagctttataggaaggataaatatcatctaaacaatggttctggctattagaaaggattattagtgacttccattttgccattatctatttttaaaatttttaaataaccctgtgtacaagacagcaaaagaaacactgatgtatagatcagtcttatggactctgtgggagatggagagggtggggagatttgggagaatagcattgaaacatgtataatatcatgtatgaaacgagtcgccagtccaggttcgatgcacgatactgaatgctttgggctggtgcactgggacgacccagagggagggtatggggagggaggagggacgagggttcaggatggggaacacagggtatacctgtggtggattcatttcgatatttggcaaaactaatataatattgtaaagtttaaaaataaaataaaattaaaaaaaaaaaaaagaaagggaaaaaaaatttttttccaaaagaaagtacatacattaatacacacaaaatattttttttttttttaaagaaagtgagcaaagcctttgagacattctttatcattggttgtacagttgaattttagaaaaggagaacagacccttcttgtgcttcagtagtgtggagcctgccagcctcaagtaacatgtaggcttcattctagtgcaggacagtctgcaaattatgtcaaggttctatgagtttgacagccgttgtcggaaggggacaactgctcattttcaactgggtctcacaagcat

SEQ ID NO: 52403 - DNA, 1304 bp, Bovine  19866881075617
ctgatgtacagcaaaatgtaaatactttcaaaacagcatcatcatcatacaatttttataaacaacatagatcatcactttcctaaatgcgatactctgcaagtaacaatccatctattcatttatttaataaaatgtcatatttcttctacaaaatgtcttctccaccttgatttatatatatatatatatatatatatatatatatatatatatatgaggagggcatggcaacccactccagtattcttgcctggataatcccgtggacagaggagcactggcgggctacagtcagtggggtcacaaagagttggacgtgactgaagtcacttggcatacatacttatataatatatatatatatataagattgaaagtggaaaaggaaagattcaaggtgggaggagaaggagatgagaggatgagatggttggatggcatcaccaactccatggacatgagtttgagtaagctccaggagcttagtgatggacagggaagcctggcttgctgcagttcatggagtcgcagagtcagacaagactgagcgactgaactgactgaactatatagtcttagttcatagattcaaaaactgcattgatttgatcgtataatacttcttttgtgggaggtcgtcctgtacattgtaatctgtttagcaacatctctagtctcttccccctagaaatcagttacagatcccatgccccagttgtaacaatatctccagacattgccaaatagttcctggcaggcaaaaatatctgcctggttgagaattactgcactactttgatctgcagatatgacagtggtattagttgctcatcctcaaccacaaagtataacttatggggggaaaataagaggataaaaagatgagatggttggagtccatcactgattcaatggagatgaacttgggcgaactccgggagatgatgagggacaaggaggcctggtgtactgcagcccgtactgcagtgcatggggtagcaaagagtcagacaatttagcaactgagcaacaacagcaacaacaacatagattatttttacaactaacttagtaccatcaacaatcttcaatagttagctctttgtggggccaaattttggtctagttccaatgtaaactcacacctctttgggcttcattaaggtttaacatcaatcacattaccttctttcatgttattggtaagccagagtttgaactcatagctacaacaagataacaatttaaatatgtaaaactgatgccctagtttttgaactttccgaacaaatgcaattttt

SEQ ID NO: 52404 - DNA, 1124 bp, Bovine  19866881093854
aatgaagttttagttacttagttccaaggttatttggtctactttgtggtgatataggatgcttgcaatagaagaaatttttattgttacatggtgtgatatttttcagattgacagttgcagtcttttagtgggtcatgaaatcattttaggacccggtaactcagtgggtttatcttacagctaaggaaccaatcacatttagataaaccccagtattatagtattgctggcagattcgtccaactttgtgcaggaagaagacattgtctttgttattctggtcaggaacaaacctgccatctctccaggaagggcaatctgtctctatcctccaaggctttctgttatacaaacatccttggaaatctaatctggaataagagctgtcccaaatcatgtagaagtaccatggagaattgattttcaaaaggttgcctttatctttactcttattaataaagaaatctactgaacgatttctttaaaaaaattaatacccagtatatatatatttccaataaaatagaaaatatcagaatgcactgtaaataataactacagtttttgaaatttttatttcagttctacatatatgtccactgagtcatgatttaaaatgtgtttattcacatgggtcattgtcaaaaacgtttggaaaacaattatctatttcttataaacaagggaattgtgttagttatctattgccgtgaaacaaattatactaaaatttagtgccttaaaacagaagcaggtcacatttcctttggttcaggaatctgggagtggcttaggtaggtgattctggctctgggtctctcatgaggttggagtcaagctgttatctgggccgccagcgtctggggctcaatcaaggatctggtcccacaggttcactcagaccatcagtcctcagttccttgccatgtaggcctcttcactttcatgacagtggcagctagctttccccaaactgtgtgatccaagagagagaggaggcttgagatgggagccagtgtcttctataacctggtctcagatgtgacacaccatcgcttctgctgtattttacttgtcatacagaccagctctggtaccatgtgggaggggacttcctatca

SEQ ID NO: 52405 - DNA, 1952 bp, Bovine  19866881228260
atcaccaactcctggagtccacccaaacccatgtccattgagtcagtgatgccatccaaccatctcatcctctgtcattcccttcttctcctgccctcaatctttactagcatcagggtcttttccaatgagtcagctcttcacatcagggtggccaaattattggactttctgtcattagagtggtatcatctgcatatctgaggttattgatatttttcctggcaattttgattccagctcatgatcagtccagtctggcattttgcactgatatactctgcatataagttaaatacgaaaggtaacaatatacagccttgacatactgctttcctaattttgaacagtctgatgtttcgtgtctggttctaagtgctgttttttgacctgtatacatgtttctcaggagataggtagagttatgaataaattataataattatacataccacttagtacagtgtctagcacaaaggaattgtgtaacctaggaggactctgtggggctcctggtcacagaagccttttttatccccgtttctgtaggcaagactccagtcttcataaccttccctgagttccaaaggacagattttaacagttgctaatcaaggaaaagaagtaagaaaccacctgaggcaagattacaagaaccagagaagttcaccaagattaggagaccaaccacctgaaacctggaacacaccctaatcttgtcagcacactctcacccttgaactattgctgtaaaattcctcaccatatcctcctcccaggttgggagcgatggatttttgaagcaggagcccactttgtcctgctttgcctggcaaaacaataatgctatccttttctacttcacccaaaactctgtctccaagatttgatttggcaatggtttatacaaagactgaactttgggcatcaaatgctcagtaattggtggctactgtggtgtatgtaaatcaaatacaatacacatgtgtatcatttattaactactccaccttatataaggatttgagagctatatttaatgtacacattcatatgttcatttcatgtttatcagttatcttatctgactgattcagatatcaattggcattctgtgatatcctgttttctacatcttcatctttaaaactagcaataatattaaattaaaagaaacatgtaaaccgtggtaaatatccagtttaagtaaactgaaaaacatgttaaacaactctaaatagatagactttttcttatctttttcttcttttaaacaggatacatgcctatacatgtaaggctttgtcttttttaaagttaattgaattttttggtttgtgtaaagttaacagagaagatataaacctttataaaaaaatcatactacacattttcaatattctctgaaatagacacttttttgcaagagtacttttctatttaaatttgcatatccaaacaggtttttaagaaaatggatgattcttaagctctgaaattgtataaccattgaatgttgataatttctgattttaaatttatgcaataaagaaattaaatttgaaaaatatgtcatagctagagaaataaactattgctaaaattaagtagatattactagataaaatattaccacaaaatatttcataaataagaatgatatttcatgaggttttaccctgaaatagtgtatgtctcagaaagcttttctatgtcattatgtcacatagattatattaagtagtaattactgctaacaaagtgtaatattgcaaaaattaccacagacattcttttatgaacataactttataaaaaataagaaagctattgctaaagctatcaaaacaatcccctctgaaatttgaactataattgccatttttattctgtcccgtgagacacagaggaattcaggaggcagcgacaatccacacatgtaatagtttctc

SEQ ID NO: 52406 - DNA, 1205 bp, Bovine  19866881505681
actgtcagaggataagatgtgttgatgaaaaaaaaatttttttcctccagtgacacaaataccatgcatcagtgaagtgaatgaagtgtttggctctatcacagatgccaaagacattctttgaatgtgcagattttgttttctgaacaagataaatattgtcctctacaaaaaatatatatatcaattttctggcactgtcaagtcatttatcaatggacttgtgtctaagaaagtgagtttatgaacgagagatgattcaatctggtgctgaaaatgaaacatcagaagcatgaaattatattattgacccagaaaattagtgaagtatttgaaaatcttatgtatctcaattttctgattcctttaaaaactatccattttaatattccatttcatatttttgaattaatattgagggatagctctgcttttaagtagttttgataactttctttctgaaacatttcttcactctttaataaagcacacccttagaaattctcaccactattcatctcagttcctgttcaaatcctaaacttaatttaactataatgccatttctgttaacttgctctctgtgtgataatacagccatgtagatgatgcattttgctgatggttgaatatttatatttcctcacacatattccagctctcttgcaactctcttgcaacgcaggaccaacaggttatgaaataccttgaatctctgagccaaatttagaggtatgcccaaccagtaactaaagttccatgagtaaagagtaggcatttatttgttaagtcattgagatttgggggattatacataaatggagatcacccttacttatgtgagtcctagaccctagataacctagataacttatagaagatattctgtaagtagaatatctttatacttcagttccagtcttgatctgaagagtaggaaagaagcatggaaaagaggagtaacttacccagagcagtgatatttaagattctaagagctctcagtcaagcttaattcagaaattctgctagaaaagcagatttacaccattggttgcctctttatacacactagtatatataaaacatttgaccaataggatctactgcatagcacagggaaccatactcaatattttgcaataccctatatgggaaaagaatctgaacagattctgctttactttctagtacaactaaaacta

SEQ ID NO: 52407 - DNA, 719 bp, Bovine  19866881527714
tatgaatacgtctctgccacttttagtagtataaccagcaatgattttaagagctcagcaatagcatatggctatgcaatgaaaatttaaaacatgcaccaacttttagaactatgttgaatattaaatacctgaaattgctagtggctaaagcacttcatttagcacaatgtatataaactttgaaactattttcaggcaccggttttaataaatgaagtgcaaagttgaggaagtttactaaaaaatattttgttttaaaatcatttattttggaactacccatattgaatctttgtaagacatatgaagttagagaaaagagtaattctcactcagaatttaaattaagttcaagcatgcttttaaacatattcttaagaataaagaacaaaaatattgtttataattcaatttctgtagtgtatatacaggatttgaatttatattattaaaaaaataagaaatttaacaagaggtaaacaaaatagcctaattcatatgtaagccaatgaagaaaactagacaattgatgttgtatcagtgctgaattaactagttctgagtataaagcaataattaaaatctcaaataactgtattttatgctcatcatttcaaccctcagtttatatgctccaatgttctcagaattgatgtacattagaaatgtcccttcttttcatacatatgcatgatgatgctcctaatgtgaagaat

SEQ ID NO: 52408 - DNA, 1133 bp, Bovine  19866881947824
gttgcatacataaaggatggctccttgattcttaagtcctagtcttgaatgaagttacttctctgagtattttgtacagcccctaagatctgagaaatagtaactcatgtaaattaatacgaaaaataaattgaaccattttctctttctttaaaggccaaggcaaatgcaatttttaaccatgaataatgatacagaattctgctatttctattacatcttaaattaaaaactcacataccttatttaaaagctgaattttcattttatgatgatacatatttttatattggttttctaggtggagtattcctttgagcaaaaagagtatttttagggttaataggatctgttctcattaaaactaaaactcatgaacgattttagatatcacctaagggaaaacacagcaaatgcgaactgccaactcatatatatgcattctaaaatctcaatcaagcacagtgaagtctttttaggaaaaataattattctcctgattaaagagtgcattttttctgtccctagtgacaaaggaaacatttaattattaaaagcttatggttcacagttgacatcttgtttaatacacctctccaaatatattataatactctagttaagaaaaaactcttagaactttcagatggtttcacagaaggttaaaataaatgactattatttcaatattaaactttctagttaccaaaatctaatcagcatcaattggcatgaaaagccaaggagttgtaggatagtaaaaagtgttctgaactggctttatgaagccattcatagcacttttccattcctaacacttccatgaaagctgtgatgttagcagagacatatagcttttttatctttttagtttccaggtaaaacaactatagacttcgcctaaacatgctttatggtccattatagaggcaaactatttatttcttttcttaaacagctttctgtgcacttggtccctctataataagaaaaaaaaattacaaattgcaattgaacaattaatggccaatctaaacaataagaaaataattctaaatgaaagcacatttcataaattctggatttgacaatgcaatgctgattagcaaagaaaaacagctgatcataattca

SEQ ID NO: 52409 - DNA, 1523 bp, Bovine  19866880115550
tattgctgaagcctggcttggagaattttgagcattactttactagcatgtgagatgagtgcaattgtgcggtagtttgagcattctttggcgttgcctttctttgggattggaatgaaaactgaccttttccagtcctgtgaccactgctgagttttccaaatttgctggcatactgagtgcagcactttcacagcatcatctttcaggatttgaaatagctcaactggaactccatcacctccactagctctgtttgtaatgatgctttctaaggcacacttgacttcacattccaggatgtctggctctaggtgagtgatcacatcatcagttactaatatcaaccaggtagttattaggaggagaaattctttttccatttgagctcttattcacctagacatccccaggtgaatgaacccggaatctttgtgtccttttccccctccctcttctctgataaatgtgcgctccttttcatctagtcttaattaaaattctgttgagtattttaagttttggtaacaatcaaagacaaatgagacaagggacttacccataaaggggttctgtgaattgggaccaatttaggaacttcactagctgatacaattttcttaatttctgatcaggcacccatctgacggggatgtgaaagtagcaatacgcagtactcccaagatcctacgaggatggtcagagctgcaacttcaggtccctgacagccaatgaggtttcaagagccttgcctgagagtgcaggctgggcttccatagagcctccactgcattgttataactggtatcataattagctgaggtgaggtcttgtttcctgttttttgaagccacgtttgctgtaacctcggataaataccctcctaagcagtcattagaccaggaagcattttttagggcctatatcctgttctggcagggagatgggatcagatgagctaatgggtctttccatgactaaatgctgtgacagctgccatgttagcagtggcaggagccacaaaacagtgagctgtccagtgtgagaaaggttgagttttaatttccatcagcataggaaaataaggaatcaaggccaccatgtttattgttagtgtggaaattaaaattagaatggaaggtgttggaacccacctgttctaggatgtgtcgttgactcacaaccagaagggataagtaacaacaaacaatagcagtaataacaacaacaataataatataaaaataaaccccttgggattatattttagatctgcaaggaaaacatgtggtccatacctcccccgttttggtgacggggcttcagagaagtagaagatctgaatggtgctgaggccattcattcatggagtatttgtaaaaaaaaagaaaaaagaaaaaaggatccagtcatagtgacgggagttgatatgaggtctagtcccctaactctgtgtggggaagatggggttcaagtctttcccttctagcgaacatcctccccgaaccgtagctttcagccaa

SEQ ID NO: 52410 - DNA, 1063 bp, Bovine  19866880390039
attagttgtggccttcacatgacaattcgttcttgtcctctcgctggtagtgtggcttctgaggtaaattacatgaagaaaaccagttctcatttggtaatctccggtgggttacagagctggggaactgatcctgtcactgaccaccatatacatagccccgctggtgagctcaagaccagtaaaattattaaaagtatattaatactgggacaaataaagcaggaaaaacagaccctaatcagctatggacatttcacttaaacaaaatagaaagaagaaaaaaaaaaaaacccaaacaagggaccatctggagagagtcaagagtcatgaaaatcagcaaatacggaaacagttggagaagctgagtatgttttgctggagaagagatgttttaagaaagccaagacagctaacttcaaatatccgggaaagaacttacaaatggacaagtaaccatagtcgttaaagtgccagagggcagaatgaagtcagaacatagatttacagtgtaagagggctttgaattcaattccgtgaagacaagatattctcacaagagcccaactaccaatagtggagatacgggaaaattcctgtcccagcagcaaatgcctgatggttatttgtcaggcttcctgcactaggagggagattggattcaacctctaaggacttttccaaaagtaagatgctatctgtctaattaattgccagtcatagtcttaggtactgccctgggttctcatctccctgtcagcgaaatttggattcagttgtccctaactcttagataatcgaggagattcgtatctttaaatcagtcgtcagcaagaatactgatggaagagcgataaattcccaggccttcagtctgattaactagagcctcagaggcttggttgaggaaaatcgaggggaagcatgaggccagttggagctgagtgttgttgatacccaccaggcaggtacccatctctatctgcctcctctaaggaaaaagtaattcccgtttttggtggtttgagtttggttggggatgtttcagcgttcagtggggagt

SEQ ID NO: 52411 - DNA, 850 bp, Bovine  19866880439220
tttgtcccctgacagacagagaggaagggggagagggagagggagagacagagaagtaggggagaatgggcaagttcctgcccaggctgttagagaaacatatacactggacttattttgaatttgaatgaataatctttgtgtcctcagcaggaatgttgttctgggaagtttgcattcctgtttacatgcctgccctggctctcacagcctgggagcaggcaaatgttaagtggctggcttaacgtttacactggaaagcactttatcaagaaagtgtatacactcggccacccaaaaatgcaacttatatatttccctggatttttcatctctggtaccctttagaaaaagtggaaacagtggcagattttattttcttgggccccaaaatcactgcagatgatgactgcagccatgaaattaaaagatgttcgctccttggaagaaaagctatgacaaacctagactgcatattaaaaagcagagacatcactctcccaaaaaggtctgtagagtcaaagctatggtttttccagtagtcatatatgggatgtgaaagttgaactataaaaaaggctgagtgccaaagaatagattcttttaaactgtggtgctggagaagactcttgagagtcccttggacagcaaggagattaaaccagtcaattctaaaggaaatcagtcctgaatattcattggaaggactgatgctaaagctgaagctccaatacttgggccatttaatgtgaagagcttaacactgggaaagattgaagttcaggaggagaagggagtgacagaggatgaaatggttggatgccatcaccaactcagtgggcatgagttt

SEQ ID NO: 52412 - DNA, 2085 bp, Bovine  19866880479582
ctggaaggcgactgaactgaactgaacgcacaagaagcatggtcattgtctagagggaggaggggtccctagagaatcccaggtgaaattcccttcagtctgtcccagaaccacaggggacaaatggggtgaaaaggtcagttctcatacctccttcatgcactcgggccacacctcctgagagtcactgtcccaaatgttggattctagtctggtgaacctatagctgaacattaacacaaggatccaaagatttcagaatccagaggatccagagatttctggtctcatagccttttattctaattactattcaaaagaaactcattacaatgaaaatatcattatacaagtctaggtatataatcccatgagtgtgtgcctgctcagtcacgtccaactctttgggaccctatggtctgtagcccaccaggctcctctgtccccaggattctccaggcaagaatactagagtgagtcgtcatttccttctccagggaatcttcctgaccctgggatcaaaccggagtctcccgcattgcagatgaattctttaccactgagccgcctgggaaaccaatataatcttttgctgaaaccaaaatcaatagatggtgttctcaaaagatagtatgtgagggacttccctggtgggccagtggttaagactctgcactttcactgcggggggaagcacagattcaatcccaggtcagggaagtaagatcccgcatgtcccaaaatgttttgagcagtcaaaaacaaagacagtatgtgaacagaaattgcttcatatagtaagtcatgtaacatatgatgtatgcactaggatactatagatatgtgtttgtttttttctttgaatttaaaaaaattttttactggactatagttgatttacaatgttgtgccagtttcggttttacagcaaaatgaatcagctgtaagtacacatacatccacgcttttctttagattcttttcccatgtagcccattacagagaatattagacatttaaaggactcctttactgaattattatacattatatttatatgattatatatgtattttgtttttataatatattttattatacatgtatgtgtgttagttgctcagttgtgtctgactctgagatcccatggactgtagcccaccagactcctctgtccataattatatatatcattatatatgttatataaatcatatgtattaatatataatatactagtcggacactgagtgacttcattttcacttttcactttcatgcattggagaaggaaatggcaacacactccagtgtttttgcctggagaatctcagggatggaggagcctggtgggctgccgtctatggggtcgcacagatttggacatgactgaagcgacttagcagcagcgtatgttatattatataatagtttataaagaaaagaatcatttttgcaaatgaaaatatcatcctctcacttatgtgatttgtacaagtccgtgtgttgtggggatgtgtagtttgttttgtctgaaaactagacacatctgtgataaaatgatttttaagtcacctctctcaagtacccaactcaaatggcactggcatttaataaaagaattttaatgtttaccaagagttctatttattatgtatccagagaccctgttattagtctgatccttctagttctctatggtttgggttggtatcacatcaattcagtctttccagcccagaaaggaatggattctatgtggactaggggccttgaatatgctttactgagtgtctgcatcaagaaagtacactttgtttttgcgaaaacacatagaaccccaaacctcaatgcctcataaaatagtggagtaattcaactgatgccttgagcttggccctacgggactagtagtcatgaagcggtaccacaggtgaagggtttcctgtgggtccagcctcacaccaagaaacacgcaaagagaaggcacagaactgagtttggagggggcatctggatgccttccagccccatattctagcttatgtttcctgtcacagcccggggaggggcctttcaggcagg

SEQ ID NO: 52413 - DNA, 2045 bp, Bovine  19866880572869
gggttcccaggtagctcatgggtaaagaatcagcctgcaatgcaggagatatgggtttgatccctgagtcaggaagatccccttagagaaggaaatagcaacccactccagtattcttgcctgaagaatccccatggacagaggagtctggtgggctacagtccatggggtcgcagagagtctgacatgactgagtgactgagtacaagattattgtggtatgggttaaagctggagaggttgactaagattcactccaaaataattatttgtttatatcacttatctgctcctctaagagaaaaatcttgctttattcctatttctgtttccatgaggagtgcagcaagaacactggagagatggatgaagctgcgtggactgaagagctccacagggctggaatcaaacttcactgaacagtccatgtggaagaaacatagattttcacacagcttttggttgactttgagagaggatgttgatttcattctttcaactccctatttcatccattttattaccatatatttcctaaagagaaggcctggccagtatcaaaacaaagcactctactctgttttaaattacccttttcaaggccacgctaggcaatgcagatgctgcctggtctaacttgaactgcaaacagcaatgttttgtccgctttccttgaaagcgctggatggagtgtgtgaagcttagagtgataaggattgaattttcaggtttatcttttaataggcacgataagattctaatgcctcagcgctccatgctatctggatgttggtggtgggaaccgtcaccagagggatgtactgggcggtgggggtgggggtggggggctggggttaaccctcaagaagaacacaaacatgagtgggtggagtgcgccctttccatgagaatcgccgtccctctctttcacagcctggcccaaatgatcaggctttatgccagtaagcaaagcaacggattattttttccattggtcagaggaagttttctttctttctttctttcttttttcctttttgtgaatggagataaaaaacgctcatttgaaaagggaactataggaatttcattttagtaaaatgaaaggctgcttaggttcccaagaagccctggaggaaggtgcaaagctcaaggcaacaagggtccttggaatcctgcagatgtgcatgtaaatcctatttctgttgcagaccagctgtgcagccttaatgtggctttaccttcatgaacttcagttttctggactatcacaaggggaaaattctaggtaaataaagtgaaacgagtgcaagtaaaatatttagaagacactcaatatttattagtttccttcttttgcctttgaactaagacaaaagattacacaggcttcccacccatcttctgtgtatttgggaacaaagtcatgaatacaaatataggaagcccgagggacggctctgcatatacaacatcttatcctgccagctgatctcattcacttcaactcaccaaatatttatgaagtgtatgcttgtgcttcaagctgcttgggactgtcgagtttacagttgaatgagagatggttactgacttgtgtcttccagaaacttctctcttacacaacaacaaagctttgtacgttgggcaggttaatagtacacggtgatgtgtctacgtgcgtgtatttaggcacgcacacacacacacgttgcacataaacagttttggaagggagataatccacaagggctggaggaatgaaagggacttcttaattttcttggctgggatgggaggggctctacaaggagcaaaaataccaccctataactattcttctttctaaactaaagtcaggggcctctgaatttcacaactacccagataattcccctcttaatgctattcaatatttatttaaatgccaagaacattggagcctccatgcctccaggcttcagctatttcttctggctggaattctctcttccaactttagaaatctgactcacgcgtccactcccagctcaaagctcctctct

SEQ ID NO: 52414 - DNA, 959 bp, Bovine  19866880606278
gaaatggcaacccaccccattattcctgctgggagaactccatggacaaaggagcctggcgggctacagtccatgaggtcacaatgagtcagacgtgactgagcacaccatacacacacacacacaaacacacacgcatgtacacatgcacacaccttgatctcttactttctaacgcgaggtgcctacatctttatggagcctgtcacggcagagacctgtgaattctcttcctccatttatggtaacttaaagctacatcctacctagcacttccaaacactttatctaagtttttcctcactacaccactgcgaaatagattaaacaaatatcgctggcattttatgcatgaggaagcacagacttcgaaacgttcaggagcttgatctaaacttgcaaaaaccggaacctcctactcgggtttccaaagtccaaattgattctgttctaggataggatgaaatcatttcaaaagatacatgacacatcgcagagctgttaaataattgttctgaagttatacagccatctcagattaaatagcttttccctggaacatgagtgactgataatcaaggtcttttattgccattttaaagaggacgtcagcattgataacctgtaacttgaacactaaagaaggcaaagtatggctggcctgccaatgacttgctcagtgagtagttcctgtcagtatatacttgagaaccttgctggatacttgatgtatgtttaaaatttaccgtatttgaactctgagttaaaaaataacactaatccagtttttcaggtgaggaatggaagctttgagagaacaataaactgctcacatcaaattgctaatgagccagcatagagcatgtggaaagtgacttggggatctcgtagctattaatatttatggccatatatatgtatatcacatgactccagtcatggcctgggtgccaggaaaa

SEQ ID NO: 52415 - DNA, 763 bp, Bovine  19866880617890
tcccactgcaggcaggcaagggtttgatccttggttggggaactaagataccgcgtgtggtacagtgtggccaaaaaaagaaaactaagatggggatatcaacaaaatatcaatcttaaaattttggcttatgggtattaaatgaaagcatgcagaaaagagtgaagtgaaatgaaatgaaagcatcgctaatctgaccacttcaagagaatgaccattaccattctgctatctcagcatcctggcttctttctaggcctccttaaaatatgtaacttcgctgaaaaattctttacatctaatgatgcaggatcacctctttctgtgaatggaactctgcctgggaccccagctccacacatggaacatctggggttcaggctcccctcttcccatcacctatgagatcctcgggagtctacctgaagccagtttcctggctgggcactgaggtctctggaagaatttccgctgaccctgagacctgggacagctaaagggcatatgcccctgctactgagctatatgtttccccgacaggtactcctcttcatcctctctagcccagtggatactcgccagcagacagcaagattcacggccgtctggcttctccctctcctcccccagaggagatgaagccagatgagagcgcctgagacagaaccgaggagaggcagcctggaggatggatggcaagcctagcagagacggacagtatctggttcccactcggccttcagcttaatcgtaatcacatgaa

SEQ ID NO: 52416 - DNA, 742 bp, Bovine  19866880722586
cgcccaaagatagataccactgtcaaaacgaattttctgcaaggtgagttaatttccatgtgtgagatgttcttcatagtttgaaatatatatttgagatgctctctaatcgctttacctttactccatggtttcggtgtagaaaaaacacagaatactccttcaatacagcctacagatcttggtggtcatttgctttcatggagaaagaaacggtggggttgatcttagctggactgcggttcctgaagaactaatagataaacgtctgaggagctcagtgtccaccctgtggactttgaaatcccaattctgttggcgaagaagaaagccctaatacctgttcagaaaaagatgtcaggagaagcttttcatcagaatcctaaatgtctggatgagccttttaaaatgaaaagagccaacttcattttccttttttgtgtgtgtctcattatcacttagctgcttcagtgtgggtgtaacggcggtaaacatccttccccttcattccacctctggtcacacagtcatactggttgtgtagggtagcacggagagagacaagctttcctaaaatgttactgatgcaggatgagaacaaagacacagcttgcctgttgagtctccatgccttgggggaagagccaccatcatctctgccttctgctccagcagaggaccatcttcaaagtagatgacttcttccacattgtcaccccttcactcacacctcaaggtcagt

SEQ ID NO: 52417 - DNA, 1542 bp, Bovine  19866880747294
tgacctgccactgctgctgctaagtcacttcagtcgtgtctgactctgtgcgacccccatagacggcagcccaccaggctcccccgtccgtgggattctccaggcaagaatactggagcgggttgccatttccttctccaatgcatgaaagtgaaaagtgaaagtgaaatcgctcagtctggaccaaaagctgcagtctgcacagtcagaccaaaaccaaattgtccttactccttcctatcctcccttcgtgctagaaggtcacccagaacccaggcacattcccgcctgagagcccactccacactctcccttcagagaagggaacaaactgaaacagggagaagggaacaagagaggaagcgaagtaaagtaagagagtctggggtagggagaaagcacgtacttcttttctctttctctctcttaaataaagctcctgggctttctcaagtcaacctccgtctgaatctggttttcatttgcacgcccccacaaccgtgaaccgagcttcttctcatagataatttgacttgattactttctgaaagggcaacagagccggagtagcccagcgctcatttacttgtcactcccagcactgccttaattggggttgaactgcacctccccctccaggaatgaccctgagacaggatcaaaattccccagggatgagctgctagggagctggacagtcctctccgcccagttaggcaggcagggccttggacaaaatgttaacaccatttgacaaaagaagtttcacaaaaggctgaatataagataaaacttggcttcccaggtggcacagtggtaaagaatctgcttgccaatgcaggagacgcaggagacaagggtttgatacctgagttgcaaagatccaacctactctgattatcttgcctgggaaatcccatggacagagaagcctggcaggctatagtccatgggatcacaaagagtcagacgtaactgagcgactgagcacgcaagataaaactctgggatggttaaatatcaaattattggttttgtgagcatggggacgtgtgtcatactcttatttcacacatttcaacccgtaatatactgccccttccttctttgagactgagaatggattctaccatctcttcgcttcatacctaggaggttactccattcaagattcacaataaatgcttaatagttactgcctgattagggcttcaacatcttttagctttaaaaagattttgatggatcaagttgctaaatttgggcattagtgtgacaaggagtagaaaagagtagccaagagcttgggattagggatcagacatgttttgatttgagaatcagtttaaaccctgtgtctttaggtgagtgatttggtccctaggctttgatttcttcatctataaagttcaaacaatgatattgatctcctagagtttgtggaaatagtgttttacgcaaagcttcacacgtggtaagacaccagctgccattccataattataaatattaatagttatatatgaaataagaagactaatg

SEQ ID NO: 52418 - DNA, 1903 bp, Bovine  19866880864746
cattcgaagagttgactcattggaaaagactctgatgctgggagggattgggggcaggaggagaaggggacgacagaggatgagatggctggatggcatcactgactcgatggctgtgagtctgggtgaacttcgggagttggtgatggaaagggaggcctggcgtgctgcgattcatggggtcataaagagtatgacacgactgagtgactgaactgaacctgattatgtataaaataaataaactacaagaatatattgtacaatacagataatatagtcaatattttaataactataaatggagtataacctttaaaagttgtgaatcactgttaaacacctgtaatttatataatgttgtacataaactgtatctcaatttttaaaaagtgttctgctttgaacagtgaattacaaaatagttgtcctagccatatggagtatatttactcatttacagtcagcatttagagagccactttcacacatggccctggggttattaggtacggttagcttcattttaccactcattctattctaaaagaactcaaaacctgcctgcatcctcagattagctccacagtagacaccgggtagcttctggaaattatttagcctccctcctttactcacattatctgtgaaatgggaataatttcttcaatcctgccacatcaggtaacaaataatagtctagcaaataatgaggcttaggaactgggtagaaattgaacaaaatgcttaagtactaattagcaatatagcttagcagattgtagttgacagaagtccaaatccataccaagtgaatgtcagcttgttgctccacttgtttcagttatatatatatgtatatatacatatgatatattatattataatacataaatgcatatatatatatttaatgaagagggcatggcaattcactccatattcttgcctggagaatcccatggacagagggtcctggcacctacagtccatagagtcacaaagagttggacaggactgaaacagcttaagcacatgcatatacttaatcataaatatatgtatcttctaagcaccttctctttagaaatgaccaatgctgaacccaactgggccagatgctgtattttttccatgctttgccgggcgtctgttgatcctaacagtaaaaagtgttagaatggccaaagtgatttcatatcattgtgaatatgattttgtctatgtgaaataccatagaaaacccctaaattttaatatcagacatgtttatgcatgaggtttgagtgaagaacagttattgtgttcttgggttgtgtcaggcaggcttcatgcttctgacgtgttttccaaataagatgtagaatcaacccacatttgtcaaatgcctgctctgtttcagagtttggactagacagatggttatgtctttaaatcctcattacaattctgtgtggtgaatattctgattctatttttgtagatgagcccgataaacttagcaagaaggtaaattcttcacctaaagttacagaaataataaagggtatataaaatttaaactcagatcttttttctaactttaagactcctctacaacatgtggctgacaacagtgttgccaagaggagcaactgaggatggagatgtatattttccatgttgaaatagttaaacctcttgctacaagaatggcatataaataataaaaagctttttctcaacattctcctctagcccagatcctttagaagtcctgattctatttttaattcttatgtttttctggttactgaattcctgtgcaattaaaaaaagaaaagcaaaggggtgggggatggggggaagaaaaaaatgctttggaatttctttcatgctctgttcccagccagcgtgtgtattt

SEQ ID NO: 52419 - DNA, 2556 bp, Bovine  19866881001882
tgtaagagaaaaattcctcaagattgtgtttgtccagaaatagacagtttacggtccctgagtcaaaacactcaaagattggaagccagggtttcctgggctgaacccagttactaaataaaatgaaaaggaaggagcaatcagatgccgtggattgttgggaagtgggtggggtcggttcgaaggcttgaattcagcagatgtgacagaagaaattcagggaggaggcccttgggtttgccaagcccccttccctacccaaacgggcgctgctgtgccccacagctagactttctgggtgctggaggtgcccggggccccgtggaggctctgagcctggccaggtcttacgaggcagccaggctcattgcagaaataaaaagacactggctctcttcttgttcatttgaggagcagtcttcactggtgtcctgcaaagaatgacccccatggggagtctgcctgtcctcttctaaccttccagaaatgttgggagagtggggatcagggactctatcatctatgaggaaagggattcatggcaaaagtcaccaggtgggaagagtgggaaagaaagagggacagagagagagcaggaccatggggaggctgcccggtaacatcgggggctactgtcctctttcctcctcccccaggccagcatcccacgcgctcagacgccgcactgcacacagggcagcagggcgcctttcaggaccaccctggccgaacactaagggaagaaaggggccgggcgagcacaggacatgtctgtgcccctggtcaccgactgtgagctgctagtaggaagttagagtccagctgcctcctgcctgggggggaaagacagcagccacatggagcctggctctgtgtgtttggggttgcccagtgacctggccgttgctcagatgatccccagaggatcacacctcagtggtctccagagggtgctctttctgggttgaggttactgatggagcagtgaggtatagacctttgaagtttctccaggattgaagtccaaaagatggactcggagagctcctccaagggttttcttgagctgacttgaggacaaggtttagcccggtgcttcaagtaatggcaaattcagagggggtgtgaaatttcttcccaaaggtgaggagcagaaacatttcataaacaaatgaaagaggaaaaaaaaaaaaacccaccgaagcttgtaaaagattaactgtgtctctgatttctatttttgctctaaagtcctttcaaaggaaagctccatttttacaactgacccttccaggaacagaattaagtggtttctagaattgaatctgattgtctgtgtccctgaggagtgtttcatggtcacccacaccgcatggcggaaaatagaatgtactgtcagacctcaccgatgccttcaaagggcttagggggcgcaccgctaatatccaggtctgtctctacctttctctgctgacttgggtaggtgcggagggcgaggttgttttgaaacagtgtagatggcctggattgaagcacagctcaaatcaccgaggtgggctggggacccatcctcaggaccaggctctactgaaggctcttctgtgccttggtccctgctcttcctccttccacttcccactcctaatttttgtcagcaaaggagctgtaacctagaatcacacaaagatgttagggatgaagtcactcatcccttatggaggcatttgcattttacagagtgaaagccatgccagggctgcgtgagatggatgtgaacatgaagccaggaaggctgaggccaggttcaaggcccgggggtgacctgcagaggcctctgtgtgcacccaagacccaccagatgggccccgatggctctgcccaaagggaggacctttggataaaggtgaactttggagggtgagaggaggcatgagttggggggtggggcaccgggagacagagggaagagatcttaagagcatgatcctggaaagccctgcaagaagagaggagagagagccaccgaagctgagtgatccatcttcagctaagttctggccattaaagactcctggacttacatcagaggacctagaacctcctaaaaccctcgtagctgagtggcattctggccaccttatccctctgtaccattttacagggtatagagattatttacaaggtacagagatggtcacagagattgttggcagagacaaaatggcctaatgtagaggtccccaacctttttggcaccagagactggtttcgtggaaaacagtttttccatggatggtggctggggagtggtggggagcggtgatggtttggggatgattcaagagcaccagattcactgtgcactttatttctaacctcatgctgctgctgatctgacagaaggtatcgttctggggcctggaggttagggacccctggtctaatgcatttgaaggtgcctccattcagagctgggcagtaaatgcttgtcaatcacgtccaggagcagtgggattggaattgttttctctggacccgggagctcttccacactta

SEQ ID NO: 52420 - DNA, 1092 bp, Bovine  19866881034154
tggttaattgtcgtttttcgcgttgtgctatgtaaacgataaattattcttctgacatgcttattttggggttgattgaaaaaaaaaaagttcatgttggaacagtggtgtgatgtgtactctagagagagttgagtgccagaatttgatatcatgttatgtgacaacagcaggagcaatgggagaaagattaaaggtcaaagaaccaagttaagaaattatgagttaattagataatacagagccaacattcaaatgtccatctatccatctgttcatccatccatccatccggtcattcattcatccacttgctattccttctgttcatccactcattcatccatccatctatccactcattcatcacccccaacagatactcacatagtcttcagttttctgggacaatgatatgagttacagggacaatggtgaatgaggttgatccatttcttgcccctatgattttacaataaacaaaggagatggacattatgcaaataattacagtataatttatgctacaaaagagaaagtcgtgtactattaaaacataacgagatgacatagtccagtgagagcagagacaggggtgttcagagaaagtctctttgcagaggtagaattcaggtcgaaaccagatgtagatgaatgtctgggacatctgcgtcttcctagcttgtctctttggtctctgagttcagggaccatcttggctatattgaggaagaaagggaagtatccaggataaacatgtcagcagcaatcctggcatttgattgaaatgatattccaaaaagctcaaaaacaaacaagtttactgctaatcattcatgagcacctggccaaaataaagagtgcattacccactgatgatgttgcttcccataaatctctcaatgcctttatggctgtggctgactgtggttattggacttttggtcctaagtatgttttgaaacagcaaaattcatgatgatcttttgtggtatctggatcgctctttcctcttccctggcttactggggggctgagctatcaactgaatccccaggcactcgatgtgaaaatgagagaattaatccatca

SEQ ID NO: 52421 - DNA, 1265 bp, Bovine  19866881035145
aatttgatctcaaaagtgatggatgggtaaggcttttctaagtagagcagctcaaacactctgacccaaatgtccttcccatcttggctactaaacttcaaactaagcgtagagaccagagattctatttatagcatttctcagcatcttcttcttgaaactcaggataaaacaagtgcctgacaatgacgccaaggcagactctgtctccaacaagccaaaatttctgattgaaaattaaaagagaaaaataacaactgtttctgttgggcacgtgatagaaagcaacacgagttgtatttttgttgagttgactagctgttgggacagggtaaaattccgcccaaacaactcacttggaattctaagcccttggcagtcactaaatctaattttagagaattcagccaggttttccttcaaggtttccagcgagcagccaaaagcataaaacaaaaaatctcatcatctcagggtgttttgaaggtttttttcccctccaacagattggcctcaatagctttattttatttgtaactcaagtctaatttcagtgaatgccagaaatacaacccaaatcctaattaactaatgaattagtacaaaaaagcctgccccatctataagtaattcaccacgtgctgctctctactgtgggtacacattccacagaagtaatcttgaaaaggacataaagtccttgctatttctctctcggttgtatttctctgagaagacactgttgtcaccagttatatatggtcactagcaagctcccaacaatgtagctggaaggcaaagaaagaaatcaactgacctttctgcaaaaggaaggaaggtgctgatagatagcagggaagccaaaccagttcggaagggaccatgactagagggccttctccttagttgcgaatgcatctggcctgtgtccatggctagatcatatatctgacaatatcctcccttttaatgctttgcagatccaaggtatattatcataccccaagcctgaactctccagggaaattatgtcaagtcatagccaaggaagttggattataagaaaatcactagaggaaccagctgtctcgtattcactgttttggaggaaggagaaaccatttaccaaaaggtggcactgtgagactgcaggatggtgactcaactcggctttactctcaagactccggaagatccgtgctcagcatttactccaggatggggagtggggagaaggagagtagaactcagctttatttttagaa

SEQ ID NO: 52422 - DNA, 1207 bp, Bovine  19866881095399
ttctaattgataccaattttgccataaatctcttctatctctgacataaccagataccatttgttctttccctcaattagtacttgttgtagtgcaaaataaagagaatttaactcaacagcaaggggcccccaattccaacaatgacaaaatcaaggttggaaccaggggtgttcaatctgtttttctatagtttcattacatgatgtgaaggacaaataaaaatcaagggaatggtatttctgatctttacactttgtaaaaataatctatcactgtcacccatttcttgtttgttttccccaagatttcactattttacatgacaaattctatagtttttgtccaatgactttattttaaaattcttattttttttttctctaggataacaattaagtggcaaattactttttctgtttctaagaagggttgactttttttcacattatttttttctttcttcaatattcttccttttcacccagcgggtctggtgctcttaatttctgaatgacatttaagacatgccctagaggggctccagtgcaaaggggaaagctgaaatgaaaacagagcagaatttgttactagcctccaggaagtcaggcaaacactttttcttaaagtttagataccccctgcagtacatcatccgacttcttctgaggaagctagctgtgcagaatgtctgaggttctgggagaaagagagatttggtatattatgataacccaatgcacattgcagctagtcatttgctgtgcttagagcttaatttatatctcagtcatttgatgagcataatacagagagagtctccgggttttatctactctggacagcatagcgtattgctccagtaagcataatgggtggaaattagggacagaacgctggctggagagttctttccatgtgaggaaagtggatatagacaaatcagtctctctgtgtaatgcctttacggtaaaccaagaaataatgccatggggaggagatggtggctgcagcttggtaccctccacaaatagctcagagaagtaggagcagtatggtctaagacctgaggttattgttatcaatcgtagacctcaagggtctgtgcttttcacaggaaggtggctgtatggatttgtcacatcctttaagtccttcccttgacttagtcacttctttggctcaccttttccatctgcactaaaat

SEQ ID NO: 52423 - DNA, 806 bp, Bovine  19866881109377
aatggaaggggttcgcctttcgggtaaacttattttggtaagtcattgactgcctcaaatttgaacactctggctccttctacctggcacggactctacacggggtagtttctcctcccttttcaacaggcagctgagctcgccagccgaggccagtgtccagccagcacacagaaggcctgaacaatgattttattttctgtgaccaacagcaccgatacctaggaaaaatagcctatttttacagaatgacaaagcgtgctgcacacatgttcaggcactccttttgttaaatatagtcgtttctattttggacctggaagagatggctgtaattctggaaaggtgggaccctgcggatgccaggaagtgcatgcccgatggacaggacagacctccgggccactcttgtccttaaaggcaagggtgggcacgtctgggtgttcccaggattcctttggggttcagaagatcttgcctctcctctctcggcaggccttgtccgtggaaccaggcactgagggtagaaagtgtgatgtgacctgttgagggcggggcttcccgaatctgtgcgtcagggttccggtgacatttgggaaactgtcatggagggtggccagggaagaaggtgcagctttcccaggtaagcatttccatagagaacagggtaccaggtgaagatgtagatgcccctccccaggacgacgagctcagaaggctgaaggacgttgggtggcacccagtgaaaagggttcccgaagtacctgcgggggacgatgaccctcctctcgttggtggtcatgttg

SEQ ID NO: 52424 - DNA, 625 bp, Bovine  19866881112937
cacaaacaaggcaggcttccaggtctacatccagccctgaaaccctttctgaaagggattccagattattcttcacttcgttctcaattcatctgtttccccaggaccaacaagattttattatttgcatgacccttgggatgaatgcccattgctggctcttaaaagtaccagaaaagtagaaaataggacaacatgctcaagccacgagtatgcacctccttatccctgccctgcatgcacacacacaaccctgatgagtttggtaccaaacccagagatgggatacttccaccagctgaccatacccagagcgcttggggaaagggatgatcacatgctccttggttaagccatttatataaaaatgaaaccaatacatgagcattgatttcatgtaaccctgcaaagcagaaaatgaatcaggattgctcactcaggtataattttcctgttagtttttccttaataacaatgtgatggtttcatttgtttgttttgcatttgttctttagtttttggtcagaaaggaggattgtagctaaaaaaaattgggcttcccaggtggctcagtggtaaagaatccacctgccgatgcaggagacacagcagacatgggtttgat

SEQ ID NO: 52425 - DNA, 1325 bp, Bovine  19866881131759
cgggggaagcgtgtgcagccccaccctctgcacggcctctcccagccagtgaaaacgttgctgtcttggttaaaggccaacttaatcctcccaacttcggctgcacttgggttgtttcacagtggacaagtatgctggggaaggctgccaggccgtggtggaggtggtgtgtgtgtgtgcggctgcgggcctgtgcatgcgtgcatgtgtgtgtgcgctcctgcacggctagcgtatgtgcccgtgtgcgtgtgcctgcaccggtggcgtcggcgcctgtgtgcgcatgcgcccacttgtggtttgcttggactagggtgggggggacccggccagctccaccagagctcagctcagacgcgggaccggggtctttccgggactgcttcatctcaggccaagtcctgctccagcagaagccaaagggccaaaccctggtgcaaagccccgaagtgctactgccgcccctcagactgccatggggacattaaaccttcaacaatctggggctccgacggctggttcttggttctctgcctggaaaaacagtaggcgaatagtaaaaccttaaattctaacatgtgtaagttatacatcttattttcattttcagcccttgttcccctctgtaagacatcaggaaaaaattaccgtctgacttctaatatctcagtggagcatttatctcccagctatgataagtgatcttcaatatttttttcctttcagattaagaaacaaattcatttaattttctttattgaatgtgctctggcctcccccttcccctgccgtgtccccaccctccttcccctctcctctcgggctcagggaccattgcttgcatgccctccgtgttgctgccttttcaggatgggcgggtccatctggcacaaccctgctcctcgcctgctcctttaggcttcagcatggtctgttcctgcccacagcagagagagggagggcagcggccagacctctggaaaaccgttgtaggttctgcagcccagagttggccggctgtaatctgaaccttatctgaactcctgggtctgagggcctggtttggagctcttgtgaagactgactgtctcccaggttgccagaactgatgcttcctgctctgggcaaccgggagggtgggtgggaaagccgcagcctctccttggtctctagtcatctccttcggccctggcactgggggagtggctgagcggaagtggcagggcaggatagcactgccctaggcacaccaggagagtctgtgaccccaggctctgggtaggtgggggggggttttgccagcctgctgaggcaccaggtgg

SEQ ID NO: 52426 - DNA, 1067 bp, Bovine  19866881228429
tgcctggccgcattctccttggcctcaagattccttggaagacagaaatgttttaccaaacagaaggcaatagaaataccagcctgcgaattctcttcattttcctgtcaagtttttttttttttttttaagctgctctattacttatttatttattcttggccatgctgggtctttgttgctgcgtgggctttttctctagttgtggcgtgtggacttctcactatggtggctttttttgttgtggagcatgggctctaggtgcatgggcttcagtagttgtggcccatgggcttcgttgctctgaggcatgtgggatctcgtcctggatcagggatcaaacccacgtgtcttgcactgattgctggattctttaccactgagccaccagggaagccccttgctgtcaagtctttttaccttaccattttccagtttattaacagatcaaaacctactgtggagataagggtacaaatcaagaacttttgcagctgacattgtagggagaaagttaatgacggaaagatatttgtgtcccaacaacatcgagatgaaataaaagactcctttctaagggaaactgaagaataagaaggaagtgttacagggagaggctggaaggagtttaaaccatagagtggatcctctactgaatcaggattagcaatggtgacttcacaatattttcctaagcttttctttactggagcaatggcagaaaaaaattaggggtaatgctctaactggcagaatctgtcatctcacagaaaaaaatgtacttatgtgagatgatggaaattaactgaacttactgtgatcattttacaatatatacatgtaacaagtcattgtgttgtacatcttgtactaatagaatctcagagttgcttagtcatgttgactttttgtgaccccatggattgtagcctgctaggctcctctgtccgtgggatttcccaggcaaatttactggagcgggttgtcattcccttttctaggggatcttcccgaccagagaaccagagatcgaaccagattctcccgcattgcaggcagattcttta

SEQ ID NO: 52427 - DNA, 790 bp, Bovine  19866881248391
gtgactttactttccttttaatatttattgtatggacaaacctcatttatttattgattcaccagtagatggacatttgagtttaactttctggctgagacgaataatgccctaccaacattcatggagtggtttttgtatggatgtgtgtattttccagtgaatcccctgggcaacaaataggtgttataatcactgatttattaggaaaagttgcagctcagagtggttaagtaccatttctgagatggaaaagcttcttgtgattgggtttgattatgctagaagggcaaataagaggaagtaaggtggaatttcacttcaccttttgcaggacattatacacaccagtgagtgaaaaaacaagagaagcctggggggacatgcgtcagcagggctgcgtgggctcctgaccttctggggggcaggtctggccgggctctgagtctgggagatgctctcctcattctctcattcaccttcttgtttcggaggcagactctagtcaagagcagctcaagacagctgccagagtcgcctggcagtctgtgaggaggcagatgggaggtctctgcagcctcatccccactctgggagggtctcctgggatgggccctgcccatgacaagaagagccccaaagagaggaattcagcaggggcccaagggcggttctagggcagagagcaccccgctgctggctctgcttccctctgcctccagggctttcccagaaagttcttggacgtgggaggctggcatgcaggcgtgccgccccattaatgcaactc

SEQ ID NO: 52428 - DNA, 1648 bp, Bovine  19866881281750
caagaacactggagtgggttgccatttccttctccagtgcaggaaagtgaaaagtgaaagtgaagtcactcagtcgtgtctgactcctggcgaccccatggactgcagcccaccagactcctccatccatgggcttttccaggcaagagtactggagtggggtgccattgccttctctgaatggggtgggaaggtggggattggggtatggtcagggaagtcagcctctgacctgacatccttagggacatccatggcatgtcaagagggcagctggatgtttatatctggagcttaagtcagtagagtccaaagttaaacactgtattaagaagcagaggcatcattttgccgacaaaggtccattctagtcaaagctgtggtttttccacaggtatggatgtgagagttctaccataaagaaggctgagtgctaaggaattgatgcttttgaactgtggtattggagaagactcttgagagtcccttggactgcaaggagatccaaccagtccatcctaaaggaaatcaaccctgaatattcattgaaaggactgatgctgaagctaaggatccaatactttggctacctgatgcatagagctgactcattggaaaagaccctgatgctgggaaagattaaaggcaggaaaagggggcgacagagcacaagatggttggatggcatcaccaactcaatggacatgagtgtgatcaagctctaggaggtagtgaaggacagggaagcttggcatgctgcagtccatggggtcgaaaagagttggacacgacttacaaattgaacaacagcagtgtagatgaaattagagacattatgctgagtgaaataagccagtcacaaaaggcaagtgtataatttgcagtacatgaagtaccctagtgtagtcaaattcatagagacaaaaaggagaaaggtggtttccaggggctggggaaggatggggtggggagttattgtttaacaggtctggcatttcagcttgggaagatgaaaaatttctggtgatagataatggtgatggctgcatagcagtgtgagtgtgcttaatgcccttgaactgttcacttaaaaatggttaagatggtaaatgttatgtgactttttaccataattttaaaaaatgtgtttcagctgaaataagccaatcagaaagttttacctaaaggaactctttcgacacctctagctcttgtgatattaatggaaacgtttgaagacagcaatcagtgagggatcaaaagattccaggtcttctcttttccagacgaatctccccaatcaagtgcctatacattttcctacaaaacctggctttttatttgaccttctccatctgtcatccagtttgggtatgccagagaattcagaattactggtaatgttcaacaagcagtgagtaaatttttcagtgtttgttttatggaaatgttaatgtaccttaagacattataaggtatttttggaaatgaagagttttgtggtcaaatgaactaaacagctattgcttgttgttattgcttttgtaggattttccagagtatttgcatgctaagttgcttcagtcgtgtccaactctttgtgactgcatggacttatagctcgtcagtctcctctggccatgggatt

SEQ ID NO: 52429 - DNA, 3119 bp, Bovine  19866881392014
gacgtaggatgtccggacttggcaggtggcactggttgcctccaccgtgccatctaaaaacacgactagttcaaagtcctgctggggaagggtttctgctgccatgtggaagaaggggctggtgtgatcaatgacatggtaaatcgtcagtggggagatgaagaataaattttcattccctgcgtcaaccacaaagttgatattgatctggtccaaaatgatggtctctccttcaggagtgatggtggtcctcagaagctttccgtatatgtgactgccgataaggaggctcttccgaagattagccactcggatcaggagacaaagcttcccaccccgcttgctgatcactgcgttcttgctgaaagtaatggtcttggcgcgttttttgggtctggagatcttggctaaaatagcaccacacatgaaagaattgatgataacgccgagtatagactggaagatgagcagaaagatggcagtgccacactgctccgtcacacaccggaatccatagccaatggtcacttgcgtttccagagaaaacagaaaaagctgaggtcaggccattaatgtgttccacgcaaggggtgtggttggcagggggatggaactcagggaggtctttgtggacgtaggcgaccacgtaccagaggaggccaaagaagaaccagctgcccaagaaggctgtaatgaagatggtcattttgtatctccacttgaggtccagcacggtcgtccatatgtccacaaagaatatcagccttgactgtgcctccacgttgccaaactcaatgttgcaccttccgtctttggagaccagcctcgctctccgccgagaatgcccaaaaaagcgagtgacaaaccatttccgaagatgcttgaacattctttctgtcaacacactgatctgaaaacacatcagagaaagaccaaacagaagaaaattatgtgtattgcactaatgagctaagtgactcacatgaagagctgtctatgaaaaggccattcagctacaatctgtgtgactgatcacttgggcaagctgacaactttattctgcatcccacaatgctatttccagtaaaaactctctactctaagaccatatggcttgaagataaagaggaaaactaattacagggagatagacatgtagaggaatctaagagaatatatatccacgtgttttctgaccttagtcacgcccaaccttaaaaatgtttcttataacacagacatacagaacagacttgtggttgccaaggggatgggaggtgggggaaagatggagagggagtttgggattagtaggtgcaaactagtatatatatgatggataagcagcaaggtcctactgaatagcacagagaactattcagtatcttgggataaaccataatggcatagaaaaaaaaaaatccatctatttatctatctatatatgtatgtataactgaattacttttctgtgaaatataaattaacacaacattgcaagtcaactacttcaataaaataaaattttaaaaatgcttatgataacaaattatgacctgtactctgatttatttgatagtattctttaaactgactctccttttttctttaataaatttagccttatgctaagcaaaaatatctgtgacagcagaaacttgatgcactatttacatttttggttcatatatagaaataaataaccatggggaaaagtttcacaacatattacctaaatcaccttgtagctagagaaattataatccaattcagttctctcatttatctaatgaaggaattgagaaaatttcagtgacatatccaaagtcaggtaccctagcaaaaatgaacacaacattgtaagtcaactataattcaatcaaaattaaaaacaacaacaaagtcaggaacctgaccagtggtgggatgacaaccagaacatgagtttctctgctcccaggtcagaggaatctctacttcacttgtgtctcagttattactttgtttatattctaaagtgagatttctctggaacattttaacacaagctttgatcaacttccttattttgtgctcaacattacttgaaacagaggtcctcagcactgtttagtcaagtcttatcgtaagatctgagacgttttctctatggatggcaagcctgggatgccaaaattcccaaagggaagagtaaggtggtcactgtcagtgcctcccactttcttccctgctcccaagctgacagacggagcactatgatttaacaaatcctacataaggtagaaccatgttttattcactcatctatcctagctgttagcacagaccatggggggttactatttattcaatgagcatcaatggaatcattctgtgaatgaattaagagcttcaaaatactatgtgggcaaaggtctcattaaaaacataattgtagcttccattttacagcatggcactgaagggatttcccccaaagagccaacacagctcaatatcccggggtcataacactagacggccccctcccctaggtgtgcccaccccactcccaaggtgtgcctgttgtggttagcagtgtcttcgtggtatttttaatcaaatgcaaacacgtttctaaaatagatttcaaaatcccccttcaaaaatgtgtttattcatacaaactaggaagcgaaaccaacttagtgataaaagttaaacaaaagtgatattctaccgcgtcttgcccatggccttcaactatgtgaaaacacaagaagaccccaagtaaaagtggtaaagagaaaaaaacaaatatatataaataaaagaaaatattaccaggagagcagacagaagttcactctctctgagggccctgctctcatcccacccaatattcattgacctcaagcccccaaagagtcccaagtacatggtcccaagagtaactcagccagggaaatggtctgtttcttcctcaatccttccctttctctgcacacatctcatctcattttgcttctatccactggggactttctccctttcccaggtttgtggaagctcagactgtttccagaagctcttcatagggtgaagtgaagtgaagtgaagtcactcagtcgtgtccaact

SEQ ID NO: 52430 - DNA, 1036 bp, Bovine  19866881589563
atgggattctccagcaagaatactggagtgggtagccattctcttctctagggggtcttcctccacccagggatcaaaccctgggtttcctgcattgcaggcagattctttatcgtctaaggcaccagggaagccccaaattacttagagtaggcaaattgcccacagtagaaatctcagtctccagtgctgtgggctcaagtcgaaagggttttcatggacaatgaagattcttcaatcagattttcaagatcctctgtattaatttatgcattcacggaacaagcactaattgaagagctatttgagtccagctcctgcgctcagagctggtaataaagcaggaaggtgagtgcagagccaggccttgtatgctttgtattctagccttgcctctttgaacccagatgtctgtggagagagaagcagggaaagcgtgggcctggccaaggcaagccgagtgtgggcactgctttctgcagggccagggagaggccatgacgtgagcaaatcctactcaatctcatcaaggccaatattgctcttcatctttcatcctctcctacatcctgaatggaaagttgtgcccagacatgatttaaagctcctgggagaggcagagcttcaagtccagcaaagtggtttagtctctttgatataaaaacacaagtggagaaagaatcaaaagaagaaaactcaaaggaagttgtatttcagaggatgcattcgttaatctgacatccatttaaatgcacctctgtattaagaatttcaaaaaatatctcccacccaacccccagtgaagaaaactccgtgtcatcaggtgttttaggaagtcgtggacacagcagcttgacagaaactgccagtggggaccagcagggtatcctgaagacagcactggcctgggagccttgtctcagactcagtttccgactgtgaagtggccatagcaggcacccttagcgatatcctcctttctctctcagatgtgctgggtcaaagtcctgagttcccttcggatttgggatgagat

SEQ ID NO: 52431 - DNA, 629 bp, Bovine  19866881803883
tgccttgcgattgcaacttacagttctgcacaagcagaaaagttatgaatggttctgttctccgttcttttcactcctcccacctctgcctcccaacaggaacagctgttttctattacacgatagtctgacaaggtgctggtctggcgcggtgtctctttggcaggtaattttgatgaggcccagaggtaagagggtgggtgtctctgatgggtttccggtcctgttatcagccccgtcccgcacccccagacatggctgccgtctgtacacggggctgatttctggctccaggcccatgcttgctgagagcatccgtcatctgtcagggttaatccattaacttttttctacttaagcccggaactaggatatgaggccaatatccagctttctggcagagaacttggtccttgaataccgagtaaccctgctagttctgactgggcactcaggctttgatttgtttttgtcatttttggccttgatttaagaaagtagaacagcaattccaaatggtaagaaatagatagtatgagaaaaagcaaatgctatgtgggaacaagttgcccttcacacttaagctatcttcacggttaggttatctgcaaaaaaagtgagcccagtca

SEQ ID NO: 52432 - DNA, 1350 bp, Bovine  19866881924465
atcacaactcggtacagaacaggcacaaaacaggtatgtgtggaaggaatatggctttgtagactcagggaaaattagaaaaagaatctatttggacacttgcgaaaaccttaaattttgctccggacaacacgctagtagtaaaacttagctgatgtatgtttctttgggcctttttgtttgtttgtttcagaaaaagtttggggagcgtgcattcatattagatctagaatctcccctttgggggatggcatcaagattcacagttatgggagtttccaggccatgcaaacacagaactgaaaatcagggggcttcatgtatgtttttctcctctaagcctttggtgattttcagctctaaaatgtcagcactccacatcccatctattaagtaggggcagaattctaagcctcaaccctgcaaaggaacatcttttcagactctttgctgggaattttagattttgttctcaacagcagagtaatcattagataatgtgtttgatattttgtataatccctttcttgtcaggaatcatttctgtcaattgcctgacctgattaacagagtaaaaagggtggattctgaattagggctcgggccagctttcccaaatcgaagaaaattcagtaagaagaatgtgtgcacatctgagatgggaggggtattcaacagtgaccaagatcactctggaagcactgcagtctgggccagtcacggaatttccatctcaattttcaggtcagctctctaagatctatgtggggcagtggttttcctctggtggttctgtgtagatcgagggatgtttcaggagataaacaaggagacaaacagcgttaccacagatacctgaatttgtttttttctcatcaaaagatactcaccacaagctggcttttttgctctcgcgcgtgtccctaccaaaggcactgacgtgcatgctcacctaattctcaaatcaaactactgaaaatttaaaattaaagaaaagtttaattcattgtctcatctttttgtctctttctgtccttgtcttcatatttcctgcttccctgcaaagtgaacgataaagttgcctcacctcagacttatctgtcaggggaaatgttgaaatgtgctgctttgggggacttaatacttgagatgtagattaatttcattggtttttctttttcagatccaaagggagatcaaaggccttaactgagatcacctagcaactggggagcaaaggtaggaagtaaaattcatagctactggatcccagggacacaaaatacgggaaaatgaaagaccacccccttattatcctcagctccagtaagtcacttgagtaaaagatta

SEQ ID NO: 52433 - DNA, 739 bp, Bovine  19866882025756
atggcttggcagaattggttcctaccgctagagaacgcgtcttagagaaggtgctcttggagaatgggccacgagaaggttcttggtgaagaatttgatgtcggaaaatttgagcctgaagtaccgagagcaggtggtgatgggagactcaggtgtgaagcttagttgtgtgtagtagctcaaaggctcaggggtccgtttggaaaaaaagggggaaagtggatccggatggacccgcttctctgagtcttcacagcatgttcctgcttgctcctaagttgggctctcaaggttaggacacgtttttcatgatgtgtatgagatatcacaagacatcttggtttctctgttttcttgcaaaagtgtaaaactctctctttccagggtgtgtctcgttgccacaattgagaagtgtacgtttgacagcagcagcacctttgataataaatggaactttgtggccacttttctcctatgattgagttgaaagaaaacaaaaaacaggctcaatgttatgcaggaaaggcctgaatcaagcaacaaaatatttttttgaaagagacgatcaacatggcagggtcacaagctttcattggcccaagcagaggagctctgctaaatcctgtcctgtgaagtgcctttccttttctactgcatggcgtgggagggactctgtgtgagcattttcccctaagagcacagacactgatgagatgtccagtgtaattaataaccacaa

SEQ ID NO: 52434 - DNA, 1762 bp, Bovine  19866880685097
ttactgaatggatgtacagatgaatgaatgaataaatgagtaatgatttggtccaacgctacctcccactttggctatcgtgtttattgttgttgttgtttagccactcgggtcccactcctttgcaaccccgtggactgtagcctgccaggctcctctgtccatgggatttcccagacgagagtgctgaaatgggttgccatgtctccaggggatcttcccccacccagggattgaacccaagtctctctcctgcactggcgggtgaattcattgccactgagctaccagggaagccccgtgtttatcataatttacatataaccaagcatctagtaccattacctgacccaagggaaatggattctgaaggtgtgaggactgagttcctctttatttccaagcttgcagtcagtctgagcagtaaaaatacaaagagctagatcacattagggtattttagctatttgtttcagttcctcaaatcaattcaaaccccgttaatacttaatttaattccttggtttttttcccccctagaacattaacagatatgttattaagctgtggggccatccataattggtcatctctctgtgaattaaattttaaaaaggaaaagtaagatcaaaggataatcagatttcctatttatgcaagacaactgagttaaattacattttcttgctaaaaatagattattttcttaagaattaaacatttatttttatctcaaacaatctccatacatcttctgtagagttaacaaataaattccaggtaatagtattacatatttaataaatgtagggtgatttgaatggtattagagtgcaaagcatcaagcaacttctggaggcaagtaaaaatggattgaagggtctcgtcccaaaaaaaggagtttgtgaaccaaagaagggtatgagccttgagggaaaggctgagcaaagctggccacagaacttatatttcaaaaaaccaagttgaagctttgagacattttgaagtattggcctagtgagatggttcctggaggagagattttttgggtctgaagagaaacatgtggtataacagaagtattaccgtgaaagtgttagttgctccgtcgcgtctgactctctgagaccccgtggactgtagcccataggctccttggtccgtggaattttccaggcaagaatgctggagcgggtagccattcgatcttcttgacccagggatcgaacctgggtctcctgcattgcaagcagattctttaccatctgtgccaccaggaggcttccttaaatcacactcgccttattaattccccacagtgatgggtacctggagtgtgttccgattgccacaccactgccaagcacacttgcacctgattctctgtgtgccacccctggcatatgtacccaggacagctggatcactaggcactatccactctgatggcacaaaaggtatgatataggccaatggttctcaactggggacagttttgccccccaggggacatacgaatatcagaagacattctgattgtcttgttcagcatgtggtgagtaggagtcaaagatgctgctaaacattttacaatgcacaggacagcccccacagcaaagagttatccagcctaaaatgtcgatatgctgaggttgagaaaccctaatctaggtatcttaattttttggtccatattcctttttgatgacctactgatggaattgagtgatttatgagcctcctgcaaatgtatgctgaattt

SEQ ID NO: 52435 - DNA, 1210 bp, Bovine  19866880741975
catgataacagaaaggagtcacccaggcaacaggggaagaagagaaaccttgcctttcccatcgacagtcttttcagtgcaccactgctggagtaatcttcccagagcaccagctttatttcatggttaacctgcttaaaaacttcagtgggtctgggtgcttagaaaaatcttaaactcctcggttggagattccagaccctccataatctagtttcgctaatttatcactctgtcatctgcacacccatgctcccacggccagactaatttcaaagctggtccctgaaactcattccttttcaatcgcagtattttgcgaatgcttctccaccacccccctttccccactggcatactctcctccgtccgctctgttcaactctgtggaagcccatgtggtattccgcaattgcttgagcactcagtgacgtcgactgaaacaaaacaaccaacgacaaaacctgtttattccgggtcctgagcactgactctcattctgaattagttttgtattgtgagccaatacacagactgggaccatgccttcgaatcctgtgtatccccttttccctccactgtgtacctagtacagcccttggtcatagtagtggctcaatagctatgcactaaatgaagttacctggtattcagcaggaaaaaaaaaatcacttaagccagttatttgactgaattgaccaggcaatgaagtcaaagtaattgatctggtagtcccaacagacaaagtctaattctgcatgtagttatcttgaaagtcaaaagtgtgctgggtgtgtgatatattataatgtgagattctaactgaacaaggaaggatcatactatcagaggcttgaaatgaaagggagtgtctgtcttattctggaatctgtataaacacagaacttcatcttttcgcctgatccagctcatctggctgttatgcagatcatttgttacataggtttataggatgggtcttggtttcagtctttattctgaaaaatatgatatgccacactccattttactcagcatttcagaatatatatccaatacgaaataccagagatgatagatattatagataaaaaccatgaacagaaaaagagtccactcaggccaagcacattccttacctgactgctcattaatcctgttctaatccttaccccatggaggtaaacgctttttaaaagttacatgtaag

SEQ ID NO: 52436 - DNA, 877 bp, Bovine  19866880811701
aaattttttttaaataataataaataaaaggaagttggacagcctgcttttttcattcaacaaaatgttgagggcaatctttttatgttaatgactacagatttacatcatccttttaaaatggctgaacagtagtttggaatggatgtaggatggaataaatgaagaacaaatgaaagcactacacatctaatttattattagcatttctagaaaagggtacttatttgtttgagtgtggtggtaaaatttaggtgagagatttatggttgtatttcattacaaagctctcctggctcaaataccagtggatacactgaagtgcaacattcaaatagtaggaatatgttgttggagaatcgaagggtttgaaagattgccaaattacatcattcagcagctgagtatgtaaagtaactaaacagcaactgtggcgtttcctttccctttaaaaataatgcttcacaaaaccagttctgagaagattgttttctgaacacatagacacacaaacagatgtaattcatcaaaacaggaagtgctttaatgctactctcagcgtaagtaatgccgcatgcagacctcttactaagtctcacttgagcaattacccaactagtacttctcattaacactcatttctcagcaaagattttaatagctgatggcttttgtaaggctctgtattaataaggcttcattaagttttcaaaatatattgcaatacatttactggaataatacaaaagtattatcgtccatcactagacctaaacaatacgcatctagataaatcagccaagcccatgtgggtagagcagtggtagattcaacactgcttttttgactctttaattcaaataaaaaccctgctatg

SEQ ID NO: 52437 - DNA, 1551 bp, Bovine  19866880981108
atgctattatgatctctgttgtgcagatgaagaagctaaccaaccacttaagtaacatgcccagtggcgcacagcctgttagtggtagacctgggatggtatcccagcctgctagctcatccctttcagacataagagagtagttgaatgatcatctttcaaggaagcccatagtcccgggttagaatccacgatctactatgaatatttacaaatctctgaagcttgcccagatttcacttactcatctataaaatggggctgtcagcattgaaaggactggatgagtctgtgcatgcgagtcaagtcactccactcgtgtccgactctgtgcggcctgccaggctcctctgtccatgggattctccaggcaataacactggagtgggttgccatgccctcctccaggggatcttcccaactcaggggtcaaatccgagtctcttatatctcctgcactggcaggcaggttctttcccaccagtgccacgtgggaagcccttgggtgagtccatgtctgtccaaatgctctacccccagaaggtaccacaaacccaagcatcctcagtcacccttccagccttttctcccccactgtatctagggagttactgtacatctttctctttttgctttactgcatgctcctccgattttcattttctttcacctaatttataccaactaattttgcccagcttgacctgcgaacacagtggtgagtggtgtcttgggcatgtcaccagcagccagctcaagggctgggtggaagcaatgtatgatttgctttgtctttgagcccctgcagtaagaaacaaaacccagacacgctggcataagcttcctaaagcaggactgtggcattttccagaagcactgaatttacttccagcaggctctcactggctcctttcattgaaaaaaggatttgtctctacctcctcccagccctggaaacctgtgttcacagtgagctgctttcttgcacgtagtgcctggatcacgcaataaaacatggccttctggtttcttttctccaggtattgatcactgttctgaattttccattccagttttgtcctgctatgatttatttgtaaaacagggggcaggtcactgcttctcaagctgcccttcctttcttttgttgtttttcattttttcctacctactaagaagaggaaaatagtcattgaatcttaacatataagagaaataattgagacctgtatttctcaaactggacgatatgcatctctgggggataattgaccaggtatcaagatgtagttttttaaaaatacaaatcaagtttggaggagctgtctgcaggattgtttcacccaaagattcagcagagaatatttttatattataacaaactaagatttattatagagtggactgcaaaatccatttggatttttaggatggaaatgaaaactctgaacttaaggaccttcaggaagagagaggcacaccaagcatcggtacttctagctcccagggcactgagaactgacttagactccaggccagagatggaggctt

SEQ ID NO: 52438 - DNA, 1144 bp, Bovine  19866881042556
gcagattctttaccatctgatcccaccagagaagcccatattaataggtgctagttgctatttattttgctttagggactttcccccgttagtctgcttctaataaaagagtcaactcttggaaagtatacccgtcaggttactgctctgtattcactgctagtatgttccgtttattctgttctcaaccagttgtcattctgcagaggagagacgaggaacccgaggaattggagtctagtggctgagctttgacgcggacgggtggttcctgagaagggtggtcagggaggctggtctgtctaggtgtggatccagaggaagcgatctttgagaaaaattgagaaactgggacttctctggtggtccagtggttaagactctgagcttccactgcaggaggcccgggtttgatccctggttggggaactaagaacctgcatgcattgcaatgcaaccaaaaaaaaagaaaatttagaaattaacaaagaaaagaagctatttccgatgttggctctttcctatggttttgaagaaggagtctgtctttttactggagtctttgtctgggccacttttgcatttattttttactgacgagaatattacttcctggtagacgtgtctaggaaacatttttaaatattcctgtgggacgctaagtgtctgatgagtttctcttcctgacgttgtaaagtaagtgctcagccttggagtctggacctcctgtgccttcctgaaaaacacttggatgtgtcaggctgcagagagatttgctacagatggataatcactctataagggctaggaatcttggtgtggaccctggggtcaactttgggggaataagaatacttggatacatatgcttctatttcatgttttgtagaaaatgaatatattggccagagtgaactttgtctcaataacaggtatccgttgagtacctactatgttccaaacatcaacatccaggaggcaaccattatactaaatttcctagacattctctcagattattctctacaggcaaagacacacacacacatgcattttgcaaaaggtacttttgtgtaccttgccttttcacttaacattgtatcttacaggtcattttgcatcagtgcattctttttaataacta

SEQ ID NO: 52439 - DNA, 827 bp, Bovine  19866881172810
attgggttgctgtctcctactttcctacttatttagcttcttggatggtctccaggcctggctcgaaaagggccacagaggggttgaaatgggcctttgcctaggtcgattcagtggggccctgaggctacctagccagctgtatccatggcaaccatttgctcccagcaataaccccccatctctgccattaggcccactggacagggggctccgtttgggggtccaatggccaattgattgctcagctgctgcacactggtcaccagtcccatactgaggctcacagccaaaccccagcctcttggggttagggaggagtcgaaggcaactttttcttgaatgccttgactatcatctcttcttttaatcatgtcctaaatgcctgtcagctattctgaagacaaaattggggaaatggcttctattctgaagatgtaagatgggcttccttgctggctcagtggtaaagaatctgcctgccaatgtcagagatgcaggttccatccctgggtcgggaagatcccccggagaaggaaatggcaacccactccagtgttcttgcctgggaaaccccatgaacagaggagcctggcaggctacagtccatggggtcgcaaagggtcagatacgacttagcaaccgaacaacaataaagatgctcttaaaggcagagatttcagcttgtaccaaatttttgtatccaaccaggtgtgactcccagaactgctgtgcaataggattcagtgccctgaacctgactcaggaaacttggatgtgagtccaggaagcccccagacctgcgactaacttaaccctgctctacc

SEQ ID NO: 52440 - DNA, 1575 bp, Bovine  19866881189013
ataaccttaaggaagaaatctaatttttaagagtatctgctcactcatatataaaatgttgacagtaatacctaccttataagattttaggaagattttttcaagtagtctatatacatatatatgtcatttacatataaatgttctaatacatagcagatgtatttcttttctttattcttctagacacatttctggtaacaatcataataactaacgttcaactaacacttacttatacgtcaggcacttttcaaagggctttagataccctaatttatttatcctcacaatactcctcaagaggtacatgacattattgttcctatttttcagttaaacaaacagagactaaagcatttaaggccacaaagctactgagcagtgagtcagaatttaaacccaagcaatccagaacactgaaactccaataaaaaggctgaactacctaaagaattaggtctgagagtaatagaaatgttatttattcactctgattagttcccactacctcttccattttaaaataaaaagaaaattacagtttgtgcattaaggtagtttagtgccccaaaccaccatagaacacttaatgtcaaataactataaaggaccctgtcttctgctgggtttgtctactctggctacagatgaaaattacctatgaagcttaaaaaaaataacatagacgtccaaatctcacccctgacattttaagtaggaactccagggtagggctcagacacatgcattttcaaaacactccagatatgattttagcacacagctagagtgagaattagagttctgaacaccaaagataacgatggcaatgcaagccaagtagcatctggaaccaggataatttttcaagggaaaattaccaacgagaaggagcagtaaagaataggaactgctgacggaggacaataagaagagtgaataaggtggacagcagggtaagaagccagacagggaggcaggttcactttcagatgccaagaaggcgagttacacacgaggaaaagcaaacagaaatgcaatctctacagccacaacagcagctcagcaacatgatctgaggacttacatgtgaccagggaaaaggcccatttttttggtcattgcttatccttgcaaatgacacaatgctttcctcatcattgttgctgcttgtttttcacaatttgccactactgttagttttgttattaactgcaattcagtgactttgtcccaattttgctgataaaacatctgaaatttggcttaactttttcaccataagatcagaaataaaattcattataacaactccaacaaagattaatgtagtcattatataaaacatgcatggttagaaagcacacaaagtaatcagcgaatcattttcacaacagtagaccacaaccaactaaaatcaagcatagcaccagaagattattaatataaaactctaacataggtttcataggattaagacattgctgctgctgctgctgctgctaagtcagcatcaaattgaggcttccaatttgtggtattacagctgaactaatcaagagggacacaagt

SEQ ID NO: 52441 - DNA, 733 bp, Bovine  19866881231574
tggtgtaatttaaagtttggcattggctcaggctcataagaacgctgtccaactggctctgaacactactgatgctgaaattccatggtatttaatttttatcagcactcagatctgaaaagatgatagctctttgttaacagggacagaagtcaggacaagagaaggatcccctaaaagagacactgactgattagtaaatgtctaaggtgatagaggcccatccccgctactattctaacaaccacctaacaatttctgattctttttttcaaatttggaaacattgaaaatcactcgctttgcctgttttctcctaaataatacaagatatacacaattaactgcaatgttttcctacaaatagacaaccaaatgggagattctgagatattaaaaaataaaataattctggaaaagtagatctttctacagtttcatttgtctcatgaaaatttggtgttttttcacagagacatgggtccatttaatcatgctaaagggtgacatggagatccattttcttgacaggacggttgatcaccctatcacagtaagaaaattaataccttcaactagccctgtgtggaaaacagaagctacatgcaatggtaaaggacatcaatgttctatatttgaagctgcaaacagaatacttgttctgtgtgaaaataatgtttcctcattattgggggctttaaacaaaatatgagcctttattttattaaaacaa

SEQ ID NO: 52442 - DNA, 2578 bp, Bovine  19866881239174
cttatgggatattttcaaagcacattatatgataaatttatacttttaagttttaaaatcaataacagatcaaaatcttcacattcaaaaataaagcatacagagttttaagatatataaacataatagctgacaacagtacagtgcttctgaaaactgttctagcttcgcttttgaatttttcattctttgttaattaccactggatctacttaggcttatttggaaaaaggtataactataaaatattatagagtatactaatatatactaacaattcatcctatttactctttaagcgtaaatgtaaaaaaaagaaagacatacctataaggtacctataatcactgaaatctttttttgtgaaaaagtattgaaagaattcaacagcataattgttagtgtcaggcaagagtcacattccactcaaagctattaagcatgcattccttatcctaattaaatgttcaaaatggctagatttgattgtcataacagagacaaatcaatattatgatacttgtttttttaaaaatatttttcaaaacccctaaacaccctgctctttgttacagagacaaacacagaagatccctaggttcttgaaatatgctaacgacagtcctgttcagaaatgaaaggcaatactgtattaaagaaaaaaatgaaaccacaaataaataacagaattatcgcgggccccactgtatcggagacgctcggtactggactgctcggctgctggaggagctccagagagttaacctggtgtgatagaagacttgacaaagcaattctgactgtgtagcaatgctaagttgcggactaatacgagaacaggaggtccaatcgctgtctttcaccaagcgcaatttacacagggctttatcaatagccttagtgctgaatacagaacacactctatttggctttcagtcaattaagctttaagctgtcagcaaacaagacttttaagttaattttgaatcaccacgaatcaagttgaaggttgtgaaagggcggctcacacgctggcatgaaaaaaggcagtttaattgcctctgaatagctattatatgctgcaattggcctattgaatcttagatgatctatttatttatcaaagtgcaaccatcaaagattagtaaaagactgaataatctgaattgtacattccctgttttgcataagaagggatagtctgcaaaggtctgaagcaatcatatttttaaagcatattttattttttaatgtaaaaattctgtgaaatggaaatcagcaatacaacctaacatgaaaatggaatcattgtatttctaggaaaataaagatataccattttaaaaggtatacttgctaccatgaaatattttcatgtgttatttgatatcaactgtactatgtagaatataaatactcctttataaatgttcacattataaatgttcatcaaaaaagagacagaaaaagaattataaaattgaattaagtcaaaggtttaaaacatcttttttagaattccttaaactccatcattaattgtgtgaaggagaacaccaaaacatatcattttaataccaaggatttctcaagaagatggtataatcaaattaaaaggattattatattcctaataccgcataacatctatttttttaaaaaagactgtggctgaccacaatcctaatcagttttttcctgcaattattttttttcaattgcatgtattctgtttattattatagggttactcatgagtgctggatgtgtatattgatttttttattagaaaagagcactgaagcattagggcgacggggggtgggggggatgctcagattttataaacagatgtaaacacagatcaactttagggatgtaaaatggaaccattttgctttggctgaaatgtgctgtagttttttgacatgttagaccctcaatagcaaacgtattcaaacatacactcgtggttgatttacatagggaaatcatatggagattaatggttataaattattcacggtttataagaatttggatagaatacaggctaattttagtattccctcaaggacagtcacatcttcttggaagactggacccatcactctccatttccagtcagcagaggtgatggttgggaagcagtactgactaccatcattccaggaactaccacactttcaggggctgaaattcaatgaaagagtgttaaaaccctttctccttctctcttctcccatccattattataaaatactcttgtttctttgcctttagattcgcaaagtataatcatttactagttacgccttacaaaaaaatcgatgctactaaaaccataaacataaagatgctaaaggagagaatgcccgacgtgatttctaagggaaacaggaggaagaaacagattaagataaaacatagtagaatccactcgaaaagtggacattcttgtcctgtcatcattaagaattattaacaaaggactttgtgttcaatggtcccaaaggtgcattgtgcatctcctgctaaatttttgggattttatatatatatatatggatatgggggg

SEQ ID NO: 52443 - DNA, 1856 bp, Bovine  19866881273049
aactcataacatggcagcctcaaagcaacagagactgcccaagacagaaccccccgtcctccttgctgtaattttggaaatgtcatcccatcaacacatgccatgttgtgttagtcactcagtcgtgtctgactctttgcaagcccaccaggttcctctgtccatggaattctccaggcaagactccaggagtgggtagttattcccttctccagggggtctttcctggcgtctccttggatcaaacccaggtctcctgcatcgcaggcagattctttaccatctgagtccccagggaagtcctatgctggcttggctaggctcagctcaccagggcaggcgtcacttgcatagggtctgcaggaagaaattaaaggaggaaaagggggaaattgtatgtatgaggaggagtgcagaagagagaagattggaaagaaagaaaactggaagattttaggctatggttggaatttcttggcttcttcatggggagagagggaaaccattttctctaacgagtgcaattttaaaaagttttttatttacttactacttggctgtgctgggtcttcactgcggcacaggcttctctttagttgcagggcacgagcttctcactgcggcggcttctcctgttgtggagcgtgggctccaggacttgaaggcatctgtaggtggcaagtgggctcagcagctgcagctccacgtctgggacgtggaggctttgttgctctgccgcacatgggatcttcccagatcagggactgaacacccatctcctgcgttggcaggcagagtctttaccgctgagccgctagggaagcccatgagtgcaaattatacaattaatgcacaaatctaggggctgctgcgggaaatgagatctgcaaagcaaggccaggttggcgtcttgagtgatgggtgtgaacctgtgtgatgaagcagaatatcttctctacactgaaatatctgaagaataaatcaggactagaatctccaaattctgatggtacattaggagcaacgtactttatcttttcttttttttaaattttatttggccacacagggtcttaagtgtagcctgtgggatctatttcccctgaccaggaacgaacccagtccccctgcactgggattgcagccttagccactggacgaccaggggaagtcccacagtttactttatcttgattcatctctttggagataagaattagggatttggggctgaatgcaaaagtctatgatccttaggagaagttgttcatgaagatgaaaggagagacccagagagaggctttggaaagtggattcctatacctgaagggatttataagaagttttgtactgcctcatggaggaaaaggctcaagtaggtaaagagatatgacagaaaacaagtgccctttaaataattggctcaggggactcaggaaaaacgctggaacgtagaaaagacaggaagcatcgcaagatggagctgcattctgggatctaaaaaggggcaggtgggagcagatggctagggagaggagagggagaccctaggagggaagaacgaattacgaggaacaaagaaacacgcacagaaatgctaagactggcttttgtgaaggtttaccagaagtcgtcctcatttacattacagaaaagaaaaacccgggaaaatacccttccagagggtccgagagggcaagcagataacaggaggattcaaaagagccgaggttttgatgggtagttttacttctgtctttaacaaaagatgctccatttggatgtaaaatctgtgggctatagtcagaaagcgaccaccagacattttgtctcatgtggaacccgacactcctggt

SEQ ID NO: 52444 - DNA, 2072 bp, Bovine  19866881430244
tctttacatcttgtgtctctgctgacagcctatttttattaaaatatttttctccgtcagaaaaagaaattggggcttccctgatagttcaggttggtaaagaatcctcctgcgatgcaggatgcctcggttccattcctgggtcaggaagatcccctggagaagggataggctacccactccagggcttcccttgtggctcagctggtaaagaatccacctgcgatgcgagagacctgggtttgatccctgggttgggaagatcccctgcagaagggaaaggctacccactccagtattctggcctggagaattccatggcctgtacagtccatggggttgcaaagtcgtacacggctgagtgactttcacttccacgacgaaattgatattattagtctgttttctcctttgtgaaacttcctaagactcccttatgattattgttcttactctgcctcttctttgtgaactttttaagactcccatatacagagttaagcactgcatttgctgcccaaccctgcccccagtatgtaattctcctccagcatccaacatagcactcacccctggagttatttatcttttaactacctgccctattagaccctgtgctccttgaagacaacatgtcattcatcattgtattcccagggcctagttagcacctgatacacagtaggtgttcaataaatggtaccaaattaataaaatacaattgctttcagccaaatcagaaaaaaaattaacattcagcttatatatgtttctttagtattcaggcagaaaccttcctctgcagtgattaaacaactgcaaacaaacatgggctggcagaaatgaacgggacttaagcaacggaggatgccggaggaggcagactttcgggaagggcagagataggccctttaaacgctgaatgatttcctcgccttagctccaggaggcttattttcacagcagacactggtgctataaggaacgctttgctaaccttcaataggataattcctaataaaactgcttcccttgcttccgctaagtgacagataaatgtccattttttgcttagacgtttccttagagaacagttgactgggaacgtaacagctacatgtatttttaacatcaattaattatacaaaaaagatttaatatatataattttcaataaaaagaacataaaccagaattaaatatggcatgattttacaaaattactgtattctaacatgcctgatctatatcacaagaaaatatgcatctgtacaacatgcatattagggaaactttttccatgtgttcgtgatttaacctctggtggcatatatcagaaacagcaaaatgaagagactaggatataaaatctattgtaaatacaagggaaaatatgggaggatgcagagtacaattaactcagcaaacatttgctgaaatgccaggaaatacagaaggcgtaaggacgcactgcgtaatgccactgcaaactccaggctttccagcgcagcacgctcactgaactgaacagacctgcagtaaggacagcactgcgcttaccttaaaaagaacaatgttacataacgatgcctaactggttgttctgttttctacaaaaacaactgctaaaacaacttcaacagacattaacactatttctgctgaacacatggaagttaaaaaaaatttttaacaaaactgtatctcaagctataaacattttaagaaccaaaaactactttaaaagaaaaataaacgtgattacattttgacattaaaaaaaaatcttcatttcctactgataaatgctatacacagacgagggcctcccaggggcaccaaggtaaagcacctgcctgccagagcaggagacatgagggagggggtccgaagatccccttggaggtggccatggcaacccactccaggatccctgcctggagaagcccacggacagaggagcctggtgggctatggtccacagggttttcgaagagctggacacgactgaagcaacagcagggcatgcacacacacacacacgattagaattatatgtcacctatgcaaca

SEQ ID NO: 52445 - DNA, 2395 bp, Bovine  19866881475810
gaagaactgatgcttaaactccatattttggcccctcatgtgaagaactgactcattggaaaagaccttgatgctgggaaaaattgaaggcaggagaaggggatgacagaggatgagatggttggatggcatcaacaactcgatgggcatgagtctgagcaggctccgggagctggtgatggatagggaggcctggcgtgctgctctccatggggtcgcagagagagttggacacaaccgagtgactgaactgaactgatatacagcaggcactcaggaaatgttcattcaatgaatgaatgaaagaatggctacctcacaaaaacatgcaaagtgttatggggtagaagaataggtttttgaaaaaccagtcttatacctagtaatcttaggctcacagaatttaagtaatgaacctagtaactgggtctcggtctaagctttctggctccttgtttggtgatcttccgttttgctttcttcctgaaatttgcccgttagcctgtgttgtgtgagagacgatccacctgctgcattttgtattcacagcactggcgacgagtgacaaacggcgggaagtgtacaagcgcgtgtaggctgttcccttctttaacctctgtctactgcagaggctgtaactccagaggcctgatacacatgtctacaggtaataaatctgtgtgagttatagctgtatccttgtagatttacaatgataagttttaattcatgtctggcaacatatttacataaattacagcaatagagtaatgatgccatatgctggaatgttcacccagagaaattcaagaggcttacggcagctggctttcttatggccacaaagggccgccctcatatatatgagaaagaagcattgaatttggtattgtgggcattatacagatgttttcttactcttgacatttgtctgaaagtaaactatgcttccagtgcctctcactgcattaatgaatagtctcgattaagatgtaactttagggaagagcagaattacttaaacagtcgaaaccttcagaggagtaagtgcacattacttctaagggtccactctgtcttcgagtgcatctgcttaacagctctgaagcttaacagccctgatgcttgagcacaagctcaaccaggctgggagggaccagggacagtgagagtaaccagggcaggcctctccctctcgggcgatgaagggaaggggcccttggcctcggacggaacatggcaagggaccacagccggatgtcatgagccttgcccagtacttcagcattccagttcactgtttctgttccaagagaagggaaagtggattcttctaaagttgtgttactattagtctcctttgctgggacagatttcccattaagagttttgttcttacatcaaaaagactctttcaaattcagaaactcacaattggatattaaggatgaccatgaatcaacccaccactaccatttactgagactgtaatagtcatgaaactaaatgtcttatgttagtttaattaatctttataagggcctaaaattaggcccataatttccaggcgtcaaagatagtaggtggaagggcaggccccaaacccagatctcgtcaaccttccttcctgtttatcacatcttacatcattccaagggccagatcaccaaactcccttgggaaggaaatgctggttgccttcctcaagccaaggtcctgtgttcaataaaggtgacagccttcatctcgggagtgaacttccactagtccatcataatttcatttctttgccagcaacaggtttagggttagggttagtggatgatatggggtatgtgatgcaatcttggtcaactgagacgtgagaacagactttctcagatggcctttctgcctctggatggtatcctctgcataggttgctggtgctgtggccacatcttgtaccctgaagtggtccagcccaagagacggacgctctgaacatggtgaagaagggagggtccttcacgacaccgctgactgctcacttcaccagccgcctctagatgtttcgttacatgagataatagatcctttaattgaaagtctctttcgtgccttctattactttgcaaataaaatatcctaagtatgaaatccttcccaaagctccatagtccctttatttaaaaactcgcctctatgcccaaacgggcttccctggcggctcagacagtgaagaacacagctgcagtgtgggagacccaggttcagtccctgggtggggaagatcccctggagaagggaatggccacccacttcagtattcttgcctggagaattccacggacagaggagcctggcgggctacagtccatggggtcacaaagcgtcagacagacgagcaaatata

SEQ ID NO: 52446 - DNA, 962 bp, Bovine  19866881531472
taaggatttggtttagaaggtttatatgtctgccggaaaaatatggggagagatttcatgcttcaaatgtggtgagagactatattctttcatggcttatccatccatccatccttccatcttttccctatttttccacccacctccatccattcatctgtactgcctatttatctacccatctaatctatctgatctgtctctatcaactatctatcacctatctgtgtatctatctagccatcatttttgcaggttcataatagcgatgttgaggccaccaatctggatgctccctggtatctcaccgccacagccctgtttatggccatcgtaaaatgtctgtggagagtccaacggctgatttcccagggtctttttctcctgtctgagggatcaggaaaaaaaatctatcagctggagaaattaagccatttttcttcgggggagagaaatggaggagccagcgctccacattaaaatgctgcagtggattccagatgagtgaaaaattggtctgcatagtgaggagtcttgaggagcaatctggagggtttgtggctggctcctggccaaggcgcgtggggtgtgttgggcgggggacaggacatcaaggcgggatgagtcaggcaagtgggtctctgggactttcactcatggggagccggcgccaaggcgtcaccctccttagtctccctgccatttatttttccaaaaagctggttgtccacgtgcttttatcagagaggggcaatttctgggctcctcttccagttatctctctttacgccctccagatgcctgaccacaacctcactgcccctcacaactcacacaggccaagtctgcaggaaagaggggttcagccttcggagggggtggggcctgtcatagaggaaggacattagcccagcttcagacaattaacccaaatagatccaggtataatgctagaccggccg

SEQ ID NO: 52447 - DNA, 580 bp, Bovine  19866881557217
ttagtttgctttcccaagagctttctgttttaataaaaggatttcaagctaaaggagtggggattgtgaacgtgtgaaaggagaagaaagcatacaacaaatgaggaatggccacatagggctgctgagcagatttgctgtccgaagggatcaaaggttacggagccagctggtggacagcccacacctgccgtaaacgtgctcgtggtgaaattgcttccaccattgtcgttaatgtgtgaggaatgatggtcgtggcaagttacagcggaaagcagtcttttccaaacctaaaacctctttccagcatagaaatctatttaatcactaaagtaggtaaaatgttaagcaatacatctggtaaacacaccacacatcaaatattttcttataattgaatcagccgagcgttcaaacatatgcaataatggcctaagtgattttggcagcttctaagttataactgagctgggtcataatttggagttatgatagctaaagagtccctctctgttagatatttgtctgaaactcaggaactgcttttagctgaagagcagaaggttacaccgcgctaatg

SEQ ID NO: 52448 - DNA, 2214 bp, Bovine  19866880143722
tgaaggagacacagattcctctgtgtgagagctgttgcttttatttgataaggcctaaaatagtgggtgtttattggaatgaatgatgctaaagctgaaactccagtactttggccacctcatgtgaagagctgactcattggaaaagaccctgatgctgggagggattgggggcaagaggagaaggggacgacagaggatgagatggctggatggcatcactgactccatggacgtgagtttgagtgaactctgggagttggtgatggacagggaggcctggcgtgctgtgattcatggagtcggaaagagccggacacgactgagcgactgaactgaactgaactgaactgaaaatagtgggtaggtaatgtttgctgaaatcaagttcactgctccaaatatgtgtcctgagcagcctgtcctcatgctctcatagccctgagcacacgacactgtcttgctgctgttttccccaccagatgatgtaccgttaccgaggtagggaatatacattatccatttttgtgtttttgtatttctcagggttgcctgtcattataataggtttctggtagctgtttgttgaatgggattaaggaataaataaaggagtagagactctaattcaaatctagttgatgttttgtctgtttaatcagattccttatcccattttgagatggtaccatttgataaaaagtgtactgagagtgggtcacatatttgttgcctgaatgggttaatcttaatcctactcttgtgttggattagaaaagctgggttagatacagaataaatagcttctgtgaaatctttcctaagccttacttaattcatccattatccttttctcggcataatgattattttgatgtctaggacctgttttcttctggtcttctgtgttttcagtaaaaataaaaatttaattgatattttggctattcacctttttctaaagatggttgagaaaactctttagcaaagctaacaacctatgttgtgtcagttgctcagtcgtgtctgactctttgcaaccccatggactgtagcccaccaggctcctccatccatgggattttccaggcaagaatattggagtgggttgccatttccttctcctcttatattgaatcagcagtaattttattttatggtgaatttacttgtagagtttagttcgatcctaatgctgtccatcagtggctagttttaggtctagatggggttatagttttgagtagaatgtgtgtttggatctctgtttctagcagcccgggagactttcccaggtgtgtacttcttcttcagccaagacttaaccttagtaggcaaatggaggcggcttcctgttcttagtgctggcccaggtgctcctccatgtgtggccccctttgagtcctggtgtccccacacttcagaatcttggagaagcaatctaagaactgctaggcagtacttgcactgtctcttgagagatgagtaacatgataaattattttaaaccagaaatgacagaattgttttggaaggtctgtgcattcacgtctgtgttggatttataagttcttgcaaaaagtgtatttagtagtataaaggggaataatgattcataagctttttcaaattcagatctacaattcatttatacttaattatgtcctcattaatatcattttgaatggttttatgtggttttctaggaacttctcagatcagaagtttagggaaagagtagtttcattgcagttggggaagcatttttctaagagtgtctgtgtgtattgagttgcatacattgtgtgaaatgtaaagccttagcaggtggaaactgatgattatttaatgaggttatttttgtctgagattttctcaggtcaaaagaccctgctggactactgagaacaccagcttctttcttattctgttgaggtctctgtaaaaacacccacagccactttgggacttatttatttctactttcctgaaataattcatagttccaggatcagaagtctattgaaagaatacaaatactgaacctttagggataggtgggttagcccagcatttgggattgttttgtcagttggccttaaatatcttctgtcacattttcccctctgtagttttttttttttttttttttaaattttatttttaaactttacataattggattaagttttgccaaatatcaaaatgaatccg

SEQ ID NO: 52449 - DNA, 1222 bp, Bovine  19866880352155
ctgatgactcatattggagactttaagctttcaattcatattttttttcactctaccaggatttcctccacaaagtagaagcctcaatagactgatcatgattacctgatatcaggaaacttaacctctacacactacaaggaaaacaagtaaaaaacaaaaaattcaaatattttttaaaatctacatttattatataattttaactcatttaacacatatctgagtactacgaatattagtgtattctcttgatgattaaactgacagtatgaatttgcctttcatatctaacatacaccatatgtacctaaaagctggtcactaaatatttggtgaaaaaaatgcaaacaaaccactagaagttgcactagcagatgaaatactgaatttggagccaagagagctgatttcaagtcccagccctactattcactagctgtataatcttgaataatgagtcattttatctctacatattgtattttcttatttataaattacagttggaattatatgatgctttattccttcaggatgctaaattctagtatcaatatactagtcactgttcacaatataaggatgatcaagaggtgtagaaatgggggccactgttggtcacactctgctatattccatagcgcttctcttttttgtcccctccctgtgtctgcttctatcctccttaggccttacctgtggcaacaagccccaggagttcctgtcactgagggaaaacagtacattcagccatgcagatgcagacaggcaggataagaatcagagttcaactgctcctcctgcacaatgtggtacaaaggagagcttattccaggaaaaagggtatctctgagtcacagagtatctaaagaccctacactagattcaaaaaggaaaaaaaaaaaaaaaagactggacaatatcctgcagcctaagatcttagaaatataacaggtataaccacatatgctcaacagtttgacaaatgaggttcaccaaaaattaactggaaagaccccaagctaacatgccttgcacggaaagcttccagcaaactgatataagtttaagtaatataattcttaagtataagaatttatggagttcattaaactgtcaactctgtccccagaaaagaagaaaaaaaaaaagaccaaagttttaattaaaaagaaaatgaaaactcataaaagtggtactgatactactgaaaattata

SEQ ID NO: 52450 - DNA, 2721 bp, Bovine  19866880401324
tttactgatgctctgagcatgtgttgtgaatggctgggtgtttaattgcacttgaaagctaggcttggtagggggaatggaaagagaattcagaccctcttgggagtaggcaccagcaagtaaattggtcagagcagtggcactgtagtgaagttcagtgggaacagggatgcttgtatattaagaaaggcctatttttcagtcatagtaaagtctaagtataaactatttactcatgaaataagattagtatagtgattttatgatttaaaatttgcttctcaagttacgtttgctgaagggctagcattttaatctccaatttatcatagaccaataatgttataaaatatatatatattttttattaaagaaaattattaaaattatttttaaaaatgacatgagcctctctttgttttcttagtttttttcttttttaccttttttgctgccttctgtttttctctctgggttaaatgcatatttttctcttttattatttggtcataaagcctccttctgtattcttctgtattcttttttttccctccccatctcttctgtttgtatggccatagtagaatacagtgttgtggggtgtgtgtatgtaatgaataatgtttgtcatttagaaaattatgtattttctctttaaccctcctatggcttttggttatttttgatgaataggatttggccctgtaaggaataccactaactacagttgggatatgtgggttccttggcccttgttggtattggttccttgttcagcactttaaacaaggagagattaagaggaagaaatgattggtaaatgggcttttggtgaaacattgactatactgcggaatatgtaggaagatgagtcttcttgagagcagataataatacttcttgcttgtaactgcattctctgcaacatggtttatatgatggacactgaacgcttgtttctagtgtcaggtcattttctttcaatgagcctctccttggcattcactgatgcagtttcatacttggtatcaaaagaaaacaatgatgtagctcttcctaaacaagacataattagaaacacctatgatgaatttttaataaactgaattttaaaattttattatttttcaaactgggagtgttttgctatggaataaaaggtatatttctattaagcaagaagcagaccatgttaatctctggacattttctccccaagaacactgttgctgtttttggtttgttttcctttcttttcttcttttagcttgcctgctggctgttaagactagaggtggcagacggtcctgatatactgttgggcagagagtctgctggtttttatttggcatagtaaatgattgaaaacagagtgatattttgttacagttctaataaagccaatacagtgctgattcttacagtgcattaattttaagctccagaaacaagtgccttagtatactgggtactgtaaatatccctggaatatatgaagaaaatcccaagcattaggcaaacatgatagaaatcacatattgcaacttttctgaaagcacataaaggatggggctcgtattttcagggataatctctcgataaaattttcttactcttgatctgttccctccccatccctcatattggtggaataagcaaatcaattaacttctcagtggcaatcactagagagcctgcctcctactaataattcctaccttagtttgttttctaaattaaaatggcatattcactattatttttttgtgtatgatcacaggttagaataattcttccccctgcacacattttcatatctgctagtttttgtcatgggaagcaacagagcagaggaatgctttcttccttgctgtgatacctaattttggaagatgtactaattggacaatgtttgatgtaggagatggttgcatagtccaaaaacacttaataagaatttgctgaataacattctctcttgtggattgggtttttttgtttgtttgttttgcatcttttgatctatctggactatttttcctatcttttgacattccataaagtagaactttacaaatcaaacaataggtaactttttattagggtctttgtttctactccttacccatatcttctcagacttaattttttttttaaagaaatctgaaaagctatcttttagtgaatcttattttctacttactatttttcattaaaggtttttaggttgactcaatttcaagcatacttagtaatacatgggttaatagctgttaaacctttttatttaataacttgaacaaagtagtggtgttcagtgagtatttttaaagataataatctatttctaacttgcctttccacatcaaggagggagcactgatattttattgcccaagaatattccatcagtgtcctggagcctgcctgtctatcttgtttccagcctgtctggcagatttataatggatttatagttacaggattagatctggtatactgggccttccttcctcttttccttttcccaccttccattaactagtgctgttctgtgatagaaattacagactactttggcttttcgtattcatctatattttgaaaagagaaaaaattgtttctaggtttcaagatccatgaagtctgagattctactctacttgccatgagttagcctgccacatttttatatatgtgctaggtaactcaggcacagca

SEQ ID NO: 52451 - DNA, 969 bp, Bovine  19866880512167
aattctgacatctgcataatcatatatagtttacaaagaacatttctttatgctgactcaattctcaaacaaatctatttgatgggcctttatttctattttatagacaaagtaagtaagatccagaaatcttaaatatcttggcctaaaaggataaactgtgcaaccagatacagtatattttacttataccatcatctgggtttttgtaaaataaatgaatccaatggtttctttggttaatatgactacaaggctaagaggatggaggcatataaattaaatatgtgtaagtattacaagataattgaaaccatacatggttctgcagatgaagtgaaactgaaagttgctcagtcatgtccgactctgtgaccccatggactacacagttcatggaattctccaggccagaatactggagtgggtagccgtttccttctccaggggatcttcccaacacaggaattgaactagggtctcctgcattgcaggcagattctttaccaactgagctatcagggaagcccatcagtaaatttatgttagaatttgatagtattattgttaccccttatttgaatttaatttgacattccataaaaacatgatttttacagttgggcttataatataaagggcttggtatctttattttcattctaatcattatccttccactgagacgatttgttcatgaagtgactgacagggctattaaaatccatgagtcatctaatcttaaaaataagatgtataagcattaaaaacactatctccaacaaagcaatatccatttcctctgactgaaaaggttataaaaaccaagagtaattcagtagctagaaagctggggggccgaagcagaacattaatatatttctaaccagtgtctttagcttacaacctgactttcagattatttcagatggagattttatcctttgcatcaagagaattcacaagtga

SEQ ID NO: 52452 - DNA, 1252 bp, Bovine  19866880600144
ccaggactatcaatcatcatgacttatgctccctctggcttattccacctatagttttcagcagagttgcccaggtgtcattcactttcctgaactgcaaaaggaaaaaaaaaaaattatcagggataaaatcttcaaaaagatcttgtttcaacccagtaaaacatcattgccctctgttctttttctttgtagaaatgctcatcaaaattatttaaagaagataacgataaccctgtatgagagacagcaaaagagacacagacgtattgaacagtcttctggtgggagagggcgagggcgggatgatatgggagaatgacattgaaacatgtatattatcatatgtgaaacaaatcgccagtccaggtttgatgcatgatacaggatgctcagcgctggtgcactaggatgacctgaagggataggatggggaggcagatgggagggggttcaggatagggaacacatggacactcatggcagattcaagtcaatgtatgcaaaaccaatacaatattgtaaagtaaaataaataaattaattaaactaaattaaattaaaataaaaaaaagacactaaaaaaaatcatttaaagaaagagaaactttagcaccacatagaaagtatcctatccaaactcaaagtaggtgcctttgtttacacctgttttatatttaaccaaggtatctcagttaactttcaggataaaatttccaaagtaattatttctattttgtagactaaaaactgaggctctggatgattaagcaatttccctcaagatcactcatttagtaactgagtctggttttgaattaaaatttgctcctaactatcaatacacagagcatatgctcattaactgtttactgtgctggtggacaagagatgctatttctctgtgcactagcacataggactggaatcaaatggaatgacccacctttttgagctctgttctgttctctcacgagaacctcatggccttcagaccttgctgtaagagtcagtggatatggcagttctccccttccaaagacaagtaaatagaattatgcaaatcaaattggtaaagtcactgcctctgaaacacacccaaaagccacaaccacccaccaaattgcataaaacagagctgtggctctgagaatacacagtagctccaaatgcactgaaatagaatgcaccagtatagctgttaggatgtcctactgggggaggaaacaagcagttactccctcaaggctga

SEQ ID NO: 52453 - DNA, 983 bp, Bovine  19866880651289
aattaaatgattgccgaattacagagttagcaatattagaaaatctctgttaggtacagatcaataatcatttcgtgacgctcacatgaaaaataaaatatatgaacaaatgtcaaatatcctggttagtaacatattttacaatgcagaagtaaactgacatctactaaataaagaatgactcctggatttaatatgaggttgtcaaatttctcgaactatagtcaaaatattttatttcctttagacagctgaagtgaaactacagctacaaatatttttctaggcctaatttaaagacagagcacctaatttacttaaaaactaatagcaccctgtcacgtagtcctaagtaacatttctaaaagagcagtaattttctaaaaccacagtatttttcttattcatattcaaagatgatgattaattgcatacaggttaaaatttcaatgaagggacaatacaaagatgtagcataaaagtccttaaagcagtctactttttaagttcagcggcactataggctgctttgacactttccctaactttcataagtactattattaacaggttgttatattcattaactcagaatcaaggtacaaacctactttggggaactggcaaactattataactgtagatttctccatctttcagttctactaagaaattatgcttttttcagaatatttaaaattaatttgaaggtcagttacaatcttgcaagaaagttaatatcttaccaaaaacaaagaaatgaaaataaagatttaaattgcaatacaagtagtctttcatttgcatgtcctatctgacagaatacattattaaagaacatgcattggaaaaaaagctttttatttcaaagcttatagaatgaatttaagatttaacctttatgttgttacctatactaaaatcactataaatatgacagttcaaaagtcattttattcaagttttatccaactcattgttta

SEQ ID NO: 52454 - DNA, 2579 bp, Bovine  19866880900630
ctgtttgtcctcaggaatatgattaactcagggaacttctatttcctcatctatataatccaaacattgacatctaccactcaaggttgttgtgagtattaaatgagaaaagcatgtgaagatgtatacaaaaatgcctatgatcatcattaacaacatgtgcacactggggcaagacattctgacaatttggtggtcttacccttcttaagtattcttctgttttctccaaacccgattctaacataggcaaaaatgtgaaatagatttaaatttccttaggaaacaatgtattcattaggaaaatagaaaagattacacacaaaggaatataagtgaaactacaaaaatcactgaggttataaaaatatcagtgttagaaccacagtatctaaggcaggtagttcaaatttaaaactgatggctgattcatgttgatgtatggaagaaatgaactcaatattgtaaagaaattatccttcaattaaaaacacataaatttttaaaaagactaccttgtaaaccaaatagtaaatagtttggtaaatggaatattattcaacaatgtaaaggactgaatacgttacaacatggatgagtctcaaatgtgacttgctaagcaaaagaggacaggcccaaaggctatatactgaatgattcaacttatgtgaaattctggaaaagtaaaaaccaatagggatagaaaacacatcagtgattgccaggagctaaggcccaggggaggcaataggaatgagtctttttttgagatgctgaaactatcttgtatattcaactgtggtggatgcacagctatgtacttgtcaaaaatccatagaagtaaatactgcaaatagtgaattttactgtgagttaagaaacaaaggaccctccaaagattgttttagggacatttaaaagtgctcacaatgaattaataaagtataaagaccatgctgataaaaataattatattgatgaagctttgggtggtgggactggattacaaggttttccccctttctaccaataaaagtaaaggcatcttacaataagcaatacattttttttaaatcaaagagatggaatattgtttttaaaagattctagaagaactctgaatgaacactctaaaaacagattaagcgtggtcactggattagaagtttttaacctgcagttcctagaagccacaaaaccactgaaatagtatgaaaaatattttctgtatgtgcatatatgcatttggagaggaggaaaaccataattttcaacagtccttgagccaccagccagtagtcaacttgcctggaacaactgtacttcttggggctaaactgataataagaacttattatagtaagacaataagacagttatgagctttgagatggttgttaaaaaaaaaaaagccttgaacatgatttaggtttcaactacccagtaataccagtaagacagttctgagctttgagatggttgttaataaaaagccttcatgatttaggtttcaactacccagtaatacctgccagtctctctcttaagaaatgctctaggctgttgagaaacacaaaaatataaaacaaaagtcataaattcaacattttaagggcaagaattcataacattacaataactcaaaaaacagccacagaagatggaatcatacacccttctgccacagggctatgttttccacctctggccaaaactgtcacagccaagaaagaaggaaaaaataaaaaaacaacccatgctggagttaacggagcaaaaaaacactgacaagatgggatttcagagctatgtatgttgattttactacactcttcatggtttcttccatcagttcattatcacttctccaagaggaaattcaagtccagtctgagcttctcagtgacctactggaaaactactctctgcaaggactaaaactggcccacatttggtggaaaatgaatagcaatttcaaaccagaaatgaatggaatgaattcaggttctgacaaacacatactaataaatccacaagaatatgaaaatccattaaccaagtgcatacaaaaaggcaaaaatgctaagtagtggggaaaacatcccttacaagtgtgaaactagaaatcatgatggcatatcttccaaggaaatatgttactttgatatcaacaaatgagatgtcactgattatttccaacccaaaccattttttccttttagcagtttgtagagaagggtctcagccacttctatcttgctctgatagtcagtctcctgaaaacagcaggatcacttgcaatgggctagtttttttaaaaactgtctattaaaaaaagaatacaacaataaaaatttttttctctctctcccattatacctcccaatattatagcagcaatgactcaacgggagaagagacacaaaaagaggattcttaaaattaataagtacttaaacagatgattctacaacaagttaattcttgttaccaaacaacccagcaattccaactctaggtatataggaagagacgaaatttatgttaatacaagcactttcatagaatgttcatagcag

SEQ ID NO: 52455 - DNA, 978 bp, Bovine  19866880908895
tgcaagaaaagcaagacagataccctcatggaaagaccacagagatccagcccactttttggtcagagagagtgaagctgacacttacactatcactatttccaggataaactaatttttagtagtaatgactatcatttttataagcaactgatgtatttgtaagatcttaatttggtggaaaagggagacagtctatgctcaatagaaaataaaagtggacagataacaagaagttatcagacaagattcctaaatattggatgcaaattgtaagaatttgggatgaaaaatcatacatctgcatatatgctcagatatataagatttatacataaagacatggacataaatgtaaaaattatataaactgacagatcaaagacaaagaaaatatttacagacacacagtagagggaacaataaggtgtacctgaacataaggaattaagaattaccagataaggttagcttgtcattttcagtatacatttatatttgtggccaggatgacaccagattcagatctaaagttgaggtacagggataataataatatctcaagtaccaactttggacagccatgaggaacagggagggagcatgaaatgagatttcgcaaggggttgctgtggacatgaatcatatttaccacaagaagatgactactgtttgtgatgctatcaattttatttatataaggtgagaggaagtaaggagtagaagagagaacagaacatagatagttaccttttaaaattcaagtctttttttaaagtttttctgtttaattctggataaaactagagatgtaagtatgagatttccagattttccagaaactacagtgaaaactgaatgtgattatttctcgtgtgaagactatataatgtgaggttttttttccatttagaatttgtatatttcagtagctaagtggaagcagccacaaatgtagacttctgtctagaaattctt

SEQ ID NO: 52456 - DNA, 1229 bp, Bovine  19866880971788
aaaatgatgaaaaatcatattcttatttcatactgtatatcaaaatcaattccagggttaattaatgatttaatgtctcattaacttaatataattattaaagtatagtttccatgtaaaaacaaaattttaaaagctccagaagaacacaagataatctcagagaacataccgccatgtctgtcttcacagtgcaatcccagcaatccatccccttaaaacccagttgttatatttgagtgaattgaattgaaaaccagttcttaaaaggaataagagccacattccataaaatgcctgtgaatatacaaatagagtattgccacagagtctttggggaaatacggcattgcctgtagtagtaagagcttaaataaacttgggaaagagacacactcagttccccacctgagagaagtcaagggtttcctgctagcagaatgagccctcagtcaaaatccacaggacagttcctgccctctcctgcagcaaagagctcctccattcaccacatctgtcatgcacagcacctgcccagctgagttgtagcaaatgtacttcccatcctgctccctggcaagcctccaaaagtgttgcttttggtgactccatctgccagtagatgtagagtatgtcacacagacaaaattgcccatggctcactacaaagagcaggcaaatactttatggatgacctggtacaaagcttcaagtggtgtggcaaagcagtgggccaaagagaagcagcagctgcagtcagaccagctctgcagtaagctattaggattccagaagctccttttgagcaaaggaatctgtccaatcgaggttgaagcaaccttagcaacagtggcaggctttgttcaagacttgctatatccaataagcaaaggtgagctctaggtggtgtcaagagggaaggatcacaagtcccaaatccacaagcaaaagatcatcatcaattagtgctaacaacctgaaaatgaaaaactatacaaaaaatatctgtgcaggtgtctaaaggcagtgagggtctgctttgtctgaaatgtgaagcttcttcaagaggaaactctgctgaaaatgtccccaaaataccaaagtgctctcattcaatgtttagctcaccttttctttaaaaaaaaaaaaaacaagtagattttgtttgtttgttcggctgcactggggtcttaattacagcatgtagaatcttactgcagcatacaaga

SEQ ID NO: 52457 - DNA, 880 bp, Bovine  19866881083624
ctttcctgacttccagctgagagctggtctattctcacagtaaatgccatacttatgcataaatttaaagttggaaccctttgtctatgcagacagaggaattcacagaacaattactgtgggaagtgactgttcacaatttgctgggaaacagctttgctgacttgtgtgcactgcaagataatttagctctgaagaacagggaataataaccaagtcctttcttgaggacccctgtaataaatgaaagcacaaccacagcagctgactatatgagttcagaaaatgccacccctacgggcagtttttagtcattgagaagctgatgtataagccttgccagtgtgctgtttcccactcttttcctttttactgtaggcacacagagctcatccatccctttacctgtgcagttgagggtttgggcgggatcctgtcagacattcagcccacttccctcccacttttatggctaatgcattttaggtgcaggcgaatgtctttgagctaattcatagtaaaggatgaaaattagtcactagaaggctgaaaaaaagaatttctccagaataagttttttccctgtgataaataacaacactttttttgagttatacttaaatttaaaaaataataaaatattttgatctttgaaaaatctgttacctttatctagagagttgatgccctttagatagggaattaaggtacatcacttagaaggccagctttgtctctaatgacctctgtagcctcaaataagtcttcctaatgatgagtaggggttagtttcctcatctatgtgtagctgacagggtggcccttggctcagcttaagcatagattgggctgggtgtcctagcagcccaagctcatcttc

SEQ ID NO: 52458 - DNA, 1405 bp, Bovine  19866881104912
tgtatgcgtcccttacatattttgaatattaacccattatcagatacatagtttgcaaaaattttctcctgttccataggttgcatttttacagaggttgtttcttctgctatacagagattttaatttgatgcagttccacctgcctatttttctttttgttatctatgcttatgttatcatatctaaaaatcattaacatgagctagtctttgttttctggaaagcagaataaactgagtttcatactatctgaattctcctttgaaatcttatgtcactcaacaaatataaagagaaacagtttgtggggaattagtggagcagaggcagtgcctacattccagaagtcaaaaccggaagacaggcacctagagcatttctgggcacagttcatggtcaggtcccacagtgttgattgctattgcttcttgcctttctgactgaagggaggacacaaaccttcctaaaatgtacactagtcatcctccaactcctagacagtttctttctctgttcagtataatactctgctcagggacttcatcaacccatctcttctccagatcctttgtgaaaatggtctttttatctgagcattgggtgagggattacaatgaccaagtttgttgtaatggcatgtgcatgactatattgtgtattgttacactgcattagagtacagtgatgactctatttgaaccaagggacattttctggaatctctgctgtgatatttgagaatattactatgctgtatatggatttgcctcaagaactgcagttaaaaaagaaaaacaacacaaaccttccaataaatgtaataattccgaagtggaaggatgcaattctgaatcttcctttctttcacttccaaacatgtgcccataagaattactcagaagcactgaaaatataaattgtgagacaaaccaagtttaattgaatgcaatctcttttggtggatatgggtcaaaccaatcctcttaacctcatttcatcagattgcaaagagcctcctacttcttactgtatacttcagttctgatggttatatggataaaatacacaaactgagattatcttaaaagaatttcagaagctcccaggatattggcagaggcagtaatgatgtaaaatccctgctgaatggttagcaatattcattctgtgttacttcttctcatgtagcctttatcttttgggccagctgcagaggaatggtttggcagctgggtttttggctgaggaatttaggttatatgtttatattatttattggtgacctctggacctcagcaatcaacatcttcacaacttttgccagagagattgtgcccctaaaggttctcagtaaatggttattcttatttctttcttctttccttcggtatctcccctgcag

SEQ ID NO: 52459 - DNA, 1628 bp, Bovine  19866881116579
ctgtctaggtttggtatagtttttcttccaggagcaagtgtcttttaatttctggctgccaacaccacgtgcagtgattttggagcccaagaaaattagtgaaatggaaatcaaaattacaatgaagtatcatctcacattggtcagaatggccatcatcaaaaatctaaaacaataaacattggggagggtatggagaaaaaggaaccctcttgcactgttgatgggaatgcaaattgatacagtcactatagagaatggcatggagatttatttaaaaactagtgataaaactatcatatgacccagaaatcccactactaggcatataccctcaggaaaccataattgaaaaagacacatgtactccaatgctcatcccagcactacttacaatagctaggacatggaagtaacctagatggacattgacagatgaatggataaggaagttatggtatatatacacaatggagtattaataagctataaaaaggaacacatttgaatcagttctaatgaggcagatcaacctataacgtattatacagactgaagcaagtcacgaagagaacgacaaatgtcatatacttaagcatatatatggaatatagaaaggtggtactgatgatcttacttgcatgacagcaaaggagagacagacagaaagaacagacttttggacacattgggggaagaagagtgtgggacaatttgagagaataacattgaaacatatacattactagataatagataaaatagatagctagtgggaatttgctgtatgatgcagggaacccaaatccagtgctctgtgacaatctagaggggttaggtggggaaggaaatgggaggggtttcaagagggaggggacatatgtatacttctggccaattcatgttgatgtttgacagaaatgatcacaatattgtaagtaatcatcctttaattaaaatttaaaaaattaaaaagaaaaagaaaacccaaaactcttttctcaaatttttgaacacaactctgcagattcaaactttactatgttatagctttaatttattgcctgagagtctatgaattaaaataaaactccatccctgacagcaaattagaaaatgatggaattaagtttaaaaggcctcttcctaaatttaaagaccagatcagagtgagttttccgatatgcagttttgataagacattatcaggctaggagataaaggctgtcttcattgccaaaaataaatctctctcttccttttattcatcaagcttctattaaaatttggttaagtatcaggctaggtgctagatgctgagattaataaacacaagtaaactgagttgtatttcttttcaaagagctgctaatatctctcatgaaagaaacaggtacaattctaaagaaggccattaataatcaaataaatttatctctatcgtttttagagattcatttcacacttaggagcagaggagcatttttgatatataatttattcatgattttaaggaatctttaagctattaaaactgcatgtccaatagcacacttgacaccaaagaataaactgtggcaaattcttttgagttggtaacattctttacccattctttgctgggaata

SEQ ID NO: 52460 - DNA, 2595 bp, Bovine  19866881228622
tcataatgaacataaatattatttcaatgctctgtagtactctaatatgatatgaaatatctatgatttctattaaaggcaaagatagttattgctcaaactactgtgatttgttccttacattttataatgaaaggaaatctcataattagaaatttatgaaaataaacacataatttttatccctatccaagtccatgaataagaaagtgttagccactcagttgtgtctgactctgtgattccttagattgtagtctgccaggttcctctgtccatggaattctataggcaagaatactatagtgggtcatcattcccttctccagggggtcttcctgactttgagattgaacccaggtctcttaaattgtaggtgaattctttacaatctgaaccatcagggaagactcaatattcaaaaaactaatatcatggcatccagttccatcacctcatggcaaatagattgggaaaaagaggaagcagtgacatagttcattttcttggcctccaaaactgtggacagtgactgcagccatgaaattaaaaggtgcttgttccttgggagaaaacttgtgacaaacctagacagcatgttaaaaagcagaatcactttgctgacaatggtccatatagtcaaagctatggtggcatcactgactcggtggatgtgagtctgagtgaactccaggagttggtgatggacagggaggcctggcgtgctgagattcatggggtcacaaagagttggacacgactgagcgactgaactgaactgaactgatggtttttaccagtagtcacttacggatgggagagttggaccataaagaaggctgaatgctgaagaattgatgcttttaaactgtggggctggagaagactcttgagagtcccctgggcagcaaggggatgaaaccagtcaattctaaaggaaatcagccctgaatattcattggaaggactgatgctgaagttgaaggtgtgataactggccacctgatgcagagtttactcattggaaaagaaaagaaaagaccctgatgttgggaaagattgagggcaggaggagaaaggcacaacagaagatgaaatggttggatggcatcactgactcaatggacatgaatttgagcaaagtccaggagatagtgaaagacagggaagcctggtatgctgcagtacatgagatcacaaaaagttagacatgacttagtgactgaagaacgacaagtccatgaatattttgacttctgtcatgaatgcttggagaacccacagacccaggtttagaacccctggaaagaactgacttcttatttctttctggctagtctcagaactctaggcttttgattttggcactttcttcccaattacccctggattctgccttacaggtcatgactgacctaaatgtagtttaaacctcatttttctttcccccctctataaagattctcttactttcatagagataaacaatatgtttcaaattttactctttttacttctgtaggagccatttgtattatattagaagaactctttttattataaagatgtggtatcattggccacacagtgaagagtagaattataggtttctcctcttttataagatcttagaagacagaaatctttttgttgttgttgaacccacaacaatggagaaaatgtttacatgtaatggatactacatgtaaatatttgttgaatgggtaaataaatgcatggactgtgggacttaaagatcacctctgacttctcacttcccagggccaactctgaactattcaaagaattttatagtttcaaggggtgaagatgcaattcttctgtgaatgcagtctgacctatgttcacagtgaattttctaactacaggtctctatatatagagataatgagtgaagcatataccagggagctatatatagatttatctagctccagagagcaagggatattagaacagagctcttacacaactaaaaaaagattacaccactttctacatttttaattgctctaataaaatcatttttttaagaagaaacattttacaagattgtctcaactttaagtaccactcttccatctgaagatatgttagttttcatttttgtttaatatcttaacctcaagggcaaaatctgccagactctaacgactgctgcttcctcctaagcttctgccaaatggaagataactgactataaatcaaacttcgggacaactttagtagaaacctaacagtttccccaactgtcattatttcaagctactataaagaacaagcaaaaacacccagatgtgttagtgacatttttctgttatgaaagattaaaattgagttctttctatgtttggttcccactgtaattagtctttcctttataaaacatcattgctctattactcctctgctatttgttagtagcaaattatgtattacttttagcatttcattcaccttttatctactaaaatgtggtactgaataagaaaaggacattttgttcagaatgttcagtgttctagaatgctgtctatagaaagatgaaaaagggagtgcaaaggagaaaccaca

SEQ ID NO: 52461 - DNA, 673 bp, Bovine  19866881275567
gtgaggtttttccacagcaatagaattcatatccccccgtcctgcagaagactatgtcatttacataacacattcaacccagttggcactgttgtcacctgtcattcaattaggtatttaggctatgtcctactctagtcataatgaaatcactatgaaaattaatagagaaatgcattctacttgggcagacattgtcttttaagttataacatctccattgttattattaattgtttttgtgtgaaaatatcatgtgattggaccaaattatgaatcagtcctctgtcaaattaaattcttaaaatcaccatcactattgggttatgctaatgtgaaacagaagcaatcaaacctagcaaacattagaacatgcctaaccagtagagaaacagaatgatttttttaaatttaaatttatttattttaattagaggctaattactttacaatattgtattggttttgccatacatcaacatgaatccgccacgagtgtacacgtgttcccaatcctgaacccacctcccacctccctccccataccatccctctgggtcatcccagttcaccagccccaagcatcctgtatcctgcatcaaaccaccactcctttatcatcccctcgataagtgctttggtatgtgcatgcatacatatatatgtgcacaca

SEQ ID NO: 52462 - DNA, 1356 bp, Bovine  19866881506388
taccacaaacagcaagtgctacattttggactcaaatgcacatccacctggatccaatatcctgttgacaaagtctccaggatatgttctcctgtgtccagtatatcatttatcattattagattttcattttaagcatcttctgttttgatacaataatatgttgtcaaaatccatttccccttttgatatcaaaaagaagtatctctgtgttgtgtgatagcatcaataaatacttctgttgaactgatgccagtgaagactgattccccaggtcccaggatgttcaattattgtgtccaggtgctgagatgacaagttttatttacatatcccttatttgtttccatgcttggtttggttctctttgctctgcatctgtccttggggggcatttttgcttaatggaagaacaagatcaataaacaagactattttattagcctcaacaaatagcagaataactggcctgatggtaacatttttgtagatctgttattaggactttggtgttctgcattttataacaatcatttctcagagaaagtagactgagatataaaaagagagtactagtgacatataaaccccatatattgccatgcttgaaatcaagcatcacccctatctggataaaatcttttattctctctctcttaaggttgttcaaatatagacacaattactgtttcacattgttgattcaatttgctatgaggaggtttgttagttatacttcttattcttcatgacaaataacttgttaagtattataaagcatagattaattctcacctttagtctaaatgccctatgtttgcattgattcagaagtttagaaagctgcctatccttctacaaagtaatcttcatttcaaaattattcatatacaatactgtactctgatattagcatttagtataggtaattataataaagagcctgtgttagtttcctatgaccgatataacaaattaccacaaatttactgactgaaaaccacatgaattcactcccacatgggtctcgaggtcagacttcagacattatatcattgggctaaagtcaaggtgttggcaaggcagggtgtctccagtagagattccttttccagcttctagaggcatattccttgttttccttagtttatggcaacttccttcatcttaaaagtcagaaacatcctctcttcaaatctctctccttgcttgtatcacatcatcttctccagaagcagtacctccctctgcctacctcttacataaatacttgtaactatatttatggcccacccagataattctagataatctctccacatcaagatctttaagttaagatcttttgcatataag

SEQ ID NO: 52463 - DNA, 1399 bp, Bovine  19866881709695
cacagcaattgtctgcttaggaaaagcctcaggattccttggaacatatccctaagggggaaaaagtgacttgatctatatgaaactgtaaaagaaatcctattccaataggtaaacaactactttttgaggcaaatcagatttattttctctattctacagatgagaaaggaggtactcaaagaggctaaatttcttcctccatgttaaaaagcaactctgtgtcattccaatttttgtaacttaaaaaacacacaaccatatgtgaatttcatatagttcagcctaacagaaaacccaagcttgcatgcagggattctgtctcccactccagagtccaatttgatacatcactgtttcttacttggatcctcaatgattacttcaagtgtgtttatttaaaggtcacttaaatatgtacaaacataaagctaagcataaacctctgagttatgtagctttattaaactacatgagcaacaattaaaggaaacattcaattaaatagtgttttcccttacagtactaagaaataaaaacactctttaaaatttttttcatttcatattaccactacacttaatggtcctgaactcttgaaagcatctatgtaagaagatggaatttatgtaacacaactgctgttttatgaagacatgcactttatagcatttgctatgtgatgactcagttcaattctaccacttgtctctatttgtacaacttgtaaaactctacctcacttaaacaataagcttccacttggattgaacctatcattgatgattatatttgctccccatgttttttttctctcattggcctataacaatttaagaatttagttcataactcctctgcagcacataattttcatacaaacaaatgagggtcttaatggattgacttttctatgaaaccaaagttgtttttctatgaaatgtcttttaattttgaattatcattccataaaaagaagtttgactctggtaaaagcattaagcatgagtttaattgaatgggctatttgaacatgagcttgaacacatagctatttgggctatttgaacacagctctgcctgcagtggcaatggtgagcagaggtaattttcagacttggcaattaactctaatatttagggacatggaattttaaacctatgcagggacactgaaaaggatgtatctctgtgaaaggactagaaaaaacttccccactgtctcagggagactcaaagggaattgtcaatgcctaggtctttaggttggataaggcaatggcatcccactccagtactcttgtctggaaaatcccatggatggaggagcctggtgggctgcagtccatgggatcgcgaagagtcggacacgactgagcgccttcacttttacttttca

SEQ ID NO: 52464 - DNA, 483 bp, Bovine  19866881731338
tgcggagcagcgaggcggcgcgcaagcccgggccggggcaggggcgggggccgaagccacggccagaggtgcctgcgcaggccgccagggctgtcctacccgctcgcgcctggccacccggccgccccgagtttcagtcgccctgcgtcccttacctggggccgccagctggctgcaaggagggagccccgccgcgcggctgcagtgtcggctgcagaaggcgcggagtgaaggggccagaaaccgagccgcgctgccgccgccgctgccgctttggggagctcagctcgcagcctattgccagagaggccggtgacgtcaggcagccaccgccagggctccaagccacccttcaggcccccaccccaccctcataccccaacacctcgtcctggcaaagccaggctctgccacacaggttctcagttccctgctgtttccctgcccaggcgctggggagtaatccccagctccaccctgtaa

SEQ ID NO: 52465 - DNA, 1664 bp, Bovine  19866880399500
ttacatgaaatccgattttaccccgaactcctgggaacctcagagacaaacgagagcaggagagttcaagggatggcaaaggacctgtagaattaagcctgtcctcctcctgacaggagtattctcttggtccccagcaaagtgtccttacaacgccttggcttactcttgagtttctgccccccgcacccgactcctgtgtggtttgaagggaccaggcaaaccccaccccacccaccccccagtcctaaaaagggcagtttattcacagaaagagtatggactttcaaattagattagagctaatatataatcaaatatgtattctctttttatgttctcctttgtcctaaatcctgtccatcctcaagtttctgaatatcagtcaagtcaccagttgactacaaatcagtgaaacttgagattaaaattctgtctgtggtcacccaggcagctccactcaagaaataaaagtttgcttccacaaaccctccactgagagtcaggaatatacagtcttcccctcaaatgctgagcttgcagagaccatggctgccctacacatccccaacccgtagtagtaagtccagacaaggtcttgggggaccctgaaatgacagattctgcagtgccttctttggagaaagtcacatctttaaaaaaaaaatgcccatgctcactttgttctggcacttgtagatacacactatgtctcatcctccccgttacaacattcccagggttaaacctgtgggaggggaattgtcctcaccttgtccttagagggtggaaatgagaatgtaacatagccctcattcccaatgggaggaaatgtgtgataaaagacagtatcctaagatcacaccccagcccaagggtccctcagagcctgctccccagagtggtggctccagggagcagctgccctgcacttacttggtgagtctctgccctcagcccctggggtgctcagcatcaccagggtcaccatcacaactgctgtccagaggcctctggggatccacagagcccaccatcccagacataattgagaacaaaggaagaactaatggtagtcaacacagctcaaacacagtggatctggtgagaccacttcacagaataaaagcctatgagagcttccatgtatggcaggattggagagtccctagaaaagggaccaatcagcagtggagtggaaaaacttcatctgtttctgggtagacatttttttttgaaggtccttaatctaatgcctggcactgtgtcctaatcaaattacactggattgagatgaaaatgttctcccagttatacaatatctgaatattgaatgccttaggagtttaaataatgaaaaaaaaaagattcaagagtagatatttctgtgatatttatttaaaacctattgttcttagaatttggggtatgggaaaataaaagtgaaagtgttaattaatgagttgtgttccactctttgcaaccccatggactgtagccctccaggatcctctgtctatggaattctcaaggcaagaatactgaaatggtttgtcattcccttctccagaggatcctcatgacccaggaatcaaacccaggtctcctgcattgcaagaggattattcctttgctgtggagccacaagggaaaataagggggat

SEQ ID NO: 52466 - DNA, 912 bp, Bovine  19866880499519
caaagtccagccaggtggcccatcgaggtgcttgtcagccatgcctacagttcggagctttgccaatgaagagggtgaggcccagaagttcaggcaaaagctgcatgagatgatggtgctcaaccggaaggaggccctggcctacgcggtcaacgtctggaccttccagtgtgagcacctgggcatgaatgcctatcccctgatatcccctatcaccattccccttccgctgaccctgctccgcactcttccttcactgggcaggggtgggttcagtgtctgtatcctagcaaccaggggctgggtgacctagtgttctgaaccccctccttctttctaggcatgctacatggcttcttttccccatggtgcacagaatctccatgaccccctttgtaggaaagcaccatgtcttccagtcccaggacttctccttgcctcatggggcagcatggggaatggcaggtagcttttgttgggcagcttcatgctgggactatgcagatgaacttgtgagagacaagggactagcagaagccaaggaggaggggcatcttgtgatgtaattgaccgagaattagaccagtgatcagaagttcctgccttgatgctaccacttgttagctctgtagccatgggctattaatagtaacttactttctctgagacttattttttcttattttaaaagatgagagtgctataaccttgtttataagattcttgatatgaaaattagatgacatcacgttcatgaaagcctcttgtgaagagcagaatgctccccaaacaaggcattcctggtgatggtgatgatggtagttgacttgtattctgtgcgcctgagtgatcacactacgggatgctgtgattcatcctttaatccccgttgagccccatgtgttacttggt

SEQ ID NO: 52467 - DNA, 736 bp, Bovine  19866880518392
tattttcctttcgacctgtcacccgatctgttactctcaagctttccattttctaccaattggcgttttaaactgctcccttctaggtttttcccctcctaaaaataaggaaagaaagaaaataaccttaatcaataccatatccccttgtggactctcttatgtacttgtcagctccccttcccagtcaagacctgaaattgtgttattttcctctctctgcctcatttcccattctttagcccatttcttccactactgacactgtcttggcaaatgtcaccaaggaccttctaattggcaaaatcaggaagcacttttcagctttcaccttatttgacctcactgaagtatttaacatttgatcaggcttccttcctgaaattctccgcacccttaatttctgtgactacttctcacttgtttcttttcctgcttgtcctgctgttcctttggtgtcctttgtggactcttctttaacctgtgttgatgtttgcccagattttgcctcagtttgcttctaattgtgtttatctttcctaagtaatctcactcagtggctcacagcctctcaaatctgtatctttatttcagtcaactcaactgagcaaaactcagtacttaattttaccacttagatagccctgacacttaaacacgttcaaaacagtgtaaactatatgcagcctagacctgctccttctattagtgtattatcctggctgatagcagtaat

SEQ ID NO: 52468 - DNA, 1700 bp, Bovine  19866880697829
ctggtaggctacagtcccggggtcacaaagagtcggacacgactgaacacttgtgtgtgtctgagtgtaggatacggtactgttgtctatggcttagatcatgaccattcctccatccacgtgaagactgggaaacccattaggcccttcacaagtcaacaggatggcctgggaattacacaaaggtctcttctgtgggagacagtagccctgtgctaggacttcccaggtggtgctagcagtaaagaacctgcctgccaacgagggaggtgggttcgactcctgggtcgggaagatcccctggaggaggaaatggcaacccactctagtactcctgcctggagaatcccatgaacagaggaacctggtaggctacagtccatagggtcgcaaataattgaacatgactgaatggacttagcatgcacgcacacaactctgtgccaggatgcatggcttggttagcaaaatgcaagctgaatttgagccacaacttacctccttggctgggtgctttggggcacaaaaatacagtcagtgctgcgactctgtcaactgaatttgtcactttagatcctagaaccttttacttgttatagctttagatggttgatgtttttatggactgggaaagtttggagagattctgtaatttcttttttgcccctattgggaggcagagcctaagtgacagacacaagaggggttgtaaacccacccactgcccccctcctccctggagcagggcttgctgttttctttttttttttttttaatatttatttatttggctgtgttgggttttagttgaggtaagcagaatcttcattaggttatgcaggatctttcgttgcggcaaatggattctctagttgtggcacaaaggcacctaaactattgctcagtagctgcagtgcacaggcttagttgcttctcagctgtgggaccttcgtttctcaaccaggagtccagccgaagtcccctgcatcgcaaggtggattcttaaccactggaccaccaaggaagtcccttgctgttttctaagctaaaggggatcccacctccctgaaccccaccctgtctcttttgcagctcctgctccagggtggagggatgagctacaaaaccacacgttcctgcacacaatgtactgccaggactggagccccaacgtggcgctctctgagtcctacgacgaggaccagcttttctccttcgacttttcccagagcatccgagtgcctcgcttgcctgaatttgctgactgggctcaccagcacggagatacttctgacattatgtttgacaaaggtttttgccgggccatgatcgaggaaattggcccagaacttgaagggcaaatcccagtgtctagaggtcagggcatttttctgtaggggtggggaggggagctgccctcttaacctcattatacactgaatttttccctttcacaccaattccccatctctcatgctttctggttctccccttgaaccttgatttttctaccacccatggtctgcactctgtttttgttgtgggcagaagaaaagcccctggggtgtagtaattcaaaattatggaacttgataaatttagcggggaccaactgatgccttctgactgttagcacttgtgctgtgattgatgctcagcaagatggaaggggagaatggaagtatctgatgatgtgtctg

SEQ ID NO: 52469 - DNA, 821 bp, Bovine  19866880942228
ccagagtctgtacttttttgtatattctttttttctgtattcggggatgggttagtgctttaggtacaaaaaaaaacaatagacctgtgctgacgtacttgtatttatttttcaaagcccaactgagattaatataaaatatctgttgtgtaaagaagctctgctcccctgaggagcacacatgtgtcctgtagcccatctctgactcactcatttgccttaatggaaacagttgttcaggcaagaaatccagatcactggattaagtagaatgtgttgaggtaatgcgttcccccaagtgataattttcttttgctcagactccccaaaaaggccacaaagacagccccacctgccctgcctgctggctacgactcagaggaggaggaagaaagcaggcccatgagttacgatgagaagcggcagttgagcctggacatcaacaagttgcccggggagaaactgggtcgcgttgtgcacataatccaagccagggagccctctttacgtgactcaaacccagaagaaattgagatagattttgaaacactcaagccgtccacacttagagagcttgaacgttacgttctttcctgcctgcgaaagaaacctcggaagccgtatagtgagtatgaaatgagattcccaagttgccttagcgagttcttgtgcggttctgaggacaatttagagaaggaggtgggggggtatgcttgatgcacttggaatcatcagttcctgggatgatgggttgcattagttgcttccttaagttcaagaaaggcattggcaacaacaggggacagggaaaccggagtgct

SEQ ID NO: 52470 - DNA, 1081 bp, Bovine  19866881229423
aatgcatcaagtttacgttctctctggggctcctcaggaccaggtgttacccaaggcccaagatctcattgtttacatcccagagcttagctccacctttctaccctgaaggaaactctcaatggtacctctcatatacacacacacaaacgacaagaaatccaatcttctgcaacacaacacactcctctcaacacaaaaccaaaccactcacggaaaagggacctatccccgacattaggaacccagagtaagagtgggccttgtaccctactcagggaatccccgttttcagtccccaaagctctatcaccatggcaaccctgtaaagcacaagatgtggccacgaaccccagccactgaaggccggacaaacggtcgcttagacaccagacccactaccctcaggacctgctgccccatccaagtcctcccccgttgcatattccgccgccacctcgctctgcccgactcagccaaaatctgaccacagcggaaaagtaacgtgtaaattgcctgcgctccctccatacgtaggatctgcggccgctaccacagtccccaaaccgccgctcacccccctccgcgagcctcgacagccaacagttgcgccacgaaacagcaacgcgcccgagtcggttccgcactccctccgaactcggcacctcacccgcgcgcgccgcggccccccaacgcccccttcccacacgcggctcgcagggacgtacttgttgtggggagtcacgttttgcagcatcttgaccacggggaaccggcgctgccctcagccgcggaaagtccgggtggcctcggttccccttacctcccggtccagcataacccgggaagtggggggagggcgggggccgctgccctcggccctccaggcgacaaccctaccccgccgggctggcacgaaagcaatctcctccgctgtccctcggagaactcccagcagcttggcgcgctccgcaggaggcggacagcgagaaaatggcggcggcctcagctgaggcgggcgagcgaaaggggacgggctcttcaaaccccaggacggcccccgtatcccagacaccgtcgc

SEQ ID NO: 52471 - DNA, 1055 bp, Bovine  19866881767994
ggcaattaagaccatgtgctctagaggctgtgctgtgtaacaagagacgccaccgcaaagacaagtccacacaccataaatagagtagcccctgcttgttgcgactagagaaagtccgcatgtagcagtaaagatgcagcacagccaaaatacacacataaataaacaaaaagccgccccaaactcaagaatagtccagatttccaaggagaatgggagtggatgctcttagggagaaggttctcctgtaaggcatcaccgaagcagaggctgtgtctccagtcttctgtatttcctttttctttccaactgtgcttttgaatatgattttttcttttttccccacagtgtctgagatccagcatgtggctcttggtgcttaagttctgcctttgtctttgtttcatctttcatctctactccacggggagcaatctatgtctgtgggaagggaggagctgctgtatttcccccgcttttctcctttcttctctgggggaagacatagacgagacaccataatgagtggatgatacctggtcttaaggttaggggcctctggctctcttttagtgtgtggttctctggcttccaggggctgaccttcacccttcgtcctggtgaggtgacggcgctggtggggcccaacgggtctgggaagagcacggtggccgcgctgctgcagaacctgtaccagcccaccgagggccaggtgctgctggatggggagcccctccccaaatacgagcaccgctacctgcacagacaggtgagcaagaagatggcatgggggagggcagggagcctcaagtcaggagagccttctctgcgggcactctgagcggaagttaggagaccctgggggagaggtgggcgtgtggtcagcagagaggccgtgtcactctgtgacaggctgtcagtggagatgctcagccttcagtctctagatgaccacactcctatgttcctcgttctatgactctgcactgtattttgtcctaggtggctgctgtgggacaagagcctctgctgttggaagaagctttaaagaaaat

SEQ ID NO: 52472 - DNA, 1022 bp, Bovine  19866881936410
gttttttttattttttatgtctgtgagtctgtttctgttttgtgtatagattcacttgtattttttttttttacatggcacatataaacaatatcatataatatttgtctttctctgtcttacttcacttagcgtgaagggactggagtgggctgtgggggttgtctgtcttctgccaaattggcccgctccatcgttggccccactgttccaggcagtcctttgggagatccaggacgctgcggcgaaagctgggcaggtggttcgggagtcggttggagggctgcagaccgtgcgcagttttggagccgaagaggaagaggtctgtcgctataaggaggcccttgaacgatgccggcggctgtggtggcgacgggacctggaacaggccctctatctgctcttaaggagggtgaggaagctgagggctggaggaggggcacaggtgggggctggtcttgggggtccttggggttcccgatgcctttgccagtgccatctttttcgtgtgtctcttctctgttggaaggtaggtgatgagcgatttgttagcccctagttttttcaggggacctcactctcctgttttcaatcccctttgtgcacaaagcacaaaatacttaaacaaagaaaagtctgcgtttgttcattcaccgttctgtgtcaagcatccatccatttactccttcattcgccacctggctccaacatcttcaaagtttatattacttattatagttacagagtcgagtgaatgtggtataacaggtgtttttgtgtcggatggaatgtctcctcctaggggcagggaggccaaagagtggaaggtcctcaggctctcctttcttctccctccagatgctgcacttggcaatgaaggtgctcttgctgaactgtgcgttgcagcagatcctggccggggacctcacccgtggcgggctcctctccttcctgctttaccaggaggacgtgggtgaccacatgcaggtgagtcgggagctgtgcgtgctctcattttcctc

SEQ ID NO: 52473 - DNA, 722 bp, Bovine  19866881946086
ttagggaagaagggtcaggatgaacaaacattgccccccaccctgacaataggctaactgtggaaacaaacatgagccgggaggtcagatcagaaaagagaaacggaacttcacggagataaaaatgctcacaggcaactgagagacattccactcaacacaaaaacacctattgtattacactcactcatatctgaactataataagcaatataaactttgaagatgttggagccaggcggcgaatggagtaaatggatggatgcttgatatagacggtgaatgaactcatacaggctttttcttcatttaagagttttgtgctttgtgcacaaaggggattgaaaacagcaaagtgaggtcccctgtaaaaactgggggctaacaaatcgctcatcacctacctcccaacagagaagagacacacgaaaaagatggcactggcaaaggcatcaggatcaaagtcgccccccaggatgtcaatcacacggccaaaatagtaagggatcacggtctcacctgcaacagccaggagggcccagtcagagtgcggctgctgaagggcctcctcccaacccccaagtccctgcgccctctccccactcacccaacacggccagggagaggaaggagaaggcggcaaccaggaaaggcaggtcaggccaggacagcttcagcagcctccacatcaagactctgttctcctggccctgcccctccgc

SEQ ID NO: 52474 - DNA, 1128 bp, Bovine  19866880286517
tcctgttcttaaatcccatccctttctaaatggttgaaataggcaatcttatgtttatgctgctgctgctgctaagtcacttcagtcgtgtccgactctgtgcgaccccatagacggcagcccaccaggctcccctgtccctgggattctccaggcaagaacactggagtgggttgccatttccttctccagtgcatgaaagtgaaaagtgaaagtgaaggtgctcagttgtgtccgactcttttcgaccccatggactgcagcccaccaggctcctctgtccatgggattttccaggcaagagtactggagtggggtgcttcttgcaaaaaagattccaccctctcctaatgtttgaggtcttctgagtcagttgtgctctgcatttggtctctagaaaagcagcatcagcatcactggaaacttgttagatattcacattccagagcccacctcagatcagaaagctctgagcagaaacctgggagttgggcccagcaatctgcattgaacaggctccacaggtgatgccgatgcacatggaagtttgagaactgctgttcttagtaggaaaaaaaatcacatgtgacctccttaaatcatggccttggaattttccagaggggcttggaaccattgcttggagtttggctgtggtatatgagtgaggagaactgttgatggcagtcatgcatagttgggtgggcttcaggtggagtgaattaaacttcttctctttcagccataaatgaagaccaaatgctcgtcattgggtttgatattagtacattcctgagctgttcatcgagttccaagaaaaggtaatgttagatttcctgttgaactatcagtaactgatgtttgcagaatgctccgctgttcttcacctgtgtaaactcacgggactgttatcatgtgcctttggattagtgagtcctctgcggccgttctggacatgaaagatggagactcaggggaaggctgggagcagtgtctctgggccccatgcagttctgacattctcaccaatcattcagcctcctctagttcaccaagagcacacaactaacagagctggtgtttgaagccctgccttctagtttagatctttttggaggcattgttaga

SEQ ID NO: 52475 - DNA, 973 bp, Bovine  19866880344573
tgctgacattttgtagattaggaaataaggcacaaagtcatttacccagacatcagcaactaagtgatggggctgagactggaatatggacaatctgatcctagtggtcacactccttgatgatacacgaagtcactaaactgaagagtaacttttacattagagatctcatttcccacatctccaggtgttatttctgatttacattaacaagacatgttggagccttggatttatgttgtcaataaacaaactttattaataattccttttaatagatattgagatgaaattcaatgtctaattgaattcatgccatatacacaaactcttgttttagattttctattggcaaacatcctgttcaatagtccttgggggttctgagtacattcacaaaatgaaatcccaattattgctgccaacaaatgagtacataagtttttcaaactaggtgggtgaaactgcttgaaaaacacaacttaaaaaaaaaaaatgtactcattaacaataggcaaatcgagttaaatcaaccactaaacaggttttaagtgagatttctcccccaaacttggaaataaaggaaatcagccctcagaatttacttttgcgattaatggatcacagagaacagggtaagtcacttttgagagaccagaattactcctagccacacaaccttccaatgtatcttgcttatttagcaagctaccttatgaaacttcaaccagaacacatactggtaaatgaacagaagaggagtcatagaagcaaaaggtggctgtgcccaaattaacattgcaaaataaaaaatggatgcatagtatcagacctaaaatgcttggaatacagatgtttcagaggcaaacttctcttaccaagacaaacttctgactatttggcttacatttgttggtttacaggaaaaaaaatgtcaggttatcaatatagttggaatcctcaaattaatgca

SEQ ID NO: 52476 - DNA, 1631 bp, Bovine  19866880347692
tgcctaatacataaaagacacttaacaattatttgttgaatgaatgattttaagaggcagtgttgcataatagcaaaattcagactttacattagaccaatcagagttctagacttaatatcaccacttactaactagtgataaatgattaaatatctctgaaccttagttttcttgtccttaatgtgaggataatgataacttatctttgtgagttgttttgagaattatagattttctaaattttcctagtgtactgcctgacagatagagatcattcattagtgggagttgttttgtctttctgaaaacagttccctgtagaatgaaagattgtagtgtccttgcttttaaagtaattagacattagatatggaaatattaaagtcccatcagttattttaaaaatatgtaattttatagtttcctgaacttgatcttttatcattttagaacatgattcaattttattaacaaagtgaaagtgaagtcgctcagtcatgtccgactcttagcgaccccatggactgcagcccaccaggctactccatctgtgggattttccaggcaagagtactggagtgggttgccatttccttctccaatgcatgaaagtgaaaagtgaaagtgaagtcgctcagtcgtgtttgactcttagcgatcccatggactgcagcctaccaggctcctgcatccatggcattttccggctaacaatactggagtggggtgcctttgccttctcccacccctagaggcagtcaacctctaatccctctcaaagaccttggaaaacacttgtctgctttgtgtctcgaaattaaaagacgcttactccttggaaggaaatttatgaccaacctagatagcatattgaacagcagagacattactttgccaacaaaggttcttctagtcaaggctatggtttttcttgtggtcatgtatggatgtgagagctggactgtgaagaaggctgagtgccgaagaattgatgcttttgaactgtggtgttggagaagactcttgagagtcccttggactgcaaggagatccaaccagtccattctgaaggagatcagccctgggatttctttggaaggactgatgctaaagctgaaactccagtactttggccacctcatgcgaagagttgactcattggaaaagactctgatgctgggagggattgggggcaggaggagaacgggacaacagaggatgagatggctggatggcatcactgactcgatggacatgagtctcagtgaactccaggagttggtgatggacagggaggcctggcgtgctgcgattcatggggtcacaaagaatcggacacgactgagcgactgatctctgatctctctctctcttcctgtatgtttcatatgaaagaatcataccatatgttgcttctttaattaatgttttaagttaatacatgttgtagcatatataataaatttcttcctttttcttactgaatgatttttcattgtatgcttatactacttttttttttttttcattcttccaattttattttatttatactacttttttaaaccaaaatgtagttgatttacaatactgttttagtgtcaggttaaagaaaagtgacttgatat

SEQ ID NO: 52477 - DNA, 1759 bp, Bovine  19866880448727
tgggggcaggaggaaaaggggatgacagaggataagatggctggatggcatccctgactcgatggacatgagtttgagtgaactccgggagatggtgatggatagggaggcctggcgtgctgcgattcatggggtcgcaaagagtcggacatgactgagcaactgatcttaactaaactgaactgaagcatttcctgtgagacaaatagtattaagtatccttatttcagaattgagaaaatggagatagaggtagattaagtaacttgcccaagggtacacaactagtgagctgcagagaagaatgtgaagtaagcagtctggctctagagttcatgagcttaatcactttgacatatcacctatttctgattgtataatatttaaaacgtcttccacactctgaattagtttagctaacagacattaccacctattcttacttgctccttcctgtggtacagagtagagcaagcctggtccataaactcaagaatatcaagccagcagaaatttaaaaactaacatccatagtaaaatctacaggacttggggatgataagattaggggatagagaaaatacaatgctcaaatttctggcttgtgcaactgagtgtacagaggtgaactttgttaagatcaggactcctggggaggaggtagaggaatgggaagtcttccctttgctgtttccttgtacattctttggctttggagggcaaagacaccccaggactcagtggttagacctctaatctccctgagctggttccctatatgcaaactgttcccttagcagccaagtgataactccttaacctccttcctctctaacaggtcaccaataatccctttgaatagggttccttttagtgaaaaaagtaaatttaagaattactgttgggacttccctggtggtccagtggtaaggaacctgccttctaatgcaggggatgctggtttgatccctggtcaggaaactaagatcccatatgccatggggcaactaaacccatgcaccacaactaagacttgatgtaacaacaacaacaacaacaacaaattatttttaactgttaaacttacatcaacaccgaactacatttcaaagaaaaaaaaaaagaaaaacacaggaaaactccatccagaaataaaccagaaatgagaccagttgatgattcttgggcatggtttagccgttcaacgagaagaagctgttatgcataccatgccaatttagacacttaattaaaagtaagaagagctaactttcctttttttccccaaaagaaagatataatagctgcatcttgatgctactctgggatattcaccctattggtatacatcaaatgtggcagcatttcaggcaaacagggagcccctggccctctccaggggctttttaccagcagtggtaaagactacactttgggagtgagaagtaaagcttatgtgtatgtccttgtgcacacacatgatgcaattatccatgctgaggagtaaatctgtaaacatgattccagagttcaatagtatccaaagaacctgggtgtataatctaaagcagtgagtactaattaattatagtgagccctaactggaccaagtctacaaagagaagcaggattgttaggctgcagcatggattaccagactatgggctgcaaactgctaaggtactgctgagttatagcaaaggactcttacatccacctacatccaaagcactattactgatcttttttgaacttaata

SEQ ID NO: 52478 - DNA, 1610 bp, Bovine  19866880487631
ttctgttacttcttgacctgcatacaggtttctcaggaggcagctaaggtggtctggtattcccatctcttgataagaattttacacagttttttgtaatctacacaaaggctttagcatagtcgttgctcagtcgtgttcaactctttgtgaccccatgggttatatagcctacgaggctcctccatccataagattctccaggcaagaatacgggagtgggttgccatttccttctccaggggatcttacccacccaaggattgaacccgggtctcctgtattgcaagcagacgcctttaccatctgagccaccatggatatttttcaatgaagcagaagtagatgtttttctggaattgtcttgctttgtctatgagccaaccgatgttagcaatttgatctctggtccctcttccttttctaaatcaggtaatttcataggctaatgagtgggaagagtattccaaatatttggggggaggagtggggatttctaggaattgggccactgcccattttttggtcctttatggttagccttagaactgtcatggtgcctgtgtatgtatcatttagcttgttgatatgttacagtgaatgtatactgaggctcaaggtctagtggaagtcaattatgtgctgtcttgaacctatttggttccaataagtttatgtcatattgtcagacgatgttcttcttttaaaggttgtgccctgccctcctcctgcctgtttcagtttcacaatttatatatacttggttttgtttgggttctcttctctttgattgttctgtcttttctttgactcgtaccatacccattttcttaatttctgtaactttatgtttttgtatctggtctggtgtgctttcaccactttagatattttcttgccgttctcacattttcttgctttttattaggtggattttggtgtcattttgtcaagttaaaaacaaatatccacactttttattttttggctccactgtgtagcatgcaggatcttagctcccagtttagaaccgaaccctttccccctggagataaagggcagagtcttaaacactggactgccaaggaagtctcaatatctgtacttttatattttaacaaaatacaagtttgacatttttacagatgtagaatactacctaaaggcatatttcatttcatattaacaatacagaatttttcattgtagagtcaaggttaattggggcattctgtgctttgttaaaatatgtttttattagagttagatctaaatggtgatactttaagagcacatgtaatttttaaacttacatacttactttttatacagaggctaatattttgtaggggctttctgtaggatctgatcacttctgaatgcttttatttctatttgtaactacttattctactgtgtcttttcagagtacctcacattcaccctatctccttaatgtgttcatcttcttttttactctctatatcaattgtatatttggtcaagaaatattgagcatctcttatgaaaggtattaggtaatggtcaagaagatgggctccaggctgggaaggcttgattgtgagatcttccttgtactccttcagtga

SEQ ID NO: 52479 - DNA, 6071 bp, Bovine  19866880514225
ttgttcctaaaagacagcacggttcaatttagtacttaatatttacttcttttttaaaaatgtgtttgtgtgtcttggttcttacctcagtggagatgaccaaatcacatatttcttttaaatttaaaaatgggaaaaagatgactcaaatgctactttaaaaaagatgttttcccagttaatgttgcagcatttcaggactactgttcctgaatcccaaatacatgggctgaatccactttttctcacgtgtctgactttattttcactttggaattagtggtcctgtaactttaaaattagtctgatccatcttttaaagtttgtatatcactttacctagaacattattgaagacaataatccagttacaattatggaactcctgttatatctgtcactcctgtgacatcacacttggcattgatggtatgaagatgaattaaactagataccattctcaagcagcttaaaatatttaaaaataagaaatttttataagcaggtttaagaaatctggttaagagtcttatacaacatttactaaccgatcattttcaccagtttcggttttattgtgtgaacataaaaataagctgtaacatgtatataataagatggagcttgtcctaattttgccatttcccttgttgttgatggtagactcgttacatcaggatagatggaagtgttccatcttcagaaagaatacatctggttaatcagtttcaaaaggatcctgagactcgtgtggctatcctcagcattcaggctgctggtcaggtaagaagtttcacgtctgaatttgataatgaaatgttgagataataaaaaggccattaaccttaactataacttcctatttggtgtgataaatactcattccaccttgaagagtgctagaaagtgtaacagaaggagacctcaacacctctgattataagcttcctgaattttcaagtaaagaatttcctgaaagagtaaagttaaatttcattataatgctttcccatgaacttttgtatagcattttctcatccctttcttacagcactcatcttacttggttgttttcatcagagtctgtgaggcaaggtggcctgaggaaaaaagaactctcctgtctttctgagttttttgtggaatgcccttagtttgtttcttagaattaggtttggctacaaataaatgtaaatccaaattaacaatgacttaaatacacaaaatttcactcttggatacagacagtccaaggctgtttaccactcttagcaggtatctcatctaagagttctgctagagctgatatctatgatccaggcagctgagtggagaaaggcatgctacatctcactggccctgcagttattcccagagccacaactgtcttaaaatgaaactggaaacagtagcctttattggtcatcaagtgttatgttacaaaggggtaagaaaagaatagatattggtctgtactacccactgtagaaggggacgcttctgaacatttttcctactagcattctagaatattttgatgtaaatatctaagccaggatatttaacagagggaaaagcaattgggcatattgttgttaaatatccaacctggtatatggcaaatctggcaacttctgtggattctggaatctggaccagggccaaagttctccttttagtgagctaattgatgtatataaaattgtctatatagagagaatccatgaagatgaagaagttgtagaactcactaggagttctaatcaaaaagatggttgtctcaacactttcatgttagattgaatttctagtagtctgagttttatatctgttagaatatttcagccatagaaaatattataaaaaagagcttaaaagtagaaatggagtaccaatagcttgggagtagataagtaggaagaatctgggcaggagagtctgggagtgacctgataaaagactttctgaaattaagattgtacaaggcactcacattctattcaaggctgtattcctgaaggccttgtataattcaaaacttaatacccttgaatactattaataaaatcttcatcagaatgaaggaaagtagaaagggctttgtcctggaggtttctgaatcttccattgtagtttagtattaatagcatctttgagtgatttgatcttgccaacatattttcccttttttcttgtatggtcatatgatactttttacacttttatgatactttttactttaaatgctacttaattttcttgcgttatctctgatattttgcagcttttcaaatcctaaatagcagcacattttaacatggtgtttatttgactctgtccatgtttttattacttctaagttctgttccaaagtggttgatcttcagcttgagaatgagtgccactgtttagtgaatgctaatatgatgttgttatgtgatatgaaaatattttaagttaaaataacatcagagcagcacagcagtcatgaaagtcactcacagaagttccagggcatgtgaacaacagccatggattagataacactaccataatatggtaggtgttcctgttgaccacgtaataccacccactactgtgtggcaataagcatggtccacattttgcttgacctacccactttaaagtcatgcattttttaacacagtttaaagagacttgcattatttcatatattagttataaaacaagacctagttaatacttttaatgtcatactgtttcaaactgatataaaatacagttacacaaagatgcaactgtattgtatacatcaagatacaaatcagtaaacatcagtctttgggatgcaacatgagaaattccaaagatagaaaaggttttgactgtagacatgattttattgctttataaaacagaatgaattaaatgaatagaggatgtcattgctctctgcctagttgctatggataccatgtgttagaattatattctcatttataatgtattttattagattttccaatggtagtgtgaacccagtatacatcagaggataaagtgattttgtttatgtatacatccgtcaaactgacttttgaaatactgaaataccttttaaacatgtactttgtagttcacctgactaatttgcagtaagcagtcttcatttatctgaattaaattttcttaatttgacttaaaatgaaagactgatttgtttttaagtccttcagtgttctcttgtccagtgaacgtactcagaaagactttattatacatggctctatgttaaattctcagtttatttgcatctcagtttctttactttgggcttccggggtgactgcactgcaggagaccaggtttgattcctgggtcaggaagatcctctgaagaagggaatggctacccactcagtccagagaactctatggacagaggaacctggcaggctacagtccagggggtctcaaagagtcggacacaactgagtgtctaacactttcacttttcactttttttcttcactttattttgcttagggtttgacatttactgctgcaactcatgttgtgtttgctgagttgtactgggaccctggacatataaaacaagcagaagaccgtgctcaccggattggacagtgcagttctgtgaatattcactaccttattgcaaatgggactctagacacccttatgtggggaatgttgaatcgtaaggtaaagcttgaatttaaaccaggttaccaacttttactcagagcttattatccatagcttgtatgagttaagaggctgagttttggtgttttcaggcaaagcatatatacatacactgagatattgatgttgatagagaccaagtccagaaaaggcttcggttggtaatactttacctgctgtccttggtaataagagagcaacatgaatttacttgtgttcctattgtcttccaagtccttctctaccattttagaggccaggggaggatgagctagtaaggaaacaaaacattttcaaaccccaagtcctttttgtaagctgagaacatacactttctcaaaagcattcttgaaccttgagtgattcttgattgctaaagcccatgatatattgaaaaaataagattttctttattggattgcttgtgactcaaatgcaaaaccaggttactgcttagtaaatgtcatctgtaaggcaacctgtcgtaaaatctatatgcttttccatcttacaggctcaggttacaggaagcacactgaatgggaggaaggaaaaacttcaggccgaggagggtgataaagaaaaatgggatttcctgcagtttgctgaagcttggactccaaatgaaaggtctgaagagctcagggatgaaatgttgttcactcatgtaagattatattcttttctatttattttaataccgtgaaactatgactttaccatatattattttaaatagtaattttcagttgtttatgcttttgaaaggagtctccatgtaaaggtggaaaagctctgagaactaaaggatgactttgatataaggaggctgcaagagtggtttgtatttttcaacagtaatagatcagggctcactgttcagctccttataaaaacaagccaagtagaattcctgccttcaggagaaaatatgggagactatctctgagaccctgagggtagggaaagatatattaaatttgccacaaaaagtgacatacagaagtctcatactcagtaaagatattttgcattacagtgttcaaagtatataactttatacaattcagttagtaaaacaaacaagctagtagaaaaaataggcaaacaatgagagcgtcagagactggcctgaatagacaaaacatgaagagaaactagcttctccaaaataagacaaatttataaaggtacccttttctctttacaattagtatgtaatctatggtgtgatactttgagatcacatgactattactatttccaaaacctttcacgccttggttttaacattcattgatgtttgcctgaagcagttttgaaatagtgattttttgaattccatcattgcttcttcattagctggcattttttctgtagagaaaaatttctgatttcctcctttttaaaaaatatcactatgaacttgggattctcttattatttagtgtgttataatctgggccttttttttaagatctggctgcaggaagcacctttattttattttattgggtttttgttgttgtttgggatttttattgaagaatagttggtttacaatatttgaatttgtctcagatgtactgcaaagtgattcagttatgtgtttttttcagatttttttccattataggttattataagatattgaatatagaaccctgtgctatacagcaggaccttatgtttatctattttatgtatagtagtttatatctgtgaaaattatcccatactcctagtttattcctctccaccccctttcccctttgataactataaggttgttttctgtctgtgtgtctgtttctgctttgtaagtaagttcagttgtatcacattttagagtccttataagtgcttgcatatgatacttgtctttctctgactttgtttggtaatctataggttcatccacatcgctgcaaatggcataatttcattcttttttatggctgaggtgtattgctatgtttcagttcagttcagttcagttcagtcactcagtcacgtccgactctttgcgaccccatgaatcgcagcatgccaggcctccctgtccatcaccatctcctggagttcactcaaactcacgtccatcgagtcggtgatgccatccagccatctcatcctctgtcgtccccttctccacctgccctcaatccctctgagcatcagagtctttttcaatgagcctatccatatatctatctataccacagcttctttatacattcctctgttgatgaacatgcaggttgcttccatgtcttggctattgtaaatagtgctgctatgaacattgggtgcatgtatcttttagaatagagttttctccagaggtatgccctgaagtga

SEQ ID NO: 52480 - DNA, 1876 bp, Bovine  19866880562168
tatgggatggcaaactaaatttaaggatttcaagttaaaaaccaagtatttccttataaagttctagaaaacaatagatacttacttcgatttattatgtttctgactctggcatgaaacaagaatcaggtttgttttcacatcctataatatctttgccagtttactagccagagcctcacaaatatatttccttattaacaccaatacgaattttcctcatactgcagaaattattttcttaatgtttaaaacttgtttgttaagatttaaaaatctaaagtatttagatttttaatgctaagagtagaacactctcattgttctaagtagttaaacaaaattattttccccaatatggagataatcttttcccccaagattgtaagcaaactcttactgttgtaaaaatttggatagtacagagaattataaagaaaaattaatgaccctaaaaaaattaatcacattaatctcactacccactgatgatcactgtcaacatttaacatctagtatattcaaatatatgtaaattttacaatataggattatattatttgttcttattttccatctaatgtgattatttttctcatgggtaaatataggactatatcatcttttcactgggctcattgtatagctaatctcctttaatggatactgaaattgtacatttatcccacgttatgtaattttcaaatatttcaagctttcagaccttgtagtgaatgttttttacagattcaacagactgtaatccatataacaagcacctggttggtctatttttaaactcagctcttaaatatctgggtaattaatggaaacaattcaggtttactcatgtaatttttcataattaactaatactttatatgaattctattaaatcaagattttaacatttttaaagttagaaaattttactgaaaattttttataccataattttacatatttcaaacttttccttaatattaaattttaataaactttcatcatgattacatttatcattgttatatccatatttaaatagaattctgcaaacaaatcactgattggattttgctttggttgtgctaaattaagtcagacatctaatcttaaattcattgggttatctattttcaagccatgagtactttgttttagtatttttaatcttgtgaaagagctaggtttttgcttaacatttcctcattaagtgacattctgtacgttgcctgttgagccatcagatgcatgagtggtgggatttgtctgctcagctggatggctaggtgtgttgtatgtggtgtgttttttgtcttgatattctttttgataggaccatgttccttaatgtagtgcatgctgtctctgaaataatcttgaaatctcttgtctagctctttttaaaccatcttgcttgtttccctttcatcactgtttcttttctcacccttcctcaagctgactgagtcttctgatgaggtaacaaaatagcctttgtcccttgtagtttcttgtttcttgttccttcccatttctctaacttcataaggtcattaagactaaccaacctcctcttcaacagtctgggtttggcatacctttctttcttacatttcatatttccattgccaaaacaacttttttcctgaaattaatggtatcgtgaaagaaatatagtgatcagagttaaaataaaagctcttgttgaatatatgttttatgcaattttaatgaaaaaatagatgcctttaatgttgagaacttctcttttgtggccactgctacatttcatggatctctctcacttctgcatcacattaatcatctggcaaacaaaccagtgttcccagttttaatttgacaagtgaaaaga

SEQ ID NO: 52481 - DNA, 1356 bp, Bovine  19866880617545
ctgaggcctggcatctgtacaatgacgtgtaccgtgcccggcaaggtggcgtcatctccatcaccatcagcagcgactgggctgagcccagagacccctccaaccaggaggatgtggaggcagccaagagatacgttcaggtcagattttcctctgggtgttgtttttgctccttctcttttcccctcctgtcatgatctaatgaaaacagaagtagactgtgaaacaaagattaaggatctaggctttgttttgctattaccttattttgtgcacttgggaaaatcatctaaccttttaatatcttagttttcttgtctttaaaatagacgtgacctaactaccccacagctttgctggaatgaaagttctttggggttgagttttctttcaagtcttaaaaaatcagttatacatgcaactcttactggatgcaacattggcttgagactaaaaaatagaaattcagcctcttcagtctgtggtttgactataggacagggctgcaacgtcacacttcacctctaggtgtcactgtctgattttacttactctgcctaagacttccttaaattggaattctgtgaaactcatcagcgcccctaattttctaattccatgagtttaatataaagacttgcatcttttggtcatggaattttgctcttaggaagtagagacacaagtaagcaggtgccaacatggcccgccttatttcagtctgggtccctgaaaggagaaagagagaacagccctcttcaggcatagcttgtccccggctcctgctactgtctctgaaaggttggaaggtgccctcttcgtgtttcaggatcaggaaagaaaggcaagcatctctctctccagactgctcccacgtttggccctgaggagaccatgcagcctggcatttctgaaaggacaccaatggccttggtttgccaaatccttcacaaaggaacttgacaaaagtggtcaaatgaattaagtgcaaacgagaatttaatgtccccatttggtagtcagcttgtggggcgtgggggaagcctaggaccaaaattaaggtattccctcatttcagatgcacagaactgatgaattagagctataattcatttttggaaatcaaaaacaaacctgcagaaatgtcacgctgtagtctcatcatcagtctgttagtgagctgtgattctgcagcccaggacagtgatctgcacaccccctcatgaattcagcttccccagaaacccaattcctcacctcccagtgaactgaagcttcttttactggagcgagtatcttctaaacctcatctttggctgaaaatggaaggctgctctcactccacattccaggcag

SEQ ID NO: 52482 - DNA, 1610 bp, Bovine  19866880618268
tggcttgtggtcgtttgcctgtagattaggtgaaaggaggaaaggaagcacagaaacagtgatacccgtcctgattagaaactctgcctccacgtctggcatcactgggatttgtctgactgtgcttggggttaaggcacatcagattgttcatcgaaacatttaatgagcacccgccgtacaccagacattgctgcactgacagccgggccaccaaggtgacagatgccacgtctagtcttcctagtcttgctggagggaagccagtcagcagacacataactgctcagtgcagtgtgatagtcccatgacgttcagaaagtgtgtacaggaagctgcaggagttcagaaatcggggggagcagagaaggtgatgctgacttacgtcctgactcaggaccccccactgacaggaagggcttgactacatgactgacttgaccatgtcttgtcctcttaagatcgaaggtgcatggagagcagacggcaaaggactcagtatctgggacacgttttctcacacacccctgaaggttgagaacaatgacacaggagacgtggcctgtgacagttaccacaagatcgccgaggacctggccgccctgcagaccctgggcgtgacccactatcgcttttccatctcttggactcgcatcctccccgacgggaccaacaagtacgtcaacgaggcgggcctggactactacgtgcggctcatcgacacgctgctggccgccaacatccagccccaggtgaggggccctgagcaggcctgggccaagtccacgagagggagccggctgggctgggacgcacatctcctgggaaaaatcagtgctcttgccaagtttaatttttgagttgtctgtaaagattttccttctgtccctgaccaccccctcccagctatctattcccctccttacaggtgaccagggctgctgagtcttcacgtccttttgggtatctgaccagtgggcaatatgtgtgtgtgtgtgtgtatgcttattaccctcctttttcctaatggtacgatacacatagtttgatactttttatttaccaatagttcttacaggtatttccatatccctatgtgttttcctcatttgtcctgtctttttagttatgtggaaactgtacctcacttctctagtcacttccctataaatggacactcttccctgttttcactcttcttcctttgtaaccagcactgcaatgagtgtgtatgcatgctaagctgcttcagtcgtgtccaacccttcgcaaccctatggacttcgggcccaccaggctcctctgtctgtgtaactgcagttacataattacgctaggatagacgtttataggacatggtcctaggagaagaactgctgaaggcaaaagttcgtgtgcttttaagctgtgagttcttatgaataataaagctcatatgggggcttcctttgctgccaccagatcttttacgttttacctgggagcctaagaacccttggccttttctcctgggccatctatgataaagggccagagggcactagctccaggggactgctgtgtcctccgcggtagtgattggagattacgtacggcagccagagtatagt

SEQ ID NO: 52483 - DNA, 4717 bp, Bovine  19866880638130
tacatgtcaattgtatctcaattaaaataacccctcactttaccaggatttctacagcaaaagagaatattcagagaactgaaataaatcgtaggattgtagttttgtctccacccccatgattaagtaattcctgctgcagtattggccctaattatgtatcctctccatctgtgacattctacagtcaaacacttaaaaattccacagtccttgggagtgagtgattttcacagtgctccttcctacttctttctctgtgtctggctccttaatctgactcatttgggaggcagctcgcacctgctttcaggagcacaatatccataatcgcaacacaccagcttgtgtgtgcagggggcgacgggcgggggtgggttgggatcccctgggaccaagtagggctttgcagatgctctagagggagagaacatctgcaccagagcctggtaacacctattgctcttgagctgcaaaaagtaaacccgcagtctgggctggaagccagccaggctccaggcaagctgcggatggcagaatccccttcccctagcccccattttgggtttcctagcagtttgattctgctgggccaacaagtggggaaagctttctataaagaacttgagctaaactggacaactgggtgctcaaaacatcagctaagaccacaaattctttaaacgatcataatgttctgttttcagctgtctcactctatattcattcatactcacaactgtctacaactgactggtattaacttacgagaggacaaatgacatgagttacacccacaagaaacactcctatagagaaactgatgctttgtagaatatttgtaaagtggggggatttcatgtctttcatcttccctaagtctgaaaatgaaatcttcaagataggttaagtcttcaggactgactctcatttaaaaaggtgattttaatttacaaaaagacaaagtgggtatatatttgtaaacatttattcttttgaactgaaaaaggcttgcatcagcacacattgtacagccttgcaaattgaaaaaaaggttccttgttcataagtgcaatgaatctttgatgtccagtgatccgctgcaaacaatgaaaacacatttttaaccacttaagaagtttccagcactcatcaaatgcatttcctcaggtgaccaaaaaaaaaaaaaaaatccacaagaaagggaaagcaaataagtggcatttagttatcggagggagactttaaaaaaaaaaaaaaaaaaaaaaaggaagtattttcctgcctagaatgattcctattcccttttgaatctaagtggtttgattaagaggtgttaagaacataatttacttgacagtgttcatatgacctaagtgaataaggaaaggaccctataagggaattctttattttctggaaactgtttgtgtttagagatacaggggaagagtaatcttttgtttgtgagctctccttagtcacctactgggccccccaaaagacagtatgtagttttaacttggctactccactcctgcattcttattcccccaaattctatgtcaggtcacactgtgctgctggctgcaaaaaagaaatacaggttgcaactggtggtactcattttgaagaataatttgctgtacaatcgagctttggatctgatacaagaattcagaaatataaaacaaaataactataaaagttaggaggcatttgaacagcatttcctcagaaaaagctgctaactctgtatcattctgatgtggattcctacagtcatttggggtgaaatgtgcatttttcccctctttgctggatcactggcctgtcttcagaagttgtaacgccatgaccacacatcctaggagtctctatcatgttaacagaagctcccgataccaagccagttaaagatgggtgacgatggggggatcacaaaaggccaagggtctgaggtggctgttactgagaacttgccctttccaaaatgtgaaagtcatagtgcttcttgcttgttctcagcttaaacttgttaaccgagttaatttgtttcttcaatgcattctgcgcagcggagatggaggggaatgtggctaggacggtgtacgtggaggccaagtcactgggtttcgagcgttcggggttgacagtgctgtcaccactgccacagcagagcgggtggcgacgcatttggggctgggactgagggtcccggagccaccggatcttggcgccaattttaaagagttccccaaagagcttctcggcttccatgcgagttattccatctggtagttcagtaatttccaagaccttcccaacaactagaatggaaaaggtaaagaattaatccctgttaccaagaggtgggcagaatgtactgcagactcaaatgacacaagaaatgaacataattttctaaaaccattcaaatccacagttatacttggtatggccatcttctaaatatttcttacacccaagcaaggggtgcagagaggcccttgccaccggccacactcacagcctcacatacaaaatgcagcctgtgcagtggcttcttcaaactaggtgtgtgatcctggtacagtttcctgaacttcagattcccattgtcaaattatacgtatcttcaatttttattttttggctgtgtcgtgaggcacgtgggatcttagttccctgatgggggatggaacccatgcccccttcattggaagtgcagccttaaccactggaccacaagggaagtattctgtatgttatctttaaaacagcacttgccctaacaaacccaaggctattgaatagaaagttaaggtacagacttgaaagccctctgccacagaaaggcaatgtatttgttcttcagactatactgcctgaagggtataaagaatacttcctttctcaaagaacacagaggcaatgcatttcattctacctattcctctctcacatctctttcgaatccctttggtgcctgccctcctcttaaacccacctttgtttcagtactcccaaatccgaaatgagacagaattaaaagaacattcaagaagcctgccttatagacagcataactgtctaagactttgtgtaggattctagacaaggaaaacccacttctgtggcgtggcagttttagactctcaggccaacagtttatagaagcacatccggatgcctcttggggacacacctgcttctcctgcacccaggtcggtggatgcagcttttttggcttgtttccttcctcggttgccatgcctgttgccagattgaccctgaaaatccacaaacatgagaaataagttgatgctgctacaaaatgtaattgcagtgtttgaccacttaacaactaactgcactgagtctggggtttgtactttagaagaaaaaaacccccacctctaggccttctgaattctgcctcagtggcagtagaactttggcccatcacttgctgacagtcttttctaagtaacggcacccaatgcctcctgccgcccgccccccacccctcatatctggactgtgttgggaactgatgctcctaccaccttctccctcactctgctctcggtagggccaggacgccccactctcaccagcagaagtacaatgctctgccaacaaagcccaggaagtcagacagcagctctcacacctgttgggctggaatgtgtccgtgcagaacagcaggagggttgtactgcagggtctggccaagtaacgggtatctggcatctcctgaaagttaataaaacatcactttcacattttcctttattcgggtacaaagtacttcacagttttctcagttgtctcaggatgagagagggaacatattctaccaaatagaataaaaaagtggaggtactgatatctttttttaaaaaaattaaaagcctccacatatccttcaaagaactggggtaaacttctgcaagcactagggactaataacaacagttatgaaggaggttaagtgggagagctggcagacaaattagcatggagagaaacttcttggtaaaccttaacattctatgtgaaatcctccaaaggaactataagaactcattccacccatctgagatactaaaatccacattttctctgatggttaaaagtgaacagaacatacattcaggggacaaaagaaaccttggaaaaacatgaagctctctatctcccccaaatcattattaattactataaatatattttctttcacaccttagtgcctagagtcatcccatggaaagcgcttcacacatgctgactgcaaaagttttgtctgtaatgttttcatttgttgtagtctcattttaactgtaagtccccaaatgtagcacattcagtgtctggaggagggttatgggtgggtgctaagagagcatcttcagaaaatcatacagtgcttctcctgatagtttcctaacagagacaagcaaggcgtgagcctcttgctactgtgtggagctcttttctgatgaacactgtcggggtgcttgggcagctccctggtagaacacacccacgacatacttgctccttcctaaacactagctgaaaggcagatacaacatgaaggtttagcactgagaccagagacacgattttaagcatgaagatggagtgaagtggtatttcattgagattttaatactcccttccttaatgaatgatgttgagcaccttttca

SEQ ID NO: 52484 - DNA, 1342 bp, Bovine  19866880644055
atgtagaagccttcagaatgagatcaccttgggctgtgcagggatttagaaatgggacacattctccaccttcaagaaattctctagaaggggcaaaacattgaataggtaattaattaaggctcactctattttaaatcgttgttacttcatttacaggtcttcaaagtttctgtgctgacaaacagtaaacacagggcacgcagattctgcgatccactgtggagacgaaatagtaatagctatagtcggcactctgttacactccaaggaaaagagaggatggtgtgttcagaaaaattaatttgaatacaaatacgctgcctctctttggaacttagatgtcttcaagttacacagactctgaggcgtctggagaagatggaaaatgaaaagttagaaaatccttcttcagtctgggaaaagacaggctgccctgctcactcaatgtgttgggtcacacacttcattaggaccaggaggccattaccaagatttccatgaacatctatctgaatattgctggccttcgggagacagactgttcacatccattcagtgacagaaccagggaaccagcagtgctgacaggaattagaacgggagacttgctacatgtgcctcctacaggtaaactcagacagaattaaaattagagatgaaacatggcaggacataagctcactttgttaaactaaaggaaaaggtacattactcaagaatgttggaaagtcctgcatgggaattacaatagctactttgctgttagaagtgttaaaagaaaaactttttatgatagaaagaactcaagactggggggcagagcccacattggacctcaggactagtatctggtagcctggggcatgtcttataacccacttggcctcaggtaccttcttgatctctaatttctaagataagggcatcaggagcctcgcagcgttgctaggacagaagagctattacattgtgaaagcttttagtaacgtgtaaactggtcacacagtggtaaactattgttatagaaattaatacattcatttaaagaaagagtcttagtaccactacgcctgacaagtaaaaaacctcttactttgtagaagggtcccctggcttgggcccctttgtgatcaatcggacatggcccccgtcattcttcaccttgtccatcgaggctgcagcaacatcttctttcgttatatatctgaaacaaatacacatgaagtggatgtcctttaagagtttctctatttcatgttcacattgctccttgcaaaagcagtaggagaaaaaggaatatataagtctattcaccgtgctaatacttaaattagggaac

SEQ ID NO: 52485 - DNA, 1432 bp, Bovine  19866880704798
tcaagaatggggattaccctgaggtgatgaagacgcggatccgtgacaggagcttagcggaaggcctcaacaagtctcggtaggtcctggtgccacgccctcagccactgaggctcctgggtggctggcacaggtgctgttggggttggagaggagtgtcttaggcaagttactgtctgagcttccatgcatgctggaaagacaacacgagtgtgtatgtggagctctcagccccggacaggcacagctctgacaaaggcagttgctcttgttattctttagaataggcaggccatctggggcacccacttcttagtgacccactggctccctctttgagcctcctatagcccagctgtgaggattaagtaatccaccccaacccttacatcatgcgtgtgctggcctggttagggaagtcctgctgagccaaaaggtctgatctgtcgaccctggtctccaaccagcaagcgagtgctccagttcctcaacacaaccgtgctgaagcacctactgtgtaccaaggccggtgccaggcccagcagggtccacatagaggggactctaagtatggcttcctcaggtgctgacacaccagctggaaagacagtgaccttcatcactccagggaattctattccccaatttcttcatgcgttgaagactcagatgagatcagggcaggctgggtcgacccaggagaccccctggacaagacaggatatcggctgactgggccttgacaatgaacagcactggggaaagcagaaggctttcgatccaagggaaagggtgtgagcaccggcctagaggtaggagtgagtggaatgctgcaattggggacactggcccagcagcagggagagccaaggccgcgtggcagagcgactggaggctggcacaggtgctcagtcttgaagccacaggatctgagaagcccttgctggctcctgagcagggaagtaaaaggtatggcagcggtggtgtggggaacttgggccttagttttgccccagtatttcagaaactccaggaagtaaggttctttcctaggttaatggtagcaggaaggtcaaaatgaagtgtcagggcctaagcagggcattctctcagcaaccctaaaccagcagcatgtggtcaggatctgggagaggggaacctctaagtgctgcacacaagggcatgttaatcacatcacacagaaaagtctaagaatacatggaaaaaatgtaaatatgtatagaaataagtcacacagcagagactggcacaacattgtaaatcacctatatttcaatttttaaaaatatatatggaaaatgttctcctagatgtttaaaaagaaagggcagtaaaatcatgagagcagaaaagtccagatctcaaaaggtcgatttgtaaaagcatttcccctacttgtaaggcacagact

SEQ ID NO: 52486 - DNA, 2578 bp, Bovine  19866880796016
ttttcctgtgtttttaaatcatgagtatgtattatgtgatgccaaaggaaaaccaaaagaggaagtgactgccactattggttctagaatcctaggatgaaatttcacatttctcactatatgcctggcacatattggggaattaataaataagaggcagggtgagcagtggttaagaattcaggaatgagacagagctggatgtgaatctcagctccaaagtttgctgaccaaggccttaaagtcttattgagggtgaggacagataaagtgggagactggcattaacatatgtgctgtgctgtgctgtgctgtgcttagtcgctcagtcatgtccgactctttgcaaccccatgcactgtaagcccaccaggctcctctctccatggaattttccaggcaggaatactggagtgggatgccatgccttcttccaggggatcttcccaacccgtgaattgaacccaggtctcccgcactgcagatggcttctttaccagctgagtgacctgggaagcccattgacatatacacattactatacataaaacaggtaactaataagggcctactgtatagcacagagaactctactcaatactctgtaatgacctaaaggggaaaaaatttacgagtggatatatgtacatacgtaactgattcaccttgctgtacaggagaaactaacgcaacatttgaaatcaactaatacgccaataaaaaaaatttttagtcttcactgagctccaatttcttcacctataaaatgtcacagaacaatccttgcagattgctgaaggagacactcttgaaagcacttaacaccattcctggctcaaaggaaatagtcaataaaatgaaaaccatcattattatttattgacttgatttatactggaagcactcatgacaaaaaaaaatctaagcatctatagaagaactttctgctaaattataagaaatccccaattagcattaaaaagaaagaggcaacactctgaaggactcagaacactgtttggctgaaaagtgagatgacattcctgtatctaccagtattacactataaaatttatcatctagttgatgtataaacaccactcatgagtctaggaaacaaacctatcagtgtttcaagtaaaaaaaaaaaaaaaaaaacccagagaaaatatgcttagtttagtccacaggtagaatgaaaaaactagcaaaacatgactaatgaagatctgacttagagatacaacaagtaaccctaccattaattttgtttggcttctgtcttcctcactacttttgcataaggagcctgtctttttggcactgctattcctaaatctggcatagtgcctggttggcctgggtttaattgctcagtctagcaattaaactagactctttgcaaccccatgcactgtagcctgccaggctcctctgtccattggattctccaggcaagaatacaagagtgggtagcctgtcccttccttctccagcggatcttcccagcccaggcatgaaacccaggtttcccgcactgcaggcagattctttacagtctgcgccaccaggaaggcagcatagtgcctaacacaatattaaattctcaataaatatttacaatataacttcgaagacaaagtctcagcgaaagaagagagaaaattgagtaagaacttatcggagaaagtctgtcaaaatgatggtgaaagccatcaggcttggggagggagtcctgtttttggaggggttggggggaagaacttgtcttataccaccttctgcatttcctttgatcaatgagttatccaaggaacctcaaagggaacgttcaacggtaaacacacacacacaacttagcacccagacaggggcacaaacagggcctagtgtgttcaactttttaggcttttggctccaacgcctttctgatgatctgtattcatcggggtactatagttggcatcctgtcgacccttgtttaatgtctgctttactaaaaaaaaaaaaaaaagtaatgcgcttattctcaagtatcaatcatgagcccttctgcagtttttcttcgaaccagcctttcagttggtttgtaaaaatgggaagacttcgctcagaacttctgagtcgcttccttttagtcaaagtgaagacgtgaaggttttagaggcacactccccaaatttatgcgtgcaatctaatacttggcaagtcaaaagacaagtgagactccgggattgacaaggaggctggagaaccgcatcttggactttggaactacccccatcccattttacccactctttcttaaaatgcaattaaattctgttcaacttcctatcactcacgcaagaaactaccaactaccccgccacgccacacccggacgaccacacctggtgtatccgctgcagaatctccaactcccgccacgggtttggcctgtgtccgtcccaaagcggaagtgacttcaaagggacaaactgaaagtaatagaatgcaaatagcaggaatctaaaacccctaccacgttgcgagaaaatactcttccccgactcgcttttctaaccctttctcgctc

SEQ ID NO: 52487 - DNA, 1223 bp, Bovine  19866880854223
acctgaacacaagcactgcagtatttcatcagtcttatcggatagccaagagggctgcaaggtgactaatgagcaggtagcatatacagtgtggatatgctggacaaaggaatgattcatgtcccaaatgggacatgatttcctcacactatcacaacggtccgaaatttaaaacttatgaattatttttagaattttccatgtaatactttcaaagtgcagttgcccctaagtaattgaaagcagggaaagagaaggggcagatttgggggcactgctgctgctaagtcgcttcagttgtgtccgactctctgcgaccccccagacggcagcccaccaggctcccccgtccctgggattctccaggcaagaacactggagtggattgccatttccttctccagtgcatgaaaagtgaaagtgaagttgctcagtcgtgtccaactcttcgcaaccccatggactgcagcctaccaggctcctctgtccatgggattttacaggcaagagtactggagtggggtgacactgccttctcccttgggggcacaacccatacgctaaccaagctatggaagacccaggctctcatcccagctctggcacttaaggtggcacatttaaattttctgggcctctttttttttaatatcagagattaaaatgttgttaggattagtatgtttaaaacttaatgtgatttttatgttaaaacatttttttttaattgataaactgcaatcatacataaatacaatgacaccaagtcagcagattagacagatgagggaagaagttgaaaatgtatttagtgtgtttagtcttttactaacgttacaaatataaagcccaggataatggaacaataaattaatctaatatttttggatactttggattctaattatccacagtatattttttcactttcccttcctctaattataagaaaaaatcaacagcagaacagacagacctgtaagaatagaaaaaatatacatgcatatacatactggcaacagtaccactgaagcactcggggcaagttccaaatccaataacttctttttataatcttctttggtaaattccctcctgggaaacattgttgctaatgaaaagttaccgtaagtgttgccaacagtctgtaatataaaaataagttttaaaaccttacagttgagcctttttaaaaactaagatattacaaactcatacacatt

SEQ ID NO: 52488 - DNA, 1519 bp, Bovine  19866880990581
tgacagttccttgaagatggagctggcctggcatttagtccttactgttcttttaagtttttcttgctggggtttagactgggactctgataaaaatttcatctcagctgctggtcctctaaccaacagcttgctacacgacctgagagatcccctgggaaaccaggcttctccctttgtagcagaagatgaagaaatttacgtttgtcgccagccactgcctgcattcctgccagagtactttagaagtgtccgcgccagtatgatcacccattacaaagtatttctgccatgggcacaacttctcccagaaggaatctcggagaacccagacaaggaaacagtgctgtgctataggcaactgcttgaagccctcaagactgctcagcttcagcccttggtggttctacaccaccaagaccctccctgccagcactctccagagaactgagacctttgccgatctctttgcggcctatgcctcctttgccttccactcctttggggacctagttgagatctggttcacttttagtgacttggagagagtgatcacgaagcttccccaccaggaatcaagatcttcacgtctgcagatgctcactgatgcccacagaaaagcctatgagatttaccatgaaaaatatgcttctcaaggtgagttcacacaaccctgatggctgacccaccagcagccttcatcatacaccttcatccacccttcttaaagcaggactcagcatttctttccacttactttcaacagtcccctcatagctatttacaagtgagaaattaatatcctgaagatttcttggtggaggtaggtaggggtggcttgcgttgtaccatgcccaacatcccctttgaaaaatgtctttaaaccctccttacccagtcttgagtctacactattatcaattatctttctgtctttccttcttcagtcttgcctccctgactctccctaggatttcaagattgcccattttctttcagcctccctgctttcttttttacattttaattttttatactttttgaccatgctgcgtggcttgggagaccttagttcccaacgaggggtcaaaaccatgccccgtgtaatggaagctcagagtcctaacccctggaccatcagagaaaccttgagcctccccgtttttcttatgtgaagagaattacatgctctagttgaagcttatattccagcaggggagacaaatacaagataaaataacgatacgctgatggatagtgagaagaacatgattacaattgtccatattcctgcttcatagctcatttaagcttcccattcagtaggtctggacagactaaggacattgattttaatatattccctagatgaatctgaggtataccaattttgagaaccaattagataattaggttaattggattagatatgctttctagtttttattatatactgagtatttgtatacttactatatatctgtatacttgtatattctactttttaaaatttattttt

SEQ ID NO: 52489 - DNA, 1218 bp, Bovine  19866880991126
ctagtgtgaaccataccagaactgtctgtcctttaagattttcacctgttcactttttcctaagtttttatcaagtatatgatataagtatatcaagtatatgacaagtgtaactcattgtgctaaatgtaaggaaacaaagaaggtacagctgtggccttagcagagactacaaataagaaagcgaagcgcatagccagataagcactgtgaaagaagtgtgcaatgtgtgtgtagaacatagaggcatatccttcgaggaagatgtagggcttttcccagtattcagcttatccatctaactgtcagagccattcattcagtctgtggatgctggaggagccatggttttaatcagctccactgatcgaagaatagtagagaagatttgagcaggtcgtgattcagagatacctgggtctccatccctcctgccacttccgggggggaccttgggaaagttacttaatagctatcgtcatcagtgtgtgcatgctatgttgcttcagtcatgtctggctttctgtgaccctatgggctataacccaccaggctcctctgtccatgggattctctaggcaagaatactggagtgggttgtcatgccctcctccagggaatctttctgacccagggatcgaacctgcgtctcttaggtctcctgcattggcaggcaagttctttaccactagcaccacctgggaagcccaatcaccatcagcgtatcaattaaagtttttattatttttaaaggacattggctattttgtcaaatatataggaaccaccataaggaaagcatttttaatgttaaatgtttatgcttgtgttatttataagagtggtgcatttaaaaaaagtaaatatttccaaaaggagttttgtgggtttttttttttttttttttttgcaatctctaaaaatgaagttcccttggaatggtggattttctttttaacttttcaaatatcctatcaccacactatgtagcacaacatgacaggcttgggattatagagctgggaggaacttagaggtcatcagacccaaacccttcgttttagagatgaaaaaactgacagtcatgaggttgtgagatggctcatggccacttttgtaatgaaaggcagatggatgtctttcacaccatttttgtagtcatccttgagggcaaacacctagctgacatgttagagtaagaaaaacatacagcataca

SEQ ID NO: 52490 - DNA, 1210 bp, Bovine  19866881085749
ttgatataggttttgtggtaaaatatcctgtcggtgtcttcagtttggggtctgtcagccccactccgttctcagtgatgtaaacggggatgtccccatactcttccttgatccagttgagcagtctccgcatcccccaggcggcagccctgttcatggctgtggcaggccaggaagtgtcctcccactccagcagctcctggtcacttgtgtaggagggtgggtttaacctgggtgtcgtgtgttgcacaatcctggaggagtaagtgttgaggcagaacacgtcggcggtagctgcgatgtactgcttctcctcctccgtgaagctgggcaggcgggaggtggccaagtgctgcagttcactcctgttccccaccttccacttcatggcatcggggtagtctccgtttcggaagatggggtgggcaaaccaacccaaggagaactgcagcatccggtcagctgcctccacgtccctggggaccagcgactggggctctgcccagtgggaactgaggctcaaggagatgacccccttctgctcttgcctgtacttctcgtcgtacgtgtgatagactctggcatgagctttgatgattgcatggccaatccggtaaggtccactgcctgagtcattcacatttgggggaaattcccctgagccatatcccaaccaggcctggtacgtgggctcattaaaagtcatccagaacttgactctgtcaccaaaggtctggaagcagaagtctgcatagctgttgaacaagtcaaccagtaaaggattctcccagcctccgatgtcctgcagggcctggggcaggtcccagtggaacagggtcaccatgggagagatgttgttttccaccaagccgttgatcagcttgttgtaataatccacaccatgtgcgttgacagaagtgtttctcccagttgggaaaatccgagaccaggagatggagaagcgataagccttcaccttcaatgcttggagcatgttcaggtcggcatccaggtggttatagctgtcacaggccacgtctccagtggcattgtctttcacgttgctccctggtgtgtgggtaaagttgtcccagatgctggggcctttgccgtcagcgtcccaagctccttcaatctgataggctgacgaggacacgccccacagaaagtcatcgcggaatgtgccgtggtagaacagatctctctcaaa

SEQ ID NO: 52491 - DNA, 1196 bp, Bovine  19866881102348
cactccagtactcttgcctggaaaatcccatggatggaggatcctggtaggctgcagtccatggggtcgttaagagtcggacacgactgagtgacttcactttcacttttcacttttatgcattggaggaggaaatggcaacccactccagtgttcttgcctggagaatcccagggatggtgtagcctggtggtctgccatctatggggtcacacagagtcggacacgactgaagcgacttagcagcagcagcagcagcagtggttttgatttgcatttctctgataacaggtgatgttgagcaccttttcatgtgtttgttagccatctgtatgtcttctttggagaaatgtctgtttagttctttggcccttttttttattgggttgtttatttttctggaattgagctgcaggagctgcttatatatttttgagattctttgtcagttgcttcgtttgctattattttctcccattctaaaggctgtcttttcacctcgcttatagtttcctttgttgtgcaatctgtttgctattttaaattgcattttttattgctgtctgcttttcttgggcagatgcattcctttcatgaaagaaaatgaaacttatctcatcatgataaataatttaatagaaaatatctcagtataattaggatttttcaaactctagtcatagaatcagtgttttccaaaatagtataaacacaagcattttagaataaacaacaaaaaaggatctggatttctatttggagttctggagttctgtcaacaaaaaaggatttctattcgtggtaatctgattttacaaatgttcccttccaattacccttcagaactggaacatttgatacaccataaactcaatcctacatctcttgaaccctagtacttaactattctgaatagctatggaaataatttcccagaaagaatgtaattgctaaatcactacctaattagttgatttcctttatgtacaaaaatgcctgatatttggtaaaatacctagattttaaaatgacatgatatttctgattatgcagaaacaatttacattttttcttaacaagtgcccccaaacacttacaacactgaaatattatgggatgcttatttggaagccaaggagcttgttgctgacatagtaataatttggttgtttgcacattttataaaatattaaaat

SEQ ID NO: 52492 - DNA, 1357 bp, Bovine  19866881186053
atggcacagtttacaattgagactgtgcccagcaaaacatattttaagtgcatgcacacacacacacacacacacacctcttaaaagaacaaaaatgaaaaacaaggatcattgctttgctgtctaaattaaatgtggtttttgttgttaaaaacattaaaaaaatcttccttagtataacattgtctaagcttctagtctgaaagaaatagactgtttcatctcacactttgacagagatgggctttttgaaaaaatttataaaaagagttgaaaggcatgaagcttgtcatttgagctgattttaattccaaatgttgatctatcctgttaaattttcactccagccttgatgtagggctcaccagtatgattttgagtttgtccccaaaatgagtcagggaggactgacccagtgtgaactgagcagctcctttcccatcctttccttccctctttctcccaggtttgtgagttgccttctggagcaacccgaggtgttagtcgttggtgcaggccgaggacacgctggcaggatcattcacaagctgtttgtgaatgctcagagggtatgtgagattccttcttgactgtgtcatgctctctccaggcctctactcagtaaggtactgttttgattcccacacatgaagctgctaaaggcactgggttcaaacattgaagaaataatgactctaacagtgacttcttagtctttgaaatccatctgctcttttacacatttaaataaaatgataagtttatttctgaaatttgtacctaagtttcagaagttagaatggtctgaaattccttgttaaagaatccgatagagacttgggtagcaatgaccagtgcagtggtgtggaaaaaatgtttactgctgtcaaattagaatagagtttagttttactggttttaaactccatgtactgcaagtggattcacaacttggcttgtgaaattgcaaatcttaactatttttataacagtgaaaagatataacttcaaagttttcctcagaaagaagagcaagattcagatttttaggacagtggaaacagtcttcagcatagaagaaaaagcccaatttgaaaacttttctgtcattacctttattggtgaaaggaaatgtttaaaaattatatggtaccttctgacattctaaaccactaagatttgaattttttatgaggttggtattagttatactctatgttgactctttgtgtacaaatgtttactggttgtttactggttaagaggtgctggctttttgcacatgagtctcacattaggacttcttaaagactctataaaagtatttgaagcatagtaaatatagggtgccccttct

SEQ ID NO: 52493 - DNA, 1631 bp, Bovine  19866881222694
atggaagttctttgaaggccttaaaggtattaagctctgtcatcaaagagtctcagcaaaattcacgctgagctactggcacatttatctaacctatccaaaggttctttgatggcttatgtatttcatcaacatgtgaaacttcattttctctagcatttgaatcagtaggtttaacatgacccatttcctccttatgacaaaaaatgtttcctttacaagattttaatttaggttacaattggcagacattctgttttataactattaatgtgccacccttcacttcttgaactgccaactacattctttccaacaaaggatcacaaccctctttcaagaaagcacctagggattatgttcaggggaaaaaaggctcaaaaatgttttatttcttttcagtcaaagagcatttcatggtcagtaaaaatagcttaaaaacagcttgaggtagaacaggtgttgtctttcaatggccaccatctacagtcatactctataaaaggatgtgcacaacaaagtgcaaatactattatagcttgaagatgctgctgctaggcatgtgtgaacaccactgagaacctcctggtctccagaaattcacactatcccctacatttgtagaatgagcagatatagcttctgtttaaagtgcctaaggttctgtccaatttaattagttcaaaatgaataaatccagtctaatacgtgcttataacaggaaaacatagatttgtcattgctctgattagcgtaatcaattatcacattgcaaaagagaacaaatgctaaccaagctgtaatttttgagaactgatttctaatacgtttcagattggatttattaatgactttctttcattattccttgaactatacccactacatcaaattgttttagtagttattaatagtttataagtttctgttgctttctttacaattgtcactgaaattcaatggggcattcagtctacaatttctgatgtcattcatttgctacctgttaaaagaagttgtggtttagctagcactttgaaaatactgagatgataaaatgttctactgtctctctctagtgatcctgtattaggcatgacattagatatgcttggtaatcagcactgcatatgttcaaactacttgaaaaaaaaaaaaaatggaaaaggcacgtgatttctgtcgaagtgccttctgctgaagatagaaaccatacacccttctaagtatttgaaaataacagaaaagagagaagatgtcaaaccagcatagtagattgaataatgatttacagacacgataaagcagtaactcttaattatttttagaccataaacggatccggcttgagaagcttattaaactctgcagggatgcagcactcagacatgagtaggttcatggacattttccatgtggttttaggttatttagaagcacatacataaatcctagttggcatctcttgttttatattttatatatgcatgttatacaatgttttgtatgtgtgttttatatgaaatataaaacaagattgttaattaacattcaagtataggcttgggagaaacacacacacatatccacacatgcacatgtatacatatatacacgcagattttacacaa

SEQ ID NO: 52494 - DNA, 1204 bp, Bovine  19866881229674
aaactggctggggaattttataaacccataaaaatcatgaaaacacttacttcatcagccaccatacacctggaaaaaaataaaaataaaaccaaattaatgtcttaattaccaaagtcaaccatttaaaaagttttgattaagcgttgttaagtagcttgccacaaaacagtttacacattatagcactaagccagagagaggtgtttataagtgtgcataagaataagggcctttcctgacttacaagactctccagctgccaacggcatatggttatgtgggactgttagtttcagatacgctgtttcccaatgcccacccatgatgatagctacaatgacccttcaaaaacgtgagcaaaacagcaagtgattgtaccaatgacttccctccttaccagtaagtaaggtttactggtctcccctagagattagacagatgctgtattaaagtgcattaacatgttttacaaaaaattatattaatatatgctatattatacatgctaggccactttcaagctgaattttgtattctactattatttcactaaattttctcctccctattctttcttattaacctacagaagtaaattctatccactggaaattgaggacaggggcataaactaaggtcataattagaagaaaaaagcaaagaacaaaacaaaggatagcagatacggtccagatcacgaggggtcctttagagacagtgagtacatcataaggggaaaaaccaatctcttaaccaaggtgatatccaggaaatttggaaaaaaagaaaaactggaatattataaaaatcagaaaggaaaaagtccctatttgcatttttctccttcctttaatcccaacggccttgacattatactatattacatgctttcttttaacataaaacacaaattaagaatttggtaataaatacattattaagaaataacctacaggtaaaatggaattttgttcttaaaatgaaaaaaagatggtaggttatatattaagtttttatgggaaaataaaatataaatagtctaactgaaatttaaaacatatgcaagagtaacaagtttattacattttttccaaacaggctggaaaagtagaaaactaaaaagcaatactttgaaaaatacgccttatttccaggaagatttacatgtatacctactttttcattttacatccaattcaaa

SEQ ID NO: 52495 - DNA, 1277 bp, Bovine  19866881404407
taaaaattcagatactactttccctttttaatgattctttaagacattattttttaaatatttacttatatatttacttggctgtgccagggcttagttgtgacatttgggatcttatttcctcaactaggaatcaaacctgtgatgcctgcagtggaagtgtagagtcttaaccagtgtactgcccaggtaagtagcattaattaattatttgtgatgaaacattaggttaggagagaaaatggtaacaaatgaaaatgcctgaggaaggtgaaaatgcagtcctttggaaaagggaaggtagcagtaccaggtaaattacaaattgatggggagtgaatggatgtcttaaaattctctgaggctgtgactagctttctgcacttaccttgcccagagacaaaaggtctagaaaactggggtatgatggcaaggggtggtccagagggacggacagttttcagggtagacagctgagctggtgctggtgactgagctggtgaaataatgggactactgagttgaggactgtgctgcaattatatcaagaaaacaggtcaacattttagtcagggtttttgaagagctccttttggacagaaatttttattctttctgattacaagtatgtacacattacattataataggtacttgttatttaagaaattaaaacagtacagaaaaatttataattttcaattcccaaggataaacactagtaacactgtttctatgtatatgtatccatatatctgcttcataaaaatggaaacagactatacatcctatttttgaatttcacttttgtacttttaaaatagtattgcagatatttttccattagaaaatatatactatacaccatactggtagaattttactagcttttaaaattgcccatgtacttaactgagagttttttcccctagtatagcttcatattactgtttagtattatactttcatttccctttgcagtggctcctttgaaaatttctggtagagcaggtctcaaattttgtttatctagaaatttttaatttctccctcacttctaaagaacagttttactagatataaaattcttggttgacagtttagcactttgaatatatttattcactttttgcccccaaatgtcttttgactggtattcaagggaagatccccatacattgcatctgattgttagaactcttgagtctttaaatttataatagattcatccttcaattcaaaatgccaactatttgttaaagaaataggcaatttgt

SEQ ID NO: 52496 - DNA, 904 bp, Bovine  19866881492769
ccagtacgtggctgcgcttcttgggccctgaccctcctggtataaagctgtcctctgccctctgtgcaatgtccccagcctacagacttgatggtgtcaaccttcgaggatatgctgcctggtccctgatggacaactttgagtggctgaatggctacacggtcaagtttggactgtaccatgttgattttgatgacgtgaacaagtctcgcacagcaagagcctcagccaggtactacacagaggtcatcaccaacaatggcatgccgctgtccaaagaggatgagttcctatacggacagttccccaaggacttcatctggagtgcagctaccgcctcatatcaggtgaggagttaaccatctacattagatctactatgtgccaggctctgtcagggctgcagagggcagacaggagcagtggattttcacagacctgtgggcaggaggtacaggtactgcagggtggggataaaggggcatctgggaggccctcttcccagacagtctggcttgttcacatccccaaattcaggtggacaagtacagttagaagggccaggctgagataggtgttagcaggccagatggagcaggtggaaccacgcagaaacccttaggcaaagatgtgcaaataagaagattctcagctggatgccttcatttcttacctagtatcttccaagcagacagtttgatcaaaatgactatcatgcggacccgggctttttctgacgtcctaataacatgcctttaccttattcacgctaaatgaatactaatactcactaatactaatactcactaatactcactaatacagaaaatacgagggttcacttttcctcagagaaatgaaagctacaaagtgaagtgtgacttgcctaggcagctaagggtgg

SEQ ID NO: 52497 - DNA, 1191 bp, Bovine  19866881523584
agattgagcaagcaaccccagcaggacttggagaagcccgggaaggaggcagtgagagccagggtgggtctggatgtcttgctctgacccaagggcccagctgcttggttgggagaggggtttgtgccttgtatccagcctggcacagatacctgcccgcacagcagcccccagcaagggcactgctctgtgcgccccagtgcgatcagcaccctgtcaggtgacacaggatgggctgctgtctcctgagggatgccctgtgctcacagcgtccaggagcccccgtcccatcgctggctggtgatgggtgggagcgtgcgacttttcctttgcctgagcgagtggccttcactgcacatggactctcttgtgtcaagcacttgtcaggaaggtgacctgggctgctgctgggggccagtcagacctgtctaatcagcgatggagacatggatcagaacttttcttaacttcttcagccatttgacagtttgagtaaataatgacttgtcagtgctatttattcccattcctctttttcagccctatttttggcccagaacactctttatttttgtctgtgttacataaggagggaacagcattcttagtaacccactgtcactcctgtgttatcttgcctacacgaaaaaaggaagtatttttagagagtgaatttcccaaacgttctcaactattctggactggagggataacgtcatggtgggagggcggcatggggagaggcctggtcgtcttgtctttggctggggctgacccctgcacctcaggagctggctggacctcccgcctacctgatgctgccctggccaagaggcaggggctcctctctgcaccggtctaacgtgttcagctggttctggagcctaggaatacccttagttgagattcttcattatgaaggttagagggggtacaaaacgagtacaagcagtgaacccctcttcttcagcattcaagtgacaggctggatccccttagtgggatgtcaaaccagggaagccaaagtgctctgaataagtttaaaaggctccttcctggcagccctgggaaggcatatgtagcttaactggctctggtgtcagaggcagcttccatgaaatgggtgtgagccgggcgagcacagtcccaacaggatgggctcggctgaactgcagagtctaaaaattaaac

SEQ ID NO: 52498 - DNA, 1104 bp, Bovine  19866881786888
cacttacaagcaggtcacatggacccaagaaacattcttctgatctgaatgcaagtccaccaggttattctgaataattaaatgaaaccccccaaaaaggaagcacaaaaccaaaaagagcccatgctcccttcaggggttatgactgatagcaatgtttcagaaattattgcactgcacagtatgtgggaggcagtaaggacagctagactgactcctagcatgacttccaccagagtttcggagggtgtgtggcgtgtgtgggttttgttgctgttgttatatattttaattaacagaagcaaagggctatagtattttgtgctgctactggtcccttctgtgctacagctctgtgtaggaatcctccttcagtcatcagtgtgttgggatatcctgcagtgggcagacgtttttgtagatagggctcttagaaacttacaacctaatgatggaggcagattatgaatataaatatacattgtagaaaaattcaagtataacaaaatatacaaagtataaagtgatataaaagtagaaaggtgaaatgcgagattctagttaggatattttctgtaaaattagataacctcatcatcgttcatcgttcagtcacaagtcatgtctgatctgactctttgcaaccccgtggactgcagcatgccaggctcccctgtccttcactatctcccagagtttgctcaaactcgtgtccattgaatcagtgatgccatccaaccatttcatcctctgcagccccattttcctcctgccctcaatctttcccagcatcagggtcttttccagtgagtcggctcttcacatcaggtggccaaagtataacctattgggataatctattgagaaaacctattgggaggcaaaaaaatcattcattctttacagtaaattataattttaacaattccaagtaatacatattcagagggaaacagacaaaggcagaggaataagtaagtgaacaaataaaagccaccccaaattgtatcacacagaaatattattggttagtattttgatgatgtgtattcttccatgtgaaacacattattgtacagctgttttttttaacaactcaaccaa

SEQ ID NO: 52499 - DNA, 2023 bp, Bovine  19866881229710
tatactgtacaacccagagcgcaagtatttttgaggcatttacggaaaatgtttctttgtctttggacttataaaaatggatctgagaagaaattctgaatgtattctgagtcagcagcagcgaagggcatctaaacaagacagagtttaaaaagacagcgttaactatgtaccaaagccacgagactaaaggtggccccaggcttccaacatttcccagtcactttcaaactgggcaggtccaaaaatgagacatttggcctgccagttggcttaattagggtcaagttaaaaggggtaaggttagcaagcctcagattccaggagattctggacatctagaggcaccaaggcagggtcagataaggccaaagttccctaaacatcatctgtggtcttctggtgggggttaagggaggggggaatcttttcaggggtctgtgtggtcaaaagtattttcataacaatgctaaaagtttttctgattgtgctgttatgtgaactgacagtgcaaaagcaatgttggataaaactgctggtgcttttgcaaaaaatcaggcctgtggcaccaaactgtacggacagtcactgtatttcaccaccatatacccacaataaaaaaccaataaatttaaaagccagtttcatttaagaatgtccttaataaagcagtaaaataattttataaaatccttgagtaaatctttttaatagttacagaatgagacgtgcttaaagcacttacgctgcacactaagtatgatggttgtctcaagaaaaagcacttgtgcgacggtttaagttttaaactgaaccaatcacttttttcataggacaccatttttactattgcaaactatggtttttcagacttgggtatttagcatacattttcttgaaaatgagtgaacctgcaacttcaaggaaaaacaactgacaagtgataacattttagctttcaagcaaaagttagaatttgggggaaaacttgtatctactgcattgagcttgactgcttgccaaaacttaagatatttctgatcacaggtaatattaacagtgatgatgttttaaccttatacaatgaggtgtgtcaacatttggaagatctgcataactcagtaaaccagtattttccaaatgaccaatataagatatttcagaatcatgtgaaggtaaaaaagatccatcctaaataccaatatacaccaatggatttttacagagtaccaaaatttcattgatatggtttcagattccacattgtgccttatcttttaagaaacctccacctgctgagttctgatgtaatatcaaagaataccatggttatttgaaaaggccattaaagtacctcccttttccaactgcctgtttatgagaggtcagattttctttagatatttacttcagacagcatatctaaacagactgaatggagaagcaagtgagaatccaattaaattctgttaagctagacattcaacttgcaaaatatgtgtgtgtgtatatatatatatatatatatgaaatgatacttgcaacttttattttggaaaattgtttttttcattaaaatgctattcatgttcatgtgtaataagtttattatacttttagtggttttaacttcagatatagtaatactgataaatatagcctatataaacaaaagttctttggagtccttaatcattttttagagtgtaaagttcttcagcactttttcagaaagttgaactgtggagataaagttgtaatgccatctactggcaaggcttgaaatcactgcttctcctgaaatctagctgctaccagtttcctcacccacatccagatacccctgaggtgcttttctgtgagattcggtcatgggagggtgaagagggtagacagctgagggaagacagagttcttctactgaggagtggtaatagtattcagtatttctcagtagcctctctcagagcttaaaccactggttactaatgttggcccctgtggggcaactaatgatgatcta

SEQ ID NO: 52500 - DNA, 2727 bp, Bovine  19866880373205
tgcccgacattttaaatcttcataaaatataaatgagcaacagcttcctgctaaccacaaattccccttcttgttttgctttgtctaaatgttcttcttgaatgcccaaaggactttctcttcctgcttggcacagtctgaaattagtttgaatcacattattcttacatccagggtacctgcattatgattccaagggtaatttgtgtcctttaaccatagagtgcttatcatcaatgcttcaagggactctaatctggccttgatcttgctcacttcatcaaggctgctcaggggtagatctgttcactggaaaaaatattggtttcattcctatgacaactaagaaatctatttctcaaccaagccagcgatttctaacagcgttctttttttttttaaatcacatttacaagacagtgttggtacagaagtgtgcacccatttttttcaccattaagttcaaagcaagcagttctttttgccatctctccttgaacttcaattctgacctaaatattcagctcttgagtatcaactaaaaatcttgctctgcctctgtgtgagtgtgctattttttaagtgtgtgtatgtatctctgtgtgtgtttcctttccaatgtctcattaaaagattgacacactatcattacactgttattagttgaaataaatgggtagactttgccttgcttactgctcattcatgcttttattaattttataattaactatatatataattataattttaaaactcttccagttagatcatcctaatggcaggtcactttatctgccaaaaagactgattataaacctttgttttgtgaaaaattcccactgtccacagggtgtgtgcagagacactcgagaattcctgagttgccgtaatattataatattttttgtgaatgaattgatctactttaggaaatgtgatctccaagttggattttgtaaccaactatttcccaggtttatttctggccactaacctggtagctattctctccgttcaaagtcattgtcacacgtacgctgaagatagctaacattctcctaaattctttgaaattcttgattaatagcatcttgcctcaagttgaatttgtgtaaacctcgaactacaatgtggaaaaaactgttaaagccttaatttcacatcaggtgtgaaaaaaatgtgctgtgataaattctttttatgggctcaattcagtcaagacagtatcaatgtgacatcagacagaaatgaagagatttaagcccagaatgtgtatatgaccacactactgtcatataagcattgaggtgggggttatcttaaagcactaataatcatagttctcactccagatagttctcattacctcatcaaaaagctcaaatgattgagatccagatcaagtcttgatactctctaactagctggatgataagacaagttagataacctctttgtgcctcagttttctttctgtaaaactggaggactgagccagaacagcaactgacaggtccatctggcatgacttgggtcagagtatgaccaagttccagtcctggcaccagctgcagtagagccaaaagtctagtctacatcgtctaccagaagcccctttagccagtgggaatgagtggcaacagagtgttagtcctcaggtgggccaggggcgatagagaggttgatatctcctggtggagatgatctctaagatatattcaaggatataaattcttccacctaaagtgaatcactgggatacaaaaaaattaacccattttaaaaagagattctgaaaattcaaccttgagctacactgtataaaaaataatactgttttaatcaacaaggatgtactgtatagcacggggaactctactcaacactctgtagttacccatatgggaaaagaatctgaaaagaataaatatatgcatatgtgtaattgaaccactttgctgtacacctgaaactaacagaacattgtaaatcatccattattgttgttcagttgctaagtcgtgtccaactctttgtgaccccatggaccacagcatgccaggtttccctgtccttcactatcttctggagtgtattctaacttatgtccactcagttggtgatgccattcaactttactccaatataaaataaaaatttaaataataataatgcatctttaaagggataagattatgtgaataaaacatgtaagaaatattgtcatgtcgaccactttcactcaaagatagtgaaagaacgggcttccttagtggctaagtggtaaggaatccacctgtcaatacaggagatgtgcgtttgatcccaggatcaggaagagcccctggagaagaaaatggcaactactccagtatttttgcttggaaaatcccagggacagaggaactggtgggctacagtccacagggtcacaaaagaattagacacaacttagtggctaaacagcaaaataagtagaataaaatatcaagactgctttacttttccagaatgcagcctatgactagtgaaacagcgcccgttctttcaaaggaggcagacatattttccaacaattaaaatgcatgtgcttaaagaaaatgtggtacatatatacaagggaattttactaagccagaaaaaagaatgaaataatgccaatttcagtaacatggatggacctagaaatggacctactaagtaagtaggtcagacgaagacaaa

SEQ ID NO: 52501 - DNA, 1646 bp, Bovine  19866880828004
atttctttgtctaaacccctgtactttttctttagagccgtggggcaacatttgtaactgtacacctttcagtatgattatatcgtctgtccccctcactggcctgtaaagctttaggtgatctggaatctcttctgtctatccttcccgttgtatgctcagtacccatatgatgcctggaaactaataaatattctactagtatatcttaaataaaatatttatcaaataattcacagactgtgacttagagtgctattattacaatatttgtctaaagttaaatatatatagtgtaatttcttctctgtggctccatcttgttaaacttcgtgttttatctctaaatttctagagggaaatgtttccctgtcattcgtgtttccattccatgcttcctttatttcttgagctgtacatctttgagaaagcaatgcttgagatcaggtatcttgagtttattgaaatttttcaatttaaagccagttatcttaaatccttccatagacttctaaactgaccttccactaagaaaaagaaagtgcttatctgaaggaaaaaagaaatggcagctttcctattgaagattcttcatccaagcttgacatatagaaacagtctctctccctgaattttacttagtcataagtttttagctcaaatttcaattataagagctgacaaatatttaatattgaaaaaaaaatgaatggctgcttccaaataacacattgttctttgagaaagatcacttaaaatatcaaatttatctcagctccattatcaattgttctgaaagtctcctttgggtcatttatctttgtgatcattgttttaatccatatattggcatttagccaggtaggacagatggacaaaatctaaaaaaatatataccgatgtataaaaatgcacccacaatacccctactaaaatattaatgataaagaaaccaaatgtaatgtgttcttttttataataactttaaagaattcatgtttaattaaaagtgatctataaatcatgctgtttgctagcactattgactgtgtcgttcccattctgccaaacttaatataaaattaattgttaattttcaggccagtagtctgctcttcaccaagacatatgctgattgtttagacatgagtcagtgaaatataaaacttcataattgagggctctctttgtgatgtcttaaagtaattctgaagatttgacactactctcaatatgtaagtttgccccttttatacactgaaatgactgttctgaaatacaactttagacatgctatgcatcaagtctatttcacatgcaattgaatggatattatttctgtaaagtgcacttaactttaagagtagtgtgaccttgtagggtagtaaagaatggcttatcttttgcacaatcacacacacaactgtggaccaatgtaaacttttctcactttataatacttgaagacctctgggttagcctgaccttacataaacaaatgtaacatttcagcagcctttcacatgcttgttcagaacaactcttcaagccaaaatagccaccaactccaaaataagtgatgattaacttagggagtacttggctctgtctttaagaaggttagcagacctcaaatacaaaattat

SEQ ID NO: 52502 - DNA, 1081 bp, Bovine  19866880872554
cagaaacccaaaaatgaagtgttaattacttctaaggcactatctttaaatatgtataaaatgcattttaaaccgtttttatctgaaattttaactactcttattttcctttcacaattatttagagaaaaaaatgaagtgttttaatattaggcctattttacttcatttcttattttcattctgaaagttctagtaccaacagatttgacagagccaataatctggaatcattcattaacaaaatagccaaatggaggtatacagttaaacatattagatacgtactatatgtttcttataaaatacactggtcaaagatagctactattataaaaccttacattttatgatgctttttaatccatagaacattttaacatgttattccctttgataactcttagatacactagtctatatgtaagtaatcaagttaattgtgagatatttttggtattaaatggcacttgaacatattaaagacaatggaccattgttctattttttggcatgtgtttttgattagttctaatagatttttttatctcatcccatgtgcattgtatcaaaagtaaattcatgtgacctaatgttattaaaatgctatcctctttggtttccctcttctctggaatatactaggcaccatgcagaatattgcaagtttacataatacagaacagcaaatataaattttgagatagtaattctgttgtcttttcaagatatactgcagtaggactaaagactatacatctcagccttagcaagatctaattttcctttctaaaccaaagagccattcccaagatttagactttcattttgcaaaattattccattaaaaatacacaagaaacaccaagacagtaaaataacaaaaatgtgtggctgtatacaaaatcgttgtcttataatgaagtgatgcttctttaatcacttccaaattgtacattctgatttctatataacttctagtataatatattgagtactgaaagttgcacaaggtggttaatttaataattacaataagaagaaaagcttacatttgtaaggacaaattattaataatatt

SEQ ID NO: 52503 - DNA, 747 bp, Bovine  19866880915792
cccatcttcaaatatatagttcatgcagcaagcagtgatctttgctttctgattgttgatacacaaagcatccagtatcgataatgatgcactagtgacctaaacagaagagccatttccaaactttttcttttcttccttaatgctgagtctgagaggcatgttaaatctggcacttgtgcaactactccagtttttctacaaaagaggaaggaaattcctttcaataggaagcaaaagaaaagtttaaaaatgatatttgcttagttgtgtataacttctgtattgtcatctttcttttacagctggaacacattctttgtttttaatatctaatcatcagtagactgatttttttttttaatttatttggctctgctgggtcttagttgcagaatgtgggatctagttcccttcctagggattgaacctccacctcttgcactgggggtgtggtgtcttaaccactggaccaccagggaagtcccagcaagctgttgttaaggtcttaaagtcttcaaagtcttggtggctggttttcgtgcatttctgactttcaacttggcgagagagtgcctggatgggctctttcatccattattgccatggttttcatccttgtgttcagttttaattaaagtgtactaaactatatcaatcagatctaagtaggaaaataattgtcctaattaaaaaacaaaaacaataaaaattcttatggctggttgatttcaaaatattgagtgc

SEQ ID NO: 52504 - DNA, 1881 bp, Bovine  19866881197720
tttgcctacttactcccttctaatcttacctttaccttatctctcacctttctgacagtcagctccttgctctactgcttcaagtcttccctctccttcttctacattccacactcttactctatgatcatttacccttccctacagtcttaatctattggcctcaacacaatatccttagagtctttaatttcacaaactaaacttactaacaccatggtataagtgatgcagatttttttgtttaaaaggcaagcttgtgattcctaattctactgtagctggcaataaagtaagtatgatcaaatatgcatctgcacactttgcctaaactgtcagagtttaagcccatactttctgggctcaatagaaattcagctgaatcctgaataaggagagcctccagcagttttttcagttttctgaaagaaaggagaaaagagagcagaggtgcttattatgggaggtacaggcagtccaagggctaccttgctgtgccagctataacagaaggtatgtgacagattaatttaggccagcacacaccttactgggaagtatgcattaatataggaaagtggaattaagtatttaagtctgtcaaaataaaaatgtgaattgtctctgctccctcctcatttcatatatactagtttttcaaaggtggcttttgtctggtgatctaggtagtcagctctgacaactctgactcatttgtaaattcaaaggccttttggaccacagtctaggtactggggaactgatgacttgttttttttagcttagaaataaaaatttaagtgagtatttttgagtgaatagaaaaaaatgagaaaattttgtttgtagaaaagggaggtgagattctgtactggtctgaaaagtccatggtaatggtttaagaggacagggaataatgatatatataaaacaaagaagaaagtctataaaattcaatcaacttttgtaggcttgtttggtacaaaaaccccaggaaagcttggagtagcttggcatttcagcaaacataatgggccttggccttcagcctactccagtgcattcattttctctagggagtttttcttttttcttatccaaggaactggtctaaaaacagttagggttacttaagaagtgatgatttactatttagtcctgaaagggctgtaatgtcttggaagtctaatctctacctgactttatctgaatgaatgcatctctcttgcttgataaacatatttactggacaacaatgcaattatttggctaattatgatgtcagttgacacaggtggtataaagacatcctaaagttggattctggatgaatgtggaagaggagagtgaaaaagctggcttgaaactcaatattcagaaaactaagatcatggcatcctgtctcctcactttatggcaaatagatgggggaaaaatggaaatagttgcagattttattttcttgggctcccaaatcactgtggactgtgattgcagccacgaaatcaaaagacacttgctccttggaagaaaggctatgacaaatctagacagcatattaaaaagcagagacatcactttgctgactaagatctgtatagtcagagctttgatttttcaaatatttaggaatggttgtgagagtttgaccataaagaaggctgagggatggaaagaattgatgcttttcaactgtggtgctggagaagactctttagagtcccttggacagcaagcatatcaaaccagtcactcctaaagcaaatcaaccctgaatagtcattggaaagactgatggtaaagctgaagctccaatactttggccatctgatgcgaagagccgacttattggaaaaggccctgatgctggaaagactgagg

SEQ ID NO: 52505 - DNA, 1387 bp, Bovine  19866881218894
tatatagaatatataggaaaaaaaacttaagtagtatttaagtattaagcaagtatttgaagaaattctcgatcattttagtattcacagaaacataaactaaataaaaaaggaaaaagtacttgattatcagattggcagtaaggacatagataaaaccaagtgctgatcaggatgtggggaaactagaacccttatgtactatgcgaccccatagacagcagcccaccaggcttccccgtccctgggattctccaggcaagaacagtggagtgggttgccattgccttctcccaatgcaggaaagtgaaaagtgaaagtgaagtcgctcagtcgtgtccgactcctagcgaccccatggactgcagcccaccaggctcctctgtccatgggattttccaggcaagagtactggagtgggctgccattgccttctccgtgtactgcttctagttatgtaaacaggcataaatattctggagaactgtactcactaagtgaaatgacaaggatactcacaaaaatggatatgtgctcactgtgacctagcaaacttctagaagcataccctaaaagttctcctgcaagtccatgagagaagagaagaattgtttgtggatttgtttgtataatcaccacgatgtaaaagatatttcaatttttgtgactataatggaataacatgcaaccttcagaggtagtgaaccaaatgtacatacagcaagatgaatacatcctatttcttaaaaacgttttagaaaaaagtaagaactagaataagatatatcacttatgtaaattaaagcacatgcatgcacataaatgatacaacacactacataaaacttactatgtgcataaaatatctctttctaatttacaaatacctgcatatacaaaaacatataggcattagaataattgtggggctacaaagtagcccaatgcaattctatactttttgtgtatgtttaaattttttcaaaacttttttttttcactttacattaagtacttcatccagtctcatctggatgctgcagaatgaatcttaaagacagactcatagaaacaccacatcttgctgagagaattgcttcagttttgtgcaagatcagaacttggtgtcactatccaactaatatcgttccagttcctgacaatgaattctacagagagataatctgtctgctgctctgttctactgagagtcctggatatcagggccaagaactcaaacttccacataactgatcataaagttcttggaacacctccatctcacatgaacctgatttagtttttactgcattaggatgctgaatcctgaatccacatgttcctaacacaactccatcctcagagggattaggatcaaaatcaaaga

SEQ ID NO: 52506 - DNA, 712 bp, Bovine  19866881256254
atgaatggatcttggcattctaccaaacaataacatatcaacttttagttatccattctactttttcctatctttgcatgtgttccacttcttttttttcttccagttcttttagcaagcatgttaaatagtcagtttctggtttggggcagatcatttgcttctgagcaatcatcttacatctgactgttccgtattcattgttgagtcatgcacacaccccttggctttgttttacatattattacatttagttgttgttgttttcttcagttgctactttgaaacactgtatttcaatacctactactattactatatttgtttctttccttcatattgctcaaatttgggtatagatattggaatgttgaataagtagccagcaatcatctaagtagacttactattcaggtaatacttttggtggcaaaatggtggcaaaacaaacaaacagtgcttcatcataagctgagttcataaacatgaaagaattaagagtaaaaataataaattaaaatgattgaaacatcgccctttaatcattagactcaacctcttcctcataaagcctttttatatgtacaattaacaataacaaatttattggagttttgtctctcctttatgacaatgcccactggagctggtaatgagcaggaaaatgattaagaggcaggtagcagagaagctaaggatatgaatcaaagag

SEQ ID NO: 52507 - DNA, 1414 bp, Bovine  19866881348051
gttttcaccactttcttcaatttcagtctgaattgggcaataaggagttcatgatctgagccacagtcagctcccagtcttgtttttgctgactgtatagagcttctccatctttggctgcaaagaatataaccaatcttattttggtgtagaccatctggtggtgttcatgtgtagagtcttctcttgtgttgttagaagagggtgtttgctatgaccagtgcattcccttggcagaactgcattagcctttgccctgcttcattctataccccaaggccaaacttgcctgttactccaggtgtttcttgacttcctacttttgcattccagtcccctataatgaaaaggacatctttttggggtgttagttctagaaggtcttgtaggtcttcatagaaccattcaactttagcttcttcggtgttactggtcggggcatagacttggattaccttgatattgaatggtatcatcagagaaaagcaaatcaaaaccacaatgacatatctttactcacctgtaagactggctatcatcgagaagacaagagataatgtgttgccaaagatgtggagaaatgggaactccgtaaactgttgaagggaatataaatcagttcagccattatggagaacagtattgaggttcctccaaaaactaaatataaaactgcctttgatccagcatttcccctcctgggtatatatccaaagaaatgaaagcagagatacctgcactctggtgtgtactacagcattactcatgatagccaagttatggaaaaacttaagtatctgccaacagataaatgagagaataaaaatcttacagtccaaggcacagaatggaagatgtaggttggtaggaggggatgaaggtgtctctgagttttccagttggactcaatgaatgagcagctggaaatacaaatcagtatctgaagacagagatgtgggctagagatctaggttagggtgtgtcttcaaagtacaagtgatagctgcaatcatagcagggaataagagcatatctaaagcaacagaaaaagtacatagtcttttttgcagatgtgtacagggaaaaggctccagtaaaagatggtattaaaaatgcatcttactcaactctttccatcatcatgggataaaggcattaggagttcatacttagagcttccacgtgtttcctctacttttttttttaattttttagattttattggaatgtagtttatttacaatgttgtgctagtttcagctgtacaacaaagtgaatccattatacacatacatatatccattcttttttagattcttttcccatataggtcattacagaggatagagtagggttccctgtgctatataaaatgttctcgtcagccacctactgatgtcactttttctgacat

SEQ ID NO: 52508 - DNA, 756 bp, Bovine  19866881561843
tgagagtatctgaaataatgggcttatatggggaaacaatacaattcatcatctgttgccagccatatcactgctgctttatgacaaagcaagagccttacctcctgctaacactgtagtttcatggctacagcttcagacttcttcaagttcaggtacaaaaaagcagatgagttgttcaacactgcaagttctaaatcacttcactctccatcaatgcagttagtgggcacaggcagagaatgccttctttagcaaacctttacttctttccatctctactgagtccatctaactcagaagattttgataaaattagcaaaaatgaaccaacacctataaacacctatggatactatgagctcattctattatttccttgaacactataacctcaggcaacagctatcttgcttttaaaagtaaacaagtgagagactaaccaaatatttggctaccagataaaaactaaattctgagccctcactctccaaagcttctactaaattagtgttacttgtaccttccagcatctcatttctggtaccaattactacacaggtcatgcatagttcttggtttcagaaaataagattaaaattttctagtttaaacaaaaatgagtttattataatgtaatagataatttataatggtttttgttggtactcaggaaccactacctttggaggatatataggagaaatataccgctgacattgggggtgatcaaatggaaacaccgtcattatgtca

SEQ ID NO: 52509 - DNA, 1221 bp, Bovine  19866882056349
ccttggactgcaaggagatccaacccgtccttctaaaggagatcagtcctgggatttcttttgaaggagcgatgctaaagctgaaactccagtactttggccacctcatgcgaagagttgactcattggaaaagactctgatgctgggagggattgggggcaggaggagaagggaacaacagaggatgagatggctggatggcatcactgactcgatggacatgagtttgagtgaactccgggagttggtgatggacagggaggcctgacgtgctgcagttcatggggttgcaaagattcggacacgactgagcaactgaactgagctgaactgataacatataataatgtatatgaatatttttatgttttatccaggtaaatcgcaacaatatggaacgttttgggaaaagtgctattacaggctttacaattgtataaaaaatattcatgaattacctgatcttgaaattgtttgaaaggtttgtttgaatgcttcagtatgactctatttggcaaaattgccaggtatgaaggtggtttactatattatatataaataatcactgctacctctctgtgccaaatctctatcccaatgtacgctgtgaaaggatcaaaattgatatgctacttctatcagaagaaccttagtgattttgacatttattcagagtttcttttctatattctcagtcatctttttgctcaattctcatatccaaatttactgaatactttttacaataatagcaaaaggatttattaagctttgcctattttagggcatgattttatgggtcatcaatatacttgctctaagaacatgaggactactgtaatgaaaaaaaaaaacaatgaaaataaactagaaaacattctaatcattaaaaaaaaggggcttttcatgtaaattatttcctgtgccacttacaaatctatctttagtaaggtggttggtcttgagaatcactgttaaagaatacaaaaagtattctctcaagaatggttgaatgtggcttctaggttttgataataaaagcaggactcttcatgcataacagaatcagacttttctattttattttttttaaggcatgccttcctttgttattctggacaggtgtttccatagtgcaatttaaactacaaaaaatggctcataattgccaacacctactttaactttcttaatcaatcataaaacaacctcctctttca

SEQ ID NO: 52510 - DNA, 1342 bp, Bovine  19866880353715
tgaatattcaggactgatttccttaggatggactggttggatctccttgcagtccaagggactctcaagagtcttctccaacaccacatttcaaaagcatcaattcttcgacactcagctctatggtccaactctcacatccatacatgactactggaaaaaaccatagctttgactagacagatctttgttggcaaagtaacatctctgctttttactatgctgcctaggtttgtcacagcttttcttccaaggagcaagtgtcttttaatttcatggctgcagtcaccatctgcagtgattttggagcccaagaaaatagtctgtcatggtttccattgtttccccatctatttgccatgaagtgatgggactggatcccatgatcttagtttttgatctttttttttttttctcagcctcattttagatattgtgaaaaggaggcccaaagattagaacagcttgtccacgatcaagcggtgggagctgggagcctgcactctttctctgaggtactactgctgttgccacaatctaccttgactgggccagaaggaatgcttacaggaggagagagaggtcactcttcagccacacatcagtcagaacgactggcactaacagagagcttgctgtgcttgcagctctgagagaaggccctgctgccaggtagaggatgtatcgaatcacttagcttttctttgatttgcaggaatgaattcagagcatggacggacatcaagcctgtgaaacccataaaagccaagccccagtacaagcccccagatgataagatggctcatgagaccagctacagtgcccagttcaaaggggaggccaataagccaaccccagctgacaataaggtcattgatcgcagaagaatacgcagcctctacagcgagcccttcaaggaacctccaaaggtgagacagatcttctggggacccatcagcagcctgacatggaggggttaatggtagcagagatgggggcggggctactgccaactctggtccttaaccttaaagtcccttctttccgtcttagcacatagagacagagtggcttcttaccgggaaagtgaaactgaaagttgctcagtcctatctgactctttgcaaccccatgaactatacagtccatgggattctccaggccagaatactgaagtgggtagcccttcccttctccaggggatcttcccaacccagggatcaaacccaggtctcccacattgcaggtggattctttaccagctgagccacaagggaaccccaacctttgctaaatcaaaacggaatttctaaaggaacattacctaaaacaaggattcccg

SEQ ID NO: 52511 - DNA, 2952 bp, Bovine  19866880360267
ctctgtgcgaccccagagacggcagcccaccacgctcccccgtccctgggattctccagccaagaacactggagtgggttgccgtttccttctccaatgcatgaaggtgaaaagtgaaagtgaagtcgctcagtcgtgtccgactcttagcgaccccatggactgcagcctacaggctcctccgtccatgggattttccaggcaagagtactggagtcgggtgccatgtgctaagcatttcacttgcatgttctcatttatctttccaaacccctttcaggcaggtgctcactctccccacgtctgcagctcaggaaacacgctctgagagggtaaccatccccattaggcacagtcaccaaggaacatgacatgagtgggtccctgaaccctgggccagccgtctgcggcttgaaccacacagagcccagattctcatcaccttcccaagaggccaacgtgctggcaaggctgatttccaactcctcccgggtcccagcacccaggcagggctcagtgaatgaacggacatactcctttatcctccatccctccagctgtcatcatgaaccgcagtgcctccggcacggaaaaccaaagaccactttctccgaggcttcccctgggctttccccactttctgggtgggatgtatcctttgcagtcagacttgaggaacagcagtctagttgttaggaatcagcgctgtttccgtggcttcaggacacagtgcgtgtggcgaaatcccacaggcgctgaccgttgcagtaatgctgcggagcataatggttgccactatgacaactgccgagttcagagaggataaaaattttcattgcattaggttcccgggaaatcagttttatcacaagtatttccactagcagttcactactataatacaacacgctcagggagtgaccctccagagatgcttgctgtgccctggagctgggggcagggagcctgcgtgttggggtgggggtcgagaggatgccccccggggctccctcccacttcactgtgagggcagatccccagaaagagcctgacctccaagacaggcaaagtgggagttgcttctgactgccccctcaaagctacatgaccaagcaaacccttatgctctctgagccccgttttcctatgtgtaaaatgaagacgataacatcctgactggactttcacaaggataaacacgaggaaaaagcgaaggggcctcccatagacccaggccacacttgggccctccacgcaccttcatatctcttattcccatgtcttctgggccggcctgtcacagtccataagggttcctacccatttcagccttattactgcttcttattagaacatttgtttccaggctgatgggccagaacgacaaacctccaaaggaaaccttaatcccagacaagaatgaatcttccctgcctggcagggaacgaagatggatcagctgccgttgctgctctcacgagccagaaactcaatttagagcctgtttggttgttggagggctctgggaatgctgctgccactgccagaaaaggcactgtagggagagaaagaggacgagagccctgctggcacagagaaccatgggagcaggcagtagggagtcaggaggaccagagatggcggtcctggctggcgccttgtggggctgggggctgtggaaggcttcagggtgaagacatgactgagttttacgagaccaggctggtggtgcacagatgtggatccagggcccaaggcagggaccctgggggctaaataaccagaagctaggcatcgcttagtgtggggaagcatcttgtgttacaggacacatgtcagatccctttgtccccacagctttctgtcccacaagggttccatcagagctccgctccttactctctctgggagggcagctcccataactcgttagaggctgggactgagagcgcgccttggtgacagggtgcatggagccacccctgcctcccctctggttgctcccgcctgaaggccggggggaaggtggactggctgtcaggctcccgcacagaacccggctcctcagcctcctgccctgtgacctgggcaagtcacccttcgccccagctccaggggagccttgatatcttcacctgtcacacaggatgaaaggtggctgggagggcgggcaaggcctggaatgggacctgctgggcaccgggaggccccgtttgctgagtgtcttccctcgccacaccctgagccctggggctatgtccccagcccagcccacctgtcttctctccaccctcctgtttctcccgtgttcccttcttcgccgggccgcccacctgcctcctcctgcctccatctctcactgtcatctacctgcctctgccctgccaggtcggcctctctcgcatgccccactctccccatccgtgtctcggcccctccctttgtctctccacctctgctctccctcccccacacacgggggacccttgggctgtccaggctctggcgccccctgaccgtctggtggctcttcccctatagatcgggctggtggccatcctggtggccaccggtggtggccatgtcggccgtggcccagctgtgggaggacgagtgggaggtgctcctcatctccctgcaggtgagtgggggtgggggcccactggctggttccccaggaccctcagaacaagacaacacctttaggtcactcccattcctccagactaaagtccagaaggtggagtaagggtccacatcacagagcaactcagagacaggaagaattctagcacccagggtccctggactcccagtgtcctctgaaaaatagagacagctgcctgccccacggatagagataggccggaaggatgccggtgaccagaaggtctgggcacggctgggagccaacagtctctcttgccccttcctgtacccaagggcacagca

SEQ ID NO: 52512 - DNA, 1249 bp, Bovine  19866880434021
cctgccccaaacatgctgccttttctaagagtttacgccttaccctcacaccctttacaaaactactcatcaaagggcaacaaaaataattttggaaaactttctatgtgcctggtactatactaggctattttttaactttaaaaattttacttcatttagttctcaaagcacctcacaaaataagtgttattcttcctattgtacagatatggaactgaggttcaagaaagggaagaccagaactggctccgggtctatctgattccatctctgttgtgcaataatctctctggaaagtgcacccagcctccagtccccagcccccagtccaagaaaaggacctctctcctctggatctatagccagagatttctctcttggcctagcactgctgccagcttcagtgtgtgattgcctctcaccaaggagaccacctcccagggcagggccaggtgtgactggtttgggtcgccagcacgcagcagtatacagtatacacgctctgtgaggtttagacggaaaggtagaggcaacttgagggatttaggagcccggccctacctacctaattcctactcaaccaccaatcagaggcgggacctcggcatctgtagccaaagcgaagccctgcggaacggaaaaccaaaccccccccgcctgcaccccgccccaggcccgcacgtgccgggcctcccggcccacgttcctgctgccgggctgcaccaaccgccggcgggggagcggctaggggcgggcacagggagcagcaggaataaccaagcagcccctcgcgaggaggaccccgcgccgcgggcggcgcagctgtgaggagcaagagtccccctacagccctcccgcgcccggccgagcccggcgctcagccacccccacggagctgaggctgcagtggttggaacggccggccccgcccctgccgcgtcggccccgcccccttatgaggttacaaattgtcgcgctcggagccgcgggcgcagtggccgtggccgtggccgtggccaaggctccgctttccgccggtgctccggcccgtctggcggcccgtcccttcgcaccctcggccgtagcggtccccgcgctcccctgctcggcgcgaagccctggccccggcggccggggcatgggccaggggcgcggggtctggcggcttcccgcggggccccgacctgtactggcttcgtcatgaagaccctcatagccgccactccggggtcctgcgaggtagcat

SEQ ID NO: 52513 - DNA, 2692 bp, Bovine  19866880492659
tgagatagtgattttgaaatgtacactctgctatataaggacgtgtgattccgtgcatacgcacatcactttgacgttctctcttctgcaccttgacgacctggcaaattcttaatcatccttcaagtcctagctcagatgtcacctgctctttgtaactctctcagcagccccctgtccacctgggaagaacaaagctgctctctcccccgagttaccctctctttaaccctctgtgggtgccttatgcaaggatggttgttcacagtgggcctcccccactgtttgccggcagtgcattcaccaccggcccctccagttctcaaggccacagtggctgtggtagagcagaggcaggatggtgaaggcgctggggagctgatctcctggagtctggccttggcaaagtccccatgtggcagtccagtccttagaatcgagcagattcccatgagggcctcagtcagattcagggactctgctcaaagcaggtggccattcatctgtgtataagagcccttcactttctgtgatgtacatactcatgcctgctgcccaggacctcctatatgtaatcaggataccaaagggccatgttggccatgacatttctggaagagagtgaaatctgagccaagggagggggagaggctatttaggccctagggagtgtattccataagctcacctaccacactctgggcttccctcataggtcagttggtaaagagtccacctgcaatgcaggagaccccagttcgattcctgggtggggaagatctgctggagaaggagtaggctacccactccagcattcttgggcttcccttgtggcccagctggtaaagaatctgcctgcaatgtgggagacctgggtttgatccctgagttgggaagatcccatggagaaggggaagactacccattccagtattctggcctggagaattccgtggactgtatagtccatgggctcacaaagagttggacactactgagcaactttcactcaccactccaggatccccagcaggctcatatcccagtgcctcaggcccaccagatacatagagagggccggataaatgttgggagatgcggcatggtggttaaaggtgcctccacctcctctctgtcttcctccatctctccagagccctgggcagtcttgttcatcctggaacttctggtgcctctcagtgccctagtcctaccatgtagtgaacttggattatgttccaggcataggcagacatcagctcattcattcccctccacaccctggaggtggtcttacctaggtgaggataggtgaggtgaggagccgtgaagtgccagggtagagatctggaccctgttcccaattactctcccattttcttcaatatttgtgtggtcttcctggggtttgaggaaagatgactagagtctccaggttggggaaggtggagctggtactgagttgtcgctccagacaggttggtggctaaggcctagcactgatcttcccagcaggtttcttgcaccccacccttacccccaaagacatgtgaggagcaggtggaagggggcttaccaaggggagaggctcagaggtgccccagaatgcccctccctgctcgctgtctcaccgagggcagctgctcttggctggcctcactgtgctcacctcgtctgcaagcctgtgtgttcttggaagtcatggaaatgcatttcttaaaaatgctcagcaataccaggctttggtctctgcccagcactctggcctcccagaaactcttcatacccatcacctcctctctgctgcccggacccatacgaggtaacgtgaccctcactgagagccagtgatccagctgaaccctgtccatcagggacccgtccagggcctcccagcgagtctgtttcttgtgggggatagtgatgatggtaagtatcatcaccactgacagagctctaactgtgtgccagggcctcgctgaacactctagatggctgaagcacaggctgatgaggcagcaggcctgcctcaccccagcccacagctcctttatgttgccccttgtttgtgcacagtccctgccctggagcagctcccatcctgggcggcaaactcccactggatcacgcccacacaggaggtgtacgagctagtgccctcagcctggaggcttggtaaagcccccctagaaggaataatgctttttccctacttgagttgtcctcaagattaaacaggaggaatagatcaaatacttagcatatgacaaataaatacatgataaatcttaaaatattgatattgtggttttgggggtttgttttctcaagtttaataaaactactcagttaaaagtttcaaaagaaggttaacttcttcatgattttgagttgacaggtgcacattttacatctgtaatacagctatttcagagaacctcttacataggaactatacctcaggatgaccaataatgaaagtatttggtttggagcacaattaggataaattgtacctttcaacagtatctaattcttttaaaacccagaagtgttgttactatatttttacttcctcatatatcaagtagatggtttgaactgcttatatttcttatttctgctctgtgactttgagaaagtaatttaatttctctgtgtttcatcatatataaagtggggaatgagagta

SEQ ID NO: 52514 - DNA, 1627 bp, Bovine  19866880523311
ttaagcagttgagaaaatgtctatcattaatacgtttttccttagctaaaggaaggtaggatctctgacccatattttaagaatccgttttcccaaaaccttgggaatcataagtggtggggaaatactgatgactgcaaccaaatatgttgccttggctattttgaagcagagggaaataaataccacagcttatcggtgatgttctaaaaaaataaatgtctgaacttatgaattcaatattgatttcatcatctaactgagataagctcatgaaaatatattttaacaaagattgaaatgtatgcgttgacattgctgaagtaaccattcttgtttttaacacaatgcaggcatggattccgtgaaggaacaacacctaaacccaagcgagcggctgttgcagcatccagttcatcttaaggatttcaacgattagtcgcacaataaatgttctggcttttaaaattatctggtgtgctaaggtatttttaataggcttgtatcaagtgatttacataggtttgtgaatgtgacaactaaaaatcaggtttatttgttaagtggctgttttggaacactaccttttaaactgggttgtgatactgcttaataggattgggcctttacaagcagaattctaagattccttaaagatgacattaagaagtaacatctgtgctactgtgagaactgtgttacctctgtggtctttgtggagtggttgtcgtcctgtatgataggctttggatttctggtgagaacacaaaggacaggagttgaaggaattccattttggaaaggtggttttgtggggtttttgtatttgatttacaatgttgcgttagttttttacagcaaagtgattcagctatacgtttttctttttaagattctcaggtgatattaactcttggcgcccagctcataggctgtgtgtgctttttaaggtggtcagctaagtgaacaactaggtatgagtcaataagaacatttgtagggccatgtgcaaatgcagtgtattgagtagaatgcaaaggaaggccaagtataaactcacttgtaggctagtagaatttttttaatcctcacctaggtgatcattgacttttcagggctctgaatttttctgccttgctttctggtgtttctgccagttttttgaagtgaagacaataccaactttgttggactggtgagagaatagaacattaattatacatcacaagtgttggagtaactagcataaaatagcaatgtggccaagctgtgctgtcccaacttgtagcttcccattttttaaagaatttaacaactttaatctgaccttgaaggagttttcatgatcatcactgcctccgcaaccttacctttaaaaactgccctagaatgcattccaagattagttaattgctcccttgcttttttccttagctcctaactctttcaggtctcagcttgcttctacaggagccccagctgatctgaatctatattgggtttcgtcccaatatgtgttatgtaatataatgactctgttctacttttgctgctgttcgctgttgagttgctaagtgtgtctgactctgcaacgccatggactgtatcccaccaggcttcctcagtc

SEQ ID NO: 52515 - DNA, 1236 bp, Bovine  19866880661130
ctgtgccactcctgagcccactggggtctcagaaagagcaggaggcatcagccacatgcattgcacgctatgtgtgccatgaacagtgagccagagagtcaaggctctggaatgtatgatgcctctttgctttgggtccaaccctgcgtggggcactggggacacagagatggaaagtcagttctggtctctgcacggagctcctagactagggagggtcagggtcagggagccagatggaaatggacaatgagacatcaggactgtggccagggagccttaggggactgggggagcctgagaagctttgtgtaggtgggaggaaaaccaaggaagggttcaaaagagagagaaagggaggtaggagcgaaaacataaagcagagaagaggcaggcgtgctgggagagcctgagatgtctcgtgtggcagaagccgagggtgacggtcccaggacagcagttgggagacgtcagcaaggggccaacctgctcagggccttaatgtctggagggagagcttggatcatcctggaagcaatggaagctgtgggaagggctttaaactgggagtcataacactgaatcagagttttaagatgagctcactgaagagaaacagaggatgagattgaagtcagagccagccagagagctggagctgtgacctacgctggttaaccacacggctgtagacctaggagcctggaccctctacttattaagttggaaaccttgggcaagttacttaacctctttgtacctcagttttcccaactgcaaatgggatgataacagcacctatgctgcagggctgctgaggcggtaaatgagtaaatatagtccagtgttagctcccagaacagttagaaccatgatccagggagggaaggtgtgtccgggccctccctctgcggctgtggcctccagcctctcccctcctccctgggtcccttggaggcccccttaccttgtgaagccagtgcaagttcatctgttgccccacggcgatgtggcatagtgccaggacctgaaggagggcccggagggcaagagtcaggcatcacgtgtggcccgggttcctgccagttccccagacaccctgctcccccggctctccaggcccggctcaagcagtcagctaaccagcaaaccattttcatgcccagccctgctcagctctgcccaaacctggccgcctcccagattatttcaggttcctccaggtgccttctcctc

SEQ ID NO: 52516 - DNA, 768 bp, Bovine  19866880676156
tggatgacctccgaggtcctccagatctggagctggttgtgcctgccttctgccaggggcagaataaatgggggtcccttagcggggttgggccttccaggcctgtcctcaccaccacccagctctgccctaccccatcctcctcactcttctgctttctttcagaatgaaaaaggcaggccttgacctccccctgaggcagtttcaaggtactttagacctcctcaagcgtgtgagaccctttctggtgctcccatccctcccgcaatctgcttcccttccctctacttaaaaaacctggaatccggtctccttccggctatctgtgggcacaggccttggttctgtgattgtgtatttttctttgtgggaccataaatcatctaaccttggcctcagggctgcgatttctctgtggcaacaggggctgggctgtgggaggctggcttgcttgcagtgacttgccttcctccgttcctgccactgggttaacagcccttcacccttgccgcacatctccctgcagagtctgatgttgcaggctcgaagctagggccagaaagtctccatggcaccccaccccctgggacctgaacccaggcctccggcttcccaggctggaagcccccctctgcaggcgggtggagataattcagtttccagcctgccacgtcacccggagccggcagtaggaacaggagcgcagctatgggctgcctgaggaatcccaaactagtcattggagctttcttaaaagcccctcccagc

SEQ ID NO: 52517 - DNA, 2038 bp, Bovine  19866880739085
gtctgaacttcgagcaatctgtgtggacatctatccatgggtctgtcccctcccagccagaggagggtggccttcaaagcggtcatgttttagctgccagaactgtattcatcacctgggacagtggccacatcctctcacgcgtcttgagcccccatccccacctcgccaagcccttgtgccccatcttcccctttctgctccccatcccgagtcaaatccgaaggccagagctgtgctggcctgtctgggggtcaataggaaaagagggggaatggagaagtgatgcagtgagagggtgagggtgctgcctgtggccctgttggcatggtgatgggggccaatcctgaggccaggggttcgccaccgtgacctggaagaccgctggggccccctggtagaaactggaagaacaaaggggagggggagccaggacaggaagaagacgaacaagcatcctagtgcatgagagtggacctggagctgcccggagggagggcggccccagtctatctgtcgttgagccgcggagagccggtaccatcctcctcttcctccttgtcatccttcatgccttttagtctctggcgggcaaagtcctcaaacacaatgtcgtcatcgctggtgggaaagacaaggaaaacaggcatgtttgcagggcaggaagaggaagcttatccagaggggtcagagggcctgcacagcccggcgggacccagaggctgtcctccaggactggtcttggatagaaaggcctgccaggccagcacatctggatgcccatcaacgacagtgggaccagccagttgcagaaataccagagggaggcatgagtttgctaagggctggaaatcgacccagcttgagaagctggggttcaggcacacatcaaattgtgggtgggggcggggagtgaggcagggttagggccagaggaggaacttattccacaaagaggccaggccgacagcggtctcacagcatattctgagtcccccaagaacgggcccaggaaaccccatccacccccacccgaagaactaccctcaggaagcattcctgttttctgagaaaaccccaaaggccctttctccagggaaatgacagctcacattctaccctgagggatcttggatatacagggcctgtgcgggctggggtgggggctaggcaaagcccaataggggtggggagcagaaaaaatgtgagtggagaaagagggtgcctgagaggggttccagggctaagggctgcctctaagaacagtgagctcccttctactaataaaatatgtctacgtgggcccattctccaggccccagccccacagaattcagccaattgcacagggtatcctccacggggtgacttaagacccgacacatctcctggaggacaaaggaagcatagatttggagctggagtgagaaagctgctcggccctggaggtggttcatgtctgcccagatcctcccctctggccactgtcctgtgaggtgacagcctttgaccacagggccatccatactggtcctcgtgagtcagaaacaacaaagatccccagaaccttcccccaccccacagcctgattccactggctggacaccagccaagcaggagggtcccagcccagggccacaaaccagccctgtgacagccgaccaggtgctgtggatggacgaacggactgacggactgacggacgtgcaaggacgagggaggaagacagaccccaccaaggcaggaggaagaggaacaggcaccgagggtccttcaagtcacatgcaggcaagcgggttgctgaagaggcgagcagaggcggctctcagcagacgggttagaccgctgctcctcggggttaattagcataagtgcaaataaccaggtagccccgcccaccgcccaaggcccgccccgcccatgtctccaggcagggttctgcttacttggtgtcaagttctatgagattggtatctaccggcgtctcgtgctctgaactaaacacagggcagataccgcccacaggttactggcgagt

SEQ ID NO: 52518 - DNA, 1117 bp, Bovine  19866880741503
ttcctgctggttgtcacgtcttctcctcatccctcttatctctgtcccgcctgcagccttctgcattcagaggagaccgtgcgtgcggaaacagcttattagcagccgggcttacagggtcacacagcactgcagccacagatcccagcccatgcaggacgtgtgagcacaggccatgctgctgccgggtgctgcccgccccagactgtgccctgggctagaactctacacacagacactgctgtgggtgcacccctaagggtcccctagcatctggggcacctccaaatagaacctggagcctgaaatctgcatcaggatggcacctgagtgggagccgcctccctgcccttggtaccaccatggacttcagactcacactcagaggcagagctgtctggcaggactcctattccctgcatgtccctcgagacagagactgtgtctgtggcccccaggacaggagcgcccctgctttggctcctacagctccagggatgggtactcctgtccgcatgctgcttggccctcctctgggctgagggttctcccttctgagacagtggccggacaggggcagggcaaagtcctgtaacattgggtgagaatcccagacaggctgcctactaaatggtggccttggagaagacactgctttatcctccccgagcaccgacttcctgttctgtaaaatggggacggcagtgttggacagaagtgcttggcaatggcagggtgtcaggagttgcttttcttgcttccatccctcccgaagtctgctcctcagctgcaatcctgctgccagttctctgataccacccagaacaaatccagccaaagggcaggaacactggggtcaaatgaccagggcacggggcaatataatcaagagctgggttttcattccccgccctcctactgctacctgtgtggccatgggccaacggttcagaacctcattcaatccccagcttcctcctctattcctgaagatgacatcacctctacctcatgggagggctgccaggcctgaatgtgactacagatgtaagcttaagtcgccaaatccacgatcgttcctataattatcatttcgtgtctgacagccctttaatta

SEQ ID NO: 52519 - DNA, 1388 bp, Bovine  19866880761533
ccttgactagacagacctttgttggcaaagtaatgtctctgctttttaatatgctgtctgggttggtcataattttccttccaaggagtaagcatcttttaatttcagggtggtattaattaggcttactaaggaaagagttttctggttcctcctatggcagtgaaaagttacagagccgaacatgcgggcccaacaagtctattatgtcaatagacttcattcaaccatgacattctggagcagagggaagtttcagaaatcatcaatcctctcattttagaaataaatcaacagcacacaagaggaactaaatgctgcagccaaagggcttgccagtcagtgacagacccaataccactactagacactgaacttccctgtggtctgaaacctgctagtcccttattgtgttaataaccattttattgaaataacttcaagaaacagtccaaaaaaaaaaaaaaaccaacagaaatattccataataacttctaagctcaagatataaagtgaactagagaggacaagaaaaagaacaacaacaaaaaaatcactttgttttcattgtatctcttggacaagtttttatatcatggtcatcaaccagtcccatgactactctttagaaactactattatgcctgttaacattacaattccaataataattgctatcatttaccaaatacttaaaatgtactaagttcaatgtcagtaactattatcagaggtaacactggagcaagaacacagaagttctaacaaagacaaccaagaactaattacatggaacctataaaaaatgtaaagtactttggcattgtcatatattgctagtgatgaagccaattagtgagcagcagaccaaatgtaataagatctgcaaaaatacttctaccttagcacagatagtgatcaaactgtttcatttttcttctggacacataagaagacaatattttcccatcccctgttcacctaaaaaggatgatgtaactgatatatggctaagggaatgtcatggaattgatgtagaacacttacatttaaaaatctccctcaaataatccctctcccttgccataccagaagcatcattccaaaagagaagcagcctggatacctgagccaccagtcaaaggagaactgccaggccagcatctgataagtaacacctacacttttgagcaactttgttcagttgctcagttgcgttgactcgttgcgaccccatggattacagcacgccaggctttcctgtccttcaacatctcccagagattgtgcaaacactgaacttagtgtttaagaattttattatgtcaagacactgaacgactcatagcatttgttatagtagctagagttactcgttcagattaata

SEQ ID NO: 52520 - DNA, 1249 bp, Bovine  19866880808931
tgaatgggtaaagaagttgtggtacacatacacaaaggaatattactcagccatgtaaaggaatgcatttgaatcagtttctaatggggtggatgaacctagagcctattatacagagtgaagtaaatcagaaacagcaagatatagtaatctaatgcatatatacagaatctagcaagacagtactgatgaatttatttgcaggctagcaatggagaaatggaaaaagagaacagacttatggacatggggagaggggaggggagggtgagatgtatggagagagtaacacggaaacttacattaccatgtgtaaaatagatagccaatgggaatttgccgtatgacttaggaaactcaaacaggggctctgtatcaacctagaggggtgggatggggaggaaatgggatggaggttcaagagagagggtatatatgtacaccgaaagctgattcgtgttgatgtttgacagaaaacaacaaaattctgtaaagcaattatccttcaactaaaaaaataaataaattttaaaaaagaaataaaagagagtctcagaaaagcctcagctctagaatttgggactaacatctcataaatgtgggcttttgtcttttcacatcaagtgctgttaagtgagaaggtggagtctgaccagccttagttttgacatcagctccacctgtttttaaccaagagcaagtgcttagcttctcagggcctcagttgcttaccctcaaaatgagagcaacatccccctcttaggagtttcataattaagtgagtgatcgtatgcaaaggttatggtagatagtggagaatcccatggacagaggagcctggtgggctacagtttatggtgtcacaaagagttggacacaattaaagcaacttagcatgcacacacatggacgtgtgttcaataattccttcccctctcccttgcccaacattctccctgatggggacttggcatttacctggatgaacttgaacctacggttgtcatctataggccaagtcaattcagatcattttgaaacctagtctggccatctgacattgtcacactcccacctatagactagatacacattttatttggcctcatccaagtccttcaaaaatacatcagacccacgagtcaacctgggggatggagcctgagcagggctctagtctgccctccaggctgccattgatctgctaatcaattctcctccaccaggtagctaggcagctagggattcc

SEQ ID NO: 52521 - DNA, 1818 bp, Bovine  19866880809543
cccgggccaggcacctgacacccttgtcccaagggcagcaccgccctccctgcaggagctctgggacagacgtgtgcctcctagagactggcaggggagccggttcctgggctgcagctggcactctgggtggggggcatgtttgctacccttcctggcccctcctcagcacccccttgctcccacagtctatgtgacgctgacctgcgccttccgctacggccgggaggacctggatgtcctgggcctgacctttcgcaaggacctgtttgtggccaacgtgcagtctttcccgccggcccctgaggacaagaagcccctgacgcggctgcaggagcgcctcatcaagaagctgggcgagcatgcctaccctttcacctttgaggtcagggactgccagcccccggggccccattccagaagcatcacttctagcaagccctctgggcaggcacacaggggcagctggggcagcagctccaggccacgcaatttccccagcgtacactggggccagggcactggcacttacgctgcctggtaagtgtctcttctctggccactgccagaggtgtcacccttacccctgcactactacccggaccctcccaagtccaggtcatcgtgggagaaggaggggtcgagggggtgctgcagagaaagaagggagtccttactggcccccgggtcactccaaggctgtctcctccttcatactggctgcccactaaccctgcttcaacccaactcccaaacaagaatggcaagtactggatttccctgctcagctgcctttccactccaggattctggattttcagtttctcagactctgattctgtgattcagtgaaatcccctgactgtgagagtcagagaaggagagaggataaggagccatcctctctgttatagacgtattatggctgctgtaactaaccattgcaaacctagtaataattaaacctgccaattagaatacaaatgtgttattttacagttctgaaggtcggaagtcaagaacagctctcatgggctaaaatcaagtgtcagcagggctgcattctctctggagctctgggagagaaactgcttccttgccttttcctgctgctagaaactgctcacattctttggcccctggcccagcccttttccatcttcaaagccagcaatggccggtccaatctttctcgaatcccatcactgtgatgctgacttttctgctccctgctttcactgttaaagacgctgtgattatggtgggtcgacctggctaatccagggtgatctccccgtctcaggatgcttcaccgaattacactgtaagacccttttgcccttgtaggtaacattatcacaggttttggagattagaatgtgaacatcttcaggggccattattctacctaccgcagtgcacatcatagaaagaccttttcagctcttgttctgtgggggctgtgatgccctgaaatccttggctttattgcaggggcctctagtgtaacatgaagcatagcttagcatgttctgatgacgtaaacatggtctgtcctgtgaattgcctagtctgatggaagggacatggtcagtccttaggggcactggtctgatgaatgtgtgtggggattgggagacctggagaggtcagtggtgaatatgacaggtctctctgtcctcttaacagatccctccgaacctcccatgctctgtgactttgcagccgggacctgaagatacagggaaggtgggtcacccctcagggagcatccctctgggttcaggacactgtgtcctcaggtccccagctctctgt

SEQ ID NO: 52522 - DNA, 862 bp, Bovine  19866880812607
ccagccataaacgttttttttttttgaattctcagactaatagatctttcctgcctccacgcctttgcataagctgattcttttgatctgtctctgttcagcaaactcctattcatccttcaaaaccctgttcaaatgtgactttaagaaatttccttaggctgggtacaagggcctctactctgagcatgcagtttcctgtgacttcatttctctagaatttgattgaatataatttctcccctgggtcattagcttttctaggactggcaaagttgtattcagtagagagttagcaaatggctggatctgcagaagaggatgggtcccctggggatctgctgatcatcccataaagcccaaggccagtgcaagactgcaagaagggaagcagctcagagataacatttaatgggaatcagtgaatgatactaaggttaaatgtcaactggcataacttaggtactcaatttgttgatttttgacaactattgatttgatatttagctaagcatcagctctcatctaaaaccctccaagatttttgctgacagtgagccacagctagtagcatgttttatatgccaggacttactgcagtcttaggttacagtgccagaggacatgtctttggaactgagggtggggggtgacctgttagagacatagttctctaaccttgttagaaacccattactgttttgtcctgcgggactggcagagtattctttgaaggccactgacagatggaaatgcttcaaaagaatttaaccctttctcatgaggaatgactgacaggagggataggaaatttgctgggagaatataaggagactcgagactcttttcactcggtgaaaag

SEQ ID NO: 52523 - DNA, 1126 bp, Bovine  19866880832532
tgatttttttttttttttttaagagcaggtaggatagagagcaggtagaaagggagaaaaaagatgtgtgactgtcagaaatgtgacagacaagaggcggctctgaggcaagaaacccgtcagacttcctggggttcagtgaccctgtaaaacctgaaatttcctctcaaaaacagaggagagccacaatcaccatctccttgagaaggcatttacttctgcgaccccattcctacccaggcccctcagttctgggatgagaaccagcgagggcccagctggagtccagagggctggggttcagtctgagctcagcatgacttgccatatcatctggttccctggtcagtcagaaacacaggttaggccccactttgtgcttgggtgctgtggattcagcagtgaacacctaagagctggcttttacctacttggtttgctccacccctgaccatggacaccccctgcccttccctggctccaggttccttctgtccagactggggctggacttgtgacctccagaggcactgtctgctctcactgaggtccatctccttcttcattaagtctgcctggcagactcatggccctaatttatgggcatggcctttcccgggctgggagaggtgaccgggggcagttattattcctgtggtaatgcacttggctgccttcagagtccccttcttggctccctcacccctctctcgccgcctctaccctcttccttcagcactgcttcatggtgacttgcccaggggtggccactcctctggagaccacctcagctaacccttctgtgtactgatgggaaagttgaggcccagtgagtgcaggagcccatccaggtcacaccaggtgtcaggagcagagcagatccacagctccggacgccccctggggttttcccttgccctgctctggatctgagtacctggcagggcttcccaaactctggactctgtatctgtgcctctgtggtaattgcctcctgcaaccaggtctgtggtgacctggagataaaaagccaacaaagaaggggtggggagctctctttaacttctatcagcagctttctgcaggcctcagaaaccccctccagccccctaccagcagaaaccct

SEQ ID NO: 52524 - DNA, 1201 bp, Bovine  19866881068489
agagcaggcacttagtaaaaacaaattccttctcctttctctaatcacctttagatacagagacagcaaagaccataatgaaactgactacaatataacttgcctcaggattcttaaatttattcaaagctgtaaaagatatctgaaacatttagtgaaactgtattacatttaatcaaaagccactatccttctttaacccctaaagaattgttagaaagcagccagttgagattttcttttaggaaaattaatataatatggatttagaaaagatgggtgcagttacaaaatgagttttcacccgaagccacactaaacaacaaacttacacttaaaacatggttctatttacacagagcttttgcctgatatgtgaatgcacacctgcactaacaaaactcacagcatcacgcaaaccctcttaccttatgttcaaatggagcaccataatagccatcattcagcccaaaaattatttcattctggttgcgggcatgaatctaagagaggaggaaaagacattattagttcatctcattccaatcaagttttaatgtgactagaaaatgacgggacctacttcaatgttgaaaaataattggctatgtctaacaagccagcagaaaacaaactgcatatcataggacaaggcaatcaatttagagtttcctgttttagtcacagttctcacaaaatcatcacatgcgatcacaggcaccatcattcacacacattttccacaaacacttcttgaggttgttacagaaagcaaattccttaagcacaggggattaagaggcatactatacattatttaatctcaaagaaaacacaatccaggacttccctgttggtccagtgagttaaaatccacctgcaatgcagaggacatgggttcaattcctcatctggaaaaattccatatgccaatggggcaagtaagcccatgcaccacaactactaaagcccatgcaccctagagtccgtgctctgcaataagaaaagccaccccaacgagaaagctgagcaccataacgtaataaagaggagccccaatcgccgctgcaactagaaaaagcccatgcacagcaaccaagacccaatgcagtcaaaaataaataaaattaaaaaaaaaataacagttcaattagtctgtcaatgctttaagtctgtcgtagaaaaaacataaaagattaat

SEQ ID NO: 52525 - DNA, 1051 bp, Bovine  19866881146173
tgagcacacatttcctaaaatgaaaacagcttaaaaactgctagatttccagagaactagcttctgattttgagaaactcagaaagaaatggtagaaaatctcacctgagccctaaacccccttgtcttaaaataactgtgcttttgcccctgaagggctagcccagacatgggggcatcctcacctgacttctttcccacccagctcctgcctcatcctctgctccaatcactggacactttctcacctcccgagtccctgaaaatcacctgctctttcttatcctttccctccatccagcagcaatccttagtctgtcagaacacacctgtcacatcagctgcaagaagtgttccaagtaatttgttactatgatgaacagtttgtgaatgagtttcatttctaaggaagatacagtggattcgggtgttttcctatgaagacgattgttgttgttcagtcactaagtcatgcctgagtctttgtgaccccatggtctgtagcacaccaagctttcctgtccatcaccatctcccagagttttgctcaatctcatgtccattgagtcggtgatgccatccaataatgctttgccttatttgtatcccaatgtgcaatcatgagaggggaaaagcctgttggagattctgctgttgaggctggaatcacacatgccataacttattctatgatatcaagccacatggaatcatgaaagtatcagctctcctttctataatagcagaaaaagtctgagaacctatgtaggctttgctctgctttgacctaaagtcttgtagtccagcagagtttcctctttggtccaggactggtttacaggtaagggaattacccaacctggtttgcctggactactccagttataacattaatggttccatattccatgaaagccctcaggcctaggcaagccaggatgatcctatttataggttgacagtgactgagagcccctgaacctcactgagtggatgacccagctggtgaggccccgcatcgtttctgtcccccttttacagatgaagtggg

SEQ ID NO: 52526 - DNA, 1272 bp, Bovine  19866881194720
cataagccccataaggtgcctgagtgtgaaacagtaaaaggcacccatgctccccttcctcaagacatttttctaccatctgctaggaagagttgataaacacacaattctacaatgtctacaatgggagtggtgtcttcatactgtggtaccctaattcaataccctgccccctccccttctcagagatgatgtcatcagattggtatggattcttcttaccctttatataaatattaatacatacttatttatctacatgtagaaaatgtatcaatcagttttatctggtctttaaaaatataactgacatcacagtgaatggatcactcaggaacttgctgatttcactcatcagagtgtttgtgctccatcttgctgagccatacagatctcatatttccattaagtggatcagtggcaggactccaggtccctacctccactctacttgaaccaagagagtctgttttgttctctacatattttatatcctggagtatggcacaaggggattcccaggtggtgctagtggtaaagcacctgcctgtcaacgcagaagacataagaaacatgggctgggaagagcccctggaggatggcatggcaacccactccagtattcttgcctggagaatccccacagacagaggagcctggcaggctacaggccataaggccacagcgagtcagacacaactgaagcaacttagcgcacacacgcacagcacatgtttacttgcacgaacatggtgcctgccctgcagcgggaaacccaagcctctgctctcccatccccaagactctgggaccagaggtttctccagagacctggatgtggatgcactgaggaggggaagaggggctgtcctcccaatctgcacacctacctgatggtgacgtcagcctggagtccatacagcttctgctccagggccttcctgaaggacatcagcgtgtgctctggggccagctgagggggaaggtggtggtgaggggaaagccaggggctagtaggcctggttctaatccccctccttcaagcagtagctgtggggccctgggcatccacacagcttctctgaagctcagtttccttatctgttaaatcatgcctgtctcacagattttttgggggggtggggggagcaaagagagaaacaggggtggttagtgttgatgaatataaatgtggaggtcagaggatatttttagtcttctgcctctttatagtcttgggctgagctgaatgccgagtttcctcctgtttat

SEQ ID NO: 52527 - DNA, 2870 bp, Bovine  19866881220997
tgtaatggagaggtgatggccccaagtagaggcagtaactgcttgagtcataaagcaaggctgtggcaggtctgagagacaaccgaggcctcctacttttggtccagtgctctgtcctgtgctccagctcccactcactatgtccctgcaggaagctagtgaccagcttgtgccttcttgcccctccacatgccctctctcttgtctccttctagggcagctctggtgccgatcttctcctttggagagaatgacctgtttgaccagattgagaactttcttggctcctggttgcactggttccaggaacaaattctgaagatcgtgggagcttccattctgcacttttctggccgtggtgttttacagtttttgtcttattccctgctgccggcccatcaacactgtgggtaagccaagaacccaggctgggaggggttgggttacagggcaaaagacttgggcttgggctgaaggggaatggaaatgggccagacacatccttgtcctcctggaattcaggttctatactgggaaatggacatactagcaagtaacccagatgcaaggcatctgagatgagaagagtaacaggggcataaagaccagttgccattactgataactgagcacctactgtgccaggctctgcgctggctacttatatgcagctgctcagttgctccgacaaccttggaagcaaaaactatcatcctcattttattgattgcaaaaggagacctatagaaggtaaatcatttccaaaagatgaccctgcatttgagtaacacaactgagatttgagtcaggatctacttgacttttactatgtcagaggaaggagtttttatttctgagaagacaatcccataaggcttattgcagaagacggatataagggaagtgcactttaggtctgttagaactctgtatagtagcaatcatcaggctacaaaggagagcctgaagaaatttcctataaataatgggcatggactttagtgcgtggatttaacaccatcttttcagttatttggtcatctcatttgctctcctcttggattccaactatcttccaatggcaaagcttataataagaggtctgtttatctccattcacccagttacctttagttgagtccaggaagtcaagagtttccctggatttgggggtagtattttcaggaatgttatagggctgctgcctccagatggctctgaagagaagaagacatgacagctgctttctgagccagatagaaccagaggaaggaagttgataaggcctcctatttcctccttagaatggggggcactgccctctagcatagctggagagagggaagtagggtgcttggggtgtgggccacctcctcccagacatttgggcatgtccagtgatggcatctgagactcccatgtccacatgtccctgagactaagagcacatttgcacggctcacaacctgacaatgattctgcctagctatgagacattaaacaagttacttaagctccctgaggtgagtttaacacctcagctgtcaaacaggaataaagcaagttctatccctgtgggattgctaggaggataaaaagaaatcatgcattaaagtatctaatacattgcctagcaggaggtcatgcagcctgtggcatttgatcatcagagcttggagttgccttaatatctagactaggtcacccaaaatacaactggaagggaggcagtacaggcaccttccagcaggtgtgaccaccggcatggggtcctggcccatgggatactgggactccagtgcttcacccacgtctgtgtcttgccatggggaagcccatcgaggtgcagaagataccgcatccctccaaggaggaggtggacaggctgtaccagcactacatgaaggagctggaaaacctcttcgaagcccataagctcaagtacaacgtcccaagagaccaacacttggagttctgctgagcagagacgctgccccaaagggcagggctggactggggaggatggagggaaggtgttgtgatcccagaagtcttcctggaggtgtctgttgaacacatctccagagccttcactgactcctgcatctccaccccatgccaggccctgggtcacagttggctccatggcagaggaaaccagactggcatgagggatttactctcctgcactgactcctctgtaatgggccctctccttggttctgcccacctgagaaatgggatagatactgggagagaatgatgtctgtgtctctgtcctctgtggtcctgttgctcaatgagcaggacaaagagcagctccaggtagcaggtttatcttcctctgctttgagtgacagctggaagcagccaccagctgcagccctttctcctacaagttccctcatcctgcatcctgcctgtcccatctccttcctccctgagctggagaggagggggaggtcacaatcccctaactcatcctggcacctttgagtttctgagtcctctgagccccgggctggcagccagagggagatccagaagttggggaaacagaactgggctctgtcactggctaaatgactgtgccctaacatcttcatcctccttctgactcttagtttccctgagtgactaagatgaactttgacctcagttctgaggtcacattagctgagaacttcaatggcagttcctactcattcagccctaacagtggcatggaatcggggctccataaatttcaattcaacaattgaaagatgctgggaattccctaggagttccatggttaggactctgtgctttcactgtcagggcccaggttcaaccccggtaggggaactaacatccctcaagccactcag

SEQ ID NO: 52528 - DNA, 1362 bp, Bovine  19866881231292
tcaagcatggctgctgagaggtgcaggtaagttacctatgtgtgtcacactagatggcccacaagactcccctcaaatcctattcattcatcaatcctcatatcggccctacatctctgcagatggaaaaccatgggcagacagaggctggacactatgtggacttccaggccacatagtggtggaaacctgatttgtctctcccagcccagtaccctactcactgcacacaggatcacacttccccatggggggaagtagtgccacgtgggcactacagtcctggccactacccagatagctccattactcaccgagacagggaaatagtcttttacgtacttccataagatccaggacctgaaggcctggatgtcctgcctccatgccatggcatgtctctgtccaggtaccaccaggtggcatacaggatagtgaagatccagaatcttgtgaacaggaggcctatgaagaccacatagcagataaaggctgggaagggaagcaggagcattagtgggcactaatggccagggtgaaggatgcactctccccatatgcccagcactggcagcactgtcctgtccagccctcaccccggggggaacaggtcagcctccccagtactccaaggaggagaaaatgcagtcgaggatgtgccacactgggaccctggatttgacaccagaactaactccaaactcacttgttcccactgtaccaggctgcctcattcactctggttttcccttccctttccctccctgtctgttaagtctttctttcccaagtgctcagtaaattcccagtagcccagtgactgcataaattgtttctagttatcattctttgggacctcagagaaatggagacattctttctgcccagccctccttctgtacactcgctgtccatctttctgtagataaatcccaccagattcctccctctacttaaacttctcatgactttgagacacagcccaagcaactcagcctgacattcagggtcctcaagaaacttgctccagcctacctcatgcacaggccccctagcttcagctacactaagctgctcagtgctcctccgattgcctgagctccttcaacctcttagcttttgctcatgcagtttcctctgcctgccatgccttttcctactgaaggaaggctgaagaggccaacacctgactggactgtaggttgggggtgcagcagggctaggactgggcctgacgaggaattgccatctgatctttgattctcagtccctaccacaggctaacctggtttcatctcaacagtcaggtgctaagataccagtggagcctaatttccagggaatattgccccttccagaccc

SEQ ID NO: 52529 - DNA, 1500 bp, Bovine  19866881421870
tgaaacctgaggttgatagcctcaagtgcctgctcaggagttgctgcaggccacgcctccccaccgcatctgccagccctccttatttgccccctctcctccttgcactcacatcttccctccctgtggcccaacagagatcagcgatggcatggaggtctccgatgagctctctgtgtgttcggacaacagttatgactcgtatgccaacagcgccaccaccccggtggccccgcgagggagcggcagccgtgccaagaccctcacagaccggagtgggcgttagctgaagacccgtctgtccagctgtacctcgtgtggagaccagagaagcccacagagctggcagaagcatgctcggggcgctaagtccacaggctcctcgttggctccggtcccttgtcagccatggcctctcttggaggggctcccctctagcctctcagatgcccctgcaggcctggggctcctctttccgggaagtttggggcccagggcccagggcctggtccactccttgaggccttcctttgcatccttacctggaagctttggagggtcactgggctgtgccatgccccctgcagcagcagaggatgtggagcctgcgtgtgcccacgtgtgtctgttctcctgtctgtgctgtgaggaaaccgccttctcggtgattctcctgcctcaaggggctgggctgggcctctgccccagcacctccgctcttccatcagtctcaaagcacaaagaagctcggcccaggaggaatgcctgctccagtggcgggaacacgtgtcttccccaaccagcctcccgctgatgctggccatgtcccccaggagctgctggagatggcaagagcaggctcagggctgctggatccacacccaggagagatccacagactgacatgacctcaggttcccacgtcagtggccaagagcaggggccacctgggaaaagtgttcaggcatggttgatggtgggtttatgaccaaggaggcctgcagtggagggagcctgaggggccttggccaggatgattaaagctgccatcttgacacgtctcatctctgaattatcagtgggagggtggggacagagcctgcagggtttgggattcaggtcccatgactgaggaagaaccattctcggaagtgaatgggagagtggcagagtggtgggccccttccccgcctcacatggcactagggcttccttaagaggcctgggttcggggcgggggggcgggggcagtgccccatcctgtggtgggggagacagtcttggagaggtaaagtgaccgtccctggccacacagcttagtacagcagagctagaaccccaccctggctgtggaccttccgtaaccagctgggaacagtaaggcaggtggggcgggctcctgggcccactataggactgggcagtgggactagcagtcacatgaagggtttcatgagctcctggcctatggaggaacaggcccttaggagacgcctctcc

SEQ ID NO: 52530 - DNA, 663 bp, Bovine  19866880381653
tgaaaatctctgaagtactttacttcttttaaccatgcaaaaaaagtaatctgtgactacgcttttttttatagaaaaagctttctgtcctcttcatgtctttttagccttcatttgtattcgtttgctcccttttggatgaaaacagtgtcagatcactgtagaatatctggcactcttaagatgacttattggaaatcatctgaattaaaatttcaaagcagtatttcataagaccaaatgaactgaaaatataaatttagtggcaatacacaatagctgtcactctcctgtccattataaaagcctaatgaatgaaaattatgatttaacacagcaaatctcataagaaaatgagctgtgcccccaaaaactatctgtacaggttaactgcagtgtatagaattcctagaaaacaacattaagtatgaattcgtatttcatattaaaaaattgccatctgtgattacaaaatagcctccaatcatcattcattcatttgaacaatgaattacaaattacaaataaggattctaacgaacatcattttcttttctttaggactataagacctacctggattttgttcttgcattagaaaaccgcaaagaaccggcagctctgcagtatatttttaagttacttgacattgagaacaaaggg

SEQ ID NO: 52531 - DNA, 1513 bp, Bovine  19866880428829
gcttccatgtccttcactcatctcctggagtttgctcaattcatgtccattgagtcagtgatactatcaaaccacctcattctctgccaccctattctcgttttgcctacagtctttcccagcatcagggtcttttccagtgagtcagttctttgcatcgggtggctggagtattagggcttcaacatctctccttgcaatgaatattcagggttgatttcctttaggattgactggtttgatctccttgcagtcaaagagactcaagactcttctcccatcaccacagttcgaaagcatcaattctttgatgctcagtcttctttatggtccaactcccacatccatagatgactactgaaaaaaccataactttgattataatggatctttgtcagcaaagtaatgtctctggtttttaacatgctgtctaggtttgtcatagctttccaaggagcaagcatattttaatttcatggctgcaattatcatctgcagtgattttggagccccccaaaataaaatgtgtcactgcttctgctgctttcccttctatttgccatgaagtggtgggaccagatgccatgatcttagttttttgaatgttgaattttaagccagcttttccactctcctctttgaccttcatcaagaggctctttagttcctcttcactttctatcattagagtggtatcatctgcatatctgaggtggttgatatttcttccggcagtcttgattccaacttctgagtcattcagcccagcatttcacatgatgtactctgtatataagttaaattaaaaagtgaaagtcgctcagttgtgtccgactctttgcgaccccatggactgtaacctaccaggctcctcagtccatgggattttccaggcaggagtactggagtgggttgccattgccttctccaggggatctcctaacccagggatcgaacctgggtctcctgcatttcaagcagatgctttaccgtctgagccaaggagccacctattaagttaaataagcagtgtgacaatatacagccttgttgtactcctttcgcaattttgaaccaatcagttgttccaggtaagttttcttactgttgcttcttgacccacgtacaggtttctcaggaaacaggtaaggtggtctggtattcccatctgtcaagaatttcccacagtttgttgtgatccacacaaagatttttgcatagtcaatgaagcaggagtagagaagtttgggaaatattaaataataccactttggcataaaaaattatgtcaaaattatgtgggtttctttcagcatattgatttctcatatgagttacatgattcttgaagcactttctttaaatgtatattataccactaaagatatctccactctggcaggcacaattacatggtggaaaagcctggcttttgcagtcatgtgttgtcagaatgcccactcttactttctattagattcatgaccataggcaaactattaacctttttggg

SEQ ID NO: 52532 - DNA, 1017 bp, Bovine  19866880766905
ttgttttctttttaaattttaatgtcataagacaataaaggaagcagttccttaacattaatggaaggtaggtttggaataccaaaagtctcttcctttatttggcatttcggatttctccatgattatattaacaataaatcatcaagaacctaagtatttgaaaagtgtttaattcaaagaggataaaggtcatatttacacacccttctaagaagagtgtctcaaaaattatgactgcttacatgaaagaagaaaagtttgaaatttaaccccatttcctatcttgttggcacttttaaatacaactgtgtgaaaaaattcagaattaccaaggattttaacttaaatcttccttaaaaataagacaacatccttgtcaagttacttaatccaaattcacttaagtagttacaagagtgaactctatttgagtaacaaaacaagtccgtacaggagcagagtaagatgtgcactcttatttatttaaaagtattgtgtgctgaaaaacttgtttagatgtaacacgtttacgtgtaactcctgtggagctggagaaaaagacttgcttaaaaataaaagcttaaaggaaacgtctttcctaaccactgctcattccttagacaggtgcagatgcctaaagccctccttccatcaagcccctactcagaaaaggtgcctcctacacacaatttatttggttgctataacactcggtttctaagccacaaaaggattgcttctgagtggagaggataaagcataagaaaaagggagggtccggctgtttcagcgattgatcaattcaggttctcacttggagatcctgcttaaacacagagatctgaaacaccctgttgttaggtgtcacaggacaaggcgatctcttgggatacaccaggcaagggactaaaattttaggggttgcaactacacacgcagcagctccggattcttatcaaaacaatagcgagtggcacatgtcaggcggcccacatgctcaaggggataaagagg

SEQ ID NO: 52533 - DNA, 1558 bp, Bovine  19866880822663
aaatattctaggtaggcacgcctcatcagtttaaaatacatttgtcagtgacctttaggacttaactgcctggatcaatattttaatgaggttttcaatgagtgtctagcaaattcaagaacctttctgtttttacaaacagggccttgaagttattgaatctacaaacttaaaatacttcacgaaagagatgacagctgaattttatgcactgaaggggatgttcttggctcagattaacaagtatgtatgttatataggtggcgggtgagagaaagactcatcagattatttaaataattgtttgtaacttaaaaagcaatgtgaagatgaagctagaaattgacatgagttggcatcagtcatcagacatggtgttcagcttttgtatctaggaaagtagtaacttgcagcaggatcagaaagctggcttgagtgtggtactttttagctatgagttgcttgaccatggaactgccaataatggtttcattgccccattttctcagcgtgctgtcttggaaacagagttgattccttttatggaggtgattcttgctttagaggaggggtcagtcaactggaaaacactgtggtgggtcctcaaaaaactgtaaacgaagaattatgtcctagcaattccactcctaggtatttatggaaaagagttgaaaacaagagctcaaacaggtagtcgttcatgaaggttcacagagttctgtttacagtagcagaatattgaaactactcaaatgactggataagcaaaatgtggtgtgtacaaacagtagaatattataagaatgaagtggtattttcccccatatgttgctgtgcttagtcactcagtcttgtccaactctttgagaccccatggactgtagcccgccaggctcctctgtccatgaggattctccaggcaagaacactggagtgggttgccatgccctcctccaggggatattcccaacccaggtatcgaacccacgtctctggcattgcaggcggattctttatcgtctgagctaccaggaaataagtaacttttatttactagtaagaattaaaagccttttttaacaggaagttaccccttggatgacctgaaaattccatgctccatcatgagcagagggggccaggctttctgtggtgagcagtttgtgtgatgaagaacattgctgaattctcttctgaaatcttttgatccaggaattcaaccatatgtggaattcaggaattcaggcttatatgtggacagacatgagttttataatgaaagctcaagcacagaataataaaaaatacaaccatgatttttaaaactgtaggatattccatttcaaagatgctatggctatggtagtctgatatttttcttatctgttgaaactcttgttatatgaaaattacttaaaataaggctggtaaatctgaattcatatagcagatctatgacattttagtcaataatttatttcatgctttgaaaatattaccttcgttagaagtgtgtttaatattttttctttccacgtttagaattccctattaagtt

SEQ ID NO: 52534 - DNA, 1206 bp, Bovine  19866880881718
attatttcttgattaatctagctgaaaacattttatgattaatttaccatatgatttctgccctaccgaaacttaaattttggagtctgcgagacaaacatataggatatacataaataaaactgctctagtgagaatcaagccactatcaagatgacgtggtaaagtttatattaataacaccaaaaaagagcaataagttgacagttctgagggaatcaaagtgaaggaaaaaaggttttttaaaggataacatgggcttgaatttgttagcaggtcaaaaaaggagcaactgaggggagatactaaagaaacaagcatgggataagatcttagaggttgaaaaaaatatggtcaaaagcacagctgtagccttggaaagaagacaacagaggaggaaaagagggtgaggtgaaaagaaaatttgggttgagaacaagtcatactgagtggcccagattttgtaaataaatgaggaggcaagatgcagctaagaaaggaagatgaggttggagtcttgagaaaaatgaagaggtttggaaaaactgttgtagcgtggtcagtagagatggctttaaaagacattagcgtgtctatgaggccctacgattagagggcatgtgtttcataataccttccaatgatagatcaggaaaaggcagcagaaagcaaatgctggggctgattcacggtgcgaataccagtgaggaattctggagtgccggtgaggctctagagcatcctgatacttgggtcaagcacctgaagagcagaaagagtatcaagagttttatttatttagtaagtattatttacttttgtatactgatcaactttgcgtgtatgtgtgtgtgtgtgttcagtcgtgtccaactctttgtgaccccatggactgtagcccgccaggcccctctgtccatggaattctccaggcaagaatactggagtggattgccatttcctactccaggggatcttctcgacctaggaatcaaacctggatctcttgcatttcctgcaatgcaggtgagttatttcccactgagcccagtcttcccaatacctggagggcatcactgctttgatattccatgtctaaaatccagtgcttcatcttcttcccaaacctatttctatacctgattgcctcaactttgttaattatgaccttcctagtctcctatgtctgaaatttctgactcatct

SEQ ID NO: 52535 - DNA, 1049 bp, Bovine  19866880977376
cttgtcattagactgttaaatactattacttttatatacagccctttagacaaatcccattcgaatctagtcttcatttattcattctgtaatatttactgagcacatactattttcaggcaggcttcccaggtggctccgtggcagagaatctgccagcaggaaacgcggatttaatccctgggtcaagaagatcccctggagtaggaaatggtaacctgctccagtatacttgtctagaaaattccaaagacaaaggagctagcaagctgcactccatggggtcacaaagagtgagacacggctgagcacacacacacattattttcagacactattctaagctcggtagattcggctgtgaacaagaaagatttccacctacctctccatctcctcccagtgccatagagctggggccagagctggcattgcagccccaggcactatgacttctggagttacagtgaatgatgaagtcaccaaaggttttaatgataagaaaataaatattctacacaaaagaagatgaaagaaagttctgtttaaatgatgaggaaagacaaataattataatagaggaagcaaaactgatcttaacaaatgacactagtgataccacggaggacccctacacattttgttatgaagttgctacctctgaaggattaccagtttgctatgtatgatgccatataaacaacaaaaaagtctaagaatacctagtattgatctattgatgccatatacacaacaaaaaagactgggcttctaagagtgcaccttttaaaaacaagatgatttatgctagctctaaagaggccattaaaaagaaatctacatatattaaatgtgaagtgaagtgaagtgaagtcgctcaatcatgtccagctctttgcgaccccatggactgtaacccaccaggctcctccatccatgggattctccaggcaagaacactggagtgggttgccatttccttctccaggggatcttcctgactcagggatcgaacccaggtctcctgcattgtaagcagaggctttaac

SEQ ID NO: 52536 - DNA, 995 bp, Bovine  19866881231485
cccccaggctcctgtgtctatggagctctccaggcaagagagtgcgtagccattcccttctccagcatcttcccaacccaggaatcagacccatgtcttctgtattgcaggcagattctttactgtctgagccaccagggaagctctgatacctatgttttcttctactcgttctgttttttttttttctttttctttttgattttactttttatcccacttagaatgtattttgctgtgtattatctaaggtaaaaagataagtttgtttttccaaagagttaaagtcaactgtcttagccctgtctttaaatttttttctctatcttaaacactattaagtgaatttattatctaagaaatcctgattaggcaagctccgaagatgaatagtatccctgaataggtttctaaaacagaagagtatttacatatcacctttcgtcttttgacagtttccttatttttcttgcctgctatatcctgttttcttctttgtgacaagggagaaaagttagacaaacttgtttaaaattggttatatttcctaacaccacatactatttcagatagtgatttataaatacattaagtcagtttaacatctttcccaaatgaccctgactgttcatgatagaactactgcagatccgttggtcagatcttaagtctgaaccttgactactcaataaaggcacaaccagatgaagtgggcagtgaatttggtgcacatccttgtcacaccaaagccttaataatgttttgaagttttaagtcctcagagacaaaaacttacaatgactcaccagtggtcatagaattcacatcttacacagatttattaattatgaaactttaaaatttttttatcatgttttataaaaaacatatcttctttcattcgtagttcttaattcatttaatttattcatattagccagctttgatcagagaatcagggtcagctttgatttgaattttcacaaatgttcctg

SEQ ID NO: 52537 - DNA, 1703 bp, Bovine  19866881722571
caacttacccattttttttcttacacaaagacaagcttgataatttaactcttcctagttggtggttaaggctctagaatgtccttaccttttttaaagatcattttaaaaccaaagcactaatttgacacagtaaaagcacaatacaaagatccaaatttcaaatctggcttttgctagatagagtttaagaataaagaaacattcttccctttcttgataataatttaaaatataaataattgtattaagtcccaagacccattgaatagagaatggtgaaagtttctggtataaaaactacctttagaagtctgatagtcatttcattctacagagggacagagactggattttgtttgctttctgtaattacttcacaatctccctccttttcaacattgagattcacaaatgaactggatgccagcgtttctggttgatcggactgaacaacggaatcagcctacagcttattttgttggtattgtctttctgcttcttctgacattctattttcttcttcttcttcttcttcttcttcctccttcttcatccggtaatactcatcaattgcattctggtattttggggtgctgatgcccaaaacagatgcaatcttctctccaagaaagtcacaaactgagagggtggatgtggcagcacgaagcatgtgaaaccataagtaggggccccaggtaagttttgtcggatcaacaggaggcagaacgtctttcttctccaggctgtccacttcatcttcgtctgtgctgtactcttccattgtttcaccgctaacaaagtggatgactctccttgggactttcttcttttttcctatgactcccagttctacattttcaaagcctctttcattactcatctgctgtgccgattccctgaacgccaaggcgcccacagctcccgaggcattcacggcttctccctcctcacagctcgctggctcccgctccatcgctgccgacgccacaggactgctggcgcggcagggcccgcctagcgccaggccgagaaatgtattgttatttcttacaagtttagtgtcggtttgagtaacttaatgcttttttaaggagggaggtgggagaagggttcaggatgagaaacacgtgtacacccgtggcggattcatgttgatgtatggcaaaaccaatacaatattgtaaagtaattatcctccaattaaaataaataaatttatattaaaaaaaagatcacaaataataattcattttaaaaatttgatatgaaatctccaaatcagaaacaagtggtacagttcattagtataggaaaatgggatggaatagggcctcatactaattccatctcctcatgcaataggcatcagcagatgggaggtatagttgattagacaatcttacaggagaatctagtttatacccttgatttcagtgaaacaaactagagtagtgaacacttataagtggtagataaaaatcatcaataaataaattttggtggataatatgcaaaagtcaaaaggcatgaggcatggtaatcagaccaaagcaggagttgaaaagcaagtgtctccctgttaagatgataaattaaaaatattttggttaatatctctatatagctttggacaataaactccatgatgttagtgattttttgtgtcttgaaaagtgaaagttgctcagtcatgtctgact

SEQ ID NO: 52538 - DNA, 1342 bp, Bovine  19866881879241
tttccagttatttttgaagcatatctcacccatcacatcatttcatccataaatatttcagtgtgtagctctgaaatacttctggttttggggggtgtttttggtcatgccgtgcgtcttgtgggatcttagttccctgaccagggactgaatccaggccctcagtagtgaaagtgccaaatattaaccactggactgccagggaattccctaaaatccagagtttgaaaacaactcactggcattattacatcttaaaaaaaaaatcagcaataatttcttatcatccaacaactacgttcagacttgattgttcaaatgaggaatataaggcacaatacagtccatacactgcaaatgatggataaatcataaattgctttgatctacaggtcttttccttctccctctctctggttctctttctctctgtctgcaattcatttattgcgaaaaacctgtttgtcttagtttcctagtttggatttggtgactgtattcttgaggtatatatggcccatatatttcctgtatatggaattatatatgcaggattatatataaattagtggttgggccctagaggttgatcaaagtttgatattttcacataccaaatctttaactcttctatttcctatttctggaaaccccaaaggagagaaccacttcaccctttagataacaagtactgctggattctaaggacgtgttatgtgctctgttcaagacttcgtttatactctgtaatgacctatatgggaacagaacccaaaaagagtggacatatgtatatgaataactgattcacttgctgtacagcagaaacaacactgaaaagcaactatattctgataaaaattaattttaaaaaatatataaaggaaaggcagtgaggtagtctaaaaagcttcacactatcaaaaccacagcaatgatttgatgtccttttcttcctttccagactgacaccatgctagacacagattctgtacttttattcacctaaatcacaacttcctcttctaccctgcactgtcttcagggctctaccctcatctctgcccccactaggaaaagatgatcttatctgacttaagacataattaggttgcctggcaacagtcagaacaagaatcatgaagtaactttctcatggttattataaagatgatattaaatgagctaacagttgtaaggtacttatagtagtgattagtgtacagtaagccttatacaaatgtttgctttagaaaaaaaggagttaaaacaaatcaagcagaattcatatctgaaacgatctctcaaacttcttcaagaatacaaatatacttctttatat

SEQ ID NO: 52539 - DNA, 1295 bp, Bovine  19866880130038
gtcctctagtcaggctatggtttttcctgtggtctgtatggatgtgagagttggactgtgaagaaagctgagcaccaaagaattgatgcttttgaactgtggtgttggagaagactcttgagagtcccttggactgcaaggagatccaaccagtccatcctaaaggagatcagtcctgggtgttctttggaaggactgatgctgaagctgaaactccagtactttggccacctcatgcgaagagttgactcattggaaaagactctgatgctgggagggattgggggcaggaggagaaggggacgacagaggatgagatggctggatggcatcactgactcgatggacatgagtttgagtgaactcccgggagtttggtgatggacagggaggcctggcatgctgcaattcatggggtcgcaaagagtcggacacaactgagtgactgaactgaactgatgctttagacacaatactaggaactgggaatatgtatacacacacacacacacacacacacagagtctctgttcttaaagaatgtctagtccagtcaatgccatatcccagggtgcagagtaaacacaggacaatgctcatatcagtccagcacccagggaagtcttgaagagcaagtgagtttgccaagcagaaaagcatggagaagacattacaggctgagggaagagcatgaaagacaccttcactgcctaattcctcagcaagtctgattttaaagcacattatcgtcattaaccggttagtccatgtcaaatctctaagggttatttctgtgaacagtaaatttagttgattagactttgacattaatgagagccccaagttaattggatagcttgccaaaagaaagtgtacagagaaaccagggtaataaccctaaaagactttaatcctagcccataagggcattctgaaacaggcagtcccaggatttcattcaacagctagtcccaggaatttattcttcactgctcctgagagtcaggtttttgaggatagctttagcaaagttttttttcctgcagcctccccatccacaaacactcacaggcaaaactctcctcatcacccatcaccacccaacatatgcatataacacctaactccagataaaccaaaagaaagaagatcaacttagtcaacataaaacagcttcacttctgaagggaaaaaaccgactcaaaatgatgccccattaatattggtagagcagctttggttatcccttccttccttcatttatttatttaacaaacacctaccaggccctaagg

SEQ ID NO: 52540 - DNA, 881 bp, Bovine  19866880383381
cgacccccatagacggcagcccaccaggctcccctgtccctgggattctccaggcaagaacactggagtgggtggccatttccttctccaaagcataaaagtgaaaagtaaaagtgaagtcgctcagtcgtgtccgactctagcgaccccatggactgcagcctaccaggctcctccgtccatgggattctctaggcaaaagtactggagtggggtgccattgccttctccaaagctcaatgtgaggtaacttcaattcagcttcaggggctaaactgagctccactgagattaagaggatagagtcccagggtcaaagtgggaagagacgttaggcatatggagaccatccaaagattcaagctgaactacccctaccatggtctgagaatttgttataggtttaccaatgagttgagagcaagcatagttttctaagatgaattaaaaggcagcagtacatgctaggactatggcaaacagcataacaagggcaagaacaggttcattcagagaagcttgagagaggaaagaacatgaggctggtttgatggaacccctcaactccatcttctactgctttacaagatgaggttttgttctaagtgaacctatttttaaagtcaatgtcctatttttattggtcaagaacatgtgcaaaattccactaaaaagacaatggaagagacttcatattaaaatatgcacaaacatgaagacttttaaaaattctgagtatgttcatttttctcctcaggtcaatggtcctatacagcagaaaatttcccagtggcacctttgaacagatcagccatcttgtgaacgaagttgtttccttaacagtaacctgctgtgcggaaggggccgatcctgactgctat

SEQ ID NO: 52541 - DNA, 2978 bp, Bovine  19866880470685
ttacttggagttattgagcttctttgatatttacattcctgtttgtcatcaagtttgggaagtttttggccatattacttcaaatactctctgcctgccccccttcttcttggactcccacaatatactgctccgcttgagagtttcccacaagtcccgtaggcactgttcactttccttcaatgttttttctttctgtgtctaagactcagtgatttctcttgtcctgtctttgagtttgctcattcttccctctacctgctcaaataaacctttgaatccttctggtaaatttttttcatttcagttattcattcagtacatttcagctccagaatttgtctggtttctttccaggttttctatttttttatttatacttctgttttgttcacatgtcattttcttgacgctctccacatctttagtttttcaagcatctttaagaagggtgttttaaagtctttgtcaagtagatatgctatcaggtctctttgggggacattttctgttgattttttttctttgagtcgacaatactttcctatttcttacatgccttgtaattttttacattgaaaactagacatttgtgtctaataatgtagtaatctagaaatcagattctgtctcttccccagggtgtggtaggtttcgtttttgattgttgtaggctatctctgtgccaaagatcaacctgaggtgtaaacttaaggttttctcaggttttttctgagcctgtgcctttccctgggcatgcacggtcacttttaattttccccatacatgcagttgcttttgaatttcctagcctttaatgtctggctctcaaaagaggaaaaagagaaaaatgaagggaaaggggtcaccattcctttaaattccctggaaatcacttcagccagaggaggaggggcttgcaaaatggagggggatgttaaacaagaatgactgtcttcctttttgcacctcgtgatcagaaacagcaatcagtggctaggagcagatgtctaatatattcggaggatgaggttttcgctgcccaccctggttcctgcaagctgtgtgcaggttgctccaggaacatgtgcacagctgcctgccaaagggcttggagtgggggataggtagctgctactgtgctgaaaactaacgttgaccaaaattaaccacttcccaaatgctcccctggaacttggaagccttcagtaaactccagggttctaaagtagttacatcagacaaattctgtcagtgtaatagctgtctaggtgaggagacagagtcctgacatcttcttagaattctcacttcagtttttccttccagttttattgagatataattggtgtacagcattgtggatgtttaaggtatacaacataatgatttgacttacatatatcatgaaatgattaacacaataagtttagtgaacatccatcatctcatacagatataaaactaaaacatagaaaaacattttttttccttataataacaactcagggtttcctctcaatcactttcatatatgatgtatagcagtgttgattatatttatcttattgtatattacatccctagtacatatttatcttataactcaaagtttgtgccttttgaccaccttcatctaatttcccctcccaccacccttcacttctgctgctaagtcgcctcagtcgtgtctgattctgcgcaaccccatagacggcagcccaccaggctcccctgtccctgggattctccaggcaagaacactggagtgggttgccatttccttctccaatgcatgagagtgaaaagtgaaagtgaagtcgctaggtcgtgtccgactcttagccaccccatggactgcaggcccaccagggcttctcccgcccatgggattctccaggcaagagtactggagtggggtgccatttgcctaggttactaggaagctcaaaatattcatatttatttatccaaatcactactaatatatacttctcccttcttgtacaaagtctaactcttctattccaaaagtcttactgtatataacttgtaagctacctcaagattttttttgtttgtttcagagagattatagacaaaaagtgaagatatggtcattacccattcagtgtctacagatattaaaatgtctgtggacaagagaagagagagaagctttattttttaaaggggctttagtcatcattacatattacattctcctagttctactatgaaccaaagtgacagaggtgcgtctcaacaaaagttttttctgggaattacctcaaaccaatttccactagggatgcagcctctgacaatctctacaggttcaaaaagagaagtgttttaaaattccaaactcacacccaagaaggtgacagatgtaaagaaaatcatctgaaaatgaagttcttcatttcattttagaatatttcttctaaagatatcatgagaccggttttcaaaggactttgaaggtgtagcagcccgtggtttcatgcccacatgattgagtccgggaaatattacctgagccttggcagtgaatttaaaatgctgacttgaaatattttcactgaagttgtaccaacattaaatagaactagaaagttatttaagctggttttaacattttcttatatatttcctctgaactgacagcaaactctcaaagttggtgagataaagaattaataggtgttaaaagcctttggggaaatttacccttagaagacaccagaggattctgacagattccaaatcatttttgatgagctggagatttctttgtgatccatcagtcacaaatcaatacgaatctgaaaataaaggatgtgcaatgcatgcatgctccattgtgtctgactctttgcactgagttctcccaattaaatgaagagtgggctaggtatgtatttaatttcatggtaagaaagtgatttatattaaaataatagttagactggcta

SEQ ID NO: 52542 - DNA, 2270 bp, Bovine  19866880584255
aaaaaaaaagctaaagcgaaaaaatccaagtgccaaaatataaatgattcttattgtctctctgataagcactgaatgaatatcgactgaggcagctccaggacgaagcaggatggattcatgattggccactcaaacttatgaattgcctcatgttaaattcataatatggtacaacctggttgccctgtcactaacacaaaccagctgtgacatgttccttccaccagacagattgacttaaagcaccattcaacagaagactgtatctctgccacctttgcatgaggatttcttgtagcaaaaaaagtaacctagaggccacttttcctccagcttcctaattactgaaaatgttaaaaaataccattaaatttcagcagaaataaaaactgtaggttctgtatgagagaagttattgacattttagggatagggatggtaaaatatacatcctggaaagatctttgagaaaagtagaaacaaatatttatttctgactggtttggtacagcttaatgcattcaacaaatatttacagtgtgtctatttgatatttgactggcactttctctgaatactggggacatagcagtgaacaaagtgtgtcctgtgaaaaccacagtggtaaatatttaacaaccagctctccagagggaaatgttctgatctgtaaacttcactgattcctataatgtaaatactccaattgtggttgacttcaatctacttacatgacataaccaaggagctgggaagtgacgcacacagccagctttcagaagccagtaggagcgagttccagcacacctctggaacatagagacaatgggctccctccccgcaaaaagctgaattatgtagaacacatgagttctaaaaaacactgtatctttttattatataggactttcctggtgactcagatggtaaagagcctgcctgcaatgcaggagaacggagtttgatccaagggttggtaagaccccctggagaagggaatggcaatacattccagtattctcacctggagaattccatgggcagaggagcttggcgggctacagtccacggaatcgcagagttgaacacaactgagcaaccagcagattttattatatattctattcttctcttcaaggttctccaaacacattaacccagtaaaagtcccatagtaaagatttacttagaatgacctagccactctttctcaaaacgatataaccatagaactagcttgtcagcctggataagctttaaactacatgatcagcccttgaagtcagtccatctgactgtgaaggacttaaaggtaagaatctcaaaatcctcagactggcaagggcaggcacaccttaatgcagccagaataacttttcccaaagtgatcatgtactccaaagacaggggaagtctgctccagatatgagttggttctcatcaccaagatttgttttagtcaccgtatactttatttctcagtgattcagggaactgtcagattatatcttcatttgtgatgtacacaaatccattttatttccttctcctaaattcttccttgtcatccatttaagactgatacaatttttaaaaaagaaattaaaagtcacactaaaccagtagttttagttgataataacttgacaataaaaacaacagcaaccaaaacttaggcttcaaaactattgattagggttgggaggtgggaaggaggttcaagagtgaggggacatatgtatacctatggctgattcatgttgatgtatgacagaaaccaatacaatattgtaaagcaattatcctccaattaaatatatatatatatatatatattgattaaaagaccatgattggaccaagattgagccaactgtccaacaaacactgataactgaaaaattataataattcagttatacttttgtgacaaaactatggagatatttgaacacatttttttttaattttatatatatgtgtttagaatatgagacccagaacaatgaggtacactagaaaatatctagcagcgattttgtgttgcaaggttagaatatgtacaactctgaaaacccatattctaccaaataatgccattttctatctgaagctttaagaaaattacagaatgttgaaagcttcttggatactaatatttctatctacttatctatctgagttttgctatggcatcaagatgctgaaagatacaatatgtttacatacactcagaaaatatttctagatgtttttaataggatttt

SEQ ID NO: 52543 - DNA, 1234 bp, Bovine  19866880694578
tcgagtgctaaagacaggtaaatgcaaggaaggttgaaggtcccttctactgtttccagtggaaggaaacgtgcaggagctggggactgtgataacaggatgaaggaagggaatgaaaaggaccaggagtggagtggggcaggtgcaatttaaaataggtggtcagggaagatatccctgagaagattcatttgaacaaatacatgaaagattcaaacatataaggtatcctttcaggaagcaattttacttcatgtcatttcctttctaaaaacatactctctgtggtggttttaaggaagcatattttatagcctttttgatcactttatacagatttaaatatgttagctcaaagatgaccatccctatcattagtatctaatattattctggaggagacaatagctaatgaaattggccaacagaagaaattaggtatcaaaatataaagcaggaggtaaacattataatttgtagatcatctaacaattatttcagcttaaaggaggaacaaaaattaactaaaactaaaagagaaatcagcaattttaatggttacaaaattaatatataactattaattgcctccataagtattaatacaaacaccaatcagttttaaaatataaaggaagattaaattctatttacaataataacagaatattgcaaaatacttaagaacaaacttgacaagaagtgtgcaagaactttgaagaaaattttgaaacactactaaggaatacaaaaaataaccttgaatacatgaaactgaatatcaagttcataattaggaagactcaacatcatgaagacagcaattcttcctaatttaaatctataatttaatatgattccaataaaaataccatcagaatttttgttggaaaaatagtgaggtgtatttaaaaagtgcatatggaaaagaaaaaagccaaaagcctgggaaactctaagaaatttaaaagtaataataagaggtgaacaagcctactaaaattatatttattttgaaactttaccaattaaaatagtgtggtgccactgagtgagtgacagacagatgaataaaacagactagaaggtctagaaacagacgtaagtatctgagggcgtttagtgtgaaggtggcgtataacaccagtgggagatgtattgtcaagtaaatggttttagaacaagtgggatagctatctattaaaattaggtcatatcatttataccactataa

SEQ ID NO: 52544 - DNA, 1069 bp, Bovine  19866880726203
tttacattacccactgcaataacgtgggaaattcaagttttggtttttttttttacttaaatgtaaagattttgcctacataactatactttgtttttagactaatgttaaaattaactttcagtccctgagcacacagttagcaagaatcagcaaccccaaagtaagctcacaggaaaagagaagccacttttgtattaagaatttgccattgctgttcagcagtttttcacactgtggattatgtatttcaacatagctggcaatttctcattatcatcgtgaaccagccatgaatggtcagtgttggtgactgtttgggaaaggaaaagtccaagaaacttatggtttccaatattctgctgcaaaatacatcaaactggcctttacccaaaccaaaaaagtaacccttaaaggcatttttctatcaagatggacaaaattttaccctgaaaggagtataaagttggagagtggggtgggaggcagagagagaattagagcactgtggggtgcggggttgtgtgccccttatattaatgagaaaaaaagagttgtctttggcaaaaagccagcaatctgttatcattctcattacttgatgtttgctatcccacaattaaaagcgcaggttccatttcctttcctattgactattgtccagtaattgagatgcatgtgtttttcttttgaaaggtcattgattaacttttctcattatctctgcgtgtggtcacctttgctattgctattcagagctgaaaaaagtgaaagtgaagttgctcagttgtcccactctttgcgaccccatggactgtagcccaccaggctcctccatccatggaattttctaggcaagagtactggagtgggttgccatttccttctccagttcagagacaggacaatgaattcggagaccttttttcaccaatcctaaaacacactatgtcccttgattctcacgagcccaaagaaagctttatttgttcatttcatactggtgtgcacacagcttggtgacaagaaaaatgaacagaaaaaatgaatggaattagaaaacaatata

SEQ ID NO: 52545 - DNA, 2067 bp, Bovine  19866880764962
ataaacttcaactagacttcctggaacttagtgctttttactttccctgggtcataagttatggcatgtgataaagcttggtcttcagctctgttctctctctcattagccagcatgtactgttttgaggtacccaaatgtcctaagtagtttttagatttatggctatattttatttctctaagtgagataatgtatgtgaatacatttgttcattattaagaattgaatatatgtgtggtaccatttttattgttaatataaattatcattactgttcatcattgtcctcttccttctccatgtacctgatggcctccaactcacaagataagaattctgactagtactttagtgctgtggtcagtgtgtggagttacagtaagactcttttaagatgttgggaataagaaaaacatgattgcattctgagagttgagttggaaaattaatgcaggatagaccacaactttggccacctcatatgaagagccaacttactggaaaagaccctgacgctgggaaatattgagagcaagaggataagtgggtgacagaggacgagatggttggatggcatcattgactcaatggacatgagttggagcaagctctgggagatagtgaaggacagggaagcctggtgtgttgcagtccatggggtcacatagagtcagacacaactgagtgcctgaacaataacaacaaagtctagaaagtcataatcatcattcagatatatgaattaataaaattatagatacaaaagcccagagagagaacagagcacttaggaaatatattctgcaataggaagacttccaaagacgagatcttccctttaaaaactagattaaattctactcccataatcaactcccatattgtgcctattgaccacagcccaaaatgtaggtttcttctacttatataggaaaattcccaaaggtaacaaataaattgtaatccttgtgagacactatggtttaaattgcagagaggaagagggcaccacagattaatgcataccctcagacttgaaaactctcaaaccagcacaggaaacacttcagagatcatagtcctttaatccatagttccttctatattcacatgagtttatcagtgaatgtgctctggaaacagagttggcttcacatcactgaccatcacaaatagtatacaggtcagaaaggctgcatttctagagattttctagctttattctatgatttattggaacttgtatctaggaagtctttatactgctaactttgaatgctgtaaaatattctttataaccaaagatttcatacattttatttactgagaatataacactgccatggaaattgcttttatgggtaagtatatttgcttgacagacatgttatttaattattggaatatggtgggaaatttttcaaatgaaataagctttcagacaaattctcaaatcataatctaacccatgaaaaaaagacatttcaaaatatgaagttgaatgtatctttgaaagattatgaaattgattttaagttcagggttatatttttgtttattccaaggatctatatcacattaaatctagatgttttctagtaatctatatcccaaacaactaattttaaagttaaaaaagtattttatgagaacttcttatttgaaaattatcattgcttaaaagactagaaatcaatgatacctaaaatactgtaattttattttttcattcaaacctcacttcaaaattgtaaaatataagcttcttataagatcaccacaggacatcaatttagttaagaaaacgatatatgaaaatattctacaaaaattgtataagcctcaagctaaaaaaaagggggttgagaaaaagaattctattatgttcataagtcctgaacagaaagatgacttgtccacctgttctaggaatttacaataatttatcagccatgagataatcaatagtatatggaagcttctgaagctcttcaaagaatcatacaggtacataaatctatgaaagatgactcatatgggaatggctgcagtcagacataaaat

SEQ ID NO: 52546 - DNA, 853 bp, Bovine  19866880777510
agctttagctttctagtataaaaaatattgagatactaatttccagggttgttgtgaacattacaaaaaataaggcctaaaactgttcaacatatttcatagaccttcaatatttctctgggaatgtacgcaatgtgggaatacctatagcaaaaatgaacactaatgcaaagtcaggattcatgaccaaacataactatttattatttttaaataaacattttcttccttaaaacaaacaaaaaaaactagaaattaaatagttccaatcccatcacatacaaagtctgtatactttatttacatctctcaaaacatattgtagactttctgacattcagtaccctcttatttttttttgccacatcatgtggcttgcaggatcttagttcccccaacccagggatcgaacccaggcccaggcagtgaaagcgccaaggcttaaccacttgactgccagagaattccctcagtatcccctcttaaaacaaaaatgatgaaacagtttaaagtttgatccacagtaactacaatttgagtaatcttggcacaatttacaatacgcgcccatattgcatttcatgttttagacagctcctttaatatagagaaactgtccatctccatgagagcgggctcccgccttactcattctcgacaacacttgcacagtgtgtatgctaccgcttccatttatggctctggtagtatttttctggttttgtcctgtttgatagaaataattttattaaaactttaagtgttcttatatttattgtatttcatgatgctgttcctaggtaattgtaagtaataatgtataggaaacattcaaataaaacaaaagtttttc
